United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 217

SEQ ID NO: 8995453 - DNA, 22 bp, Homo sapiens
ttgggagcaaataggaaagagg

SEQ ID NO: 8995454 - DNA, 22 bp, Homo sapiens
ttgggagcatttagaaaagacg

SEQ ID NO: 8995455 - DNA, 22 bp, Homo sapiens
ttgggagctggaagcaaggcct

SEQ ID NO: 8995456 - DNA, 22 bp, Homo sapiens
ttgggagctggaagcaaggcct

SEQ ID NO: 8995457 - DNA, 22 bp, Homo sapiens
ttgggagctggaagcaaggcct

SEQ ID NO: 8995458 - DNA, 22 bp, Homo sapiens
ttgggagctggaagcaaggcct

SEQ ID NO: 8995459 - DNA, 22 bp, Homo sapiens
ttgggagattcattgagccaag

SEQ ID NO: 8995460 - DNA, 22 bp, Homo sapiens
ttgggagattcattgagccaag

SEQ ID NO: 8995461 - DNA, 22 bp, Homo sapiens
ttgggacatctggcatacagtt

SEQ ID NO: 8995462 - DNA, 22 bp, Homo sapiens
ttgggacatctggcatacagtt

SEQ ID NO: 8995463 - DNA, 17 bp, Homo sapiens
ttgggagagaaaggtat

SEQ ID NO: 8995464 - DNA, 17 bp, Homo sapiens
ttgggagagaaaggtat

SEQ ID NO: 8995465 - DNA, 22 bp, Homo sapiens
ttgggagacaaaggctctgtct

SEQ ID NO: 8995466 - DNA, 22 bp, Homo sapiens
ttgggagacaaaggctctgtct

SEQ ID NO: 8995467 - DNA, 22 bp, Homo sapiens
ttgggagaaggctgggacttta

SEQ ID NO: 8995468 - DNA, 22 bp, Homo sapiens
ttgggagaaatagttgatccgc

SEQ ID NO: 8995469 - DNA, 22 bp, Homo sapiens
ttgggagaaatagttgatccgc

SEQ ID NO: 8995470 - DNA, 22 bp, Homo sapiens
ttggccatgacaggacaggaag

SEQ ID NO: 8995471 - DNA, 22 bp, Homo sapiens
ttggcccacagtaccatgctgt

SEQ ID NO: 8995472 - DNA, 22 bp, Homo sapiens
ttggccatctaagcccagccac

SEQ ID NO: 8995473 - DNA, 22 bp, Homo sapiens
ttgggaagaatggaggtggtta

SEQ ID NO: 8995474 - DNA, 22 bp, Homo sapiens
ttggcccactctcagaatgtgg

SEQ ID NO: 8995475 - DNA, 22 bp, Homo sapiens
ttgggaaggcgtggaagcagaa

SEQ ID NO: 8995476 - DNA, 22 bp, Homo sapiens
ttgggaagtaatatggtggtct

SEQ ID NO: 8995477 - DNA, 22 bp, Homo sapiens
ttgggacagaaaaggagaagat

SEQ ID NO: 8995478 - DNA, 20 bp, Homo sapiens
ttggcagttaagaatcttac

SEQ ID NO: 8995479 - DNA, 17 bp, Homo sapiens
ttggcagtttggcggcc

SEQ ID NO: 8995480 - DNA, 22 bp, Homo sapiens
ttggcataccttagtggtggag

SEQ ID NO: 8995481 - DNA, 22 bp, Homo sapiens
ttggcataccttagtggtggag

SEQ ID NO: 8995482 - DNA, 22 bp, Homo sapiens
ttggcatcagtgtaggacctgt

SEQ ID NO: 8995483 - DNA, 22 bp, Homo sapiens
ttggcatccactttgcaagttt

SEQ ID NO: 8995484 - DNA, 22 bp, Homo sapiens
ttggccaggtccatttctccat

SEQ ID NO: 8995485 - DNA, 22 bp, Homo sapiens
ttggccagcagctctggcttag

SEQ ID NO: 8995486 - DNA, 22 bp, Homo sapiens
ttggccagcgacgaccttctta

SEQ ID NO: 8995487 - DNA, 22 bp, Homo sapiens
ttggccagtggaaagaggagga

SEQ ID NO: 8995488 - DNA, 22 bp, Homo sapiens
ttggccagtggaaagaggagga

SEQ ID NO: 8995489 - DNA, 22 bp, Homo sapiens
ttggccatctaagcccagccac

SEQ ID NO: 8995490 - DNA, 22 bp, Homo sapiens
ttggccatctaagcccagccac

SEQ ID NO: 8995491 - DNA, 22 bp, Homo sapiens
ttggccaggtgtccagcccagg

SEQ ID NO: 8995492 - DNA, 22 bp, Homo sapiens
ttggccagtgaaccaggcctgg

SEQ ID NO: 8995493 - DNA, 22 bp, Homo sapiens
ttggccagtgaaccaggcctgg

SEQ ID NO: 8995494 - DNA, 23 bp, Homo sapiens
ttgcatgtagcccatgagtaact

SEQ ID NO: 8995495 - DNA, 22 bp, Homo sapiens
ttgcatgtacgtacagagagag

SEQ ID NO: 8995496 - DNA, 22 bp, Homo sapiens
ttgcagttgcatatgcccctac

SEQ ID NO: 8995497 - DNA, 22 bp, Homo sapiens
ttgcagttgcatatgcccctac

SEQ ID NO: 8995498 - DNA, 22 bp, Homo sapiens
ttgcagtcacactctaaagtag

SEQ ID NO: 8995499 - DNA, 22 bp, Homo sapiens
ttgcagttaaaaatcattagtt

SEQ ID NO: 8995500 - DNA, 22 bp, Homo sapiens
ttgcagtaggtggagtgaattt

SEQ ID NO: 8995501 - DNA, 18 bp, Homo sapiens
ttgcaggtacctctatct

SEQ ID NO: 8995502 - DNA, 22 bp, Homo sapiens
ttgcagggttaaagtaaggtag

SEQ ID NO: 8995503 - DNA, 22 bp, Homo sapiens
ttgcagggttgacactgcctgc

SEQ ID NO: 8995504 - DNA, 22 bp, Homo sapiens
ttgcagggttgaccaataggct

SEQ ID NO: 8995505 - DNA, 22 bp, Homo sapiens
ttgcagggttgaccaataggct

SEQ ID NO: 8995506 - DNA, 22 bp, Homo sapiens
ttgcagggcatctatgtctggt

SEQ ID NO: 8995507 - DNA, 22 bp, Homo sapiens
ttgcagggctggaacatggaat

SEQ ID NO: 8995508 - DNA, 22 bp, Homo sapiens
ttgcagggccttggcttcttcc

SEQ ID NO: 8995509 - DNA, 22 bp, Homo sapiens
ttgcagggcttggggattacag

SEQ ID NO: 8995510 - DNA, 22 bp, Homo sapiens
ttgcagggctggaacatggaat

SEQ ID NO: 8995511 - DNA, 22 bp, Homo sapiens
ttgcagggcatcgcgtacttct

SEQ ID NO: 8995512 - DNA, 22 bp, Homo sapiens
ttgcagggcaggaccatggaca

SEQ ID NO: 8995513 - DNA, 22 bp, Homo sapiens
ttgcagggcaggaccatggaca

SEQ ID NO: 8995514 - DNA, 22 bp, Homo sapiens
ttgcagggcaaatggtcagata

SEQ ID NO: 8995515 - DNA, 22 bp, Homo sapiens
ttgcaggggaaggagcagagct

SEQ ID NO: 8995516 - DNA, 22 bp, Homo sapiens
ttgcaggggagaggaacaaaca

SEQ ID NO: 8995517 - DNA, 22 bp, Homo sapiens
ttgcaggggaaggagcagagct

SEQ ID NO: 8995518 - DNA, 22 bp, Homo sapiens
ttgcaggggaaggagcagagct

SEQ ID NO: 8995519 - DNA, 22 bp, Homo sapiens
ttgcaggggaaggagcagagct

SEQ ID NO: 8995520 - DNA, 22 bp, Homo sapiens
ttgcagggtcccagaggcctgg

SEQ ID NO: 8995521 - DNA, 22 bp, Homo sapiens
ttgcagggtacattcttagaat

SEQ ID NO: 8995522 - DNA, 22 bp, Homo sapiens
ttgcagggtcctgtggctctcc

SEQ ID NO: 8995523 - DNA, 22 bp, Homo sapiens
ttgcagggtcctgtggctctcc

SEQ ID NO: 8995524 - DNA, 22 bp, Homo sapiens
ttgcagggtcccagaggcctgg

SEQ ID NO: 8995525 - DNA, 22 bp, Homo sapiens
ttgcaggattttagagatgaca

SEQ ID NO: 8995526 - DNA, 22 bp, Homo sapiens
ttgcaggattttagagatgaca

SEQ ID NO: 8995527 - DNA, 22 bp, Homo sapiens
ttgcaggacaatgatggtccct

SEQ ID NO: 8995528 - DNA, 22 bp, Homo sapiens
ttgcaggaagcacaagtctgag

SEQ ID NO: 8995529 - DNA, 22 bp, Homo sapiens
ttgcagggaaatagaaataaac

SEQ ID NO: 8995530 - DNA, 22 bp, Homo sapiens
ttgcagggaaacagtttaggaa

SEQ ID NO: 8995531 - DNA, 22 bp, Homo sapiens
ttgcaggaaactgagtgtgagc

SEQ ID NO: 8995532 - DNA, 22 bp, Homo sapiens
ttgcagggattaccttattttt

SEQ ID NO: 8995533 - DNA, 23 bp, Homo sapiens
ttgcagggatggagttcaaaatg

SEQ ID NO: 8995534 - DNA, 22 bp, Homo sapiens
ttgcagggataaaacaagtgaa

SEQ ID NO: 8995535 - DNA, 22 bp, Homo sapiens
ttgcagggataaaacaagtgaa

SEQ ID NO: 8995536 - DNA, 22 bp, Homo sapiens
ttgcagggaaatagaaataaac

SEQ ID NO: 8995537 - DNA, 22 bp, Homo sapiens
ttgcagggaaatcagtgaggat

SEQ ID NO: 8995538 - DNA, 22 bp, Homo sapiens
ttgcagggaaatcagtgaggat

SEQ ID NO: 8995539 - DNA, 22 bp, Homo sapiens
ttgcagggacctgcagaaagct

SEQ ID NO: 8995540 - DNA, 22 bp, Homo sapiens
ttgcagggacctgcagaaagct

SEQ ID NO: 8995541 - DNA, 22 bp, Homo sapiens
ttgcagcatgcatagacactgc

SEQ ID NO: 8995542 - DNA, 22 bp, Homo sapiens
ttgcagcatattgatctcctgt

SEQ ID NO: 8995543 - DNA, 22 bp, Homo sapiens
ttgcagattaaaacactgagct

SEQ ID NO: 8995544 - DNA, 22 bp, Homo sapiens
ttgcagatgaagaaagtggtag

SEQ ID NO: 8995545 - DNA, 19 bp, Homo sapiens
ttgcagcaaagttaggacc

SEQ ID NO: 8995546 - DNA, 22 bp, Homo sapiens
ttgcagcaaggtcatgaaatgt

SEQ ID NO: 8995547 - DNA, 20 bp, Homo sapiens
ttgcagcagtgaggtgaagg

SEQ ID NO: 8995548 - DNA, 22 bp, Homo sapiens
ttgcagagaggttaggaactca

SEQ ID NO: 8995549 - DNA, 22 bp, Homo sapiens
ttgcagagaggttaggaactca

SEQ ID NO: 8995550 - DNA, 22 bp, Homo sapiens
ttgcagagatcagcaggtttga

SEQ ID NO: 8995551 - DNA, 22 bp, Homo sapiens
ttgcagagcagtaggaatatag

SEQ ID NO: 8995552 - DNA, 22 bp, Homo sapiens
ttgcagagccatgaggctggct

SEQ ID NO: 8995553 - DNA, 22 bp, Homo sapiens
ttgcagagccatgaggctggct

SEQ ID NO: 8995554 - DNA, 22 bp, Homo sapiens
ttgcagagcagtaggaatatag

SEQ ID NO: 8995555 - DNA, 22 bp, Homo sapiens
ttgcagagtggttgtgaggatt

SEQ ID NO: 8995556 - DNA, 22 bp, Homo sapiens
ttgcagagtggttgtgaggatt

SEQ ID NO: 8995557 - DNA, 22 bp, Homo sapiens
ttgcagagtggttgtgaggatt

SEQ ID NO: 8995558 - DNA, 22 bp, Homo sapiens
ttgcagaggcaaaaatgaactc

SEQ ID NO: 8995559 - DNA, 22 bp, Homo sapiens
ttgcagaggcaaaaatgaactc

SEQ ID NO: 8995560 - DNA, 22 bp, Homo sapiens
ttgcagagccatgaggctggct

SEQ ID NO: 8995561 - DNA, 22 bp, Homo sapiens
ttgcagaatacttattctgtat

SEQ ID NO: 8995562 - DNA, 22 bp, Homo sapiens
ttgcagaagggcacagtgatca

SEQ ID NO: 8995563 - DNA, 22 bp, Homo sapiens
ttgcagaagcctgttgttcctg

SEQ ID NO: 8995564 - DNA, 22 bp, Homo sapiens
ttgcagaacttaaagacagagt

SEQ ID NO: 8995565 - DNA, 22 bp, Homo sapiens
ttgcagagaggttaggaactca

SEQ ID NO: 8995566 - DNA, 17 bp, Homo sapiens
ttgcagactttttatta

SEQ ID NO: 8995567 - DNA, 22 bp, Homo sapiens
ttgcagacttacttcgagaaat

SEQ ID NO: 8995568 - DNA, 22 bp, Homo sapiens
ttgcagaattaagcagagagcc

SEQ ID NO: 8995569 - DNA, 22 bp, Homo sapiens
ttgcagaatctcaggaaggaga

SEQ ID NO: 8995570 - DNA, 22 bp, Homo sapiens
ttgcagaatctcaggaaggaga

SEQ ID NO: 8995571 - DNA, 22 bp, Homo sapiens
ttgcagaatacttattctgtat

SEQ ID NO: 8995572 - DNA, 22 bp, Homo sapiens
ttgacacattagagcttgtaaa

SEQ ID NO: 8995573 - DNA, 22 bp, Homo sapiens
ttgacacagttttctcattaag

SEQ ID NO: 8995574 - DNA, 22 bp, Homo sapiens
ttgacacagtcaacttgatttt

SEQ ID NO: 8995575 - DNA, 22 bp, Homo sapiens
ttgacacagtcaacttgatttt

SEQ ID NO: 8995576 - DNA, 22 bp, Homo sapiens
ttgacacagttttctcattaag

SEQ ID NO: 8995577 - DNA, 22 bp, Homo sapiens
ttgacagaaatgtatttgcatg

SEQ ID NO: 8995578 - DNA, 22 bp, Homo sapiens
ttgacactaagatttccaaaca

SEQ ID NO: 8995579 - DNA, 22 bp, Homo sapiens
ttgacagagaaaagtgtgactt

SEQ ID NO: 8995580 - DNA, 22 bp, Homo sapiens
ttgacagagctaggtcaactct

SEQ ID NO: 8995581 - DNA, 22 bp, Homo sapiens
ttgacagagaaaagtgtgactt

SEQ ID NO: 8995582 - DNA, 22 bp, Homo sapiens
ttgacagaatgttacatataga

SEQ ID NO: 8995583 - DNA, 22 bp, Homo sapiens
ttgacagatgtgaaagtgagca

SEQ ID NO: 8995584 - DNA, 22 bp, Homo sapiens
ttgacagatgtgaaagtgagca

SEQ ID NO: 8995585 - DNA, 22 bp, Homo sapiens
ttgacagagctaggtcaactct

SEQ ID NO: 8995586 - DNA, 22 bp, Homo sapiens
ttgacagctacggagcagctgt

SEQ ID NO: 8995587 - DNA, 22 bp, Homo sapiens
ttgcaattagttacaaaagtgg

SEQ ID NO: 8995588 - DNA, 22 bp, Homo sapiens
ttgcacaaaaaattgttgaata

SEQ ID NO: 8995589 - DNA, 22 bp, Homo sapiens
ttgcaattgctatggagagcgt

SEQ ID NO: 8995590 - DNA, 22 bp, Homo sapiens
ttgcaattgctatggagagcgt

SEQ ID NO: 8995591 - DNA, 22 bp, Homo sapiens
ttgcaattgctatggagagcgt

SEQ ID NO: 8995592 - DNA, 22 bp, Homo sapiens
ttgacaaaggaccttgctattt

SEQ ID NO: 8995593 - DNA, 22 bp, Homo sapiens
ttgacaaaggaccttgctattt

SEQ ID NO: 8995594 - DNA, 22 bp, Homo sapiens
ttgacaaaggctgagaggaaaa

SEQ ID NO: 8995595 - DNA, 22 bp, Homo sapiens
ttgacaaaggctgagaggaaaa

SEQ ID NO: 8995596 - DNA, 22 bp, Homo sapiens
ttgacaaaggaattgaatctct

SEQ ID NO: 8995597 - DNA, 22 bp, Homo sapiens
ttgacaaaggaattgaatctct

SEQ ID NO: 8995598 - DNA, 22 bp, Homo sapiens
ttgacaaaggaattgaatctct

SEQ ID NO: 8995599 - DNA, 22 bp, Homo sapiens
ttgacaaaggaattgaatctct

SEQ ID NO: 8995600 - DNA, 22 bp, Homo sapiens
ttgacaaagatatattcatgct

SEQ ID NO: 8995601 - DNA, 23 bp, Homo sapiens
ttgaatttctcttgcaatattta

SEQ ID NO: 8995602 - DNA, 22 bp, Homo sapiens
ttgacaaaaacctcatttcacc

SEQ ID NO: 8995603 - DNA, 22 bp, Homo sapiens
ttgacaaaaacctcatttcacc

SEQ ID NO: 8995604 - DNA, 22 bp, Homo sapiens
ttgacaaaaataacacagcata

SEQ ID NO: 8995605 - DNA, 22 bp, Homo sapiens
ttgacaaaacaacacagatttc

SEQ ID NO: 8995606 - DNA, 22 bp, Homo sapiens
ttgacaaaacaacacagatttc

SEQ ID NO: 8995607 - DNA, 22 bp, Homo sapiens
ttgacaaaacaacacagatttc

SEQ ID NO: 8995608 - DNA, 22 bp, Homo sapiens
ttgacaaaacaacacagatttc

SEQ ID NO: 8995609 - DNA, 22 bp, Homo sapiens
ttgacaaaacaacacagatttc

SEQ ID NO: 8995610 - DNA, 22 bp, Homo sapiens
ttgacaatgtcctttgaatttc

SEQ ID NO: 8995611 - DNA, 22 bp, Homo sapiens
ttgacaatgtcctttgaatttc

SEQ ID NO: 8995612 - DNA, 22 bp, Homo sapiens
ttgacaatgcactgtgctaagt

SEQ ID NO: 8995613 - DNA, 22 bp, Homo sapiens
ttgacaatccctgttagaagtg

SEQ ID NO: 8995614 - DNA, 22 bp, Homo sapiens
ttgacaatgcactgtgctaagt

SEQ ID NO: 8995615 - DNA, 22 bp, Homo sapiens
ttgacaatgtcctttgaatttc

SEQ ID NO: 8995616 - DNA, 22 bp, Homo sapiens
ttgacaattgggagatataaag

SEQ ID NO: 8995617 - DNA, 22 bp, Homo sapiens
ttgacaattgggagatataaag

SEQ ID NO: 8995618 - DNA, 22 bp, Homo sapiens
ttgacacagatcaatattcaac

SEQ ID NO: 8995619 - DNA, 22 bp, Homo sapiens
ttgacacagatcaatattcaac

SEQ ID NO: 8995620 - DNA, 22 bp, Homo sapiens
ttgacacagatcaatattcaac

SEQ ID NO: 8995621 - DNA, 22 bp, Homo sapiens
ttgacacaatgtatattttcaa

SEQ ID NO: 8995622 - DNA, 22 bp, Homo sapiens
ttgacacaatgtatattttcaa

SEQ ID NO: 8995623 - DNA, 22 bp, Homo sapiens
ttgacacaaacagtgatgtagt

SEQ ID NO: 8995624 - DNA, 22 bp, Homo sapiens
ttgacacaaacagtgatgtagt

SEQ ID NO: 8995625 - DNA, 22 bp, Homo sapiens
ttgacacaatcatggcagacat

SEQ ID NO: 8995626 - DNA, 22 bp, Homo sapiens
ttgacaaagtttagtaataatc

SEQ ID NO: 8995627 - DNA, 22 bp, Homo sapiens
ttgacaaagtttagtaataatc

SEQ ID NO: 8995628 - DNA, 22 bp, Homo sapiens
ttgacaaagtttagtaataatc

SEQ ID NO: 8995629 - DNA, 22 bp, Homo sapiens
ttgacaaagtttagtaataatc

SEQ ID NO: 8995630 - DNA, 22 bp, Homo sapiens
ttgacaaagtttagtaataatc

SEQ ID NO: 8995631 - DNA, 22 bp, Homo sapiens
ttgacaaatacccattagacca

SEQ ID NO: 8995632 - DNA, 22 bp, Homo sapiens
ttgacaaatacccattagacca

SEQ ID NO: 8995633 - DNA, 22 bp, Homo sapiens
ttgacaaagtttagtaataatc

SEQ ID NO: 8995634 - DNA, 22 bp, Homo sapiens
ttgacaaagtttagtaataatc

SEQ ID NO: 8995635 - DNA, 22 bp, Homo sapiens
ttgacaagaatcgttgccttgg

SEQ ID NO: 8995636 - DNA, 22 bp, Homo sapiens
ttgacaagcgaagtaccataat

SEQ ID NO: 8995637 - DNA, 22 bp, Homo sapiens
ttgacaaggagccattgcatct

SEQ ID NO: 8995638 - DNA, 22 bp, Homo sapiens
ttgacaagtaatacttaaatta

SEQ ID NO: 8995639 - DNA, 22 bp, Homo sapiens
ttgacaagtggagatatttaag

SEQ ID NO: 8995640 - DNA, 22 bp, Homo sapiens
ttgacaatccctgttagaagtg

SEQ ID NO: 8995641 - DNA, 22 bp, Homo sapiens
ttgctgaagctgccaaaccagt

SEQ ID NO: 8995642 - DNA, 22 bp, Homo sapiens
ttgctgaagaaaaaatatgtta

SEQ ID NO: 8995643 - DNA, 22 bp, Homo sapiens
ttgctgaaccctgccctctaat

SEQ ID NO: 8995644 - DNA, 22 bp, Homo sapiens
ttgctgaagtattgtgaatcct

SEQ ID NO: 8995645 - DNA, 22 bp, Homo sapiens
ttgctgaagtattgtgaatcct

SEQ ID NO: 8995646 - DNA, 22 bp, Homo sapiens
ttgctgaagtatgaaaaagaca

SEQ ID NO: 8995647 - DNA, 22 bp, Homo sapiens
ttgctgaaggcctcttggggtt

SEQ ID NO: 8995648 - DNA, 19 bp, Homo sapiens
ttgctgaaggaagcctctg

SEQ ID NO: 8995649 - DNA, 22 bp, Homo sapiens
ttgctgaagttgctcagctcca

SEQ ID NO: 8995650 - DNA, 22 bp, Homo sapiens
ttgctgaatgcaagttggatag

SEQ ID NO: 8995651 - DNA, 22 bp, Homo sapiens
ttgctgaagttgctcagctcca

SEQ ID NO: 8995652 - DNA, 22 bp, Homo sapiens
ttgctgaagttaatgcttgcaa

SEQ ID NO: 8995653 - DNA, 22 bp, Homo sapiens
ttgctgaagtgaaggtatgttt

SEQ ID NO: 8995654 - DNA, 22 bp, Homo sapiens
ttgctgaagttaatgcttgcaa

SEQ ID NO: 8995655 - DNA, 22 bp, Homo sapiens
ttgctgaaagtggcaagaagta

SEQ ID NO: 8995656 - DNA, 22 bp, Homo sapiens
ttgctgaaaggtagctgtgtgg

SEQ ID NO: 8995657 - DNA, 22 bp, Homo sapiens
ttgctgaaaggtagctgtgtgg

SEQ ID NO: 8995658 - DNA, 22 bp, Homo sapiens
ttgctgaaagtggcaagaagta

SEQ ID NO: 8995659 - DNA, 22 bp, Homo sapiens
ttgctgaaatctatgacatcct

SEQ ID NO: 8995660 - DNA, 22 bp, Homo sapiens
ttgctgaagaaaaaatatgtta

SEQ ID NO: 8995661 - DNA, 22 bp, Homo sapiens
ttgctgaaaacaggtcatcagg

SEQ ID NO: 8995662 - DNA, 22 bp, Homo sapiens
ttgctgaaaacaggtcatcagg

SEQ ID NO: 8995663 - DNA, 22 bp, Homo sapiens
ttgctgaaaagctggcctttgt

SEQ ID NO: 8995664 - DNA, 22 bp, Homo sapiens
ttgctgaaaacagtgggtattg

SEQ ID NO: 8995665 - DNA, 21 bp, Homo sapiens
ttgctgttttcccaatgcagt

SEQ ID NO: 8995666 - DNA, 21 bp, Homo sapiens
ttgctgttttcccaatgcagt

SEQ ID NO: 8995667 - DNA, 22 bp, Homo sapiens
ttgctgtttaatgatgtcttat

SEQ ID NO: 8995668 - DNA, 22 bp, Homo sapiens
ttgctgttttacatctggtggg

SEQ ID NO: 8995669 - DNA, 21 bp, Homo sapiens
ttgcttatggcactgctttgc

SEQ ID NO: 8995670 - DNA, 22 bp, Homo sapiens
ttgcttatgcctcttgacaaag

SEQ ID NO: 8995671 - DNA, 22 bp, Homo sapiens
ttgcttatttgattaaatgtct

SEQ ID NO: 8995672 - DNA, 22 bp, Homo sapiens
ttgcttagagccaatcttgatt

SEQ ID NO: 8995673 - DNA, 22 bp, Homo sapiens
ttgcttaattctgaaaatatag

SEQ ID NO: 8995674 - DNA, 23 bp, Homo sapiens
ttgctgagataaagaatgcaggg

SEQ ID NO: 8995675 - DNA, 22 bp, Homo sapiens
ttgctgtgtaactcctggcctg

SEQ ID NO: 8995676 - DNA, 22 bp, Homo sapiens
ttgctgtgaaaccatgggaagt

SEQ ID NO: 8995677 - DNA, 22 bp, Homo sapiens
ttgctgaattgaatcctttggt

SEQ ID NO: 8995678 - DNA, 22 bp, Homo sapiens
ttgctgtgtctgatggctgaga

SEQ ID NO: 8995679 - DNA, 22 bp, Homo sapiens
ttgctgttacaattatttaccc

SEQ ID NO: 8995680 - DNA, 20 bp, Homo sapiens
ttgctgttgccaagattttg

SEQ ID NO: 8995681 - DNA, 22 bp, Homo sapiens
ttgctgttacaattatttaccc

SEQ ID NO: 8995682 - DNA, 22 bp, Homo sapiens
ttgctgtgtctgatggctgaga

SEQ ID NO: 8995683 - DNA, 22 bp, Homo sapiens
ttgctgtgtcatttgtttaatc

SEQ ID NO: 8995684 - DNA, 22 bp, Homo sapiens
ttgctgtgtaactcctggcctg

SEQ ID NO: 8995685 - DNA, 19 bp, Homo sapiens
ttgctcccaccccagtttt

SEQ ID NO: 8995686 - DNA, 19 bp, Homo sapiens
ttgctcccaccccagtttt

SEQ ID NO: 8995687 - DNA, 19 bp, Homo sapiens
ttgctcccaccccagtttt

SEQ ID NO: 8995688 - DNA, 22 bp, Homo sapiens
ttgctctcagaggaggaggccg

SEQ ID NO: 8995689 - DNA, 22 bp, Homo sapiens
ttgctctatgtttgtaaacaga

SEQ ID NO: 8995690 - DNA, 22 bp, Homo sapiens
ttgctctccagaggctcacagc

SEQ ID NO: 8995691 - DNA, 22 bp, Homo sapiens
ttgctctcggggaggctgcagg

SEQ ID NO: 8995692 - DNA, 22 bp, Homo sapiens
ttgcatttactgcaccgtgagt

SEQ ID NO: 8995693 - DNA, 22 bp, Homo sapiens
ttgctcatttgcctttaggttt

SEQ ID NO: 8995694 - DNA, 22 bp, Homo sapiens
ttgcatttcactttcagtaggc

SEQ ID NO: 8995695 - DNA, 22 bp, Homo sapiens
ttgctcattccgtgagaagatc

SEQ ID NO: 8995696 - DNA, 22 bp, Homo sapiens
ttgctctgcagtccagacagta

SEQ ID NO: 8995697 - DNA, 22 bp, Homo sapiens
ttgctctgtaataatctggggt

SEQ ID NO: 8995698 - DNA, 22 bp, Homo sapiens
ttgctctgattaggtggaaaca

SEQ ID NO: 8995699 - DNA, 22 bp, Homo sapiens
ttgctctccagaggctcacagc

SEQ ID NO: 8995700 - DNA, 22 bp, Homo sapiens
ttgctctgattaggtggaaaca

SEQ ID NO: 8995701 - DNA, 22 bp, Homo sapiens
ttgctctgactggagtgcagtg

SEQ ID NO: 8995702 - DNA, 22 bp, Homo sapiens
ttgctctgaacccagggcacca

SEQ ID NO: 8995703 - DNA, 22 bp, Homo sapiens
ttgctctgactggagtgcagtg

SEQ ID NO: 8995704 - DNA, 22 bp, Homo sapiens
ttgctctgtccagccagcaggt

SEQ ID NO: 8995705 - DNA, 22 bp, Homo sapiens
ttgctcttgaaaattgatgctg

SEQ ID NO: 8995706 - DNA, 22 bp, Homo sapiens
ttgctctgtcagggcctcagtc

SEQ ID NO: 8995707 - DNA, 22 bp, Homo sapiens
ttgctctgtcagggcctcagtc

SEQ ID NO: 8995708 - DNA, 22 bp, Homo sapiens
ttgctctgtcagggcctcagtc

SEQ ID NO: 8995709 - DNA, 22 bp, Homo sapiens
ttgctctgtcagggcctcagtc

SEQ ID NO: 8995710 - DNA, 22 bp, Homo sapiens
ttgctctgtaataatctggggt

SEQ ID NO: 8995711 - DNA, 22 bp, Homo sapiens
ttgcattgtaggatgttagaag

SEQ ID NO: 8995712 - DNA, 19 bp, Homo sapiens
ttgcattgtagttggactg

SEQ ID NO: 8995713 - DNA, 22 bp, Homo sapiens
ttgcattgtgattacagaggtg

SEQ ID NO: 8995714 - DNA, 22 bp, Homo sapiens
ttgcattgatgtctatacgctg

SEQ ID NO: 8995715 - DNA, 22 bp, Homo sapiens
ttgcattgaatgcacattttta

SEQ ID NO: 8995716 - DNA, 22 bp, Homo sapiens
ttgcattctggtgaggttgcct

SEQ ID NO: 8995717 - DNA, 22 bp, Homo sapiens
ttgcattctggtgaggttgcct

SEQ ID NO: 8995718 - DNA, 22 bp, Homo sapiens
ttgcattcccagccaagttagt

SEQ ID NO: 8995719 - DNA, 21 bp, Homo sapiens
ttgcattcctgttagtataag

SEQ ID NO: 8995720 - DNA, 22 bp, Homo sapiens
ttgcattctgttaaaatgtatt

SEQ ID NO: 8995721 - DNA, 22 bp, Homo sapiens
ttgcattctgttaaaatgtatt

SEQ ID NO: 8995722 - DNA, 23 bp, Homo sapiens
ttgcattaatgtggaggcacagg

SEQ ID NO: 8995723 - DNA, 22 bp, Homo sapiens
ttgcattccagtccccactgtg

SEQ ID NO: 8995724 - DNA, 22 bp, Homo sapiens
ttgcattatttaatgagactct

SEQ ID NO: 8995725 - DNA, 22 bp, Homo sapiens
ttgcattccatggttttccttc

SEQ ID NO: 8995726 - DNA, 22 bp, Homo sapiens
ttgcatgtttttgtaatacacc

SEQ ID NO: 8995727 - DNA, 22 bp, Homo sapiens
ttgcatgtgtataaaagttgga

SEQ ID NO: 8995728 - DNA, 22 bp, Homo sapiens
ttgcatgtgtataaaagttgga

SEQ ID NO: 8995729 - DNA, 22 bp, Homo sapiens
ttgctttattgggtttactgcc

SEQ ID NO: 8995730 - DNA, 22 bp, Homo sapiens
ttgctttattgggtttactgcc

SEQ ID NO: 8995731 - DNA, 22 bp, Homo sapiens
ttgctttattgggtttactgcc

SEQ ID NO: 8995732 - DNA, 22 bp, Homo sapiens
ttgctttatttggcatgccact

SEQ ID NO: 8995733 - DNA, 22 bp, Homo sapiens
ttgctttattgggtttactgcc

SEQ ID NO: 8995734 - DNA, 22 bp, Homo sapiens
ttgctttatttggcatgccact

SEQ ID NO: 8995735 - DNA, 23 bp, Homo sapiens
ttgctttcatcatgagatgctcc

SEQ ID NO: 8995736 - DNA, 22 bp, Homo sapiens
ttgcttcagagggagacacttt

SEQ ID NO: 8995737 - DNA, 22 bp, Homo sapiens
ttgcttcagagggagacacttt

SEQ ID NO: 8995738 - DNA, 22 bp, Homo sapiens
ttgcttatttgattaaatgtct

SEQ ID NO: 8995739 - DNA, 22 bp, Homo sapiens
ttgcttatttgattaaatgtct

SEQ ID NO: 8995740 - DNA, 22 bp, Homo sapiens
ttgcttatttgattaaatgtct

SEQ ID NO: 8995741 - DNA, 22 bp, Homo sapiens
ttgctttcccaaggcagaacat

SEQ ID NO: 8995742 - DNA, 22 bp, Homo sapiens
ttgctttccgtcatgtgctaat

SEQ ID NO: 8995743 - DNA, 22 bp, Homo sapiens
ttggaaaatgtatttctagaag

SEQ ID NO: 8995744 - DNA, 22 bp, Homo sapiens
ttggaaaatgtatttctagaag

SEQ ID NO: 8995745 - DNA, 22 bp, Homo sapiens
ttggaaaatgtatttctagaag

SEQ ID NO: 8995746 - DNA, 22 bp, Homo sapiens
ttggaaaccaggctttgagacg

SEQ ID NO: 8995747 - DNA, 22 bp, Homo sapiens
ttggaaacgtcaccttttcctt

SEQ ID NO: 8995748 - DNA, 22 bp, Homo sapiens
ttggaaactttcaagcataatg

SEQ ID NO: 8995749 - DNA, 22 bp, Homo sapiens
ttggaaacgtcaccttttcctt

SEQ ID NO: 8995750 - DNA, 22 bp, Homo sapiens
ttggaaagaagggctgagcaag

SEQ ID NO: 8995751 - DNA, 22 bp, Homo sapiens
ttggaaagaagggctgagcaag

SEQ ID NO: 8995752 - DNA, 22 bp, Homo sapiens
ttggaaagaccgaattcctgtt

SEQ ID NO: 8995753 - DNA, 22 bp, Homo sapiens
ttggaaagcaacttttgagagt

SEQ ID NO: 8995754 - DNA, 22 bp, Homo sapiens
ttggaaagattattattatgaa

SEQ ID NO: 8995755 - DNA, 22 bp, Homo sapiens
ttggaaagcaacttttgagagt

SEQ ID NO: 8995756 - DNA, 22 bp, Homo sapiens
ttggaaagattattattatgaa

SEQ ID NO: 8995757 - DNA, 22 bp, Homo sapiens
ttggaaagcaagctggacatac

SEQ ID NO: 8995758 - DNA, 22 bp, Homo sapiens
ttggaaagcaagctggacatac

SEQ ID NO: 8995759 - DNA, 22 bp, Homo sapiens
ttggaaagcccattatttggac

SEQ ID NO: 8995760 - DNA, 22 bp, Homo sapiens
ttggaaaggagattctattgtg

SEQ ID NO: 8995761 - DNA, 22 bp, Homo sapiens
ttggaaagcagccgcagccaat

SEQ ID NO: 8995762 - DNA, 22 bp, Homo sapiens
ttggaaagggaggaatgtagac

SEQ ID NO: 8995763 - DNA, 22 bp, Homo sapiens
ttggaaaggagtttttagctat

SEQ ID NO: 8995764 - DNA, 22 bp, Homo sapiens
ttggaaagggatatctgtactt

SEQ ID NO: 8995765 - DNA, 22 bp, Homo sapiens
ttggaaagggaggaatgtagac

SEQ ID NO: 8995766 - DNA, 22 bp, Homo sapiens
ttggaaagtttttactgaagac

SEQ ID NO: 8995767 - DNA, 22 bp, Homo sapiens
ttggaaagtctcacccagttga

SEQ ID NO: 8995768 - DNA, 22 bp, Homo sapiens
ttggaaagtgacgttcaactgt

SEQ ID NO: 8995769 - DNA, 22 bp, Homo sapiens
ttggaaaggtgcttttgtctgt

SEQ ID NO: 8995770 - DNA, 22 bp, Homo sapiens
ttggaaagtttttactgaagac

SEQ ID NO: 8995771 - DNA, 22 bp, Homo sapiens
ttggaaatacagcagttacttt

SEQ ID NO: 8995772 - DNA, 22 bp, Homo sapiens
ttggaaatacagcagttacttt

SEQ ID NO: 8995773 - DNA, 22 bp, Homo sapiens
ttggaaatacagcagttacttt

SEQ ID NO: 8995774 - DNA, 22 bp, Homo sapiens
ttggaaatacagcagttacttt

SEQ ID NO: 8995775 - DNA, 22 bp, Homo sapiens
ttggaaatacgagtagtatcat

SEQ ID NO: 8995776 - DNA, 22 bp, Homo sapiens
ttggaaatgatttctattatta

SEQ ID NO: 8995777 - DNA, 22 bp, Homo sapiens
ttggaaatgcaaatatattgaa

SEQ ID NO: 8995778 - DNA, 22 bp, Homo sapiens
ttggaaatgcaaatatattgaa

SEQ ID NO: 8995779 - DNA, 22 bp, Homo sapiens
ttggaaatgcaaatatattgaa

SEQ ID NO: 8995780 - DNA, 22 bp, Homo sapiens
ttggaacaatcacatccttgct

SEQ ID NO: 8995781 - DNA, 22 bp, Homo sapiens
ttggaacaatcacatccttgct

SEQ ID NO: 8995782 - DNA, 21 bp, Homo sapiens
ttggaacaagcagcagtttgc

SEQ ID NO: 8995783 - DNA, 22 bp, Homo sapiens
ttggaaatgtagaaaagcagat

SEQ ID NO: 8995784 - DNA, 22 bp, Homo sapiens
ttggaaattgcaagtgatttgc

SEQ ID NO: 8995785 - DNA, 22 bp, Homo sapiens
ttggaaattgcaagtgatttgc

SEQ ID NO: 8995786 - DNA, 22 bp, Homo sapiens
ttggaaatggctgtagttatga

SEQ ID NO: 8995787 - DNA, 22 bp, Homo sapiens
ttggaaatggctgtagttatga

SEQ ID NO: 8995788 - DNA, 22 bp, Homo sapiens
ttggaaatgcatttgttattat

SEQ ID NO: 8995789 - DNA, 23 bp, Homo sapiens
ttggaaatggggagaacagattc

SEQ ID NO: 8995790 - DNA, 22 bp, Homo sapiens
ttggaaatggctgtagttatga

SEQ ID NO: 8995791 - DNA, 23 bp, Homo sapiens
ttggaaatggggagaacagattc

SEQ ID NO: 8995792 - DNA, 22 bp, Homo sapiens
ttggaattgaggatttacatag

SEQ ID NO: 8995793 - DNA, 22 bp, Homo sapiens
ttggaattgaggatttacatag

SEQ ID NO: 8995794 - DNA, 22 bp, Homo sapiens
ttggaattcctgttgtttcgtc

SEQ ID NO: 8995795 - DNA, 22 bp, Homo sapiens
ttggaacacagcagctgatttt

SEQ ID NO: 8995796 - DNA, 22 bp, Homo sapiens
ttggaatttagtaaaataatgc

SEQ ID NO: 8995797 - DNA, 22 bp, Homo sapiens
ttggaatttagtaaaataatgc

SEQ ID NO: 8995798 - DNA, 22 bp, Homo sapiens
ttggaattgtgaactaagtgat

SEQ ID NO: 8995799 - DNA, 22 bp, Homo sapiens
ttggaattgctattgataacaa

SEQ ID NO: 8995800 - DNA, 22 bp, Homo sapiens
ttggaatttgagaccaagaaaa

SEQ ID NO: 8995801 - DNA, 22 bp, Homo sapiens
ttggaatttgcttcagctaata

SEQ ID NO: 8995802 - DNA, 21 bp, Homo sapiens
ttggaatttgggagctatgtg

SEQ ID NO: 8995803 - DNA, 21 bp, Homo sapiens
ttggaatttgggagctatgtg

SEQ ID NO: 8995804 - DNA, 22 bp, Homo sapiens
ttggaattttccaggtacagtg

SEQ ID NO: 8995805 - DNA, 22 bp, Homo sapiens
ttggacagaattttgtgtgtgt

SEQ ID NO: 8995806 - DNA, 22 bp, Homo sapiens
ttggacagtaaattgtgcttaa

SEQ ID NO: 8995807 - DNA, 20 bp, Homo sapiens
tttcacaatgaacatgtctc

SEQ ID NO: 8995808 - DNA, 20 bp, Homo sapiens
tttcacaatgaacatgtctc

SEQ ID NO: 8995809 - DNA, 22 bp, Homo sapiens
tttcaagcaggatcaaagcaaa

SEQ ID NO: 8995810 - DNA, 23 bp, Homo sapiens
tttcacaatgagcattacagaat

SEQ ID NO: 8995811 - DNA, 23 bp, Homo sapiens
tttcacaatgagcattacagaat

SEQ ID NO: 8995812 - DNA, 20 bp, Homo sapiens
tttcacaatgaacatgtctc

SEQ ID NO: 8995813 - DNA, 20 bp, Homo sapiens
tttcacaatgaacatgtctc

SEQ ID NO: 8995814 - DNA, 20 bp, Homo sapiens
tttcacaatgaacatgtctc

SEQ ID NO: 8995815 - DNA, 23 bp, Homo sapiens
tttcacaatgagcattacagaat

SEQ ID NO: 8995816 - DNA, 23 bp, Homo sapiens
tttcacaatgagcattacagaat

SEQ ID NO: 8995817 - DNA, 23 bp, Homo sapiens
tttcacaatgagcattacagaat

SEQ ID NO: 8995818 - DNA, 23 bp, Homo sapiens
tttcacaatgagcattacagaat

SEQ ID NO: 8995819 - DNA, 23 bp, Homo sapiens
tttcacaatgagcattacagaat

SEQ ID NO: 8995820 - DNA, 23 bp, Homo sapiens
tttcacaatgagcattacagaat

SEQ ID NO: 8995821 - DNA, 23 bp, Homo sapiens
tttcacaatgagcattacagaat

SEQ ID NO: 8995822 - DNA, 23 bp, Homo sapiens
tttcacaatgagcattacagaat

SEQ ID NO: 8995823 - DNA, 22 bp, Homo sapiens
tttcacaatgcaatcctacttc

SEQ ID NO: 8995824 - DNA, 22 bp, Homo sapiens
tttcacaatgcaatcctacttc

SEQ ID NO: 8995825 - DNA, 22 bp, Homo sapiens
tttcacaattttaaggagcaaa

SEQ ID NO: 8995826 - DNA, 22 bp, Homo sapiens
tttcacaattttaaggagcaaa

SEQ ID NO: 8995827 - DNA, 22 bp, Homo sapiens
tttcacaattttaaggagcaaa

SEQ ID NO: 8995828 - DNA, 22 bp, Homo sapiens
tttcacaattttaaggagcaaa

SEQ ID NO: 8995829 - DNA, 22 bp, Homo sapiens
tttcacacaacgtgaatatact

SEQ ID NO: 8995830 - DNA, 22 bp, Homo sapiens
tttcacacaacgtgaatatact

SEQ ID NO: 8995831 - DNA, 22 bp, Homo sapiens
tttcacacccactaggactgtt

SEQ ID NO: 8995832 - DNA, 22 bp, Homo sapiens
tttcacacccactaggactgtt

SEQ ID NO: 8995833 - DNA, 22 bp, Homo sapiens
tttcacactagtcagaatacca

SEQ ID NO: 8995834 - DNA, 22 bp, Homo sapiens
tttcacactgcagcatcagaga

SEQ ID NO: 8995835 - DNA, 22 bp, Homo sapiens
tttcacactgcagcatcagaga

SEQ ID NO: 8995836 - DNA, 22 bp, Homo sapiens
tttcacactgcagcatcagaga

SEQ ID NO: 8995837 - DNA, 22 bp, Homo sapiens
tttcacactgcagcatcagaga

SEQ ID NO: 8995838 - DNA, 22 bp, Homo sapiens
tttcacactgcagcatcagaga

SEQ ID NO: 8995839 - DNA, 22 bp, Homo sapiens
tttcacactagtcagaatacca

SEQ ID NO: 8995840 - DNA, 22 bp, Homo sapiens
tttcacagagaaatataacagg

SEQ ID NO: 8995841 - DNA, 22 bp, Homo sapiens
tttcacagatcctacagcttgt

SEQ ID NO: 8995842 - DNA, 22 bp, Homo sapiens
tttcacagaaagaagctagttt

SEQ ID NO: 8995843 - DNA, 22 bp, Homo sapiens
tttcacacttgatttgcagtta

SEQ ID NO: 8995844 - DNA, 22 bp, Homo sapiens
tttcacagaaagacaacagata

SEQ ID NO: 8995845 - DNA, 22 bp, Homo sapiens
tttcacagaaaggataacatta

SEQ ID NO: 8995846 - DNA, 22 bp, Homo sapiens
tttcacagaactcactaaggag

SEQ ID NO: 8995847 - DNA, 22 bp, Homo sapiens
tttcacagaaaggataacatta

SEQ ID NO: 8995848 - DNA, 23 bp, Homo sapiens
tttcacagaaggattgtagggcc

SEQ ID NO: 8995849 - DNA, 22 bp, Homo sapiens
tttcaacatataccataatgcc

SEQ ID NO: 8995850 - DNA, 22 bp, Homo sapiens
tttcaacatataccataatgcc

SEQ ID NO: 8995851 - DNA, 22 bp, Homo sapiens
tttcaacatataccataatgcc

SEQ ID NO: 8995852 - DNA, 22 bp, Homo sapiens
tttcaacatacctcagtgtatg

SEQ ID NO: 8995853 - DNA, 22 bp, Homo sapiens
tttcaacatacctcagtgtatg

SEQ ID NO: 8995854 - DNA, 22 bp, Homo sapiens
tttcaacatacctcagtgtatg

SEQ ID NO: 8995855 - DNA, 22 bp, Homo sapiens
tttcaacatacctcagtgtatg

SEQ ID NO: 8995856 - DNA, 22 bp, Homo sapiens
tttcaacataatgcctgctagg

SEQ ID NO: 8995857 - DNA, 22 bp, Homo sapiens
tttcaacataatgcctgctagg

SEQ ID NO: 8995858 - DNA, 22 bp, Homo sapiens
tttcaacatcacctagcagttc

SEQ ID NO: 8995859 - DNA, 22 bp, Homo sapiens
tttcaacatcacctagcagttc

SEQ ID NO: 8995860 - DNA, 22 bp, Homo sapiens
tttcaacatataccataatgcc

SEQ ID NO: 8995861 - DNA, 17 bp, Homo sapiens
tttcaacatcactcagc

SEQ ID NO: 8995862 - DNA, 17 bp, Homo sapiens
tttcaacatcactcagc

SEQ ID NO: 8995863 - DNA, 17 bp, Homo sapiens
tttcaacatcactcagc

SEQ ID NO: 8995864 - DNA, 22 bp, Homo sapiens
tttcaacatcacctagcagttc

SEQ ID NO: 8995865 - DNA, 17 bp, Homo sapiens
tttcaacatcactcagc

SEQ ID NO: 8995866 - DNA, 22 bp, Homo sapiens
tttcaacatcacctagcagttc

SEQ ID NO: 8995867 - DNA, 22 bp, Homo sapiens
tttcaacagctctcaaatgatc

SEQ ID NO: 8995868 - DNA, 22 bp, Homo sapiens
tttcaacagctctcaaatgatc

SEQ ID NO: 8995869 - DNA, 22 bp, Homo sapiens
tttcaacagctctcaaatgatc

SEQ ID NO: 8995870 - DNA, 22 bp, Homo sapiens
tttcaacagctctcaaatgatc

SEQ ID NO: 8995871 - DNA, 22 bp, Homo sapiens
tttcaacagctctcaaatgatc

SEQ ID NO: 8995872 - DNA, 22 bp, Homo sapiens
tttcaacagctctcaaatgatc

SEQ ID NO: 8995873 - DNA, 22 bp, Homo sapiens
tttcaacaggatgataataggc

SEQ ID NO: 8995874 - DNA, 22 bp, Homo sapiens
tttcaacaggatgataataggc

SEQ ID NO: 8995875 - DNA, 22 bp, Homo sapiens
tttcaacaggatgataataggc

SEQ ID NO: 8995876 - DNA, 22 bp, Homo sapiens
tttcaacaggatgataataggc

SEQ ID NO: 8995877 - DNA, 22 bp, Homo sapiens
tttcaacaggatgataataggc

SEQ ID NO: 8995878 - DNA, 22 bp, Homo sapiens
tttcaacaggatgataataggc

SEQ ID NO: 8995879 - DNA, 22 bp, Homo sapiens
tttcaacagggcacaggtgcca

SEQ ID NO: 8995880 - DNA, 23 bp, Homo sapiens
tttcaacaggcagagaagactta

SEQ ID NO: 8995881 - DNA, 22 bp, Homo sapiens
tttcaacataatgcctgctagg

SEQ ID NO: 8995882 - DNA, 23 bp, Homo sapiens
tttcaacaggcagagaagactta

SEQ ID NO: 8995883 - DNA, 23 bp, Homo sapiens
tttcaacaggcagagaagactta

SEQ ID NO: 8995884 - DNA, 22 bp, Homo sapiens
tttcaagaacaacattcattca

SEQ ID NO: 8995885 - DNA, 22 bp, Homo sapiens
tttcaagaacaacattcattca

SEQ ID NO: 8995886 - DNA, 22 bp, Homo sapiens
tttcaagaagcaaattaaagtc

SEQ ID NO: 8995887 - DNA, 22 bp, Homo sapiens
tttcaagaagcaaattaaagtc

SEQ ID NO: 8995888 - DNA, 22 bp, Homo sapiens
tttcaagaagcaaattaaagtc

SEQ ID NO: 8995889 - DNA, 22 bp, Homo sapiens
tttcaagaacagcagcattcca

SEQ ID NO: 8995890 - DNA, 22 bp, Homo sapiens
tttcaagaacagcagcattcca

SEQ ID NO: 8995891 - DNA, 22 bp, Homo sapiens
tttcaactcatgctaaaggaag

SEQ ID NO: 8995892 - DNA, 22 bp, Homo sapiens
tttcaactagcccctaagtcct

SEQ ID NO: 8995893 - DNA, 22 bp, Homo sapiens
tttcaacttgaagaattgatac

SEQ ID NO: 8995894 - DNA, 23 bp, Homo sapiens
tttcaactcctgccattatttct

SEQ ID NO: 8995895 - DNA, 22 bp, Homo sapiens
tttcaacttgaagaattgatac

SEQ ID NO: 8995896 - DNA, 22 bp, Homo sapiens
tttcaagagaaaactaacctat

SEQ ID NO: 8995897 - DNA, 22 bp, Homo sapiens
tttcaagagcaggaaaaaggtc

SEQ ID NO: 8995898 - DNA, 22 bp, Homo sapiens
tttcaagagcaggaaaaaggtc

SEQ ID NO: 8995899 - DNA, 22 bp, Homo sapiens
tttcaagagggaactgaacaca

SEQ ID NO: 8995900 - DNA, 22 bp, Homo sapiens
tttcaagagggaactgaacaca

SEQ ID NO: 8995901 - DNA, 22 bp, Homo sapiens
tttcaagaggccagagcgaggc

SEQ ID NO: 8995902 - DNA, 22 bp, Homo sapiens
tttcaagagaaaactaacctat

SEQ ID NO: 8995903 - DNA, 22 bp, Homo sapiens
tttcaagacgttaagtcagctt

SEQ ID NO: 8995904 - DNA, 22 bp, Homo sapiens
tttcaagaattgaagaggattt

SEQ ID NO: 8995905 - DNA, 22 bp, Homo sapiens
tttcaagactcattgagtattg

SEQ ID NO: 8995906 - DNA, 22 bp, Homo sapiens
tttattgaacacttgcactggc

SEQ ID NO: 8995907 - DNA, 22 bp, Homo sapiens
tttattgaacacttgcactggc

SEQ ID NO: 8995908 - DNA, 22 bp, Homo sapiens
tttattgaacacttgcactggc

SEQ ID NO: 8995909 - DNA, 22 bp, Homo sapiens
tttattcttgagagtgagaaga

SEQ ID NO: 8995910 - DNA, 22 bp, Homo sapiens
tttattcttgagagtgagaaga

SEQ ID NO: 8995911 - DNA, 22 bp, Homo sapiens
tttattcttgagagtgagaaga

SEQ ID NO: 8995912 - DNA, 22 bp, Homo sapiens
tttattcttgagagtgagaaga

SEQ ID NO: 8995913 - DNA, 22 bp, Homo sapiens
tttattctgtgctacatgaaga

SEQ ID NO: 8995914 - DNA, 22 bp, Homo sapiens
tttattctgtgctacatgaaga

SEQ ID NO: 8995915 - DNA, 22 bp, Homo sapiens
tttattctgtgctacatgaaga

SEQ ID NO: 8995916 - DNA, 22 bp, Homo sapiens
tttattctgtgctacatgaaga

SEQ ID NO: 8995917 - DNA, 22 bp, Homo sapiens
tttattctgtgctacatgaaga

SEQ ID NO: 8995918 - DNA, 23 bp, Homo sapiens
tttattctcagatacataggtct

SEQ ID NO: 8995919 - DNA, 23 bp, Homo sapiens
tttattctcagatacataggtct

SEQ ID NO: 8995920 - DNA, 22 bp, Homo sapiens
tttattctctagttggtcagat

SEQ ID NO: 8995921 - DNA, 22 bp, Homo sapiens
tttattctctagttggtcagat

SEQ ID NO: 8995922 - DNA, 22 bp, Homo sapiens
tttattctataggcattaagca

SEQ ID NO: 8995923 - DNA, 22 bp, Homo sapiens
tttattctagctcagaatagtt

SEQ ID NO: 8995924 - DNA, 22 bp, Homo sapiens
tttattctagctcagaatagtt

SEQ ID NO: 8995925 - DNA, 22 bp, Homo sapiens
tttattctagctcagaatagtt

SEQ ID NO: 8995926 - DNA, 22 bp, Homo sapiens
tttattctagctcagaatagtt

SEQ ID NO: 8995927 - DNA, 22 bp, Homo sapiens
tttattctataggcattaagca

SEQ ID NO: 8995928 - DNA, 22 bp, Homo sapiens
tttattctataggcattaagca

SEQ ID NO: 8995929 - DNA, 21 bp, Homo sapiens
tttattctcagatacagggag

SEQ ID NO: 8995930 - DNA, 21 bp, Homo sapiens
tttattctcagatacagggag

SEQ ID NO: 8995931 - DNA, 21 bp, Homo sapiens
tttattctcagatacagggag

SEQ ID NO: 8995932 - DNA, 22 bp, Homo sapiens
tttattctagctcagaatagtt

SEQ ID NO: 8995933 - DNA, 22 bp, Homo sapiens
tttattctagctcagaatagtt

SEQ ID NO: 8995934 - DNA, 20 bp, Homo sapiens
tttattcacagagaagagtt

SEQ ID NO: 8995935 - DNA, 20 bp, Homo sapiens
tttattcacagagaagagtt

SEQ ID NO: 8995936 - DNA, 20 bp, Homo sapiens
tttattcacagagaagagtt

SEQ ID NO: 8995937 - DNA, 20 bp, Homo sapiens
tttattcacagagaagagtt

SEQ ID NO: 8995938 - DNA, 22 bp, Homo sapiens
tttattgacccaaagcgagagt

SEQ ID NO: 8995939 - DNA, 22 bp, Homo sapiens
tttattgacccaaagcgagagt

SEQ ID NO: 8995940 - DNA, 22 bp, Homo sapiens
tttattgacttcagtgagtctt

SEQ ID NO: 8995941 - DNA, 22 bp, Homo sapiens
tttattgacttcagtgagtctt

SEQ ID NO: 8995942 - DNA, 22 bp, Homo sapiens
tttattgacttcagtgagtctt

SEQ ID NO: 8995943 - DNA, 22 bp, Homo sapiens
tttattgagcacccgttgtgcg

SEQ ID NO: 8995944 - DNA, 22 bp, Homo sapiens
tttattgagtatctactatgtg

SEQ ID NO: 8995945 - DNA, 22 bp, Homo sapiens
tttattgagtatctactatgtg

SEQ ID NO: 8995946 - DNA, 22 bp, Homo sapiens
tttattgagtatctactatgtg

SEQ ID NO: 8995947 - DNA, 20 bp, Homo sapiens
tttattgagcacgtactgtg

SEQ ID NO: 8995948 - DNA, 20 bp, Homo sapiens
tttattgagcacgtactgtg

SEQ ID NO: 8995949 - DNA, 22 bp, Homo sapiens
tttattgcatacacaaatgtca

SEQ ID NO: 8995950 - DNA, 22 bp, Homo sapiens
tttattgcatacacaaatgtca

SEQ ID NO: 8995951 - DNA, 22 bp, Homo sapiens
tttattgcatacacaaatgtca

SEQ ID NO: 8995952 - DNA, 22 bp, Homo sapiens
tttattgcactgtctcaatacc

SEQ ID NO: 8995953 - DNA, 19 bp, Homo sapiens
tttcaaagggcataagcct

SEQ ID NO: 8995954 - DNA, 22 bp, Homo sapiens
tttcaaagggaagttatgaagt

SEQ ID NO: 8995955 - DNA, 22 bp, Homo sapiens
tttattgcatacacaaatgtca

SEQ ID NO: 8995956 - DNA, 22 bp, Homo sapiens
tttcaacagaatatgatcagag

SEQ ID NO: 8995957 - DNA, 22 bp, Homo sapiens
tttcaacagaatatgatcagag

SEQ ID NO: 8995958 - DNA, 22 bp, Homo sapiens
tttcaacaccagagaccatgcg

SEQ ID NO: 8995959 - DNA, 22 bp, Homo sapiens
tttcaacaccagagaccatgcg

SEQ ID NO: 8995960 - DNA, 20 bp, Homo sapiens
tttcaacaatttcccttcca

SEQ ID NO: 8995961 - DNA, 23 bp, Homo sapiens
tttcaacaatgcttagagaaaac

SEQ ID NO: 8995962 - DNA, 22 bp, Homo sapiens
tttcaacagatctgtcttcagg

SEQ ID NO: 8995963 - DNA, 22 bp, Homo sapiens
tttcaacagaatatgatcagag

SEQ ID NO: 8995964 - DNA, 22 bp, Homo sapiens
tttcaacagaatatgatcagag

SEQ ID NO: 8995965 - DNA, 22 bp, Homo sapiens
tttcaacagaatatgatcagag

SEQ ID NO: 8995966 - DNA, 22 bp, Homo sapiens
tttcaacagaatatgatcagag

SEQ ID NO: 8995967 - DNA, 22 bp, Homo sapiens
tttcaacagaatatgatcagag

SEQ ID NO: 8995968 - DNA, 22 bp, Homo sapiens
tttcaacagaatatgatcagag

SEQ ID NO: 8995969 - DNA, 22 bp, Homo sapiens
tttcaacagatctgtcttcagg

SEQ ID NO: 8995970 - DNA, 22 bp, Homo sapiens
tttcaacagaatatgatcagag

SEQ ID NO: 8995971 - DNA, 23 bp, Homo sapiens
tttcaacaatgcttagagaaaac

SEQ ID NO: 8995972 - DNA, 23 bp, Homo sapiens
tttcaacaatgcttagagaaaac

SEQ ID NO: 8995973 - DNA, 23 bp, Homo sapiens
tttcaacaatgcttagagaaaac

SEQ ID NO: 8995974 - DNA, 22 bp, Homo sapiens
tttcaaaggtggaagagtgaat

SEQ ID NO: 8995975 - DNA, 22 bp, Homo sapiens
tttcaaaggtggaagagtgaat

SEQ ID NO: 8995976 - DNA, 22 bp, Homo sapiens
tttcaaaggttttgtcatgtct

SEQ ID NO: 8995977 - DNA, 22 bp, Homo sapiens
tttcaaaggttttgtcatgtct

SEQ ID NO: 8995978 - DNA, 22 bp, Homo sapiens
tttcaaaggttttgtcatgtct

SEQ ID NO: 8995979 - DNA, 22 bp, Homo sapiens
tttcaaagtaaggattttcatc

SEQ ID NO: 8995980 - DNA, 22 bp, Homo sapiens
tttcactgttaggagtatgcta

SEQ ID NO: 8995981 - DNA, 22 bp, Homo sapiens
tttcactgtgttggtcaggccg

SEQ ID NO: 8995982 - DNA, 20 bp, Homo sapiens
tttcactgtggtgctggaga

SEQ ID NO: 8995983 - DNA, 22 bp, Homo sapiens
tttcactgggcttgcagaaatc

SEQ ID NO: 8995984 - DNA, 22 bp, Homo sapiens
tttcactgggcttgcagaaatc

SEQ ID NO: 8995985 - DNA, 20 bp, Homo sapiens
tttcactggcttgataaggt

SEQ ID NO: 8995986 - DNA, 20 bp, Homo sapiens
tttcactggcttgataaggt

SEQ ID NO: 8995987 - DNA, 20 bp, Homo sapiens
tttcactggcttgataaggt

SEQ ID NO: 8995988 - DNA, 20 bp, Homo sapiens
tttcactggcttgataaggt

SEQ ID NO: 8995989 - DNA, 22 bp, Homo sapiens
tttcacctcagtctttttatat

SEQ ID NO: 8995990 - DNA, 22 bp, Homo sapiens
tttcacatttgttttaagaagt

SEQ ID NO: 8995991 - DNA, 22 bp, Homo sapiens
tttcacatttgttttaagaagt

SEQ ID NO: 8995992 - DNA, 22 bp, Homo sapiens
tttcacatttgttttaagaagt

SEQ ID NO: 8995993 - DNA, 22 bp, Homo sapiens
tttcacatttgttttaagaagt

SEQ ID NO: 8995994 - DNA, 22 bp, Homo sapiens
tttcacatttgttttaagaagt

SEQ ID NO: 8995995 - DNA, 23 bp, Homo sapiens
tttcacagcttttattctgcatc

SEQ ID NO: 8995996 - DNA, 23 bp, Homo sapiens
tttcacagcttttattctgcatc

SEQ ID NO: 8995997 - DNA, 22 bp, Homo sapiens
tttcaccctgtctgaatcgttc

SEQ ID NO: 8995998 - DNA, 22 bp, Homo sapiens
tttcaccacagaggcaagacaa

SEQ ID NO: 8995999 - DNA, 22 bp, Homo sapiens
tttcacattttatacttaagcc

SEQ ID NO: 8996000 - DNA, 22 bp, Homo sapiens
tttcacattttatacttaagcc

SEQ ID NO: 8996001 - DNA, 18 bp, Homo sapiens
tttcacagattcatgact

SEQ ID NO: 8996002 - DNA, 22 bp, Homo sapiens
tttcacagatgttttggagtct

SEQ ID NO: 8996003 - DNA, 22 bp, Homo sapiens
tttcacagatgttttggagtct

SEQ ID NO: 8996004 - DNA, 18 bp, Homo sapiens
tttcacagattcatgact

SEQ ID NO: 8996005 - DNA, 22 bp, Homo sapiens
tttcacagcagaatttctgagg

SEQ ID NO: 8996006 - DNA, 22 bp, Homo sapiens
tttcacagcaacactgtctgca

SEQ ID NO: 8996007 - DNA, 22 bp, Homo sapiens
tttcacagcagaatttctgagg

SEQ ID NO: 8996008 - DNA, 22 bp, Homo sapiens
tttcacagcatataggtgtact

SEQ ID NO: 8996009 - DNA, 22 bp, Homo sapiens
tttcacagcatataggtgtact

SEQ ID NO: 8996010 - DNA, 22 bp, Homo sapiens
tttcacagctgggaagagatat

SEQ ID NO: 8996011 - DNA, 22 bp, Homo sapiens
tttcacagcgtctttctcttgc

SEQ ID NO: 8996012 - DNA, 22 bp, Homo sapiens
tttcacagctagtgagcttcta

SEQ ID NO: 8996013 - DNA, 22 bp, Homo sapiens
tttcacagctgggtggcagagt

SEQ ID NO: 8996014 - DNA, 22 bp, Homo sapiens
tttcacagctgggtggcagagt

SEQ ID NO: 8996015 - DNA, 22 bp, Homo sapiens
tttcacagctgtcttccgtctc

SEQ ID NO: 8996016 - DNA, 22 bp, Homo sapiens
tttcacagctgggtggcagagt

SEQ ID NO: 8996017 - DNA, 22 bp, Homo sapiens
tttcacagctgggtggcagagt

SEQ ID NO: 8996018 - DNA, 22 bp, Homo sapiens
tttcagaaatggcactgaaatc

SEQ ID NO: 8996019 - DNA, 22 bp, Homo sapiens
tttcagaaatggcactgaaatc

SEQ ID NO: 8996020 - DNA, 22 bp, Homo sapiens
tttcagaatatcgattcagtga

SEQ ID NO: 8996021 - DNA, 22 bp, Homo sapiens
tttcagaatatcgattcagtga

SEQ ID NO: 8996022 - DNA, 22 bp, Homo sapiens
tttcagaaagctgaacatatga

SEQ ID NO: 8996023 - DNA, 22 bp, Homo sapiens
tttcagaaagctgaacatatga

SEQ ID NO: 8996024 - DNA, 22 bp, Homo sapiens
tttcagaaagctgaacatatga

SEQ ID NO: 8996025 - DNA, 22 bp, Homo sapiens
tttcagaaagctgaacatatga

SEQ ID NO: 8996026 - DNA, 22 bp, Homo sapiens
tttcagaaatcaaaaccagggt

SEQ ID NO: 8996027 - DNA, 22 bp, Homo sapiens
tttcagaaagcatcatcaaagt

SEQ ID NO: 8996028 - DNA, 22 bp, Homo sapiens
tttcagaaacgattatgaacac

SEQ ID NO: 8996029 - DNA, 22 bp, Homo sapiens
tttcagaaagcatcatcaaagt

SEQ ID NO: 8996030 - DNA, 22 bp, Homo sapiens
tttcagaaagcatcatcaaagt

SEQ ID NO: 8996031 - DNA, 22 bp, Homo sapiens
tttcagaaagcatcatcaaagt

SEQ ID NO: 8996032 - DNA, 22 bp, Homo sapiens
tttcagaaacgattatgaacac

SEQ ID NO: 8996033 - DNA, 22 bp, Homo sapiens
tttcagaaacgattatgaacac

SEQ ID NO: 8996034 - DNA, 22 bp, Homo sapiens
tttcagaaaacttatcatcagt

SEQ ID NO: 8996035 - DNA, 19 bp, Homo sapiens
tttcagacatttcaaattt

SEQ ID NO: 8996036 - DNA, 22 bp, Homo sapiens
tttcagactgctgtgtgaaact

SEQ ID NO: 8996037 - DNA, 22 bp, Homo sapiens
tttcagagaactgagtccttgc

SEQ ID NO: 8996038 - DNA, 22 bp, Homo sapiens
tttcagactccaaattcataag

SEQ ID NO: 8996039 - DNA, 22 bp, Homo sapiens
tttcagactccaaattcataag

SEQ ID NO: 8996040 - DNA, 22 bp, Homo sapiens
tttcagagaggcttcaaatctt

SEQ ID NO: 8996041 - DNA, 22 bp, Homo sapiens
tttcagagaggcttcaaatctt

SEQ ID NO: 8996042 - DNA, 22 bp, Homo sapiens
tttcagagaattagaagctgat

SEQ ID NO: 8996043 - DNA, 22 bp, Homo sapiens
tttcagagaattagaagctgat

SEQ ID NO: 8996044 - DNA, 22 bp, Homo sapiens
tttcagagaattagaagctgat

SEQ ID NO: 8996045 - DNA, 22 bp, Homo sapiens
tttcagagaactgagtccttgc

SEQ ID NO: 8996046 - DNA, 22 bp, Homo sapiens
tttcagagatgtctagcctatt

SEQ ID NO: 8996047 - DNA, 22 bp, Homo sapiens
tttcagagatgtctagcctatt

SEQ ID NO: 8996048 - DNA, 22 bp, Homo sapiens
tttcagagcctttatctctcta

SEQ ID NO: 8996049 - DNA, 22 bp, Homo sapiens
tttcccagttagtgaagacatg

SEQ ID NO: 8996050 - DNA, 22 bp, Homo sapiens
tttcccagttagtgaagacatg

SEQ ID NO: 8996051 - DNA, 22 bp, Homo sapiens
tttcccagttccctgctctata

SEQ ID NO: 8996052 - DNA, 22 bp, Homo sapiens
tttcccagttccctgctctata

SEQ ID NO: 8996053 - DNA, 22 bp, Homo sapiens
tttcccatccatagccctgcaa

SEQ ID NO: 8996054 - DNA, 22 bp, Homo sapiens
tttcccatccatagccctgcaa

SEQ ID NO: 8996055 - DNA, 22 bp, Homo sapiens
tttcccagttccctgctctata

SEQ ID NO: 8996056 - DNA, 22 bp, Homo sapiens
tttcccatcttagcagattaaa

SEQ ID NO: 8996057 - DNA, 22 bp, Homo sapiens
tttcccatggcagaagccctgt

SEQ ID NO: 8996058 - DNA, 22 bp, Homo sapiens
tttcccatggcagaagccctgt

SEQ ID NO: 8996059 - DNA, 22 bp, Homo sapiens
tttcccattctaattactcatt

SEQ ID NO: 8996060 - DNA, 22 bp, Homo sapiens
tttccccaggtagatagataat

SEQ ID NO: 8996061 - DNA, 22 bp, Homo sapiens
tttcccagcctcctttgcagct

SEQ ID NO: 8996062 - DNA, 22 bp, Homo sapiens
tttcccaggccctcagggctgc

SEQ ID NO: 8996063 - DNA, 22 bp, Homo sapiens
tttcccaggccctcagggctgc

SEQ ID NO: 8996064 - DNA, 22 bp, Homo sapiens
tttcccaggccctcagggctgc

SEQ ID NO: 8996065 - DNA, 19 bp, Homo sapiens
tttcccagtcccaggagtg

SEQ ID NO: 8996066 - DNA, 22 bp, Homo sapiens
tttcattgatgggtgatagaaa

SEQ ID NO: 8996067 - DNA, 21 bp, Homo sapiens
tttcccagcagagatagctgg

SEQ ID NO: 8996068 - DNA, 22 bp, Homo sapiens
tttcattgcagagtctgtgtgc

SEQ ID NO: 8996069 - DNA, 22 bp, Homo sapiens
tttcattgatgggtgatagaaa

SEQ ID NO: 8996070 - DNA, 21 bp, Homo sapiens
tttcccagcagagatagctgg

SEQ ID NO: 8996071 - DNA, 21 bp, Homo sapiens
tttcccagcagagatagctgg

SEQ ID NO: 8996072 - DNA, 19 bp, Homo sapiens
tttcccagcccttgctgtg

SEQ ID NO: 8996073 - DNA, 19 bp, Homo sapiens
tttcccagcccttgctgtg

SEQ ID NO: 8996074 - DNA, 22 bp, Homo sapiens
tttcattcattatacagtagag

SEQ ID NO: 8996075 - DNA, 22 bp, Homo sapiens
tttcattcattatacagtagag

SEQ ID NO: 8996076 - DNA, 22 bp, Homo sapiens
tttcattcattatacagtagag

SEQ ID NO: 8996077 - DNA, 22 bp, Homo sapiens
tttcattcattatacagtagag

SEQ ID NO: 8996078 - DNA, 21 bp, Homo sapiens
tttcattgaatgagataaggt

SEQ ID NO: 8996079 - DNA, 22 bp, Homo sapiens
tttcattgaactaaagaatctg

SEQ ID NO: 8996080 - DNA, 22 bp, Homo sapiens
tttcattcatgtgttaaaggtg

SEQ ID NO: 8996081 - DNA, 22 bp, Homo sapiens
tttcattcagcaccctgaggtg

SEQ ID NO: 8996082 - DNA, 22 bp, Homo sapiens
tttcattatgttcctggaagag

SEQ ID NO: 8996083 - DNA, 22 bp, Homo sapiens
tttcattatgttcctggaagag

SEQ ID NO: 8996084 - DNA, 22 bp, Homo sapiens
tttcattattcatgctagttat

SEQ ID NO: 8996085 - DNA, 22 bp, Homo sapiens
tttcattatgttcctggaagag

SEQ ID NO: 8996086 - DNA, 22 bp, Homo sapiens
tttcattgagaatataagattt

SEQ ID NO: 8996087 - DNA, 22 bp, Homo sapiens
tttcattgagaatataagattt

SEQ ID NO: 8996088 - DNA, 22 bp, Homo sapiens
tttcattgaactaaagaatctg

SEQ ID NO: 8996089 - DNA, 21 bp, Homo sapiens
tttcattgaatgagataaggt

SEQ ID NO: 8996090 - DNA, 21 bp, Homo sapiens
tttcattgaatgagataaggt

SEQ ID NO: 8996091 - DNA, 22 bp, Homo sapiens
tttcattgagactatagacatc

SEQ ID NO: 8996092 - DNA, 22 bp, Homo sapiens
tttcattgagactatagacatc

SEQ ID NO: 8996093 - DNA, 22 bp, Homo sapiens
tttcattgagactatagacatc

SEQ ID NO: 8996094 - DNA, 22 bp, Homo sapiens
tttcatgtcattccatttcaga

SEQ ID NO: 8996095 - DNA, 22 bp, Homo sapiens
tttcatgtctgaattctttagt

SEQ ID NO: 8996096 - DNA, 22 bp, Homo sapiens
tttcatgtatttcccaaagctt

SEQ ID NO: 8996097 - DNA, 22 bp, Homo sapiens
tttcatgtatttcccaaagctt

SEQ ID NO: 8996098 - DNA, 22 bp, Homo sapiens
tttcatgtacttttttgataga

SEQ ID NO: 8996099 - DNA, 22 bp, Homo sapiens
tttcatgtacttttttgataga

SEQ ID NO: 8996100 - DNA, 22 bp, Homo sapiens
tttcatgtactgtcgaagttga

SEQ ID NO: 8996101 - DNA, 22 bp, Homo sapiens
tttcatgtgttgaatgtgtaca

SEQ ID NO: 8996102 - DNA, 22 bp, Homo sapiens
tttcatgtgttgaatgtgtaca

SEQ ID NO: 8996103 - DNA, 22 bp, Homo sapiens
tttcatgtgttgaatgtgtaca

SEQ ID NO: 8996104 - DNA, 22 bp, Homo sapiens
tttcatgttacagtgtaaaagt

SEQ ID NO: 8996105 - DNA, 22 bp, Homo sapiens
tttcattatacagcttcataaa

SEQ ID NO: 8996106 - DNA, 22 bp, Homo sapiens
tttcatgtggcgatgtctctgg

SEQ ID NO: 8996107 - DNA, 22 bp, Homo sapiens
tttcatgtgcaattagcaatat

SEQ ID NO: 8996108 - DNA, 22 bp, Homo sapiens
tttcatcttccttggcataggt

SEQ ID NO: 8996109 - DNA, 22 bp, Homo sapiens
tttcagagctcagcagctagag

SEQ ID NO: 8996110 - DNA, 22 bp, Homo sapiens
tttcagagctcagcagctagag

SEQ ID NO: 8996111 - DNA, 22 bp, Homo sapiens
tttcagagctctaggctctcag

SEQ ID NO: 8996112 - DNA, 22 bp, Homo sapiens
tttcatgagattcctccacatc

SEQ ID NO: 8996113 - DNA, 22 bp, Homo sapiens
tttcatcttgattctatatggc

SEQ ID NO: 8996114 - DNA, 22 bp, Homo sapiens
tttcatcttgattctatatggc

SEQ ID NO: 8996115 - DNA, 22 bp, Homo sapiens
tttcatgaggggcaaaatctca

SEQ ID NO: 8996116 - DNA, 22 bp, Homo sapiens
tttcatgaggggcaaaatctca

SEQ ID NO: 8996117 - DNA, 22 bp, Homo sapiens
tttcatgaggctgcataaggag

SEQ ID NO: 8996118 - DNA, 22 bp, Homo sapiens
tttcatgagtggaagaagtgta

SEQ ID NO: 8996119 - DNA, 22 bp, Homo sapiens
tttcatgatccatttacaaaat

SEQ ID NO: 8996120 - DNA, 22 bp, Homo sapiens
tttcatgattaacttagtgaat

SEQ ID NO: 8996121 - DNA, 22 bp, Homo sapiens
tttcatgattaacttagtgaat

SEQ ID NO: 8996122 - DNA, 22 bp, Homo sapiens
tttcatgattaacttagtgaat

SEQ ID NO: 8996123 - DNA, 22 bp, Homo sapiens
tttcatgattaacttagtgaat

SEQ ID NO: 8996124 - DNA, 22 bp, Homo sapiens
tttcatgcacaaatgagcaagg

SEQ ID NO: 8996125 - DNA, 22 bp, Homo sapiens
tttcatggctaggactagagtg

SEQ ID NO: 8996126 - DNA, 22 bp, Homo sapiens
tttcatggctaggactagagtg

SEQ ID NO: 8996127 - DNA, 22 bp, Homo sapiens
tttcatgcctgtggtgcagtgt

SEQ ID NO: 8996128 - DNA, 22 bp, Homo sapiens
tttcatgctacctggcagtgac

SEQ ID NO: 8996129 - DNA, 22 bp, Homo sapiens
tttcatgcctcttgagaaagat

SEQ ID NO: 8996130 - DNA, 22 bp, Homo sapiens
tttcatgcctggaattgccctt

SEQ ID NO: 8996131 - DNA, 22 bp, Homo sapiens
tttaatgatagtcttacgaaaa

SEQ ID NO: 8996132 - DNA, 22 bp, Homo sapiens
tttaatgatagctgtttcacat

SEQ ID NO: 8996133 - DNA, 22 bp, Homo sapiens
tttaatgcaatttctggtctgc

SEQ ID NO: 8996134 - DNA, 22 bp, Homo sapiens
tttaatgatagtcttacgaaaa

SEQ ID NO: 8996135 - DNA, 22 bp, Homo sapiens
tttaatggcaagaaggctgcag

SEQ ID NO: 8996136 - DNA, 22 bp, Homo sapiens
tttaatgggatccatctggtta

SEQ ID NO: 8996137 - DNA, 22 bp, Homo sapiens
tttaatgtagcgtgaaatgatt

SEQ ID NO: 8996138 - DNA, 22 bp, Homo sapiens
tttaatgtagcgtgaaatgatt

SEQ ID NO: 8996139 - DNA, 22 bp, Homo sapiens
tttacagcttctatactatgtg

SEQ ID NO: 8996140 - DNA, 22 bp, Homo sapiens
tttacagcttctatactatgtg

SEQ ID NO: 8996141 - DNA, 22 bp, Homo sapiens
tttaatgtattctttggaacca

SEQ ID NO: 8996142 - DNA, 22 bp, Homo sapiens
tttaatgtgacatcttttagag

SEQ ID NO: 8996143 - DNA, 22 bp, Homo sapiens
tttacagtctctatagtcaaaa

SEQ ID NO: 8996144 - DNA, 22 bp, Homo sapiens
tttacagtctgtctagcaatgt

SEQ ID NO: 8996145 - DNA, 22 bp, Homo sapiens
tttacagtctgtctagcaatgt

SEQ ID NO: 8996146 - DNA, 22 bp, Homo sapiens
tttacagtctatgttgaattaa

SEQ ID NO: 8996147 - DNA, 22 bp, Homo sapiens
tttacagtctatgttgaattaa

SEQ ID NO: 8996148 - DNA, 22 bp, Homo sapiens
tttacagggttcaagaatgaaa

SEQ ID NO: 8996149 - DNA, 22 bp, Homo sapiens
tttacagtaaggtggatggtac

SEQ ID NO: 8996150 - DNA, 22 bp, Homo sapiens
tttaagtgaaatgtaatacagt

SEQ ID NO: 8996151 - DNA, 22 bp, Homo sapiens
tttaatctattccctaaacacc

SEQ ID NO: 8996152 - DNA, 22 bp, Homo sapiens
tttaagtgatgaaatgcagata

SEQ ID NO: 8996153 - DNA, 22 bp, Homo sapiens
tttaagtgaaatgtaatacagt

SEQ ID NO: 8996154 - DNA, 22 bp, Homo sapiens
tttaatctcccactctcagcct

SEQ ID NO: 8996155 - DNA, 22 bp, Homo sapiens
tttaatctattccctaaacacc

SEQ ID NO: 8996156 - DNA, 22 bp, Homo sapiens
tttaatctattccctaaacacc

SEQ ID NO: 8996157 - DNA, 22 bp, Homo sapiens
tttaatcttcaaaatagtctta

SEQ ID NO: 8996158 - DNA, 22 bp, Homo sapiens
tttaatcttcaaaatagtctta

SEQ ID NO: 8996159 - DNA, 16 bp, Homo sapiens
tttaatctctcaggaa

SEQ ID NO: 8996160 - DNA, 22 bp, Homo sapiens
tttaatgaataattcaaatctg

SEQ ID NO: 8996161 - DNA, 22 bp, Homo sapiens
tttaaggcagtgaaactattct

SEQ ID NO: 8996162 - DNA, 22 bp, Homo sapiens
tttaagggtggaggaacaaatg

SEQ ID NO: 8996163 - DNA, 22 bp, Homo sapiens
tttaagggattgtgattttcac

SEQ ID NO: 8996164 - DNA, 22 bp, Homo sapiens
tttaagggatattttgatagct

SEQ ID NO: 8996165 - DNA, 22 bp, Homo sapiens
tttaaggcttcactggagtggg

SEQ ID NO: 8996166 - DNA, 22 bp, Homo sapiens
tttaagctaatgtcataattag

SEQ ID NO: 8996167 - DNA, 22 bp, Homo sapiens
tttaagcacagggataaagtta

SEQ ID NO: 8996168 - DNA, 22 bp, Homo sapiens
tttaagcagagaaatgatgtat

SEQ ID NO: 8996169 - DNA, 22 bp, Homo sapiens
tttaagatttcttctcctgaga

SEQ ID NO: 8996170 - DNA, 22 bp, Homo sapiens
tttaagcaagttgacatagcat

SEQ ID NO: 8996171 - DNA, 22 bp, Homo sapiens
tttaagcaagttgacatagcat

SEQ ID NO: 8996172 - DNA, 19 bp, Homo sapiens
tttaagcaatagtatcttg

SEQ ID NO: 8996173 - DNA, 22 bp, Homo sapiens
tttaagcacagggataaagtta

SEQ ID NO: 8996174 - DNA, 22 bp, Homo sapiens
tttaagcacagggataaagtta

SEQ ID NO: 8996175 - DNA, 22 bp, Homo sapiens
tttaagattcagtaaggcaaac

SEQ ID NO: 8996176 - DNA, 22 bp, Homo sapiens
tttaagattcagtaaggcaaac

SEQ ID NO: 8996177 - DNA, 22 bp, Homo sapiens
tttaagatggtattttataaag

SEQ ID NO: 8996178 - DNA, 22 bp, Homo sapiens
tttaagatggtattttataaag

SEQ ID NO: 8996179 - DNA, 22 bp, Homo sapiens
tttaagattcagtaaggcaaac

SEQ ID NO: 8996180 - DNA, 22 bp, Homo sapiens
tttaaatgtgttcttagtagct

SEQ ID NO: 8996181 - DNA, 22 bp, Homo sapiens
tttaaatgtgttcttagtagct

SEQ ID NO: 8996182 - DNA, 22 bp, Homo sapiens
tttaaatggcattttcccagat

SEQ ID NO: 8996183 - DNA, 22 bp, Homo sapiens
tttaaatggcattttcccagat

SEQ ID NO: 8996184 - DNA, 22 bp, Homo sapiens
tttaaatgttcatgatactgaa

SEQ ID NO: 8996185 - DNA, 22 bp, Homo sapiens
tttaaatgttcatgatactgaa

SEQ ID NO: 8996186 - DNA, 22 bp, Homo sapiens
tttaaatgtgttcttagtagct

SEQ ID NO: 8996187 - DNA, 22 bp, Homo sapiens
tttaaatgtgttcttagtagct

SEQ ID NO: 8996188 - DNA, 22 bp, Homo sapiens
tttaaatgtgttcttagtagct

SEQ ID NO: 8996189 - DNA, 22 bp, Homo sapiens
tttaaatgtttatagagagtac

SEQ ID NO: 8996190 - DNA, 22 bp, Homo sapiens
tttaaatgtttatagagagtac

SEQ ID NO: 8996191 - DNA, 22 bp, Homo sapiens
tttaaatgtttatagagagtac

SEQ ID NO: 8996192 - DNA, 22 bp, Homo sapiens
tttaagatggtattttataaag

SEQ ID NO: 8996193 - DNA, 22 bp, Homo sapiens
tttaagatggtattttataaag

SEQ ID NO: 8996194 - DNA, 22 bp, Homo sapiens
tttaagatggtattttataaag

SEQ ID NO: 8996195 - DNA, 22 bp, Homo sapiens
tttaaatgtttaaaactcgtga

SEQ ID NO: 8996196 - DNA, 22 bp, Homo sapiens
tttaaatgtttatagagagtac

SEQ ID NO: 8996197 - DNA, 22 bp, Homo sapiens
tttaaatgtttaaaactcgtga

SEQ ID NO: 8996198 - DNA, 22 bp, Homo sapiens
tttaaatgttcatgatactgaa

SEQ ID NO: 8996199 - DNA, 22 bp, Homo sapiens
tttaaataggactcctgggggt

SEQ ID NO: 8996200 - DNA, 22 bp, Homo sapiens
tttaaataggactcctgggggt

SEQ ID NO: 8996201 - DNA, 22 bp, Homo sapiens
tttaaataggactcctgggggt

SEQ ID NO: 8996202 - DNA, 22 bp, Homo sapiens
tttaaataggactcctgggggt

SEQ ID NO: 8996203 - DNA, 22 bp, Homo sapiens
tttaaataggactcctgggggt

SEQ ID NO: 8996204 - DNA, 22 bp, Homo sapiens
tttaaataggactcctgggggt

SEQ ID NO: 8996205 - DNA, 22 bp, Homo sapiens
tttaaatgctttaagcaagggt

SEQ ID NO: 8996206 - DNA, 22 bp, Homo sapiens
tttaaatgctttaagcaagggt

SEQ ID NO: 8996207 - DNA, 22 bp, Homo sapiens
tttaaatgcagacgttgattca

SEQ ID NO: 8996208 - DNA, 22 bp, Homo sapiens
tttaaatgcagacgttgattca

SEQ ID NO: 8996209 - DNA, 22 bp, Homo sapiens
tttaaatgcagacgttgattca

SEQ ID NO: 8996210 - DNA, 22 bp, Homo sapiens
tttaaagtttttgcacattctg

SEQ ID NO: 8996211 - DNA, 22 bp, Homo sapiens
tttaaagtttttgcacattctg

SEQ ID NO: 8996212 - DNA, 22 bp, Homo sapiens
tttaaataggactcctgggggt

SEQ ID NO: 8996213 - DNA, 22 bp, Homo sapiens
tttaaataggactcctgggggt

SEQ ID NO: 8996214 - DNA, 22 bp, Homo sapiens
tttaaagtgctgctcctatcct

SEQ ID NO: 8996215 - DNA, 22 bp, Homo sapiens
tttaaagtggtccatttcagaa

SEQ ID NO: 8996216 - DNA, 22 bp, Homo sapiens
tttaaagtggtccatttcagaa

SEQ ID NO: 8996217 - DNA, 22 bp, Homo sapiens
ttgtgtgtactggttatgggca

SEQ ID NO: 8996218 - DNA, 22 bp, Homo sapiens
ttgtgtgataagtctcttgtgc

SEQ ID NO: 8996219 - DNA, 22 bp, Homo sapiens
ttgtgtgctgagggcctgctgt

SEQ ID NO: 8996220 - DNA, 22 bp, Homo sapiens
ttgtgtgcataaattctgatgt

SEQ ID NO: 8996221 - DNA, 22 bp, Homo sapiens
ttgtgtgtagactcagccattg

SEQ ID NO: 8996222 - DNA, 22 bp, Homo sapiens
ttgtgtgtagactcagccattg

SEQ ID NO: 8996223 - DNA, 22 bp, Homo sapiens
ttgtgtgtactggttatgggca

SEQ ID NO: 8996224 - DNA, 22 bp, Homo sapiens
ttgtgtgtactggttatgggca

SEQ ID NO: 8996225 - DNA, 22 bp, Homo sapiens
tttaaacatcttgttgccttaa

SEQ ID NO: 8996226 - DNA, 22 bp, Homo sapiens
tttaaacatcttgttgccttaa

SEQ ID NO: 8996227 - DNA, 22 bp, Homo sapiens
tttaaacatcttgttgccttaa

SEQ ID NO: 8996228 - DNA, 22 bp, Homo sapiens
tttaaacatcttgttgccttaa

SEQ ID NO: 8996229 - DNA, 22 bp, Homo sapiens
tttaaacatcttgttgccttaa

SEQ ID NO: 8996230 - DNA, 17 bp, Homo sapiens
ttgtgtgtagttctgat

SEQ ID NO: 8996231 - DNA, 22 bp, Homo sapiens
tttaaacatatctgttgaggga

SEQ ID NO: 8996232 - DNA, 22 bp, Homo sapiens
ttgtgtgtagactcagccattg

SEQ ID NO: 8996233 - DNA, 17 bp, Homo sapiens
ttgtgtgtagttctgat

SEQ ID NO: 8996234 - DNA, 17 bp, Homo sapiens
ttgtgtgtagttctgat

SEQ ID NO: 8996235 - DNA, 22 bp, Homo sapiens
tttaaagaaattcctcatcttt

SEQ ID NO: 8996236 - DNA, 17 bp, Homo sapiens
tttaaactactacaagg

SEQ ID NO: 8996237 - DNA, 17 bp, Homo sapiens
tttaaactactacaagg

SEQ ID NO: 8996238 - DNA, 22 bp, Homo sapiens
tttaaactaacagtacacgttg

SEQ ID NO: 8996239 - DNA, 22 bp, Homo sapiens
tttaaactaacagtacacgttg

SEQ ID NO: 8996240 - DNA, 22 bp, Homo sapiens
tttaaactaacagtacacgttg

SEQ ID NO: 8996241 - DNA, 17 bp, Homo sapiens
tttaaactactacaagg

SEQ ID NO: 8996242 - DNA, 22 bp, Homo sapiens
tttaaagagaatgtgaaggagt

SEQ ID NO: 8996243 - DNA, 22 bp, Homo sapiens
tttaaagagaatgtgaaggagt

SEQ ID NO: 8996244 - DNA, 22 bp, Homo sapiens
tttaaagagaatgtgaaggagt

SEQ ID NO: 8996245 - DNA, 19 bp, Homo sapiens
tttaaagtgactggtattt

SEQ ID NO: 8996246 - DNA, 22 bp, Homo sapiens
tttaaagaaattcctcatcttt

SEQ ID NO: 8996247 - DNA, 22 bp, Homo sapiens
tttaaagaaattcctcatcttt

SEQ ID NO: 8996248 - DNA, 22 bp, Homo sapiens
tttaaagaaattcctcatcttt

SEQ ID NO: 8996249 - DNA, 22 bp, Homo sapiens
tttaaagaaattcctcatcttt

SEQ ID NO: 8996250 - DNA, 19 bp, Homo sapiens
tttagaagttgaaactctg

SEQ ID NO: 8996251 - DNA, 22 bp, Homo sapiens
tttagaagttcacacatttaaa

SEQ ID NO: 8996252 - DNA, 22 bp, Homo sapiens
tttagaagttcacacatttaaa

SEQ ID NO: 8996253 - DNA, 19 bp, Homo sapiens
tttagaagttgaaactctg

SEQ ID NO: 8996254 - DNA, 22 bp, Homo sapiens
tttagaagttcacacatttaaa

SEQ ID NO: 8996255 - DNA, 22 bp, Homo sapiens
tttagaagggctggtcagaaat

SEQ ID NO: 8996256 - DNA, 20 bp, Homo sapiens
tttagaagaatgagcacttt

SEQ ID NO: 8996257 - DNA, 22 bp, Homo sapiens
tttagaaggactacagtgtgat

SEQ ID NO: 8996258 - DNA, 22 bp, Homo sapiens
tttaccaaatgagactattgtt

SEQ ID NO: 8996259 - DNA, 22 bp, Homo sapiens
tttaccaaatagattatgtcag

SEQ ID NO: 8996260 - DNA, 22 bp, Homo sapiens
tttaccaaagtactctgaggca

SEQ ID NO: 8996261 - DNA, 22 bp, Homo sapiens
tttaccaaagtactctgaggca

SEQ ID NO: 8996262 - DNA, 22 bp, Homo sapiens
tttaccaaatgagactattgtt

SEQ ID NO: 8996263 - DNA, 20 bp, Homo sapiens
tttaccaactcaccagtatc

SEQ ID NO: 8996264 - DNA, 20 bp, Homo sapiens
tttaccaactcaccagtatc

SEQ ID NO: 8996265 - DNA, 22 bp, Homo sapiens
tttaccaagagttgtcactgtt

SEQ ID NO: 8996266 - DNA, 22 bp, Homo sapiens
tttaccaagatagcatctggtt

SEQ ID NO: 8996267 - DNA, 22 bp, Homo sapiens
tttaccaagctttaattacata

SEQ ID NO: 8996268 - DNA, 22 bp, Homo sapiens
tttaccaagagttgtcactgtt

SEQ ID NO: 8996269 - DNA, 22 bp, Homo sapiens
tttaccaagagttgtcactgtt

SEQ ID NO: 8996270 - DNA, 22 bp, Homo sapiens
tttaccaagctttaattacata

SEQ ID NO: 8996271 - DNA, 22 bp, Homo sapiens
tttaccaaggcatagtaatctc

SEQ ID NO: 8996272 - DNA, 22 bp, Homo sapiens
tttaccaagctttaattacata

SEQ ID NO: 8996273 - DNA, 22 bp, Homo sapiens
tttaccacaattttaaacaatg

SEQ ID NO: 8996274 - DNA, 22 bp, Homo sapiens
tttaccacaataatcatcacaa

SEQ ID NO: 8996275 - DNA, 22 bp, Homo sapiens
tttaccaaggcatagtaatctc

SEQ ID NO: 8996276 - DNA, 20 bp, Homo sapiens
tttacattttgaaacagtga

SEQ ID NO: 8996277 - DNA, 20 bp, Homo sapiens
tttacattttgaaacagtga

SEQ ID NO: 8996278 - DNA, 20 bp, Homo sapiens
tttacattttgaaacagtga

SEQ ID NO: 8996279 - DNA, 20 bp, Homo sapiens
tttacattttgaaacagtga

SEQ ID NO: 8996280 - DNA, 20 bp, Homo sapiens
tttacattttgaaacagtga

SEQ ID NO: 8996281 - DNA, 20 bp, Homo sapiens
tttaccaaaggagttatgat

SEQ ID NO: 8996282 - DNA, 22 bp, Homo sapiens
tttaccaaagtactctgaggca

SEQ ID NO: 8996283 - DNA, 22 bp, Homo sapiens
tttacagtgagagcttagtgag

SEQ ID NO: 8996284 - DNA, 22 bp, Homo sapiens
tttacagtgagagcttagtgag

SEQ ID NO: 8996285 - DNA, 22 bp, Homo sapiens
tttacagtctgtctagcaatgt

SEQ ID NO: 8996286 - DNA, 22 bp, Homo sapiens
tttacagtctgtctagcaatgt

SEQ ID NO: 8996287 - DNA, 22 bp, Homo sapiens
tttacagtctgtctagcaatgt

SEQ ID NO: 8996288 - DNA, 22 bp, Homo sapiens
tttacagtctgtctagcaatgt

SEQ ID NO: 8996289 - DNA, 22 bp, Homo sapiens
tttagcaaaacattatgtctgt

SEQ ID NO: 8996290 - DNA, 21 bp, Homo sapiens
tttagcaagagtatagtgcat

SEQ ID NO: 8996291 - DNA, 22 bp, Homo sapiens
tttagcaaggagaaataatcct

SEQ ID NO: 8996292 - DNA, 22 bp, Homo sapiens
tttagcaaggagaaataatcct

SEQ ID NO: 8996293 - DNA, 22 bp, Homo sapiens
tttagagttgagtattcattgg

SEQ ID NO: 8996294 - DNA, 22 bp, Homo sapiens
tttagagttggtcccctgtgag

SEQ ID NO: 8996295 - DNA, 22 bp, Homo sapiens
tttagagttgtagctctcagct

SEQ ID NO: 8996296 - DNA, 22 bp, Homo sapiens
tttagagtctaatggtgaagat

SEQ ID NO: 8996297 - DNA, 22 bp, Homo sapiens
tttagagtccctttctcaccac

SEQ ID NO: 8996298 - DNA, 22 bp, Homo sapiens
tttagagttaattccattctgt

SEQ ID NO: 8996299 - DNA, 22 bp, Homo sapiens
tttagagtctttaggagaaatg

SEQ ID NO: 8996300 - DNA, 22 bp, Homo sapiens
tttagagtccaagttcttcact

SEQ ID NO: 8996301 - DNA, 22 bp, Homo sapiens
tttagagtccaagttcttcact

SEQ ID NO: 8996302 - DNA, 22 bp, Homo sapiens
tttagagtccttgctcttattc

SEQ ID NO: 8996303 - DNA, 22 bp, Homo sapiens
tttagataatgctcaagcaatt

SEQ ID NO: 8996304 - DNA, 22 bp, Homo sapiens
tttagagtttctaaatggaatt

SEQ ID NO: 8996305 - DNA, 22 bp, Homo sapiens
tttagagtttctaaatggaatt

SEQ ID NO: 8996306 - DNA, 22 bp, Homo sapiens
tttagattgtgacctcccccca

SEQ ID NO: 8996307 - DNA, 22 bp, Homo sapiens
tttagattgtgacctcccccca

SEQ ID NO: 8996308 - DNA, 22 bp, Homo sapiens
tttagagagtgtaaaaatatat

SEQ ID NO: 8996309 - DNA, 22 bp, Homo sapiens
tttagagcagggtgtggcacat

SEQ ID NO: 8996310 - DNA, 22 bp, Homo sapiens
tttagagcccatgtgagtgtga

SEQ ID NO: 8996311 - DNA, 22 bp, Homo sapiens
tttagagctgtgctgccacatg

SEQ ID NO: 8996312 - DNA, 22 bp, Homo sapiens
tttagaggaattgggagaacgt

SEQ ID NO: 8996313 - DNA, 22 bp, Homo sapiens
tttagagctgtgctgccacatg

SEQ ID NO: 8996314 - DNA, 22 bp, Homo sapiens
tttagaggaattgggagaacgt

SEQ ID NO: 8996315 - DNA, 22 bp, Homo sapiens
tttagagtaaaaactgtgacct

SEQ ID NO: 8996316 - DNA, 22 bp, Homo sapiens
tttagaggttggggactttgca

SEQ ID NO: 8996317 - DNA, 22 bp, Homo sapiens
tttagaggttagaggctgatag

SEQ ID NO: 8996318 - DNA, 22 bp, Homo sapiens
tttagagtcattttatattgac

SEQ ID NO: 8996319 - DNA, 22 bp, Homo sapiens
tttagaggtctgtttcacatca

SEQ ID NO: 8996320 - DNA, 22 bp, Homo sapiens
tttagaggttagaggctgatag

SEQ ID NO: 8996321 - DNA, 22 bp, Homo sapiens
tttagaggggaaagtggctggt

SEQ ID NO: 8996322 - DNA, 22 bp, Homo sapiens
tttagaggtaggtagagtccaa

SEQ ID NO: 8996323 - DNA, 22 bp, Homo sapiens
tttagaggggaaagtggctggt

SEQ ID NO: 8996324 - DNA, 22 bp, Homo sapiens
tttagaggaggaagaaattttg

SEQ ID NO: 8996325 - DNA, 21 bp, Homo sapiens
tttagaggacacagggaggca

SEQ ID NO: 8996326 - DNA, 22 bp, Homo sapiens
tttagaggcatcttgcttttct

SEQ ID NO: 8996327 - DNA, 17 bp, Homo sapiens
tttagaggataagcccc

SEQ ID NO: 8996328 - DNA, 22 bp, Homo sapiens
tttagaggctgcctatcacaac

SEQ ID NO: 8996329 - DNA, 22 bp, Homo sapiens
tttagagaattagaacagtact

SEQ ID NO: 8996330 - DNA, 22 bp, Homo sapiens
tttagagaccctctgctatttt

SEQ ID NO: 8996331 - DNA, 17 bp, Homo sapiens
tttagaatacaatgttt

SEQ ID NO: 8996332 - DNA, 22 bp, Homo sapiens
tttagagagaaataaatgagat

SEQ ID NO: 8996333 - DNA, 22 bp, Homo sapiens
tttagagagaaataaatgagat

SEQ ID NO: 8996334 - DNA, 22 bp, Homo sapiens
tttagagagaattttcaaagtg

SEQ ID NO: 8996335 - DNA, 22 bp, Homo sapiens
tttagagaggctctgtaaaatg

SEQ ID NO: 8996336 - DNA, 22 bp, Homo sapiens
tttagagaggctctgtaaaatg

SEQ ID NO: 8996337 - DNA, 22 bp, Homo sapiens
tttagagaggctctgtaaaatg

SEQ ID NO: 8996338 - DNA, 22 bp, Homo sapiens
tttatatagagatttgtgcatg

SEQ ID NO: 8996339 - DNA, 22 bp, Homo sapiens
tttatatagagatttgtgcatg

SEQ ID NO: 8996340 - DNA, 22 bp, Homo sapiens
tttatatagagatttgtgcatg

SEQ ID NO: 8996341 - DNA, 22 bp, Homo sapiens
tttatatatggctggtctggat

SEQ ID NO: 8996342 - DNA, 22 bp, Homo sapiens
tttatatatggctggtctggat

SEQ ID NO: 8996343 - DNA, 22 bp, Homo sapiens
tttatatatggctggtctggat

SEQ ID NO: 8996344 - DNA, 22 bp, Homo sapiens
tttatatatggctggtctggat

SEQ ID NO: 8996345 - DNA, 22 bp, Homo sapiens
tttatatagagatttgtgcatg

SEQ ID NO: 8996346 - DNA, 22 bp, Homo sapiens
tttatattgggagtcgttttga

SEQ ID NO: 8996347 - DNA, 22 bp, Homo sapiens
tttatattgggagtcgttttga

SEQ ID NO: 8996348 - DNA, 22 bp, Homo sapiens
tttatattgggagtcgttttga

SEQ ID NO: 8996349 - DNA, 22 bp, Homo sapiens
tttatattgggagtcgttttga

SEQ ID NO: 8996350 - DNA, 23 bp, Homo sapiens
tttatattcctaatgtcttgagc

SEQ ID NO: 8996351 - DNA, 22 bp, Homo sapiens
tttatatatggctggtctggat

SEQ ID NO: 8996352 - DNA, 22 bp, Homo sapiens
tttatattgtaaaaatggttct

SEQ ID NO: 8996353 - DNA, 22 bp, Homo sapiens
tttatattgtaaaaatggttct

SEQ ID NO: 8996354 - DNA, 22 bp, Homo sapiens
tttatattgtaaaaatggttct

SEQ ID NO: 8996355 - DNA, 22 bp, Homo sapiens
tttagcaatatcataaggaaga

SEQ ID NO: 8996356 - DNA, 22 bp, Homo sapiens
tttagcaatttctaaaagtgtt

SEQ ID NO: 8996357 - DNA, 22 bp, Homo sapiens
tttagcagagcatatgatatcc

SEQ ID NO: 8996358 - DNA, 22 bp, Homo sapiens
tttagcagaatttctctagaag

SEQ ID NO: 8996359 - DNA, 22 bp, Homo sapiens
tttagcagaaactcattaaatt

SEQ ID NO: 8996360 - DNA, 22 bp, Homo sapiens
tttagcagcaaataagtagtgc

SEQ ID NO: 8996361 - DNA, 22 bp, Homo sapiens
tttagcagcaaataagtagtgc

SEQ ID NO: 8996362 - DNA, 22 bp, Homo sapiens
tttagcagagcatatgatatcc

SEQ ID NO: 8996363 - DNA, 22 bp, Homo sapiens
tttagcagtgaagtgaagtgaa

SEQ ID NO: 8996364 - DNA, 22 bp, Homo sapiens
tttagcatatcctataaaacta

SEQ ID NO: 8996365 - DNA, 22 bp, Homo sapiens
tttagcagctggtgttaccata

SEQ ID NO: 8996366 - DNA, 22 bp, Homo sapiens
tttatatagagatttgtgcatg

SEQ ID NO: 8996367 - DNA, 22 bp, Homo sapiens
tttatatagagatttgtgcatg

SEQ ID NO: 8996368 - DNA, 22 bp, Homo sapiens
tttagcatccaaggttatgact

SEQ ID NO: 8996369 - DNA, 22 bp, Homo sapiens
tttagcatccaaggttatgact

SEQ ID NO: 8996370 - DNA, 22 bp, Homo sapiens
tttagcatatttaaggaatgat

SEQ ID NO: 8996371 - DNA, 22 bp, Homo sapiens
tttagcatatcctataaaacta

SEQ ID NO: 8996372 - DNA, 22 bp, Homo sapiens
tttatcagaggctatgtttcat

SEQ ID NO: 8996373 - DNA, 20 bp, Homo sapiens
tttatcaggcacttactatt

SEQ ID NO: 8996374 - DNA, 22 bp, Homo sapiens
tttatcagtagcaaagttttaa

SEQ ID NO: 8996375 - DNA, 22 bp, Homo sapiens
tttatcagtagcaaagttttaa

SEQ ID NO: 8996376 - DNA, 20 bp, Homo sapiens
tttatcaggcacttactatt

SEQ ID NO: 8996377 - DNA, 22 bp, Homo sapiens
tttatcaaacaaattatccagc

SEQ ID NO: 8996378 - DNA, 22 bp, Homo sapiens
tttatcaaacaaattatccagc

SEQ ID NO: 8996379 - DNA, 22 bp, Homo sapiens
tttatcaaacaaattatccagc

SEQ ID NO: 8996380 - DNA, 22 bp, Homo sapiens
tttatcagaagttagagaaaga

SEQ ID NO: 8996381 - DNA, 22 bp, Homo sapiens
tttatcagaagttagagaaaga

SEQ ID NO: 8996382 - DNA, 22 bp, Homo sapiens
tttatccacagtatccaaaatc

SEQ ID NO: 8996383 - DNA, 22 bp, Homo sapiens
tttatccaagggttttaactgt

SEQ ID NO: 8996384 - DNA, 22 bp, Homo sapiens
tttatccactcatccatgcctc

SEQ ID NO: 8996385 - DNA, 21 bp, Homo sapiens
tttatcatcacgagcttgagc

SEQ ID NO: 8996386 - DNA, 21 bp, Homo sapiens
tttatcatcacgagcttgagc

SEQ ID NO: 8996387 - DNA, 22 bp, Homo sapiens
tttatcatcttgtttttaaagc

SEQ ID NO: 8996388 - DNA, 22 bp, Homo sapiens
tttatcatcttgtttttaaagc

SEQ ID NO: 8996389 - DNA, 22 bp, Homo sapiens
tttatcatcttgtttttaaagc

SEQ ID NO: 8996390 - DNA, 22 bp, Homo sapiens
tttatccagcagctattcaaaa

SEQ ID NO: 8996391 - DNA, 22 bp, Homo sapiens
tttatccatatcattaaaatct

SEQ ID NO: 8996392 - DNA, 22 bp, Homo sapiens
tttatccatcatctgctgaagg

SEQ ID NO: 8996393 - DNA, 22 bp, Homo sapiens
tttatccatcatctgctgaagg

SEQ ID NO: 8996394 - DNA, 22 bp, Homo sapiens
tttatccatcatctgctgaagg

SEQ ID NO: 8996395 - DNA, 22 bp, Homo sapiens
tttatctattgtattgttgatg

SEQ ID NO: 8996396 - DNA, 22 bp, Homo sapiens
tttatctattgtattgttgatg

SEQ ID NO: 8996397 - DNA, 22 bp, Homo sapiens
tttatctattgtattgttgatg

SEQ ID NO: 8996398 - DNA, 22 bp, Homo sapiens
tttatctattgtattgttgatg

SEQ ID NO: 8996399 - DNA, 22 bp, Homo sapiens
tttatctgagctgatagatagt

SEQ ID NO: 8996400 - DNA, 22 bp, Homo sapiens
tttatctgagctgatagatagt

SEQ ID NO: 8996401 - DNA, 22 bp, Homo sapiens
tttatctgacctcacttcttaa

SEQ ID NO: 8996402 - DNA, 22 bp, Homo sapiens
tttatctgaatatgctccccac

SEQ ID NO: 8996403 - DNA, 22 bp, Homo sapiens
tttatctctgcatagaagtgat

SEQ ID NO: 8996404 - DNA, 22 bp, Homo sapiens
tttattcaagatgaggttcatg

SEQ ID NO: 8996405 - DNA, 22 bp, Homo sapiens
tttattcaagatgaggttcatg

SEQ ID NO: 8996406 - DNA, 22 bp, Homo sapiens
tttatctgaggaaagcagacaa

SEQ ID NO: 8996407 - DNA, 22 bp, Homo sapiens
tttatctgagctgatagatagt

SEQ ID NO: 8996408 - DNA, 22 bp, Homo sapiens
tttatctgaggaaagcagacaa

SEQ ID NO: 8996409 - DNA, 22 bp, Homo sapiens
tttatctgatattcagcgattt

SEQ ID NO: 8996410 - DNA, 22 bp, Homo sapiens
tttattattctgttctctctac

SEQ ID NO: 8996411 - DNA, 22 bp, Homo sapiens
acagcagtggattagaggatgg

SEQ ID NO: 8996412 - DNA, 22 bp, Homo sapiens
acagcagtggattagaggatgg

SEQ ID NO: 8996413 - DNA, 22 bp, Homo sapiens
acagcagtcttaacacattgca

SEQ ID NO: 8996414 - DNA, 22 bp, Homo sapiens
acagcagtgcacagagaaccct

SEQ ID NO: 8996415 - DNA, 22 bp, Homo sapiens
acagcaggttttaactttgaag

SEQ ID NO: 8996416 - DNA, 22 bp, Homo sapiens
acagcaggttttaactttgaag

SEQ ID NO: 8996417 - DNA, 22 bp, Homo sapiens
acagcaggttttaactttgaag

SEQ ID NO: 8996418 - DNA, 22 bp, Homo sapiens
acagcaggttttaactttgaag

SEQ ID NO: 8996419 - DNA, 22 bp, Homo sapiens
acagcaggttttaactttgaag

SEQ ID NO: 8996420 - DNA, 21 bp, Homo sapiens
acagcagggctggcatgacag

SEQ ID NO: 8996421 - DNA, 21 bp, Homo sapiens
acagcagggctggcatgacag

SEQ ID NO: 8996422 - DNA, 22 bp, Homo sapiens
acagcaggttacagtggcacag

SEQ ID NO: 8996423 - DNA, 22 bp, Homo sapiens
acagcaggttattgttatggca

SEQ ID NO: 8996424 - DNA, 21 bp, Homo sapiens
acagcagggctggcatgacag

SEQ ID NO: 8996425 - DNA, 22 bp, Homo sapiens
acagcaggttattgttatggca

SEQ ID NO: 8996426 - DNA, 22 bp, Homo sapiens
acagcaggttattgttatggca

SEQ ID NO: 8996427 - DNA, 18 bp, Homo sapiens
acagcaggtttcattctt

SEQ ID NO: 8996428 - DNA, 18 bp, Homo sapiens
acagcaggtttcattctt

SEQ ID NO: 8996429 - DNA, 18 bp, Homo sapiens
acagcaggtttcattctt

SEQ ID NO: 8996430 - DNA, 17 bp, Homo sapiens
acagcaggcccggaggg

SEQ ID NO: 8996431 - DNA, 17 bp, Homo sapiens
acagcaggcccggaggg

SEQ ID NO: 8996432 - DNA, 17 bp, Homo sapiens
acagcaggcccggaggg

SEQ ID NO: 8996433 - DNA, 17 bp, Homo sapiens
acagcaggcccggaggg

SEQ ID NO: 8996434 - DNA, 22 bp, Homo sapiens
acagcaggcccatactggaagg

SEQ ID NO: 8996435 - DNA, 17 bp, Homo sapiens
acagcaggcccggaggg

SEQ ID NO: 8996436 - DNA, 17 bp, Homo sapiens
acagcaggcccggaggg

SEQ ID NO: 8996437 - DNA, 22 bp, Homo sapiens
acagcaggcccatactggaagg

SEQ ID NO: 8996438 - DNA, 22 bp, Homo sapiens
acagcaggcccatactggaagg

SEQ ID NO: 8996439 - DNA, 22 bp, Homo sapiens
acagcaggcatgaatgacactg

SEQ ID NO: 8996440 - DNA, 22 bp, Homo sapiens
acagcaggcccatactggaagg

SEQ ID NO: 8996441 - DNA, 22 bp, Homo sapiens
acagcaggcatgaatgacactg

SEQ ID NO: 8996442 - DNA, 17 bp, Homo sapiens
acagcagggaagtgttg

SEQ ID NO: 8996443 - DNA, 17 bp, Homo sapiens
acagcagggaagtgttg

SEQ ID NO: 8996444 - DNA, 17 bp, Homo sapiens
acagcagggaagtgttg

SEQ ID NO: 8996445 - DNA, 22 bp, Homo sapiens
acagcagggaatatgggaattg

SEQ ID NO: 8996446 - DNA, 22 bp, Homo sapiens
acagcagggaatatgggaattg

SEQ ID NO: 8996447 - DNA, 22 bp, Homo sapiens
acagcagggaatatgggaattg

SEQ ID NO: 8996448 - DNA, 22 bp, Homo sapiens
acagcagggaatatgggaattg

SEQ ID NO: 8996449 - DNA, 22 bp, Homo sapiens
acagcagggaatatgggaattg

SEQ ID NO: 8996450 - DNA, 19 bp, Homo sapiens
acagcagggatttttggag

SEQ ID NO: 8996451 - DNA, 19 bp, Homo sapiens
acagcagggatttttggag

SEQ ID NO: 8996452 - DNA, 19 bp, Homo sapiens
acagcagggatttttggag

SEQ ID NO: 8996453 - DNA, 22 bp, Homo sapiens
agctgagggttcggtgtccaca

SEQ ID NO: 8996454 - DNA, 22 bp, Homo sapiens
agctgagggcaggatggggtga

SEQ ID NO: 8996455 - DNA, 22 bp, Homo sapiens
agctgagggcaggatggggtga

SEQ ID NO: 8996456 - DNA, 22 bp, Homo sapiens
agctgagggttcggtgtccaca

SEQ ID NO: 8996457 - DNA, 22 bp, Homo sapiens
agctgagggttcggtgtccaca

SEQ ID NO: 8996458 - DNA, 21 bp, Homo sapiens
agctgaggtaaggcaagagag

SEQ ID NO: 8996459 - DNA, 22 bp, Homo sapiens
acagcagcgtgaagtgtgttat

SEQ ID NO: 8996460 - DNA, 22 bp, Homo sapiens
agctgagggcaggatggggtga

SEQ ID NO: 8996461 - DNA, 22 bp, Homo sapiens
agctgagcacattcaaacaggt

SEQ ID NO: 8996462 - DNA, 22 bp, Homo sapiens
agctgagcacattcaaacaggt

SEQ ID NO: 8996463 - DNA, 22 bp, Homo sapiens
acagcagccttgttggtttcga

SEQ ID NO: 8996464 - DNA, 21 bp, Homo sapiens
agctgaggtaaggcaagagag

SEQ ID NO: 8996465 - DNA, 21 bp, Homo sapiens
agctgaggtaaggcaagagag

SEQ ID NO: 8996466 - DNA, 21 bp, Homo sapiens
agctgaggtaaggcaagagag

SEQ ID NO: 8996467 - DNA, 21 bp, Homo sapiens
agctgaggtaaggcaagagag

SEQ ID NO: 8996468 - DNA, 21 bp, Homo sapiens
agctgaggtaaggcaagagag

SEQ ID NO: 8996469 - DNA, 23 bp, Homo sapiens
agctgaggtgcagatccaaagaa

SEQ ID NO: 8996470 - DNA, 23 bp, Homo sapiens
agctgaggtgcagatccaaagaa

SEQ ID NO: 8996471 - DNA, 23 bp, Homo sapiens
agctgaggtgcagatccaaagaa

SEQ ID NO: 8996472 - DNA, 23 bp, Homo sapiens
agctgaggtgcagatccaaagaa

SEQ ID NO: 8996473 - DNA, 22 bp, Homo sapiens
agctgaggttagtataaatgtg

SEQ ID NO: 8996474 - DNA, 22 bp, Homo sapiens
agctgagttaattcatcactta

SEQ ID NO: 8996475 - DNA, 22 bp, Homo sapiens
agctgaggttgaagagtgaacg

SEQ ID NO: 8996476 - DNA, 22 bp, Homo sapiens
agctgaggttgaagagtgaacg

SEQ ID NO: 8996477 - DNA, 22 bp, Homo sapiens
acagcaggcatgaatgacactg

SEQ ID NO: 8996478 - DNA, 22 bp, Homo sapiens
agctgatgccatgtggaacagt

SEQ ID NO: 8996479 - DNA, 22 bp, Homo sapiens
agctgatgtgacaaaacatagg

SEQ ID NO: 8996480 - DNA, 22 bp, Homo sapiens
acagatatatgattgtgtaaat

SEQ ID NO: 8996481 - DNA, 22 bp, Homo sapiens
acagatatttaagagcttttgt

SEQ ID NO: 8996482 - DNA, 22 bp, Homo sapiens
acagatataaactatagtagtg

SEQ ID NO: 8996483 - DNA, 20 bp, Homo sapiens
acagataccctgtgctggtg

SEQ ID NO: 8996484 - DNA, 22 bp, Homo sapiens
acagatacaaatatacaaatac

SEQ ID NO: 8996485 - DNA, 20 bp, Homo sapiens
acagataccagggacatggg

SEQ ID NO: 8996486 - DNA, 22 bp, Homo sapiens
acagatacaaatatacaaatac

SEQ ID NO: 8996487 - DNA, 22 bp, Homo sapiens
acagataatttaattaatgcat

SEQ ID NO: 8996488 - DNA, 22 bp, Homo sapiens
acagatactcagctctatgctt

SEQ ID NO: 8996489 - DNA, 22 bp, Homo sapiens
acagatactataatgtaaagtg

SEQ ID NO: 8996490 - DNA, 22 bp, Homo sapiens
acagatactcagctctatgctt

SEQ ID NO: 8996491 - DNA, 22 bp, Homo sapiens
acagatagcactaagggatctg

SEQ ID NO: 8996492 - DNA, 22 bp, Homo sapiens
acagatatttaagagcttttgt

SEQ ID NO: 8996493 - DNA, 22 bp, Homo sapiens
acagcagaccactactagtagg

SEQ ID NO: 8996494 - DNA, 22 bp, Homo sapiens
acagcagaccactactagtagg

SEQ ID NO: 8996495 - DNA, 22 bp, Homo sapiens
acagcagaccactactagtagg

SEQ ID NO: 8996496 - DNA, 22 bp, Homo sapiens
acagcagaccccagtgccatgg

SEQ ID NO: 8996497 - DNA, 22 bp, Homo sapiens
acagcagaccccagtgccatgg

SEQ ID NO: 8996498 - DNA, 22 bp, Homo sapiens
acagcagagtggagatgagcac

SEQ ID NO: 8996499 - DNA, 22 bp, Homo sapiens
acagcagagtgtgagatagcca

SEQ ID NO: 8996500 - DNA, 22 bp, Homo sapiens
acagcagagtgtgagatagcca

SEQ ID NO: 8996501 - DNA, 22 bp, Homo sapiens
acagcagagtgtgagatagcca

SEQ ID NO: 8996502 - DNA, 22 bp, Homo sapiens
acagcagagtgtgagatagcca

SEQ ID NO: 8996503 - DNA, 20 bp, Homo sapiens
acagcagataccacaactat

SEQ ID NO: 8996504 - DNA, 22 bp, Homo sapiens
acagcagagtgtgagatagcca

SEQ ID NO: 8996505 - DNA, 22 bp, Homo sapiens
acagcagagtgtgagatagcca

SEQ ID NO: 8996506 - DNA, 22 bp, Homo sapiens
acagcagagtgtgagatagcca

SEQ ID NO: 8996507 - DNA, 22 bp, Homo sapiens
acagcagatctggctacaggtt

SEQ ID NO: 8996508 - DNA, 22 bp, Homo sapiens
acagcagatctggctacaggtt

SEQ ID NO: 8996509 - DNA, 22 bp, Homo sapiens
acagcagatctggctacaggtt

SEQ ID NO: 8996510 - DNA, 20 bp, Homo sapiens
acagcagataccacaactat

SEQ ID NO: 8996511 - DNA, 20 bp, Homo sapiens
acagcagataccacaactat

SEQ ID NO: 8996512 - DNA, 22 bp, Homo sapiens
acagcagcataaactgactaag

SEQ ID NO: 8996513 - DNA, 22 bp, Homo sapiens
acagcagcataaactgactaag

SEQ ID NO: 8996514 - DNA, 22 bp, Homo sapiens
acagcagcatcctatttcactc

SEQ ID NO: 8996515 - DNA, 22 bp, Homo sapiens
acagcagccagccactgtgagc

SEQ ID NO: 8996516 - DNA, 22 bp, Homo sapiens
acagcagcactattgacatttt

SEQ ID NO: 8996517 - DNA, 22 bp, Homo sapiens
acagcagccttgttggtttcga

SEQ ID NO: 8996518 - DNA, 22 bp, Homo sapiens
acagcagccttgttggtttcga

SEQ ID NO: 8996519 - DNA, 22 bp, Homo sapiens
acagcagcctgcagccctgtgt

SEQ ID NO: 8996520 - DNA, 22 bp, Homo sapiens
acagcagcctgcagccctgtgt

SEQ ID NO: 8996521 - DNA, 22 bp, Homo sapiens
acagcagcctgcagccctgtgt

SEQ ID NO: 8996522 - DNA, 22 bp, Homo sapiens
acagcagccagccactgtgagc

SEQ ID NO: 8996523 - DNA, 22 bp, Homo sapiens
acagcagattacattctgctat

SEQ ID NO: 8996524 - DNA, 22 bp, Homo sapiens
acagcagatgacaactatttat

SEQ ID NO: 8996525 - DNA, 22 bp, Homo sapiens
acagcagatgacaactatttat

SEQ ID NO: 8996526 - DNA, 22 bp, Homo sapiens
acagcagattacattctgctat

SEQ ID NO: 8996527 - DNA, 22 bp, Homo sapiens
acagcagatctgtggagcttat

SEQ ID NO: 8996528 - DNA, 22 bp, Homo sapiens
acagcagcaatagcagtgacat

SEQ ID NO: 8996529 - DNA, 22 bp, Homo sapiens
acagcagcaatagcagtgacat

SEQ ID NO: 8996530 - DNA, 22 bp, Homo sapiens
acagcagcaatagcagtgacat

SEQ ID NO: 8996531 - DNA, 21 bp, Homo sapiens
acagcagcaatctgtctttcc

SEQ ID NO: 8996532 - DNA, 22 bp, Homo sapiens
acagcagcactattgacatttt

SEQ ID NO: 8996533 - DNA, 22 bp, Homo sapiens
agcgtgaattagttggtacaca

SEQ ID NO: 8996534 - DNA, 22 bp, Homo sapiens
agcgtggactgctgggcaaggt

SEQ ID NO: 8996535 - DNA, 22 bp, Homo sapiens
agcgtgaattagttggtacaca

SEQ ID NO: 8996536 - DNA, 21 bp, Homo sapiens
agcgtcaatatcgtcaacagg

SEQ ID NO: 8996537 - DNA, 22 bp, Homo sapiens
agcggtggtgtcggcagcggct

SEQ ID NO: 8996538 - DNA, 21 bp, Homo sapiens
agcgtcaatatcgtcaacagg

SEQ ID NO: 8996539 - DNA, 22 bp, Homo sapiens
agcgtgaattagttggtacaca

SEQ ID NO: 8996540 - DNA, 22 bp, Homo sapiens
agcgtggactgctgggcaaggt

SEQ ID NO: 8996541 - DNA, 22 bp, Homo sapiens
agcgtggatgtggggcgcggct

SEQ ID NO: 8996542 - DNA, 22 bp, Homo sapiens
agcgtgtgcctcggggtacacg

SEQ ID NO: 8996543 - DNA, 22 bp, Homo sapiens
agcgtgggtccaaggctctggt

SEQ ID NO: 8996544 - DNA, 22 bp, Homo sapiens
agcgtttataagaagccagggc

SEQ ID NO: 8996545 - DNA, 22 bp, Homo sapiens
agcgtgtgtgcgggtcttcttt

SEQ ID NO: 8996546 - DNA, 22 bp, Homo sapiens
agcgtgtggagaactaagcaga

SEQ ID NO: 8996547 - DNA, 22 bp, Homo sapiens
acagataattagcataaatgct

SEQ ID NO: 8996548 - DNA, 22 bp, Homo sapiens
acagataattagcataaatgct

SEQ ID NO: 8996549 - DNA, 22 bp, Homo sapiens
acagataattagcataaatgct

SEQ ID NO: 8996550 - DNA, 22 bp, Homo sapiens
acagataattagcataaatgct

SEQ ID NO: 8996551 - DNA, 22 bp, Homo sapiens
acagataattagcataaatgct

SEQ ID NO: 8996552 - DNA, 22 bp, Homo sapiens
acagataattagcataaatgct

SEQ ID NO: 8996553 - DNA, 22 bp, Homo sapiens
agctaaatgcatttcaagactg

SEQ ID NO: 8996554 - DNA, 22 bp, Homo sapiens
agctaaagagccctacccaaag

SEQ ID NO: 8996555 - DNA, 22 bp, Homo sapiens
agctaaatgtgaaatgtcaacc

SEQ ID NO: 8996556 - DNA, 22 bp, Homo sapiens
agctaaatgttgcttaaaattt

SEQ ID NO: 8996557 - DNA, 22 bp, Homo sapiens
agcgggctcaagtggccagcag

SEQ ID NO: 8996558 - DNA, 22 bp, Homo sapiens
agcgggctcacccggttgttgt

SEQ ID NO: 8996559 - DNA, 19 bp, Homo sapiens
agcggttctcaaagtcagg

SEQ ID NO: 8996560 - DNA, 22 bp, Homo sapiens
agcggtggtgtcggcagcggct

SEQ ID NO: 8996561 - DNA, 20 bp, Homo sapiens
agcggctggcggaggacacg

SEQ ID NO: 8996562 - DNA, 22 bp, Homo sapiens
agcggctgtcggccagccggag

SEQ ID NO: 8996563 - DNA, 22 bp, Homo sapiens
agcggctgtcggccagccggag

SEQ ID NO: 8996564 - DNA, 20 bp, Homo sapiens
agcggctggcggaggacacg

SEQ ID NO: 8996565 - DNA, 22 bp, Homo sapiens
agcgggcagaagtggggtctgc

SEQ ID NO: 8996566 - DNA, 22 bp, Homo sapiens
agcggctgctccgcaggctggc

SEQ ID NO: 8996567 - DNA, 22 bp, Homo sapiens
agcggctgctccgcaggctggc

SEQ ID NO: 8996568 - DNA, 22 bp, Homo sapiens
agcggctgctcttttcagatcc

SEQ ID NO: 8996569 - DNA, 22 bp, Homo sapiens
agcggctggaccagcgttcaag

SEQ ID NO: 8996570 - DNA, 20 bp, Homo sapiens
agcggcagcttcctgcttcg

SEQ ID NO: 8996571 - DNA, 22 bp, Homo sapiens
agcggctgctccgcaggctggc

SEQ ID NO: 8996572 - DNA, 22 bp, Homo sapiens
agcggctgctccgcaggctggc

SEQ ID NO: 8996573 - DNA, 22 bp, Homo sapiens
agccttagggattgaggttgct

SEQ ID NO: 8996574 - DNA, 22 bp, Homo sapiens
agccttcaacctagctagagca

SEQ ID NO: 8996575 - DNA, 22 bp, Homo sapiens
agccttcaacctagctagagca

SEQ ID NO: 8996576 - DNA, 22 bp, Homo sapiens
agccttcactgggaccttggat

SEQ ID NO: 8996577 - DNA, 16 bp, Homo sapiens
agccttaggaacagcc

SEQ ID NO: 8996578 - DNA, 22 bp, Homo sapiens
agccttagatttgggcaagaac

SEQ ID NO: 8996579 - DNA, 22 bp, Homo sapiens
acagaggtcatggagagttctc

SEQ ID NO: 8996580 - DNA, 22 bp, Homo sapiens
acagaggtcatggagagttctc

SEQ ID NO: 8996581 - DNA, 22 bp, Homo sapiens
acagaggctgcgcttgggaacg

SEQ ID NO: 8996582 - DNA, 22 bp, Homo sapiens
acagaggctgcgcttgggaacg

SEQ ID NO: 8996583 - DNA, 22 bp, Homo sapiens
acagaggctgcgcttgggaacg

SEQ ID NO: 8996584 - DNA, 22 bp, Homo sapiens
acagaggctgatcttcaagccc

SEQ ID NO: 8996585 - DNA, 22 bp, Homo sapiens
acagaggcctcgtaggtacaac

SEQ ID NO: 8996586 - DNA, 22 bp, Homo sapiens
acagaggcctcgtaggtacaac

SEQ ID NO: 8996587 - DNA, 23 bp, Homo sapiens
acagaggcttaaatgagtggcag

SEQ ID NO: 8996588 - DNA, 23 bp, Homo sapiens
acagaggcttaaatgagtggcag

SEQ ID NO: 8996589 - DNA, 23 bp, Homo sapiens
acagaggcttaaatgagtggcag

SEQ ID NO: 8996590 - DNA, 23 bp, Homo sapiens
acagaggcttaaatgagtggcag

SEQ ID NO: 8996591 - DNA, 23 bp, Homo sapiens
acagaggcttaaatgagtggcag

SEQ ID NO: 8996592 - DNA, 22 bp, Homo sapiens
acagaggcctcggcctgcccag

SEQ ID NO: 8996593 - DNA, 22 bp, Homo sapiens
acagaggcctcggcctgcccag

SEQ ID NO: 8996594 - DNA, 22 bp, Homo sapiens
acagaggcctcgtaggtacaac

SEQ ID NO: 8996595 - DNA, 22 bp, Homo sapiens
acagaggcctcgtaggtacaac

SEQ ID NO: 8996596 - DNA, 22 bp, Homo sapiens
acagaggcctcgtaggtacaac

SEQ ID NO: 8996597 - DNA, 22 bp, Homo sapiens
acagaggccccgtgggagagcc

SEQ ID NO: 8996598 - DNA, 22 bp, Homo sapiens
acagaggccccgtgggagagcc

SEQ ID NO: 8996599 - DNA, 22 bp, Homo sapiens
acagaggccccgtgggagagcc

SEQ ID NO: 8996600 - DNA, 22 bp, Homo sapiens
acagaggccgcctctctcacgg

SEQ ID NO: 8996601 - DNA, 22 bp, Homo sapiens
acagaggccgcctctctcacgg

SEQ ID NO: 8996602 - DNA, 22 bp, Homo sapiens
acagaggccccgtgggagagcc

SEQ ID NO: 8996603 - DNA, 22 bp, Homo sapiens
acagaggtaggacatgagatat

SEQ ID NO: 8996604 - DNA, 22 bp, Homo sapiens
acagaggtcacctttgtatctt

SEQ ID NO: 8996605 - DNA, 22 bp, Homo sapiens
acagaggtcacctttgtatctt

SEQ ID NO: 8996606 - DNA, 22 bp, Homo sapiens
acagaggtaggacatgagatat

SEQ ID NO: 8996607 - DNA, 22 bp, Homo sapiens
acagaggtaggacatgagatat

SEQ ID NO: 8996608 - DNA, 22 bp, Homo sapiens
acagagggtgtggaggaagacg

SEQ ID NO: 8996609 - DNA, 22 bp, Homo sapiens
acagagggtgtggaggaagacg

SEQ ID NO: 8996610 - DNA, 22 bp, Homo sapiens
acagagggtttctaaggatttg

SEQ ID NO: 8996611 - DNA, 22 bp, Homo sapiens
acagagggtgtggaggaagacg

SEQ ID NO: 8996612 - DNA, 22 bp, Homo sapiens
acagagggggccttggagtgca

SEQ ID NO: 8996613 - DNA, 22 bp, Homo sapiens
acagagggggccttggagtgca

SEQ ID NO: 8996614 - DNA, 22 bp, Homo sapiens
acagagggggccttggagtgca

SEQ ID NO: 8996615 - DNA, 22 bp, Homo sapiens
acagagggggccttggagtgca

SEQ ID NO: 8996616 - DNA, 22 bp, Homo sapiens
acagaggggtcacagcctgaag

SEQ ID NO: 8996617 - DNA, 22 bp, Homo sapiens
acagagggtctgggcacaggac

SEQ ID NO: 8996618 - DNA, 22 bp, Homo sapiens
acagagggtctgggcacaggac

SEQ ID NO: 8996619 - DNA, 22 bp, Homo sapiens
acagagggtctgggcacaggac

SEQ ID NO: 8996620 - DNA, 22 bp, Homo sapiens
acagaattaacatttgatgaat

SEQ ID NO: 8996621 - DNA, 22 bp, Homo sapiens
acagaattaacatttgatgaat

SEQ ID NO: 8996622 - DNA, 22 bp, Homo sapiens
acagagctgtacatgtgccatg

SEQ ID NO: 8996623 - DNA, 22 bp, Homo sapiens
acagagctgtacatgtgccatg

SEQ ID NO: 8996624 - DNA, 17 bp, Homo sapiens
acagaggcaggagtgga

SEQ ID NO: 8996625 - DNA, 17 bp, Homo sapiens
acagaggcaggagtgga

SEQ ID NO: 8996626 - DNA, 22 bp, Homo sapiens
acagaattaacatttgatgaat

SEQ ID NO: 8996627 - DNA, 22 bp, Homo sapiens
acagaattaaagtgtttgtgga

SEQ ID NO: 8996628 - DNA, 22 bp, Homo sapiens
acagaattaaagtgtttgtgga

SEQ ID NO: 8996629 - DNA, 22 bp, Homo sapiens
acagaatgggatttgaatattt

SEQ ID NO: 8996630 - DNA, 22 bp, Homo sapiens
acagaatgggatttgaatattt

SEQ ID NO: 8996631 - DNA, 22 bp, Homo sapiens
acagaatgggatttgaatattt

SEQ ID NO: 8996632 - DNA, 22 bp, Homo sapiens
acagaatgggatttgaatattt

SEQ ID NO: 8996633 - DNA, 22 bp, Homo sapiens
acagaatgggatttgaatattt

SEQ ID NO: 8996634 - DNA, 22 bp, Homo sapiens
acagaatgcgtagtgcatgttg

SEQ ID NO: 8996635 - DNA, 22 bp, Homo sapiens
acagaatgcgtagtgcatgttg

SEQ ID NO: 8996636 - DNA, 22 bp, Homo sapiens
acagaatgggatttgaatattt

SEQ ID NO: 8996637 - DNA, 21 bp, Homo sapiens
acagaggcatacagcttaagg

SEQ ID NO: 8996638 - DNA, 21 bp, Homo sapiens
acagaggcatacagcttaagg

SEQ ID NO: 8996639 - DNA, 22 bp, Homo sapiens
acagaggccatgagctgccacc

SEQ ID NO: 8996640 - DNA, 22 bp, Homo sapiens
acagaggccatgagctgccacc

SEQ ID NO: 8996641 - DNA, 22 bp, Homo sapiens
acagaggccatgagctgccacc

SEQ ID NO: 8996642 - DNA, 17 bp, Homo sapiens
acagaggcaggagtgga

SEQ ID NO: 8996643 - DNA, 17 bp, Homo sapiens
acagaggcaggagtgga

SEQ ID NO: 8996644 - DNA, 17 bp, Homo sapiens
acagaggcaggagtgga

SEQ ID NO: 8996645 - DNA, 22 bp, Homo sapiens
acagaggcagtgtgagatactg

SEQ ID NO: 8996646 - DNA, 22 bp, Homo sapiens
acagaggcagtgtgagatactg

SEQ ID NO: 8996647 - DNA, 22 bp, Homo sapiens
acagaggcagtgtgagatactg

SEQ ID NO: 8996648 - DNA, 22 bp, Homo sapiens
acagaatattggttactgttgc

SEQ ID NO: 8996649 - DNA, 22 bp, Homo sapiens
acagaatattggttactgttgc

SEQ ID NO: 8996650 - DNA, 22 bp, Homo sapiens
acagaatattggttactgttgc

SEQ ID NO: 8996651 - DNA, 22 bp, Homo sapiens
acagaatattggttactgttgc

SEQ ID NO: 8996652 - DNA, 22 bp, Homo sapiens
acagaatattggttactgttgc

SEQ ID NO: 8996653 - DNA, 22 bp, Homo sapiens
acagaatattgtaagtgccact

SEQ ID NO: 8996654 - DNA, 22 bp, Homo sapiens
acagaatattgtaagtgccact

SEQ ID NO: 8996655 - DNA, 22 bp, Homo sapiens
acagaatattgtaagtgccact

SEQ ID NO: 8996656 - DNA, 22 bp, Homo sapiens
acagaatatttggcatgcgtct

SEQ ID NO: 8996657 - DNA, 22 bp, Homo sapiens
acagaatattttatttagatca

SEQ ID NO: 8996658 - DNA, 22 bp, Homo sapiens
acagaatgcattgacgtacgat

SEQ ID NO: 8996659 - DNA, 22 bp, Homo sapiens
acagaatgcagagatgcccaga

SEQ ID NO: 8996660 - DNA, 22 bp, Homo sapiens
acagaatgcagagatgcccaga

SEQ ID NO: 8996661 - DNA, 22 bp, Homo sapiens
acagaatgcgtagtgcatgttg

SEQ ID NO: 8996662 - DNA, 22 bp, Homo sapiens
acagaatgcgtagtgcatgttg

SEQ ID NO: 8996663 - DNA, 22 bp, Homo sapiens
acagaatgcgtagtgcatgttg

SEQ ID NO: 8996664 - DNA, 22 bp, Homo sapiens
acagaatagtagcttaaagtca

SEQ ID NO: 8996665 - DNA, 22 bp, Homo sapiens
acagaatagtagcttaaagtca

SEQ ID NO: 8996666 - DNA, 22 bp, Homo sapiens
acagaataggtacagtcagtca

SEQ ID NO: 8996667 - DNA, 22 bp, Homo sapiens
acagaataggtacagtcagtca

SEQ ID NO: 8996668 - DNA, 22 bp, Homo sapiens
acagaatagagactgcctgctc

SEQ ID NO: 8996669 - DNA, 22 bp, Homo sapiens
acagaatactcataagaagggg

SEQ ID NO: 8996670 - DNA, 22 bp, Homo sapiens
acagaatactcataagaagggg

SEQ ID NO: 8996671 - DNA, 22 bp, Homo sapiens
acagaatagtagcttaaagtca

SEQ ID NO: 8996672 - DNA, 22 bp, Homo sapiens
acagaatagtagcttaaagtca

SEQ ID NO: 8996673 - DNA, 22 bp, Homo sapiens
acagaatagtagcttaaagtca

SEQ ID NO: 8996674 - DNA, 22 bp, Homo sapiens
acagaatagtagcttaaagtca

SEQ ID NO: 8996675 - DNA, 20 bp, Homo sapiens
acagaatatgctggttgtgg

SEQ ID NO: 8996676 - DNA, 20 bp, Homo sapiens
acagaatatgctggttgtgg

SEQ ID NO: 8996677 - DNA, 22 bp, Homo sapiens
acagaatattggttactgttgc

SEQ ID NO: 8996678 - DNA, 22 bp, Homo sapiens
acagaagtggcttcaaagagca

SEQ ID NO: 8996679 - DNA, 22 bp, Homo sapiens
acagaagtggcttcaaagagca

SEQ ID NO: 8996680 - DNA, 22 bp, Homo sapiens
acagaagtggcttcaaagagca

SEQ ID NO: 8996681 - DNA, 22 bp, Homo sapiens
acagaagtgagtggcaagaact

SEQ ID NO: 8996682 - DNA, 22 bp, Homo sapiens
acagaagtgagtggcaagaact

SEQ ID NO: 8996683 - DNA, 22 bp, Homo sapiens
acagaagtgagtggcaagaact

SEQ ID NO: 8996684 - DNA, 22 bp, Homo sapiens
acagaagtgagtggcaagaact

SEQ ID NO: 8996685 - DNA, 22 bp, Homo sapiens
acagaagtgacaatttcttggg

SEQ ID NO: 8996686 - DNA, 21 bp, Homo sapiens
acagaagtggcttggtctcag

SEQ ID NO: 8996687 - DNA, 21 bp, Homo sapiens
acagaagtggcttggtctcag

SEQ ID NO: 8996688 - DNA, 22 bp, Homo sapiens
acagaagtggcttcaaagagca

SEQ ID NO: 8996689 - DNA, 22 bp, Homo sapiens
acagaagtgtctttttcattca

SEQ ID NO: 8996690 - DNA, 22 bp, Homo sapiens
acagaagttggaattagatact

SEQ ID NO: 8996691 - DNA, 22 bp, Homo sapiens
acagaagttggaattagatact

SEQ ID NO: 8996692 - DNA, 22 bp, Homo sapiens
acagaagtgttgaagttttcat

SEQ ID NO: 8996693 - DNA, 22 bp, Homo sapiens
acagaagtgtgtgtgtaggaat

SEQ ID NO: 8996694 - DNA, 22 bp, Homo sapiens
acagaagtgtgtgtgtaggaat

SEQ ID NO: 8996695 - DNA, 22 bp, Homo sapiens
acagaagtgttgaagttttcat

SEQ ID NO: 8996696 - DNA, 22 bp, Homo sapiens
acagaagtgtctttttcattca

SEQ ID NO: 8996697 - DNA, 22 bp, Homo sapiens
acagaagtgtctttttcattca

SEQ ID NO: 8996698 - DNA, 22 bp, Homo sapiens
acagaagtgtctttttcattca

SEQ ID NO: 8996699 - DNA, 22 bp, Homo sapiens
acagaagtgtgtgtgtaggaat

SEQ ID NO: 8996700 - DNA, 22 bp, Homo sapiens
acagaataaggtttatctctcc

SEQ ID NO: 8996701 - DNA, 23 bp, Homo sapiens
acagaataccattgactaggtgt

SEQ ID NO: 8996702 - DNA, 23 bp, Homo sapiens
acagaataccattgactaggtgt

SEQ ID NO: 8996703 - DNA, 22 bp, Homo sapiens
acagaatactcataagaagggg

SEQ ID NO: 8996704 - DNA, 22 bp, Homo sapiens
acagaatactacagactggtta

SEQ ID NO: 8996705 - DNA, 22 bp, Homo sapiens
acagaatactacagactggtta

SEQ ID NO: 8996706 - DNA, 22 bp, Homo sapiens
acagaagtttcaagtaagaagt

SEQ ID NO: 8996707 - DNA, 22 bp, Homo sapiens
acagaagtttcaagtaagaagt

SEQ ID NO: 8996708 - DNA, 22 bp, Homo sapiens
acagaagtttcaagtaagaagt

SEQ ID NO: 8996709 - DNA, 22 bp, Homo sapiens
acagaagtttcaagtaagaagt

SEQ ID NO: 8996710 - DNA, 22 bp, Homo sapiens
acagaagtttcaagtaagaagt

SEQ ID NO: 8996711 - DNA, 22 bp, Homo sapiens
acagaagttggaattagatact

SEQ ID NO: 8996712 - DNA, 22 bp, Homo sapiens
acagaataactcttgcttgagt

SEQ ID NO: 8996713 - DNA, 22 bp, Homo sapiens
acagaataactcttgcttgagt

SEQ ID NO: 8996714 - DNA, 22 bp, Homo sapiens
acagaataactcttgcttgagt

SEQ ID NO: 8996715 - DNA, 21 bp, Homo sapiens
acagaagcggcgagtggcccc

SEQ ID NO: 8996716 - DNA, 19 bp, Homo sapiens
acagaagcatagaaaagga

SEQ ID NO: 8996717 - DNA, 23 bp, Homo sapiens
acagaagccaggagccgctgggc

SEQ ID NO: 8996718 - DNA, 22 bp, Homo sapiens
acagaacttcctgctggagtgg

SEQ ID NO: 8996719 - DNA, 22 bp, Homo sapiens
acagaactttctgatcctgagc

SEQ ID NO: 8996720 - DNA, 22 bp, Homo sapiens
acagaacttccagggaacatac

SEQ ID NO: 8996721 - DNA, 22 bp, Homo sapiens
acagaagtccccatgaagaagc

SEQ ID NO: 8996722 - DNA, 22 bp, Homo sapiens
acagaagtccccatgaagaagc

SEQ ID NO: 8996723 - DNA, 22 bp, Homo sapiens
acagaagtccccatgaagaagc

SEQ ID NO: 8996724 - DNA, 22 bp, Homo sapiens
acagaagtgacaatttcttggg

SEQ ID NO: 8996725 - DNA, 22 bp, Homo sapiens
acagaagtgacaatttcttggg

SEQ ID NO: 8996726 - DNA, 22 bp, Homo sapiens
acagaagtgacaatttcttggg

SEQ ID NO: 8996727 - DNA, 22 bp, Homo sapiens
acagaaggcggggacaaggcgg

SEQ ID NO: 8996728 - DNA, 22 bp, Homo sapiens
acagaagctcaagagagcagtg

SEQ ID NO: 8996729 - DNA, 22 bp, Homo sapiens
acagaaggacttgagaaagaca

SEQ ID NO: 8996730 - DNA, 22 bp, Homo sapiens
acagaaggacttgagaaagaca

SEQ ID NO: 8996731 - DNA, 22 bp, Homo sapiens
agccagctggtgggtcagctgg

SEQ ID NO: 8996732 - DNA, 22 bp, Homo sapiens
agccagctggtgggtcagctgg

SEQ ID NO: 8996733 - DNA, 22 bp, Homo sapiens
agccagctggtgggtcagctgg

SEQ ID NO: 8996734 - DNA, 22 bp, Homo sapiens
agccagctgtactgcctgctca

SEQ ID NO: 8996735 - DNA, 22 bp, Homo sapiens
agccagctgtactgcctgctca

SEQ ID NO: 8996736 - DNA, 22 bp, Homo sapiens
agccagctgtcctccctttcct

SEQ ID NO: 8996737 - DNA, 22 bp, Homo sapiens
agccagctgtactgcctgctca

SEQ ID NO: 8996738 - DNA, 22 bp, Homo sapiens
agccagctgtggctatggctcc

SEQ ID NO: 8996739 - DNA, 22 bp, Homo sapiens
agccagctgtggctatggctcc

SEQ ID NO: 8996740 - DNA, 22 bp, Homo sapiens
agccagctgtcctccctttcct

SEQ ID NO: 8996741 - DNA, 22 bp, Homo sapiens
agccagctgtcctccctttcct

SEQ ID NO: 8996742 - DNA, 22 bp, Homo sapiens
agccagctgttctggggcagca

SEQ ID NO: 8996743 - DNA, 22 bp, Homo sapiens
agccagctgtgtggtcaggcaa

SEQ ID NO: 8996744 - DNA, 22 bp, Homo sapiens
agccagctgtgtggtcaggcaa

SEQ ID NO: 8996745 - DNA, 22 bp, Homo sapiens
agccagctgtgggctcaggcgg

SEQ ID NO: 8996746 - DNA, 22 bp, Homo sapiens
agccagctgtgggctcaggcgg

SEQ ID NO: 8996747 - DNA, 22 bp, Homo sapiens
agccagctttcacaaatgaaga

SEQ ID NO: 8996748 - DNA, 22 bp, Homo sapiens
agccagctttcacaaatgaaga

SEQ ID NO: 8996749 - DNA, 22 bp, Homo sapiens
agccaggaaccagctacagtct

SEQ ID NO: 8996750 - DNA, 22 bp, Homo sapiens
agccagctgttctggggcagca

SEQ ID NO: 8996751 - DNA, 22 bp, Homo sapiens
agccagctgttctggggcagca

SEQ ID NO: 8996752 - DNA, 22 bp, Homo sapiens
agccagcttctttacggtggca

SEQ ID NO: 8996753 - DNA, 22 bp, Homo sapiens
agccaggaagagaggcctcacc

SEQ ID NO: 8996754 - DNA, 22 bp, Homo sapiens
agccaggaagagaggcctcacc

SEQ ID NO: 8996755 - DNA, 22 bp, Homo sapiens
agccaggaagagaggcctcacc

SEQ ID NO: 8996756 - DNA, 22 bp, Homo sapiens
agccaggaagagaggcctcacc

SEQ ID NO: 8996757 - DNA, 22 bp, Homo sapiens
agccagagggaatctttgggga

SEQ ID NO: 8996758 - DNA, 22 bp, Homo sapiens
agccagaggccagcctgcctca

SEQ ID NO: 8996759 - DNA, 22 bp, Homo sapiens
agccagaggccagcctgcctca

SEQ ID NO: 8996760 - DNA, 22 bp, Homo sapiens
agccagaggtcatgagcacagg

SEQ ID NO: 8996761 - DNA, 22 bp, Homo sapiens
agccagaggtcatgagcacagg

SEQ ID NO: 8996762 - DNA, 22 bp, Homo sapiens
agccagaggtcatgagcacagg

SEQ ID NO: 8996763 - DNA, 22 bp, Homo sapiens
agccagaggtcatgagcacagg

SEQ ID NO: 8996764 - DNA, 22 bp, Homo sapiens
agccagaggtcatgagcacagg

SEQ ID NO: 8996765 - DNA, 22 bp, Homo sapiens
agccagctgcctttcacatctg

SEQ ID NO: 8996766 - DNA, 22 bp, Homo sapiens
agccagctgctcgggggaaaca

SEQ ID NO: 8996767 - DNA, 22 bp, Homo sapiens
agccagctggagaccactgttt

SEQ ID NO: 8996768 - DNA, 22 bp, Homo sapiens
agccagctggagaccactgttt

SEQ ID NO: 8996769 - DNA, 22 bp, Homo sapiens
agccagctgctcgggggaaaca

SEQ ID NO: 8996770 - DNA, 22 bp, Homo sapiens
agccagctggtgggtcagctgg

SEQ ID NO: 8996771 - DNA, 22 bp, Homo sapiens
agccagctggagaccactgttt

SEQ ID NO: 8996772 - DNA, 22 bp, Homo sapiens
agccagctggtgggtcagctgg

SEQ ID NO: 8996773 - DNA, 22 bp, Homo sapiens
agccagctggagaccactgttt

SEQ ID NO: 8996774 - DNA, 19 bp, Homo sapiens
agccagagtggcccagggg

SEQ ID NO: 8996775 - DNA, 19 bp, Homo sapiens
agccagagtggcccagggg

SEQ ID NO: 8996776 - DNA, 22 bp, Homo sapiens
agccagaggtcatgagcacagg

SEQ ID NO: 8996777 - DNA, 22 bp, Homo sapiens
agccagaggtcatgagcacagg

SEQ ID NO: 8996778 - DNA, 22 bp, Homo sapiens
agccagctgcctttcacatctg

SEQ ID NO: 8996779 - DNA, 19 bp, Homo sapiens
agccagagtggcccagggg

SEQ ID NO: 8996780 - DNA, 22 bp, Homo sapiens
agccagagattgagatgcaggc

SEQ ID NO: 8996781 - DNA, 22 bp, Homo sapiens
agccagagattgagatgcaggc

SEQ ID NO: 8996782 - DNA, 22 bp, Homo sapiens
agccagagattgagatgcaggc

SEQ ID NO: 8996783 - DNA, 22 bp, Homo sapiens
agccacagtctgatgcctgaga

SEQ ID NO: 8996784 - DNA, 22 bp, Homo sapiens
acacttcaaatggttggaaaat

SEQ ID NO: 8996785 - DNA, 23 bp, Homo sapiens
acacttcacccattgtgatagga

SEQ ID NO: 8996786 - DNA, 22 bp, Homo sapiens
agccacagtctgtagccagctt

SEQ ID NO: 8996787 - DNA, 22 bp, Homo sapiens
agccagagattgagatgcaggc

SEQ ID NO: 8996788 - DNA, 22 bp, Homo sapiens
agccagagattgagatgcaggc

SEQ ID NO: 8996789 - DNA, 22 bp, Homo sapiens
agccagagattgagatgcaggc

SEQ ID NO: 8996790 - DNA, 22 bp, Homo sapiens
agccagagattgagatgcaggc

SEQ ID NO: 8996791 - DNA, 22 bp, Homo sapiens
agccagagattgagatgcaggc

SEQ ID NO: 8996792 - DNA, 22 bp, Homo sapiens
agccagagattgagatgcaggc

SEQ ID NO: 8996793 - DNA, 22 bp, Homo sapiens
agccagaggaacttgatgactg

SEQ ID NO: 8996794 - DNA, 22 bp, Homo sapiens
agccagaggaagcctggccctc

SEQ ID NO: 8996795 - DNA, 22 bp, Homo sapiens
agccagaggaagcctggccctc

SEQ ID NO: 8996796 - DNA, 20 bp, Homo sapiens
acactgttcttcacacattt

SEQ ID NO: 8996797 - DNA, 20 bp, Homo sapiens
acactgttcttcacacattt

SEQ ID NO: 8996798 - DNA, 20 bp, Homo sapiens
acactgttcttcacacattt

SEQ ID NO: 8996799 - DNA, 22 bp, Homo sapiens
acactgttcctgaaattgttat

SEQ ID NO: 8996800 - DNA, 22 bp, Homo sapiens
acactgttctttgcactgagaa

SEQ ID NO: 8996801 - DNA, 22 bp, Homo sapiens
acactgttctttgcactgagaa

SEQ ID NO: 8996802 - DNA, 22 bp, Homo sapiens
acactgttgctggcacagacag

SEQ ID NO: 8996803 - DNA, 22 bp, Homo sapiens
acactgttcctgaaattgttat

SEQ ID NO: 8996804 - DNA, 22 bp, Homo sapiens
acactgttccacactaagaagg

SEQ ID NO: 8996805 - DNA, 22 bp, Homo sapiens
acactgttccacactaagaagg

SEQ ID NO: 8996806 - DNA, 22 bp, Homo sapiens
acactgttccacactaagaagg

SEQ ID NO: 8996807 - DNA, 22 bp, Homo sapiens
acactgttccacactaagaagg

SEQ ID NO: 8996808 - DNA, 22 bp, Homo sapiens
acacttaatcttactgaggatc

SEQ ID NO: 8996809 - DNA, 22 bp, Homo sapiens
acacttatttcttgtctaacca

SEQ ID NO: 8996810 - DNA, 22 bp, Homo sapiens
acacttatacaaagaatgtctg

SEQ ID NO: 8996811 - DNA, 22 bp, Homo sapiens
acacttcaaagggtgacttgat

SEQ ID NO: 8996812 - DNA, 22 bp, Homo sapiens
acacttatttttgtccacttcc

SEQ ID NO: 8996813 - DNA, 22 bp, Homo sapiens
acacttatttttgtccacttcc

SEQ ID NO: 8996814 - DNA, 22 bp, Homo sapiens
acacttatttttgtccacttcc

SEQ ID NO: 8996815 - DNA, 22 bp, Homo sapiens
acacttcaaagggtgacttgat

SEQ ID NO: 8996816 - DNA, 22 bp, Homo sapiens
acactgttgctggcacagacag

SEQ ID NO: 8996817 - DNA, 22 bp, Homo sapiens
acactgttgctggcacagacag

SEQ ID NO: 8996818 - DNA, 22 bp, Homo sapiens
acactgttgctggcacagacag

SEQ ID NO: 8996819 - DNA, 22 bp, Homo sapiens
acactgttctttgcactgagaa

SEQ ID NO: 8996820 - DNA, 22 bp, Homo sapiens
acactgttgcttacagttttgg

SEQ ID NO: 8996821 - DNA, 22 bp, Homo sapiens
acacttaacttctgagaataaa

SEQ ID NO: 8996822 - DNA, 22 bp, Homo sapiens
acacttaagcatgaagtataaa

SEQ ID NO: 8996823 - DNA, 22 bp, Homo sapiens
acacttaagcatgaagtataaa

SEQ ID NO: 8996824 - DNA, 22 bp, Homo sapiens
acaccagtttcttaagaatatt

SEQ ID NO: 8996825 - DNA, 22 bp, Homo sapiens
acaccaggtcccgtctgtacct

SEQ ID NO: 8996826 - DNA, 22 bp, Homo sapiens
acaccagggcctagccagggcg

SEQ ID NO: 8996827 - DNA, 22 bp, Homo sapiens
acaccagggcctagccagggcg

SEQ ID NO: 8996828 - DNA, 22 bp, Homo sapiens
acaccagtcatttattcagtca

SEQ ID NO: 8996829 - DNA, 22 bp, Homo sapiens
acaccagggcctagccagggcg

SEQ ID NO: 8996830 - DNA, 22 bp, Homo sapiens
acaccagggcctagccagggcg

SEQ ID NO: 8996831 - DNA, 22 bp, Homo sapiens
agcaggtgtatcggtcacctac

SEQ ID NO: 8996832 - DNA, 22 bp, Homo sapiens
acaccatggttcccaaactgtg

SEQ ID NO: 8996833 - DNA, 22 bp, Homo sapiens
acaccattcaccatcagtacct

SEQ ID NO: 8996834 - DNA, 22 bp, Homo sapiens
acacccacctctttaggccatg

SEQ ID NO: 8996835 - DNA, 21 bp, Homo sapiens
acacccacttatgcccgcttg

SEQ ID NO: 8996836 - DNA, 22 bp, Homo sapiens
acacccagagcgccagtgccga

SEQ ID NO: 8996837 - DNA, 22 bp, Homo sapiens
acacccagattatgcacacaaa

SEQ ID NO: 8996838 - DNA, 22 bp, Homo sapiens
acacccagagcgccagtgccga

SEQ ID NO: 8996839 - DNA, 22 bp, Homo sapiens
acacccagagcgccagtgccga

SEQ ID NO: 8996840 - DNA, 22 bp, Homo sapiens
acacccagagcgccagtgccga

SEQ ID NO: 8996841 - DNA, 22 bp, Homo sapiens
acacccagagcgccagtgccga

SEQ ID NO: 8996842 - DNA, 22 bp, Homo sapiens
acacccagagcgccagtgccga

SEQ ID NO: 8996843 - DNA, 22 bp, Homo sapiens
agcaggtgtatataaggctgag

SEQ ID NO: 8996844 - DNA, 22 bp, Homo sapiens
agcaggtgtagggctctttgta

SEQ ID NO: 8996845 - DNA, 21 bp, Homo sapiens
agcaggtgtaaaggaggaaat

SEQ ID NO: 8996846 - DNA, 21 bp, Homo sapiens
agcaggtgtaaaggaggaaat

SEQ ID NO: 8996847 - DNA, 21 bp, Homo sapiens
agcaggtgtaaaggaggaaat

SEQ ID NO: 8996848 - DNA, 22 bp, Homo sapiens
agcaggtggtaggcagtcagca

SEQ ID NO: 8996849 - DNA, 22 bp, Homo sapiens
agcaggtggtaggcagtcagca

SEQ ID NO: 8996850 - DNA, 22 bp, Homo sapiens
acacatctccagaagtgggctg

SEQ ID NO: 8996851 - DNA, 22 bp, Homo sapiens
agcaggtgagcacagccaggct

SEQ ID NO: 8996852 - DNA, 22 bp, Homo sapiens
agcaggtggtaggcagtcagca

SEQ ID NO: 8996853 - DNA, 22 bp, Homo sapiens
agcaggtggtaggcagtcagca

SEQ ID NO: 8996854 - DNA, 22 bp, Homo sapiens
agccaaggtcgccccagggcaa

SEQ ID NO: 8996855 - DNA, 22 bp, Homo sapiens
agccaataaatttacaactaga

SEQ ID NO: 8996856 - DNA, 22 bp, Homo sapiens
agccaaggtcgccccagggcaa

SEQ ID NO: 8996857 - DNA, 22 bp, Homo sapiens
agccaagtgtctccgtttactc

SEQ ID NO: 8996858 - DNA, 22 bp, Homo sapiens
agccaatacactgaagatctaa

SEQ ID NO: 8996859 - DNA, 22 bp, Homo sapiens
agccaaggtcgccccagggcaa

SEQ ID NO: 8996860 - DNA, 22 bp, Homo sapiens
agccaaggtcgccccagggcaa

SEQ ID NO: 8996861 - DNA, 22 bp, Homo sapiens
agccaaggtcgccccagggcaa

SEQ ID NO: 8996862 - DNA, 22 bp, Homo sapiens
agccaaggtcgccccagggcaa

SEQ ID NO: 8996863 - DNA, 22 bp, Homo sapiens
agccaaggtcgccccagggcaa

SEQ ID NO: 8996864 - DNA, 22 bp, Homo sapiens
agccaaggtatcatgagaggca

SEQ ID NO: 8996865 - DNA, 22 bp, Homo sapiens
agccaatcatcctcagactctc

SEQ ID NO: 8996866 - DNA, 22 bp, Homo sapiens
agccaatagcattatacagtga

SEQ ID NO: 8996867 - DNA, 22 bp, Homo sapiens
agccaatctacaacaaaggata

SEQ ID NO: 8996868 - DNA, 22 bp, Homo sapiens
agccaagggtcagctgcacaga

SEQ ID NO: 8996869 - DNA, 22 bp, Homo sapiens
agccaaggtatcatgagaggca

SEQ ID NO: 8996870 - DNA, 22 bp, Homo sapiens
agccaagggtcagctgcacaga

SEQ ID NO: 8996871 - DNA, 22 bp, Homo sapiens
agccaagggtcagctgcacaga

SEQ ID NO: 8996872 - DNA, 22 bp, Homo sapiens
agccaaggtatcatgagaggca

SEQ ID NO: 8996873 - DNA, 22 bp, Homo sapiens
agccaaggtatcatgagaggca

SEQ ID NO: 8996874 - DNA, 22 bp, Homo sapiens
agccaaggtatcatgagaggca

SEQ ID NO: 8996875 - DNA, 22 bp, Homo sapiens
agccaaggtatcatgagaggca

SEQ ID NO: 8996876 - DNA, 22 bp, Homo sapiens
agccaaggtatcatgagaggca

SEQ ID NO: 8996877 - DNA, 22 bp, Homo sapiens
agccaaggtatcatgagaggca

SEQ ID NO: 8996878 - DNA, 22 bp, Homo sapiens
agccaaggtatcatgagaggca

SEQ ID NO: 8996879 - DNA, 22 bp, Homo sapiens
agccaaggcagctagagctctg

SEQ ID NO: 8996880 - DNA, 22 bp, Homo sapiens
agccaagggtcagctgcacaga

SEQ ID NO: 8996881 - DNA, 22 bp, Homo sapiens
agccaaggcagctagagctctg

SEQ ID NO: 8996882 - DNA, 22 bp, Homo sapiens
agccaaggcagctagagctctg

SEQ ID NO: 8996883 - DNA, 22 bp, Homo sapiens
agccaaggcagctagagctctg

SEQ ID NO: 8996884 - DNA, 22 bp, Homo sapiens
agccaaggactcagtggtaggc

SEQ ID NO: 8996885 - DNA, 18 bp, Homo sapiens
agccaaggaggaggagga

SEQ ID NO: 8996886 - DNA, 18 bp, Homo sapiens
agccaaggaggaggagga

SEQ ID NO: 8996887 - DNA, 18 bp, Homo sapiens
agccaaggaggaggagga

SEQ ID NO: 8996888 - DNA, 18 bp, Homo sapiens
agccaaggaggaggagga

SEQ ID NO: 8996889 - DNA, 22 bp, Homo sapiens
agccaaggactcagtggtaggc

SEQ ID NO: 8996890 - DNA, 18 bp, Homo sapiens
agccaaggaggaggagga

SEQ ID NO: 8996891 - DNA, 18 bp, Homo sapiens
agccaaggaggaggagga

SEQ ID NO: 8996892 - DNA, 22 bp, Homo sapiens
agccaaggagtgcaggtggctt

SEQ ID NO: 8996893 - DNA, 22 bp, Homo sapiens
agccaaggagtgcaggtggctt

SEQ ID NO: 8996894 - DNA, 18 bp, Homo sapiens
agccaaggaggaggagga

SEQ ID NO: 8996895 - DNA, 22 bp, Homo sapiens
agccaaggagtgcaggtggctt

SEQ ID NO: 8996896 - DNA, 22 bp, Homo sapiens
agccaaggagtgcaggtggctt

SEQ ID NO: 8996897 - DNA, 22 bp, Homo sapiens
agccaaggagtgcaggtggctt

SEQ ID NO: 8996898 - DNA, 22 bp, Homo sapiens
agccaaggagtgcaggtggctt

SEQ ID NO: 8996899 - DNA, 22 bp, Homo sapiens
agccaaggagtgcaggtggctt

SEQ ID NO: 8996900 - DNA, 22 bp, Homo sapiens
agccaaggagtgcaggtggctt

SEQ ID NO: 8996901 - DNA, 22 bp, Homo sapiens
agccaaggagtgcaggtggctt

SEQ ID NO: 8996902 - DNA, 22 bp, Homo sapiens
agccaaggagtgcaggtggctt

SEQ ID NO: 8996903 - DNA, 22 bp, Homo sapiens
agccaaggagtgcaggtggctt

SEQ ID NO: 8996904 - DNA, 22 bp, Homo sapiens
agccaaggagtgcaggtggctt

SEQ ID NO: 8996905 - DNA, 22 bp, Homo sapiens
agccaaggcagctagagctctg

SEQ ID NO: 8996906 - DNA, 22 bp, Homo sapiens
agccaaggcagctagagctctg

SEQ ID NO: 8996907 - DNA, 22 bp, Homo sapiens
agccaaggactcagtggtaggc

SEQ ID NO: 8996908 - DNA, 22 bp, Homo sapiens
agccaaggacacggagcctcct

SEQ ID NO: 8996909 - DNA, 22 bp, Homo sapiens
acacccagcttttgaatgccct

SEQ ID NO: 8996910 - DNA, 22 bp, Homo sapiens
acacccagcttttgaatgccct

SEQ ID NO: 8996911 - DNA, 22 bp, Homo sapiens
acacccagcttttgaatgccct

SEQ ID NO: 8996912 - DNA, 22 bp, Homo sapiens
acacccagctgggccacctcca

SEQ ID NO: 8996913 - DNA, 22 bp, Homo sapiens
acacccagcttttgaatgccct

SEQ ID NO: 8996914 - DNA, 22 bp, Homo sapiens
acacccagctgggccacctcca

SEQ ID NO: 8996915 - DNA, 22 bp, Homo sapiens
acacccagctgggccacctcca

SEQ ID NO: 8996916 - DNA, 19 bp, Homo sapiens
acacaatgacacatatata

SEQ ID NO: 8996917 - DNA, 19 bp, Homo sapiens
acacaatgacacatatata

SEQ ID NO: 8996918 - DNA, 19 bp, Homo sapiens
acacaatgacacatatata

SEQ ID NO: 8996919 - DNA, 19 bp, Homo sapiens
acacaatgacacatatata

SEQ ID NO: 8996920 - DNA, 22 bp, Homo sapiens
acacaatgcatatttttccaga

SEQ ID NO: 8996921 - DNA, 22 bp, Homo sapiens
acacaatgattcacaagcagca

SEQ ID NO: 8996922 - DNA, 22 bp, Homo sapiens
acacaatgtcatcataatgtca

SEQ ID NO: 8996923 - DNA, 22 bp, Homo sapiens
acacaatgtcatcataatgtca

SEQ ID NO: 8996924 - DNA, 22 bp, Homo sapiens
acacacaaatctattagtgaat

SEQ ID NO: 8996925 - DNA, 22 bp, Homo sapiens
acacacaactcattgtgtaata

SEQ ID NO: 8996926 - DNA, 22 bp, Homo sapiens
acacacaactcattgtgtaata

SEQ ID NO: 8996927 - DNA, 22 bp, Homo sapiens
acacaatttcctgtccatatgt

SEQ ID NO: 8996928 - DNA, 22 bp, Homo sapiens
acacaatttcctgtccatatgt

SEQ ID NO: 8996929 - DNA, 22 bp, Homo sapiens
acacaatttcctgtccatatgt

SEQ ID NO: 8996930 - DNA, 22 bp, Homo sapiens
acacacaaatctattagtgaat

SEQ ID NO: 8996931 - DNA, 22 bp, Homo sapiens
acacacaactcattgtgtaata

SEQ ID NO: 8996932 - DNA, 22 bp, Homo sapiens
acacacaactcattgtgtaata

SEQ ID NO: 8996933 - DNA, 22 bp, Homo sapiens
acacacaactcattgtgtaata

SEQ ID NO: 8996934 - DNA, 22 bp, Homo sapiens
acacacaactcattgtgtaata

SEQ ID NO: 8996935 - DNA, 22 bp, Homo sapiens
acacacaattagttttatgctt

SEQ ID NO: 8996936 - DNA, 23 bp, Homo sapiens
acacaagggtaactgccagccat

SEQ ID NO: 8996937 - DNA, 22 bp, Homo sapiens
acacaagtccctccatactctc

SEQ ID NO: 8996938 - DNA, 22 bp, Homo sapiens
acacaagtgaatattttaagga

SEQ ID NO: 8996939 - DNA, 22 bp, Homo sapiens
acacaatacagggctcaaaata

SEQ ID NO: 8996940 - DNA, 22 bp, Homo sapiens
acacaatacagggctcaaaata

SEQ ID NO: 8996941 - DNA, 22 bp, Homo sapiens
acacaataaatttatcctttga

SEQ ID NO: 8996942 - DNA, 22 bp, Homo sapiens
acacaataaatttatcctttga

SEQ ID NO: 8996943 - DNA, 22 bp, Homo sapiens
acacaataaatttatcctttga

SEQ ID NO: 8996944 - DNA, 22 bp, Homo sapiens
acacaatacagggctcaaaata

SEQ ID NO: 8996945 - DNA, 22 bp, Homo sapiens
acacaatacagggctcaaaata

SEQ ID NO: 8996946 - DNA, 22 bp, Homo sapiens
acacaatacagggctcaaaata

SEQ ID NO: 8996947 - DNA, 23 bp, Homo sapiens
acacaatagagtactattcagcc

SEQ ID NO: 8996948 - DNA, 22 bp, Homo sapiens
acacaatacagggctcaaaata

SEQ ID NO: 8996949 - DNA, 19 bp, Homo sapiens
acacaatgacacatatata

SEQ ID NO: 8996950 - DNA, 23 bp, Homo sapiens
acacaatagagtactattcagcc

SEQ ID NO: 8996951 - DNA, 23 bp, Homo sapiens
acacaatagagtactattcagcc

SEQ ID NO: 8996952 - DNA, 21 bp, Homo sapiens
acacaagcactcgtacatacg

SEQ ID NO: 8996953 - DNA, 21 bp, Homo sapiens
acacaagcactcgtacatacg

SEQ ID NO: 8996954 - DNA, 22 bp, Homo sapiens
acacaagggcctatagtgtatt

SEQ ID NO: 8996955 - DNA, 22 bp, Homo sapiens
acacaagggcctatagtgtatt

SEQ ID NO: 8996956 - DNA, 22 bp, Homo sapiens
acacaagggcctatagtgtatt

SEQ ID NO: 8996957 - DNA, 17 bp, Homo sapiens
acacaagcaccttgagg

SEQ ID NO: 8996958 - DNA, 17 bp, Homo sapiens
acacaagcaccttgagg

SEQ ID NO: 8996959 - DNA, 22 bp, Homo sapiens
acacaagattgtgtattgaatt

SEQ ID NO: 8996960 - DNA, 22 bp, Homo sapiens
acacaagattgtgtattgaatt

SEQ ID NO: 8996961 - DNA, 22 bp, Homo sapiens
acacaagattgtgtattgaatt

SEQ ID NO: 8996962 - DNA, 22 bp, Homo sapiens
acacaagattgtgtattgaatt

SEQ ID NO: 8996963 - DNA, 22 bp, Homo sapiens
acacaagattgtgtattgaatt

SEQ ID NO: 8996964 - DNA, 22 bp, Homo sapiens
acacaagattgtgtattgaatt

SEQ ID NO: 8996965 - DNA, 22 bp, Homo sapiens
acacaagaataatgatgaaggt

SEQ ID NO: 8996966 - DNA, 22 bp, Homo sapiens
acacaagaataatgatgaaggt

SEQ ID NO: 8996967 - DNA, 22 bp, Homo sapiens
acacaagaataatgatgaaggt

SEQ ID NO: 8996968 - DNA, 22 bp, Homo sapiens
acacacacaagcaggttgtgga

SEQ ID NO: 8996969 - DNA, 22 bp, Homo sapiens
acacacacaagcaggttgtgga

SEQ ID NO: 8996970 - DNA, 18 bp, Homo sapiens
acacacacacctgtgtat

SEQ ID NO: 8996971 - DNA, 18 bp, Homo sapiens
acacacacacctgtgtat

SEQ ID NO: 8996972 - DNA, 19 bp, Homo sapiens
acacagggctagagttaca

SEQ ID NO: 8996973 - DNA, 19 bp, Homo sapiens
acacagggctagagttaca

SEQ ID NO: 8996974 - DNA, 22 bp, Homo sapiens
acacagtatgaaaagtctagtt

SEQ ID NO: 8996975 - DNA, 22 bp, Homo sapiens
acacagtatgaaaagtctagtt

SEQ ID NO: 8996976 - DNA, 22 bp, Homo sapiens
acacagtatgaaaagtctagtt

SEQ ID NO: 8996977 - DNA, 22 bp, Homo sapiens
acacagtatgaaaagtctagtt

SEQ ID NO: 8996978 - DNA, 22 bp, Homo sapiens
acacagtatcaaatttcatctt

SEQ ID NO: 8996979 - DNA, 19 bp, Homo sapiens
acacagggctagagttaca

SEQ ID NO: 8996980 - DNA, 22 bp, Homo sapiens
acacagtatcaaatttcatctt

SEQ ID NO: 8996981 - DNA, 22 bp, Homo sapiens
acacagtatcaaatttcatctt

SEQ ID NO: 8996982 - DNA, 22 bp, Homo sapiens
acacagtatgcatctagaaatt

SEQ ID NO: 8996983 - DNA, 22 bp, Homo sapiens
acacagtatgcatctagaaatt

SEQ ID NO: 8996984 - DNA, 22 bp, Homo sapiens
acacagtatgcatctagaaatt

SEQ ID NO: 8996985 - DNA, 22 bp, Homo sapiens
acacagtatgcatctagaaatt

SEQ ID NO: 8996986 - DNA, 22 bp, Homo sapiens
acacagtattacaataggtgct

SEQ ID NO: 8996987 - DNA, 22 bp, Homo sapiens
acacagtattacaataggtgct

SEQ ID NO: 8996988 - DNA, 22 bp, Homo sapiens
acacagtattacaataggtgct

SEQ ID NO: 8996989 - DNA, 22 bp, Homo sapiens
acacagtatgacattggcagag

SEQ ID NO: 8996990 - DNA, 22 bp, Homo sapiens
acacagtatgacattggcagag

SEQ ID NO: 8996991 - DNA, 22 bp, Homo sapiens
acacagtatgcatctagaaatt

SEQ ID NO: 8996992 - DNA, 22 bp, Homo sapiens
acacagtgtcttaggtagtgtc

SEQ ID NO: 8996993 - DNA, 22 bp, Homo sapiens
acacagtgtcttaggtagtgtc

SEQ ID NO: 8996994 - DNA, 22 bp, Homo sapiens
acacagtgtcttaggtagtgtc

SEQ ID NO: 8996995 - DNA, 22 bp, Homo sapiens
acacagtgtgtgcagtcggacg

SEQ ID NO: 8996996 - DNA, 22 bp, Homo sapiens
acacagtgtgtgcagtcggacg

SEQ ID NO: 8996997 - DNA, 22 bp, Homo sapiens
acacagtgtcagggcaggggcc

SEQ ID NO: 8996998 - DNA, 22 bp, Homo sapiens
acacagtgtcagggcaggggcc

SEQ ID NO: 8996999 - DNA, 22 bp, Homo sapiens
acacagtgtcagggcaggggcc

SEQ ID NO: 8997000 - DNA, 22 bp, Homo sapiens
acacagtgtcagggcaggggcc

SEQ ID NO: 8997001 - DNA, 22 bp, Homo sapiens
acacagtggtgtttacaaaatt

SEQ ID NO: 8997002 - DNA, 22 bp, Homo sapiens
acacagtggtgtttacaaaatt

SEQ ID NO: 8997003 - DNA, 22 bp, Homo sapiens
acacagtggtgtttacaaaatt

SEQ ID NO: 8997004 - DNA, 22 bp, Homo sapiens
acacagtggtgtttacaaaatt

SEQ ID NO: 8997005 - DNA, 22 bp, Homo sapiens
acacagtggtgtttacaaaatt

SEQ ID NO: 8997006 - DNA, 22 bp, Homo sapiens
acacagtattgtgactataact

SEQ ID NO: 8997007 - DNA, 22 bp, Homo sapiens
acacagtattgtgactataact

SEQ ID NO: 8997008 - DNA, 22 bp, Homo sapiens
acacagtattgtgactataact

SEQ ID NO: 8997009 - DNA, 22 bp, Homo sapiens
acacagtattgtgactataact

SEQ ID NO: 8997010 - DNA, 22 bp, Homo sapiens
acacagtattgtgactataact

SEQ ID NO: 8997011 - DNA, 22 bp, Homo sapiens
acacagtattgtgactataact

SEQ ID NO: 8997012 - DNA, 22 bp, Homo sapiens
acacagtattgtgactataact

SEQ ID NO: 8997013 - DNA, 22 bp, Homo sapiens
acacagtattacaataggtgct

SEQ ID NO: 8997014 - DNA, 22 bp, Homo sapiens
acacagtattacaataggtgct

SEQ ID NO: 8997015 - DNA, 18 bp, Homo sapiens
acacagtggatgcctggt

SEQ ID NO: 8997016 - DNA, 18 bp, Homo sapiens
acacagtggatgcctggt

SEQ ID NO: 8997017 - DNA, 22 bp, Homo sapiens
acacagtggtgagtctggacct

SEQ ID NO: 8997018 - DNA, 22 bp, Homo sapiens
acacagtgccaaattgcagtta

SEQ ID NO: 8997019 - DNA, 20 bp, Homo sapiens
acacagtgacaggaaagaga

SEQ ID NO: 8997020 - DNA, 22 bp, Homo sapiens
acacagtgccaaattgcagtta

SEQ ID NO: 8997021 - DNA, 20 bp, Homo sapiens
acacagtgacaggaaagaga

SEQ ID NO: 8997022 - DNA, 22 bp, Homo sapiens
agcaggcttgttatgtctgaga

SEQ ID NO: 8997023 - DNA, 22 bp, Homo sapiens
agcaggcttgttatgtctgaga

SEQ ID NO: 8997024 - DNA, 22 bp, Homo sapiens
agcaggcttgttatgtctgaga

SEQ ID NO: 8997025 - DNA, 22 bp, Homo sapiens
agcaggcttgttatgtctgaga

SEQ ID NO: 8997026 - DNA, 22 bp, Homo sapiens
agcaggcttgttatgtctgaga

SEQ ID NO: 8997027 - DNA, 22 bp, Homo sapiens
agcaggcttggtccccagcctc

SEQ ID NO: 8997028 - DNA, 22 bp, Homo sapiens
agcaggcttggtccccagcctc

SEQ ID NO: 8997029 - DNA, 22 bp, Homo sapiens
acacagtttttcagacagagat

SEQ ID NO: 8997030 - DNA, 16 bp, Homo sapiens
acacagttttaaggca

SEQ ID NO: 8997031 - DNA, 19 bp, Homo sapiens
agcaggccacagggccagc

SEQ ID NO: 8997032 - DNA, 19 bp, Homo sapiens
agcaggccacagggccagc

SEQ ID NO: 8997033 - DNA, 19 bp, Homo sapiens
agcaggccacagggccagc

SEQ ID NO: 8997034 - DNA, 19 bp, Homo sapiens
agcaggccacagggccagc

SEQ ID NO: 8997035 - DNA, 22 bp, Homo sapiens
agcaggctttcaagagtcttct

SEQ ID NO: 8997036 - DNA, 22 bp, Homo sapiens
agcaggctttcaagagtcttct

SEQ ID NO: 8997037 - DNA, 22 bp, Homo sapiens
agcaggctttcaagagtcttct

SEQ ID NO: 8997038 - DNA, 22 bp, Homo sapiens
agcaggctttccacagaaggag

SEQ ID NO: 8997039 - DNA, 22 bp, Homo sapiens
agcaggctttccacagaaggag

SEQ ID NO: 8997040 - DNA, 21 bp, Homo sapiens
agcaggctttggagtggggct

SEQ ID NO: 8997041 - DNA, 22 bp, Homo sapiens
agcagggaagcctccagaacct

SEQ ID NO: 8997042 - DNA, 22 bp, Homo sapiens
agcagggaagcctccagaacct

SEQ ID NO: 8997043 - DNA, 22 bp, Homo sapiens
agcagggaagcctccagaacct

SEQ ID NO: 8997044 - DNA, 22 bp, Homo sapiens
agcagggaagcctccagaacct

SEQ ID NO: 8997045 - DNA, 22 bp, Homo sapiens
agcaggctttccacagaaggag

SEQ ID NO: 8997046 - DNA, 22 bp, Homo sapiens
agcaggctttccacagaaggag

SEQ ID NO: 8997047 - DNA, 21 bp, Homo sapiens
agcaggctttggagtggggct

SEQ ID NO: 8997048 - DNA, 22 bp, Homo sapiens
acacagttctcttcttgtaact

SEQ ID NO: 8997049 - DNA, 22 bp, Homo sapiens
acacagttcttagcaggtgtct

SEQ ID NO: 8997050 - DNA, 22 bp, Homo sapiens
acacagttcttagcaggtgtct

SEQ ID NO: 8997051 - DNA, 22 bp, Homo sapiens
acacagttctttcactgttggt

SEQ ID NO: 8997052 - DNA, 22 bp, Homo sapiens
acacagttctttcactgttggt

SEQ ID NO: 8997053 - DNA, 22 bp, Homo sapiens
acacagttcgttgttttctact

SEQ ID NO: 8997054 - DNA, 22 bp, Homo sapiens
acacagttcaggatcaaatagc

SEQ ID NO: 8997055 - DNA, 22 bp, Homo sapiens
acacagttcaggatcaaatagc

SEQ ID NO: 8997056 - DNA, 22 bp, Homo sapiens
acacagttcaggatcaaatagc

SEQ ID NO: 8997057 - DNA, 22 bp, Homo sapiens
acacagttcaggatcaaatagc

SEQ ID NO: 8997058 - DNA, 22 bp, Homo sapiens
acacagttcgtgcttttctatt

SEQ ID NO: 8997059 - DNA, 22 bp, Homo sapiens
acacagtttaaacgattagtac

SEQ ID NO: 8997060 - DNA, 22 bp, Homo sapiens
acacagttggtggctcagtctg

SEQ ID NO: 8997061 - DNA, 22 bp, Homo sapiens
acacagtttatggtattctgtt

SEQ ID NO: 8997062 - DNA, 22 bp, Homo sapiens
acacagtttatggtattctgtt

SEQ ID NO: 8997063 - DNA, 22 bp, Homo sapiens
acacagtttatggtattctgtt

SEQ ID NO: 8997064 - DNA, 22 bp, Homo sapiens
acacagttgattgtcactcagg

SEQ ID NO: 8997065 - DNA, 22 bp, Homo sapiens
acacagttggtggctcagtctg

SEQ ID NO: 8997066 - DNA, 22 bp, Homo sapiens
acacagttgattgtcactcagg

SEQ ID NO: 8997067 - DNA, 22 bp, Homo sapiens
acacagttctttcactgttggt

SEQ ID NO: 8997068 - DNA, 22 bp, Homo sapiens
acacagttgattgtcactcagg

SEQ ID NO: 8997069 - DNA, 22 bp, Homo sapiens
acacatctatattgcatctgca

SEQ ID NO: 8997070 - DNA, 22 bp, Homo sapiens
acacatcctgaccaagttcagg

SEQ ID NO: 8997071 - DNA, 22 bp, Homo sapiens
acacatctatctctacacaagg

SEQ ID NO: 8997072 - DNA, 22 bp, Homo sapiens
acacatcatgccaagtttcacc

SEQ ID NO: 8997073 - DNA, 22 bp, Homo sapiens
acacatctcaggggacactctc

SEQ ID NO: 8997074 - DNA, 22 bp, Homo sapiens
agcaggtgagcacagccaggct

SEQ ID NO: 8997075 - DNA, 22 bp, Homo sapiens
acacatctatctctacacaagg

SEQ ID NO: 8997076 - DNA, 22 bp, Homo sapiens
acacatctcaggggacactctc

SEQ ID NO: 8997077 - DNA, 22 bp, Homo sapiens
acacatctatctctacacaagg

SEQ ID NO: 8997078 - DNA, 22 bp, Homo sapiens
acacatatgtcattgaaaaatc

SEQ ID NO: 8997079 - DNA, 22 bp, Homo sapiens
acacatatgtggcaactgtaga

SEQ ID NO: 8997080 - DNA, 22 bp, Homo sapiens
acacatatgtggcaactgtaga

SEQ ID NO: 8997081 - DNA, 22 bp, Homo sapiens
acacatatgtggcaactgtaga

SEQ ID NO: 8997082 - DNA, 22 bp, Homo sapiens
acacatatgtggcaactgtaga

SEQ ID NO: 8997083 - DNA, 22 bp, Homo sapiens
acacatcagaaatatgaatgag

SEQ ID NO: 8997084 - DNA, 22 bp, Homo sapiens
acacatcagaaatatgaatgag

SEQ ID NO: 8997085 - DNA, 22 bp, Homo sapiens
acacatcagaaatatgaatgag

SEQ ID NO: 8997086 - DNA, 22 bp, Homo sapiens
acacatcagcctcagctttggg

SEQ ID NO: 8997087 - DNA, 22 bp, Homo sapiens
acacatcagcctcagctttggg

SEQ ID NO: 8997088 - DNA, 22 bp, Homo sapiens
agcagggaatagcggaaagaat

SEQ ID NO: 8997089 - DNA, 22 bp, Homo sapiens
agcagggaatagcggaaagaat

SEQ ID NO: 8997090 - DNA, 22 bp, Homo sapiens
agcagggaagcctccagaacct

SEQ ID NO: 8997091 - DNA, 22 bp, Homo sapiens
agcagggaatagcggaaagaat

SEQ ID NO: 8997092 - DNA, 22 bp, Homo sapiens
agcagggacatggcatctctcc

SEQ ID NO: 8997093 - DNA, 22 bp, Homo sapiens
agcagggacatggcatctctcc

SEQ ID NO: 8997094 - DNA, 22 bp, Homo sapiens
agcagggactacgtgaaagtga

SEQ ID NO: 8997095 - DNA, 22 bp, Homo sapiens
agcagggactacgtgaaagtga

SEQ ID NO: 8997096 - DNA, 19 bp, Homo sapiens
agcagggacatggaacttt

SEQ ID NO: 8997097 - DNA, 22 bp, Homo sapiens
agcagggacatggcatctctcc

SEQ ID NO: 8997098 - DNA, 19 bp, Homo sapiens
agcagggacatggaacttt

SEQ ID NO: 8997099 - DNA, 19 bp, Homo sapiens
agcagggacatggaacttt

SEQ ID NO: 8997100 - DNA, 19 bp, Homo sapiens
agcagggacatggaacttt

SEQ ID NO: 8997101 - DNA, 22 bp, Homo sapiens
agcagggactgagccagtggga

SEQ ID NO: 8997102 - DNA, 22 bp, Homo sapiens
agcagggactgagccagtggga

SEQ ID NO: 8997103 - DNA, 22 bp, Homo sapiens
agcagggactgagccagtggga

SEQ ID NO: 8997104 - DNA, 22 bp, Homo sapiens
agcagggactgagccagtggga

SEQ ID NO: 8997105 - DNA, 22 bp, Homo sapiens
agcagggactacgtgaaagtga

SEQ ID NO: 8997106 - DNA, 22 bp, Homo sapiens
agcagggactgagccagtggga

SEQ ID NO: 8997107 - DNA, 22 bp, Homo sapiens
agcagggactgagccagtggga

SEQ ID NO: 8997108 - DNA, 22 bp, Homo sapiens
agcagggactgagccagtggga

SEQ ID NO: 8997109 - DNA, 22 bp, Homo sapiens
agcagggactgagccagtggga

SEQ ID NO: 8997110 - DNA, 22 bp, Homo sapiens
agcagggactgagccagtggga

SEQ ID NO: 8997111 - DNA, 22 bp, Homo sapiens
agcagggactgagccagtggga

SEQ ID NO: 8997112 - DNA, 22 bp, Homo sapiens
agcagggactgagccagtggga

SEQ ID NO: 8997113 - DNA, 22 bp, Homo sapiens
acacatatgtcattgaaaaatc

SEQ ID NO: 8997114 - DNA, 22 bp, Homo sapiens
agcagggagaccatctcttcct

SEQ ID NO: 8997115 - DNA, 22 bp, Homo sapiens
acacatatgtcattgaaaaatc

SEQ ID NO: 8997116 - DNA, 22 bp, Homo sapiens
agaggaagtaatcaggacctgc

SEQ ID NO: 8997117 - DNA, 22 bp, Homo sapiens
agaggaagtaatcaggacctgc

SEQ ID NO: 8997118 - DNA, 22 bp, Homo sapiens
agaggaagtaatcaggacctgc

SEQ ID NO: 8997119 - DNA, 22 bp, Homo sapiens
agaggaagtaatcaggacctgc

SEQ ID NO: 8997120 - DNA, 22 bp, Homo sapiens
agaggaagtaatcaggacctgc

SEQ ID NO: 8997121 - DNA, 22 bp, Homo sapiens
agaggaagtaatcaggacctgc

SEQ ID NO: 8997122 - DNA, 22 bp, Homo sapiens
agaggaagtaatcaggacctgc

SEQ ID NO: 8997123 - DNA, 22 bp, Homo sapiens
agaggaagtaatcaggacctgc

SEQ ID NO: 8997124 - DNA, 22 bp, Homo sapiens
agaggaagtaatcaggacctgc

SEQ ID NO: 8997125 - DNA, 22 bp, Homo sapiens
agaggaagtaatcaggacctgc

SEQ ID NO: 8997126 - DNA, 22 bp, Homo sapiens
agaggaagtaatcaggacctgc

SEQ ID NO: 8997127 - DNA, 22 bp, Homo sapiens
agaggaagtaatcaggacctgc

SEQ ID NO: 8997128 - DNA, 21 bp, Homo sapiens
agaggaagtgattggtctggc

SEQ ID NO: 8997129 - DNA, 21 bp, Homo sapiens
agaggaagtgattggtctggc

SEQ ID NO: 8997130 - DNA, 22 bp, Homo sapiens
agaggaataaatttctgtagtg

SEQ ID NO: 8997131 - DNA, 22 bp, Homo sapiens
agaggaatatgggtgcactaga

SEQ ID NO: 8997132 - DNA, 22 bp, Homo sapiens
agaggaatctgtctagacacaa

SEQ ID NO: 8997133 - DNA, 22 bp, Homo sapiens
agaggaatctgtctagacacaa

SEQ ID NO: 8997134 - DNA, 22 bp, Homo sapiens
agaggaatttctggaaggaggc

SEQ ID NO: 8997135 - DNA, 22 bp, Homo sapiens
aattccaacagacaaagttaga

SEQ ID NO: 8997136 - DNA, 22 bp, Homo sapiens
aattccaacagacaaagttaga

SEQ ID NO: 8997137 - DNA, 22 bp, Homo sapiens
aattccaagagcttcctaagtg

SEQ ID NO: 8997138 - DNA, 22 bp, Homo sapiens
aattccaagagcttcctaagtg

SEQ ID NO: 8997139 - DNA, 22 bp, Homo sapiens
aattccaagtagcatcccatca

SEQ ID NO: 8997140 - DNA, 22 bp, Homo sapiens
aattccacagatgtctatctgt

SEQ ID NO: 8997141 - DNA, 22 bp, Homo sapiens
aattccacagctgcacagaggt

SEQ ID NO: 8997142 - DNA, 20 bp, Homo sapiens
aattccagcatgatatttat

SEQ ID NO: 8997143 - DNA, 22 bp, Homo sapiens
aattccagaggaggacagtcct

SEQ ID NO: 8997144 - DNA, 22 bp, Homo sapiens
aattccagaccacaagtgattt

SEQ ID NO: 8997145 - DNA, 22 bp, Homo sapiens
agaggaaggatgcatatccaaa

SEQ ID NO: 8997146 - DNA, 22 bp, Homo sapiens
agaggaaggatgcatatccaaa

SEQ ID NO: 8997147 - DNA, 22 bp, Homo sapiens
agaggaaggatgcatatccaaa

SEQ ID NO: 8997148 - DNA, 22 bp, Homo sapiens
agaggaagtaatcaggacctgc

SEQ ID NO: 8997149 - DNA, 22 bp, Homo sapiens
agagctgggtggtggtgactca

SEQ ID NO: 8997150 - DNA, 22 bp, Homo sapiens
agagctgggtggtggtgactca

SEQ ID NO: 8997151 - DNA, 22 bp, Homo sapiens
agagctgggtggtggtgactca

SEQ ID NO: 8997152 - DNA, 22 bp, Homo sapiens
agagctgggtggtggtgactca

SEQ ID NO: 8997153 - DNA, 22 bp, Homo sapiens
aatttcaattacttttgcacca

SEQ ID NO: 8997154 - DNA, 22 bp, Homo sapiens
aatttcacagtgaactttgagg

SEQ ID NO: 8997155 - DNA, 22 bp, Homo sapiens
aatttcctgggataaaaagcca

SEQ ID NO: 8997156 - DNA, 22 bp, Homo sapiens
aatttcctgggataaaaagcca

SEQ ID NO: 8997157 - DNA, 18 bp, Homo sapiens
aatttccatatgaattgc

SEQ ID NO: 8997158 - DNA, 22 bp, Homo sapiens
agaggattttaacttatgcaac

SEQ ID NO: 8997159 - DNA, 22 bp, Homo sapiens
agaggattttaacttatgcaac

SEQ ID NO: 8997160 - DNA, 22 bp, Homo sapiens
agaggattttaaaagcatatgt

SEQ ID NO: 8997161 - DNA, 22 bp, Homo sapiens
agaggattttaaaagcatatgt

SEQ ID NO: 8997162 - DNA, 22 bp, Homo sapiens
agaggattgttactgattagct

SEQ ID NO: 8997163 - DNA, 22 bp, Homo sapiens
aatttcaatgcactcatggttg

SEQ ID NO: 8997164 - DNA, 22 bp, Homo sapiens
agaggattcttagaattctgag

SEQ ID NO: 8997165 - DNA, 22 bp, Homo sapiens
agaggattgaaggatttgttga

SEQ ID NO: 8997166 - DNA, 22 bp, Homo sapiens
agaggattgaaggatttgttga

SEQ ID NO: 8997167 - DNA, 22 bp, Homo sapiens
agaggattgttactgattagct

SEQ ID NO: 8997168 - DNA, 22 bp, Homo sapiens
agaggattgatcaaacactgca

SEQ ID NO: 8997169 - DNA, 22 bp, Homo sapiens
agaggatgttctaggcactcat

SEQ ID NO: 8997170 - DNA, 22 bp, Homo sapiens
agaggatgttctaggcactcat

SEQ ID NO: 8997171 - DNA, 22 bp, Homo sapiens
agaggattatattttcaacaag

SEQ ID NO: 8997172 - DNA, 22 bp, Homo sapiens
agaggaggtggtgatgctttaa

SEQ ID NO: 8997173 - DNA, 22 bp, Homo sapiens
agaggaggtggtgatgctttaa

SEQ ID NO: 8997174 - DNA, 22 bp, Homo sapiens
agaggaggtggtgatgctttaa

SEQ ID NO: 8997175 - DNA, 22 bp, Homo sapiens
agaggagtgggaagcagtgcaa

SEQ ID NO: 8997176 - DNA, 22 bp, Homo sapiens
agaggatcatctagtttgactc

SEQ ID NO: 8997177 - DNA, 22 bp, Homo sapiens
agaggatcatctagtttgactc

SEQ ID NO: 8997178 - DNA, 22 bp, Homo sapiens
agaggagtgggaagcagtgcaa

SEQ ID NO: 8997179 - DNA, 22 bp, Homo sapiens
agaggatgattttaaggacact

SEQ ID NO: 8997180 - DNA, 22 bp, Homo sapiens
agaggatggttgaggaagacct

SEQ ID NO: 8997181 - DNA, 22 bp, Homo sapiens
agagctgcagggtggacccagg

SEQ ID NO: 8997182 - DNA, 22 bp, Homo sapiens
agagctgcaatttcatgtggtg

SEQ ID NO: 8997183 - DNA, 22 bp, Homo sapiens
agagctgcacctatgcagacct

SEQ ID NO: 8997184 - DNA, 22 bp, Homo sapiens
agagctgcacctatgcagacct

SEQ ID NO: 8997185 - DNA, 22 bp, Homo sapiens
agagctgcacctatgcagacct

SEQ ID NO: 8997186 - DNA, 22 bp, Homo sapiens
agagctgcaatttcatgtggtg

SEQ ID NO: 8997187 - DNA, 22 bp, Homo sapiens
agagctgcaatttcatgtggtg

SEQ ID NO: 8997188 - DNA, 22 bp, Homo sapiens
agagctgccgagctggggccat

SEQ ID NO: 8997189 - DNA, 22 bp, Homo sapiens
agagctgcccacacagcagatt

SEQ ID NO: 8997190 - DNA, 22 bp, Homo sapiens
agagctgcagggtggacccagg

SEQ ID NO: 8997191 - DNA, 22 bp, Homo sapiens
agagctgagaatgtggcttcct

SEQ ID NO: 8997192 - DNA, 22 bp, Homo sapiens
agagctgagcaccaagcatggt

SEQ ID NO: 8997193 - DNA, 22 bp, Homo sapiens
agagctgcaacttcataggcct

SEQ ID NO: 8997194 - DNA, 22 bp, Homo sapiens
agagctgcaatttcatgtggtg

SEQ ID NO: 8997195 - DNA, 22 bp, Homo sapiens
agagctgaggatccagctgagc

SEQ ID NO: 8997196 - DNA, 22 bp, Homo sapiens
agagctgatttgattacagtgc

SEQ ID NO: 8997197 - DNA, 22 bp, Homo sapiens
agagctgaggatccagctgagc

SEQ ID NO: 8997198 - DNA, 22 bp, Homo sapiens
agagctgaggatccagctgagc

SEQ ID NO: 8997199 - DNA, 22 bp, Homo sapiens
agagctgaggatccagctgagc

SEQ ID NO: 8997200 - DNA, 22 bp, Homo sapiens
agagctggaagctgctcttaga

SEQ ID NO: 8997201 - DNA, 22 bp, Homo sapiens
agagctgctcagatgtcactgc

SEQ ID NO: 8997202 - DNA, 22 bp, Homo sapiens
aattcatagcaacaaagaccca

SEQ ID NO: 8997203 - DNA, 22 bp, Homo sapiens
aattcatagcaacaaagaccca

SEQ ID NO: 8997204 - DNA, 22 bp, Homo sapiens
aattcatactctatattgcttt

SEQ ID NO: 8997205 - DNA, 22 bp, Homo sapiens
aattcatactctatattgcttt

SEQ ID NO: 8997206 - DNA, 22 bp, Homo sapiens
aattcatatggatatgctagta

SEQ ID NO: 8997207 - DNA, 22 bp, Homo sapiens
aattcatatggatatgctagta

SEQ ID NO: 8997208 - DNA, 22 bp, Homo sapiens
aattcatatggatatgctagta

SEQ ID NO: 8997209 - DNA, 22 bp, Homo sapiens
aattcatagcaacaaagaccca

SEQ ID NO: 8997210 - DNA, 22 bp, Homo sapiens
aattcatatggatatgctagta

SEQ ID NO: 8997211 - DNA, 22 bp, Homo sapiens
aattcattgccagaatctatga

SEQ ID NO: 8997212 - DNA, 22 bp, Homo sapiens
aattcattaagaaagagctaaa

SEQ ID NO: 8997213 - DNA, 22 bp, Homo sapiens
aattcatgagtagaatctatat

SEQ ID NO: 8997214 - DNA, 22 bp, Homo sapiens
aattcatccatgaacaattcca

SEQ ID NO: 8997215 - DNA, 22 bp, Homo sapiens
aattcatcattttatagctagt

SEQ ID NO: 8997216 - DNA, 22 bp, Homo sapiens
aattcatccatgaacaattcca

SEQ ID NO: 8997217 - DNA, 22 bp, Homo sapiens
aattcatcattttatagctagt

SEQ ID NO: 8997218 - DNA, 22 bp, Homo sapiens
aattccaaatcaactagtctag

SEQ ID NO: 8997219 - DNA, 22 bp, Homo sapiens
aattccaaatcaactagtctag

SEQ ID NO: 8997220 - DNA, 22 bp, Homo sapiens
aattcattgccagaatctatga

SEQ ID NO: 8997221 - DNA, 21 bp, Homo sapiens
aattacagatggaattacaga

SEQ ID NO: 8997222 - DNA, 22 bp, Homo sapiens
agagcctggctcccagctaccg

SEQ ID NO: 8997223 - DNA, 22 bp, Homo sapiens
agagcctggctcccagctaccg

SEQ ID NO: 8997224 - DNA, 22 bp, Homo sapiens
agagcctggctcccagctaccg

SEQ ID NO: 8997225 - DNA, 22 bp, Homo sapiens
agagctgaattcaagtgctggc

SEQ ID NO: 8997226 - DNA, 22 bp, Homo sapiens
agagctgaattcaagtgctggc

SEQ ID NO: 8997227 - DNA, 23 bp, Homo sapiens
aattacaaccaagaactggaagg

SEQ ID NO: 8997228 - DNA, 23 bp, Homo sapiens
aattacaaccaagaactggaagg

SEQ ID NO: 8997229 - DNA, 23 bp, Homo sapiens
aattacaaccaagaactggaagg

SEQ ID NO: 8997230 - DNA, 23 bp, Homo sapiens
aattacaaccaagaactggaagg

SEQ ID NO: 8997231 - DNA, 23 bp, Homo sapiens
aattacaaccaagaactggaagg

SEQ ID NO: 8997232 - DNA, 21 bp, Homo sapiens
aattacagatggaattacaga

SEQ ID NO: 8997233 - DNA, 22 bp, Homo sapiens
aattacaaatgtagactctcat

SEQ ID NO: 8997234 - DNA, 22 bp, Homo sapiens
aattacaaatgtagactctcat

SEQ ID NO: 8997235 - DNA, 22 bp, Homo sapiens
aattaattttgttcattcagtc

SEQ ID NO: 8997236 - DNA, 22 bp, Homo sapiens
aattaattttgttcattcagtc

SEQ ID NO: 8997237 - DNA, 22 bp, Homo sapiens
aattaattttgttcattcagtc

SEQ ID NO: 8997238 - DNA, 22 bp, Homo sapiens
aattaatggaaagtaaggaagg

SEQ ID NO: 8997239 - DNA, 22 bp, Homo sapiens
aattaatggaaagtaaggaagg

SEQ ID NO: 8997240 - DNA, 22 bp, Homo sapiens
aattaattcagtttttaaggga

SEQ ID NO: 8997241 - DNA, 22 bp, Homo sapiens
aattaattcagtttttaaggga

SEQ ID NO: 8997242 - DNA, 22 bp, Homo sapiens
aattaatatttgtggaattaat

SEQ ID NO: 8997243 - DNA, 22 bp, Homo sapiens
aattaatatttgtggaattaat

SEQ ID NO: 8997244 - DNA, 22 bp, Homo sapiens
aattaagtcacacacctaaacc

SEQ ID NO: 8997245 - DNA, 22 bp, Homo sapiens
aattaatatttgtggaattaat

SEQ ID NO: 8997246 - DNA, 22 bp, Homo sapiens
aattaatatttgtggaattaat

SEQ ID NO: 8997247 - DNA, 22 bp, Homo sapiens
aattaactaatttggtacaaga

SEQ ID NO: 8997248 - DNA, 22 bp, Homo sapiens
aattaactaatttggtacaaga

SEQ ID NO: 8997249 - DNA, 22 bp, Homo sapiens
aattaactaatttggtacaaga

SEQ ID NO: 8997250 - DNA, 22 bp, Homo sapiens
aattaagaaaatgttttatgat

SEQ ID NO: 8997251 - DNA, 22 bp, Homo sapiens
aattaagagagagttgaagcaa

SEQ ID NO: 8997252 - DNA, 22 bp, Homo sapiens
aattaagtcacacacctaaacc

SEQ ID NO: 8997253 - DNA, 22 bp, Homo sapiens
agagcacactgacgtcagtctg

SEQ ID NO: 8997254 - DNA, 22 bp, Homo sapiens
agagcacagaagaataggtgct

SEQ ID NO: 8997255 - DNA, 22 bp, Homo sapiens
agagcacaaattagttggtctt

SEQ ID NO: 8997256 - DNA, 22 bp, Homo sapiens
agagcacaaattagttggtctt

SEQ ID NO: 8997257 - DNA, 22 bp, Homo sapiens
agagcacaaattttaaggaggc

SEQ ID NO: 8997258 - DNA, 22 bp, Homo sapiens
agagcacactgacgtcagtctg

SEQ ID NO: 8997259 - DNA, 22 bp, Homo sapiens
aattaactaaaattcactttat

SEQ ID NO: 8997260 - DNA, 22 bp, Homo sapiens
aattaacagagggcttattact

SEQ ID NO: 8997261 - DNA, 22 bp, Homo sapiens
aattaactaaaattcactttat

SEQ ID NO: 8997262 - DNA, 22 bp, Homo sapiens
aattaacagagggcttattact

SEQ ID NO: 8997263 - DNA, 22 bp, Homo sapiens
aattaacagagggcttattact

SEQ ID NO: 8997264 - DNA, 22 bp, Homo sapiens
agagcacagcagatctctgatg

SEQ ID NO: 8997265 - DNA, 22 bp, Homo sapiens
agagcacagccaccatttacaa

SEQ ID NO: 8997266 - DNA, 22 bp, Homo sapiens
agagcacagcagatctctgatg

SEQ ID NO: 8997267 - DNA, 22 bp, Homo sapiens
agacattggctaaaagtagtgt

SEQ ID NO: 8997268 - DNA, 22 bp, Homo sapiens
agacatttatgtttctctagga

SEQ ID NO: 8997269 - DNA, 22 bp, Homo sapiens
agacatttatgtttctctagga

SEQ ID NO: 8997270 - DNA, 22 bp, Homo sapiens
agacatttattcacacatttat

SEQ ID NO: 8997271 - DNA, 22 bp, Homo sapiens
agacatttattcacacatttat

SEQ ID NO: 8997272 - DNA, 22 bp, Homo sapiens
agacatttattcacacatttat

SEQ ID NO: 8997273 - DNA, 22 bp, Homo sapiens
aatgtataatatttaatgcttt

SEQ ID NO: 8997274 - DNA, 22 bp, Homo sapiens
aatgtataatatttaatgcttt

SEQ ID NO: 8997275 - DNA, 22 bp, Homo sapiens
aatgtataatatttaatgcttt

SEQ ID NO: 8997276 - DNA, 22 bp, Homo sapiens
aatgtataatatttaatgcttt

SEQ ID NO: 8997277 - DNA, 22 bp, Homo sapiens
aatgtataaccataggaaattt

SEQ ID NO: 8997278 - DNA, 22 bp, Homo sapiens
aatgtataaccataggaaattt

SEQ ID NO: 8997279 - DNA, 22 bp, Homo sapiens
aatgtataaccataggaaattt

SEQ ID NO: 8997280 - DNA, 22 bp, Homo sapiens
agacatggagaaggagccagtg

SEQ ID NO: 8997281 - DNA, 22 bp, Homo sapiens
agacatggagaaggagccagtg

SEQ ID NO: 8997282 - DNA, 22 bp, Homo sapiens
agacatggtttattttaatggt

SEQ ID NO: 8997283 - DNA, 22 bp, Homo sapiens
agacattatgctgagtgaaaga

SEQ ID NO: 8997284 - DNA, 22 bp, Homo sapiens
agacattatgctgagtgaaaga

SEQ ID NO: 8997285 - DNA, 22 bp, Homo sapiens
agacattatgctgagtgaaaga

SEQ ID NO: 8997286 - DNA, 22 bp, Homo sapiens
agacatgtggtataatcagggg

SEQ ID NO: 8997287 - DNA, 22 bp, Homo sapiens
agacattatgctgagtgaaaga

SEQ ID NO: 8997288 - DNA, 21 bp, Homo sapiens
agacatgtgaactaaaggtga

SEQ ID NO: 8997289 - DNA, 22 bp, Homo sapiens
aatgtatgagcgtgaaagcact

SEQ ID NO: 8997290 - DNA, 22 bp, Homo sapiens
aatgtatgagcgtgaaagcact

SEQ ID NO: 8997291 - DNA, 22 bp, Homo sapiens
aatgtatgagcgtgaaagcact

SEQ ID NO: 8997292 - DNA, 20 bp, Homo sapiens
aatgtatattttatgccagg

SEQ ID NO: 8997293 - DNA, 20 bp, Homo sapiens
aatgtatattttatgccagg

SEQ ID NO: 8997294 - DNA, 22 bp, Homo sapiens
aatgtataatatttaatgcttt

SEQ ID NO: 8997295 - DNA, 20 bp, Homo sapiens
aatgtatattttatgccagg

SEQ ID NO: 8997296 - DNA, 22 bp, Homo sapiens
aatgtatgggtgagaaagttga

SEQ ID NO: 8997297 - DNA, 22 bp, Homo sapiens
aatgtatgggtgagaaagttga

SEQ ID NO: 8997298 - DNA, 23 bp, Homo sapiens
aatgtatgttagtatcttagaga

SEQ ID NO: 8997299 - DNA, 23 bp, Homo sapiens
aatgtatgttagtatcttagaga

SEQ ID NO: 8997300 - DNA, 22 bp, Homo sapiens
aatgtatgtgtatatcaaatca

SEQ ID NO: 8997301 - DNA, 22 bp, Homo sapiens
aatgtatgtgtatatcaaatca

SEQ ID NO: 8997302 - DNA, 23 bp, Homo sapiens
aatgtatgttagtatcttagaga

SEQ ID NO: 8997303 - DNA, 21 bp, Homo sapiens
aatgtatgtttatctcacagt

SEQ ID NO: 8997304 - DNA, 22 bp, Homo sapiens
aatgtattatacataatttgtg

SEQ ID NO: 8997305 - DNA, 22 bp, Homo sapiens
agacatgcttggaggagaagga

SEQ ID NO: 8997306 - DNA, 22 bp, Homo sapiens
agacatgccaagaaacccagtg

SEQ ID NO: 8997307 - DNA, 22 bp, Homo sapiens
agacatgccaagaaacccagtg

SEQ ID NO: 8997308 - DNA, 19 bp, Homo sapiens
agacatgagacacaggatg

SEQ ID NO: 8997309 - DNA, 22 bp, Homo sapiens
agacatgagaaacccaccagag

SEQ ID NO: 8997310 - DNA, 22 bp, Homo sapiens
agacatgacagatagttgctag

SEQ ID NO: 8997311 - DNA, 22 bp, Homo sapiens
agacatctctatgcaggatctc

SEQ ID NO: 8997312 - DNA, 22 bp, Homo sapiens
agacatctacctttcattcaaa

SEQ ID NO: 8997313 - DNA, 22 bp, Homo sapiens
agacatctcccatgcattttta

SEQ ID NO: 8997314 - DNA, 22 bp, Homo sapiens
agacatcttgcacacatatact

SEQ ID NO: 8997315 - DNA, 22 bp, Homo sapiens
agacatcttgcacacatatact

SEQ ID NO: 8997316 - DNA, 22 bp, Homo sapiens
agacatgaaaattccaaacatc

SEQ ID NO: 8997317 - DNA, 22 bp, Homo sapiens
aatgctgagggatgagagaggc

SEQ ID NO: 8997318 - DNA, 22 bp, Homo sapiens
aatgctgagtcctgtgagtctt

SEQ ID NO: 8997319 - DNA, 22 bp, Homo sapiens
agacatcaatgatcagaggtag

SEQ ID NO: 8997320 - DNA, 22 bp, Homo sapiens
agacatcagcttgtgtgcaggg

SEQ ID NO: 8997321 - DNA, 22 bp, Homo sapiens
agacatcagcttgtgtgcaggg

SEQ ID NO: 8997322 - DNA, 23 bp, Homo sapiens
agacatcaggatggtggctggga

SEQ ID NO: 8997323 - DNA, 22 bp, Homo sapiens
agacatcatgttacagattaag

SEQ ID NO: 8997324 - DNA, 22 bp, Homo sapiens
aatgccttggagagcctagagg

SEQ ID NO: 8997325 - DNA, 22 bp, Homo sapiens
aatgccttgcctgctacaactt

SEQ ID NO: 8997326 - DNA, 22 bp, Homo sapiens
aatgccttgcctgctacaactt

SEQ ID NO: 8997327 - DNA, 22 bp, Homo sapiens
aatgccttgcctgctacaactt

SEQ ID NO: 8997328 - DNA, 22 bp, Homo sapiens
aatgccttggagagcctagagg

SEQ ID NO: 8997329 - DNA, 22 bp, Homo sapiens
aatgccttggagagcctagagg

SEQ ID NO: 8997330 - DNA, 22 bp, Homo sapiens
aatgctaaaatggcactaaagt

SEQ ID NO: 8997331 - DNA, 22 bp, Homo sapiens
aatgctaaatgtgttatgttaa

SEQ ID NO: 8997332 - DNA, 22 bp, Homo sapiens
aatgctaacattggtttatatc

SEQ ID NO: 8997333 - DNA, 22 bp, Homo sapiens
aatgctctctgccatagctaac

SEQ ID NO: 8997334 - DNA, 22 bp, Homo sapiens
aatgctgaatttagtatttatg

SEQ ID NO: 8997335 - DNA, 22 bp, Homo sapiens
aatgctctttgaatttgtcaga

SEQ ID NO: 8997336 - DNA, 22 bp, Homo sapiens
aatgctctgtctctgacagtgg

SEQ ID NO: 8997337 - DNA, 22 bp, Homo sapiens
aatgctctttaacctattctga

SEQ ID NO: 8997338 - DNA, 22 bp, Homo sapiens
aatgctctttgaatttgtcaga

SEQ ID NO: 8997339 - DNA, 22 bp, Homo sapiens
aatgctctttgaatttgtcaga

SEQ ID NO: 8997340 - DNA, 22 bp, Homo sapiens
aatgctcaaaatgtttcatcta

SEQ ID NO: 8997341 - DNA, 22 bp, Homo sapiens
aatgctctctgccatagctaac

SEQ ID NO: 8997342 - DNA, 22 bp, Homo sapiens
aatgctattcattaagcctact

SEQ ID NO: 8997343 - DNA, 22 bp, Homo sapiens
aatgctatcggctctaagcatg

SEQ ID NO: 8997344 - DNA, 22 bp, Homo sapiens
aatgctagtgtgatatgtaagg

SEQ ID NO: 8997345 - DNA, 22 bp, Homo sapiens
aatgctaacattggtttatatc

SEQ ID NO: 8997346 - DNA, 22 bp, Homo sapiens
aatgctaacattggtttatatc

SEQ ID NO: 8997347 - DNA, 21 bp, Homo sapiens
agagaagggactcttccagtc

SEQ ID NO: 8997348 - DNA, 21 bp, Homo sapiens
agagaagggattccaggccct

SEQ ID NO: 8997349 - DNA, 21 bp, Homo sapiens
agagaagggattccaggccct

SEQ ID NO: 8997350 - DNA, 21 bp, Homo sapiens
agagaagggattccaggccct

SEQ ID NO: 8997351 - DNA, 21 bp, Homo sapiens
agagaagggattccaggccct

SEQ ID NO: 8997352 - DNA, 22 bp, Homo sapiens
agagaagggcctgtatgtaatc

SEQ ID NO: 8997353 - DNA, 22 bp, Homo sapiens
agagaagggcctgtatgtaatc

SEQ ID NO: 8997354 - DNA, 21 bp, Homo sapiens
agagaagggactcttccagtc

SEQ ID NO: 8997355 - DNA, 22 bp, Homo sapiens
agagaagggaagggattcaccc

SEQ ID NO: 8997356 - DNA, 22 bp, Homo sapiens
agagaagggaagggattcaccc

SEQ ID NO: 8997357 - DNA, 22 bp, Homo sapiens
agagaaggcatagaacttgagt

SEQ ID NO: 8997358 - DNA, 21 bp, Homo sapiens
agagaagggactcttccagtc

SEQ ID NO: 8997359 - DNA, 22 bp, Homo sapiens
agagaaggcatagaacttgagt

SEQ ID NO: 8997360 - DNA, 22 bp, Homo sapiens
agagaaggcatagaacttgagt

SEQ ID NO: 8997361 - DNA, 22 bp, Homo sapiens
agagaaggcatagaacttgagt

SEQ ID NO: 8997362 - DNA, 22 bp, Homo sapiens
agagaaggcatagaacttgagt

SEQ ID NO: 8997363 - DNA, 19 bp, Homo sapiens
agagaaggatcctatggtt

SEQ ID NO: 8997364 - DNA, 19 bp, Homo sapiens
agagaaggatcctatggtt

SEQ ID NO: 8997365 - DNA, 22 bp, Homo sapiens
agagaaatttccctgccttctg

SEQ ID NO: 8997366 - DNA, 22 bp, Homo sapiens
agagaaatggggtaatctttca

SEQ ID NO: 8997367 - DNA, 22 bp, Homo sapiens
agagaaatgattcctgggcaga

SEQ ID NO: 8997368 - DNA, 22 bp, Homo sapiens
agagaaatggggtaatctttca

SEQ ID NO: 8997369 - DNA, 22 bp, Homo sapiens
agagaaatgattcctgggcaga

SEQ ID NO: 8997370 - DNA, 22 bp, Homo sapiens
aatgtattatacataatttgtg

SEQ ID NO: 8997371 - DNA, 22 bp, Homo sapiens
aatgtattcctcatgcaagagt

SEQ ID NO: 8997372 - DNA, 22 bp, Homo sapiens
aatgtgtactttttcatgctca

SEQ ID NO: 8997373 - DNA, 22 bp, Homo sapiens
aatgtgtacatgacagatagaa

SEQ ID NO: 8997374 - DNA, 22 bp, Homo sapiens
aatgtgtactttttcatgctca

SEQ ID NO: 8997375 - DNA, 22 bp, Homo sapiens
agagaaggggtaaagagtcctg

SEQ ID NO: 8997376 - DNA, 22 bp, Homo sapiens
agagaaggggtaaagagtcctg

SEQ ID NO: 8997377 - DNA, 22 bp, Homo sapiens
aatgtgtagcatttaatgcagt

SEQ ID NO: 8997378 - DNA, 22 bp, Homo sapiens
aatgtgtagcatttaatgcagt

SEQ ID NO: 8997379 - DNA, 22 bp, Homo sapiens
aatgtgtagatgttgcattcct

SEQ ID NO: 8997380 - DNA, 22 bp, Homo sapiens
aatgtgtagcagaaccaggatt

SEQ ID NO: 8997381 - DNA, 22 bp, Homo sapiens
aatgtgtagatgttgcattcct

SEQ ID NO: 8997382 - DNA, 22 bp, Homo sapiens
aatgtgtagcatttaatgcagt

SEQ ID NO: 8997383 - DNA, 22 bp, Homo sapiens
aatgtgtagcatttaatgcagt

SEQ ID NO: 8997384 - DNA, 22 bp, Homo sapiens
aatgtgtagcagaaccaggatt

SEQ ID NO: 8997385 - DNA, 22 bp, Homo sapiens
agagaagggcctgtatgtaatc

SEQ ID NO: 8997386 - DNA, 22 bp, Homo sapiens
agagaagggcctgtatgtaatc

SEQ ID NO: 8997387 - DNA, 21 bp, Homo sapiens
agagaagggattccaggccct

SEQ ID NO: 8997388 - DNA, 22 bp, Homo sapiens
agagaagggcctgtatgtaatc

SEQ ID NO: 8997389 - DNA, 22 bp, Homo sapiens
agagaagggggaaagatctcac

SEQ ID NO: 8997390 - DNA, 22 bp, Homo sapiens
agagaagggggaaagatctcac

SEQ ID NO: 8997391 - DNA, 22 bp, Homo sapiens
agagaagggggaaagatctcac

SEQ ID NO: 8997392 - DNA, 22 bp, Homo sapiens
agagaagggggaaagatctcac

SEQ ID NO: 8997393 - DNA, 22 bp, Homo sapiens
agagaagggcctgtatgtaatc

SEQ ID NO: 8997394 - DNA, 22 bp, Homo sapiens
agagaaggggtaaagagtcctg

SEQ ID NO: 8997395 - DNA, 22 bp, Homo sapiens
agagaaggggtaaagagtcctg

SEQ ID NO: 8997396 - DNA, 22 bp, Homo sapiens
agagaaggggtaaagagtcctg

SEQ ID NO: 8997397 - DNA, 22 bp, Homo sapiens
agagaagggggaaagatctcac

SEQ ID NO: 8997398 - DNA, 22 bp, Homo sapiens
agagatgaaaagtggagactgg

SEQ ID NO: 8997399 - DNA, 22 bp, Homo sapiens
agagatttacacatgccttttc

SEQ ID NO: 8997400 - DNA, 22 bp, Homo sapiens
agagatgaaaagggtactgagg

SEQ ID NO: 8997401 - DNA, 22 bp, Homo sapiens
aatgtgttactgtgtaagagca

SEQ ID NO: 8997402 - DNA, 22 bp, Homo sapiens
aatgtgtgttcggggcccagag

SEQ ID NO: 8997403 - DNA, 22 bp, Homo sapiens
aatgtgtgaattgagagaagag

SEQ ID NO: 8997404 - DNA, 22 bp, Homo sapiens
aatgtgtgaattgagagaagag

SEQ ID NO: 8997405 - DNA, 22 bp, Homo sapiens
aatgtgtgaacttcagagcatc

SEQ ID NO: 8997406 - DNA, 22 bp, Homo sapiens
aatgtgtgaacactaatgcaac

SEQ ID NO: 8997407 - DNA, 22 bp, Homo sapiens
aatgtgtgcctgttaaggggca

SEQ ID NO: 8997408 - DNA, 21 bp, Homo sapiens
aatgtgtgctatttatctttt

SEQ ID NO: 8997409 - DNA, 22 bp, Homo sapiens
aatgtgtgtatttctaggcgag

SEQ ID NO: 8997410 - DNA, 22 bp, Homo sapiens
aatgtgtatatgaacatacagg

SEQ ID NO: 8997411 - DNA, 22 bp, Homo sapiens
aatgtgtatgaggaagagagaa

SEQ ID NO: 8997412 - DNA, 22 bp, Homo sapiens
aatgtgtatgaggaagagagaa

SEQ ID NO: 8997413 - DNA, 22 bp, Homo sapiens
aatgtgtatgaggaagagagaa

SEQ ID NO: 8997414 - DNA, 22 bp, Homo sapiens
aatgtgtcatttcccacaggtg

SEQ ID NO: 8997415 - DNA, 22 bp, Homo sapiens
aatgtgtatactggcaattaag

SEQ ID NO: 8997416 - DNA, 22 bp, Homo sapiens
aatgtgtataagggagagctaa

SEQ ID NO: 8997417 - DNA, 22 bp, Homo sapiens
aatgtgtatatgaacatacagg

SEQ ID NO: 8997418 - DNA, 22 bp, Homo sapiens
aatgtgtatatgaacatacagg

SEQ ID NO: 8997419 - DNA, 22 bp, Homo sapiens
aatgtgtatactggcaattaag

SEQ ID NO: 8997420 - DNA, 22 bp, Homo sapiens
aatgtgtataagggagagctaa

SEQ ID NO: 8997421 - DNA, 22 bp, Homo sapiens
aatgtgtagtcattgatcaaga

SEQ ID NO: 8997422 - DNA, 22 bp, Homo sapiens
aatgtgtataagggagagctaa

SEQ ID NO: 8997423 - DNA, 22 bp, Homo sapiens
aatgtgtatactggcaattaag

SEQ ID NO: 8997424 - DNA, 22 bp, Homo sapiens
agagcaaatagagaagccagct

SEQ ID NO: 8997425 - DNA, 22 bp, Homo sapiens
agagcaaatagagaagccagct

SEQ ID NO: 8997426 - DNA, 22 bp, Homo sapiens
agagcaacagagaaatttaggt

SEQ ID NO: 8997427 - DNA, 23 bp, Homo sapiens
agagcaaggaaatgaggtgtgat

SEQ ID NO: 8997428 - DNA, 22 bp, Homo sapiens
agagcaaagggacatggaagag

SEQ ID NO: 8997429 - DNA, 22 bp, Homo sapiens
agagatttgtcaatgatttcca

SEQ ID NO: 8997430 - DNA, 22 bp, Homo sapiens
agagatttgtcaatgatttcca

SEQ ID NO: 8997431 - DNA, 20 bp, Homo sapiens
agagattttagtagccacag

SEQ ID NO: 8997432 - DNA, 22 bp, Homo sapiens
agagatttctactgcactcttt

SEQ ID NO: 8997433 - DNA, 22 bp, Homo sapiens
agagatttgtcaatgatttcca

SEQ ID NO: 8997434 - DNA, 22 bp, Homo sapiens
agagatttctactgcactcttt

SEQ ID NO: 8997435 - DNA, 22 bp, Homo sapiens
agagcaatggcatccagctgat

SEQ ID NO: 8997436 - DNA, 22 bp, Homo sapiens
agagcaattagcttaggtaaaa

SEQ ID NO: 8997437 - DNA, 22 bp, Homo sapiens
agagcaagtgacagaaacaggg

SEQ ID NO: 8997438 - DNA, 21 bp, Homo sapiens
agagcaagttaaggcattaat

SEQ ID NO: 8997439 - DNA, 22 bp, Homo sapiens
agagcaatttcttctccaagtt

SEQ ID NO: 8997440 - DNA, 22 bp, Homo sapiens
agagcaatttcttctccaagtt

SEQ ID NO: 8997441 - DNA, 22 bp, Homo sapiens
agagcaatttcttctccaagtt

SEQ ID NO: 8997442 - DNA, 22 bp, Homo sapiens
agagcaattctcaaggaggtgt

SEQ ID NO: 8997443 - DNA, 23 bp, Homo sapiens
agagcaaggaaatgaggtgtgat

SEQ ID NO: 8997444 - DNA, 23 bp, Homo sapiens
agagcaaggaaatgaggtgtgat

SEQ ID NO: 8997445 - DNA, 23 bp, Homo sapiens
agagcaaggaaatgaggtgtgat

SEQ ID NO: 8997446 - DNA, 22 bp, Homo sapiens
agagcaagtgacagaaacaggg

SEQ ID NO: 8997447 - DNA, 22 bp, Homo sapiens
agagcaagtgacagaaacaggg

SEQ ID NO: 8997448 - DNA, 22 bp, Homo sapiens
agagcaagtgacagaaacaggg

SEQ ID NO: 8997449 - DNA, 22 bp, Homo sapiens
agcacaggctttggtgtgaggg

SEQ ID NO: 8997450 - DNA, 22 bp, Homo sapiens
agcacaggacgtagagcttgga

SEQ ID NO: 8997451 - DNA, 22 bp, Homo sapiens
agcacaggacgtagagcttgga

SEQ ID NO: 8997452 - DNA, 22 bp, Homo sapiens
agcacaggaccaaggaagctgt

SEQ ID NO: 8997453 - DNA, 22 bp, Homo sapiens
agcacaggaccaaggaagctgt

SEQ ID NO: 8997454 - DNA, 22 bp, Homo sapiens
agcacaggacgtagagcttgga

SEQ ID NO: 8997455 - DNA, 22 bp, Homo sapiens
agcacaggaccaaggaagctgt

SEQ ID NO: 8997456 - DNA, 22 bp, Homo sapiens
agcacagggcccagcctaggcc

SEQ ID NO: 8997457 - DNA, 22 bp, Homo sapiens
agcacagggcccagcctaggcc

SEQ ID NO: 8997458 - DNA, 22 bp, Homo sapiens
agcacagggcccagcctaggcc

SEQ ID NO: 8997459 - DNA, 22 bp, Homo sapiens
agcacagggacaatgccaggtg

SEQ ID NO: 8997460 - DNA, 22 bp, Homo sapiens
agcacagggacaatgccaggtg

SEQ ID NO: 8997461 - DNA, 22 bp, Homo sapiens
agcacagggcccagcctaggcc

SEQ ID NO: 8997462 - DNA, 22 bp, Homo sapiens
agcacagggcccagcctaggcc

SEQ ID NO: 8997463 - DNA, 22 bp, Homo sapiens
agcacagggcccagcctaggcc

SEQ ID NO: 8997464 - DNA, 22 bp, Homo sapiens
agcacagggacaatgccaggtg

SEQ ID NO: 8997465 - DNA, 22 bp, Homo sapiens
agcacagggacaatgccaggtg

SEQ ID NO: 8997466 - DNA, 22 bp, Homo sapiens
agcacagggacaatgccaggtg

SEQ ID NO: 8997467 - DNA, 21 bp, Homo sapiens
acacaacaggcagtcattttc

SEQ ID NO: 8997468 - DNA, 21 bp, Homo sapiens
acacaacaggcagtcattttc

SEQ ID NO: 8997469 - DNA, 21 bp, Homo sapiens
acacaacaggcagtcattttc

SEQ ID NO: 8997470 - DNA, 22 bp, Homo sapiens
acacaagaagttaatgggcaaa

SEQ ID NO: 8997471 - DNA, 22 bp, Homo sapiens
acacaacagaagagcaattgca

SEQ ID NO: 8997472 - DNA, 22 bp, Homo sapiens
acacaacagaagagcaattgca

SEQ ID NO: 8997473 - DNA, 22 bp, Homo sapiens
acacaacagaagagcaattgca

SEQ ID NO: 8997474 - DNA, 22 bp, Homo sapiens
acacaacagaagagcaattgca

SEQ ID NO: 8997475 - DNA, 22 bp, Homo sapiens
acacaaattgtaggataattgc

SEQ ID NO: 8997476 - DNA, 22 bp, Homo sapiens
acacaaaatcaaagtcctaggc

SEQ ID NO: 8997477 - DNA, 22 bp, Homo sapiens
acacaaaatcaaagtcctaggc

SEQ ID NO: 8997478 - DNA, 22 bp, Homo sapiens
acacaaattgtaggataattgc

SEQ ID NO: 8997479 - DNA, 22 bp, Homo sapiens
acacaaattgtaggataattgc

SEQ ID NO: 8997480 - DNA, 22 bp, Homo sapiens
acacaaattgtaggataattgc

SEQ ID NO: 8997481 - DNA, 22 bp, Homo sapiens
acaatttttcaaagaagcttat

SEQ ID NO: 8997482 - DNA, 22 bp, Homo sapiens
acaattttccccataggttatc

SEQ ID NO: 8997483 - DNA, 22 bp, Homo sapiens
agcacaggtaatacagagtaac

SEQ ID NO: 8997484 - DNA, 22 bp, Homo sapiens
agcacaggtaatacagagtaac

SEQ ID NO: 8997485 - DNA, 22 bp, Homo sapiens
agcacaggtaatacagagtaac

SEQ ID NO: 8997486 - DNA, 22 bp, Homo sapiens
agcacagggcccagcctaggcc

SEQ ID NO: 8997487 - DNA, 22 bp, Homo sapiens
agcacaggtaatacagagtaac

SEQ ID NO: 8997488 - DNA, 22 bp, Homo sapiens
agcacagggcccagcctaggcc

SEQ ID NO: 8997489 - DNA, 19 bp, Homo sapiens
agcacagacaagaccagca

SEQ ID NO: 8997490 - DNA, 21 bp, Homo sapiens
agcacagctttaagccatgtg

SEQ ID NO: 8997491 - DNA, 22 bp, Homo sapiens
agcacagaatggcttggaagcc

SEQ ID NO: 8997492 - DNA, 19 bp, Homo sapiens
agcacagacaagaccagca

SEQ ID NO: 8997493 - DNA, 22 bp, Homo sapiens
agcacagaatggcttggaagcc

SEQ ID NO: 8997494 - DNA, 22 bp, Homo sapiens
agcacagaatggcttggaagcc

SEQ ID NO: 8997495 - DNA, 22 bp, Homo sapiens
agcacagaatgaggtggaagtg

SEQ ID NO: 8997496 - DNA, 22 bp, Homo sapiens
agcacaggaccaaggaagctgt

SEQ ID NO: 8997497 - DNA, 22 bp, Homo sapiens
agcacaggaccaaggaagctgt

SEQ ID NO: 8997498 - DNA, 21 bp, Homo sapiens
agcacagctttaagccatgtg

SEQ ID NO: 8997499 - DNA, 22 bp, Homo sapiens
agcacaggaacatggagatggg

SEQ ID NO: 8997500 - DNA, 22 bp, Homo sapiens
agcacacctattacataaatgg

SEQ ID NO: 8997501 - DNA, 22 bp, Homo sapiens
agcacacatcacttctgctcat

SEQ ID NO: 8997502 - DNA, 22 bp, Homo sapiens
agcacagaaagcacatttgaaa

SEQ ID NO: 8997503 - DNA, 22 bp, Homo sapiens
agcacagaatgaggtggaagtg

SEQ ID NO: 8997504 - DNA, 22 bp, Homo sapiens
agcacagaatgaggtggaagtg

SEQ ID NO: 8997505 - DNA, 22 bp, Homo sapiens
agcacaatgtgaaaagagctct

SEQ ID NO: 8997506 - DNA, 22 bp, Homo sapiens
agcacacaggacttgattcatg

SEQ ID NO: 8997507 - DNA, 22 bp, Homo sapiens
agcacacaggacttgattcatg

SEQ ID NO: 8997508 - DNA, 22 bp, Homo sapiens
agcacacaggacttgattcatg

SEQ ID NO: 8997509 - DNA, 22 bp, Homo sapiens
agcacacaggccacctccactt

SEQ ID NO: 8997510 - DNA, 22 bp, Homo sapiens
agcacacagtattagccattgt

SEQ ID NO: 8997511 - DNA, 22 bp, Homo sapiens
agcacacagtattagccattgt

SEQ ID NO: 8997512 - DNA, 22 bp, Homo sapiens
agcacaaatataaaaatgtctg

SEQ ID NO: 8997513 - DNA, 22 bp, Homo sapiens
agcacaaatataaaaatgtctg

SEQ ID NO: 8997514 - DNA, 22 bp, Homo sapiens
agcacaatagagcagttaaaaa

SEQ ID NO: 8997515 - DNA, 22 bp, Homo sapiens
agcacaaatataaaaatgtctg

SEQ ID NO: 8997516 - DNA, 22 bp, Homo sapiens
agcacaaaagcagccacagatg

SEQ ID NO: 8997517 - DNA, 23 bp, Homo sapiens
agcacaaagtgttttccttgtag

SEQ ID NO: 8997518 - DNA, 22 bp, Homo sapiens
agcacaaaagcagccacagatg

SEQ ID NO: 8997519 - DNA, 22 bp, Homo sapiens
agcacaaaagcagccacagatg

SEQ ID NO: 8997520 - DNA, 22 bp, Homo sapiens
agcaaggccgagaggatgctat

SEQ ID NO: 8997521 - DNA, 22 bp, Homo sapiens
agcaaggcagtcagctggctgg

SEQ ID NO: 8997522 - DNA, 22 bp, Homo sapiens
agcaaggccgagaggatgctat

SEQ ID NO: 8997523 - DNA, 22 bp, Homo sapiens
agcaaatacatttttagcataa

SEQ ID NO: 8997524 - DNA, 19 bp, Homo sapiens
agcaaatacatcaaaattg

SEQ ID NO: 8997525 - DNA, 19 bp, Homo sapiens
agcaaatacatcaaaattg

SEQ ID NO: 8997526 - DNA, 19 bp, Homo sapiens
agcaaatacatcaaaattg

SEQ ID NO: 8997527 - DNA, 22 bp, Homo sapiens
agcaaataaagacaattatgtc

SEQ ID NO: 8997528 - DNA, 22 bp, Homo sapiens
agcaaataaagacaattatgtc

SEQ ID NO: 8997529 - DNA, 22 bp, Homo sapiens
agcaaataaagacaattatgtc

SEQ ID NO: 8997530 - DNA, 22 bp, Homo sapiens
agcaaataaagacaattatgtc

SEQ ID NO: 8997531 - DNA, 22 bp, Homo sapiens
agcaaataaagacaattatgtc

SEQ ID NO: 8997532 - DNA, 22 bp, Homo sapiens
agcaaaagatagattaacaaga

SEQ ID NO: 8997533 - DNA, 22 bp, Homo sapiens
agcaaagtagctgctgttctta

SEQ ID NO: 8997534 - DNA, 21 bp, Homo sapiens
agcaaaggcaggagaggtttc

SEQ ID NO: 8997535 - DNA, 22 bp, Homo sapiens
agcaaagtcagtggaaccatcc

SEQ ID NO: 8997536 - DNA, 22 bp, Homo sapiens
agcaaagtggctttccaaacca

SEQ ID NO: 8997537 - DNA, 22 bp, Homo sapiens
agcaaagttaaggtttctcttt

SEQ ID NO: 8997538 - DNA, 22 bp, Homo sapiens
acaacattcttaaatacactga

SEQ ID NO: 8997539 - DNA, 22 bp, Homo sapiens
acaacattcttaaatacactga

SEQ ID NO: 8997540 - DNA, 22 bp, Homo sapiens
acaacattcttaaatacactga

SEQ ID NO: 8997541 - DNA, 22 bp, Homo sapiens
acaacattcttaaatacactga

SEQ ID NO: 8997542 - DNA, 22 bp, Homo sapiens
acaacattcttaaatacactga

SEQ ID NO: 8997543 - DNA, 18 bp, Homo sapiens
agattttgagaaatacaa

SEQ ID NO: 8997544 - DNA, 22 bp, Homo sapiens
acaacatttccatttccttggt

SEQ ID NO: 8997545 - DNA, 18 bp, Homo sapiens
agattttgagaaatacaa

SEQ ID NO: 8997546 - DNA, 22 bp, Homo sapiens
agcaaaagatagattaacaaga

SEQ ID NO: 8997547 - DNA, 22 bp, Homo sapiens
agcaaaagatagattaacaaga

SEQ ID NO: 8997548 - DNA, 22 bp, Homo sapiens
agcaaaagatagattaacaaga

SEQ ID NO: 8997549 - DNA, 22 bp, Homo sapiens
agattttggctggctggagaga

SEQ ID NO: 8997550 - DNA, 22 bp, Homo sapiens
acaacagtttaggtatttgtag

SEQ ID NO: 8997551 - DNA, 22 bp, Homo sapiens
acaacattatacatagaaagct

SEQ ID NO: 8997552 - DNA, 22 bp, Homo sapiens
acaacattatacatagaaagct

SEQ ID NO: 8997553 - DNA, 22 bp, Homo sapiens
acaacattatacatagaaagct

SEQ ID NO: 8997554 - DNA, 22 bp, Homo sapiens
acaacagtaggaaaacatgtct

SEQ ID NO: 8997555 - DNA, 22 bp, Homo sapiens
acaacagtccagtatagactgt

SEQ ID NO: 8997556 - DNA, 22 bp, Homo sapiens
acaacagtccagtatagactgt

SEQ ID NO: 8997557 - DNA, 22 bp, Homo sapiens
acaacagtccagtatagactgt

SEQ ID NO: 8997558 - DNA, 22 bp, Homo sapiens
acaacagtccagtatagactgt

SEQ ID NO: 8997559 - DNA, 22 bp, Homo sapiens
acaacagtgtggtggaaggagc

SEQ ID NO: 8997560 - DNA, 22 bp, Homo sapiens
acaacagtgtggtggaaggagc

SEQ ID NO: 8997561 - DNA, 22 bp, Homo sapiens
agcaaatacttgaataaaaaga

SEQ ID NO: 8997562 - DNA, 22 bp, Homo sapiens
agcaaatacttgaataaaaaga

SEQ ID NO: 8997563 - DNA, 22 bp, Homo sapiens
agcaaatacttttcactgagcc

SEQ ID NO: 8997564 - DNA, 22 bp, Homo sapiens
agcaaatacttttcactgagcc

SEQ ID NO: 8997565 - DNA, 19 bp, Homo sapiens
agcaaatataatagtgttc

SEQ ID NO: 8997566 - DNA, 22 bp, Homo sapiens
agcaaatacatttttagcataa

SEQ ID NO: 8997567 - DNA, 22 bp, Homo sapiens
agcaaatacatttttagcataa

SEQ ID NO: 8997568 - DNA, 22 bp, Homo sapiens
agcaaatacttgaataaaaaga

SEQ ID NO: 8997569 - DNA, 22 bp, Homo sapiens
agcaaatacttgaataaaaaga

SEQ ID NO: 8997570 - DNA, 19 bp, Homo sapiens
agcaaatataatagtgttc

SEQ ID NO: 8997571 - DNA, 19 bp, Homo sapiens
agcaaatataatagtgttc

SEQ ID NO: 8997572 - DNA, 19 bp, Homo sapiens
agcaaatataatagtgttc

SEQ ID NO: 8997573 - DNA, 18 bp, Homo sapiens
agcaaatattaagtgcat

SEQ ID NO: 8997574 - DNA, 18 bp, Homo sapiens
agcaaatattaagtgcat

SEQ ID NO: 8997575 - DNA, 18 bp, Homo sapiens
agcaaatattaagtgcat

SEQ ID NO: 8997576 - DNA, 22 bp, Homo sapiens
acaagtttcattgtttagaacc

SEQ ID NO: 8997577 - DNA, 22 bp, Homo sapiens
acaagtttttgatagactagaa

SEQ ID NO: 8997578 - DNA, 22 bp, Homo sapiens
acaagtttttgatagactagaa

SEQ ID NO: 8997579 - DNA, 22 bp, Homo sapiens
acaagttttggaagtcttaagg

SEQ ID NO: 8997580 - DNA, 22 bp, Homo sapiens
acaagttttggaagtcttaagg

SEQ ID NO: 8997581 - DNA, 22 bp, Homo sapiens
acaagttttggaagtcttaagg

SEQ ID NO: 8997582 - DNA, 19 bp, Homo sapiens
acaataactcattgattgc

SEQ ID NO: 8997583 - DNA, 19 bp, Homo sapiens
acaataactcattgattgc

SEQ ID NO: 8997584 - DNA, 22 bp, Homo sapiens
acaagtttttgatagactagaa

SEQ ID NO: 8997585 - DNA, 22 bp, Homo sapiens
acaataacttctgtttccttgc

SEQ ID NO: 8997586 - DNA, 22 bp, Homo sapiens
acaatactattttcagtatcct

SEQ ID NO: 8997587 - DNA, 20 bp, Homo sapiens
acaatacaggttgtgtctga

SEQ ID NO: 8997588 - DNA, 20 bp, Homo sapiens
acaatacaggttgtgtctga

SEQ ID NO: 8997589 - DNA, 22 bp, Homo sapiens
acaataatgtattgccaaaagt

SEQ ID NO: 8997590 - DNA, 22 bp, Homo sapiens
acaataatgtattgccaaaagt

SEQ ID NO: 8997591 - DNA, 22 bp, Homo sapiens
acaataatgtattgccaaaagt

SEQ ID NO: 8997592 - DNA, 22 bp, Homo sapiens
acaataatgtattgccaaaagt

SEQ ID NO: 8997593 - DNA, 22 bp, Homo sapiens
acaataagtattgggcttttga

SEQ ID NO: 8997594 - DNA, 20 bp, Homo sapiens
acaatacaggttgtgtctga

SEQ ID NO: 8997595 - DNA, 22 bp, Homo sapiens
acaatacaggcttctggactta

SEQ ID NO: 8997596 - DNA, 22 bp, Homo sapiens
acaataatgtattgccaaaagt

SEQ ID NO: 8997597 - DNA, 22 bp, Homo sapiens
acaatacttaccaatgtttttg

SEQ ID NO: 8997598 - DNA, 22 bp, Homo sapiens
acaatagaaataattaagcaca

SEQ ID NO: 8997599 - DNA, 22 bp, Homo sapiens
acaatagaaataattaagcaca

SEQ ID NO: 8997600 - DNA, 22 bp, Homo sapiens
acaatagaaataattaagcaca

SEQ ID NO: 8997601 - DNA, 19 bp, Homo sapiens
acaatagaaaagtcttttg

SEQ ID NO: 8997602 - DNA, 22 bp, Homo sapiens
acaatagaaggaaactgacata

SEQ ID NO: 8997603 - DNA, 22 bp, Homo sapiens
acaatagaaggaaactgacata

SEQ ID NO: 8997604 - DNA, 22 bp, Homo sapiens
acaatagaaggaaactgacata

SEQ ID NO: 8997605 - DNA, 22 bp, Homo sapiens
agcaaggcagtcagctggctgg

SEQ ID NO: 8997606 - DNA, 22 bp, Homo sapiens
acaatagaaataattaagcaca

SEQ ID NO: 8997607 - DNA, 22 bp, Homo sapiens
acaatagaaggaaactgacata

SEQ ID NO: 8997608 - DNA, 22 bp, Homo sapiens
agagtggtggccgtggtgtcac

SEQ ID NO: 8997609 - DNA, 22 bp, Homo sapiens
agagtgggttataggcagactt

SEQ ID NO: 8997610 - DNA, 22 bp, Homo sapiens
agagtgggttataggcagactt

SEQ ID NO: 8997611 - DNA, 20 bp, Homo sapiens
agagtgggtgtcacaggctg

SEQ ID NO: 8997612 - DNA, 20 bp, Homo sapiens
agagtgggtgtcacaggctg

SEQ ID NO: 8997613 - DNA, 22 bp, Homo sapiens
aatttggtgtgttccaggaact

SEQ ID NO: 8997614 - DNA, 22 bp, Homo sapiens
aatttggtgtcttagtttccct

SEQ ID NO: 8997615 - DNA, 23 bp, Homo sapiens
aatttggtatatctgaaccactg

SEQ ID NO: 8997616 - DNA, 22 bp, Homo sapiens
aatttggggaggttcagactct

SEQ ID NO: 8997617 - DNA, 22 bp, Homo sapiens
aatttgggcgaggagggaggca

SEQ ID NO: 8997618 - DNA, 22 bp, Homo sapiens
aatttggttttaagagcatcag

SEQ ID NO: 8997619 - DNA, 23 bp, Homo sapiens
aatttggttgatgaaagcattgt

SEQ ID NO: 8997620 - DNA, 22 bp, Homo sapiens
aatttgtacaaaatgtttataa

SEQ ID NO: 8997621 - DNA, 22 bp, Homo sapiens
aatttgtacaaaatgtttataa

SEQ ID NO: 8997622 - DNA, 22 bp, Homo sapiens
aatttgtacaaaatgtttataa

SEQ ID NO: 8997623 - DNA, 22 bp, Homo sapiens
agagtgaagtttttgaaagtga

SEQ ID NO: 8997624 - DNA, 22 bp, Homo sapiens
agagtgaagttcatcgtgcagc

SEQ ID NO: 8997625 - DNA, 22 bp, Homo sapiens
aatttgtatacatgttacattt

SEQ ID NO: 8997626 - DNA, 22 bp, Homo sapiens
agagtgaagttcatcgtgcagc

SEQ ID NO: 8997627 - DNA, 22 bp, Homo sapiens
agagtgaaggttgacacttcac

SEQ ID NO: 8997628 - DNA, 22 bp, Homo sapiens
aatttgtatacatgttacattt

SEQ ID NO: 8997629 - DNA, 22 bp, Homo sapiens
aatttgtataaaatggtgtttt

SEQ ID NO: 8997630 - DNA, 22 bp, Homo sapiens
aatttgtataaaatggtgtttt

SEQ ID NO: 8997631 - DNA, 22 bp, Homo sapiens
aatttgtacaaaatgtttataa

SEQ ID NO: 8997632 - DNA, 22 bp, Homo sapiens
agagtgtgttccccaagaaaga

SEQ ID NO: 8997633 - DNA, 22 bp, Homo sapiens
agagtgttatttgctctgtatt

SEQ ID NO: 8997634 - DNA, 18 bp, Homo sapiens
agagtgttctcagtgaaa

SEQ ID NO: 8997635 - DNA, 22 bp, Homo sapiens
agagtgtgtctatggaaggggt

SEQ ID NO: 8997636 - DNA, 22 bp, Homo sapiens
agagtgtggaacttgaggagct

SEQ ID NO: 8997637 - DNA, 22 bp, Homo sapiens
agagtgtggaaatgttcagagt

SEQ ID NO: 8997638 - DNA, 22 bp, Homo sapiens
agagtggtcatttgtccaggat

SEQ ID NO: 8997639 - DNA, 22 bp, Homo sapiens
agagtgtctggtagctgctctg

SEQ ID NO: 8997640 - DNA, 22 bp, Homo sapiens
agagttatggacttaatgcagg

SEQ ID NO: 8997641 - DNA, 22 bp, Homo sapiens
agagttcacactcagtgcaccc

SEQ ID NO: 8997642 - DNA, 22 bp, Homo sapiens
agagttatattggttgagaatt

SEQ ID NO: 8997643 - DNA, 22 bp, Homo sapiens
agagttatcactccatgcagct

SEQ ID NO: 8997644 - DNA, 21 bp, Homo sapiens
agagttactgtcatcctaggt

SEQ ID NO: 8997645 - DNA, 22 bp, Homo sapiens
agagttaaatgaaatggtatgt

SEQ ID NO: 8997646 - DNA, 22 bp, Homo sapiens
aatttgattccctgcacctgtt

SEQ ID NO: 8997647 - DNA, 22 bp, Homo sapiens
aatttgattttcttaaaccata

SEQ ID NO: 8997648 - DNA, 22 bp, Homo sapiens
aatttgcatgatgagaacaata

SEQ ID NO: 8997649 - DNA, 22 bp, Homo sapiens
aatttggaagatgttgtttatc

SEQ ID NO: 8997650 - DNA, 22 bp, Homo sapiens
aatttggaagatgttgtttatc

SEQ ID NO: 8997651 - DNA, 22 bp, Homo sapiens
aatttggagagagattaatgtt

SEQ ID NO: 8997652 - DNA, 22 bp, Homo sapiens
aatttggcagtgtcttgaagta

SEQ ID NO: 8997653 - DNA, 22 bp, Homo sapiens
aatttggagagaaacaagtagg

SEQ ID NO: 8997654 - DNA, 22 bp, Homo sapiens
aatttggagagaaacaagtagg

SEQ ID NO: 8997655 - DNA, 18 bp, Homo sapiens
aatttctttgacaactta

SEQ ID NO: 8997656 - DNA, 18 bp, Homo sapiens
aatttctttgacaactta

SEQ ID NO: 8997657 - DNA, 18 bp, Homo sapiens
aatttctttgacaactta

SEQ ID NO: 8997658 - DNA, 18 bp, Homo sapiens
aatttctttgacaactta

SEQ ID NO: 8997659 - DNA, 22 bp, Homo sapiens
aatttgatgagtttgtaagtct

SEQ ID NO: 8997660 - DNA, 22 bp, Homo sapiens
aatttgattcagcaaatgttca

SEQ ID NO: 8997661 - DNA, 22 bp, Homo sapiens
aatttgattcagcaaatgttca

SEQ ID NO: 8997662 - DNA, 22 bp, Homo sapiens
aatttgattcagcaaatgttca

SEQ ID NO: 8997663 - DNA, 22 bp, Homo sapiens
aatttgacagcaatagaagatt

SEQ ID NO: 8997664 - DNA, 22 bp, Homo sapiens
aatttcttcagctctaaaatgg

SEQ ID NO: 8997665 - DNA, 22 bp, Homo sapiens
aatttctgtatgaatagagaaa

SEQ ID NO: 8997666 - DNA, 22 bp, Homo sapiens
aatttcttcagctctaaaatgg

SEQ ID NO: 8997667 - DNA, 22 bp, Homo sapiens
aatttctctctcatgcttcatg

SEQ ID NO: 8997668 - DNA, 22 bp, Homo sapiens
aatttcttcagctctaaaatgg

SEQ ID NO: 8997669 - DNA, 22 bp, Homo sapiens
aatttcttgggagctcagagaa

SEQ ID NO: 8997670 - DNA, 22 bp, Homo sapiens
aatttctcatggattcagttat

SEQ ID NO: 8997671 - DNA, 22 bp, Homo sapiens
aatttctccaagaatgcttaga

SEQ ID NO: 8997672 - DNA, 22 bp, Homo sapiens
aatttctcactctcttgatcac

SEQ ID NO: 8997673 - DNA, 22 bp, Homo sapiens
aatttctcatggattcagttat

SEQ ID NO: 8997674 - DNA, 22 bp, Homo sapiens
aatttctaattgaatctctctt

SEQ ID NO: 8997675 - DNA, 22 bp, Homo sapiens
aatttctccaagaatgcttaga

SEQ ID NO: 8997676 - DNA, 22 bp, Homo sapiens
aatttctccaagaatgcttaga

SEQ ID NO: 8997677 - DNA, 22 bp, Homo sapiens
aatttctcggttttgatattgt

SEQ ID NO: 8997678 - DNA, 22 bp, Homo sapiens
aatttctcggttttgatattgt

SEQ ID NO: 8997679 - DNA, 21 bp, Homo sapiens
agatgcagtttgcaggtgggt

SEQ ID NO: 8997680 - DNA, 21 bp, Homo sapiens
agatgcagtttgcaggtgggt

SEQ ID NO: 8997681 - DNA, 21 bp, Homo sapiens
agatgcagtttgcaggtgggt

SEQ ID NO: 8997682 - DNA, 21 bp, Homo sapiens
agatgcagttatgagatgcag

SEQ ID NO: 8997683 - DNA, 22 bp, Homo sapiens
agatgccagcttacactgggaa

SEQ ID NO: 8997684 - DNA, 22 bp, Homo sapiens
agatgccaggttgggaagtgat

SEQ ID NO: 8997685 - DNA, 22 bp, Homo sapiens
agatgcctaaatctgggcaagg

SEQ ID NO: 8997686 - DNA, 22 bp, Homo sapiens
agatgcctgccagttatttagc

SEQ ID NO: 8997687 - DNA, 22 bp, Homo sapiens
agatgccttttatttattgtca

SEQ ID NO: 8997688 - DNA, 22 bp, Homo sapiens
agatgcagacttggttcaggca

SEQ ID NO: 8997689 - DNA, 22 bp, Homo sapiens
agatgcagacttggttcaggca

SEQ ID NO: 8997690 - DNA, 22 bp, Homo sapiens
agatgcagacttggttcaggca

SEQ ID NO: 8997691 - DNA, 22 bp, Homo sapiens
agatgcagagttgcttaagcat

SEQ ID NO: 8997692 - DNA, 22 bp, Homo sapiens
agatgcagacttggttcaggca

SEQ ID NO: 8997693 - DNA, 22 bp, Homo sapiens
agatgcagagtttgctgtggac

SEQ ID NO: 8997694 - DNA, 22 bp, Homo sapiens
agatgcagagtttgctgtggac

SEQ ID NO: 8997695 - DNA, 22 bp, Homo sapiens
agatgcagatttggattcagga

SEQ ID NO: 8997696 - DNA, 21 bp, Homo sapiens
agatgcagtgacccactgggg

SEQ ID NO: 8997697 - DNA, 22 bp, Homo sapiens
agatgcagatttggattcagga

SEQ ID NO: 8997698 - DNA, 22 bp, Homo sapiens
agatgcagatttggattcagga

SEQ ID NO: 8997699 - DNA, 21 bp, Homo sapiens
agatgcagtgacccactgggg

SEQ ID NO: 8997700 - DNA, 22 bp, Homo sapiens
agatgcagtggttaacaataca

SEQ ID NO: 8997701 - DNA, 22 bp, Homo sapiens
agatgcagtggttaacaataca

SEQ ID NO: 8997702 - DNA, 22 bp, Homo sapiens
agatgctgctccacaggccagg

SEQ ID NO: 8997703 - DNA, 22 bp, Homo sapiens
agatgctgctccacaggccagg

SEQ ID NO: 8997704 - DNA, 22 bp, Homo sapiens
agatgctgctccacaggccagg

SEQ ID NO: 8997705 - DNA, 22 bp, Homo sapiens
agatgctgcctctcctcacaag

SEQ ID NO: 8997706 - DNA, 22 bp, Homo sapiens
agatgctgccaggcccctcagt

SEQ ID NO: 8997707 - DNA, 22 bp, Homo sapiens
agatgctgaagctgaggcaaca

SEQ ID NO: 8997708 - DNA, 22 bp, Homo sapiens
agatgctgaattattgtgcttt

SEQ ID NO: 8997709 - DNA, 22 bp, Homo sapiens
agatgctgaattattgtgcttt

SEQ ID NO: 8997710 - DNA, 21 bp, Homo sapiens
agatgctgatgctgcaggtcc

SEQ ID NO: 8997711 - DNA, 22 bp, Homo sapiens
acaacagtaggaaaacatgtct

SEQ ID NO: 8997712 - DNA, 22 bp, Homo sapiens
acaacagtagcctttacaaggc

SEQ ID NO: 8997713 - DNA, 22 bp, Homo sapiens
acaacagtaggaaaacatgtct

SEQ ID NO: 8997714 - DNA, 22 bp, Homo sapiens
acaacagtaggaaaacatgtct

SEQ ID NO: 8997715 - DNA, 22 bp, Homo sapiens
acaacagtaggaaaacatgtct

SEQ ID NO: 8997716 - DNA, 22 bp, Homo sapiens
acaacagtagcctttacaaggc

SEQ ID NO: 8997717 - DNA, 22 bp, Homo sapiens
acaacagtagcctttacaaggc

SEQ ID NO: 8997718 - DNA, 22 bp, Homo sapiens
acaacagagctggactgagagg

SEQ ID NO: 8997719 - DNA, 22 bp, Homo sapiens
agatgctgctccacaggccagg

SEQ ID NO: 8997720 - DNA, 22 bp, Homo sapiens
agatgctggatggaaaatgatc

SEQ ID NO: 8997721 - DNA, 22 bp, Homo sapiens
acaaataggtagatttgcaaca

SEQ ID NO: 8997722 - DNA, 22 bp, Homo sapiens
acaaataggtagatttgcaaca

SEQ ID NO: 8997723 - DNA, 22 bp, Homo sapiens
acaaataggtagatttgcaaca

SEQ ID NO: 8997724 - DNA, 22 bp, Homo sapiens
acaaatagagattcaaataaag

SEQ ID NO: 8997725 - DNA, 22 bp, Homo sapiens
acaaatagagattcaaataaag

SEQ ID NO: 8997726 - DNA, 22 bp, Homo sapiens
acaaatagaaaatctggattgg

SEQ ID NO: 8997727 - DNA, 22 bp, Homo sapiens
acaaatagagattcaaataaag

SEQ ID NO: 8997728 - DNA, 22 bp, Homo sapiens
acaaatagaaaatctggattgg

SEQ ID NO: 8997729 - DNA, 22 bp, Homo sapiens
agatctttagtgaagctaaatc

SEQ ID NO: 8997730 - DNA, 22 bp, Homo sapiens
agatctttagtgaagctaaatc

SEQ ID NO: 8997731 - DNA, 22 bp, Homo sapiens
agatctttagtgaagctaaatc

SEQ ID NO: 8997732 - DNA, 22 bp, Homo sapiens
agatgcagaaaaactaagtgat

SEQ ID NO: 8997733 - DNA, 22 bp, Homo sapiens
acaaagtgtgcggagcccaggg

SEQ ID NO: 8997734 - DNA, 22 bp, Homo sapiens
acaaagtgtgcggagcccaggg

SEQ ID NO: 8997735 - DNA, 22 bp, Homo sapiens
acaaagtgctgacattacaggc

SEQ ID NO: 8997736 - DNA, 22 bp, Homo sapiens
acaaagtgtgcggagcccaggg

SEQ ID NO: 8997737 - DNA, 22 bp, Homo sapiens
acaaagtgctgacattacaggc

SEQ ID NO: 8997738 - DNA, 22 bp, Homo sapiens
acaaagtgttttctgaaggcct

SEQ ID NO: 8997739 - DNA, 22 bp, Homo sapiens
acaaagtgttttctgaaggcct

SEQ ID NO: 8997740 - DNA, 22 bp, Homo sapiens
acaaagtgtgcggagcccaggg

SEQ ID NO: 8997741 - DNA, 22 bp, Homo sapiens
acaaagtgttttctgaaggcct

SEQ ID NO: 8997742 - DNA, 22 bp, Homo sapiens
acaaagtttcttctaacatctg

SEQ ID NO: 8997743 - DNA, 22 bp, Homo sapiens
acaaagttattctttcagagga

SEQ ID NO: 8997744 - DNA, 22 bp, Homo sapiens
acaaagtttgtggtattccaag

SEQ ID NO: 8997745 - DNA, 22 bp, Homo sapiens
acaaagtttgtggtattccaag

SEQ ID NO: 8997746 - DNA, 22 bp, Homo sapiens
acaaagtttgtggtattccaag

SEQ ID NO: 8997747 - DNA, 22 bp, Homo sapiens
acaaagtttgtggtattccaag

SEQ ID NO: 8997748 - DNA, 22 bp, Homo sapiens
agagttcacactcagtgcaccc

SEQ ID NO: 8997749 - DNA, 22 bp, Homo sapiens
agagttcacactcagtgcaccc

SEQ ID NO: 8997750 - DNA, 22 bp, Homo sapiens
agagttcagaaagtgcaggttt

SEQ ID NO: 8997751 - DNA, 22 bp, Homo sapiens
agagttcagttgtagccatatt

SEQ ID NO: 8997752 - DNA, 22 bp, Homo sapiens
agagttccacgtacagcttttg

SEQ ID NO: 8997753 - DNA, 22 bp, Homo sapiens
agagttcagttgtagccatatt

SEQ ID NO: 8997754 - DNA, 22 bp, Homo sapiens
agagttcatgtcttagcctatc

SEQ ID NO: 8997755 - DNA, 22 bp, Homo sapiens
acaaagtcctggtgtatggcca

SEQ ID NO: 8997756 - DNA, 20 bp, Homo sapiens
acaaagtattgaggacaagt

SEQ ID NO: 8997757 - DNA, 20 bp, Homo sapiens
acaaagtattgaggacaagt

SEQ ID NO: 8997758 - DNA, 20 bp, Homo sapiens
acaaagtattgaggacaagt

SEQ ID NO: 8997759 - DNA, 22 bp, Homo sapiens
acaaagtgaaaagcatcgaatt

SEQ ID NO: 8997760 - DNA, 22 bp, Homo sapiens
acaaagtgaaaagcatcgaatt

SEQ ID NO: 8997761 - DNA, 22 bp, Homo sapiens
acaaagtgaattgcatcgagtt

SEQ ID NO: 8997762 - DNA, 22 bp, Homo sapiens
acaaagtgaaaagcatcgaatt

SEQ ID NO: 8997763 - DNA, 22 bp, Homo sapiens
acaaagtctctaataatcttct

SEQ ID NO: 8997764 - DNA, 22 bp, Homo sapiens
acaaagtgaattgcatcgagtt

SEQ ID NO: 8997765 - DNA, 22 bp, Homo sapiens
acaaagtgaattgcatcgagtt

SEQ ID NO: 8997766 - DNA, 22 bp, Homo sapiens
acaaagtgcacaagatgagaac

SEQ ID NO: 8997767 - DNA, 22 bp, Homo sapiens
acaaagtgcacaagatgagaac

SEQ ID NO: 8997768 - DNA, 19 bp, Homo sapiens
acaaagtgcgtgctctttt

SEQ ID NO: 8997769 - DNA, 22 bp, Homo sapiens
acaaagtgctgacattacaggc

SEQ ID NO: 8997770 - DNA, 22 bp, Homo sapiens
acaaagtgctgacattacaggc

SEQ ID NO: 8997771 - DNA, 19 bp, Homo sapiens
acaaagtgcgtgctctttt

SEQ ID NO: 8997772 - DNA, 22 bp, Homo sapiens
acaaagtgctgacattacaggc

SEQ ID NO: 8997773 - DNA, 22 bp, Homo sapiens
acaaagtgcacaagatgagaac

SEQ ID NO: 8997774 - DNA, 19 bp, Homo sapiens
acaaagtgcgtgctctttt

SEQ ID NO: 8997775 - DNA, 22 bp, Homo sapiens
aatagcatagagttaaaatgca

SEQ ID NO: 8997776 - DNA, 22 bp, Homo sapiens
aatagcatagagttaaaatgca

SEQ ID NO: 8997777 - DNA, 22 bp, Homo sapiens
aatagcatcctaaaacatactt

SEQ ID NO: 8997778 - DNA, 22 bp, Homo sapiens
aatagcataagatgtcaaatag

SEQ ID NO: 8997779 - DNA, 22 bp, Homo sapiens
aatagcataagatgtcaaatag

SEQ ID NO: 8997780 - DNA, 19 bp, Homo sapiens
aatagcaggagcagttccc

SEQ ID NO: 8997781 - DNA, 22 bp, Homo sapiens
aatagcaaagttatcaaattaa

SEQ ID NO: 8997782 - DNA, 22 bp, Homo sapiens
aatagaatttaaatgcagtggc

SEQ ID NO: 8997783 - DNA, 22 bp, Homo sapiens
aatagaatttaaatgcagtggc

SEQ ID NO: 8997784 - DNA, 23 bp, Homo sapiens
actgtctgatatgttttccatca

SEQ ID NO: 8997785 - DNA, 22 bp, Homo sapiens
aatagcaaagttatcaaattaa

SEQ ID NO: 8997786 - DNA, 22 bp, Homo sapiens
aatagcaaagttatcaaattaa

SEQ ID NO: 8997787 - DNA, 22 bp, Homo sapiens
aatagcaaagttatcaaattaa

SEQ ID NO: 8997788 - DNA, 22 bp, Homo sapiens
aatagcaaagttatcaaattaa

SEQ ID NO: 8997789 - DNA, 22 bp, Homo sapiens
aatagcaattacccttcaactc

SEQ ID NO: 8997790 - DNA, 20 bp, Homo sapiens
aatagcacagctcaaacatt

SEQ ID NO: 8997791 - DNA, 22 bp, Homo sapiens
aatagcaaatgctcatttgaaa

SEQ ID NO: 8997792 - DNA, 22 bp, Homo sapiens
aatagcaaatgctcatttgaaa

SEQ ID NO: 8997793 - DNA, 22 bp, Homo sapiens
aatagcaaatgctcatttgaaa

SEQ ID NO: 8997794 - DNA, 22 bp, Homo sapiens
aatagcaattacatttgcacca

SEQ ID NO: 8997795 - DNA, 22 bp, Homo sapiens
actgtcgattatgatgagtcag

SEQ ID NO: 8997796 - DNA, 22 bp, Homo sapiens
actgtctcctcatcatgcctgg

SEQ ID NO: 8997797 - DNA, 22 bp, Homo sapiens
actgtcctagaacctgcagctc

SEQ ID NO: 8997798 - DNA, 22 bp, Homo sapiens
actgtccttttaatgcagccgt

SEQ ID NO: 8997799 - DNA, 22 bp, Homo sapiens
actgtctcctcatcatgcctgg

SEQ ID NO: 8997800 - DNA, 22 bp, Homo sapiens
actgtcctcagatattcttctg

SEQ ID NO: 8997801 - DNA, 22 bp, Homo sapiens
actgtcctcagatattcttctg

SEQ ID NO: 8997802 - DNA, 22 bp, Homo sapiens
actgtcctagaacctgcagctc

SEQ ID NO: 8997803 - DNA, 22 bp, Homo sapiens
actgtcctgaatactgcatgac

SEQ ID NO: 8997804 - DNA, 22 bp, Homo sapiens
actgtcctgaatactgcatgac

SEQ ID NO: 8997805 - DNA, 22 bp, Homo sapiens
actgtcctgaatactgcatgac

SEQ ID NO: 8997806 - DNA, 22 bp, Homo sapiens
aatagaatttaaatgcagtggc

SEQ ID NO: 8997807 - DNA, 22 bp, Homo sapiens
aatagaatgtaatctaatacat

SEQ ID NO: 8997808 - DNA, 22 bp, Homo sapiens
aatagaatgtaatctaatacat

SEQ ID NO: 8997809 - DNA, 23 bp, Homo sapiens
actgtctgatatgttttccatca

SEQ ID NO: 8997810 - DNA, 22 bp, Homo sapiens
actgtctgagctgattgagcta

SEQ ID NO: 8997811 - DNA, 22 bp, Homo sapiens
actgtctgagtcaggagtcaca

SEQ ID NO: 8997812 - DNA, 22 bp, Homo sapiens
actgtctgagctgattgagcta

SEQ ID NO: 8997813 - DNA, 18 bp, Homo sapiens
actgtctctgagagtggt

SEQ ID NO: 8997814 - DNA, 22 bp, Homo sapiens
actgtctctctagcagttcagg

SEQ ID NO: 8997815 - DNA, 22 bp, Homo sapiens
actgtctctctagcagttcagg

SEQ ID NO: 8997816 - DNA, 22 bp, Homo sapiens
actgtctctctagcagttcagg

SEQ ID NO: 8997817 - DNA, 22 bp, Homo sapiens
actgtacatatggattctaaga

SEQ ID NO: 8997818 - DNA, 22 bp, Homo sapiens
actgtacatatggattctaaga

SEQ ID NO: 8997819 - DNA, 22 bp, Homo sapiens
actgtacacgtgtcatttacag

SEQ ID NO: 8997820 - DNA, 22 bp, Homo sapiens
actgtacacgtgtcatttacag

SEQ ID NO: 8997821 - DNA, 22 bp, Homo sapiens
actgtacacgtgtcatttacag

SEQ ID NO: 8997822 - DNA, 22 bp, Homo sapiens
actgtacacgtgtcatttacag

SEQ ID NO: 8997823 - DNA, 22 bp, Homo sapiens
actgtacacattcgtcaagact

SEQ ID NO: 8997824 - DNA, 22 bp, Homo sapiens
actgtacacattcgtcaagact

SEQ ID NO: 8997825 - DNA, 22 bp, Homo sapiens
actgtacacagtggtgtactgt

SEQ ID NO: 8997826 - DNA, 22 bp, Homo sapiens
actgtccggcacaagtgccacc

SEQ ID NO: 8997827 - DNA, 22 bp, Homo sapiens
actgtccgcatgtgtgccacct

SEQ ID NO: 8997828 - DNA, 22 bp, Homo sapiens
actgtcccatttatgtagacat

SEQ ID NO: 8997829 - DNA, 22 bp, Homo sapiens
actgtcatgcattatggcatgt

SEQ ID NO: 8997830 - DNA, 21 bp, Homo sapiens
actgtcatttgcttagggagg

SEQ ID NO: 8997831 - DNA, 22 bp, Homo sapiens
actgtcatgcattatggcatgt

SEQ ID NO: 8997832 - DNA, 22 bp, Homo sapiens
actgtaatgttttaaagcagag

SEQ ID NO: 8997833 - DNA, 22 bp, Homo sapiens
actgtaatggtggatccatgtc

SEQ ID NO: 8997834 - DNA, 22 bp, Homo sapiens
actgtaatggtggatccatgtc

SEQ ID NO: 8997835 - DNA, 22 bp, Homo sapiens
actgtaatggtggatccatgtc

SEQ ID NO: 8997836 - DNA, 22 bp, Homo sapiens
actgtaatggtggatccatgtc

SEQ ID NO: 8997837 - DNA, 22 bp, Homo sapiens
actgtaatggtggatccatgtc

SEQ ID NO: 8997838 - DNA, 22 bp, Homo sapiens
actgtaatattttaagatgtct

SEQ ID NO: 8997839 - DNA, 22 bp, Homo sapiens
actgtaattggattgtctgact

SEQ ID NO: 8997840 - DNA, 22 bp, Homo sapiens
actgtaatgttttaaagcagag

SEQ ID NO: 8997841 - DNA, 22 bp, Homo sapiens
actgtaattatctgaacgtgca

SEQ ID NO: 8997842 - DNA, 22 bp, Homo sapiens
actgtaattatctgaacgtgca

SEQ ID NO: 8997843 - DNA, 22 bp, Homo sapiens
actgtaattggattgtctgact

SEQ ID NO: 8997844 - DNA, 22 bp, Homo sapiens
actgtaattggattgtctgact

SEQ ID NO: 8997845 - DNA, 22 bp, Homo sapiens
actgtaatatgaaggtcctatt

SEQ ID NO: 8997846 - DNA, 22 bp, Homo sapiens
actgtaatatggttcttttgat

SEQ ID NO: 8997847 - DNA, 22 bp, Homo sapiens
actgtaatatggttcttttgat

SEQ ID NO: 8997848 - DNA, 22 bp, Homo sapiens
actgtaatattttaagatgtct

SEQ ID NO: 8997849 - DNA, 22 bp, Homo sapiens
actgtaatattttaagatgtct

SEQ ID NO: 8997850 - DNA, 22 bp, Homo sapiens
actgtaatattttaagatgtct

SEQ ID NO: 8997851 - DNA, 22 bp, Homo sapiens
actgtacaaatattgcaaaata

SEQ ID NO: 8997852 - DNA, 22 bp, Homo sapiens
actgtacaaatattgcaaaata

SEQ ID NO: 8997853 - DNA, 22 bp, Homo sapiens
actgtacaaatattgcaaaata

SEQ ID NO: 8997854 - DNA, 22 bp, Homo sapiens
actgtacaacctctgcccctgt

SEQ ID NO: 8997855 - DNA, 22 bp, Homo sapiens
actgtacaactgctgagcagaa

SEQ ID NO: 8997856 - DNA, 22 bp, Homo sapiens
actgtacaactgctgagcagaa

SEQ ID NO: 8997857 - DNA, 22 bp, Homo sapiens
actgtacacacttctctgtctt

SEQ ID NO: 8997858 - DNA, 22 bp, Homo sapiens
actgtacacacttctctgtctt

SEQ ID NO: 8997859 - DNA, 21 bp, Homo sapiens
aataaaacagttggtgtcaat

SEQ ID NO: 8997860 - DNA, 21 bp, Homo sapiens
aataaaacagttggtgtcaat

SEQ ID NO: 8997861 - DNA, 20 bp, Homo sapiens
aataaaagaagccttcaccc

SEQ ID NO: 8997862 - DNA, 20 bp, Homo sapiens
aataaaagaagccttcaccc

SEQ ID NO: 8997863 - DNA, 22 bp, Homo sapiens
aataaaatgaactggtagagtt

SEQ ID NO: 8997864 - DNA, 22 bp, Homo sapiens
aataaaatgaactggtagagtt

SEQ ID NO: 8997865 - DNA, 22 bp, Homo sapiens
aataaaatgaactggtagagtt

SEQ ID NO: 8997866 - DNA, 22 bp, Homo sapiens
aataaaatgaactggtagagtt

SEQ ID NO: 8997867 - DNA, 22 bp, Homo sapiens
aataaaatgaactggtagagtt

SEQ ID NO: 8997868 - DNA, 22 bp, Homo sapiens
aataaaatgaactggtagagtt

SEQ ID NO: 8997869 - DNA, 22 bp, Homo sapiens
aataaaatgaactggtagagtt

SEQ ID NO: 8997870 - DNA, 20 bp, Homo sapiens
aagttttctccaaatacagt

SEQ ID NO: 8997871 - DNA, 22 bp, Homo sapiens
aagttttgaaatactgaagtgt

SEQ ID NO: 8997872 - DNA, 22 bp, Homo sapiens
aagttttgaaatactgaagtgt

SEQ ID NO: 8997873 - DNA, 22 bp, Homo sapiens
aagtttttggtagagaaaagta

SEQ ID NO: 8997874 - DNA, 22 bp, Homo sapiens
aagtttttggtagagaaaagta

SEQ ID NO: 8997875 - DNA, 22 bp, Homo sapiens
aagtttttgattctaagagaga

SEQ ID NO: 8997876 - DNA, 22 bp, Homo sapiens
aagtttttggtagagaaaagta

SEQ ID NO: 8997877 - DNA, 22 bp, Homo sapiens
actgggagggtcttgaagaggg

SEQ ID NO: 8997878 - DNA, 22 bp, Homo sapiens
actgggagggtcttgaagaggg

SEQ ID NO: 8997879 - DNA, 22 bp, Homo sapiens
actgggagtcatgaggaaggag

SEQ ID NO: 8997880 - DNA, 22 bp, Homo sapiens
actgggagggtcttgaagaggg

SEQ ID NO: 8997881 - DNA, 22 bp, Homo sapiens
actgggagggtcttgaagaggg

SEQ ID NO: 8997882 - DNA, 22 bp, Homo sapiens
actgggagttctccatgtccct

SEQ ID NO: 8997883 - DNA, 22 bp, Homo sapiens
actgggagttctccatgtccct

SEQ ID NO: 8997884 - DNA, 22 bp, Homo sapiens
actgggagtcatgaggaaggag

SEQ ID NO: 8997885 - DNA, 22 bp, Homo sapiens
actgggagtcatgaggaaggag

SEQ ID NO: 8997886 - DNA, 22 bp, Homo sapiens
actgggagtcatgaggaaggag

SEQ ID NO: 8997887 - DNA, 22 bp, Homo sapiens
actgggaggcaaagagcaagga

SEQ ID NO: 8997888 - DNA, 22 bp, Homo sapiens
actgggaggcaaagagcaagga

SEQ ID NO: 8997889 - DNA, 22 bp, Homo sapiens
actgggaggcatctggagctga

SEQ ID NO: 8997890 - DNA, 22 bp, Homo sapiens
actgggaggcatctggagctga

SEQ ID NO: 8997891 - DNA, 22 bp, Homo sapiens
actggctgagttgcttcagcaa

SEQ ID NO: 8997892 - DNA, 22 bp, Homo sapiens
aataaaatggtcagttttctca

SEQ ID NO: 8997893 - DNA, 22 bp, Homo sapiens
actggctgagtttatgttcaca

SEQ ID NO: 8997894 - DNA, 22 bp, Homo sapiens
aataaggtgtgggtgctaatat

SEQ ID NO: 8997895 - DNA, 22 bp, Homo sapiens
aataaggtgtgggtgctaatat

SEQ ID NO: 8997896 - DNA, 22 bp, Homo sapiens
aataagctggagctatattgag

SEQ ID NO: 8997897 - DNA, 19 bp, Homo sapiens
aataagcttgggtaaaact

SEQ ID NO: 8997898 - DNA, 19 bp, Homo sapiens
aataagcttgggtaaaact

SEQ ID NO: 8997899 - DNA, 22 bp, Homo sapiens
aataagcaagcctgtgtgcaag

SEQ ID NO: 8997900 - DNA, 22 bp, Homo sapiens
aataagccagcccatgtgaccc

SEQ ID NO: 8997901 - DNA, 22 bp, Homo sapiens
aataagctggagctatattgag

SEQ ID NO: 8997902 - DNA, 22 bp, Homo sapiens
aataagctgctaggaacttagt

SEQ ID NO: 8997903 - DNA, 22 bp, Homo sapiens
aataagccagcccatgtgaccc

SEQ ID NO: 8997904 - DNA, 22 bp, Homo sapiens
aataagttgcctgttgaatcat

SEQ ID NO: 8997905 - DNA, 22 bp, Homo sapiens
aataataagatactaagggagt

SEQ ID NO: 8997906 - DNA, 22 bp, Homo sapiens
aataagttgcctgttgaatcat

SEQ ID NO: 8997907 - DNA, 22 bp, Homo sapiens
aataagtgatgatgagtcactc

SEQ ID NO: 8997908 - DNA, 22 bp, Homo sapiens
aataagtgatgatgagtcactc

SEQ ID NO: 8997909 - DNA, 22 bp, Homo sapiens
aataagtacttggggataactt

SEQ ID NO: 8997910 - DNA, 22 bp, Homo sapiens
aataagtgagtttagcaagttt

SEQ ID NO: 8997911 - DNA, 22 bp, Homo sapiens
aataagtacttggggataactt

SEQ ID NO: 8997912 - DNA, 22 bp, Homo sapiens
aataagtacttggggataactt

SEQ ID NO: 8997913 - DNA, 22 bp, Homo sapiens
actgggagttctccatgtccct

SEQ ID NO: 8997914 - DNA, 22 bp, Homo sapiens
actgggcaccatcatgagatag

SEQ ID NO: 8997915 - DNA, 22 bp, Homo sapiens
aataagcaagcctgtgtgcaag

SEQ ID NO: 8997916 - DNA, 22 bp, Homo sapiens
aataatagcagagtttacaatc

SEQ ID NO: 8997917 - DNA, 22 bp, Homo sapiens
aataatagcagagtttacaatc

SEQ ID NO: 8997918 - DNA, 22 bp, Homo sapiens
aataatacttcgtaaagttgtt

SEQ ID NO: 8997919 - DNA, 22 bp, Homo sapiens
aataatacttcgtaaagttgtt

SEQ ID NO: 8997920 - DNA, 22 bp, Homo sapiens
aataatagcagagtttacaatc

SEQ ID NO: 8997921 - DNA, 22 bp, Homo sapiens
aataatagcagagtttacaatc

SEQ ID NO: 8997922 - DNA, 22 bp, Homo sapiens
actggggaatggaactgggaat

SEQ ID NO: 8997923 - DNA, 22 bp, Homo sapiens
actggggagagtcatgccagca

SEQ ID NO: 8997924 - DNA, 22 bp, Homo sapiens
actggggagagtcatgccagca

SEQ ID NO: 8997925 - DNA, 22 bp, Homo sapiens
aataatagttgcaaagtgttta

SEQ ID NO: 8997926 - DNA, 22 bp, Homo sapiens
aataatacatgagattaatgtt

SEQ ID NO: 8997927 - DNA, 22 bp, Homo sapiens
aataatacatgagattaatgtt

SEQ ID NO: 8997928 - DNA, 22 bp, Homo sapiens
aataatacatgagattaatgtt

SEQ ID NO: 8997929 - DNA, 22 bp, Homo sapiens
aataatacatgagattaatgtt

SEQ ID NO: 8997930 - DNA, 22 bp, Homo sapiens
aataatacttcgtaaagttgtt

SEQ ID NO: 8997931 - DNA, 22 bp, Homo sapiens
aataatactgcatgtaaggtgc

SEQ ID NO: 8997932 - DNA, 22 bp, Homo sapiens
aataatactgcatgtaaggtgc

SEQ ID NO: 8997933 - DNA, 22 bp, Homo sapiens
aataataagatactaagggagt

SEQ ID NO: 8997934 - DNA, 22 bp, Homo sapiens
aataatacatgagattaatgtt

SEQ ID NO: 8997935 - DNA, 22 bp, Homo sapiens
aataatacatgagattaatgtt

SEQ ID NO: 8997936 - DNA, 22 bp, Homo sapiens
aataatacatgagattaatgtt

SEQ ID NO: 8997937 - DNA, 22 bp, Homo sapiens
aataatacatgagattaatgtt

SEQ ID NO: 8997938 - DNA, 22 bp, Homo sapiens
aagtgtggggtctcagagctga

SEQ ID NO: 8997939 - DNA, 22 bp, Homo sapiens
aagtgtgggaagttgctaaaat

SEQ ID NO: 8997940 - DNA, 22 bp, Homo sapiens
aagtgtgatttgtagaatgcct

SEQ ID NO: 8997941 - DNA, 22 bp, Homo sapiens
aagtgtgggaagtaggtggcga

SEQ ID NO: 8997942 - DNA, 22 bp, Homo sapiens
aagtgtgggaagtaggtggcga

SEQ ID NO: 8997943 - DNA, 22 bp, Homo sapiens
aagtgtgaattttagagtcagg

SEQ ID NO: 8997944 - DNA, 22 bp, Homo sapiens
aagtgtgacactgtgttaatta

SEQ ID NO: 8997945 - DNA, 22 bp, Homo sapiens
aagtgtgagacacacaaaatta

SEQ ID NO: 8997946 - DNA, 22 bp, Homo sapiens
aagtgtgagacacacaaaatta

SEQ ID NO: 8997947 - DNA, 22 bp, Homo sapiens
aagtgtctttatatttgagaaa

SEQ ID NO: 8997948 - DNA, 22 bp, Homo sapiens
aagtgtgaattttagagtcagg

SEQ ID NO: 8997949 - DNA, 22 bp, Homo sapiens
aagtgtcttttagccactttta

SEQ ID NO: 8997950 - DNA, 22 bp, Homo sapiens
aagtgtgttgactgaattgggg

SEQ ID NO: 8997951 - DNA, 22 bp, Homo sapiens
aagtgtgttgactgaattgggg

SEQ ID NO: 8997952 - DNA, 19 bp, Homo sapiens
aagtgtgttgagccaggat

SEQ ID NO: 8997953 - DNA, 22 bp, Homo sapiens
aagtgtgttttcagtgtactta

SEQ ID NO: 8997954 - DNA, 22 bp, Homo sapiens
aagtgtgtttccgtgattgagg

SEQ ID NO: 8997955 - DNA, 22 bp, Homo sapiens
aagtgtgtgggcaggcagtggt

SEQ ID NO: 8997956 - DNA, 22 bp, Homo sapiens
aagtgtgttctctgataaactc

SEQ ID NO: 8997957 - DNA, 22 bp, Homo sapiens
aagtgtgtgagcctgtcaggct

SEQ ID NO: 8997958 - DNA, 22 bp, Homo sapiens
aagtgtgtgagcctgtcaggct

SEQ ID NO: 8997959 - DNA, 22 bp, Homo sapiens
aagtgtgtattgtttatgctgc

SEQ ID NO: 8997960 - DNA, 22 bp, Homo sapiens
aagtgtggggtctcagagctga

SEQ ID NO: 8997961 - DNA, 22 bp, Homo sapiens
aagtgtggtttaggcatctttt

SEQ ID NO: 8997962 - DNA, 22 bp, Homo sapiens
aagtgtgtatttttcttcagtg

SEQ ID NO: 8997963 - DNA, 22 bp, Homo sapiens
aagtgtgtattgtttatgctgc

SEQ ID NO: 8997964 - DNA, 22 bp, Homo sapiens
aagtgtgtatttttcttcagtg

SEQ ID NO: 8997965 - DNA, 22 bp, Homo sapiens
aagtgtgggcagggcatttctg

SEQ ID NO: 8997966 - DNA, 22 bp, Homo sapiens
aagtgtgtatttttcttcagtg

SEQ ID NO: 8997967 - DNA, 22 bp, Homo sapiens
aagtgtgtcttgggaagggagg

SEQ ID NO: 8997968 - DNA, 22 bp, Homo sapiens
aagtgtgtctggcggcccagtg

SEQ ID NO: 8997969 - DNA, 22 bp, Homo sapiens
aagtgtctgcaaaatgacagag

SEQ ID NO: 8997970 - DNA, 22 bp, Homo sapiens
aagtgtctgctggctctaccct

SEQ ID NO: 8997971 - DNA, 22 bp, Homo sapiens
aagtgtctgcaaaatgacagag

SEQ ID NO: 8997972 - DNA, 22 bp, Homo sapiens
aagtgtctttatatttgagaaa

SEQ ID NO: 8997973 - DNA, 22 bp, Homo sapiens
aagtgtcttctgatggggtgtg

SEQ ID NO: 8997974 - DNA, 22 bp, Homo sapiens
aagtgtcttctgatggggtgtg

SEQ ID NO: 8997975 - DNA, 22 bp, Homo sapiens
aagtgtcttaactccttttggg

SEQ ID NO: 8997976 - DNA, 22 bp, Homo sapiens
aagtgtctgatggagcgaaatg

SEQ ID NO: 8997977 - DNA, 22 bp, Homo sapiens
aagtgtctgatggagcgaaatg

SEQ ID NO: 8997978 - DNA, 22 bp, Homo sapiens
aagtgtctgatggagcgaaatg

SEQ ID NO: 8997979 - DNA, 22 bp, Homo sapiens
aagtgtctgacacaaaatatgt

SEQ ID NO: 8997980 - DNA, 22 bp, Homo sapiens
aagtgtctgcaaaatgacagag

SEQ ID NO: 8997981 - DNA, 22 bp, Homo sapiens
aagtgtctgacacaaaatatgt

SEQ ID NO: 8997982 - DNA, 22 bp, Homo sapiens
aagtgtctgacacaaaatatgt

SEQ ID NO: 8997983 - DNA, 22 bp, Homo sapiens
acctgcctatggagccacatgg

SEQ ID NO: 8997984 - DNA, 22 bp, Homo sapiens
acctgcctatggagccacatgg

SEQ ID NO: 8997985 - DNA, 22 bp, Homo sapiens
acctgcctatggagccacatgg

SEQ ID NO: 8997986 - DNA, 22 bp, Homo sapiens
acctgcctcagtgcagctggat

SEQ ID NO: 8997987 - DNA, 22 bp, Homo sapiens
acctgcctcagtgcagctggat

SEQ ID NO: 8997988 - DNA, 22 bp, Homo sapiens
acctgcctcagtgcagctggat

SEQ ID NO: 8997989 - DNA, 22 bp, Homo sapiens
aagtgggtcagggacagatctt

SEQ ID NO: 8997990 - DNA, 22 bp, Homo sapiens
acctgcctctaagcagcaggtg

SEQ ID NO: 8997991 - DNA, 22 bp, Homo sapiens
aagtgttaaaagattaaatgct

SEQ ID NO: 8997992 - DNA, 22 bp, Homo sapiens
aagtgttacagaaacaaatgaa

SEQ ID NO: 8997993 - DNA, 22 bp, Homo sapiens
aagtgttaaagacttgaacact

SEQ ID NO: 8997994 - DNA, 22 bp, Homo sapiens
aagtgttagggtaaagttggta

SEQ ID NO: 8997995 - DNA, 22 bp, Homo sapiens
aagtgttctacactttgacctt

SEQ ID NO: 8997996 - DNA, 22 bp, Homo sapiens
aagtgttatgtaggatttcaga

SEQ ID NO: 8997997 - DNA, 22 bp, Homo sapiens
aagtgtttaaattatttgcagg

SEQ ID NO: 8997998 - DNA, 22 bp, Homo sapiens
aagtgtttaaattatttgcagg

SEQ ID NO: 8997999 - DNA, 22 bp, Homo sapiens
aagtgtttaaattatttgcagg

SEQ ID NO: 8998000 - DNA, 22 bp, Homo sapiens
aagtgtttaaattatttgcagg

SEQ ID NO: 8998001 - DNA, 22 bp, Homo sapiens
aagtgtttatggttattgttaa

SEQ ID NO: 8998002 - DNA, 22 bp, Homo sapiens
aagtgtttattgattggtctag

SEQ ID NO: 8998003 - DNA, 22 bp, Homo sapiens
aagtgtttattgattggtctag

SEQ ID NO: 8998004 - DNA, 22 bp, Homo sapiens
aagtgtttaacggtgattgagc

SEQ ID NO: 8998005 - DNA, 22 bp, Homo sapiens
aagtgtttatggttattgttaa

SEQ ID NO: 8998006 - DNA, 22 bp, Homo sapiens
aagtgtttatttataacgatct

SEQ ID NO: 8998007 - DNA, 22 bp, Homo sapiens
aagtgtttatttataacgatct

SEQ ID NO: 8998008 - DNA, 22 bp, Homo sapiens
aagtgtttatttataacgatct

SEQ ID NO: 8998009 - DNA, 22 bp, Homo sapiens
aagtgtttcaataatttggacc

SEQ ID NO: 8998010 - DNA, 22 bp, Homo sapiens
aagtgtttaatggttttgatga

SEQ ID NO: 8998011 - DNA, 22 bp, Homo sapiens
aagtgtttacttaaagtcatgg

SEQ ID NO: 8998012 - DNA, 22 bp, Homo sapiens
aagtgtttacttaaagtcatgg

SEQ ID NO: 8998013 - DNA, 22 bp, Homo sapiens
aagtgtttacttaaagtcatgg

SEQ ID NO: 8998014 - DNA, 22 bp, Homo sapiens
aagtgtttacttaaagtcatgg

SEQ ID NO: 8998015 - DNA, 22 bp, Homo sapiens
aagtgtttagagagggccttct

SEQ ID NO: 8998016 - DNA, 22 bp, Homo sapiens
aagtgtttacttaaagtcatgg

SEQ ID NO: 8998017 - DNA, 22 bp, Homo sapiens
aagtgtttaggtttgcagtcga

SEQ ID NO: 8998018 - DNA, 22 bp, Homo sapiens
aagtgtttaggtttgcagtcga

SEQ ID NO: 8998019 - DNA, 20 bp, Homo sapiens
actctttagaagggaaaaca

SEQ ID NO: 8998020 - DNA, 20 bp, Homo sapiens
actctttagaagggaaaaca

SEQ ID NO: 8998021 - DNA, 22 bp, Homo sapiens
actctttagaggtacatctctt

SEQ ID NO: 8998022 - DNA, 22 bp, Homo sapiens
actctttacttaaactctaagt

SEQ ID NO: 8998023 - DNA, 22 bp, Homo sapiens
actcttgtctcaacttttgtat

SEQ ID NO: 8998024 - DNA, 22 bp, Homo sapiens
actcttggccactcttggtgtc

SEQ ID NO: 8998025 - DNA, 22 bp, Homo sapiens
actcttgaactgattaagaatg

SEQ ID NO: 8998026 - DNA, 18 bp, Homo sapiens
actctgggacctgttatt

SEQ ID NO: 8998027 - DNA, 22 bp, Homo sapiens
actcttcttgctgctcattaat

SEQ ID NO: 8998028 - DNA, 22 bp, Homo sapiens
actctgggaatcctcaccttcc

SEQ ID NO: 8998029 - DNA, 22 bp, Homo sapiens
actctgggaatcctcaccttcc

SEQ ID NO: 8998030 - DNA, 22 bp, Homo sapiens
aagtgttttctccccaccaggc

SEQ ID NO: 8998031 - DNA, 22 bp, Homo sapiens
aagtgtttggggatcattttaa

SEQ ID NO: 8998032 - DNA, 22 bp, Homo sapiens
aagtgtttccattgtgcaggct

SEQ ID NO: 8998033 - DNA, 22 bp, Homo sapiens
aagtgtttggggatcattttaa

SEQ ID NO: 8998034 - DNA, 22 bp, Homo sapiens
aagtgtttcttggaatgttgcg

SEQ ID NO: 8998035 - DNA, 22 bp, Homo sapiens
aagtgtttccattgtgcaggct

SEQ ID NO: 8998036 - DNA, 22 bp, Homo sapiens
aagtgtttccgggagacttggt

SEQ ID NO: 8998037 - DNA, 22 bp, Homo sapiens
actgcaggccttggtgccagca

SEQ ID NO: 8998038 - DNA, 22 bp, Homo sapiens
actgcagtcatcatctccctgg

SEQ ID NO: 8998039 - DNA, 22 bp, Homo sapiens
actgcagtcatcatctccctgg

SEQ ID NO: 8998040 - DNA, 23 bp, Homo sapiens
actgcagtcttgatctcctgggc

SEQ ID NO: 8998041 - DNA, 22 bp, Homo sapiens
actgcaggtggatggcacttta

SEQ ID NO: 8998042 - DNA, 22 bp, Homo sapiens
actgcagggcatcctggccaag

SEQ ID NO: 8998043 - DNA, 22 bp, Homo sapiens
actgcagggcatcctggccaag

SEQ ID NO: 8998044 - DNA, 22 bp, Homo sapiens
actgcatgataataatagcaga

SEQ ID NO: 8998045 - DNA, 21 bp, Homo sapiens
actgcatctgaagtcccagga

SEQ ID NO: 8998046 - DNA, 22 bp, Homo sapiens
actgcatgctttacatgacatg

SEQ ID NO: 8998047 - DNA, 22 bp, Homo sapiens
actgcatgctttacatgacatg

SEQ ID NO: 8998048 - DNA, 21 bp, Homo sapiens
actgcatctgaagtcccagga

SEQ ID NO: 8998049 - DNA, 22 bp, Homo sapiens
actgcatctgaactgtgaatgg

SEQ ID NO: 8998050 - DNA, 22 bp, Homo sapiens
actgcatctgaaacatgggtca

SEQ ID NO: 8998051 - DNA, 22 bp, Homo sapiens
actgcatctgaaacatgggtca

SEQ ID NO: 8998052 - DNA, 22 bp, Homo sapiens
actgcatctgaactgtgaatgg

SEQ ID NO: 8998053 - DNA, 22 bp, Homo sapiens
actgcatgtaaggcaatatgtt

SEQ ID NO: 8998054 - DNA, 20 bp, Homo sapiens
aagttttctccaaatacagt

SEQ ID NO: 8998055 - DNA, 20 bp, Homo sapiens
aagttttctccaaatacagt

SEQ ID NO: 8998056 - DNA, 22 bp, Homo sapiens
aagttcctgggccaagtccagg

SEQ ID NO: 8998057 - DNA, 22 bp, Homo sapiens
aagttcctgggccaagtccagg

SEQ ID NO: 8998058 - DNA, 22 bp, Homo sapiens
aagttccttagccttagggctt

SEQ ID NO: 8998059 - DNA, 22 bp, Homo sapiens
aagttcctgttactccccagaa

SEQ ID NO: 8998060 - DNA, 22 bp, Homo sapiens
aagttccttgaatgaagctagg

SEQ ID NO: 8998061 - DNA, 22 bp, Homo sapiens
aagttctaacaggaggtctctt

SEQ ID NO: 8998062 - DNA, 22 bp, Homo sapiens
aagttcgtaggtgagctgctgc

SEQ ID NO: 8998063 - DNA, 22 bp, Homo sapiens
aagttcgaaatttagggagatg

SEQ ID NO: 8998064 - DNA, 22 bp, Homo sapiens
aagttctaacatctacgtggaa

SEQ ID NO: 8998065 - DNA, 22 bp, Homo sapiens
aagttctaacatctacgtggaa

SEQ ID NO: 8998066 - DNA, 22 bp, Homo sapiens
actgcactccagcctgggtgac

SEQ ID NO: 8998067 - DNA, 22 bp, Homo sapiens
aagttctaaggtgcattattct

SEQ ID NO: 8998068 - DNA, 22 bp, Homo sapiens
actgcactccagcctgggtgac

SEQ ID NO: 8998069 - DNA, 22 bp, Homo sapiens
actgcagccttgaactctgggc

SEQ ID NO: 8998070 - DNA, 22 bp, Homo sapiens
actgcagcctttgggctcataa

SEQ ID NO: 8998071 - DNA, 22 bp, Homo sapiens
actgcagccttgaactctgggc

SEQ ID NO: 8998072 - DNA, 22 bp, Homo sapiens
actgcaggagacacagctgctg

SEQ ID NO: 8998073 - DNA, 22 bp, Homo sapiens
actgcaggagacacagctgctg

SEQ ID NO: 8998074 - DNA, 22 bp, Homo sapiens
actgcaggagacacagctgctg

SEQ ID NO: 8998075 - DNA, 22 bp, Homo sapiens
actgcaggccttggtgccagca

SEQ ID NO: 8998076 - DNA, 22 bp, Homo sapiens
actcttttataaagcatcttga

SEQ ID NO: 8998077 - DNA, 22 bp, Homo sapiens
actctttattgtttgtggctag

SEQ ID NO: 8998078 - DNA, 22 bp, Homo sapiens
actctttagaggtacatctctt

SEQ ID NO: 8998079 - DNA, 22 bp, Homo sapiens
actctttagaggtacatctctt

SEQ ID NO: 8998080 - DNA, 18 bp, Homo sapiens
actctttctgcccacagg

SEQ ID NO: 8998081 - DNA, 18 bp, Homo sapiens
actctttctgcccacagg

SEQ ID NO: 8998082 - DNA, 18 bp, Homo sapiens
actctttctgcccacagg

SEQ ID NO: 8998083 - DNA, 18 bp, Homo sapiens
actctttctgcccacagg

SEQ ID NO: 8998084 - DNA, 22 bp, Homo sapiens
actgaaaaagacatcttggtaa

SEQ ID NO: 8998085 - DNA, 22 bp, Homo sapiens
actgaaaaagtatgattcactg

SEQ ID NO: 8998086 - DNA, 22 bp, Homo sapiens
actgaaaaagacatcttggtaa

SEQ ID NO: 8998087 - DNA, 22 bp, Homo sapiens
actgaaaaagacatcttggtaa

SEQ ID NO: 8998088 - DNA, 22 bp, Homo sapiens
actgaaaaagtatgattcactg

SEQ ID NO: 8998089 - DNA, 22 bp, Homo sapiens
actgaaaaagtatgattcactg

SEQ ID NO: 8998090 - DNA, 22 bp, Homo sapiens
actgaaaaagtatgattcactg

SEQ ID NO: 8998091 - DNA, 22 bp, Homo sapiens
actgaaaatgaattagaaacag

SEQ ID NO: 8998092 - DNA, 22 bp, Homo sapiens
aagttcaaggctctagagttcc

SEQ ID NO: 8998093 - DNA, 22 bp, Homo sapiens
actgaaaatgaattagaaacag

SEQ ID NO: 8998094 - DNA, 22 bp, Homo sapiens
aagttcaagtagtgttacatgg

SEQ ID NO: 8998095 - DNA, 22 bp, Homo sapiens
aagttcaagtctcctgagtata

SEQ ID NO: 8998096 - DNA, 22 bp, Homo sapiens
aagttcaagtctcctgagtata

SEQ ID NO: 8998097 - DNA, 23 bp, Homo sapiens
aagttcaagtcacagcctgtctt

SEQ ID NO: 8998098 - DNA, 22 bp, Homo sapiens
aagttcaatcagatgaaaaagc

SEQ ID NO: 8998099 - DNA, 22 bp, Homo sapiens
aagttcaagtgtaatctttatt

SEQ ID NO: 8998100 - DNA, 22 bp, Homo sapiens
aagttcactaagaccatagaat

SEQ ID NO: 8998101 - DNA, 22 bp, Homo sapiens
aagttcatcaaagagtaaatat

SEQ ID NO: 8998102 - DNA, 22 bp, Homo sapiens
aagttcatcaaagagtaaatat

SEQ ID NO: 8998103 - DNA, 18 bp, Homo sapiens
aagttccacaagagatct

SEQ ID NO: 8998104 - DNA, 18 bp, Homo sapiens
aagttccacaagagatct

SEQ ID NO: 8998105 - DNA, 22 bp, Homo sapiens
aagttcctaaagtcaggggtca

SEQ ID NO: 8998106 - DNA, 22 bp, Homo sapiens
aagttccctttctttgccagga

SEQ ID NO: 8998107 - DNA, 22 bp, Homo sapiens
aagttccctttctttgccagga

SEQ ID NO: 8998108 - DNA, 22 bp, Homo sapiens
aagttcctcttctctgcaggga

SEQ ID NO: 8998109 - DNA, 22 bp, Homo sapiens
aagttcctcaaataaaacatga

SEQ ID NO: 8998110 - DNA, 22 bp, Homo sapiens
aagttcctatatccaaatacag

SEQ ID NO: 8998111 - DNA, 22 bp, Homo sapiens
aagttcctcttctctgcaggga

SEQ ID NO: 8998112 - DNA, 22 bp, Homo sapiens
aagttcctcttctctgcaggga

SEQ ID NO: 8998113 - DNA, 19 bp, Homo sapiens
aatgcctcaaattgggaga

SEQ ID NO: 8998114 - DNA, 22 bp, Homo sapiens
aatgcccccaggcctggaggag

SEQ ID NO: 8998115 - DNA, 22 bp, Homo sapiens
aatgccatctggtgatgtatta

SEQ ID NO: 8998116 - DNA, 22 bp, Homo sapiens
aatgccttcccatttatacttt

SEQ ID NO: 8998117 - DNA, 22 bp, Homo sapiens
aatgccaacttggatatacatt

SEQ ID NO: 8998118 - DNA, 22 bp, Homo sapiens
aatgccaacttggatatacatt

SEQ ID NO: 8998119 - DNA, 22 bp, Homo sapiens
aatgcattttattatatgtgac

SEQ ID NO: 8998120 - DNA, 18 bp, Homo sapiens
aatgcatttatggagatg

SEQ ID NO: 8998121 - DNA, 22 bp, Homo sapiens
aatgccaatgggcagaactaga

SEQ ID NO: 8998122 - DNA, 22 bp, Homo sapiens
aatgccaatgggcagaactaga

SEQ ID NO: 8998123 - DNA, 22 bp, Homo sapiens
aatgccactaaatctgtgaata

SEQ ID NO: 8998124 - DNA, 21 bp, Homo sapiens
aatgccagtcccagggaatgc

SEQ ID NO: 8998125 - DNA, 21 bp, Homo sapiens
aatgccagtcccagggaatgc

SEQ ID NO: 8998126 - DNA, 22 bp, Homo sapiens
aatgccatcagagaaaactctt

SEQ ID NO: 8998127 - DNA, 22 bp, Homo sapiens
aatgccatccctctgtcaccaa

SEQ ID NO: 8998128 - DNA, 22 bp, Homo sapiens
aatgcacaaaggtgtctattgc

SEQ ID NO: 8998129 - DNA, 22 bp, Homo sapiens
aatgcacaaaggtgtctattgc

SEQ ID NO: 8998130 - DNA, 22 bp, Homo sapiens
aatgcacaaaggtgtctattgc

SEQ ID NO: 8998131 - DNA, 22 bp, Homo sapiens
aatgcatacgtgtttgtggcaa

SEQ ID NO: 8998132 - DNA, 22 bp, Homo sapiens
aatgcatacgtgtttgtggcaa

SEQ ID NO: 8998133 - DNA, 22 bp, Homo sapiens
aatgcatacgtgtttgtggcaa

SEQ ID NO: 8998134 - DNA, 22 bp, Homo sapiens
aatgcataccatgtcatctttg

SEQ ID NO: 8998135 - DNA, 22 bp, Homo sapiens
aatgcataccatgtcatctttg

SEQ ID NO: 8998136 - DNA, 22 bp, Homo sapiens
aatgcatcagaaatgtgtataa

SEQ ID NO: 8998137 - DNA, 22 bp, Homo sapiens
aatgcatcagaaatgtgtataa

SEQ ID NO: 8998138 - DNA, 22 bp, Homo sapiens
aatgcatatgtaggcaagcagt

SEQ ID NO: 8998139 - DNA, 22 bp, Homo sapiens
aatgcatccctgccaatgcttt

SEQ ID NO: 8998140 - DNA, 22 bp, Homo sapiens
aatgcatccctgccaatgcttt

SEQ ID NO: 8998141 - DNA, 22 bp, Homo sapiens
aatgcattaaagttagagactt

SEQ ID NO: 8998142 - DNA, 22 bp, Homo sapiens
aatgcattaaagttagagactt

SEQ ID NO: 8998143 - DNA, 22 bp, Homo sapiens
aatgcattaaagttagagactt

SEQ ID NO: 8998144 - DNA, 22 bp, Homo sapiens
aatgcattctttcatggacctg

SEQ ID NO: 8998145 - DNA, 22 bp, Homo sapiens
aatgcattagctacatatgtct

SEQ ID NO: 8998146 - DNA, 22 bp, Homo sapiens
aatgcattccactgagatttgt

SEQ ID NO: 8998147 - DNA, 22 bp, Homo sapiens
aatgcattccactgagatttgt

SEQ ID NO: 8998148 - DNA, 22 bp, Homo sapiens
aatgcattagctacatatgtct

SEQ ID NO: 8998149 - DNA, 22 bp, Homo sapiens
aatgcattagctacatatgtct

SEQ ID NO: 8998150 - DNA, 23 bp, Homo sapiens
aatgcattaatttgggagagtac

SEQ ID NO: 8998151 - DNA, 21 bp, Homo sapiens
aatgcattaacataaagctga

SEQ ID NO: 8998152 - DNA, 21 bp, Homo sapiens
aatgcattaacataaagctga

SEQ ID NO: 8998153 - DNA, 21 bp, Homo sapiens
aatgcattaacataaagctga

SEQ ID NO: 8998154 - DNA, 21 bp, Homo sapiens
aatgcattaacataaagctga

SEQ ID NO: 8998155 - DNA, 22 bp, Homo sapiens
agaagccagcttcagctgcccg

SEQ ID NO: 8998156 - DNA, 22 bp, Homo sapiens
agaagccagtcgctctcccgca

SEQ ID NO: 8998157 - DNA, 22 bp, Homo sapiens
agaagccagtcgctctcccgca

SEQ ID NO: 8998158 - DNA, 22 bp, Homo sapiens
agaagccagcttcagctgcccg

SEQ ID NO: 8998159 - DNA, 22 bp, Homo sapiens
agaagccagccttgcctccttt

SEQ ID NO: 8998160 - DNA, 22 bp, Homo sapiens
agaagccagcttcagctgcccg

SEQ ID NO: 8998161 - DNA, 22 bp, Homo sapiens
agaagccagccttgcctccttt

SEQ ID NO: 8998162 - DNA, 22 bp, Homo sapiens
agaagccagattgtagtgggac

SEQ ID NO: 8998163 - DNA, 22 bp, Homo sapiens
agaagccagattgtagtgggac

SEQ ID NO: 8998164 - DNA, 22 bp, Homo sapiens
agaagccagattgtagtgggac

SEQ ID NO: 8998165 - DNA, 22 bp, Homo sapiens
agaagccagaggcagtgggtac

SEQ ID NO: 8998166 - DNA, 22 bp, Homo sapiens
agaagccagaggcagtgggtac

SEQ ID NO: 8998167 - DNA, 22 bp, Homo sapiens
agaagcttgaaggagcagtgac

SEQ ID NO: 8998168 - DNA, 22 bp, Homo sapiens
agaagcttgaaggagcagtgac

SEQ ID NO: 8998169 - DNA, 22 bp, Homo sapiens
agaagcttccacggatgtgtct

SEQ ID NO: 8998170 - DNA, 22 bp, Homo sapiens
agaagctgttgcattcctggcg

SEQ ID NO: 8998171 - DNA, 22 bp, Homo sapiens
agaagctgttgcattcctggcg

SEQ ID NO: 8998172 - DNA, 22 bp, Homo sapiens
agaagctgtggtatgaaatgtg

SEQ ID NO: 8998173 - DNA, 22 bp, Homo sapiens
agaagccagtcgctctcccgca

SEQ ID NO: 8998174 - DNA, 22 bp, Homo sapiens
agaagcttcaagatatttggta

SEQ ID NO: 8998175 - DNA, 22 bp, Homo sapiens
agaaggaaaacctgtcttatgt

SEQ ID NO: 8998176 - DNA, 22 bp, Homo sapiens
agaaggaaaacctgtcttatgt

SEQ ID NO: 8998177 - DNA, 22 bp, Homo sapiens
agaaggaaaacctgtcttatgt

SEQ ID NO: 8998178 - DNA, 22 bp, Homo sapiens
agaaggaaaacctgtcttatgt

SEQ ID NO: 8998179 - DNA, 22 bp, Homo sapiens
agaaggaaacagctgtgctttg

SEQ ID NO: 8998180 - DNA, 22 bp, Homo sapiens
agaaggaaggctgagtgctgat

SEQ ID NO: 8998181 - DNA, 22 bp, Homo sapiens
agaaggaaggataactgcatta

SEQ ID NO: 8998182 - DNA, 22 bp, Homo sapiens
agaaggaaggataactgcatta

SEQ ID NO: 8998183 - DNA, 22 bp, Homo sapiens
agaaggaaggataactgcatta

SEQ ID NO: 8998184 - DNA, 22 bp, Homo sapiens
agaaggaaggctgagtgctgat

SEQ ID NO: 8998185 - DNA, 22 bp, Homo sapiens
agaaggaaggctgagtgctgat

SEQ ID NO: 8998186 - DNA, 22 bp, Homo sapiens
agaaggaaggctgagtgctgat

SEQ ID NO: 8998187 - DNA, 22 bp, Homo sapiens
agaaggactttgtagggttgtt

SEQ ID NO: 8998188 - DNA, 18 bp, Homo sapiens
aatgcaatgtatttgcag

SEQ ID NO: 8998189 - DNA, 22 bp, Homo sapiens
aatgcacaaaaattgtatgtaa

SEQ ID NO: 8998190 - DNA, 22 bp, Homo sapiens
aatgcacaaaaattgtatgtaa

SEQ ID NO: 8998191 - DNA, 22 bp, Homo sapiens
aatgcacaaaaattgtatgtaa

SEQ ID NO: 8998192 - DNA, 22 bp, Homo sapiens
agaaggaaggaagcattctgtt

SEQ ID NO: 8998193 - DNA, 22 bp, Homo sapiens
agaaggaaggaagcattctgtt

SEQ ID NO: 8998194 - DNA, 22 bp, Homo sapiens
agaaggaaggaagcattctgtt

SEQ ID NO: 8998195 - DNA, 22 bp, Homo sapiens
agaaggaaggaagcattctgtt

SEQ ID NO: 8998196 - DNA, 22 bp, Homo sapiens
agaaggaagccaggagggtgca

SEQ ID NO: 8998197 - DNA, 22 bp, Homo sapiens
agaaggaagccaggagggtgca

SEQ ID NO: 8998198 - DNA, 22 bp, Homo sapiens
agaaggaaacagctgtgctttg

SEQ ID NO: 8998199 - DNA, 22 bp, Homo sapiens
agaaggaagccaggagggtgca

SEQ ID NO: 8998200 - DNA, 22 bp, Homo sapiens
agaaggaaacagctgtgctttg

SEQ ID NO: 8998201 - DNA, 22 bp, Homo sapiens
agaaggaagccaggagggtgca

SEQ ID NO: 8998202 - DNA, 22 bp, Homo sapiens
agaagaaagattgaaggttcct

SEQ ID NO: 8998203 - DNA, 22 bp, Homo sapiens
agaagaaagattgaaggttcct

SEQ ID NO: 8998204 - DNA, 22 bp, Homo sapiens
agaagaaactgtcggggatatt

SEQ ID NO: 8998205 - DNA, 22 bp, Homo sapiens
aatgaagaaatggacatcttta

SEQ ID NO: 8998206 - DNA, 22 bp, Homo sapiens
aatgaagaaatggacatcttta

SEQ ID NO: 8998207 - DNA, 22 bp, Homo sapiens
aatgaagaaatggacatcttta

SEQ ID NO: 8998208 - DNA, 22 bp, Homo sapiens
aatgaactggagaacaatgacc

SEQ ID NO: 8998209 - DNA, 22 bp, Homo sapiens
aatgaactgtgttaactgaata

SEQ ID NO: 8998210 - DNA, 22 bp, Homo sapiens
agaagaaagattgaaggttcct

SEQ ID NO: 8998211 - DNA, 22 bp, Homo sapiens
agaacttttggagacttttagt

SEQ ID NO: 8998212 - DNA, 22 bp, Homo sapiens
agaacttttggagacttttagt

SEQ ID NO: 8998213 - DNA, 22 bp, Homo sapiens
agaacttttggagacttttagt

SEQ ID NO: 8998214 - DNA, 22 bp, Homo sapiens
agaacttcagcaaaaccagtta

SEQ ID NO: 8998215 - DNA, 22 bp, Homo sapiens
agaacttaggaacaacagctta

SEQ ID NO: 8998216 - DNA, 22 bp, Homo sapiens
agaagaaactgtcggggatatt

SEQ ID NO: 8998217 - DNA, 22 bp, Homo sapiens
agaagaaactgtcggggatatt

SEQ ID NO: 8998218 - DNA, 22 bp, Homo sapiens
agaacttaggaacaacagctta

SEQ ID NO: 8998219 - DNA, 22 bp, Homo sapiens
agaacttacattatagagctgt

SEQ ID NO: 8998220 - DNA, 20 bp, Homo sapiens
agaactgttgtttgggtcct

SEQ ID NO: 8998221 - DNA, 22 bp, Homo sapiens
agaacttaattcagtgacttaa

SEQ ID NO: 8998222 - DNA, 22 bp, Homo sapiens
agaactgtccttggaggagagt

SEQ ID NO: 8998223 - DNA, 17 bp, Homo sapiens
agaactgtagtagctcc

SEQ ID NO: 8998224 - DNA, 19 bp, Homo sapiens
agaactgggtccatggctt

SEQ ID NO: 8998225 - DNA, 22 bp, Homo sapiens
agaactgtcacgagtgacaaag

SEQ ID NO: 8998226 - DNA, 22 bp, Homo sapiens
agaactgtcacgagtgacaaag

SEQ ID NO: 8998227 - DNA, 22 bp, Homo sapiens
agaactctatattcatgaacaa

SEQ ID NO: 8998228 - DNA, 22 bp, Homo sapiens
agaactctaggattggctggat

SEQ ID NO: 8998229 - DNA, 22 bp, Homo sapiens
agaactctcgctggatcagact

SEQ ID NO: 8998230 - DNA, 22 bp, Homo sapiens
agaactctgaacactgtctgga

SEQ ID NO: 8998231 - DNA, 22 bp, Homo sapiens
agaactctttatctgtggaatg

SEQ ID NO: 8998232 - DNA, 22 bp, Homo sapiens
agaactctttatctgtggaatg

SEQ ID NO: 8998233 - DNA, 20 bp, Homo sapiens
agaactgaatcattttgggt

SEQ ID NO: 8998234 - DNA, 22 bp, Homo sapiens
agaactgatttgaaggttgggg

SEQ ID NO: 8998235 - DNA, 22 bp, Homo sapiens
agaacgctattcagaacactgg

SEQ ID NO: 8998236 - DNA, 22 bp, Homo sapiens
agaacgtggaatgtggctcctt

SEQ ID NO: 8998237 - DNA, 22 bp, Homo sapiens
agaacggcttggttggcattgt

SEQ ID NO: 8998238 - DNA, 22 bp, Homo sapiens
agaactattgcaataacaagaa

SEQ ID NO: 8998239 - DNA, 22 bp, Homo sapiens
agaacacacgtcagagtttcct

SEQ ID NO: 8998240 - DNA, 22 bp, Homo sapiens
agaacaattgccccaaagcttg

SEQ ID NO: 8998241 - DNA, 22 bp, Homo sapiens
agaacacacgtcagagtttcct

SEQ ID NO: 8998242 - DNA, 22 bp, Homo sapiens
agaacacactgggggaaacaag

SEQ ID NO: 8998243 - DNA, 22 bp, Homo sapiens
agaacacacgtcagagtttcct

SEQ ID NO: 8998244 - DNA, 22 bp, Homo sapiens
agaacacactgggggaaacaag

SEQ ID NO: 8998245 - DNA, 22 bp, Homo sapiens
agaacacactgggggaaacaag

SEQ ID NO: 8998246 - DNA, 22 bp, Homo sapiens
aatgaagcagtccatctgctct

SEQ ID NO: 8998247 - DNA, 22 bp, Homo sapiens
aatgaagcagtccatctgctct

SEQ ID NO: 8998248 - DNA, 22 bp, Homo sapiens
aatgaagccaggtagaagagaa

SEQ ID NO: 8998249 - DNA, 22 bp, Homo sapiens
aatgaagccagctgggatgcga

SEQ ID NO: 8998250 - DNA, 22 bp, Homo sapiens
aatgaagataaaatgggatgga

SEQ ID NO: 8998251 - DNA, 22 bp, Homo sapiens
aatgaagataaaatgggatgga

SEQ ID NO: 8998252 - DNA, 22 bp, Homo sapiens
aatgaagacacatctttctcat

SEQ ID NO: 8998253 - DNA, 22 bp, Homo sapiens
aatgaagacacatctttctcat

SEQ ID NO: 8998254 - DNA, 22 bp, Homo sapiens
aatgaagataaaatgggatgga

SEQ ID NO: 8998255 - DNA, 22 bp, Homo sapiens
aatgaagattatggtgattaag

SEQ ID NO: 8998256 - DNA, 22 bp, Homo sapiens
aatgaagattatggtgattaag

SEQ ID NO: 8998257 - DNA, 22 bp, Homo sapiens
aatgaagaaatggacatcttta

SEQ ID NO: 8998258 - DNA, 22 bp, Homo sapiens
aatgaagaaatggacatcttta

SEQ ID NO: 8998259 - DNA, 22 bp, Homo sapiens
aatgaagaaatggacatcttta

SEQ ID NO: 8998260 - DNA, 22 bp, Homo sapiens
aatgaagttctattcattttct

SEQ ID NO: 8998261 - DNA, 22 bp, Homo sapiens
aatgaagttctattcattttct

SEQ ID NO: 8998262 - DNA, 22 bp, Homo sapiens
aatgaagttctattcattttct

SEQ ID NO: 8998263 - DNA, 20 bp, Homo sapiens
aatgaagttattaatgatgt

SEQ ID NO: 8998264 - DNA, 22 bp, Homo sapiens
aatgaataccgtttcactcagt

SEQ ID NO: 8998265 - DNA, 22 bp, Homo sapiens
aatgaataccgtttcactcagt

SEQ ID NO: 8998266 - DNA, 22 bp, Homo sapiens
aatgaataccgtttcactcagt

SEQ ID NO: 8998267 - DNA, 22 bp, Homo sapiens
aatgaataccgtttcactcagt

SEQ ID NO: 8998268 - DNA, 22 bp, Homo sapiens
aatgaataccgtttcactcagt

SEQ ID NO: 8998269 - DNA, 22 bp, Homo sapiens
aatgaagtgtttagaagtttta

SEQ ID NO: 8998270 - DNA, 20 bp, Homo sapiens
aatgaagttattaatgatgt

SEQ ID NO: 8998271 - DNA, 20 bp, Homo sapiens
aatgaagttattaatgatgt

SEQ ID NO: 8998272 - DNA, 22 bp, Homo sapiens
aatgaagtgttatttagtttca

SEQ ID NO: 8998273 - DNA, 22 bp, Homo sapiens
aatgaagtgttatttagtttca

SEQ ID NO: 8998274 - DNA, 22 bp, Homo sapiens
aatgaagtgttatttagtttca

SEQ ID NO: 8998275 - DNA, 21 bp, Homo sapiens
aatgaagtggctattttgagg

SEQ ID NO: 8998276 - DNA, 21 bp, Homo sapiens
aatgaagtggctattttgagg

SEQ ID NO: 8998277 - DNA, 20 bp, Homo sapiens
aatgaatgaacgaatggatg

SEQ ID NO: 8998278 - DNA, 17 bp, Homo sapiens
aatgaatgaattctttg

SEQ ID NO: 8998279 - DNA, 22 bp, Homo sapiens
agaagcagctttcaaggtgatt

SEQ ID NO: 8998280 - DNA, 22 bp, Homo sapiens
aatgaatgggtttaatatttta

SEQ ID NO: 8998281 - DNA, 22 bp, Homo sapiens
aatgaataccgtttcactcagt

SEQ ID NO: 8998282 - DNA, 22 bp, Homo sapiens
aatgaatgaaccacatataaca

SEQ ID NO: 8998283 - DNA, 22 bp, Homo sapiens
aatgaatgaaccacatataaca

SEQ ID NO: 8998284 - DNA, 22 bp, Homo sapiens
agaagcagctttcaaggtgatt

SEQ ID NO: 8998285 - DNA, 22 bp, Homo sapiens
agaagcagctttcaaggtgatt

SEQ ID NO: 8998286 - DNA, 22 bp, Homo sapiens
agaagcagctttcaaggtgatt

SEQ ID NO: 8998287 - DNA, 22 bp, Homo sapiens
agaagccaccagctgaggaaga

SEQ ID NO: 8998288 - DNA, 22 bp, Homo sapiens
agaagccaccagctgaggaaga

SEQ ID NO: 8998289 - DNA, 22 bp, Homo sapiens
agaagccactggaggttgagat

SEQ ID NO: 8998290 - DNA, 22 bp, Homo sapiens
agaagccagaatattcatggat

SEQ ID NO: 8998291 - DNA, 22 bp, Homo sapiens
agaagccagaggcagtgggtac

SEQ ID NO: 8998292 - DNA, 22 bp, Homo sapiens
agaagccagaggcagtgggtac

SEQ ID NO: 8998293 - DNA, 22 bp, Homo sapiens
agaagccactggaggttgagat

SEQ ID NO: 8998294 - DNA, 22 bp, Homo sapiens
agaagccagaatattcatggat

SEQ ID NO: 8998295 - DNA, 22 bp, Homo sapiens
agaagccaccagctgaggaaga

SEQ ID NO: 8998296 - DNA, 22 bp, Homo sapiens
agaagccaccagctgaggaaga

SEQ ID NO: 8998297 - DNA, 18 bp, Homo sapiens
agaagccacgaggagtcc

SEQ ID NO: 8998298 - DNA, 22 bp, Homo sapiens
agaagccactgctcccagtgag

SEQ ID NO: 8998299 - DNA, 22 bp, Homo sapiens
agaagccactggaggttgagat

SEQ ID NO: 8998300 - DNA, 22 bp, Homo sapiens
agaagccactgctcccagtgag

SEQ ID NO: 8998301 - DNA, 22 bp, Homo sapiens
agaaaggcaatattaactacac

SEQ ID NO: 8998302 - DNA, 22 bp, Homo sapiens
agaaaggattagtttggtataa

SEQ ID NO: 8998303 - DNA, 22 bp, Homo sapiens
agaaaggcaatattaactacac

SEQ ID NO: 8998304 - DNA, 22 bp, Homo sapiens
agaaaggattagtttggtataa

SEQ ID NO: 8998305 - DNA, 22 bp, Homo sapiens
agaaaggaggaagaatgacctc

SEQ ID NO: 8998306 - DNA, 22 bp, Homo sapiens
agaaaggaggaagaatgacctc

SEQ ID NO: 8998307 - DNA, 22 bp, Homo sapiens
agaaaggaggaagaatgacctc

SEQ ID NO: 8998308 - DNA, 22 bp, Homo sapiens
agaaaggaggaagaatgacctc

SEQ ID NO: 8998309 - DNA, 22 bp, Homo sapiens
agaaaggaggaagaatgacctc

SEQ ID NO: 8998310 - DNA, 22 bp, Homo sapiens
agaaaggagaccagctctgccc

SEQ ID NO: 8998311 - DNA, 22 bp, Homo sapiens
agaaaggagaccagctctgccc

SEQ ID NO: 8998312 - DNA, 22 bp, Homo sapiens
agaaaggagaccagctctgccc

SEQ ID NO: 8998313 - DNA, 22 bp, Homo sapiens
agaaaggagcaccgtgggggat

SEQ ID NO: 8998314 - DNA, 22 bp, Homo sapiens
agaaaggagcaccgtgggggat

SEQ ID NO: 8998315 - DNA, 22 bp, Homo sapiens
agaaaggacatctccctttaag

SEQ ID NO: 8998316 - DNA, 22 bp, Homo sapiens
agaaaggacatctccctttaag

SEQ ID NO: 8998317 - DNA, 22 bp, Homo sapiens
agaaaggacatctccctttaag

SEQ ID NO: 8998318 - DNA, 22 bp, Homo sapiens
agaaaggaagggaggagtttat

SEQ ID NO: 8998319 - DNA, 22 bp, Homo sapiens
agaaagcttatgaatgggcaag

SEQ ID NO: 8998320 - DNA, 22 bp, Homo sapiens
agaaagcttatgaatgggcaag

SEQ ID NO: 8998321 - DNA, 22 bp, Homo sapiens
agaaagcttatgaatgggcaag

SEQ ID NO: 8998322 - DNA, 22 bp, Homo sapiens
agaaagctggagtcaagcagag

SEQ ID NO: 8998323 - DNA, 22 bp, Homo sapiens
agaaagctggagtcaagcagag

SEQ ID NO: 8998324 - DNA, 22 bp, Homo sapiens
agaaagctggagtcaagcagag

SEQ ID NO: 8998325 - DNA, 22 bp, Homo sapiens
agaaactgaattatttctgagg

SEQ ID NO: 8998326 - DNA, 22 bp, Homo sapiens
aatcacatctcattcaacagcc

SEQ ID NO: 8998327 - DNA, 22 bp, Homo sapiens
aatcacatagccatctctttga

SEQ ID NO: 8998328 - DNA, 22 bp, Homo sapiens
aatcacagttagtaagggagaa

SEQ ID NO: 8998329 - DNA, 22 bp, Homo sapiens
aatcacagtgggtactagattg

SEQ ID NO: 8998330 - DNA, 20 bp, Homo sapiens
aatcacagttaactctttct

SEQ ID NO: 8998331 - DNA, 20 bp, Homo sapiens
aatcacagttaactctttct

SEQ ID NO: 8998332 - DNA, 22 bp, Homo sapiens
aatcacaggcatagattgctcc

SEQ ID NO: 8998333 - DNA, 22 bp, Homo sapiens
aatcacaaatttagacagagct

SEQ ID NO: 8998334 - DNA, 22 bp, Homo sapiens
aatcacaaatttagacagagct

SEQ ID NO: 8998335 - DNA, 22 bp, Homo sapiens
aatcacaaatttagacagagct

SEQ ID NO: 8998336 - DNA, 22 bp, Homo sapiens
aatcacaattacttttgcacca

SEQ ID NO: 8998337 - DNA, 22 bp, Homo sapiens
aatcacaaatttagacagagct

SEQ ID NO: 8998338 - DNA, 22 bp, Homo sapiens
aatcacaaatgcaagttgtcac

SEQ ID NO: 8998339 - DNA, 22 bp, Homo sapiens
aatcacaaatgcaagttgtcac

SEQ ID NO: 8998340 - DNA, 22 bp, Homo sapiens
aatcacaaatgcaagttgtcac

SEQ ID NO: 8998341 - DNA, 23 bp, Homo sapiens
aatcaagttttgatgaggaagcc

SEQ ID NO: 8998342 - DNA, 22 bp, Homo sapiens
aatcacaaatgcaagttgtcac

SEQ ID NO: 8998343 - DNA, 22 bp, Homo sapiens
aatcacacaaaggcaacttttg

SEQ ID NO: 8998344 - DNA, 22 bp, Homo sapiens
aatcacaattacttttgcacca

SEQ ID NO: 8998345 - DNA, 22 bp, Homo sapiens
aatcacaattacttttgcacca

SEQ ID NO: 8998346 - DNA, 22 bp, Homo sapiens
aatcacagagtccagcagatga

SEQ ID NO: 8998347 - DNA, 22 bp, Homo sapiens
aatcacagccacaacctggggg

SEQ ID NO: 8998348 - DNA, 22 bp, Homo sapiens
agaaagggaactggcaaagcca

SEQ ID NO: 8998349 - DNA, 22 bp, Homo sapiens
agaaagggaactggcaaagcca

SEQ ID NO: 8998350 - DNA, 22 bp, Homo sapiens
agaaagggaactggcaaagcca

SEQ ID NO: 8998351 - DNA, 22 bp, Homo sapiens
agaaaggattagtttggtataa

SEQ ID NO: 8998352 - DNA, 22 bp, Homo sapiens
agaaaggcagggatgaggattg

SEQ ID NO: 8998353 - DNA, 22 bp, Homo sapiens
agaaagggaactggcaaagcca

SEQ ID NO: 8998354 - DNA, 22 bp, Homo sapiens
agaaagggaactggcaaagcca

SEQ ID NO: 8998355 - DNA, 22 bp, Homo sapiens
agaaagggagagccagcacacg

SEQ ID NO: 8998356 - DNA, 22 bp, Homo sapiens
agaaagggagagccagcacacg

SEQ ID NO: 8998357 - DNA, 22 bp, Homo sapiens
agaaagggagcgtggatcaatt

SEQ ID NO: 8998358 - DNA, 22 bp, Homo sapiens
agaaagggagcgtggatcaatt

SEQ ID NO: 8998359 - DNA, 22 bp, Homo sapiens
aatcctttgcactagaggtcca

SEQ ID NO: 8998360 - DNA, 22 bp, Homo sapiens
aatccttactgaatgagaaaaa

SEQ ID NO: 8998361 - DNA, 22 bp, Homo sapiens
aatcctgtcttgccatccaata

SEQ ID NO: 8998362 - DNA, 22 bp, Homo sapiens
aatcctgtgtgactctggggag

SEQ ID NO: 8998363 - DNA, 22 bp, Homo sapiens
aatcgcttggtaattttaaaag

SEQ ID NO: 8998364 - DNA, 22 bp, Homo sapiens
aatcgcttggtaattttaaaag

SEQ ID NO: 8998365 - DNA, 22 bp, Homo sapiens
aatcgcttggtaattttaaaag

SEQ ID NO: 8998366 - DNA, 22 bp, Homo sapiens
aatcctgtagattctaattcct

SEQ ID NO: 8998367 - DNA, 22 bp, Homo sapiens
agaaagggatgaggtagctgct

SEQ ID NO: 8998368 - DNA, 22 bp, Homo sapiens
agaaagggatgaggtagctgct

SEQ ID NO: 8998369 - DNA, 22 bp, Homo sapiens
aatctagagacaatttgaatat

SEQ ID NO: 8998370 - DNA, 22 bp, Homo sapiens
aatctagagaactgtggggcag

SEQ ID NO: 8998371 - DNA, 22 bp, Homo sapiens
aatctagaattttaggggtata

SEQ ID NO: 8998372 - DNA, 23 bp, Homo sapiens
aatctagaatgacctactcatct

SEQ ID NO: 8998373 - DNA, 22 bp, Homo sapiens
aatctagagtgctaggtctgtg

SEQ ID NO: 8998374 - DNA, 22 bp, Homo sapiens
aatctagagtgctaggtctgtg

SEQ ID NO: 8998375 - DNA, 22 bp, Homo sapiens
aatctagattcggatcaaaggg

SEQ ID NO: 8998376 - DNA, 22 bp, Homo sapiens
aatctagattcggatcaaaggg

SEQ ID NO: 8998377 - DNA, 22 bp, Homo sapiens
aatctagagttcccagcataaa

SEQ ID NO: 8998378 - DNA, 22 bp, Homo sapiens
aatctagagttcccagcataaa

SEQ ID NO: 8998379 - DNA, 22 bp, Homo sapiens
aatctagagttcccagcataaa

SEQ ID NO: 8998380 - DNA, 22 bp, Homo sapiens
aatctagtttcagactttgagt

SEQ ID NO: 8998381 - DNA, 23 bp, Homo sapiens
aatctatacttaggctggtaata

SEQ ID NO: 8998382 - DNA, 22 bp, Homo sapiens
aatctaaggacttagcattgct

SEQ ID NO: 8998383 - DNA, 22 bp, Homo sapiens
aatctaagggaaattggagatg

SEQ ID NO: 8998384 - DNA, 22 bp, Homo sapiens
aatctacatagagatcaaatga

SEQ ID NO: 8998385 - DNA, 22 bp, Homo sapiens
aatctacatagagatcaaatga

SEQ ID NO: 8998386 - DNA, 22 bp, Homo sapiens
aatctacatagagatcaaatga

SEQ ID NO: 8998387 - DNA, 19 bp, Homo sapiens
aatctagaaatatgtgttc

SEQ ID NO: 8998388 - DNA, 22 bp, Homo sapiens
aatctacatttcagttttgccc

SEQ ID NO: 8998389 - DNA, 22 bp, Homo sapiens
aatctacatgcaatatttttag

SEQ ID NO: 8998390 - DNA, 22 bp, Homo sapiens
aatctacatgcaatatttttag

SEQ ID NO: 8998391 - DNA, 22 bp, Homo sapiens
aatctacatgcaatatttttag

SEQ ID NO: 8998392 - DNA, 22 bp, Homo sapiens
aatctacatagagatcaaatga

SEQ ID NO: 8998393 - DNA, 22 bp, Homo sapiens
acttttatcaaggaagtgatct

SEQ ID NO: 8998394 - DNA, 22 bp, Homo sapiens
acttttatcaaggaagtgatct

SEQ ID NO: 8998395 - DNA, 22 bp, Homo sapiens
acttttatcaaggaagtgatct

SEQ ID NO: 8998396 - DNA, 22 bp, Homo sapiens
acttttatcaaggaagtgatct

SEQ ID NO: 8998397 - DNA, 22 bp, Homo sapiens
acttttaaggggccttgattta

SEQ ID NO: 8998398 - DNA, 22 bp, Homo sapiens
acttttaaggggccttgattta

SEQ ID NO: 8998399 - DNA, 22 bp, Homo sapiens
acttttatcaaggaagtgatct

SEQ ID NO: 8998400 - DNA, 22 bp, Homo sapiens
acttttatgataatcaatgttc

SEQ ID NO: 8998401 - DNA, 22 bp, Homo sapiens
aatcaagtcaaccatcatgtgc

SEQ ID NO: 8998402 - DNA, 22 bp, Homo sapiens
aatcaagtattttccagtggca

SEQ ID NO: 8998403 - DNA, 22 bp, Homo sapiens
aatcaagtcaaccatcatgtgc

SEQ ID NO: 8998404 - DNA, 22 bp, Homo sapiens
aatcaagagttgtgtaatattt

SEQ ID NO: 8998405 - DNA, 22 bp, Homo sapiens
aatcaagagttgtgtaatattt

SEQ ID NO: 8998406 - DNA, 23 bp, Homo sapiens
aatcaagttttgatgaggaagcc

SEQ ID NO: 8998407 - DNA, 22 bp, Homo sapiens
aatcaatgttagtcatgaattt

SEQ ID NO: 8998408 - DNA, 22 bp, Homo sapiens
aatcaatgttagtcatgaattt

SEQ ID NO: 8998409 - DNA, 22 bp, Homo sapiens
aatcaagagttgtgtaatattt

SEQ ID NO: 8998410 - DNA, 21 bp, Homo sapiens
aatcaagagtactggtgtggc

SEQ ID NO: 8998411 - DNA, 22 bp, Homo sapiens
acttttcaaatgggaaactcag

SEQ ID NO: 8998412 - DNA, 22 bp, Homo sapiens
acttttatgataatcaatgttc

SEQ ID NO: 8998413 - DNA, 22 bp, Homo sapiens
acttttatgataatcaatgttc

SEQ ID NO: 8998414 - DNA, 22 bp, Homo sapiens
actttgatagtttaatctagga

SEQ ID NO: 8998415 - DNA, 22 bp, Homo sapiens
actttgatagtttaatctagga

SEQ ID NO: 8998416 - DNA, 22 bp, Homo sapiens
actttgatcctttgaatatttg

SEQ ID NO: 8998417 - DNA, 22 bp, Homo sapiens
actttgttcctttcacaaagaa

SEQ ID NO: 8998418 - DNA, 22 bp, Homo sapiens
actttgatctaagtttctttga

SEQ ID NO: 8998419 - DNA, 22 bp, Homo sapiens
actttgttgaagaatatgttag

SEQ ID NO: 8998420 - DNA, 22 bp, Homo sapiens
actttgttgaagaatatgttag

SEQ ID NO: 8998421 - DNA, 22 bp, Homo sapiens
actttgttgatgaaatagtttt

SEQ ID NO: 8998422 - DNA, 22 bp, Homo sapiens
actttgttgatgaaatagtttt

SEQ ID NO: 8998423 - DNA, 22 bp, Homo sapiens
acttttaaatgagtttcagttg

SEQ ID NO: 8998424 - DNA, 22 bp, Homo sapiens
acttttaaatgagtttcagttg

SEQ ID NO: 8998425 - DNA, 22 bp, Homo sapiens
acttttaaatgagtttcagttg

SEQ ID NO: 8998426 - DNA, 22 bp, Homo sapiens
acttttaaatgagtttcagttg

SEQ ID NO: 8998427 - DNA, 22 bp, Homo sapiens
actttgttttcatgaaacagct

SEQ ID NO: 8998428 - DNA, 22 bp, Homo sapiens
actttgttttcatgaaacagct

SEQ ID NO: 8998429 - DNA, 22 bp, Homo sapiens
actttgttttatagcacataag

SEQ ID NO: 8998430 - DNA, 22 bp, Homo sapiens
actttgttttatagcacataag

SEQ ID NO: 8998431 - DNA, 22 bp, Homo sapiens
actttgttttatagcacataag

SEQ ID NO: 8998432 - DNA, 22 bp, Homo sapiens
aatagcttttgtatgatgaaat

SEQ ID NO: 8998433 - DNA, 22 bp, Homo sapiens
aatagcttttgtatgatgaaat

SEQ ID NO: 8998434 - DNA, 22 bp, Homo sapiens
aatagcttttgtatgatgaaat

SEQ ID NO: 8998435 - DNA, 22 bp, Homo sapiens
aataggaaaatatttaacaaga

SEQ ID NO: 8998436 - DNA, 22 bp, Homo sapiens
aataggaagcaccaaattctcc

SEQ ID NO: 8998437 - DNA, 22 bp, Homo sapiens
aataggaaaatatttaacaaga

SEQ ID NO: 8998438 - DNA, 22 bp, Homo sapiens
aatagcttggacccattgcttt

SEQ ID NO: 8998439 - DNA, 22 bp, Homo sapiens
aatagctttctcatgacttcac

SEQ ID NO: 8998440 - DNA, 22 bp, Homo sapiens
aatagctttggtcaccatctgg

SEQ ID NO: 8998441 - DNA, 22 bp, Homo sapiens
aatagctttctcatgacttcac

SEQ ID NO: 8998442 - DNA, 22 bp, Homo sapiens
aatagctttggtcaccatctgg

SEQ ID NO: 8998443 - DNA, 22 bp, Homo sapiens
aatagcttgcctaatcctcatg

SEQ ID NO: 8998444 - DNA, 22 bp, Homo sapiens
aatagcttggacccattgcttt

SEQ ID NO: 8998445 - DNA, 22 bp, Homo sapiens
aatagcttattgacagtgaatt

SEQ ID NO: 8998446 - DNA, 22 bp, Homo sapiens
aataggaagtcacatcaaggga

SEQ ID NO: 8998447 - DNA, 22 bp, Homo sapiens
aataggaagcaccaaattctcc

SEQ ID NO: 8998448 - DNA, 22 bp, Homo sapiens
aataggcagttggatatgcaag

SEQ ID NO: 8998449 - DNA, 22 bp, Homo sapiens
aataggcagttggatatgcaag

SEQ ID NO: 8998450 - DNA, 22 bp, Homo sapiens
aatagtaaaagatacagctaat

SEQ ID NO: 8998451 - DNA, 22 bp, Homo sapiens
aatagtaaaagatacagctaat

SEQ ID NO: 8998452 - DNA, 22 bp, Homo sapiens
aataggtttaggaaagcgtttt

SEQ ID NO: 8998453 - DNA, 22 bp, Homo sapiens
actttgaaggggaacattttaa

SEQ ID NO: 8998454 - DNA, 22 bp, Homo sapiens
aatagtaaaagatacagctaat

SEQ ID NO: 8998455 - DNA, 22 bp, Homo sapiens
aatagcatgttcatgataaaat

SEQ ID NO: 8998456 - DNA, 22 bp, Homo sapiens
aatagccaaagtgcatttatga

SEQ ID NO: 8998457 - DNA, 22 bp, Homo sapiens
aatagcatgttcatgataaaat

SEQ ID NO: 8998458 - DNA, 22 bp, Homo sapiens
aatagcatgttcatgataaaat

SEQ ID NO: 8998459 - DNA, 22 bp, Homo sapiens
aatagctgggacctgaattagc

SEQ ID NO: 8998460 - DNA, 22 bp, Homo sapiens
aatagctgggaggcacattcat

SEQ ID NO: 8998461 - DNA, 22 bp, Homo sapiens
aatagctgggaggcacattcat

SEQ ID NO: 8998462 - DNA, 22 bp, Homo sapiens
aatagctgtctttgattttggt

SEQ ID NO: 8998463 - DNA, 23 bp, Homo sapiens
aatagctggtaatgatagcacaa

SEQ ID NO: 8998464 - DNA, 23 bp, Homo sapiens
aatagctggtaatgatagcacaa

SEQ ID NO: 8998465 - DNA, 23 bp, Homo sapiens
aatagctggtaatgatagcacaa

SEQ ID NO: 8998466 - DNA, 22 bp, Homo sapiens
aatagcttatgggatagatgtt

SEQ ID NO: 8998467 - DNA, 22 bp, Homo sapiens
aatagcttagtcctgattctgt

SEQ ID NO: 8998468 - DNA, 22 bp, Homo sapiens
aatagcttagtcctgattctgt

SEQ ID NO: 8998469 - DNA, 22 bp, Homo sapiens
aatagcttagtcctgattctgt

SEQ ID NO: 8998470 - DNA, 22 bp, Homo sapiens
aatagcttagtcctgattctgt

SEQ ID NO: 8998471 - DNA, 22 bp, Homo sapiens
aatagcttagtcctgattctgt

SEQ ID NO: 8998472 - DNA, 17 bp, Homo sapiens
aatagctgctcagagag

SEQ ID NO: 8998473 - DNA, 17 bp, Homo sapiens
aatagctgctcagagag

SEQ ID NO: 8998474 - DNA, 17 bp, Homo sapiens
aatagctgctcagagag

SEQ ID NO: 8998475 - DNA, 22 bp, Homo sapiens
aatagctgattagcctacaata

SEQ ID NO: 8998476 - DNA, 22 bp, Homo sapiens
aatagctgcataaagtatagaa

SEQ ID NO: 8998477 - DNA, 22 bp, Homo sapiens
aatagctgcataaagtatagaa

SEQ ID NO: 8998478 - DNA, 22 bp, Homo sapiens
aatagctgattaatgtactacc

SEQ ID NO: 8998479 - DNA, 22 bp, Homo sapiens
aatagctgattaatgtactacc

SEQ ID NO: 8998480 - DNA, 21 bp, Homo sapiens
aatagctgaggtcacccagcc

SEQ ID NO: 8998481 - DNA, 22 bp, Homo sapiens
aatagctgagggtgaggcccaa

SEQ ID NO: 8998482 - DNA, 20 bp, Homo sapiens
aatagctgagggcaagagta

SEQ ID NO: 8998483 - DNA, 20 bp, Homo sapiens
aatagctgagggcaagagta

SEQ ID NO: 8998484 - DNA, 22 bp, Homo sapiens
aatagctcactgatttctcttt

SEQ ID NO: 8998485 - DNA, 22 bp, Homo sapiens
acatccgcaggttataaagccc

SEQ ID NO: 8998486 - DNA, 22 bp, Homo sapiens
acatcctcggggaaaggcactg

SEQ ID NO: 8998487 - DNA, 22 bp, Homo sapiens
acatcctcccgatctactggct

SEQ ID NO: 8998488 - DNA, 22 bp, Homo sapiens
acatcctcccgatctactggct

SEQ ID NO: 8998489 - DNA, 22 bp, Homo sapiens
acatcctcccgatctactggct

SEQ ID NO: 8998490 - DNA, 22 bp, Homo sapiens
acatcctcccgatctactggct

SEQ ID NO: 8998491 - DNA, 20 bp, Homo sapiens
acatcctggtgactagaact

SEQ ID NO: 8998492 - DNA, 22 bp, Homo sapiens
acatcctgaagtcagtcatttg

SEQ ID NO: 8998493 - DNA, 22 bp, Homo sapiens
acatcctgaagtcagtcatttg

SEQ ID NO: 8998494 - DNA, 22 bp, Homo sapiens
acatcctcggggaaaggcactg

SEQ ID NO: 8998495 - DNA, 22 bp, Homo sapiens
acatccttggttgattaatcaa

SEQ ID NO: 8998496 - DNA, 22 bp, Homo sapiens
acatccttgattatgtaaggat

SEQ ID NO: 8998497 - DNA, 22 bp, Homo sapiens
acatccttaaggttagggtttc

SEQ ID NO: 8998498 - DNA, 22 bp, Homo sapiens
acatccttgattatgtaaggat

SEQ ID NO: 8998499 - DNA, 22 bp, Homo sapiens
acatctagaagatctgggagat

SEQ ID NO: 8998500 - DNA, 22 bp, Homo sapiens
acatctagaagatctgggagat

SEQ ID NO: 8998501 - DNA, 22 bp, Homo sapiens
acatcgatggatagagcttgct

SEQ ID NO: 8998502 - DNA, 22 bp, Homo sapiens
acatcgatggtcagccgaggag

SEQ ID NO: 8998503 - DNA, 22 bp, Homo sapiens
acatctaagccaattttgattt

SEQ ID NO: 8998504 - DNA, 22 bp, Homo sapiens
acatcgtgtatcactgaacctt

SEQ ID NO: 8998505 - DNA, 22 bp, Homo sapiens
acatctagactcttgccctctt

SEQ ID NO: 8998506 - DNA, 22 bp, Homo sapiens
acatctagactcttgccctctt

SEQ ID NO: 8998507 - DNA, 22 bp, Homo sapiens
acatctatttttttctgtccat

SEQ ID NO: 8998508 - DNA, 22 bp, Homo sapiens
acatctcacttctttgaaggct

SEQ ID NO: 8998509 - DNA, 22 bp, Homo sapiens
acatctcacttctttgaaggct

SEQ ID NO: 8998510 - DNA, 22 bp, Homo sapiens
acatctcaaattccaggctcca

SEQ ID NO: 8998511 - DNA, 22 bp, Homo sapiens
acatctcaaattccaggctcca

SEQ ID NO: 8998512 - DNA, 22 bp, Homo sapiens
acatgaagtggtcagatcaaac

SEQ ID NO: 8998513 - DNA, 22 bp, Homo sapiens
acatgaagcaagaaagatgcta

SEQ ID NO: 8998514 - DNA, 22 bp, Homo sapiens
acatgaatatatgaagttcaac

SEQ ID NO: 8998515 - DNA, 22 bp, Homo sapiens
acatgaagcaagaaagatgcta

SEQ ID NO: 8998516 - DNA, 22 bp, Homo sapiens
acatgaagcaagaaagatgcta

SEQ ID NO: 8998517 - DNA, 22 bp, Homo sapiens
acatgaagtggtcagatcaaac

SEQ ID NO: 8998518 - DNA, 22 bp, Homo sapiens
acatgaatgcagccataacact

SEQ ID NO: 8998519 - DNA, 22 bp, Homo sapiens
acatgaatgcagccataacact

SEQ ID NO: 8998520 - DNA, 22 bp, Homo sapiens
acatgacaaaatgcacaggatt

SEQ ID NO: 8998521 - DNA, 22 bp, Homo sapiens
acatgaagtggtcagatcaaac

SEQ ID NO: 8998522 - DNA, 22 bp, Homo sapiens
acatgaatgcagccataacact

SEQ ID NO: 8998523 - DNA, 22 bp, Homo sapiens
acatgaatgcagccataacact

SEQ ID NO: 8998524 - DNA, 22 bp, Homo sapiens
acatgaatgaagactttacaat

SEQ ID NO: 8998525 - DNA, 22 bp, Homo sapiens
acatctcagaactgagtaaccg

SEQ ID NO: 8998526 - DNA, 22 bp, Homo sapiens
acatctcagaactgagtaaccg

SEQ ID NO: 8998527 - DNA, 22 bp, Homo sapiens
acatctcagaactgagtaaccg

SEQ ID NO: 8998528 - DNA, 22 bp, Homo sapiens
acatgaaatgcagcctgtaacc

SEQ ID NO: 8998529 - DNA, 22 bp, Homo sapiens
acatgaaatgcagcctgtaacc

SEQ ID NO: 8998530 - DNA, 22 bp, Homo sapiens
acatctcatgaatgataaatca

SEQ ID NO: 8998531 - DNA, 22 bp, Homo sapiens
acatgaacactgcttgccacat

SEQ ID NO: 8998532 - DNA, 22 bp, Homo sapiens
acatgaaattctagctgaaccc

SEQ ID NO: 8998533 - DNA, 22 bp, Homo sapiens
acatgaaattctagctgaaccc

SEQ ID NO: 8998534 - DNA, 22 bp, Homo sapiens
acatgaaattctagctgaaccc

SEQ ID NO: 8998535 - DNA, 20 bp, Homo sapiens
acatgaacagggctacagca

SEQ ID NO: 8998536 - DNA, 21 bp, Homo sapiens
acatgcatagagagatttctg

SEQ ID NO: 8998537 - DNA, 22 bp, Homo sapiens
acatgcatactgctgccaacgc

SEQ ID NO: 8998538 - DNA, 21 bp, Homo sapiens
acatgcatagagagatttctg

SEQ ID NO: 8998539 - DNA, 22 bp, Homo sapiens
acatgcatatacttaaatatgt

SEQ ID NO: 8998540 - DNA, 22 bp, Homo sapiens
acatgcataggagaagtcttta

SEQ ID NO: 8998541 - DNA, 22 bp, Homo sapiens
acatgcatatacttaaatatgt

SEQ ID NO: 8998542 - DNA, 22 bp, Homo sapiens
acatgcataggagaagtcttta

SEQ ID NO: 8998543 - DNA, 22 bp, Homo sapiens
acatgcatctccaggctcattt

SEQ ID NO: 8998544 - DNA, 22 bp, Homo sapiens
acatgcatgaaatccataaaca

SEQ ID NO: 8998545 - DNA, 22 bp, Homo sapiens
acatgcatctctgggacacatg

SEQ ID NO: 8998546 - DNA, 19 bp, Homo sapiens
acatgcatatggacagttg

SEQ ID NO: 8998547 - DNA, 19 bp, Homo sapiens
acatgcatatggacagttg

SEQ ID NO: 8998548 - DNA, 19 bp, Homo sapiens
acatgcatatggacagttg

SEQ ID NO: 8998549 - DNA, 22 bp, Homo sapiens
acatgcatatacttaaatatgt

SEQ ID NO: 8998550 - DNA, 22 bp, Homo sapiens
acatgcatatacttaaatatgt

SEQ ID NO: 8998551 - DNA, 22 bp, Homo sapiens
acatgcatggacatgtatatat

SEQ ID NO: 8998552 - DNA, 22 bp, Homo sapiens
acatgcatggagggaaaatgtc

SEQ ID NO: 8998553 - DNA, 22 bp, Homo sapiens
acatgcatgctttggtgggtgt

SEQ ID NO: 8998554 - DNA, 22 bp, Homo sapiens
acatgcatgtctatgggcaggt

SEQ ID NO: 8998555 - DNA, 22 bp, Homo sapiens
acatgcatgtctatgggcaggt

SEQ ID NO: 8998556 - DNA, 22 bp, Homo sapiens
acatgcatgtcatcagcccttt

SEQ ID NO: 8998557 - DNA, 22 bp, Homo sapiens
acatgcatggggtaatggtatt

SEQ ID NO: 8998558 - DNA, 22 bp, Homo sapiens
acatgcatggtgttgggttgga

SEQ ID NO: 8998559 - DNA, 22 bp, Homo sapiens
acatgcatggctgcttaaatta

SEQ ID NO: 8998560 - DNA, 22 bp, Homo sapiens
acatgacaaaatgcacaggatt

SEQ ID NO: 8998561 - DNA, 22 bp, Homo sapiens
acatgacacaggcctggccaat

SEQ ID NO: 8998562 - DNA, 22 bp, Homo sapiens
acatgacacaggcctggccaat

SEQ ID NO: 8998563 - DNA, 22 bp, Homo sapiens
acatgacagtgactttataaga

SEQ ID NO: 8998564 - DNA, 22 bp, Homo sapiens
acatgacagtgcttagcaaact

SEQ ID NO: 8998565 - DNA, 22 bp, Homo sapiens
acatgacagtgactttataaga

SEQ ID NO: 8998566 - DNA, 22 bp, Homo sapiens
acatgacagggaatgaggtgaa

SEQ ID NO: 8998567 - DNA, 22 bp, Homo sapiens
acatgcatacacgtacatacct

SEQ ID NO: 8998568 - DNA, 22 bp, Homo sapiens
acatgcatactgctgccaacgc

SEQ ID NO: 8998569 - DNA, 22 bp, Homo sapiens
acatgcatacgtgtgtttaaaa

SEQ ID NO: 8998570 - DNA, 22 bp, Homo sapiens
acatgcatacacgtacatacct

SEQ ID NO: 8998571 - DNA, 22 bp, Homo sapiens
acatgcatacacgtacatacct

SEQ ID NO: 8998572 - DNA, 22 bp, Homo sapiens
acatgacagtgcttagcaaact

SEQ ID NO: 8998573 - DNA, 22 bp, Homo sapiens
acatgacagtgcttagcaaact

SEQ ID NO: 8998574 - DNA, 22 bp, Homo sapiens
acatgacagtgcttagcaaact

SEQ ID NO: 8998575 - DNA, 22 bp, Homo sapiens
acatgacagtgcttagcaaact

SEQ ID NO: 8998576 - DNA, 22 bp, Homo sapiens
acatgacagtgcttagcaaact

SEQ ID NO: 8998577 - DNA, 22 bp, Homo sapiens
aaggccagcctgagagctaaca

SEQ ID NO: 8998578 - DNA, 22 bp, Homo sapiens
aaggccagcctgagagctaaca

SEQ ID NO: 8998579 - DNA, 22 bp, Homo sapiens
aaggccagcctgagagctaaca

SEQ ID NO: 8998580 - DNA, 22 bp, Homo sapiens
acatccatttgctttatttgct

SEQ ID NO: 8998581 - DNA, 22 bp, Homo sapiens
acatccatttgtcagctcttga

SEQ ID NO: 8998582 - DNA, 22 bp, Homo sapiens
acatccattttgttcaaaagca

SEQ ID NO: 8998583 - DNA, 22 bp, Homo sapiens
acatccatttgtcagctcttga

SEQ ID NO: 8998584 - DNA, 22 bp, Homo sapiens
acatccattttgttcaaaagca

SEQ ID NO: 8998585 - DNA, 22 bp, Homo sapiens
acatccattttgttcaaaagca

SEQ ID NO: 8998586 - DNA, 22 bp, Homo sapiens
acatcccacagaaacatacata

SEQ ID NO: 8998587 - DNA, 22 bp, Homo sapiens
aaggccagcctgagagctaaca

SEQ ID NO: 8998588 - DNA, 22 bp, Homo sapiens
aaggccagccctaatgatgctc

SEQ ID NO: 8998589 - DNA, 22 bp, Homo sapiens
aaggccagccctaatgatgctc

SEQ ID NO: 8998590 - DNA, 22 bp, Homo sapiens
aaggccagattctctctagggg

SEQ ID NO: 8998591 - DNA, 22 bp, Homo sapiens
aaggccagcagtttgagaccag

SEQ ID NO: 8998592 - DNA, 22 bp, Homo sapiens
aaggccagattctctctagggg

SEQ ID NO: 8998593 - DNA, 22 bp, Homo sapiens
aaggccagattctctctagggg

SEQ ID NO: 8998594 - DNA, 22 bp, Homo sapiens
aaggccagattctctctagggg

SEQ ID NO: 8998595 - DNA, 22 bp, Homo sapiens
aaggccagattcactttacaat

SEQ ID NO: 8998596 - DNA, 22 bp, Homo sapiens
aaggccagagttgaactgctcc

SEQ ID NO: 8998597 - DNA, 22 bp, Homo sapiens
aaggccagagttgaactgctcc

SEQ ID NO: 8998598 - DNA, 22 bp, Homo sapiens
aaggccagagtactagaggctg

SEQ ID NO: 8998599 - DNA, 22 bp, Homo sapiens
aaggccagagcgtgtcctgcct

SEQ ID NO: 8998600 - DNA, 22 bp, Homo sapiens
aaggccagagtactagaggctg

SEQ ID NO: 8998601 - DNA, 22 bp, Homo sapiens
aaggccagagtactagaggctg

SEQ ID NO: 8998602 - DNA, 22 bp, Homo sapiens
aaggccagagtactagaggctg

SEQ ID NO: 8998603 - DNA, 22 bp, Homo sapiens
aaggccagagtactagaggctg

SEQ ID NO: 8998604 - DNA, 22 bp, Homo sapiens
aaggcacatattttagagtcac

SEQ ID NO: 8998605 - DNA, 22 bp, Homo sapiens
aaggccagagcagactggagtt

SEQ ID NO: 8998606 - DNA, 22 bp, Homo sapiens
aaggccagagcgtgtcctgcct

SEQ ID NO: 8998607 - DNA, 22 bp, Homo sapiens
aaggccagagcagactggagtt

SEQ ID NO: 8998608 - DNA, 22 bp, Homo sapiens
aaggccagagcagactggagtt

SEQ ID NO: 8998609 - DNA, 22 bp, Homo sapiens
aaggccagagcgtgtcctgcct

SEQ ID NO: 8998610 - DNA, 22 bp, Homo sapiens
aaggcacattcctgaaaacaat

SEQ ID NO: 8998611 - DNA, 22 bp, Homo sapiens
aaggcacatgacctaggcctgg

SEQ ID NO: 8998612 - DNA, 22 bp, Homo sapiens
aaggcacatattttagagtcac

SEQ ID NO: 8998613 - DNA, 22 bp, Homo sapiens
aaggcaccataggcaaatccag

SEQ ID NO: 8998614 - DNA, 22 bp, Homo sapiens
aaggcattgctgatcctcaggt

SEQ ID NO: 8998615 - DNA, 22 bp, Homo sapiens
aaggcattgagcagttacagta

SEQ ID NO: 8998616 - DNA, 22 bp, Homo sapiens
aaggccagagcagactggagtt

SEQ ID NO: 8998617 - DNA, 22 bp, Homo sapiens
aaggccagagcagactggagtt

SEQ ID NO: 8998618 - DNA, 22 bp, Homo sapiens
aaggcattgagcagttacagta

SEQ ID NO: 8998619 - DNA, 22 bp, Homo sapiens
aaggcacatattttagagtcac

SEQ ID NO: 8998620 - DNA, 22 bp, Homo sapiens
aaggcacatattgcagatcttg

SEQ ID NO: 8998621 - DNA, 22 bp, Homo sapiens
aaggcacagccacttgatcatc

SEQ ID NO: 8998622 - DNA, 22 bp, Homo sapiens
aaggcaattggcttgtataaga

SEQ ID NO: 8998623 - DNA, 22 bp, Homo sapiens
aaggcaattggcttgtataaga

SEQ ID NO: 8998624 - DNA, 22 bp, Homo sapiens
aaggcaattggcttgtataaga

SEQ ID NO: 8998625 - DNA, 22 bp, Homo sapiens
aaggcaatttggaagaggcaga

SEQ ID NO: 8998626 - DNA, 22 bp, Homo sapiens
aaggcacaacacaagagggtga

SEQ ID NO: 8998627 - DNA, 22 bp, Homo sapiens
aaggcacagaggcagggcactt

SEQ ID NO: 8998628 - DNA, 22 bp, Homo sapiens
aaggcaactgtaaaacatgcac

SEQ ID NO: 8998629 - DNA, 22 bp, Homo sapiens
aaggcaaatgtgttcttttagt

SEQ ID NO: 8998630 - DNA, 22 bp, Homo sapiens
aaggcaaatgtgttcttttagt

SEQ ID NO: 8998631 - DNA, 22 bp, Homo sapiens
aaggcaaggcttccagctcccc

SEQ ID NO: 8998632 - DNA, 22 bp, Homo sapiens
aaggcaagttttagttttctgg

SEQ ID NO: 8998633 - DNA, 22 bp, Homo sapiens
aaggcaatgactgatttagaat

SEQ ID NO: 8998634 - DNA, 22 bp, Homo sapiens
aaggcaatgactgatttagaat

SEQ ID NO: 8998635 - DNA, 22 bp, Homo sapiens
aaggcaatagtattaaactgga

SEQ ID NO: 8998636 - DNA, 22 bp, Homo sapiens
aaggcaatgactgatttagaat

SEQ ID NO: 8998637 - DNA, 22 bp, Homo sapiens
aaggcaatgtcatggctcttgc

SEQ ID NO: 8998638 - DNA, 22 bp, Homo sapiens
aaggcaatgtaaattacagctt

SEQ ID NO: 8998639 - DNA, 22 bp, Homo sapiens
aaggcaatgtaaattacagctt

SEQ ID NO: 8998640 - DNA, 22 bp, Homo sapiens
aagcttcaggcccacccatgtc

SEQ ID NO: 8998641 - DNA, 21 bp, Homo sapiens
aagcttccctgctctccaggg

SEQ ID NO: 8998642 - DNA, 23 bp, Homo sapiens
aagcttccttgactggcccctag

SEQ ID NO: 8998643 - DNA, 20 bp, Homo sapiens
aagcttccttgggcgcccgg

SEQ ID NO: 8998644 - DNA, 23 bp, Homo sapiens
aagcttccttcacgtctcctggg

SEQ ID NO: 8998645 - DNA, 23 bp, Homo sapiens
aagcttctatctctgcagaagga

SEQ ID NO: 8998646 - DNA, 22 bp, Homo sapiens
aagcttcttagaatgcatgtgc

SEQ ID NO: 8998647 - DNA, 23 bp, Homo sapiens
aagcttctatctctgcagaagga

SEQ ID NO: 8998648 - DNA, 23 bp, Homo sapiens
aagcttctagggtgggcaagatg

SEQ ID NO: 8998649 - DNA, 22 bp, Homo sapiens
aaggaagaagggaagttactta

SEQ ID NO: 8998650 - DNA, 22 bp, Homo sapiens
aaggaagaagggaagttactta

SEQ ID NO: 8998651 - DNA, 22 bp, Homo sapiens
aagcttgtactgtagtttgttg

SEQ ID NO: 8998652 - DNA, 22 bp, Homo sapiens
aagcttgtagagtttgacttcc

SEQ ID NO: 8998653 - DNA, 22 bp, Homo sapiens
aagcttctttacaggagagatt

SEQ ID NO: 8998654 - DNA, 20 bp, Homo sapiens
aagcttcacttcatttgatc

SEQ ID NO: 8998655 - DNA, 20 bp, Homo sapiens
aagcttcacttcatttgatc

SEQ ID NO: 8998656 - DNA, 22 bp, Homo sapiens
aagcttaggtacagaagttaag

SEQ ID NO: 8998657 - DNA, 22 bp, Homo sapiens
aagcttatatcagaacaatgct

SEQ ID NO: 8998658 - DNA, 22 bp, Homo sapiens
aagcttatatcagaacaatgct

SEQ ID NO: 8998659 - DNA, 22 bp, Homo sapiens
aagctgtttttaggtggaggta

SEQ ID NO: 8998660 - DNA, 22 bp, Homo sapiens
aagctgtttgcagtggatggag

SEQ ID NO: 8998661 - DNA, 22 bp, Homo sapiens
aagctgtttgcagtggatggag

SEQ ID NO: 8998662 - DNA, 22 bp, Homo sapiens
aagctgttttggccttagttga

SEQ ID NO: 8998663 - DNA, 22 bp, Homo sapiens
aagctgtttgcagtggatggag

SEQ ID NO: 8998664 - DNA, 22 bp, Homo sapiens
aagctgttgttcatcctgaatt

SEQ ID NO: 8998665 - DNA, 22 bp, Homo sapiens
aagctgttgttcatcctgaatt

SEQ ID NO: 8998666 - DNA, 22 bp, Homo sapiens
aagctgttctgaatcagtaagt

SEQ ID NO: 8998667 - DNA, 22 bp, Homo sapiens
aagctgttgccctgctctttct

SEQ ID NO: 8998668 - DNA, 22 bp, Homo sapiens
aagctgttgaagtaattcagcc

SEQ ID NO: 8998669 - DNA, 22 bp, Homo sapiens
aagctgttgaagtaattcagcc

SEQ ID NO: 8998670 - DNA, 22 bp, Homo sapiens
aagctgttctctaagtttcatg

SEQ ID NO: 8998671 - DNA, 22 bp, Homo sapiens
aagctgttctgaatcagtaagt

SEQ ID NO: 8998672 - DNA, 22 bp, Homo sapiens
aagctgttctgaatcagtaagt

SEQ ID NO: 8998673 - DNA, 22 bp, Homo sapiens
aagctgttctgaatcagtaagt

SEQ ID NO: 8998674 - DNA, 22 bp, Homo sapiens
aagctgttctctaagtttcatg

SEQ ID NO: 8998675 - DNA, 22 bp, Homo sapiens
aagctgttatcttctggcggac

SEQ ID NO: 8998676 - DNA, 22 bp, Homo sapiens
aagctgttatcttctggcggac

SEQ ID NO: 8998677 - DNA, 22 bp, Homo sapiens
aagctgttctccagtgactcag

SEQ ID NO: 8998678 - DNA, 22 bp, Homo sapiens
aagctgttagggagtggtaggt

SEQ ID NO: 8998679 - DNA, 22 bp, Homo sapiens
aagctgttagggagtggtaggt

SEQ ID NO: 8998680 - DNA, 22 bp, Homo sapiens
aagctgtgtgcagatgatctca

SEQ ID NO: 8998681 - DNA, 21 bp, Homo sapiens
aagctgtgttccactgatagc

SEQ ID NO: 8998682 - DNA, 22 bp, Homo sapiens
aagctgttaatggcttgcagct

SEQ ID NO: 8998683 - DNA, 21 bp, Homo sapiens
aagctgtgttccactgatagc

SEQ ID NO: 8998684 - DNA, 22 bp, Homo sapiens
aagctgtgtgcagatgatctca

SEQ ID NO: 8998685 - DNA, 21 bp, Homo sapiens
aagctgtgttccactgatagc

SEQ ID NO: 8998686 - DNA, 22 bp, Homo sapiens
aagctgtgtgactatttctgag

SEQ ID NO: 8998687 - DNA, 22 bp, Homo sapiens
aagctgtgtattacagaatatt

SEQ ID NO: 8998688 - DNA, 22 bp, Homo sapiens
aagctgtgtcctagaggtgtaa

SEQ ID NO: 8998689 - DNA, 22 bp, Homo sapiens
aagctgtgtgactatttctgag

SEQ ID NO: 8998690 - DNA, 22 bp, Homo sapiens
aagctgtgtgcagatgatctca

SEQ ID NO: 8998691 - DNA, 22 bp, Homo sapiens
aagctgtgtgcagatgatctca

SEQ ID NO: 8998692 - DNA, 22 bp, Homo sapiens
aagctgtgtgcagatgatctca

SEQ ID NO: 8998693 - DNA, 22 bp, Homo sapiens
aagctgtggtaaagggtagagg

SEQ ID NO: 8998694 - DNA, 22 bp, Homo sapiens
aagctgtggtaaagggtagagg

SEQ ID NO: 8998695 - DNA, 22 bp, Homo sapiens
aagctgtgtaagttgcttggtt

SEQ ID NO: 8998696 - DNA, 22 bp, Homo sapiens
aagctgtgtaagttgcttggtt

SEQ ID NO: 8998697 - DNA, 22 bp, Homo sapiens
aagctgtgtcctagaggtgtaa

SEQ ID NO: 8998698 - DNA, 22 bp, Homo sapiens
aagctgtgtgactatttctgag

SEQ ID NO: 8998699 - DNA, 22 bp, Homo sapiens
aagctgtgtattacagaatatt

SEQ ID NO: 8998700 - DNA, 22 bp, Homo sapiens
aagctgtgtattacagaatatt

SEQ ID NO: 8998701 - DNA, 22 bp, Homo sapiens
aagctgtgtattacagaatatt

SEQ ID NO: 8998702 - DNA, 22 bp, Homo sapiens
aagctgtgcctttgcctagaat

SEQ ID NO: 8998703 - DNA, 22 bp, Homo sapiens
aagctgtggcttggaggaaaca

SEQ ID NO: 8998704 - DNA, 22 bp, Homo sapiens
aagctgtgcctttgcctagaat

SEQ ID NO: 8998705 - DNA, 22 bp, Homo sapiens
aagctgtgcctttgcctagaat

SEQ ID NO: 8998706 - DNA, 22 bp, Homo sapiens
aagctgtggcttggaggaaaca

SEQ ID NO: 8998707 - DNA, 22 bp, Homo sapiens
aagctgtggcttggaggaaaca

SEQ ID NO: 8998708 - DNA, 22 bp, Homo sapiens
aagctgtgcaggaactgcttgc

SEQ ID NO: 8998709 - DNA, 22 bp, Homo sapiens
aagctgtgcaggaactgcttgc

SEQ ID NO: 8998710 - DNA, 22 bp, Homo sapiens
aagctgtgcaggaactgcttgc

SEQ ID NO: 8998711 - DNA, 22 bp, Homo sapiens
aagctgtgagctggatgctcca

SEQ ID NO: 8998712 - DNA, 22 bp, Homo sapiens
aagctgtgcaggaactgcttgc

SEQ ID NO: 8998713 - DNA, 22 bp, Homo sapiens
aagctgtgaagagcaagtgagg

SEQ ID NO: 8998714 - DNA, 22 bp, Homo sapiens
aagctgtgagctggatgctcca

SEQ ID NO: 8998715 - DNA, 22 bp, Homo sapiens
aagctgtgagctggatgctcca

SEQ ID NO: 8998716 - DNA, 22 bp, Homo sapiens
aagctgtgaagagcaagtgagg

SEQ ID NO: 8998717 - DNA, 22 bp, Homo sapiens
aagctgtgaaatctctagtgca

SEQ ID NO: 8998718 - DNA, 22 bp, Homo sapiens
aagctgtgaagagcaagtgagg

SEQ ID NO: 8998719 - DNA, 22 bp, Homo sapiens
aagctgtgaaatctctagtgca

SEQ ID NO: 8998720 - DNA, 22 bp, Homo sapiens
acagctggacaggggagagttt

SEQ ID NO: 8998721 - DNA, 22 bp, Homo sapiens
acagctggagccctatggctgg

SEQ ID NO: 8998722 - DNA, 22 bp, Homo sapiens
acagctggagccctatggctgg

SEQ ID NO: 8998723 - DNA, 22 bp, Homo sapiens
acagctggaggccccattgtcc

SEQ ID NO: 8998724 - DNA, 22 bp, Homo sapiens
acagctggaggccccattgtcc

SEQ ID NO: 8998725 - DNA, 22 bp, Homo sapiens
acagctggaggggctgcagagg

SEQ ID NO: 8998726 - DNA, 22 bp, Homo sapiens
acagctggaggggctgcagagg

SEQ ID NO: 8998727 - DNA, 22 bp, Homo sapiens
acagctggaggggctgcagagg

SEQ ID NO: 8998728 - DNA, 22 bp, Homo sapiens
aagctgtgaaatctctagtgca

SEQ ID NO: 8998729 - DNA, 22 bp, Homo sapiens
aagctgtgaaatctctagtgca

SEQ ID NO: 8998730 - DNA, 22 bp, Homo sapiens
aagctggaggctgagatcacca

SEQ ID NO: 8998731 - DNA, 22 bp, Homo sapiens
aagctggagagtttcacagatg

SEQ ID NO: 8998732 - DNA, 22 bp, Homo sapiens
aagctggagagtttcacagatg

SEQ ID NO: 8998733 - DNA, 22 bp, Homo sapiens
aagctggagtgcagtgcaatgg

SEQ ID NO: 8998734 - DNA, 22 bp, Homo sapiens
aagctggagtgcagtgcaatgg

SEQ ID NO: 8998735 - DNA, 22 bp, Homo sapiens
acagctggagtgaggatggagt

SEQ ID NO: 8998736 - DNA, 22 bp, Homo sapiens
acagctggaggtctgtgagcac

SEQ ID NO: 8998737 - DNA, 22 bp, Homo sapiens
acagctggagtgttggtgaggt

SEQ ID NO: 8998738 - DNA, 22 bp, Homo sapiens
aagctggagagtttcacagatg

SEQ ID NO: 8998739 - DNA, 22 bp, Homo sapiens
aaggatctgacagactatagaa

SEQ ID NO: 8998740 - DNA, 22 bp, Homo sapiens
aaggatgattggtaatgacact

SEQ ID NO: 8998741 - DNA, 22 bp, Homo sapiens
aaggatgattggtaatgacact

SEQ ID NO: 8998742 - DNA, 22 bp, Homo sapiens
aaggatgaacattaatacatca

SEQ ID NO: 8998743 - DNA, 22 bp, Homo sapiens
aaggaggcctgcgagaaggggc

SEQ ID NO: 8998744 - DNA, 22 bp, Homo sapiens
aaggatcatgtatatgtttaag

SEQ ID NO: 8998745 - DNA, 22 bp, Homo sapiens
aaggcaaaagaggtgtcatcac

SEQ ID NO: 8998746 - DNA, 22 bp, Homo sapiens
aaggcaaaagaggtgtcatcac

SEQ ID NO: 8998747 - DNA, 22 bp, Homo sapiens
aaggcaaatgtgttcttttagt

SEQ ID NO: 8998748 - DNA, 22 bp, Homo sapiens
aaggcaaatgtgttcttttagt

SEQ ID NO: 8998749 - DNA, 22 bp, Homo sapiens
aaggatttttggaatgagatgg

SEQ ID NO: 8998750 - DNA, 22 bp, Homo sapiens
aaggcaaaagaggtgtcatcac

SEQ ID NO: 8998751 - DNA, 22 bp, Homo sapiens
aaggcaaaagaggtgtcatcac

SEQ ID NO: 8998752 - DNA, 22 bp, Homo sapiens
aaggatttttggaatgagatgg

SEQ ID NO: 8998753 - DNA, 22 bp, Homo sapiens
aaggatttgtccaaagtcacac

SEQ ID NO: 8998754 - DNA, 22 bp, Homo sapiens
aaggattgtctggctatttatg

SEQ ID NO: 8998755 - DNA, 22 bp, Homo sapiens
aaggacacaaaacagcagcagt

SEQ ID NO: 8998756 - DNA, 22 bp, Homo sapiens
aaggacaatgaagacagccaca

SEQ ID NO: 8998757 - DNA, 19 bp, Homo sapiens
aaggacacaacagagatag

SEQ ID NO: 8998758 - DNA, 22 bp, Homo sapiens
aaggacaagtagtatttgcatc

SEQ ID NO: 8998759 - DNA, 19 bp, Homo sapiens
aaggacacaacagagatag

SEQ ID NO: 8998760 - DNA, 22 bp, Homo sapiens
aaggacagaaacagattgctgg

SEQ ID NO: 8998761 - DNA, 22 bp, Homo sapiens
aaggacagaaacagattgctgg

SEQ ID NO: 8998762 - DNA, 22 bp, Homo sapiens
aaggacagaaacagattgctgg

SEQ ID NO: 8998763 - DNA, 22 bp, Homo sapiens
aaggacagaaacagattgctgg

SEQ ID NO: 8998764 - DNA, 22 bp, Homo sapiens
aaggacaggcacagtggtggag

SEQ ID NO: 8998765 - DNA, 22 bp, Homo sapiens
aaggacaggcacagtggtggag

SEQ ID NO: 8998766 - DNA, 22 bp, Homo sapiens
aaggacaggcacagtggtggag

SEQ ID NO: 8998767 - DNA, 22 bp, Homo sapiens
aaggacaggcacagtggtggag

SEQ ID NO: 8998768 - DNA, 22 bp, Homo sapiens
aaggacaggagaaaacgggatc

SEQ ID NO: 8998769 - DNA, 22 bp, Homo sapiens
aaggacaggagaaaacgggatc

SEQ ID NO: 8998770 - DNA, 22 bp, Homo sapiens
aaggacaggagaaaacgggatc

SEQ ID NO: 8998771 - DNA, 22 bp, Homo sapiens
aaggacagagagccattccaga

SEQ ID NO: 8998772 - DNA, 22 bp, Homo sapiens
aaggacagagagccattccaga

SEQ ID NO: 8998773 - DNA, 22 bp, Homo sapiens
aaggacagagagccattccaga

SEQ ID NO: 8998774 - DNA, 22 bp, Homo sapiens
aaggacagagagccattccaga

SEQ ID NO: 8998775 - DNA, 22 bp, Homo sapiens
aaggaagaatcatcacgttggg

SEQ ID NO: 8998776 - DNA, 22 bp, Homo sapiens
aaggaagaatcatcacgttggg

SEQ ID NO: 8998777 - DNA, 22 bp, Homo sapiens
aaggaagaatcatcacgttggg

SEQ ID NO: 8998778 - DNA, 22 bp, Homo sapiens
aaggaagatgctggcctgggga

SEQ ID NO: 8998779 - DNA, 22 bp, Homo sapiens
aaggaagatgctggcctgggga

SEQ ID NO: 8998780 - DNA, 22 bp, Homo sapiens
aaggaagcagccagagaccctc

SEQ ID NO: 8998781 - DNA, 22 bp, Homo sapiens
aaggaagccttgcctgaataca

SEQ ID NO: 8998782 - DNA, 22 bp, Homo sapiens
aaggaagccttgcctgaataca

SEQ ID NO: 8998783 - DNA, 22 bp, Homo sapiens
aaggaagcagcaatgcatgatt

SEQ ID NO: 8998784 - DNA, 22 bp, Homo sapiens
aaggaagatgctggcctgggga

SEQ ID NO: 8998785 - DNA, 22 bp, Homo sapiens
aaggaagcagcaatgcatgatt

SEQ ID NO: 8998786 - DNA, 22 bp, Homo sapiens
aaggaagcagcaatgcatgatt

SEQ ID NO: 8998787 - DNA, 22 bp, Homo sapiens
aaggaagctgttagacatgcat

SEQ ID NO: 8998788 - DNA, 22 bp, Homo sapiens
aaggaaggaattgatcatgcgc

SEQ ID NO: 8998789 - DNA, 22 bp, Homo sapiens
aaggaagggaaatagtgatgtc

SEQ ID NO: 8998790 - DNA, 22 bp, Homo sapiens
aaggaagggaaatagtgatgtc

SEQ ID NO: 8998791 - DNA, 22 bp, Homo sapiens
aaggaaggaattgatcatgcgc

SEQ ID NO: 8998792 - DNA, 22 bp, Homo sapiens
aaggaagggaaatagtgatgtc

SEQ ID NO: 8998793 - DNA, 22 bp, Homo sapiens
aaggaagggaaatagtgatgtc

SEQ ID NO: 8998794 - DNA, 22 bp, Homo sapiens
aaggaagggaaatagtgatgtc

SEQ ID NO: 8998795 - DNA, 22 bp, Homo sapiens
aaggaagggaaatagtgatgtc

SEQ ID NO: 8998796 - DNA, 22 bp, Homo sapiens
aaggaagggaaatagtgatgtc

SEQ ID NO: 8998797 - DNA, 21 bp, Homo sapiens
aaggaagtgactttagtggtt

SEQ ID NO: 8998798 - DNA, 22 bp, Homo sapiens
aaggaagttaagtcttagaatg

SEQ ID NO: 8998799 - DNA, 20 bp, Homo sapiens
aaggaatatttgtatctggg

SEQ ID NO: 8998800 - DNA, 22 bp, Homo sapiens
aaggaaggttcatagtcaaaga

SEQ ID NO: 8998801 - DNA, 22 bp, Homo sapiens
aaggaaggttcatagtcaaaga

SEQ ID NO: 8998802 - DNA, 22 bp, Homo sapiens
aaggaaggtactcagtgattct

SEQ ID NO: 8998803 - DNA, 22 bp, Homo sapiens
aaggaaggtactcagtgattct

SEQ ID NO: 8998804 - DNA, 22 bp, Homo sapiens
aaggacaaagcagagctggatg

SEQ ID NO: 8998805 - DNA, 22 bp, Homo sapiens
aaggacaaagcagagctggatg

SEQ ID NO: 8998806 - DNA, 22 bp, Homo sapiens
aaggaattctagaaggttttgt

SEQ ID NO: 8998807 - DNA, 22 bp, Homo sapiens
aaggaattccctttctgacaga

SEQ ID NO: 8998808 - DNA, 17 bp, Homo sapiens
aaggaatgtcagaagtt

SEQ ID NO: 8998809 - DNA, 21 bp, Homo sapiens
aaggaatgaatggatggatga

SEQ ID NO: 8998810 - DNA, 22 bp, Homo sapiens
aaggaatcacttctttaaatga

SEQ ID NO: 8998811 - DNA, 19 bp, Homo sapiens
aaggaatggctttaagtag

SEQ ID NO: 8998812 - DNA, 19 bp, Homo sapiens
aagggctgggcacctcact

SEQ ID NO: 8998813 - DNA, 19 bp, Homo sapiens
aagggctgggcacctcact

SEQ ID NO: 8998814 - DNA, 22 bp, Homo sapiens
aagggctgggtctggttaaccc

SEQ ID NO: 8998815 - DNA, 19 bp, Homo sapiens
aagggctgggcacctcact

SEQ ID NO: 8998816 - DNA, 18 bp, Homo sapiens
aagggctggcctttggag

SEQ ID NO: 8998817 - DNA, 22 bp, Homo sapiens
aagggctggccctgggaagagt

SEQ ID NO: 8998818 - DNA, 18 bp, Homo sapiens
aagggctggcctttggag

SEQ ID NO: 8998819 - DNA, 18 bp, Homo sapiens
aagggctggcctttggag

SEQ ID NO: 8998820 - DNA, 22 bp, Homo sapiens
aagggctggccctgggaagagt

SEQ ID NO: 8998821 - DNA, 22 bp, Homo sapiens
aagggctggccctgggaagagt

SEQ ID NO: 8998822 - DNA, 22 bp, Homo sapiens
aagggctggccacattctgggt

SEQ ID NO: 8998823 - DNA, 22 bp, Homo sapiens
aagggctggccctgggaagagt

SEQ ID NO: 8998824 - DNA, 22 bp, Homo sapiens
aagggctggatctctctgagca

SEQ ID NO: 8998825 - DNA, 22 bp, Homo sapiens
aagggctggccacattctgggt

SEQ ID NO: 8998826 - DNA, 22 bp, Homo sapiens
aagggctggccacattctgggt

SEQ ID NO: 8998827 - DNA, 22 bp, Homo sapiens
aagggctggccacattctgggt

SEQ ID NO: 8998828 - DNA, 22 bp, Homo sapiens
aagggctggccacattctgggt

SEQ ID NO: 8998829 - DNA, 22 bp, Homo sapiens
aagggctggagaggaaaggttg

SEQ ID NO: 8998830 - DNA, 22 bp, Homo sapiens
aagggctggatctctctgagca

SEQ ID NO: 8998831 - DNA, 22 bp, Homo sapiens
aagggctggagaggaaaggttg

SEQ ID NO: 8998832 - DNA, 22 bp, Homo sapiens
aagggctggatctctctgagca

SEQ ID NO: 8998833 - DNA, 22 bp, Homo sapiens
aagggctggatctctctgagca

SEQ ID NO: 8998834 - DNA, 22 bp, Homo sapiens
aagggctggagaggaaaggttg

SEQ ID NO: 8998835 - DNA, 22 bp, Homo sapiens
aagggctggagaggaaaggttg

SEQ ID NO: 8998836 - DNA, 22 bp, Homo sapiens
aagggctggagactgggtcttc

SEQ ID NO: 8998837 - DNA, 22 bp, Homo sapiens
aagggctggagactgggtcttc

SEQ ID NO: 8998838 - DNA, 22 bp, Homo sapiens
aagggctggagactgggtcttc

SEQ ID NO: 8998839 - DNA, 22 bp, Homo sapiens
aagggctggagactgggtcttc

SEQ ID NO: 8998840 - DNA, 22 bp, Homo sapiens
aagggctgatctcactttcttt

SEQ ID NO: 8998841 - DNA, 22 bp, Homo sapiens
aagggctgcaatccaaaacact

SEQ ID NO: 8998842 - DNA, 22 bp, Homo sapiens
acatttcagtgagctattgaag

SEQ ID NO: 8998843 - DNA, 22 bp, Homo sapiens
acatttcagtgagctattgaag

SEQ ID NO: 8998844 - DNA, 23 bp, Homo sapiens
acatttcatataaaagggatcag

SEQ ID NO: 8998845 - DNA, 22 bp, Homo sapiens
acatttcagtgagctattgaag

SEQ ID NO: 8998846 - DNA, 22 bp, Homo sapiens
acatttcagtgagctattgaag

SEQ ID NO: 8998847 - DNA, 22 bp, Homo sapiens
acatttcagtaagtgttaattt

SEQ ID NO: 8998848 - DNA, 22 bp, Homo sapiens
acatttcagtgagctattgaag

SEQ ID NO: 8998849 - DNA, 22 bp, Homo sapiens
acatttcagtgagctattgaag

SEQ ID NO: 8998850 - DNA, 22 bp, Homo sapiens
acatttcagtgagctattgaag

SEQ ID NO: 8998851 - DNA, 22 bp, Homo sapiens
acatttcagcgtgcatgacatg

SEQ ID NO: 8998852 - DNA, 22 bp, Homo sapiens
acatttcagcgtgcatgacatg

SEQ ID NO: 8998853 - DNA, 22 bp, Homo sapiens
acatttcagcgtgcatgacatg

SEQ ID NO: 8998854 - DNA, 22 bp, Homo sapiens
acatttcagattcatgaagtga

SEQ ID NO: 8998855 - DNA, 22 bp, Homo sapiens
acatttcagattcatgaagtga

SEQ ID NO: 8998856 - DNA, 22 bp, Homo sapiens
acatttcagcgtgcatgacatg

SEQ ID NO: 8998857 - DNA, 22 bp, Homo sapiens
acatttcagcgtgcatgacatg

SEQ ID NO: 8998858 - DNA, 22 bp, Homo sapiens
acatttcagcgtgcatgacatg

SEQ ID NO: 8998859 - DNA, 22 bp, Homo sapiens
acatttcagtaagtgttaattt

SEQ ID NO: 8998860 - DNA, 22 bp, Homo sapiens
acatttcagtaagtgttaattt

SEQ ID NO: 8998861 - DNA, 20 bp, Homo sapiens
aagggcagagggaacagact

SEQ ID NO: 8998862 - DNA, 22 bp, Homo sapiens
aagggcagaatagagaagatgg

SEQ ID NO: 8998863 - DNA, 22 bp, Homo sapiens
aagggcagaatagagaagatgg

SEQ ID NO: 8998864 - DNA, 22 bp, Homo sapiens
aagggcagaatagagaagatgg

SEQ ID NO: 8998865 - DNA, 20 bp, Homo sapiens
aagggcagagggaacagact

SEQ ID NO: 8998866 - DNA, 20 bp, Homo sapiens
aagggcagagggaacagact

SEQ ID NO: 8998867 - DNA, 20 bp, Homo sapiens
aagggcagagggaacagact

SEQ ID NO: 8998868 - DNA, 20 bp, Homo sapiens
aagggcagagggaacagact

SEQ ID NO: 8998869 - DNA, 22 bp, Homo sapiens
aagggcagagggaatcccacat

SEQ ID NO: 8998870 - DNA, 22 bp, Homo sapiens
acatttcagattcatgaagtga

SEQ ID NO: 8998871 - DNA, 22 bp, Homo sapiens
acatttcagattcatgaagtga

SEQ ID NO: 8998872 - DNA, 22 bp, Homo sapiens
acatttcagatgtaatgtgatg

SEQ ID NO: 8998873 - DNA, 22 bp, Homo sapiens
acatttcagatgtaatgtgatg

SEQ ID NO: 8998874 - DNA, 22 bp, Homo sapiens
acatttcagatgtaatgtgatg

SEQ ID NO: 8998875 - DNA, 22 bp, Homo sapiens
acatttcagaatcacacagctt

SEQ ID NO: 8998876 - DNA, 22 bp, Homo sapiens
aagggcagagggaatcccacat

SEQ ID NO: 8998877 - DNA, 22 bp, Homo sapiens
acatttcagatgtaatgtgatg

SEQ ID NO: 8998878 - DNA, 22 bp, Homo sapiens
acatttcagatgtaatgtgatg

SEQ ID NO: 8998879 - DNA, 22 bp, Homo sapiens
acatttcagatgtaatgtgatg

SEQ ID NO: 8998880 - DNA, 22 bp, Homo sapiens
aagggcagaaagggacgctttg

SEQ ID NO: 8998881 - DNA, 22 bp, Homo sapiens
aagggcagaatagagaagatgg

SEQ ID NO: 8998882 - DNA, 22 bp, Homo sapiens
aagggcagaatagagaagatgg

SEQ ID NO: 8998883 - DNA, 22 bp, Homo sapiens
aagggcacagggaaagagtgca

SEQ ID NO: 8998884 - DNA, 22 bp, Homo sapiens
aagggcacagggaaagagtgca

SEQ ID NO: 8998885 - DNA, 22 bp, Homo sapiens
aagggattgatcttgacacagt

SEQ ID NO: 8998886 - DNA, 22 bp, Homo sapiens
aagggattgatcttgacacagt

SEQ ID NO: 8998887 - DNA, 22 bp, Homo sapiens
aagggatgtaaacatgaataag

SEQ ID NO: 8998888 - DNA, 22 bp, Homo sapiens
aagggatgtaaacatgaataag

SEQ ID NO: 8998889 - DNA, 22 bp, Homo sapiens
aagggatgcaggaaagaaggtt

SEQ ID NO: 8998890 - DNA, 22 bp, Homo sapiens
aagggagacagttgtgtgagga

SEQ ID NO: 8998891 - DNA, 20 bp, Homo sapiens
aagggagaataatgattgta

SEQ ID NO: 8998892 - DNA, 20 bp, Homo sapiens
aagggagaataatgattgta

SEQ ID NO: 8998893 - DNA, 22 bp, Homo sapiens
acatgcatgtgaatatggacac

SEQ ID NO: 8998894 - DNA, 22 bp, Homo sapiens
acatgcatgttgtgtagggggg

SEQ ID NO: 8998895 - DNA, 22 bp, Homo sapiens
aagggaggtaaagctatttaaa

SEQ ID NO: 8998896 - DNA, 22 bp, Homo sapiens
aagggaggtaaagctatttaaa

SEQ ID NO: 8998897 - DNA, 22 bp, Homo sapiens
aagggaggtaaagctatttaaa

SEQ ID NO: 8998898 - DNA, 22 bp, Homo sapiens
aagggatgcaggaaagaaggtt

SEQ ID NO: 8998899 - DNA, 22 bp, Homo sapiens
aagggaggtaaagctatttaaa

SEQ ID NO: 8998900 - DNA, 22 bp, Homo sapiens
accagagcttacatgctagaaa

SEQ ID NO: 8998901 - DNA, 20 bp, Homo sapiens
accagaggaaagagcagtga

SEQ ID NO: 8998902 - DNA, 22 bp, Homo sapiens
accagagcttacatgctagaaa

SEQ ID NO: 8998903 - DNA, 22 bp, Homo sapiens
accagaggaagggaatctcaag

SEQ ID NO: 8998904 - DNA, 22 bp, Homo sapiens
accagaggaagggaatctcaag

SEQ ID NO: 8998905 - DNA, 20 bp, Homo sapiens
accagaggaaagagcagtga

SEQ ID NO: 8998906 - DNA, 20 bp, Homo sapiens
accagaggaaagagcagtga

SEQ ID NO: 8998907 - DNA, 22 bp, Homo sapiens
accagagctggctctgagcacc

SEQ ID NO: 8998908 - DNA, 22 bp, Homo sapiens
accagagctggctctgagcacc

SEQ ID NO: 8998909 - DNA, 22 bp, Homo sapiens
accagagcttacatgctagaaa

SEQ ID NO: 8998910 - DNA, 22 bp, Homo sapiens
accagagcttacatgctagaaa

SEQ ID NO: 8998911 - DNA, 22 bp, Homo sapiens
accagagggagacttcctcttc

SEQ ID NO: 8998912 - DNA, 22 bp, Homo sapiens
accagagggagacttcctcttc

SEQ ID NO: 8998913 - DNA, 22 bp, Homo sapiens
accagagggagacttcctcttc

SEQ ID NO: 8998914 - DNA, 22 bp, Homo sapiens
accagagggcaaaccccagtgt

SEQ ID NO: 8998915 - DNA, 22 bp, Homo sapiens
accagagggcaaaccccagtgt

SEQ ID NO: 8998916 - DNA, 22 bp, Homo sapiens
accagagggcaaaccccagtgt

SEQ ID NO: 8998917 - DNA, 22 bp, Homo sapiens
accagagtaatgtgtggaaatt

SEQ ID NO: 8998918 - DNA, 22 bp, Homo sapiens
accagaggctctgccacctcca

SEQ ID NO: 8998919 - DNA, 22 bp, Homo sapiens
accagaggctctgccacctcca

SEQ ID NO: 8998920 - DNA, 22 bp, Homo sapiens
accagaggcagtttcggctggt

SEQ ID NO: 8998921 - DNA, 22 bp, Homo sapiens
accagaggaggaattaccttcc

SEQ ID NO: 8998922 - DNA, 22 bp, Homo sapiens
accagaggaggaattaccttcc

SEQ ID NO: 8998923 - DNA, 22 bp, Homo sapiens
accagaggcagtttcggctggt

SEQ ID NO: 8998924 - DNA, 22 bp, Homo sapiens
accagaggaggaattaccttcc

SEQ ID NO: 8998925 - DNA, 22 bp, Homo sapiens
accagcacctgataggcagtaa

SEQ ID NO: 8998926 - DNA, 22 bp, Homo sapiens
accagcaagattttgctttgca

SEQ ID NO: 8998927 - DNA, 22 bp, Homo sapiens
aaggggaaaaagtgttaggagt

SEQ ID NO: 8998928 - DNA, 23 bp, Homo sapiens
accagcaaaaatgacagcccagg

SEQ ID NO: 8998929 - DNA, 23 bp, Homo sapiens
accagcaaaaatgacagcccagg

SEQ ID NO: 8998930 - DNA, 23 bp, Homo sapiens
accagcaaaaatgacagcccagg

SEQ ID NO: 8998931 - DNA, 22 bp, Homo sapiens
accagcaagattttgctttgca

SEQ ID NO: 8998932 - DNA, 22 bp, Homo sapiens
accagcaagattttgctttgca

SEQ ID NO: 8998933 - DNA, 22 bp, Homo sapiens
aagggggccacacctggtgtga

SEQ ID NO: 8998934 - DNA, 22 bp, Homo sapiens
aagggggcccagcactaagttg

SEQ ID NO: 8998935 - DNA, 22 bp, Homo sapiens
aagggggcccagcactaagttg

SEQ ID NO: 8998936 - DNA, 22 bp, Homo sapiens
aagggggcgaagacgtgattga

SEQ ID NO: 8998937 - DNA, 22 bp, Homo sapiens
aaggggaagagaccgcagagtc

SEQ ID NO: 8998938 - DNA, 22 bp, Homo sapiens
aagggggcacagtcactgtaat

SEQ ID NO: 8998939 - DNA, 22 bp, Homo sapiens
aagggggcacagtcactgtaat

SEQ ID NO: 8998940 - DNA, 22 bp, Homo sapiens
aagggggccacacctggtgtga

SEQ ID NO: 8998941 - DNA, 19 bp, Homo sapiens
aaggggtgagggaagcaga

SEQ ID NO: 8998942 - DNA, 19 bp, Homo sapiens
aaggggtgagggaagcaga

SEQ ID NO: 8998943 - DNA, 19 bp, Homo sapiens
aaggggtgagggaagcaga

SEQ ID NO: 8998944 - DNA, 22 bp, Homo sapiens
aaggggtgctgttggaaaccca

SEQ ID NO: 8998945 - DNA, 22 bp, Homo sapiens
aaggggtgctgttggaaaccca

SEQ ID NO: 8998946 - DNA, 22 bp, Homo sapiens
aaggggtgctgttggaaaccca

SEQ ID NO: 8998947 - DNA, 22 bp, Homo sapiens
aaggggtgcaagttaatcagca

SEQ ID NO: 8998948 - DNA, 22 bp, Homo sapiens
aaggggtgcaagttaatcagca

SEQ ID NO: 8998949 - DNA, 22 bp, Homo sapiens
aagggggcggcagccagtggaa

SEQ ID NO: 8998950 - DNA, 22 bp, Homo sapiens
aagggggcggcagccagtggaa

SEQ ID NO: 8998951 - DNA, 22 bp, Homo sapiens
aagggggcggcagccagtggaa

SEQ ID NO: 8998952 - DNA, 22 bp, Homo sapiens
aagggggcggcagccagtggaa

SEQ ID NO: 8998953 - DNA, 22 bp, Homo sapiens
aagggggcgaagacgtgattga

SEQ ID NO: 8998954 - DNA, 22 bp, Homo sapiens
aaggggtgagcagaggcttcgc

SEQ ID NO: 8998955 - DNA, 22 bp, Homo sapiens
aaggggtgagcagaggcttcgc

SEQ ID NO: 8998956 - DNA, 22 bp, Homo sapiens
aagggtggtgtaggagatcaaa

SEQ ID NO: 8998957 - DNA, 22 bp, Homo sapiens
aagggtgggccctggcagccat

SEQ ID NO: 8998958 - DNA, 22 bp, Homo sapiens
aagggtgggccctggcagccat

SEQ ID NO: 8998959 - DNA, 22 bp, Homo sapiens
aagggtgggcaccgccaggtca

SEQ ID NO: 8998960 - DNA, 22 bp, Homo sapiens
aagggtgggcaccgccaggtca

SEQ ID NO: 8998961 - DNA, 22 bp, Homo sapiens
aagggtggatttctgagctcta

SEQ ID NO: 8998962 - DNA, 22 bp, Homo sapiens
aagggtgggcaccgccaggtca

SEQ ID NO: 8998963 - DNA, 22 bp, Homo sapiens
aagggtggatttctgagctcta

SEQ ID NO: 8998964 - DNA, 22 bp, Homo sapiens
aagggtggatttctgagctcta

SEQ ID NO: 8998965 - DNA, 22 bp, Homo sapiens
aagggtcttagaggttcatttt

SEQ ID NO: 8998966 - DNA, 22 bp, Homo sapiens
aagggtgcaaagcactctagct

SEQ ID NO: 8998967 - DNA, 22 bp, Homo sapiens
aagggtgaagggtggtggccta

SEQ ID NO: 8998968 - DNA, 22 bp, Homo sapiens
aagggtgaagggtggtggccta

SEQ ID NO: 8998969 - DNA, 22 bp, Homo sapiens
aagggtgcgacctaggagtgag

SEQ ID NO: 8998970 - DNA, 22 bp, Homo sapiens
aaggggtgggcattagagcagt

SEQ ID NO: 8998971 - DNA, 22 bp, Homo sapiens
aaggggtgggcattagagcagt

SEQ ID NO: 8998972 - DNA, 22 bp, Homo sapiens
aaggggtgggcattagagcagt

SEQ ID NO: 8998973 - DNA, 22 bp, Homo sapiens
aaggtaatccataatagttact

SEQ ID NO: 8998974 - DNA, 22 bp, Homo sapiens
aaggtaatgaaacagcagctaa

SEQ ID NO: 8998975 - DNA, 22 bp, Homo sapiens
aaggtaatcagcctttccacaa

SEQ ID NO: 8998976 - DNA, 22 bp, Homo sapiens
aaggtaatatttttctctctaa

SEQ ID NO: 8998977 - DNA, 22 bp, Homo sapiens
aagggtttgtctccctcaaggc

SEQ ID NO: 8998978 - DNA, 22 bp, Homo sapiens
aagggtttgtctccctcaaggc

SEQ ID NO: 8998979 - DNA, 22 bp, Homo sapiens
aagggtttgtctccctcaaggc

SEQ ID NO: 8998980 - DNA, 22 bp, Homo sapiens
aagggttggggaagagcaaatt

SEQ ID NO: 8998981 - DNA, 22 bp, Homo sapiens
aagggttgcaaggtcagaggaa

SEQ ID NO: 8998982 - DNA, 22 bp, Homo sapiens
aagggttgaagataaataaggt

SEQ ID NO: 8998983 - DNA, 22 bp, Homo sapiens
aagggtgttgatcagagaggat

SEQ ID NO: 8998984 - DNA, 22 bp, Homo sapiens
aagggttgcaaggtcagaggaa

SEQ ID NO: 8998985 - DNA, 22 bp, Homo sapiens
aagggttgcaaggtcagaggaa

SEQ ID NO: 8998986 - DNA, 22 bp, Homo sapiens
aagggtggtgtaggagatcaaa

SEQ ID NO: 8998987 - DNA, 22 bp, Homo sapiens
aagggtgttgatcagagaggat

SEQ ID NO: 8998988 - DNA, 22 bp, Homo sapiens
aagggttagttggattatttat

SEQ ID NO: 8998989 - DNA, 22 bp, Homo sapiens
aagggttgaagataaataaggt

SEQ ID NO: 8998990 - DNA, 22 bp, Homo sapiens
aaggtacagaaattaacaagga

SEQ ID NO: 8998991 - DNA, 22 bp, Homo sapiens
aaggtacagaaattaacaagga

SEQ ID NO: 8998992 - DNA, 22 bp, Homo sapiens
aaggtacagaaattaacaagga

SEQ ID NO: 8998993 - DNA, 22 bp, Homo sapiens
aaggtacaaagtattatttaaa

SEQ ID NO: 8998994 - DNA, 22 bp, Homo sapiens
aaggtacaaagttatacagcgt

SEQ ID NO: 8998995 - DNA, 22 bp, Homo sapiens
aaggtacaaagttatacagcgt

SEQ ID NO: 8998996 - DNA, 22 bp, Homo sapiens
aaggtagatgttgtcatgccca

SEQ ID NO: 8998997 - DNA, 22 bp, Homo sapiens
aaggtacagttttaagaataag

SEQ ID NO: 8998998 - DNA, 22 bp, Homo sapiens
aaggtacagttttaagaataag

SEQ ID NO: 8998999 - DNA, 22 bp, Homo sapiens
acccaggcagcaggagctaaag

SEQ ID NO: 8999000 - DNA, 22 bp, Homo sapiens
aaggtacagggaaggagcaaga

SEQ ID NO: 8999001 - DNA, 22 bp, Homo sapiens
aaggtacagggaaggagcaaga

SEQ ID NO: 8999002 - DNA, 22 bp, Homo sapiens
aaggtacagggtattagattat

SEQ ID NO: 8999003 - DNA, 22 bp, Homo sapiens
aagtcctgtgtgcttacacttg

SEQ ID NO: 8999004 - DNA, 22 bp, Homo sapiens
aagtcctgggtgagaactgtcc

SEQ ID NO: 8999005 - DNA, 22 bp, Homo sapiens
aagtcctgttcctcatacttcc

SEQ ID NO: 8999006 - DNA, 22 bp, Homo sapiens
acctgcccttaacactgtgtgc

SEQ ID NO: 8999007 - DNA, 22 bp, Homo sapiens
acctgcccttaacactgtgtgc

SEQ ID NO: 8999008 - DNA, 22 bp, Homo sapiens
acctgcctagttggttctgccc

SEQ ID NO: 8999009 - DNA, 22 bp, Homo sapiens
acctgcccggggacattccttt

SEQ ID NO: 8999010 - DNA, 22 bp, Homo sapiens
acctgcctatcagctgcctgct

SEQ ID NO: 8999011 - DNA, 22 bp, Homo sapiens
acctgcctatcagctgcctgct

SEQ ID NO: 8999012 - DNA, 22 bp, Homo sapiens
acctgcctatcagctgcctgct

SEQ ID NO: 8999013 - DNA, 22 bp, Homo sapiens
acctgcctagttggttctgccc

SEQ ID NO: 8999014 - DNA, 22 bp, Homo sapiens
acctgcctatcagctgcctgct

SEQ ID NO: 8999015 - DNA, 22 bp, Homo sapiens
acctgcctagttggttctgccc

SEQ ID NO: 8999016 - DNA, 22 bp, Homo sapiens
acctgcctagttggttctgccc

SEQ ID NO: 8999017 - DNA, 22 bp, Homo sapiens
acctgcctatcagctgcctgct

SEQ ID NO: 8999018 - DNA, 22 bp, Homo sapiens
acctgcctatcagctgcctgct

SEQ ID NO: 8999019 - DNA, 22 bp, Homo sapiens
acctgcctatggagccacatgg

SEQ ID NO: 8999020 - DNA, 22 bp, Homo sapiens
acctgcctatggagccacatgg

SEQ ID NO: 8999021 - DNA, 22 bp, Homo sapiens
acctgcctatggagccacatgg

SEQ ID NO: 8999022 - DNA, 22 bp, Homo sapiens
aagtcctgtgctagagacacct

SEQ ID NO: 8999023 - DNA, 20 bp, Homo sapiens
aagtcctgacctagtctaaa

SEQ ID NO: 8999024 - DNA, 22 bp, Homo sapiens
aagtcctaaacacacacaaggc

SEQ ID NO: 8999025 - DNA, 22 bp, Homo sapiens
aagtcctaattttaggaggaga

SEQ ID NO: 8999026 - DNA, 22 bp, Homo sapiens
aagtcctcaattttctctgcta

SEQ ID NO: 8999027 - DNA, 22 bp, Homo sapiens
aagtcctagacttggatagttt

SEQ ID NO: 8999028 - DNA, 22 bp, Homo sapiens
aagtcctgaaacttctttctga

SEQ ID NO: 8999029 - DNA, 22 bp, Homo sapiens
aagtcctgaaacttctttctga

SEQ ID NO: 8999030 - DNA, 22 bp, Homo sapiens
aagtccctggttcctagcaaaa

SEQ ID NO: 8999031 - DNA, 22 bp, Homo sapiens
aagtccctggttcctagcaaaa

SEQ ID NO: 8999032 - DNA, 22 bp, Homo sapiens
aagtccctttaatcagtgcctt

SEQ ID NO: 8999033 - DNA, 22 bp, Homo sapiens
aagtccctgtggggtggaggct

SEQ ID NO: 8999034 - DNA, 22 bp, Homo sapiens
aagtccctttaatcagtgcctt

SEQ ID NO: 8999035 - DNA, 22 bp, Homo sapiens
aagtccctggtgctggctgcgc

SEQ ID NO: 8999036 - DNA, 20 bp, Homo sapiens
aagtccctaagtctctggcc

SEQ ID NO: 8999037 - DNA, 22 bp, Homo sapiens
aagtcccaaagtcactctgctt

SEQ ID NO: 8999038 - DNA, 22 bp, Homo sapiens
aagtccattaggcccctgcctg

SEQ ID NO: 8999039 - DNA, 22 bp, Homo sapiens
aagtccattcttccagccagct

SEQ ID NO: 8999040 - DNA, 22 bp, Homo sapiens
aagtcatcactcctctgaactt

SEQ ID NO: 8999041 - DNA, 22 bp, Homo sapiens
aagtccagtttttccaggtggt

SEQ ID NO: 8999042 - DNA, 22 bp, Homo sapiens
aagtatatttagctgagcttgt

SEQ ID NO: 8999043 - DNA, 22 bp, Homo sapiens
aagtatattttttgaagcatat

SEQ ID NO: 8999044 - DNA, 22 bp, Homo sapiens
aagtatatttagctgagcttgt

SEQ ID NO: 8999045 - DNA, 20 bp, Homo sapiens
aagtatatgtccgtgtactt

SEQ ID NO: 8999046 - DNA, 20 bp, Homo sapiens
aagtatatgtccgtgtactt

SEQ ID NO: 8999047 - DNA, 22 bp, Homo sapiens
aagtatatactaaatgttaatc

SEQ ID NO: 8999048 - DNA, 22 bp, Homo sapiens
aagtatatactaaatgttaatc

SEQ ID NO: 8999049 - DNA, 22 bp, Homo sapiens
aagtatatactaaatgttaatc

SEQ ID NO: 8999050 - DNA, 22 bp, Homo sapiens
aagtatattttttgaagcatat

SEQ ID NO: 8999051 - DNA, 22 bp, Homo sapiens
aagtatctcaaaaacagtaatc

SEQ ID NO: 8999052 - DNA, 22 bp, Homo sapiens
aagtatctcaaaaacagtaatc

SEQ ID NO: 8999053 - DNA, 22 bp, Homo sapiens
aagtatctcaaaaacagtaatc

SEQ ID NO: 8999054 - DNA, 22 bp, Homo sapiens
aagtcagtgaaaaggcatcatc

SEQ ID NO: 8999055 - DNA, 22 bp, Homo sapiens
aagtcagtgctagctaatggct

SEQ ID NO: 8999056 - DNA, 22 bp, Homo sapiens
aagtcatagtcgggaaagacat

SEQ ID NO: 8999057 - DNA, 22 bp, Homo sapiens
aagtataagctattcttcatga

SEQ ID NO: 8999058 - DNA, 22 bp, Homo sapiens
aagtagttggaaataagacaga

SEQ ID NO: 8999059 - DNA, 22 bp, Homo sapiens
aagtagtgtgctccagcggtga

SEQ ID NO: 8999060 - DNA, 22 bp, Homo sapiens
aagtagttaggaacattctctc

SEQ ID NO: 8999061 - DNA, 22 bp, Homo sapiens
aagtagtgtgctccagcggtga

SEQ ID NO: 8999062 - DNA, 22 bp, Homo sapiens
aagtataagctattcttcatga

SEQ ID NO: 8999063 - DNA, 22 bp, Homo sapiens
aagtatactgaaggtatccagg

SEQ ID NO: 8999064 - DNA, 22 bp, Homo sapiens
aagtatacttaaaagagttgat

SEQ ID NO: 8999065 - DNA, 22 bp, Homo sapiens
aagtatacttaggcataatggt

SEQ ID NO: 8999066 - DNA, 22 bp, Homo sapiens
aagtatacttaggcataatggt

SEQ ID NO: 8999067 - DNA, 22 bp, Homo sapiens
aagtatatactaaatgttaatc

SEQ ID NO: 8999068 - DNA, 22 bp, Homo sapiens
aagtagcatcaaggaggatcca

SEQ ID NO: 8999069 - DNA, 22 bp, Homo sapiens
aagtaggaatccgaatgagtag

SEQ ID NO: 8999070 - DNA, 22 bp, Homo sapiens
aagtagccttatggttttccag

SEQ ID NO: 8999071 - DNA, 22 bp, Homo sapiens
aagtagccaacaccctttccat

SEQ ID NO: 8999072 - DNA, 22 bp, Homo sapiens
aagtagcattttcaaaatgtat

SEQ ID NO: 8999073 - DNA, 22 bp, Homo sapiens
aagtagacttttgcatcaagga

SEQ ID NO: 8999074 - DNA, 22 bp, Homo sapiens
acccagggcagccagcggggag

SEQ ID NO: 8999075 - DNA, 22 bp, Homo sapiens
acccagggcagccagcggggag

SEQ ID NO: 8999076 - DNA, 22 bp, Homo sapiens
acccagggctcaagcgtaggca

SEQ ID NO: 8999077 - DNA, 22 bp, Homo sapiens
acccagggccacagcccgcagt

SEQ ID NO: 8999078 - DNA, 22 bp, Homo sapiens
acccagggcagccagcggggag

SEQ ID NO: 8999079 - DNA, 22 bp, Homo sapiens
acccaggcagcaggagctaaag

SEQ ID NO: 8999080 - DNA, 22 bp, Homo sapiens
acccagggagtgctcctgttct

SEQ ID NO: 8999081 - DNA, 22 bp, Homo sapiens
acccaggccattggcaagagtc

SEQ ID NO: 8999082 - DNA, 22 bp, Homo sapiens
acccaggccattggcaagagtc

SEQ ID NO: 8999083 - DNA, 22 bp, Homo sapiens
acccaggccattggcaagagtc

SEQ ID NO: 8999084 - DNA, 22 bp, Homo sapiens
acccagggcttaaggcggtgca

SEQ ID NO: 8999085 - DNA, 22 bp, Homo sapiens
acccagggctcaagcgtaggca

SEQ ID NO: 8999086 - DNA, 22 bp, Homo sapiens
acccagggctcaagcgtaggca

SEQ ID NO: 8999087 - DNA, 22 bp, Homo sapiens
acccagggctcaagcgtaggca

SEQ ID NO: 8999088 - DNA, 22 bp, Homo sapiens
acccagggctcaagcgtaggca

SEQ ID NO: 8999089 - DNA, 22 bp, Homo sapiens
acccagggcttaaggcggtgca

SEQ ID NO: 8999090 - DNA, 22 bp, Homo sapiens
acccagggcttaaggcggtgca

SEQ ID NO: 8999091 - DNA, 21 bp, Homo sapiens
acccaggggaagcagaaactg

SEQ ID NO: 8999092 - DNA, 21 bp, Homo sapiens
acccaggggaagcagaaactg

SEQ ID NO: 8999093 - DNA, 22 bp, Homo sapiens
acccaggggcagccttgctgtg

SEQ ID NO: 8999094 - DNA, 22 bp, Homo sapiens
acccaggggcagccttgctgtg

SEQ ID NO: 8999095 - DNA, 22 bp, Homo sapiens
acccaggggcgaagctggccac

SEQ ID NO: 8999096 - DNA, 19 bp, Homo sapiens
acccaggggtttatgtgtg

SEQ ID NO: 8999097 - DNA, 22 bp, Homo sapiens
acccaggggcgaagctggccac

SEQ ID NO: 8999098 - DNA, 22 bp, Homo sapiens
acccagggtagaacctcagagc

SEQ ID NO: 8999099 - DNA, 19 bp, Homo sapiens
acccaggggtttatgtgtg

SEQ ID NO: 8999100 - DNA, 22 bp, Homo sapiens
acccagggtagaacctcagagc

SEQ ID NO: 8999101 - DNA, 22 bp, Homo sapiens
acccagggtagaacctcagagc

SEQ ID NO: 8999102 - DNA, 22 bp, Homo sapiens
aaggtggtgagtacagttaggt

SEQ ID NO: 8999103 - DNA, 17 bp, Homo sapiens
acctattgatctgtcac

SEQ ID NO: 8999104 - DNA, 17 bp, Homo sapiens
acctattgatctgtcac

SEQ ID NO: 8999105 - DNA, 20 bp, Homo sapiens
acctcctggaagcaggtgcc

SEQ ID NO: 8999106 - DNA, 20 bp, Homo sapiens
acctcctggaagcaggtgcc

SEQ ID NO: 8999107 - DNA, 20 bp, Homo sapiens
acctcctggaagcaggtgcc

SEQ ID NO: 8999108 - DNA, 22 bp, Homo sapiens
aaggtgtcaccagattggcagg

SEQ ID NO: 8999109 - DNA, 20 bp, Homo sapiens
acctagtacaatctgtttct

SEQ ID NO: 8999110 - DNA, 22 bp, Homo sapiens
acctcctggctgctcatggaac

SEQ ID NO: 8999111 - DNA, 22 bp, Homo sapiens
acctcctggctgctcatggaac

SEQ ID NO: 8999112 - DNA, 20 bp, Homo sapiens
acctcctggcgggcatcctc

SEQ ID NO: 8999113 - DNA, 21 bp, Homo sapiens
acctcctggcatcctgttccc

SEQ ID NO: 8999114 - DNA, 21 bp, Homo sapiens
acctcctggcatcctgttccc

SEQ ID NO: 8999115 - DNA, 22 bp, Homo sapiens
acctcctggcctcaagcaatcc

SEQ ID NO: 8999116 - DNA, 22 bp, Homo sapiens
acctcctggcttatcatggaca

SEQ ID NO: 8999117 - DNA, 22 bp, Homo sapiens
acctcctggtgcccaagtgttt

SEQ ID NO: 8999118 - DNA, 22 bp, Homo sapiens
acctcctggcttatcatggaca

SEQ ID NO: 8999119 - DNA, 22 bp, Homo sapiens
acctctaaaaaattagaagcct

SEQ ID NO: 8999120 - DNA, 22 bp, Homo sapiens
acctctcaggtcttcctcatat

SEQ ID NO: 8999121 - DNA, 22 bp, Homo sapiens
acctctctgggcctgcttcctg

SEQ ID NO: 8999122 - DNA, 22 bp, Homo sapiens
acctctgaaacttaatctattg

SEQ ID NO: 8999123 - DNA, 22 bp, Homo sapiens
acctctcttgtagctgctggtg

SEQ ID NO: 8999124 - DNA, 22 bp, Homo sapiens
acctctgaagggccaagcaatg

SEQ ID NO: 8999125 - DNA, 22 bp, Homo sapiens
acctctgaaggtttacatttcc

SEQ ID NO: 8999126 - DNA, 22 bp, Homo sapiens
acctctgaacatttttaagact

SEQ ID NO: 8999127 - DNA, 22 bp, Homo sapiens
acctctgaagggccaagcaatg

SEQ ID NO: 8999128 - DNA, 22 bp, Homo sapiens
acctctcaggtcttcctcatat

SEQ ID NO: 8999129 - DNA, 22 bp, Homo sapiens
acctctctgggcctgcttcctg

SEQ ID NO: 8999130 - DNA, 22 bp, Homo sapiens
acctctctgggcctgcttcctg

SEQ ID NO: 8999131 - DNA, 22 bp, Homo sapiens
acctctctgggcctgcttcctg

SEQ ID NO: 8999132 - DNA, 22 bp, Homo sapiens
acctctgagatgagtcagggga

SEQ ID NO: 8999133 - DNA, 19 bp, Homo sapiens
acctctgagaatgccagtc

SEQ ID NO: 8999134 - DNA, 19 bp, Homo sapiens
acctctgagaatgccagtc

SEQ ID NO: 8999135 - DNA, 20 bp, Homo sapiens
acctctgacccagagcaggc

SEQ ID NO: 8999136 - DNA, 20 bp, Homo sapiens
acctctgacccagagcaggc

SEQ ID NO: 8999137 - DNA, 22 bp, Homo sapiens
acctctgacctctgagagagaa

SEQ ID NO: 8999138 - DNA, 22 bp, Homo sapiens
acctctgacctctgagagagaa

SEQ ID NO: 8999139 - DNA, 22 bp, Homo sapiens
acctctgagccatggaaggtga

SEQ ID NO: 8999140 - DNA, 22 bp, Homo sapiens
acctctgaggtgaggaggagct

SEQ ID NO: 8999141 - DNA, 22 bp, Homo sapiens
acctctgaggtgaggaggagct

SEQ ID NO: 8999142 - DNA, 22 bp, Homo sapiens
acctctggacactgcatccttc

SEQ ID NO: 8999143 - DNA, 22 bp, Homo sapiens
acctctggacactgcatccttc

SEQ ID NO: 8999144 - DNA, 22 bp, Homo sapiens
acctctggacactgcatccttc

SEQ ID NO: 8999145 - DNA, 22 bp, Homo sapiens
acctctggcaccccctggcttg

SEQ ID NO: 8999146 - DNA, 22 bp, Homo sapiens
acaatatttgggggcagtttgt

SEQ ID NO: 8999147 - DNA, 22 bp, Homo sapiens
acaatatttgggggcagtttgt

SEQ ID NO: 8999148 - DNA, 22 bp, Homo sapiens
acaatattgtacccagaagttt

SEQ ID NO: 8999149 - DNA, 22 bp, Homo sapiens
acaatgtagagtaaaatatgtt

SEQ ID NO: 8999150 - DNA, 22 bp, Homo sapiens
acaatgtagagtaaaatatgtt

SEQ ID NO: 8999151 - DNA, 22 bp, Homo sapiens
acaatatttgggggcagtttgt

SEQ ID NO: 8999152 - DNA, 20 bp, Homo sapiens
acaatatgtagatgaatagc

SEQ ID NO: 8999153 - DNA, 22 bp, Homo sapiens
acaatattgtacccagaagttt

SEQ ID NO: 8999154 - DNA, 22 bp, Homo sapiens
acaatattgtacccagaagttt

SEQ ID NO: 8999155 - DNA, 22 bp, Homo sapiens
acaatattgtacccagaagttt

SEQ ID NO: 8999156 - DNA, 22 bp, Homo sapiens
acaatatagtccatgagcatgc

SEQ ID NO: 8999157 - DNA, 22 bp, Homo sapiens
acaatatagtccatgagcatgc

SEQ ID NO: 8999158 - DNA, 22 bp, Homo sapiens
acaatatagtccatgagcatgc

SEQ ID NO: 8999159 - DNA, 22 bp, Homo sapiens
acaatatagtccatgagcatgc

SEQ ID NO: 8999160 - DNA, 22 bp, Homo sapiens
acaatatgggatatacatttta

SEQ ID NO: 8999161 - DNA, 20 bp, Homo sapiens
acaatatgtagatgaatagc

SEQ ID NO: 8999162 - DNA, 22 bp, Homo sapiens
acaatatgggatatacatttta

SEQ ID NO: 8999163 - DNA, 20 bp, Homo sapiens
acaatatgtagatgaatagc

SEQ ID NO: 8999164 - DNA, 22 bp, Homo sapiens
acaatatgggatatacatttta

SEQ ID NO: 8999165 - DNA, 22 bp, Homo sapiens
acaatatgggatatacatttta

SEQ ID NO: 8999166 - DNA, 22 bp, Homo sapiens
acaatgtgataatttaaagata

SEQ ID NO: 8999167 - DNA, 22 bp, Homo sapiens
acaatgtgcttatgaaggcagt

SEQ ID NO: 8999168 - DNA, 22 bp, Homo sapiens
acaatgtgataatttaaagata

SEQ ID NO: 8999169 - DNA, 22 bp, Homo sapiens
acaatgtgtttttatacatttg

SEQ ID NO: 8999170 - DNA, 22 bp, Homo sapiens
acaatgtgggcatgagaaacca

SEQ ID NO: 8999171 - DNA, 22 bp, Homo sapiens
acaatgtcacctctcatgtttt

SEQ ID NO: 8999172 - DNA, 22 bp, Homo sapiens
acaatgtctcatattcgtgttc

SEQ ID NO: 8999173 - DNA, 22 bp, Homo sapiens
acaatgtctcatattcgtgttc

SEQ ID NO: 8999174 - DNA, 23 bp, Homo sapiens
acaatgtctgttcataaaatacc

SEQ ID NO: 8999175 - DNA, 22 bp, Homo sapiens
acaatgtcaaaataggaaacat

SEQ ID NO: 8999176 - DNA, 22 bp, Homo sapiens
acaatgtagttgtcatgagaca

SEQ ID NO: 8999177 - DNA, 22 bp, Homo sapiens
acaatgtcaaaataggaaacat

SEQ ID NO: 8999178 - DNA, 22 bp, Homo sapiens
acaatgtcacctctcatgtttt

SEQ ID NO: 8999179 - DNA, 21 bp, Homo sapiens
acaatgtcaaggtcagacatt

SEQ ID NO: 8999180 - DNA, 21 bp, Homo sapiens
acaatgtcaaggtcagacatt

SEQ ID NO: 8999181 - DNA, 22 bp, Homo sapiens
acaatgtagttgtcatgagaca

SEQ ID NO: 8999182 - DNA, 22 bp, Homo sapiens
acaatgtaggctgaaaaagctt

SEQ ID NO: 8999183 - DNA, 22 bp, Homo sapiens
acaatgtaggctgaaaaagctt

SEQ ID NO: 8999184 - DNA, 22 bp, Homo sapiens
acaatgtaggatatgtacttgt

SEQ ID NO: 8999185 - DNA, 22 bp, Homo sapiens
acaatgtaggagtatgacagta

SEQ ID NO: 8999186 - DNA, 22 bp, Homo sapiens
acaatgtaggagtatgacagta

SEQ ID NO: 8999187 - DNA, 22 bp, Homo sapiens
acaatgtaggatatgtacttgt

SEQ ID NO: 8999188 - DNA, 22 bp, Homo sapiens
acaaatttgaatcctgacttct

SEQ ID NO: 8999189 - DNA, 22 bp, Homo sapiens
acaaatttggtgagagtaaata

SEQ ID NO: 8999190 - DNA, 22 bp, Homo sapiens
acaaatttgaatcctgacttct

SEQ ID NO: 8999191 - DNA, 22 bp, Homo sapiens
acaaatttgaatcctgacttct

SEQ ID NO: 8999192 - DNA, 22 bp, Homo sapiens
acaaatttgaatcctgacttct

SEQ ID NO: 8999193 - DNA, 22 bp, Homo sapiens
acaacaaaatcactagtcttcc

SEQ ID NO: 8999194 - DNA, 22 bp, Homo sapiens
acaaatttgtgtagttatggca

SEQ ID NO: 8999195 - DNA, 22 bp, Homo sapiens
acaaatttgtgtagttatggca

SEQ ID NO: 8999196 - DNA, 22 bp, Homo sapiens
acaaatttggtgagagtaaata

SEQ ID NO: 8999197 - DNA, 22 bp, Homo sapiens
acaaatttcataggcaaatttt

SEQ ID NO: 8999198 - DNA, 22 bp, Homo sapiens
acaaatttcataggcaaatttt

SEQ ID NO: 8999199 - DNA, 22 bp, Homo sapiens
acaaatttcataggcaaatttt

SEQ ID NO: 8999200 - DNA, 22 bp, Homo sapiens
acaaatttcataggcaaatttt

SEQ ID NO: 8999201 - DNA, 22 bp, Homo sapiens
acaaattgttgcttcatgaatg

SEQ ID NO: 8999202 - DNA, 22 bp, Homo sapiens
acaaattgttgcttcatgaatg

SEQ ID NO: 8999203 - DNA, 22 bp, Homo sapiens
acaaattgttgcttcatgaatg

SEQ ID NO: 8999204 - DNA, 22 bp, Homo sapiens
acaaattgttgggactcagccc

SEQ ID NO: 8999205 - DNA, 20 bp, Homo sapiens
acaatagatttgagcaaagt

SEQ ID NO: 8999206 - DNA, 20 bp, Homo sapiens
acaatagatttgagcaaagt

SEQ ID NO: 8999207 - DNA, 20 bp, Homo sapiens
acaatagatttgagcaaagt

SEQ ID NO: 8999208 - DNA, 22 bp, Homo sapiens
acaataggtgtccaattaacaa

SEQ ID NO: 8999209 - DNA, 22 bp, Homo sapiens
acaatagtatgagccttttaga

SEQ ID NO: 8999210 - DNA, 22 bp, Homo sapiens
acaatagtaaggtatattgtca

SEQ ID NO: 8999211 - DNA, 22 bp, Homo sapiens
acaatatacacatcctaatggg

SEQ ID NO: 8999212 - DNA, 22 bp, Homo sapiens
acaatagagttctcataggaca

SEQ ID NO: 8999213 - DNA, 22 bp, Homo sapiens
acaatagagttctcataggaca

SEQ ID NO: 8999214 - DNA, 22 bp, Homo sapiens
acaatagagttctcataggaca

SEQ ID NO: 8999215 - DNA, 22 bp, Homo sapiens
acaatagacccatgacacatac

SEQ ID NO: 8999216 - DNA, 22 bp, Homo sapiens
acaatagacccatgacacatac

SEQ ID NO: 8999217 - DNA, 22 bp, Homo sapiens
acaatagagttctcataggaca

SEQ ID NO: 8999218 - DNA, 22 bp, Homo sapiens
acaatagagttctcataggaca

SEQ ID NO: 8999219 - DNA, 20 bp, Homo sapiens
acaatagatttgagcaaagt

SEQ ID NO: 8999220 - DNA, 22 bp, Homo sapiens
acaatagatactgggcacatat

SEQ ID NO: 8999221 - DNA, 22 bp, Homo sapiens
acaatagatactgggcacatat

SEQ ID NO: 8999222 - DNA, 22 bp, Homo sapiens
acaaggcttatagttgcttttt

SEQ ID NO: 8999223 - DNA, 21 bp, Homo sapiens
acaatagacataagcagagca

SEQ ID NO: 8999224 - DNA, 21 bp, Homo sapiens
acaatagacataagcagagca

SEQ ID NO: 8999225 - DNA, 22 bp, Homo sapiens
acaaggcttcacacagtatgaa

SEQ ID NO: 8999226 - DNA, 22 bp, Homo sapiens
acaatagacccatgacacatac

SEQ ID NO: 8999227 - DNA, 22 bp, Homo sapiens
acaatagacccatgacacatac

SEQ ID NO: 8999228 - DNA, 22 bp, Homo sapiens
acaacaaaatcactagtcttcc

SEQ ID NO: 8999229 - DNA, 22 bp, Homo sapiens
acaacaaaatcactagtcttcc

SEQ ID NO: 8999230 - DNA, 22 bp, Homo sapiens
acaacaaaatcactagtcttcc

SEQ ID NO: 8999231 - DNA, 22 bp, Homo sapiens
acaaggcttatagttgcttttt

SEQ ID NO: 8999232 - DNA, 22 bp, Homo sapiens
aagataatgtgtctgtctttgc

SEQ ID NO: 8999233 - DNA, 22 bp, Homo sapiens
aagataatgtgtctgtctttgc

SEQ ID NO: 8999234 - DNA, 22 bp, Homo sapiens
aagatacaaatgtcaatattgg

SEQ ID NO: 8999235 - DNA, 22 bp, Homo sapiens
aagatacaaatgtcaatattgg

SEQ ID NO: 8999236 - DNA, 22 bp, Homo sapiens
aagatacaaatgtcaatattgg

SEQ ID NO: 8999237 - DNA, 22 bp, Homo sapiens
aagatacaaatgtcaatattgg

SEQ ID NO: 8999238 - DNA, 22 bp, Homo sapiens
aagatacaccaagagcctagta

SEQ ID NO: 8999239 - DNA, 22 bp, Homo sapiens
aagatacaccaagagcctagta

SEQ ID NO: 8999240 - DNA, 22 bp, Homo sapiens
aagatacaaatgtcaatattgg

SEQ ID NO: 8999241 - DNA, 22 bp, Homo sapiens
aagatacaaatgtcaatattgg

SEQ ID NO: 8999242 - DNA, 22 bp, Homo sapiens
aagatacacggtcaactctcaa

SEQ ID NO: 8999243 - DNA, 22 bp, Homo sapiens
aagatacaccaagagcctagta

SEQ ID NO: 8999244 - DNA, 22 bp, Homo sapiens
aagataatattcattaactaga

SEQ ID NO: 8999245 - DNA, 22 bp, Homo sapiens
aagataatattcattaactaga

SEQ ID NO: 8999246 - DNA, 22 bp, Homo sapiens
aagataagtaacgagcctcagt

SEQ ID NO: 8999247 - DNA, 22 bp, Homo sapiens
aagataatattcattaactaga

SEQ ID NO: 8999248 - DNA, 22 bp, Homo sapiens
aagataatgtgtctgtctttgc

SEQ ID NO: 8999249 - DNA, 22 bp, Homo sapiens
aagataatattcattaactaga

SEQ ID NO: 8999250 - DNA, 22 bp, Homo sapiens
aagataatattcattaactaga

SEQ ID NO: 8999251 - DNA, 22 bp, Homo sapiens
aagagtttccagttgtggctca

SEQ ID NO: 8999252 - DNA, 22 bp, Homo sapiens
aagagtttccagttgtggctca

SEQ ID NO: 8999253 - DNA, 22 bp, Homo sapiens
acacagctttcagtcattatct

SEQ ID NO: 8999254 - DNA, 22 bp, Homo sapiens
aagagtttatgatataacatgt

SEQ ID NO: 8999255 - DNA, 22 bp, Homo sapiens
aagataacaggaggagtttgta

SEQ ID NO: 8999256 - DNA, 21 bp, Homo sapiens
acacagctgccggagacggat

SEQ ID NO: 8999257 - DNA, 22 bp, Homo sapiens
acacagctcagtgcctccaaga

SEQ ID NO: 8999258 - DNA, 21 bp, Homo sapiens
acacagctgccggagacggat

SEQ ID NO: 8999259 - DNA, 22 bp, Homo sapiens
acacagctgtgcagttttttca

SEQ ID NO: 8999260 - DNA, 22 bp, Homo sapiens
acacagctgtgcagttttttca

SEQ ID NO: 8999261 - DNA, 22 bp, Homo sapiens
acacagcttcaaagtctaattc

SEQ ID NO: 8999262 - DNA, 22 bp, Homo sapiens
acacagctgtgcagttttttca

SEQ ID NO: 8999263 - DNA, 22 bp, Homo sapiens
acacagcttcaaagtctaattc

SEQ ID NO: 8999264 - DNA, 22 bp, Homo sapiens
acacagcttcaaagtctaattc

SEQ ID NO: 8999265 - DNA, 22 bp, Homo sapiens
acacagctgtgcagttttttca

SEQ ID NO: 8999266 - DNA, 22 bp, Homo sapiens
acacagctttcagtcattatct

SEQ ID NO: 8999267 - DNA, 22 bp, Homo sapiens
acacagctagtgagtggcagag

SEQ ID NO: 8999268 - DNA, 22 bp, Homo sapiens
acacagctagtgagtggcagag

SEQ ID NO: 8999269 - DNA, 22 bp, Homo sapiens
acacagctatggggtaggaaac

SEQ ID NO: 8999270 - DNA, 22 bp, Homo sapiens
acacagctagtgagtggcagag

SEQ ID NO: 8999271 - DNA, 22 bp, Homo sapiens
acacagctatggggtaggaaac

SEQ ID NO: 8999272 - DNA, 22 bp, Homo sapiens
acacagctcacaacgtgtgcat

SEQ ID NO: 8999273 - DNA, 22 bp, Homo sapiens
acacagctatggggtaggaaac

SEQ ID NO: 8999274 - DNA, 22 bp, Homo sapiens
acacagctcagtgcctccaaga

SEQ ID NO: 8999275 - DNA, 22 bp, Homo sapiens
acacagctcacaacgtgtgcat

SEQ ID NO: 8999276 - DNA, 22 bp, Homo sapiens
acacagctcacaacgtgtgcat

SEQ ID NO: 8999277 - DNA, 22 bp, Homo sapiens
acacagcaaggtctgactttgg

SEQ ID NO: 8999278 - DNA, 22 bp, Homo sapiens
acacagccagggtagtaaggct

SEQ ID NO: 8999279 - DNA, 22 bp, Homo sapiens
acacagcagaaggcccgtgtct

SEQ ID NO: 8999280 - DNA, 17 bp, Homo sapiens
acacagccaggttctcc

SEQ ID NO: 8999281 - DNA, 17 bp, Homo sapiens
acacagccaggttctcc

SEQ ID NO: 8999282 - DNA, 22 bp, Homo sapiens
acacagccgtgaatctgcttct

SEQ ID NO: 8999283 - DNA, 22 bp, Homo sapiens
acacagctagtgagtggcagag

SEQ ID NO: 8999284 - DNA, 22 bp, Homo sapiens
acacagccagggtagtaaggct

SEQ ID NO: 8999285 - DNA, 22 bp, Homo sapiens
acacagccccacggtgagcaaa

SEQ ID NO: 8999286 - DNA, 22 bp, Homo sapiens
acacagccccacggtgagcaaa

SEQ ID NO: 8999287 - DNA, 17 bp, Homo sapiens
acacagccaggttctcc

SEQ ID NO: 8999288 - DNA, 22 bp, Homo sapiens
acacagccccacggtgagcaaa

SEQ ID NO: 8999289 - DNA, 22 bp, Homo sapiens
acacagagccagggaatacagt

SEQ ID NO: 8999290 - DNA, 22 bp, Homo sapiens
acacagagccagggaatacagt

SEQ ID NO: 8999291 - DNA, 22 bp, Homo sapiens
acacagagctggaactgcttca

SEQ ID NO: 8999292 - DNA, 22 bp, Homo sapiens
acacagagccagggaatacagt

SEQ ID NO: 8999293 - DNA, 22 bp, Homo sapiens
acacagagccagggaatacagt

SEQ ID NO: 8999294 - DNA, 22 bp, Homo sapiens
acacagagccagggaatacagt

SEQ ID NO: 8999295 - DNA, 22 bp, Homo sapiens
acacagagcaaatcatgacaga

SEQ ID NO: 8999296 - DNA, 22 bp, Homo sapiens
acacagagcaaatcatgacaga

SEQ ID NO: 8999297 - DNA, 22 bp, Homo sapiens
acacagagcaaatcatgacaga

SEQ ID NO: 8999298 - DNA, 22 bp, Homo sapiens
acacagagcaaatcatgacaga

SEQ ID NO: 8999299 - DNA, 22 bp, Homo sapiens
acacagagccaaaccatatcac

SEQ ID NO: 8999300 - DNA, 22 bp, Homo sapiens
acacagcaacttgcagtatgga

SEQ ID NO: 8999301 - DNA, 22 bp, Homo sapiens
acacagcaacttgcagtatgga

SEQ ID NO: 8999302 - DNA, 22 bp, Homo sapiens
acacagcaacttgcagtatgga

SEQ ID NO: 8999303 - DNA, 22 bp, Homo sapiens
acacagagcttctcaactggga

SEQ ID NO: 8999304 - DNA, 22 bp, Homo sapiens
acacagagctggaactgcttca

SEQ ID NO: 8999305 - DNA, 17 bp, Homo sapiens
acacagagattaacaca

SEQ ID NO: 8999306 - DNA, 17 bp, Homo sapiens
acacagagattaacaca

SEQ ID NO: 8999307 - DNA, 17 bp, Homo sapiens
acacagagattaacaca

SEQ ID NO: 8999308 - DNA, 17 bp, Homo sapiens
acacagagattaacaca

SEQ ID NO: 8999309 - DNA, 17 bp, Homo sapiens
acacagagattaacaca

SEQ ID NO: 8999310 - DNA, 22 bp, Homo sapiens
acacagagatgtaaagttaggc

SEQ ID NO: 8999311 - DNA, 20 bp, Homo sapiens
acacagactcagcttggatg

SEQ ID NO: 8999312 - DNA, 20 bp, Homo sapiens
acacagactcagcttggatg

SEQ ID NO: 8999313 - DNA, 17 bp, Homo sapiens
acacagacaggcagaca

SEQ ID NO: 8999314 - DNA, 17 bp, Homo sapiens
acacagacaggcagaca

SEQ ID NO: 8999315 - DNA, 17 bp, Homo sapiens
acacagacaggcagaca

SEQ ID NO: 8999316 - DNA, 22 bp, Homo sapiens
acacagaagctttttctattcc

SEQ ID NO: 8999317 - DNA, 22 bp, Homo sapiens
acacacatgcctttcctaagta

SEQ ID NO: 8999318 - DNA, 22 bp, Homo sapiens
acacacatgcctttcctaagta

SEQ ID NO: 8999319 - DNA, 22 bp, Homo sapiens
acacacatgcctttcctaagta

SEQ ID NO: 8999320 - DNA, 22 bp, Homo sapiens
acacagaagatctcttaatgct

SEQ ID NO: 8999321 - DNA, 22 bp, Homo sapiens
acacacatgcctttcctaagta

SEQ ID NO: 8999322 - DNA, 22 bp, Homo sapiens
acaatgttctacatatacataa

SEQ ID NO: 8999323 - DNA, 22 bp, Homo sapiens
aagaacagtgtcctgggactcg

SEQ ID NO: 8999324 - DNA, 22 bp, Homo sapiens
aagaacatgttaaaagattcac

SEQ ID NO: 8999325 - DNA, 22 bp, Homo sapiens
aagaacatgttaaaagattcac

SEQ ID NO: 8999326 - DNA, 22 bp, Homo sapiens
aagaacatgttaaaagattcac

SEQ ID NO: 8999327 - DNA, 22 bp, Homo sapiens
aagaacatgttaaaagattcac

SEQ ID NO: 8999328 - DNA, 22 bp, Homo sapiens
aagaacatgttaaaagattcac

SEQ ID NO: 8999329 - DNA, 22 bp, Homo sapiens
aagaacatgttaaaagattcac

SEQ ID NO: 8999330 - DNA, 22 bp, Homo sapiens
aagaacaggttctagaaccatt

SEQ ID NO: 8999331 - DNA, 22 bp, Homo sapiens
aagaacaggttctagaaccatt

SEQ ID NO: 8999332 - DNA, 22 bp, Homo sapiens
aagaacattcgaactattttct

SEQ ID NO: 8999333 - DNA, 22 bp, Homo sapiens
aagaacattgactaagaggggc

SEQ ID NO: 8999334 - DNA, 22 bp, Homo sapiens
aatgtacaataagacaaagagg

SEQ ID NO: 8999335 - DNA, 22 bp, Homo sapiens
aatgtacaataagacaaagagg

SEQ ID NO: 8999336 - DNA, 22 bp, Homo sapiens
aagaacaggttctagaaccatt

SEQ ID NO: 8999337 - DNA, 22 bp, Homo sapiens
aatgtacaataagacaaagagg

SEQ ID NO: 8999338 - DNA, 22 bp, Homo sapiens
aatgtacaagggttccagtttt

SEQ ID NO: 8999339 - DNA, 22 bp, Homo sapiens
aatgtacaagggttccagtttt

SEQ ID NO: 8999340 - DNA, 22 bp, Homo sapiens
aatgtacaagggttccagtttt

SEQ ID NO: 8999341 - DNA, 22 bp, Homo sapiens
aatgtacaagggttccagtttt

SEQ ID NO: 8999342 - DNA, 22 bp, Homo sapiens
aatgtacaagggttccagtttt

SEQ ID NO: 8999343 - DNA, 23 bp, Homo sapiens
aagaactgcgaatggagaaagta

SEQ ID NO: 8999344 - DNA, 23 bp, Homo sapiens
aagaactgcgaatggagaaagta

SEQ ID NO: 8999345 - DNA, 22 bp, Homo sapiens
aagaactgagtacgttaataaa

SEQ ID NO: 8999346 - DNA, 22 bp, Homo sapiens
aagaactggttatgttatcttg

SEQ ID NO: 8999347 - DNA, 21 bp, Homo sapiens
aagaactattgaggtacacag

SEQ ID NO: 8999348 - DNA, 18 bp, Homo sapiens
aagaactgaggtcctaga

SEQ ID NO: 8999349 - DNA, 22 bp, Homo sapiens
aagaactgagtacgttaataaa

SEQ ID NO: 8999350 - DNA, 22 bp, Homo sapiens
aagaacctatatgctgatgaat

SEQ ID NO: 8999351 - DNA, 22 bp, Homo sapiens
aagaaccaaaatgaagctaggt

SEQ ID NO: 8999352 - DNA, 22 bp, Homo sapiens
aagaactagtcttacagcctca

SEQ ID NO: 8999353 - DNA, 22 bp, Homo sapiens
aagaactatctctggctgtagg

SEQ ID NO: 8999354 - DNA, 22 bp, Homo sapiens
aagaacattttgtagaatgaca

SEQ ID NO: 8999355 - DNA, 22 bp, Homo sapiens
aagaacattttgtagaatgaca

SEQ ID NO: 8999356 - DNA, 22 bp, Homo sapiens
aagaacattgatattgtctatg

SEQ ID NO: 8999357 - DNA, 22 bp, Homo sapiens
aagaacatttatgatggcattt

SEQ ID NO: 8999358 - DNA, 22 bp, Homo sapiens
aagaacattttgtagaatgaca

SEQ ID NO: 8999359 - DNA, 22 bp, Homo sapiens
aagaacattttgtagaatgaca

SEQ ID NO: 8999360 - DNA, 22 bp, Homo sapiens
aagaacattttgtagaatgaca

SEQ ID NO: 8999361 - DNA, 22 bp, Homo sapiens
aagaacattttgtagaatgaca

SEQ ID NO: 8999362 - DNA, 22 bp, Homo sapiens
aagaacattttgtagaatgaca

SEQ ID NO: 8999363 - DNA, 22 bp, Homo sapiens
aagaacattttgtagaatgaca

SEQ ID NO: 8999364 - DNA, 22 bp, Homo sapiens
aagaacattttgtagaatgaca

SEQ ID NO: 8999365 - DNA, 22 bp, Homo sapiens
aagaactttaaagcacttatga

SEQ ID NO: 8999366 - DNA, 22 bp, Homo sapiens
aagaactttgatttcattgcat

SEQ ID NO: 8999367 - DNA, 22 bp, Homo sapiens
aagaactttaaagcacttatga

SEQ ID NO: 8999368 - DNA, 22 bp, Homo sapiens
aagaactttaaagcacttatga

SEQ ID NO: 8999369 - DNA, 22 bp, Homo sapiens
aagaacttgggctgagtgaaag

SEQ ID NO: 8999370 - DNA, 22 bp, Homo sapiens
aagaactttaaagcacttatga

SEQ ID NO: 8999371 - DNA, 22 bp, Homo sapiens
aagaacttcctaatatattttc

SEQ ID NO: 8999372 - DNA, 22 bp, Homo sapiens
aagaacttcctaatatattttc

SEQ ID NO: 8999373 - DNA, 22 bp, Homo sapiens
aagaacttcctaatatattttc

SEQ ID NO: 8999374 - DNA, 22 bp, Homo sapiens
aagaactttaaagcacttatga

SEQ ID NO: 8999375 - DNA, 22 bp, Homo sapiens
aagaactgtttacaattttcac

SEQ ID NO: 8999376 - DNA, 22 bp, Homo sapiens
aagaactgtttacaattttcac

SEQ ID NO: 8999377 - DNA, 22 bp, Homo sapiens
aagaactgtgctccaggctcca

SEQ ID NO: 8999378 - DNA, 22 bp, Homo sapiens
aagaactgtgctccaggctcca

SEQ ID NO: 8999379 - DNA, 22 bp, Homo sapiens
aagaactgtatcaagatgtagt

SEQ ID NO: 8999380 - DNA, 22 bp, Homo sapiens
aagaactgtatcaagatgtagt

SEQ ID NO: 8999381 - DNA, 22 bp, Homo sapiens
aagaactgtatcaagatgtagt

SEQ ID NO: 8999382 - DNA, 22 bp, Homo sapiens
aagaactgtatcaagatgtagt

SEQ ID NO: 8999383 - DNA, 23 bp, Homo sapiens
aagaactttggtcctgcagagtc

SEQ ID NO: 8999384 - DNA, 23 bp, Homo sapiens
aagaactttggtcctgcagagtc

SEQ ID NO: 8999385 - DNA, 23 bp, Homo sapiens
aagaactttggtcctgcagagtc

SEQ ID NO: 8999386 - DNA, 22 bp, Homo sapiens
aagaacttttggcaagtgttat

SEQ ID NO: 8999387 - DNA, 22 bp, Homo sapiens
aagaacttttggcaagtgttat

SEQ ID NO: 8999388 - DNA, 22 bp, Homo sapiens
aagaagaagtgttatttttaga

SEQ ID NO: 8999389 - DNA, 22 bp, Homo sapiens
aagaagagaaatgtgctgctgg

SEQ ID NO: 8999390 - DNA, 22 bp, Homo sapiens
aagaagaagtgttatttttaga

SEQ ID NO: 8999391 - DNA, 22 bp, Homo sapiens
aagaagagaaatgtgctgctgg

SEQ ID NO: 8999392 - DNA, 22 bp, Homo sapiens
acaaaacagtgttcctgcccct

SEQ ID NO: 8999393 - DNA, 22 bp, Homo sapiens
acaaaacagtgttcctgcccct

SEQ ID NO: 8999394 - DNA, 22 bp, Homo sapiens
acaaaacagtgttcctgcccct

SEQ ID NO: 8999395 - DNA, 22 bp, Homo sapiens
acaaaacagtgttcctgcccct

SEQ ID NO: 8999396 - DNA, 22 bp, Homo sapiens
acaaaacagtgttcctgcccct

SEQ ID NO: 8999397 - DNA, 22 bp, Homo sapiens
acaaaaattagctgggcatggt

SEQ ID NO: 8999398 - DNA, 22 bp, Homo sapiens
acaaaaattagctgggcatggt

SEQ ID NO: 8999399 - DNA, 22 bp, Homo sapiens
acaaaacagtgttcctgcccct

SEQ ID NO: 8999400 - DNA, 22 bp, Homo sapiens
acaaaaattagctgggcatggt

SEQ ID NO: 8999401 - DNA, 22 bp, Homo sapiens
aattttatctctaagcaggctt

SEQ ID NO: 8999402 - DNA, 22 bp, Homo sapiens
aattttatctctaagcaggctt

SEQ ID NO: 8999403 - DNA, 21 bp, Homo sapiens
aagaagcaatttattggaagg

SEQ ID NO: 8999404 - DNA, 21 bp, Homo sapiens
aagaagcaatttattggaagg

SEQ ID NO: 8999405 - DNA, 21 bp, Homo sapiens
aagaagcaatttattggaagg

SEQ ID NO: 8999406 - DNA, 19 bp, Homo sapiens
aagaagcaataagctgtga

SEQ ID NO: 8999407 - DNA, 19 bp, Homo sapiens
aagaagcaataagctgtga

SEQ ID NO: 8999408 - DNA, 19 bp, Homo sapiens
aagaagcaataagctgtga

SEQ ID NO: 8999409 - DNA, 19 bp, Homo sapiens
aagaagcaataagctgtga

SEQ ID NO: 8999410 - DNA, 22 bp, Homo sapiens
aagaagatggttaactttcagt

SEQ ID NO: 8999411 - DNA, 22 bp, Homo sapiens
aagaagatggttaactttcagt

SEQ ID NO: 8999412 - DNA, 22 bp, Homo sapiens
acaaatctgttttatagacttt

SEQ ID NO: 8999413 - DNA, 22 bp, Homo sapiens
acaaatctgttttatagacttt

SEQ ID NO: 8999414 - DNA, 22 bp, Homo sapiens
acaaatctgttttatagacttt

SEQ ID NO: 8999415 - DNA, 22 bp, Homo sapiens
acaaatgaacatataagcttga

SEQ ID NO: 8999416 - DNA, 22 bp, Homo sapiens
acaaatgaacatataagcttga

SEQ ID NO: 8999417 - DNA, 22 bp, Homo sapiens
acaaatgaacctgaaatctcag

SEQ ID NO: 8999418 - DNA, 22 bp, Homo sapiens
acaaatgaacctgaaatctcag

SEQ ID NO: 8999419 - DNA, 22 bp, Homo sapiens
acaaatgaacctgaaatctcag

SEQ ID NO: 8999420 - DNA, 22 bp, Homo sapiens
acaaatgaacatataagcttga

SEQ ID NO: 8999421 - DNA, 22 bp, Homo sapiens
acaaatgaacatataagcttga

SEQ ID NO: 8999422 - DNA, 22 bp, Homo sapiens
acaaatgaacatataagcttga

SEQ ID NO: 8999423 - DNA, 22 bp, Homo sapiens
acaaatgaacctgaaatctcag

SEQ ID NO: 8999424 - DNA, 22 bp, Homo sapiens
acaaatgaatcatacataatgt

SEQ ID NO: 8999425 - DNA, 19 bp, Homo sapiens
acaaattgtcctcatcaag

SEQ ID NO: 8999426 - DNA, 22 bp, Homo sapiens
acaaatgaatcatacataatgt

SEQ ID NO: 8999427 - DNA, 22 bp, Homo sapiens
acaaatgaatcatacataatgt

SEQ ID NO: 8999428 - DNA, 22 bp, Homo sapiens
acaaatgaatcatacataatgt

SEQ ID NO: 8999429 - DNA, 22 bp, Homo sapiens
acaaatgaatcatacataatgt

SEQ ID NO: 8999430 - DNA, 22 bp, Homo sapiens
acaaatgaatcatacataatgt

SEQ ID NO: 8999431 - DNA, 22 bp, Homo sapiens
acaaatgaatcatacataatgt

SEQ ID NO: 8999432 - DNA, 22 bp, Homo sapiens
acaaatgaatcatacataatgt

SEQ ID NO: 8999433 - DNA, 22 bp, Homo sapiens
acaaatgaatcatacataatgt

SEQ ID NO: 8999434 - DNA, 22 bp, Homo sapiens
acaaatgaatcatacataatgt

SEQ ID NO: 8999435 - DNA, 22 bp, Homo sapiens
acaaatgaatcatacataatgt

SEQ ID NO: 8999436 - DNA, 22 bp, Homo sapiens
aagaatctctcaagtgtgacaa

SEQ ID NO: 8999437 - DNA, 18 bp, Homo sapiens
aagaatctctgactcttt

SEQ ID NO: 8999438 - DNA, 22 bp, Homo sapiens
aagaatctctctactttattac

SEQ ID NO: 8999439 - DNA, 22 bp, Homo sapiens
aagaatctccattcctgtttta

SEQ ID NO: 8999440 - DNA, 22 bp, Homo sapiens
aagaatctccatctgattcact

SEQ ID NO: 8999441 - DNA, 22 bp, Homo sapiens
aagaatctctgatcaggcttta

SEQ ID NO: 8999442 - DNA, 15 bp, Homo sapiens
aagaatctgaagctt

SEQ ID NO: 8999443 - DNA, 22 bp, Homo sapiens
aagaatctctgatcaggcttta

SEQ ID NO: 8999444 - DNA, 22 bp, Homo sapiens
aagaatctgacataatttcctg

SEQ ID NO: 8999445 - DNA, 22 bp, Homo sapiens
acaaagctagagaagagaattg

SEQ ID NO: 8999446 - DNA, 23 bp, Homo sapiens
aagaatctcagaattagaaatac

SEQ ID NO: 8999447 - DNA, 23 bp, Homo sapiens
aagaatctcagaattagaaatac

SEQ ID NO: 8999448 - DNA, 22 bp, Homo sapiens
aagaatctatggtacatccaag

SEQ ID NO: 8999449 - DNA, 22 bp, Homo sapiens
aagaatcattgtaaagttctgt

SEQ ID NO: 8999450 - DNA, 22 bp, Homo sapiens
acaaatatttactgaatccact

SEQ ID NO: 8999451 - DNA, 22 bp, Homo sapiens
acaaagctctggaaggctcgtc

SEQ ID NO: 8999452 - DNA, 22 bp, Homo sapiens
acaaagctagagaagagaattg

SEQ ID NO: 8999453 - DNA, 22 bp, Homo sapiens
acaaatatttactgaatccact

SEQ ID NO: 8999454 - DNA, 22 bp, Homo sapiens
acaaagctctggaaggctcgtc

SEQ ID NO: 8999455 - DNA, 22 bp, Homo sapiens
acaaagctagagaagagaattg

SEQ ID NO: 8999456 - DNA, 22 bp, Homo sapiens
acaaagctagagaagagaattg

SEQ ID NO: 8999457 - DNA, 22 bp, Homo sapiens
acaaatatttactgaatccact

SEQ ID NO: 8999458 - DNA, 22 bp, Homo sapiens
acaaatatttactgaatccact

SEQ ID NO: 8999459 - DNA, 22 bp, Homo sapiens
acaaatatttactgaatccact

SEQ ID NO: 8999460 - DNA, 22 bp, Homo sapiens
acaaatatttactgaatccact

SEQ ID NO: 8999461 - DNA, 22 bp, Homo sapiens
acaaatatttactgaatccact

SEQ ID NO: 8999462 - DNA, 22 bp, Homo sapiens
acaaatatttactgaatccact

SEQ ID NO: 8999463 - DNA, 22 bp, Homo sapiens
acaaatatttactgaatccact

SEQ ID NO: 8999464 - DNA, 22 bp, Homo sapiens
acaaatatttactgaatccact

SEQ ID NO: 8999465 - DNA, 22 bp, Homo sapiens
acaaaactcttgctgggatttt

SEQ ID NO: 8999466 - DNA, 22 bp, Homo sapiens
acaaaactcttgctgggatttt

SEQ ID NO: 8999467 - DNA, 22 bp, Homo sapiens
acaaaaccagaaaatctctacc

SEQ ID NO: 8999468 - DNA, 22 bp, Homo sapiens
acaaaagaataagatgagtcat

SEQ ID NO: 8999469 - DNA, 21 bp, Homo sapiens
acaaaagaagctgccttttaa

SEQ ID NO: 8999470 - DNA, 21 bp, Homo sapiens
acaaaagaagctgccttttaa

SEQ ID NO: 8999471 - DNA, 21 bp, Homo sapiens
acaaaagaagctgccttttaa

SEQ ID NO: 8999472 - DNA, 22 bp, Homo sapiens
acaaaagaataagatgagtcat

SEQ ID NO: 8999473 - DNA, 22 bp, Homo sapiens
acaaaagaataagatgagtcat

SEQ ID NO: 8999474 - DNA, 22 bp, Homo sapiens
acaaaagaataagatgagtcat

SEQ ID NO: 8999475 - DNA, 22 bp, Homo sapiens
acaaaagaataagatgagtcat

SEQ ID NO: 8999476 - DNA, 22 bp, Homo sapiens
acaaaagaataagatgagtcat

SEQ ID NO: 8999477 - DNA, 22 bp, Homo sapiens
acaaaagcactgcagagtaagc

SEQ ID NO: 8999478 - DNA, 22 bp, Homo sapiens
acaaaagcactgcagagtaagc

SEQ ID NO: 8999479 - DNA, 22 bp, Homo sapiens
acaaaagaataagatgagtcat

SEQ ID NO: 8999480 - DNA, 22 bp, Homo sapiens
acaaaagaataagatgagtcat

SEQ ID NO: 8999481 - DNA, 22 bp, Homo sapiens
acaaaagaataagatgagtcat

SEQ ID NO: 8999482 - DNA, 22 bp, Homo sapiens
acaaaagtgagtgtgtctcaga

SEQ ID NO: 8999483 - DNA, 22 bp, Homo sapiens
acaaaagtgtaggaattcctta

SEQ ID NO: 8999484 - DNA, 22 bp, Homo sapiens
acaaaagtgtaggaattcctta

SEQ ID NO: 8999485 - DNA, 22 bp, Homo sapiens
acaaaagtgtaggaattcctta

SEQ ID NO: 8999486 - DNA, 22 bp, Homo sapiens
acaaaagtgagtgtgtctcaga

SEQ ID NO: 8999487 - DNA, 22 bp, Homo sapiens
acaaaagtgagtgtgtctcaga

SEQ ID NO: 8999488 - DNA, 22 bp, Homo sapiens
acaaaagcttttggagggttgt

SEQ ID NO: 8999489 - DNA, 22 bp, Homo sapiens
acaaaagtagttgcggtttttg

SEQ ID NO: 8999490 - DNA, 22 bp, Homo sapiens
acaaaagcactgcagagtaagc

SEQ ID NO: 8999491 - DNA, 22 bp, Homo sapiens
acaaaatagagttctcccctgg

SEQ ID NO: 8999492 - DNA, 22 bp, Homo sapiens
acaaaatagagttctcccctgg

SEQ ID NO: 8999493 - DNA, 22 bp, Homo sapiens
acaaaatagagttctcccctgg

SEQ ID NO: 8999494 - DNA, 22 bp, Homo sapiens
acaaaatagagttctcccctgg

SEQ ID NO: 8999495 - DNA, 22 bp, Homo sapiens
acaaaagtgtaggaattcctta

SEQ ID NO: 8999496 - DNA, 22 bp, Homo sapiens
aagaatatagattttttgaagt

SEQ ID NO: 8999497 - DNA, 22 bp, Homo sapiens
aagaatatagattttttgaagt

SEQ ID NO: 8999498 - DNA, 22 bp, Homo sapiens
aagaatatctgttttatttagg

SEQ ID NO: 8999499 - DNA, 22 bp, Homo sapiens
aagaatatctgttttatttagg

SEQ ID NO: 8999500 - DNA, 22 bp, Homo sapiens
aagaatatctgttttatttagg

SEQ ID NO: 8999501 - DNA, 22 bp, Homo sapiens
aagaatatctgttttatttagg

SEQ ID NO: 8999502 - DNA, 22 bp, Homo sapiens
aagaatatctgttttatttagg

SEQ ID NO: 8999503 - DNA, 22 bp, Homo sapiens
aagaatatctgttttatttagg

SEQ ID NO: 8999504 - DNA, 22 bp, Homo sapiens
aagaatcatctgaactttgagg

SEQ ID NO: 8999505 - DNA, 22 bp, Homo sapiens
aagaatcatctgaactttgagg

SEQ ID NO: 8999506 - DNA, 22 bp, Homo sapiens
aagaatcatcctgcaagagtct

SEQ ID NO: 8999507 - DNA, 17 bp, Homo sapiens
aagaatcattagagaag

SEQ ID NO: 8999508 - DNA, 22 bp, Homo sapiens
aagaatcattgtaaagttctgt

SEQ ID NO: 8999509 - DNA, 22 bp, Homo sapiens
aagaatcatcctgcaagagtct

SEQ ID NO: 8999510 - DNA, 22 bp, Homo sapiens
aagaatcatcctgcaagagtct

SEQ ID NO: 8999511 - DNA, 22 bp, Homo sapiens
aagaatcatagagccactgata

SEQ ID NO: 8999512 - DNA, 22 bp, Homo sapiens
aagaatatttcctgcacttggg

SEQ ID NO: 8999513 - DNA, 22 bp, Homo sapiens
aagaatatttcctgcacttggg

SEQ ID NO: 8999514 - DNA, 21 bp, Homo sapiens
acagcagggctggcatgacag

SEQ ID NO: 8999515 - DNA, 21 bp, Homo sapiens
acagcagggctggcatgacag

SEQ ID NO: 8999516 - DNA, 21 bp, Homo sapiens
acagcagggctggcatgacag

SEQ ID NO: 8999517 - DNA, 22 bp, Homo sapiens
acagcagggggagctgttggac

SEQ ID NO: 8999518 - DNA, 22 bp, Homo sapiens
acagcagggggagctgttggac

SEQ ID NO: 8999519 - DNA, 22 bp, Homo sapiens
acagcaggggtggaataaacgt

SEQ ID NO: 8999520 - DNA, 22 bp, Homo sapiens
acagcagggggagctgttggac

SEQ ID NO: 8999521 - DNA, 22 bp, Homo sapiens
acagcagggggagctgttggac

SEQ ID NO: 8999522 - DNA, 19 bp, Homo sapiens
acagcaggtgtggggataa

SEQ ID NO: 8999523 - DNA, 19 bp, Homo sapiens
acagcaggtgtggggataa

SEQ ID NO: 8999524 - DNA, 22 bp, Homo sapiens
acagcaggtagctttgtgcctc

SEQ ID NO: 8999525 - DNA, 19 bp, Homo sapiens
acagcaggtgtggggataa

SEQ ID NO: 8999526 - DNA, 22 bp, Homo sapiens
acagcaggtagctttgtgcctc

SEQ ID NO: 8999527 - DNA, 22 bp, Homo sapiens
acagcaggtagctttgtgcctc

SEQ ID NO: 8999528 - DNA, 22 bp, Homo sapiens
acagcagggggagctgttggac

SEQ ID NO: 8999529 - DNA, 22 bp, Homo sapiens
acagcaggggtggaataaacgt

SEQ ID NO: 8999530 - DNA, 22 bp, Homo sapiens
acagcaggggtggaataaacgt

SEQ ID NO: 8999531 - DNA, 22 bp, Homo sapiens
acagcagggtcacattccctct

SEQ ID NO: 8999532 - DNA, 22 bp, Homo sapiens
acagcaggggtggaataaacgt

SEQ ID NO: 8999533 - DNA, 22 bp, Homo sapiens
acagcagggtcacattccctct

SEQ ID NO: 8999534 - DNA, 22 bp, Homo sapiens
acagcagggtcacattccctct

SEQ ID NO: 8999535 - DNA, 22 bp, Homo sapiens
aagcagtttttcaactgtttag

SEQ ID NO: 8999536 - DNA, 22 bp, Homo sapiens
aagcagtttttcaactgtttag

SEQ ID NO: 8999537 - DNA, 22 bp, Homo sapiens
aagcataaaacgttacaacatg

SEQ ID NO: 8999538 - DNA, 22 bp, Homo sapiens
aagcagtttttcaactgtttag

SEQ ID NO: 8999539 - DNA, 19 bp, Homo sapiens
aagcagtttatatatttgt

SEQ ID NO: 8999540 - DNA, 19 bp, Homo sapiens
aagcagtttatatatttgt

SEQ ID NO: 8999541 - DNA, 22 bp, Homo sapiens
aagcagtttagataggcaaagg

SEQ ID NO: 8999542 - DNA, 22 bp, Homo sapiens
acagcaggaagctggagggaaa

SEQ ID NO: 8999543 - DNA, 22 bp, Homo sapiens
acagcaggaagctggagggaaa

SEQ ID NO: 8999544 - DNA, 22 bp, Homo sapiens
acagcaggaagctggagggaaa

SEQ ID NO: 8999545 - DNA, 22 bp, Homo sapiens
aagcataaaacgttacaacatg

SEQ ID NO: 8999546 - DNA, 22 bp, Homo sapiens
aagcataaaacgttacaacatg

SEQ ID NO: 8999547 - DNA, 22 bp, Homo sapiens
aagcataaaacgttacaacatg

SEQ ID NO: 8999548 - DNA, 22 bp, Homo sapiens
aagcataaaacgttacaacatg

SEQ ID NO: 8999549 - DNA, 22 bp, Homo sapiens
aagcataacttgctgcacatag

SEQ ID NO: 8999550 - DNA, 22 bp, Homo sapiens
aagcagttaatgttttgtcaat

SEQ ID NO: 8999551 - DNA, 22 bp, Homo sapiens
aagcagttactatttactatta

SEQ ID NO: 8999552 - DNA, 22 bp, Homo sapiens
aagcagttactatttactatta

SEQ ID NO: 8999553 - DNA, 22 bp, Homo sapiens
aagcagttactatttactatta

SEQ ID NO: 8999554 - DNA, 22 bp, Homo sapiens
aagcagtgcgctcatctaaggg

SEQ ID NO: 8999555 - DNA, 22 bp, Homo sapiens
aagcagtgttcccagctggccc

SEQ ID NO: 8999556 - DNA, 22 bp, Homo sapiens
aagcagtgatgcatacagctgt

SEQ ID NO: 8999557 - DNA, 22 bp, Homo sapiens
aagcagtcttggctgggttcag

SEQ ID NO: 8999558 - DNA, 22 bp, Homo sapiens
aagcaggaaggagcccagggca

SEQ ID NO: 8999559 - DNA, 21 bp, Homo sapiens
aagcaggacatatgatgccct

SEQ ID NO: 8999560 - DNA, 22 bp, Homo sapiens
acagagcaattcttgggtgttt

SEQ ID NO: 8999561 - DNA, 21 bp, Homo sapiens
aagcaggacatatgatgccct

SEQ ID NO: 8999562 - DNA, 22 bp, Homo sapiens
aagcaggacgtatttctatcct

SEQ ID NO: 8999563 - DNA, 22 bp, Homo sapiens
aagcaggctcacgccaggcagt

SEQ ID NO: 8999564 - DNA, 22 bp, Homo sapiens
aagcaggctagattgaagggct

SEQ ID NO: 8999565 - DNA, 22 bp, Homo sapiens
aagcaggcgagggcctggagca

SEQ ID NO: 8999566 - DNA, 21 bp, Homo sapiens
aagcaggctgtaatcatgtgg

SEQ ID NO: 8999567 - DNA, 22 bp, Homo sapiens
aagcaggctcacgccaggcagt

SEQ ID NO: 8999568 - DNA, 22 bp, Homo sapiens
aagcaggcttggtgtggccgct

SEQ ID NO: 8999569 - DNA, 22 bp, Homo sapiens
aagcaggcttggtgtggccgct

SEQ ID NO: 8999570 - DNA, 21 bp, Homo sapiens
aagcagggactgcccaggtcc

SEQ ID NO: 8999571 - DNA, 21 bp, Homo sapiens
aagcagggactgcccaggtcc

SEQ ID NO: 8999572 - DNA, 22 bp, Homo sapiens
aagcagggagaaatttttcttc

SEQ ID NO: 8999573 - DNA, 21 bp, Homo sapiens
aagcagggactgcccaggtcc

SEQ ID NO: 8999574 - DNA, 22 bp, Homo sapiens
aagcagggagaaatttttcttc

SEQ ID NO: 8999575 - DNA, 23 bp, Homo sapiens
aagcagggagattcttagctgag

SEQ ID NO: 8999576 - DNA, 23 bp, Homo sapiens
aagcagggagattcttagctgag

SEQ ID NO: 8999577 - DNA, 22 bp, Homo sapiens
aagcagggctccctggggactc

SEQ ID NO: 8999578 - DNA, 22 bp, Homo sapiens
aagcagggctccctggggactc

SEQ ID NO: 8999579 - DNA, 22 bp, Homo sapiens
aagcagggctagaccaagaaga

SEQ ID NO: 8999580 - DNA, 22 bp, Homo sapiens
aagcagggctagaccaagaaga

SEQ ID NO: 8999581 - DNA, 22 bp, Homo sapiens
aagcagggctccctggggactc

SEQ ID NO: 8999582 - DNA, 22 bp, Homo sapiens
aagcagggctttaagcggtttt

SEQ ID NO: 8999583 - DNA, 18 bp, Homo sapiens
aagcagggtccattgtgc

SEQ ID NO: 8999584 - DNA, 18 bp, Homo sapiens
aagcagggtccattgtgc

SEQ ID NO: 8999585 - DNA, 18 bp, Homo sapiens
aagcagggtccattgtgc

SEQ ID NO: 8999586 - DNA, 22 bp, Homo sapiens
aagcagggtcttcctcagttgg

SEQ ID NO: 8999587 - DNA, 18 bp, Homo sapiens
aagcagggtccattgtgc

SEQ ID NO: 8999588 - DNA, 22 bp, Homo sapiens
aagcagggtttttccaccgcag

SEQ ID NO: 8999589 - DNA, 22 bp, Homo sapiens
aagcaggtaaatatgtttccct

SEQ ID NO: 8999590 - DNA, 22 bp, Homo sapiens
aagcagggtgtcttgacccatg

SEQ ID NO: 8999591 - DNA, 22 bp, Homo sapiens
aagcagggtgtcttgacccatg

SEQ ID NO: 8999592 - DNA, 22 bp, Homo sapiens
aagcagggtcttcctcagttgg

SEQ ID NO: 8999593 - DNA, 22 bp, Homo sapiens
aagcagggtgtcttgacccatg

SEQ ID NO: 8999594 - DNA, 22 bp, Homo sapiens
aagcagtaatgaggtactattt

SEQ ID NO: 8999595 - DNA, 22 bp, Homo sapiens
aagcagtatggtatttaagtca

SEQ ID NO: 8999596 - DNA, 22 bp, Homo sapiens
aagcaggttatgaaatatagaa

SEQ ID NO: 8999597 - DNA, 22 bp, Homo sapiens
aagccaggttccatggaggagc

SEQ ID NO: 8999598 - DNA, 22 bp, Homo sapiens
acagccagggacatacaatggt

SEQ ID NO: 8999599 - DNA, 22 bp, Homo sapiens
acagccagggacatacaatggt

SEQ ID NO: 8999600 - DNA, 22 bp, Homo sapiens
acagccagggacatacaatggt

SEQ ID NO: 8999601 - DNA, 22 bp, Homo sapiens
aagcccagcatccctgcaccag

SEQ ID NO: 8999602 - DNA, 22 bp, Homo sapiens
aagcccagcatccctgcaccag

SEQ ID NO: 8999603 - DNA, 22 bp, Homo sapiens
aagcccagatgtgagaactgag

SEQ ID NO: 8999604 - DNA, 22 bp, Homo sapiens
aagccaggtttgaaatatccca

SEQ ID NO: 8999605 - DNA, 22 bp, Homo sapiens
aagccaggttccatggaggagc

SEQ ID NO: 8999606 - DNA, 22 bp, Homo sapiens
aagccaggttccatggaggagc

SEQ ID NO: 8999607 - DNA, 23 bp, Homo sapiens
acagccaggatgggagcagaagc

SEQ ID NO: 8999608 - DNA, 23 bp, Homo sapiens
acagccaggatgggagcagaagc

SEQ ID NO: 8999609 - DNA, 23 bp, Homo sapiens
acagccaggatgggagcagaagc

SEQ ID NO: 8999610 - DNA, 22 bp, Homo sapiens
acagccaggcccagcacgcagg

SEQ ID NO: 8999611 - DNA, 22 bp, Homo sapiens
acagccaggcccagcacgcagg

SEQ ID NO: 8999612 - DNA, 22 bp, Homo sapiens
acagccaggagccatgggcagg

SEQ ID NO: 8999613 - DNA, 22 bp, Homo sapiens
acagccaggaggaactcagtga

SEQ ID NO: 8999614 - DNA, 22 bp, Homo sapiens
acagccaggaggaactcagtga

SEQ ID NO: 8999615 - DNA, 22 bp, Homo sapiens
acagccaggaggaactcagtga

SEQ ID NO: 8999616 - DNA, 21 bp, Homo sapiens
acagccaggaacatgaggggc

SEQ ID NO: 8999617 - DNA, 21 bp, Homo sapiens
acagccaggaacatgaggggc

SEQ ID NO: 8999618 - DNA, 22 bp, Homo sapiens
acagccaggaattctggagaag

SEQ ID NO: 8999619 - DNA, 22 bp, Homo sapiens
acagccaggaattctggagaag

SEQ ID NO: 8999620 - DNA, 22 bp, Homo sapiens
acagccagcagagctgtttcct

SEQ ID NO: 8999621 - DNA, 22 bp, Homo sapiens
acagccagcttgatgggatccg

SEQ ID NO: 8999622 - DNA, 21 bp, Homo sapiens
acagccaggaacatgaggggc

SEQ ID NO: 8999623 - DNA, 22 bp, Homo sapiens
acagccaggacttggccctctt

SEQ ID NO: 8999624 - DNA, 22 bp, Homo sapiens
acagccaggacttggccctctt

SEQ ID NO: 8999625 - DNA, 22 bp, Homo sapiens
acagccaggagccatgggcagg

SEQ ID NO: 8999626 - DNA, 22 bp, Homo sapiens
acagccaggaattctggagaag

SEQ ID NO: 8999627 - DNA, 22 bp, Homo sapiens
acagccaggaattctggagaag

SEQ ID NO: 8999628 - DNA, 22 bp, Homo sapiens
acagccaggacttggccctctt

SEQ ID NO: 8999629 - DNA, 19 bp, Homo sapiens
acagcaggtgtggggataa

SEQ ID NO: 8999630 - DNA, 19 bp, Homo sapiens
acagcaggtgtggggataa

SEQ ID NO: 8999631 - DNA, 22 bp, Homo sapiens
acagcaggttacagtggcacag

SEQ ID NO: 8999632 - DNA, 22 bp, Homo sapiens
acagcaggttacagtggcacag

SEQ ID NO: 8999633 - DNA, 22 bp, Homo sapiens
acagcaggttacagtggcacag

SEQ ID NO: 8999634 - DNA, 22 bp, Homo sapiens
acagcaggttacagtggcacag

SEQ ID NO: 8999635 - DNA, 22 bp, Homo sapiens
acagcaggttacagtggcacag

SEQ ID NO: 8999636 - DNA, 22 bp, Homo sapiens
acagcaggttacagtggcacag

SEQ ID NO: 8999637 - DNA, 22 bp, Homo sapiens
acagccagatctgagagatctt

SEQ ID NO: 8999638 - DNA, 22 bp, Homo sapiens
acagccagatctgagagatctt

SEQ ID NO: 8999639 - DNA, 22 bp, Homo sapiens
acagccagatctgagagatctt

SEQ ID NO: 8999640 - DNA, 22 bp, Homo sapiens
acagccagatctgagagatctt

SEQ ID NO: 8999641 - DNA, 22 bp, Homo sapiens
acagccagatctgagagatctt

SEQ ID NO: 8999642 - DNA, 22 bp, Homo sapiens
acagccagatctgagagatctt

SEQ ID NO: 8999643 - DNA, 22 bp, Homo sapiens
acagccagatctgagagatctt

SEQ ID NO: 8999644 - DNA, 22 bp, Homo sapiens
aagcccagtaccttcagtgagg

SEQ ID NO: 8999645 - DNA, 19 bp, Homo sapiens
aagcccagtgtatgctctt

SEQ ID NO: 8999646 - DNA, 19 bp, Homo sapiens
aagcccagtgtatgctctt

SEQ ID NO: 8999647 - DNA, 22 bp, Homo sapiens
aagcccagtttcacactgagac

SEQ ID NO: 8999648 - DNA, 22 bp, Homo sapiens
aagcccagtttcacactgagac

SEQ ID NO: 8999649 - DNA, 22 bp, Homo sapiens
aagcccagtttcacactgagac

SEQ ID NO: 8999650 - DNA, 22 bp, Homo sapiens
aagcccagtttcacactgagac

SEQ ID NO: 8999651 - DNA, 23 bp, Homo sapiens
aagccccaaggaacttcctggga

SEQ ID NO: 8999652 - DNA, 22 bp, Homo sapiens
aagcccaggtaagtggctcatg

SEQ ID NO: 8999653 - DNA, 22 bp, Homo sapiens
aagcccaggtaagtggctcatg

SEQ ID NO: 8999654 - DNA, 22 bp, Homo sapiens
aagcccaggtaagtggctcatg

SEQ ID NO: 8999655 - DNA, 22 bp, Homo sapiens
aagcccagctgaaagcattttt

SEQ ID NO: 8999656 - DNA, 22 bp, Homo sapiens
aagcccagcatccctgcaccag

SEQ ID NO: 8999657 - DNA, 22 bp, Homo sapiens
aagcccagcatccctgcaccag

SEQ ID NO: 8999658 - DNA, 22 bp, Homo sapiens
aagcccagctctgcctgctctg

SEQ ID NO: 8999659 - DNA, 22 bp, Homo sapiens
aagcccagctctgcctgctctg

SEQ ID NO: 8999660 - DNA, 22 bp, Homo sapiens
aagcccagctgaaagcattttt

SEQ ID NO: 8999661 - DNA, 22 bp, Homo sapiens
aagcccagctctgcctgctctg

SEQ ID NO: 8999662 - DNA, 22 bp, Homo sapiens
aagcccagctctgcctgctctg

SEQ ID NO: 8999663 - DNA, 23 bp, Homo sapiens
aagccctgaaggtttcaggccct

SEQ ID NO: 8999664 - DNA, 22 bp, Homo sapiens
aagccctccgtacgtgctagct

SEQ ID NO: 8999665 - DNA, 22 bp, Homo sapiens
aagccctcattagccatagccc

SEQ ID NO: 8999666 - DNA, 22 bp, Homo sapiens
aagccctcattagccatagccc

SEQ ID NO: 8999667 - DNA, 23 bp, Homo sapiens
aagccctgaaggtttcaggccct

SEQ ID NO: 8999668 - DNA, 23 bp, Homo sapiens
aagccctgaaggtttcaggccct

SEQ ID NO: 8999669 - DNA, 22 bp, Homo sapiens
aagccctgacctgagagtccgt

SEQ ID NO: 8999670 - DNA, 22 bp, Homo sapiens
aagccctgacctgagagtccgt

SEQ ID NO: 8999671 - DNA, 22 bp, Homo sapiens
aagccctcatccccatgggcgt

SEQ ID NO: 8999672 - DNA, 22 bp, Homo sapiens
aagcccggttgggaacgtggtg

SEQ ID NO: 8999673 - DNA, 22 bp, Homo sapiens
aagccctcagagcctctttgac

SEQ ID NO: 8999674 - DNA, 23 bp, Homo sapiens
aagccccaaggaacttcctggga

SEQ ID NO: 8999675 - DNA, 22 bp, Homo sapiens
acagctgctgcttctcactggg

SEQ ID NO: 8999676 - DNA, 22 bp, Homo sapiens
acagctgctgtggaggttttca

SEQ ID NO: 8999677 - DNA, 22 bp, Homo sapiens
acagctgctgcttctcactggg

SEQ ID NO: 8999678 - DNA, 22 bp, Homo sapiens
acagctgctctatatctcagcc

SEQ ID NO: 8999679 - DNA, 22 bp, Homo sapiens
acagctgctctatatctcagcc

SEQ ID NO: 8999680 - DNA, 22 bp, Homo sapiens
acagctggacaggggagagttt

SEQ ID NO: 8999681 - DNA, 21 bp, Homo sapiens
acagctggaaattacttgccc

SEQ ID NO: 8999682 - DNA, 21 bp, Homo sapiens
acagctggaaattacttgccc

SEQ ID NO: 8999683 - DNA, 22 bp, Homo sapiens
acagctgctttctcttactatg

SEQ ID NO: 8999684 - DNA, 22 bp, Homo sapiens
acagctgctttctcttactatg

SEQ ID NO: 8999685 - DNA, 22 bp, Homo sapiens
acagctgctgtttttgaaggac

SEQ ID NO: 8999686 - DNA, 22 bp, Homo sapiens
acagctgctgtggaggttttca

SEQ ID NO: 8999687 - DNA, 22 bp, Homo sapiens
acagctgctgtggaggttttca

SEQ ID NO: 8999688 - DNA, 22 bp, Homo sapiens
acagaccaaaaaaggatattgg

SEQ ID NO: 8999689 - DNA, 22 bp, Homo sapiens
acagaccaagtttccagcaggt

SEQ ID NO: 8999690 - DNA, 22 bp, Homo sapiens
acagacattttaattattaaat

SEQ ID NO: 8999691 - DNA, 22 bp, Homo sapiens
acagacattttaagacacttta

SEQ ID NO: 8999692 - DNA, 22 bp, Homo sapiens
acagacattttaagacacttta

SEQ ID NO: 8999693 - DNA, 23 bp, Homo sapiens
acagacattccataatgtacacc

SEQ ID NO: 8999694 - DNA, 19 bp, Homo sapiens
acagacatttgcaattagc

SEQ ID NO: 8999695 - DNA, 22 bp, Homo sapiens
acagacattttaagacacttta

SEQ ID NO: 8999696 - DNA, 22 bp, Homo sapiens
acagacattttaagacacttta

SEQ ID NO: 8999697 - DNA, 22 bp, Homo sapiens
acagacatttaataaatgctga

SEQ ID NO: 8999698 - DNA, 22 bp, Homo sapiens
acagacatttaataaatgctga

SEQ ID NO: 8999699 - DNA, 22 bp, Homo sapiens
acagacatttaataaatgctga

SEQ ID NO: 8999700 - DNA, 22 bp, Homo sapiens
acagacatttaataaatgctga

SEQ ID NO: 8999701 - DNA, 23 bp, Homo sapiens
acagacattccataatgtacacc

SEQ ID NO: 8999702 - DNA, 23 bp, Homo sapiens
acagacattccataatgtacacc

SEQ ID NO: 8999703 - DNA, 23 bp, Homo sapiens
acagacattgtacatcttgtttt

SEQ ID NO: 8999704 - DNA, 23 bp, Homo sapiens
acagacaacactgatgagagaaa

SEQ ID NO: 8999705 - DNA, 23 bp, Homo sapiens
acagacaacactgatgagagaaa

SEQ ID NO: 8999706 - DNA, 23 bp, Homo sapiens
acagacaacactgatgagagaaa

SEQ ID NO: 8999707 - DNA, 23 bp, Homo sapiens
acagacaacactgatgagagaaa

SEQ ID NO: 8999708 - DNA, 23 bp, Homo sapiens
acagacattccataatgtacacc

SEQ ID NO: 8999709 - DNA, 23 bp, Homo sapiens
acagacattccataatgtacacc

SEQ ID NO: 8999710 - DNA, 23 bp, Homo sapiens
acagacaacactgatgagagaaa

SEQ ID NO: 8999711 - DNA, 23 bp, Homo sapiens
acagaaatcatttgtaaggtacc

SEQ ID NO: 8999712 - DNA, 23 bp, Homo sapiens
acagaaatcatttgtaaggtacc

SEQ ID NO: 8999713 - DNA, 23 bp, Homo sapiens
acagacaacactgatgagagaaa

SEQ ID NO: 8999714 - DNA, 22 bp, Homo sapiens
acagaaatgatgtttggcaata

SEQ ID NO: 8999715 - DNA, 22 bp, Homo sapiens
acagaaatgatgtttggcaata

SEQ ID NO: 8999716 - DNA, 23 bp, Homo sapiens
acagaaatcatttgtaaggtacc

SEQ ID NO: 8999717 - DNA, 23 bp, Homo sapiens
acagaaatcatttgtaaggtacc

SEQ ID NO: 8999718 - DNA, 22 bp, Homo sapiens
acagaaatattcgtggtgcttg

SEQ ID NO: 8999719 - DNA, 22 bp, Homo sapiens
acagaaatattcgtggtgcttg

SEQ ID NO: 8999720 - DNA, 18 bp, Homo sapiens
acagaaatagctgtgcct

SEQ ID NO: 8999721 - DNA, 18 bp, Homo sapiens
acagaaatagctgtgcct

SEQ ID NO: 8999722 - DNA, 18 bp, Homo sapiens
acagaaatagctgtgcct

SEQ ID NO: 8999723 - DNA, 18 bp, Homo sapiens
acagaaatagctgtgcct

SEQ ID NO: 8999724 - DNA, 18 bp, Homo sapiens
acagaaatagctgtgcct

SEQ ID NO: 8999725 - DNA, 22 bp, Homo sapiens
acagaaatatagaaggtaggaa

SEQ ID NO: 8999726 - DNA, 22 bp, Homo sapiens
acagaaatatagaaggtaggaa

SEQ ID NO: 8999727 - DNA, 22 bp, Homo sapiens
acagaaatatagaaggtaggaa

SEQ ID NO: 8999728 - DNA, 22 bp, Homo sapiens
acagaaataactttttatgttt

SEQ ID NO: 8999729 - DNA, 22 bp, Homo sapiens
acagaaataactttttatgttt

SEQ ID NO: 8999730 - DNA, 23 bp, Homo sapiens
acagaaagttctgctggacagag

SEQ ID NO: 8999731 - DNA, 23 bp, Homo sapiens
acagaaagttctgctggacagag

SEQ ID NO: 8999732 - DNA, 23 bp, Homo sapiens
acagaaagttctgctggacagag

SEQ ID NO: 8999733 - DNA, 22 bp, Homo sapiens
acagaaataactttttatgttt

SEQ ID NO: 8999734 - DNA, 22 bp, Homo sapiens
acagagcaatgcgtgttctcta

SEQ ID NO: 8999735 - DNA, 22 bp, Homo sapiens
acagagcaatgcgtgttctcta

SEQ ID NO: 8999736 - DNA, 22 bp, Homo sapiens
acagagcaataacagggagagg

SEQ ID NO: 8999737 - DNA, 22 bp, Homo sapiens
acagagcaataacagggagagg

SEQ ID NO: 8999738 - DNA, 22 bp, Homo sapiens
acagagcaactttatttcatgg

SEQ ID NO: 8999739 - DNA, 22 bp, Homo sapiens
acagagcaacttgagtatcctc

SEQ ID NO: 8999740 - DNA, 22 bp, Homo sapiens
acagagatgtggatgagggatt

SEQ ID NO: 8999741 - DNA, 22 bp, Homo sapiens
acagagatgaattagacagggt

SEQ ID NO: 8999742 - DNA, 22 bp, Homo sapiens
acagagatgagtcaacacagct

SEQ ID NO: 8999743 - DNA, 22 bp, Homo sapiens
acagagatgagtcaacacagct

SEQ ID NO: 8999744 - DNA, 22 bp, Homo sapiens
acagagatggcacagagaaggt

SEQ ID NO: 8999745 - DNA, 22 bp, Homo sapiens
acagagatggcacagagaaggt

SEQ ID NO: 8999746 - DNA, 22 bp, Homo sapiens
acagagatggcttttcagaggc

SEQ ID NO: 8999747 - DNA, 22 bp, Homo sapiens
acagagatgggaacattcaggt

SEQ ID NO: 8999748 - DNA, 22 bp, Homo sapiens
acagagatgtcagattggcagc

SEQ ID NO: 8999749 - DNA, 23 bp, Homo sapiens
acagactgtattcaaagtaggac

SEQ ID NO: 8999750 - DNA, 22 bp, Homo sapiens
acagactggagtgagagaaata

SEQ ID NO: 8999751 - DNA, 22 bp, Homo sapiens
acagagatgaataatacaggtg

SEQ ID NO: 8999752 - DNA, 22 bp, Homo sapiens
acagagatgaataatacaggtg

SEQ ID NO: 8999753 - DNA, 22 bp, Homo sapiens
acagagatgaataatacaggtg

SEQ ID NO: 8999754 - DNA, 23 bp, Homo sapiens
acagagatcttgacttgtatgga

SEQ ID NO: 8999755 - DNA, 22 bp, Homo sapiens
acagaccaagtttccagcaggt

SEQ ID NO: 8999756 - DNA, 22 bp, Homo sapiens
acagaccaagtttccagcaggt

SEQ ID NO: 8999757 - DNA, 22 bp, Homo sapiens
acagaccaagtttccagcaggt

SEQ ID NO: 8999758 - DNA, 22 bp, Homo sapiens
acagaccagctttcattccctt

SEQ ID NO: 8999759 - DNA, 22 bp, Homo sapiens
acagacctatggcagctgccat

SEQ ID NO: 8999760 - DNA, 22 bp, Homo sapiens
acagactgattcattgctcagg

SEQ ID NO: 8999761 - DNA, 22 bp, Homo sapiens
acagactggagcccttttgccc

SEQ ID NO: 8999762 - DNA, 22 bp, Homo sapiens
acagactgattcattgctcagg

SEQ ID NO: 8999763 - DNA, 22 bp, Homo sapiens
acagactaaaattgcacagtgg

SEQ ID NO: 8999764 - DNA, 22 bp, Homo sapiens
acacttgaggtttttaggtgcg

SEQ ID NO: 8999765 - DNA, 22 bp, Homo sapiens
acacttgaggaatgtggtgatt

SEQ ID NO: 8999766 - DNA, 20 bp, Homo sapiens
acacttgacaccagaaatgg

SEQ ID NO: 8999767 - DNA, 22 bp, Homo sapiens
acacttgataggtcaaatcagt

SEQ ID NO: 8999768 - DNA, 22 bp, Homo sapiens
acacttgataggtcaaatcagt

SEQ ID NO: 8999769 - DNA, 22 bp, Homo sapiens
acacttgccatgctgcacactg

SEQ ID NO: 8999770 - DNA, 22 bp, Homo sapiens
acacttggagcaacacttatgg

SEQ ID NO: 8999771 - DNA, 22 bp, Homo sapiens
acacttggagcaacacttatgg

SEQ ID NO: 8999772 - DNA, 22 bp, Homo sapiens
acacttggagcaacacttatgg

SEQ ID NO: 8999773 - DNA, 22 bp, Homo sapiens
acacttggagcaacacttatgg

SEQ ID NO: 8999774 - DNA, 22 bp, Homo sapiens
acactttaagcatttcacactg

SEQ ID NO: 8999775 - DNA, 22 bp, Homo sapiens
acagaaagatgatttgaaatgg

SEQ ID NO: 8999776 - DNA, 22 bp, Homo sapiens
acagaaagatgatttgaaatgg

SEQ ID NO: 8999777 - DNA, 22 bp, Homo sapiens
acagaaagatgatttgaaatgg

SEQ ID NO: 8999778 - DNA, 22 bp, Homo sapiens
acactttaagcatttcacactg

SEQ ID NO: 8999779 - DNA, 22 bp, Homo sapiens
acactttaagcatttcacactg

SEQ ID NO: 8999780 - DNA, 23 bp, Homo sapiens
acagaaagttctgctggacagag

SEQ ID NO: 8999781 - DNA, 23 bp, Homo sapiens
acagaaagttctgctggacagag

SEQ ID NO: 8999782 - DNA, 20 bp, Homo sapiens
acagaaagctgccttgtccc

SEQ ID NO: 8999783 - DNA, 22 bp, Homo sapiens
acagaaagatgatttgaaatgg

SEQ ID NO: 8999784 - DNA, 20 bp, Homo sapiens
acagaaagctgccttgtccc

SEQ ID NO: 8999785 - DNA, 18 bp, Homo sapiens
acacttcctggtggtgtg

SEQ ID NO: 8999786 - DNA, 22 bp, Homo sapiens
acacttctattccctgcacaaa

SEQ ID NO: 8999787 - DNA, 22 bp, Homo sapiens
acacttctctttgaagaacaat

SEQ ID NO: 8999788 - DNA, 22 bp, Homo sapiens
acacttctctttgaagaacaat

SEQ ID NO: 8999789 - DNA, 22 bp, Homo sapiens
acacttctttgtcacctgcttc

SEQ ID NO: 8999790 - DNA, 22 bp, Homo sapiens
acacttctttgtcacctgcttc

SEQ ID NO: 8999791 - DNA, 22 bp, Homo sapiens
acacttctcatttgatactaac

SEQ ID NO: 8999792 - DNA, 22 bp, Homo sapiens
acacttctcatttgatactaac

SEQ ID NO: 8999793 - DNA, 20 bp, Homo sapiens
acacttcatttgcagcagct

SEQ ID NO: 8999794 - DNA, 22 bp, Homo sapiens
acacttcatttacattataggc

SEQ ID NO: 8999795 - DNA, 22 bp, Homo sapiens
acacttcatgcattcttcactc

SEQ ID NO: 8999796 - DNA, 22 bp, Homo sapiens
acacttcatgcattcttcactc

SEQ ID NO: 8999797 - DNA, 22 bp, Homo sapiens
acacttcaggactctggggcaa

SEQ ID NO: 8999798 - DNA, 21 bp, Homo sapiens
acacttcagtttttaaaggga

SEQ ID NO: 8999799 - DNA, 22 bp, Homo sapiens
acacttcatagcaaggttggag

SEQ ID NO: 8999800 - DNA, 22 bp, Homo sapiens
acacttcagctccacaaacatt

SEQ ID NO: 8999801 - DNA, 22 bp, Homo sapiens
acacttcagctccacaaacatt

SEQ ID NO: 8999802 - DNA, 22 bp, Homo sapiens
acacttcagctccacaaacatt

SEQ ID NO: 8999803 - DNA, 22 bp, Homo sapiens
acacttcaggactctggggcaa

SEQ ID NO: 8999804 - DNA, 22 bp, Homo sapiens
acacttcagctccacaaacatt

SEQ ID NO: 8999805 - DNA, 22 bp, Homo sapiens
acactggttgttaatagtaaca

SEQ ID NO: 8999806 - DNA, 22 bp, Homo sapiens
acactggttggttgaatttact

SEQ ID NO: 8999807 - DNA, 22 bp, Homo sapiens
acactggttgaattgtataact

SEQ ID NO: 8999808 - DNA, 22 bp, Homo sapiens
aagatacatcaaagcaaattgg

SEQ ID NO: 8999809 - DNA, 22 bp, Homo sapiens
aagatacatcaaagcaaattgg

SEQ ID NO: 8999810 - DNA, 22 bp, Homo sapiens
aagatacatcaaagcaaattgg

SEQ ID NO: 8999811 - DNA, 22 bp, Homo sapiens
acacataagcctaatcatctcc

SEQ ID NO: 8999812 - DNA, 22 bp, Homo sapiens
acacataagcctaatcatctcc

SEQ ID NO: 8999813 - DNA, 22 bp, Homo sapiens
acacataagcctaatcatctcc

SEQ ID NO: 8999814 - DNA, 22 bp, Homo sapiens
aagatacataaaggtagagtct

SEQ ID NO: 8999815 - DNA, 22 bp, Homo sapiens
aagatacataaaggtagagtct

SEQ ID NO: 8999816 - DNA, 22 bp, Homo sapiens
aagatacagtgaaagggcattg

SEQ ID NO: 8999817 - DNA, 22 bp, Homo sapiens
aagatacataaaggtagagtct

SEQ ID NO: 8999818 - DNA, 22 bp, Homo sapiens
aagatacatatttgttctagtg

SEQ ID NO: 8999819 - DNA, 22 bp, Homo sapiens
aagatacatatttgttctagtg

SEQ ID NO: 8999820 - DNA, 22 bp, Homo sapiens
aagatacagacagagccaaaat

SEQ ID NO: 8999821 - DNA, 22 bp, Homo sapiens
aagatacagacagagccaaaat

SEQ ID NO: 8999822 - DNA, 22 bp, Homo sapiens
aagatacagacagagccaaaat

SEQ ID NO: 8999823 - DNA, 23 bp, Homo sapiens
aagatacaggtgtggaatggttt

SEQ ID NO: 8999824 - DNA, 23 bp, Homo sapiens
aagatacaggtgtggaatggttt

SEQ ID NO: 8999825 - DNA, 23 bp, Homo sapiens
aagatacaggtgtggaatggttt

SEQ ID NO: 8999826 - DNA, 22 bp, Homo sapiens
aagatacagacagagccaaaat

SEQ ID NO: 8999827 - DNA, 22 bp, Homo sapiens
aagatacagacagagccaaaat

SEQ ID NO: 8999828 - DNA, 22 bp, Homo sapiens
aagatacagacagagccaaaat

SEQ ID NO: 8999829 - DNA, 22 bp, Homo sapiens
aagatacagacagagccaaaat

SEQ ID NO: 8999830 - DNA, 22 bp, Homo sapiens
aagatacacgttgtattgaata

SEQ ID NO: 8999831 - DNA, 22 bp, Homo sapiens
aagatacacgttgtattgaata

SEQ ID NO: 8999832 - DNA, 22 bp, Homo sapiens
aagatacacgttgtattgaata

SEQ ID NO: 8999833 - DNA, 22 bp, Homo sapiens
aagatacacgttgtattgaata

SEQ ID NO: 8999834 - DNA, 22 bp, Homo sapiens
aagatacacgttgtattgaata

SEQ ID NO: 8999835 - DNA, 22 bp, Homo sapiens
aagatacacggtcaactctcaa

SEQ ID NO: 8999836 - DNA, 22 bp, Homo sapiens
acacatataccactgtaaatga

SEQ ID NO: 8999837 - DNA, 22 bp, Homo sapiens
acacatataccactgtaaatga

SEQ ID NO: 8999838 - DNA, 22 bp, Homo sapiens
acacatataccactgtaaatga

SEQ ID NO: 8999839 - DNA, 22 bp, Homo sapiens
acacatataccactgtaaatga

SEQ ID NO: 8999840 - DNA, 22 bp, Homo sapiens
acacataagcctaatcatctcc

SEQ ID NO: 8999841 - DNA, 20 bp, Homo sapiens
acacatatagcagcataaac

SEQ ID NO: 8999842 - DNA, 20 bp, Homo sapiens
acacatatagcagcataaac

SEQ ID NO: 8999843 - DNA, 22 bp, Homo sapiens
acacatataccactgtaaatga

SEQ ID NO: 8999844 - DNA, 22 bp, Homo sapiens
acacatataccactgtaaatga

SEQ ID NO: 8999845 - DNA, 20 bp, Homo sapiens
acacatatagcagcataaac

SEQ ID NO: 8999846 - DNA, 20 bp, Homo sapiens
acacatatagcagcataaac

SEQ ID NO: 8999847 - DNA, 20 bp, Homo sapiens
acacatatagcagcataaac

SEQ ID NO: 8999848 - DNA, 20 bp, Homo sapiens
acacatatagcagcataaac

SEQ ID NO: 8999849 - DNA, 20 bp, Homo sapiens
acacatatagcagcataaac

SEQ ID NO: 8999850 - DNA, 20 bp, Homo sapiens
acacatatagcagcataaac

SEQ ID NO: 8999851 - DNA, 20 bp, Homo sapiens
acacatatagcagcataaac

SEQ ID NO: 8999852 - DNA, 22 bp, Homo sapiens
acacatatatacatatttgtgc

SEQ ID NO: 8999853 - DNA, 20 bp, Homo sapiens
acacatatagcagcataaac

SEQ ID NO: 8999854 - DNA, 22 bp, Homo sapiens
aaggagggttcccaggtcctgg

SEQ ID NO: 8999855 - DNA, 22 bp, Homo sapiens
aaggagggttcccaggtcctgg

SEQ ID NO: 8999856 - DNA, 16 bp, Homo sapiens
aaggagggaagagaat

SEQ ID NO: 8999857 - DNA, 16 bp, Homo sapiens
aaggagggaagagaat

SEQ ID NO: 8999858 - DNA, 22 bp, Homo sapiens
aaggagaagtctgttgagattg

SEQ ID NO: 8999859 - DNA, 22 bp, Homo sapiens
aaggagggaaagcagtgcttct

SEQ ID NO: 8999860 - DNA, 22 bp, Homo sapiens
aaggagggaaagcagtgcttct

SEQ ID NO: 8999861 - DNA, 22 bp, Homo sapiens
aaggagaagggtaatcaacaca

SEQ ID NO: 8999862 - DNA, 22 bp, Homo sapiens
aaggagaagggtaatcaacaca

SEQ ID NO: 8999863 - DNA, 22 bp, Homo sapiens
aaggagaagggtaatcaacaca

SEQ ID NO: 8999864 - DNA, 18 bp, Homo sapiens
aaatggcagaatggatag

SEQ ID NO: 8999865 - DNA, 18 bp, Homo sapiens
aaatggcagaatggatag

SEQ ID NO: 8999866 - DNA, 18 bp, Homo sapiens
aaatggcagaatggatag

SEQ ID NO: 8999867 - DNA, 22 bp, Homo sapiens
aaatggcactttgacagcctgc

SEQ ID NO: 8999868 - DNA, 22 bp, Homo sapiens
aaatggcactttgacagcctgc

SEQ ID NO: 8999869 - DNA, 22 bp, Homo sapiens
aaatggcactttgacagcctgc

SEQ ID NO: 8999870 - DNA, 18 bp, Homo sapiens
aaatggcacacagacctg

SEQ ID NO: 8999871 - DNA, 18 bp, Homo sapiens
aaatggcacacagacctg

SEQ ID NO: 8999872 - DNA, 18 bp, Homo sapiens
aaatggcacacagacctg

SEQ ID NO: 8999873 - DNA, 22 bp, Homo sapiens
aaatggcaatttagtttattta

SEQ ID NO: 8999874 - DNA, 22 bp, Homo sapiens
aaatggatgttgagttaaatgt

SEQ ID NO: 8999875 - DNA, 22 bp, Homo sapiens
aaatggatgttgagttaaatgt

SEQ ID NO: 8999876 - DNA, 22 bp, Homo sapiens
aaatggcaacagaagggagttc

SEQ ID NO: 8999877 - DNA, 22 bp, Homo sapiens
aaatggcaacagaagggagttc

SEQ ID NO: 8999878 - DNA, 22 bp, Homo sapiens
aaatggcaatcagcagaagcta

SEQ ID NO: 8999879 - DNA, 22 bp, Homo sapiens
aaatggcaatcagcagaagcta

SEQ ID NO: 8999880 - DNA, 22 bp, Homo sapiens
aaatggcaatcagcagaagcta

SEQ ID NO: 8999881 - DNA, 22 bp, Homo sapiens
aaatggcaatcagcagaagcta

SEQ ID NO: 8999882 - DNA, 22 bp, Homo sapiens
aaatggaagaagtgcaatactg

SEQ ID NO: 8999883 - DNA, 22 bp, Homo sapiens
aaatggaagctatttatgattc

SEQ ID NO: 8999884 - DNA, 22 bp, Homo sapiens
aaatggaagctatttatgattc

SEQ ID NO: 8999885 - DNA, 22 bp, Homo sapiens
aaatggaagaagtgcaatactg

SEQ ID NO: 8999886 - DNA, 22 bp, Homo sapiens
aaatggaactgttgtgcatttg

SEQ ID NO: 8999887 - DNA, 22 bp, Homo sapiens
aaatggaagaagtgcaatactg

SEQ ID NO: 8999888 - DNA, 22 bp, Homo sapiens
aaatggaagtgtatttagtgtt

SEQ ID NO: 8999889 - DNA, 22 bp, Homo sapiens
aaatggaagctatttatgattc

SEQ ID NO: 8999890 - DNA, 22 bp, Homo sapiens
aaatggaagtgtatttagtgtt

SEQ ID NO: 8999891 - DNA, 22 bp, Homo sapiens
aaatggaatgtgtttataattc

SEQ ID NO: 8999892 - DNA, 22 bp, Homo sapiens
aaatggaatgtgtttataattc

SEQ ID NO: 8999893 - DNA, 22 bp, Homo sapiens
aaatggaatgtgtttataattc

SEQ ID NO: 8999894 - DNA, 22 bp, Homo sapiens
aaatggaatgtgtttataattc

SEQ ID NO: 8999895 - DNA, 22 bp, Homo sapiens
aaatggaatgtgtttataattc

SEQ ID NO: 8999896 - DNA, 22 bp, Homo sapiens
aaatggaggcaaaattggtttc

SEQ ID NO: 8999897 - DNA, 21 bp, Homo sapiens
aaatggatagggcaatggaag

SEQ ID NO: 8999898 - DNA, 22 bp, Homo sapiens
aaatggaggcacgcagtggtta

SEQ ID NO: 8999899 - DNA, 18 bp, Homo sapiens
aaatggatgacagtacca

SEQ ID NO: 8999900 - DNA, 22 bp, Homo sapiens
aaatggatctttttataatgca

SEQ ID NO: 8999901 - DNA, 22 bp, Homo sapiens
aaatggatctgtggaatacatt

SEQ ID NO: 8999902 - DNA, 22 bp, Homo sapiens
aaggagtgctgaaaggaagcgg

SEQ ID NO: 8999903 - DNA, 22 bp, Homo sapiens
aaggagtgctgaaaggaagcgg

SEQ ID NO: 8999904 - DNA, 22 bp, Homo sapiens
aaggagtttgggtagtcataca

SEQ ID NO: 8999905 - DNA, 22 bp, Homo sapiens
aaggagtttgggtagtcataca

SEQ ID NO: 8999906 - DNA, 22 bp, Homo sapiens
aaggatacttttagagcctgag

SEQ ID NO: 8999907 - DNA, 22 bp, Homo sapiens
aaggatatgggtagtatgatgt

SEQ ID NO: 8999908 - DNA, 22 bp, Homo sapiens
aaggataagaatggaaggaaca

SEQ ID NO: 8999909 - DNA, 22 bp, Homo sapiens
aaggatacttttagagcctgag

SEQ ID NO: 8999910 - DNA, 22 bp, Homo sapiens
aaggaggttatcccagtggact

SEQ ID NO: 8999911 - DNA, 22 bp, Homo sapiens
aaggagtctcagctgggcctga

SEQ ID NO: 8999912 - DNA, 22 bp, Homo sapiens
aaggagggttcccaggtcctgg

SEQ ID NO: 8999913 - DNA, 22 bp, Homo sapiens
aaggagtctgggccattcagag

SEQ ID NO: 8999914 - DNA, 22 bp, Homo sapiens
aaggagtctgggccattcagag

SEQ ID NO: 8999915 - DNA, 22 bp, Homo sapiens
aaggagtctgggccattcagag

SEQ ID NO: 8999916 - DNA, 22 bp, Homo sapiens
aaggcactgaaaaattgtgtgt

SEQ ID NO: 8999917 - DNA, 22 bp, Homo sapiens
aaggcactgaaaaattgtgtgt

SEQ ID NO: 8999918 - DNA, 22 bp, Homo sapiens
aaggcactgaaaaattgtgtgt

SEQ ID NO: 8999919 - DNA, 22 bp, Homo sapiens
aaggcactgaaaaattgtgtgt

SEQ ID NO: 8999920 - DNA, 22 bp, Homo sapiens
aaggcactcattcaaggagata

SEQ ID NO: 8999921 - DNA, 22 bp, Homo sapiens
aaggcactcattcaaggagata

SEQ ID NO: 8999922 - DNA, 22 bp, Homo sapiens
aaggcactcattcaaggagata

SEQ ID NO: 8999923 - DNA, 22 bp, Homo sapiens
aaggcactgactgtgcagggga

SEQ ID NO: 8999924 - DNA, 22 bp, Homo sapiens
aaggcactgagccagccgtctc

SEQ ID NO: 8999925 - DNA, 22 bp, Homo sapiens
aaggcactgagccagccgtctc

SEQ ID NO: 8999926 - DNA, 22 bp, Homo sapiens
aaggcactgactgtgcagggga

SEQ ID NO: 8999927 - DNA, 22 bp, Homo sapiens
aaggcactgactgtgcagggga

SEQ ID NO: 8999928 - DNA, 22 bp, Homo sapiens
aaggcactgaacttaaattctg

SEQ ID NO: 8999929 - DNA, 22 bp, Homo sapiens
aaggcactgaacttaaattctg

SEQ ID NO: 8999930 - DNA, 22 bp, Homo sapiens
aaggcactgaacttaaattctg

SEQ ID NO: 8999931 - DNA, 22 bp, Homo sapiens
aaggcactgaaaaattgtgtgt

SEQ ID NO: 8999932 - DNA, 22 bp, Homo sapiens
aaggcactgaacttaaattctg

SEQ ID NO: 8999933 - DNA, 22 bp, Homo sapiens
aaggcactagcagaattagtga

SEQ ID NO: 8999934 - DNA, 22 bp, Homo sapiens
aaggcactagcagaattagtga

SEQ ID NO: 8999935 - DNA, 22 bp, Homo sapiens
aaggcactagcagaattagtga

SEQ ID NO: 8999936 - DNA, 22 bp, Homo sapiens
aaggcactagcagaattagtga

SEQ ID NO: 8999937 - DNA, 20 bp, Homo sapiens
aaggcactatgtctgctagc

SEQ ID NO: 8999938 - DNA, 20 bp, Homo sapiens
aaggcactatgtctgctagc

SEQ ID NO: 8999939 - DNA, 22 bp, Homo sapiens
aaggcactcagccttgggacag

SEQ ID NO: 8999940 - DNA, 22 bp, Homo sapiens
aaggcactcagccttgggacag

SEQ ID NO: 8999941 - DNA, 22 bp, Homo sapiens
aaggcactcattcaaggagata

SEQ ID NO: 8999942 - DNA, 22 bp, Homo sapiens
aaggcactcattcaaggagata

SEQ ID NO: 8999943 - DNA, 22 bp, Homo sapiens
aaggatatttggctacagaagc

SEQ ID NO: 8999944 - DNA, 22 bp, Homo sapiens
aaggcactagcaagctgcctgg

SEQ ID NO: 8999945 - DNA, 22 bp, Homo sapiens
aaggcactagcaagctgcctgg

SEQ ID NO: 8999946 - DNA, 22 bp, Homo sapiens
aaggcactagcaagctgcctgg

SEQ ID NO: 8999947 - DNA, 22 bp, Homo sapiens
aaggcactagcaagctgcctgg

SEQ ID NO: 8999948 - DNA, 22 bp, Homo sapiens
aaggcactagcaagctgcctgg

SEQ ID NO: 8999949 - DNA, 22 bp, Homo sapiens
aaggatcaagtggattttctta

SEQ ID NO: 8999950 - DNA, 22 bp, Homo sapiens
aaggccaggtccctgcagtgca

SEQ ID NO: 8999951 - DNA, 22 bp, Homo sapiens
aaggccaggtccctgcagtgca

SEQ ID NO: 8999952 - DNA, 22 bp, Homo sapiens
aaggccaggtccctgcagtgca

SEQ ID NO: 8999953 - DNA, 23 bp, Homo sapiens
aaggccagagagaggctagtgtc

SEQ ID NO: 8999954 - DNA, 22 bp, Homo sapiens
aaggccagactctggaatgaca

SEQ ID NO: 8999955 - DNA, 22 bp, Homo sapiens
aaggccagactctggaatgaca

SEQ ID NO: 8999956 - DNA, 22 bp, Homo sapiens
aaggccagactctggaatgaca

SEQ ID NO: 8999957 - DNA, 23 bp, Homo sapiens
aaggccagagagaggctagtgtc

SEQ ID NO: 8999958 - DNA, 23 bp, Homo sapiens
aaggccagagagaggctagtgtc

SEQ ID NO: 8999959 - DNA, 22 bp, Homo sapiens
aaggcactgctttgctgcgccc

SEQ ID NO: 8999960 - DNA, 22 bp, Homo sapiens
aaggcactgctttgctgcgccc

SEQ ID NO: 8999961 - DNA, 22 bp, Homo sapiens
aaggcactgctttgctgcgccc

SEQ ID NO: 8999962 - DNA, 22 bp, Homo sapiens
aaggcactgagccagccgtctc

SEQ ID NO: 8999963 - DNA, 22 bp, Homo sapiens
aaggcactgtactagttagtta

SEQ ID NO: 8999964 - DNA, 22 bp, Homo sapiens
aaggcactgctttgctgcgccc

SEQ ID NO: 8999965 - DNA, 22 bp, Homo sapiens
aaggcccagcctggagcttgtt

SEQ ID NO: 8999966 - DNA, 22 bp, Homo sapiens
aaggcccacagaactgtctcca

SEQ ID NO: 8999967 - DNA, 22 bp, Homo sapiens
aaggcccacagaactgtctcca

SEQ ID NO: 8999968 - DNA, 17 bp, Homo sapiens
aaggccatttccaccca

SEQ ID NO: 8999969 - DNA, 22 bp, Homo sapiens
aaggccattgtaatgtaaatat

SEQ ID NO: 8999970 - DNA, 22 bp, Homo sapiens
aaggcccacagaactgtctcca

SEQ ID NO: 8999971 - DNA, 22 bp, Homo sapiens
aaggcccacagaactgtctcca

SEQ ID NO: 8999972 - DNA, 22 bp, Homo sapiens
aaggccatctacttacggaatt

SEQ ID NO: 8999973 - DNA, 22 bp, Homo sapiens
aaggccatacaatgaaaggggc

SEQ ID NO: 8999974 - DNA, 22 bp, Homo sapiens
aaggccaggtccctgcagtgca

SEQ ID NO: 8999975 - DNA, 22 bp, Homo sapiens
aaggccaggtccctgcagtgca

SEQ ID NO: 8999976 - DNA, 22 bp, Homo sapiens
aaggcccagcgtgacctcagtg

SEQ ID NO: 8999977 - DNA, 22 bp, Homo sapiens
aaggcccaggctgccctgggca

SEQ ID NO: 8999978 - DNA, 22 bp, Homo sapiens
aaggcccagggattggaggtca

SEQ ID NO: 8999979 - DNA, 22 bp, Homo sapiens
aaggcccaggctgccctgggca

SEQ ID NO: 8999980 - DNA, 22 bp, Homo sapiens
aaggcccagcgtgacctcagtg

SEQ ID NO: 8999981 - DNA, 22 bp, Homo sapiens
aaggcccagccaatgggggcag

SEQ ID NO: 8999982 - DNA, 22 bp, Homo sapiens
aaggcccagcgtgacctcagtg

SEQ ID NO: 8999983 - DNA, 22 bp, Homo sapiens
aaggccctcatgcgtcagagcc

SEQ ID NO: 8999984 - DNA, 22 bp, Homo sapiens
aaggccctaatagagcacatat

SEQ ID NO: 8999985 - DNA, 22 bp, Homo sapiens
aaggcccagcctggagcttgtt

SEQ ID NO: 8999986 - DNA, 22 bp, Homo sapiens
aaggcccagggattggaggtca

SEQ ID NO: 8999987 - DNA, 22 bp, Homo sapiens
aaggcccaggggctctagggca

SEQ ID NO: 8999988 - DNA, 22 bp, Homo sapiens
aaggcccaggggctctagggca

SEQ ID NO: 8999989 - DNA, 22 bp, Homo sapiens
aaggcccagggattggaggtca

SEQ ID NO: 8999990 - DNA, 22 bp, Homo sapiens
aaggccctgtctccaaatacag

SEQ ID NO: 8999991 - DNA, 22 bp, Homo sapiens
aaggccctggccccagcttctt

SEQ ID NO: 8999992 - DNA, 22 bp, Homo sapiens
aaggccctggccccagcttctt

SEQ ID NO: 8999993 - DNA, 22 bp, Homo sapiens
aaggccctggagtttctggaca

SEQ ID NO: 8999994 - DNA, 22 bp, Homo sapiens
aaggccctggcaggaagcagga

SEQ ID NO: 8999995 - DNA, 22 bp, Homo sapiens
aaggccctggcaggaagcagga

SEQ ID NO: 8999996 - DNA, 22 bp, Homo sapiens
aaggccctggatggttttgaga

SEQ ID NO: 8999997 - DNA, 22 bp, Homo sapiens
aaggccctcatgcgtcagagcc

SEQ ID NO: 8999998 - DNA, 22 bp, Homo sapiens
aaggcccttcggcttcctcagc

SEQ ID NO: 8999999 - DNA, 22 bp, Homo sapiens
aaggcccttccaccagtcctcg

SEQ ID NO: 9000000 - DNA, 22 bp, Homo sapiens
aaggcccttccaccagtcctcg

SEQ ID NO: 9000001 - DNA, 22 bp, Homo sapiens
aaggctgaattcaagggtaggc

SEQ ID NO: 9000002 - DNA, 22 bp, Homo sapiens
aagggcaggcagagatcatata

SEQ ID NO: 9000003 - DNA, 22 bp, Homo sapiens
aagggcaggcagagatcatata

SEQ ID NO: 9000004 - DNA, 22 bp, Homo sapiens
aagggcaggcacccaccctcac

SEQ ID NO: 9000005 - DNA, 22 bp, Homo sapiens
aagggcaggcagagatcatata

SEQ ID NO: 9000006 - DNA, 22 bp, Homo sapiens
aagggcaggcacccaccctcac

SEQ ID NO: 9000007 - DNA, 22 bp, Homo sapiens
aagggcaggcacccaccctcac

SEQ ID NO: 9000008 - DNA, 22 bp, Homo sapiens
aagggcaggcacccaccctcac

SEQ ID NO: 9000009 - DNA, 22 bp, Homo sapiens
aagggcaggagaagacggatat

SEQ ID NO: 9000010 - DNA, 22 bp, Homo sapiens
aagggcaggcacccaccctcac

SEQ ID NO: 9000011 - DNA, 22 bp, Homo sapiens
aagggcaggagaagacggatat

SEQ ID NO: 9000012 - DNA, 22 bp, Homo sapiens
aagggcaggagaagacggatat

SEQ ID NO: 9000013 - DNA, 22 bp, Homo sapiens
aagggcaggagaagacggatat

SEQ ID NO: 9000014 - DNA, 22 bp, Homo sapiens
aagggcaggagaagacggatat

SEQ ID NO: 9000015 - DNA, 22 bp, Homo sapiens
aagggcaggaaaagatggatgt

SEQ ID NO: 9000016 - DNA, 22 bp, Homo sapiens
aagggcaggaaaagatggatgt

SEQ ID NO: 9000017 - DNA, 22 bp, Homo sapiens
aagggcaggaaaagatggatgt

SEQ ID NO: 9000018 - DNA, 22 bp, Homo sapiens
aagggaggggatgtaagcctgg

SEQ ID NO: 9000019 - DNA, 22 bp, Homo sapiens
aagggaggggatgtaagcctgg

SEQ ID NO: 9000020 - DNA, 22 bp, Homo sapiens
aaggctgagagtcacagtccta

SEQ ID NO: 9000021 - DNA, 22 bp, Homo sapiens
aagggaggccagaggttttgca

SEQ ID NO: 9000022 - DNA, 22 bp, Homo sapiens
aaggctgagagtcacagtccta

SEQ ID NO: 9000023 - DNA, 22 bp, Homo sapiens
aaggctgagacagcacaggtcc

SEQ ID NO: 9000024 - DNA, 22 bp, Homo sapiens
aaggctgagacagcacaggtcc

SEQ ID NO: 9000025 - DNA, 22 bp, Homo sapiens
aaggctgaccagtttacacttt

SEQ ID NO: 9000026 - DNA, 22 bp, Homo sapiens
aaggctgacgtttgtgtttatt

SEQ ID NO: 9000027 - DNA, 22 bp, Homo sapiens
aaggctgaccagtttacacttt

SEQ ID NO: 9000028 - DNA, 22 bp, Homo sapiens
aaggctgaccagtttacacttt

SEQ ID NO: 9000029 - DNA, 22 bp, Homo sapiens
aaggctgaccagtttacacttt

SEQ ID NO: 9000030 - DNA, 22 bp, Homo sapiens
aaggctgacgtttgtgtttatt

SEQ ID NO: 9000031 - DNA, 22 bp, Homo sapiens
aaggctgacgtttgtgtttatt

SEQ ID NO: 9000032 - DNA, 22 bp, Homo sapiens
aagtacaaattttgaagagctt

SEQ ID NO: 9000033 - DNA, 22 bp, Homo sapiens
aagtacaaattttgaagagctt

SEQ ID NO: 9000034 - DNA, 22 bp, Homo sapiens
aagtacaaattttgaagagctt

SEQ ID NO: 9000035 - DNA, 22 bp, Homo sapiens
aagtacaacgcatacagagaaa

SEQ ID NO: 9000036 - DNA, 22 bp, Homo sapiens
aagtacaacgcatacagagaaa

SEQ ID NO: 9000037 - DNA, 22 bp, Homo sapiens
aagtacaacgcatacagagaaa

SEQ ID NO: 9000038 - DNA, 22 bp, Homo sapiens
aagtacaacgcatacagagaaa

SEQ ID NO: 9000039 - DNA, 22 bp, Homo sapiens
aagtaatctggaatttggtttt

SEQ ID NO: 9000040 - DNA, 21 bp, Homo sapiens
aagtaatgtgtctcttctacc

SEQ ID NO: 9000041 - DNA, 20 bp, Homo sapiens
aagtaatatttgtgtaactg

SEQ ID NO: 9000042 - DNA, 22 bp, Homo sapiens
aagtctgagagaaactctctca

SEQ ID NO: 9000043 - DNA, 22 bp, Homo sapiens
aagtctgagtgtcagtgcaagt

SEQ ID NO: 9000044 - DNA, 22 bp, Homo sapiens
aagtctgatcatttcttctata

SEQ ID NO: 9000045 - DNA, 22 bp, Homo sapiens
aagtctgatcatttcttctata

SEQ ID NO: 9000046 - DNA, 22 bp, Homo sapiens
aagtacaacgcatacagagaaa

SEQ ID NO: 9000047 - DNA, 22 bp, Homo sapiens
aagtacaatctttctgtaaagg

SEQ ID NO: 9000048 - DNA, 22 bp, Homo sapiens
aagtacaatctttctgtaaagg

SEQ ID NO: 9000049 - DNA, 22 bp, Homo sapiens
aagtacaacgcatacagagaaa

SEQ ID NO: 9000050 - DNA, 22 bp, Homo sapiens
aagtccagtatgagaaacctgc

SEQ ID NO: 9000051 - DNA, 23 bp, Homo sapiens
aaggtgtttgttttcagaaagca

SEQ ID NO: 9000052 - DNA, 23 bp, Homo sapiens
aaggtgtttgttttcagaaagca

SEQ ID NO: 9000053 - DNA, 22 bp, Homo sapiens
aaggttactcagaataacttcc

SEQ ID NO: 9000054 - DNA, 22 bp, Homo sapiens
aaggtgttcttcagtagaggtc

SEQ ID NO: 9000055 - DNA, 22 bp, Homo sapiens
aagtaacaggtgcttagtttat

SEQ ID NO: 9000056 - DNA, 22 bp, Homo sapiens
aagtaacaggtgcttagtttat

SEQ ID NO: 9000057 - DNA, 22 bp, Homo sapiens
aagtaacaggtgcttagtttat

SEQ ID NO: 9000058 - DNA, 22 bp, Homo sapiens
aagtaacaggtgcttagtttat

SEQ ID NO: 9000059 - DNA, 22 bp, Homo sapiens
aagtaacatctgaacatgatgt

SEQ ID NO: 9000060 - DNA, 22 bp, Homo sapiens
aagtaacatctgaacatgatgt

SEQ ID NO: 9000061 - DNA, 22 bp, Homo sapiens
aagtaagtcttacattcacatt

SEQ ID NO: 9000062 - DNA, 22 bp, Homo sapiens
aagtaagtttctctctccaaga

SEQ ID NO: 9000063 - DNA, 22 bp, Homo sapiens
aagtaagtggctattagctgtg

SEQ ID NO: 9000064 - DNA, 22 bp, Homo sapiens
aagtaagtgccttttattctta

SEQ ID NO: 9000065 - DNA, 22 bp, Homo sapiens
aagtaagtaagtctcttttctg

SEQ ID NO: 9000066 - DNA, 22 bp, Homo sapiens
aagtaacttatttgcaaacagg

SEQ ID NO: 9000067 - DNA, 22 bp, Homo sapiens
aagtaacttatttgcaaacagg

SEQ ID NO: 9000068 - DNA, 22 bp, Homo sapiens
aagtaactaaagatatccattt

SEQ ID NO: 9000069 - DNA, 22 bp, Homo sapiens
aagtaactaaagatatccattt

SEQ ID NO: 9000070 - DNA, 22 bp, Homo sapiens
aagtaactaaagatatccattt

SEQ ID NO: 9000071 - DNA, 22 bp, Homo sapiens
aagtaacatgggaacatctgaa

SEQ ID NO: 9000072 - DNA, 22 bp, Homo sapiens
aagtaacatgggaacatctgaa

SEQ ID NO: 9000073 - DNA, 22 bp, Homo sapiens
aagtaacatctgaacatgatgt

SEQ ID NO: 9000074 - DNA, 22 bp, Homo sapiens
aagtaacatctgaacatgatgt

SEQ ID NO: 9000075 - DNA, 22 bp, Homo sapiens
aagtaacatctgaacatgatgt

SEQ ID NO: 9000076 - DNA, 22 bp, Homo sapiens
aagggctgctgtagaagcagag

SEQ ID NO: 9000077 - DNA, 22 bp, Homo sapiens
aagggctgctgtagaagcagag

SEQ ID NO: 9000078 - DNA, 22 bp, Homo sapiens
aagggctgctgtagaagcagag

SEQ ID NO: 9000079 - DNA, 22 bp, Homo sapiens
aagggctgctgtagaagcagag

SEQ ID NO: 9000080 - DNA, 22 bp, Homo sapiens
aagggctgctgtagaagcagag

SEQ ID NO: 9000081 - DNA, 22 bp, Homo sapiens
aagggctggaatatctcttaga

SEQ ID NO: 9000082 - DNA, 22 bp, Homo sapiens
aagggctgctgtagaagcagag

SEQ ID NO: 9000083 - DNA, 22 bp, Homo sapiens
aagggctgctgtagaagcagag

SEQ ID NO: 9000084 - DNA, 22 bp, Homo sapiens
aagggctgccagggggtgccag

SEQ ID NO: 9000085 - DNA, 22 bp, Homo sapiens
aagggctgcatttgatgtgtca

SEQ ID NO: 9000086 - DNA, 22 bp, Homo sapiens
aagggctgccagggggtgccag

SEQ ID NO: 9000087 - DNA, 22 bp, Homo sapiens
aagggctgccagggggtgccag

SEQ ID NO: 9000088 - DNA, 22 bp, Homo sapiens
aagggctgccagggggtgccag

SEQ ID NO: 9000089 - DNA, 22 bp, Homo sapiens
aagggcagggagtttgtgtcta

SEQ ID NO: 9000090 - DNA, 22 bp, Homo sapiens
aagggcagggagtttgtgtcta

SEQ ID NO: 9000091 - DNA, 22 bp, Homo sapiens
aagggcaggcagagatcatata

SEQ ID NO: 9000092 - DNA, 22 bp, Homo sapiens
aagggcagggagtttgtgtcta

SEQ ID NO: 9000093 - DNA, 22 bp, Homo sapiens
aagggcaggtgggcatttctgg

SEQ ID NO: 9000094 - DNA, 22 bp, Homo sapiens
aagggctgcatttgatgtgtca

SEQ ID NO: 9000095 - DNA, 22 bp, Homo sapiens
aagggctgcatttgatgtgtca

SEQ ID NO: 9000096 - DNA, 22 bp, Homo sapiens
aagggctgcatttgatgtgtca

SEQ ID NO: 9000097 - DNA, 22 bp, Homo sapiens
aagggctgcatttgatgtgtca

SEQ ID NO: 9000098 - DNA, 22 bp, Homo sapiens
aagggctgcaatccaaaacact

SEQ ID NO: 9000099 - DNA, 22 bp, Homo sapiens
aagggctgcaatccaaaacact

SEQ ID NO: 9000100 - DNA, 22 bp, Homo sapiens
aagggctgcaatccaaaacact

SEQ ID NO: 9000101 - DNA, 22 bp, Homo sapiens
aaggtgtgaactgattcattgg

SEQ ID NO: 9000102 - DNA, 22 bp, Homo sapiens
aaggtgtcggcagagccgcttc

SEQ ID NO: 9000103 - DNA, 22 bp, Homo sapiens
aaggtgtcgggttagctcagcc

SEQ ID NO: 9000104 - DNA, 22 bp, Homo sapiens
aaggtgttatagctgaggaata

SEQ ID NO: 9000105 - DNA, 22 bp, Homo sapiens
aaggtgttcaggttttcccatt

SEQ ID NO: 9000106 - DNA, 21 bp, Homo sapiens
aaggtctgtaaagtgacagga

SEQ ID NO: 9000107 - DNA, 22 bp, Homo sapiens
aaggtgtgaagagatgggaaga

SEQ ID NO: 9000108 - DNA, 23 bp, Homo sapiens
aaggtgtcattgatgggattcta

SEQ ID NO: 9000109 - DNA, 22 bp, Homo sapiens
aagggctggaatatctcttaga

SEQ ID NO: 9000110 - DNA, 22 bp, Homo sapiens
aagggctggaatatctcttaga

SEQ ID NO: 9000111 - DNA, 22 bp, Homo sapiens
aagggctggaatatctcttaga

SEQ ID NO: 9000112 - DNA, 22 bp, Homo sapiens
aagggctgctgtagaagcagag

SEQ ID NO: 9000113 - DNA, 22 bp, Homo sapiens
aaggtctggatgatgggtgtgc

SEQ ID NO: 9000114 - DNA, 21 bp, Homo sapiens
aaggtctgtaaagtgacagga

SEQ ID NO: 9000115 - DNA, 22 bp, Homo sapiens
aagtcttgatgatctcctcctt

SEQ ID NO: 9000116 - DNA, 22 bp, Homo sapiens
aagtcttaggaaatagcaaaga

SEQ ID NO: 9000117 - DNA, 22 bp, Homo sapiens
aagtcttacagacaagctgaag

SEQ ID NO: 9000118 - DNA, 22 bp, Homo sapiens
aagtcttttgctaagagtaatg

SEQ ID NO: 9000119 - DNA, 22 bp, Homo sapiens
aagtcttttgctaagagtaatg

SEQ ID NO: 9000120 - DNA, 22 bp, Homo sapiens
aagtcttttgttcaggctggca

SEQ ID NO: 9000121 - DNA, 22 bp, Homo sapiens
aagtcttttgctgtcataggtg

SEQ ID NO: 9000122 - DNA, 22 bp, Homo sapiens
aagtctttcataagtctcttat

SEQ ID NO: 9000123 - DNA, 22 bp, Homo sapiens
aagtcttggtagagaaggactt

SEQ ID NO: 9000124 - DNA, 18 bp, Homo sapiens
aagtcttggaatttccac

SEQ ID NO: 9000125 - DNA, 22 bp, Homo sapiens
aagtctgggcctccttcccaga

SEQ ID NO: 9000126 - DNA, 22 bp, Homo sapiens
aagtctggggagaaaaggctaa

SEQ ID NO: 9000127 - DNA, 22 bp, Homo sapiens
aagtctgggcctccttcccaga

SEQ ID NO: 9000128 - DNA, 22 bp, Homo sapiens
aagtctggaacctcatgctggc

SEQ ID NO: 9000129 - DNA, 22 bp, Homo sapiens
aagtctgcctaaccttcatgtt

SEQ ID NO: 9000130 - DNA, 18 bp, Homo sapiens
aagtctggcagctttccc

SEQ ID NO: 9000131 - DNA, 22 bp, Homo sapiens
aagtctgtagaaaaacagttta

SEQ ID NO: 9000132 - DNA, 22 bp, Homo sapiens
aagtctgtagaaaaacagttta

SEQ ID NO: 9000133 - DNA, 22 bp, Homo sapiens
aagtctggtgctgtcctcaccc

SEQ ID NO: 9000134 - DNA, 22 bp, Homo sapiens
aagtcttaaccaaataaatgtt

SEQ ID NO: 9000135 - DNA, 22 bp, Homo sapiens
aagtgcattagatagaatgatg

SEQ ID NO: 9000136 - DNA, 22 bp, Homo sapiens
aagtgaaacatgtatctcttta

SEQ ID NO: 9000137 - DNA, 22 bp, Homo sapiens
aagtgaaacatgtatctcttta

SEQ ID NO: 9000138 - DNA, 22 bp, Homo sapiens
aagtctttttgaatctataact

SEQ ID NO: 9000139 - DNA, 22 bp, Homo sapiens
aagtcttttgttcaggctggca

SEQ ID NO: 9000140 - DNA, 22 bp, Homo sapiens
aagtctttttgaatctataact

SEQ ID NO: 9000141 - DNA, 21 bp, Homo sapiens
aagtgccacccacagatgcat

SEQ ID NO: 9000142 - DNA, 21 bp, Homo sapiens
aagtgccacccacagatgcat

SEQ ID NO: 9000143 - DNA, 21 bp, Homo sapiens
aagtgccacccacagatgcat

SEQ ID NO: 9000144 - DNA, 22 bp, Homo sapiens
aagtgcattagatagaatgatg

SEQ ID NO: 9000145 - DNA, 22 bp, Homo sapiens
aagtgccagggacacttcttgt

SEQ ID NO: 9000146 - DNA, 22 bp, Homo sapiens
aagtgccagggacacttcttgt

SEQ ID NO: 9000147 - DNA, 21 bp, Homo sapiens
aagtgccacccacagatgcat

SEQ ID NO: 9000148 - DNA, 22 bp, Homo sapiens
aagtgccagtttctggcttcct

SEQ ID NO: 9000149 - DNA, 22 bp, Homo sapiens
aagtgccatcatagcatggctg

SEQ ID NO: 9000150 - DNA, 22 bp, Homo sapiens
aagtgccagtttctggcttcct

SEQ ID NO: 9000151 - DNA, 22 bp, Homo sapiens
aagtgccagtttctggcttcct

SEQ ID NO: 9000152 - DNA, 22 bp, Homo sapiens
aagtgccatcatagcatggctg

SEQ ID NO: 9000153 - DNA, 22 bp, Homo sapiens
aagtgcctgggcaacatagcaa

SEQ ID NO: 9000154 - DNA, 22 bp, Homo sapiens
aagtgcctgacctagcctggag

SEQ ID NO: 9000155 - DNA, 23 bp, Homo sapiens
aagtgctaagtactgtaatcatc

SEQ ID NO: 9000156 - DNA, 23 bp, Homo sapiens
aagtgctatgtttataagagctg

SEQ ID NO: 9000157 - DNA, 22 bp, Homo sapiens
aagtgctaggattacaggtgtg

SEQ ID NO: 9000158 - DNA, 22 bp, Homo sapiens
aagtgctagaaccccagcaaca

SEQ ID NO: 9000159 - DNA, 22 bp, Homo sapiens
aacagtaaagacagaatttatc

SEQ ID NO: 9000160 - DNA, 22 bp, Homo sapiens
aacagtaaagacagaatttatc

SEQ ID NO: 9000161 - DNA, 22 bp, Homo sapiens
aacagtaaagacagaatttatc

SEQ ID NO: 9000162 - DNA, 22 bp, Homo sapiens
aagtgcttaaaagggtggtcta

SEQ ID NO: 9000163 - DNA, 22 bp, Homo sapiens
aagtgcttaaaagggtggtcta

SEQ ID NO: 9000164 - DNA, 22 bp, Homo sapiens
aacagtgatatcaagacagaca

SEQ ID NO: 9000165 - DNA, 22 bp, Homo sapiens
aacagtgatatcaagacagaca

SEQ ID NO: 9000166 - DNA, 22 bp, Homo sapiens
aacagtgctgcattcattgagc

SEQ ID NO: 9000167 - DNA, 22 bp, Homo sapiens
aacagtgctgattattttacct

SEQ ID NO: 9000168 - DNA, 17 bp, Homo sapiens
aacagtaagccctgttt

SEQ ID NO: 9000169 - DNA, 22 bp, Homo sapiens
aacagtaagagatgttttatct

SEQ ID NO: 9000170 - DNA, 17 bp, Homo sapiens
aacagtaagccctgttt

SEQ ID NO: 9000171 - DNA, 22 bp, Homo sapiens
aacagtgatatcaagacagaca

SEQ ID NO: 9000172 - DNA, 22 bp, Homo sapiens
aacagtaacgagatgtcctaac

SEQ ID NO: 9000173 - DNA, 22 bp, Homo sapiens
aacagtaacgagatgtcctaac

SEQ ID NO: 9000174 - DNA, 22 bp, Homo sapiens
aacagtaagagatgttttatct

SEQ ID NO: 9000175 - DNA, 22 bp, Homo sapiens
aagtgctgggattacaggcatg

SEQ ID NO: 9000176 - DNA, 22 bp, Homo sapiens
aagtgctgagactacaggcatg

SEQ ID NO: 9000177 - DNA, 23 bp, Homo sapiens
aagtgctatgtttataagagctg

SEQ ID NO: 9000178 - DNA, 22 bp, Homo sapiens
aagtgctgaatgaagacacaaa

SEQ ID NO: 9000179 - DNA, 22 bp, Homo sapiens
aagtgctgtacagtgtgtaaat

SEQ ID NO: 9000180 - DNA, 22 bp, Homo sapiens
aagtgctgtttctgatgaatgc

SEQ ID NO: 9000181 - DNA, 22 bp, Homo sapiens
aacagttacccttaagatcttt

SEQ ID NO: 9000182 - DNA, 22 bp, Homo sapiens
aacagttacccttaagatcttt

SEQ ID NO: 9000183 - DNA, 17 bp, Homo sapiens
aacagttaatgggggaa

SEQ ID NO: 9000184 - DNA, 22 bp, Homo sapiens
aacagttattatcacattagtg

SEQ ID NO: 9000185 - DNA, 22 bp, Homo sapiens
aacagttatctcacatatggaa

SEQ ID NO: 9000186 - DNA, 22 bp, Homo sapiens
aacagttaatgaagaggaagcc

SEQ ID NO: 9000187 - DNA, 22 bp, Homo sapiens
aacagttaatgaagaggaagcc

SEQ ID NO: 9000188 - DNA, 22 bp, Homo sapiens
aacagttaacattttgggagct

SEQ ID NO: 9000189 - DNA, 22 bp, Homo sapiens
aacagttaagcagtcctgatat

SEQ ID NO: 9000190 - DNA, 22 bp, Homo sapiens
aacagtgtttttcttcagcact

SEQ ID NO: 9000191 - DNA, 22 bp, Homo sapiens
aacagtgttttgctctttgccc

SEQ ID NO: 9000192 - DNA, 21 bp, Homo sapiens
aacagtgcttagtagatgttc

SEQ ID NO: 9000193 - DNA, 22 bp, Homo sapiens
aacagtgcttcattcacacatt

SEQ ID NO: 9000194 - DNA, 22 bp, Homo sapiens
aacagtgctgattattttacct

SEQ ID NO: 9000195 - DNA, 22 bp, Homo sapiens
aacagtgctgttataaatgtac

SEQ ID NO: 9000196 - DNA, 22 bp, Homo sapiens
aacagtgctgttataaatgtac

SEQ ID NO: 9000197 - DNA, 22 bp, Homo sapiens
aacagtgtcaggattacagata

SEQ ID NO: 9000198 - DNA, 22 bp, Homo sapiens
aacagtggtctggggagtggag

SEQ ID NO: 9000199 - DNA, 22 bp, Homo sapiens
aacagtggggaaaagagttggt

SEQ ID NO: 9000200 - DNA, 22 bp, Homo sapiens
aacagtgtgtacacatcatagg

SEQ ID NO: 9000201 - DNA, 22 bp, Homo sapiens
aacagtgtctgtggttaaaggt

SEQ ID NO: 9000202 - DNA, 22 bp, Homo sapiens
aacagtgtctgtggttaaaggt

SEQ ID NO: 9000203 - DNA, 22 bp, Homo sapiens
aacagtgtcaggattacagata

SEQ ID NO: 9000204 - DNA, 22 bp, Homo sapiens
aacagtgttttgctctttgccc

SEQ ID NO: 9000205 - DNA, 22 bp, Homo sapiens
aacagtgtgttttgttattaag

SEQ ID NO: 9000206 - DNA, 22 bp, Homo sapiens
aatgctgtcttttctacttcat

SEQ ID NO: 9000207 - DNA, 22 bp, Homo sapiens
aatgctgtgatttattaagtat

SEQ ID NO: 9000208 - DNA, 22 bp, Homo sapiens
aatgctgtggagccgtggacag

SEQ ID NO: 9000209 - DNA, 22 bp, Homo sapiens
aatgctgtggagccgtggacag

SEQ ID NO: 9000210 - DNA, 22 bp, Homo sapiens
aatgctgtcttttctacttcat

SEQ ID NO: 9000211 - DNA, 22 bp, Homo sapiens
aatgctgtcttttctacttcat

SEQ ID NO: 9000212 - DNA, 22 bp, Homo sapiens
aatgctgtcttagcatgaaagc

SEQ ID NO: 9000213 - DNA, 22 bp, Homo sapiens
aatgcttaattcaatactgtgt

SEQ ID NO: 9000214 - DNA, 22 bp, Homo sapiens
aatgctgttgagttgttcctgt

SEQ ID NO: 9000215 - DNA, 22 bp, Homo sapiens
aatgctgttctgagtctgcagg

SEQ ID NO: 9000216 - DNA, 22 bp, Homo sapiens
aatgctgttctgagtctgcagg

SEQ ID NO: 9000217 - DNA, 19 bp, Homo sapiens
aatgcttaggacagtgcct

SEQ ID NO: 9000218 - DNA, 19 bp, Homo sapiens
aatgcttaggacagtgcct

SEQ ID NO: 9000219 - DNA, 22 bp, Homo sapiens
aatgcttataacgttagaatgt

SEQ ID NO: 9000220 - DNA, 22 bp, Homo sapiens
aatgcttataacgttagaatgt

SEQ ID NO: 9000221 - DNA, 22 bp, Homo sapiens
aatgcttataacgttagaatgt

SEQ ID NO: 9000222 - DNA, 22 bp, Homo sapiens
aatgcttatacctaatgatctt

SEQ ID NO: 9000223 - DNA, 22 bp, Homo sapiens
aatgcttatacctaatgatctt

SEQ ID NO: 9000224 - DNA, 22 bp, Homo sapiens
aatgcttatgggttccataata

SEQ ID NO: 9000225 - DNA, 22 bp, Homo sapiens
aatgcttatgggttccataata

SEQ ID NO: 9000226 - DNA, 22 bp, Homo sapiens
aatgcagtgagccattaaatgg

SEQ ID NO: 9000227 - DNA, 22 bp, Homo sapiens
aatgcagttgaatttgggtatg

SEQ ID NO: 9000228 - DNA, 22 bp, Homo sapiens
aatgcagtgagccattaaatgg

SEQ ID NO: 9000229 - DNA, 22 bp, Homo sapiens
aatgcagtttcatttgtagaat

SEQ ID NO: 9000230 - DNA, 22 bp, Homo sapiens
aatgcagtttcatttgtagaat

SEQ ID NO: 9000231 - DNA, 22 bp, Homo sapiens
aatgcataatggtttgtgacaa

SEQ ID NO: 9000232 - DNA, 22 bp, Homo sapiens
aatgctgtatatcttagctaat

SEQ ID NO: 9000233 - DNA, 22 bp, Homo sapiens
aatgcataatggtttgtgacaa

SEQ ID NO: 9000234 - DNA, 22 bp, Homo sapiens
aatgcataatggtttgtgacaa

SEQ ID NO: 9000235 - DNA, 22 bp, Homo sapiens
aatgctgtcttagcatgaaagc

SEQ ID NO: 9000236 - DNA, 22 bp, Homo sapiens
aatgctgtccaataggaacata

SEQ ID NO: 9000237 - DNA, 22 bp, Homo sapiens
aatgctgtccaataggaacata

SEQ ID NO: 9000238 - DNA, 22 bp, Homo sapiens
aatgctgtccaataggaacata

SEQ ID NO: 9000239 - DNA, 22 bp, Homo sapiens
aatgctttagaaaaccagcttt

SEQ ID NO: 9000240 - DNA, 22 bp, Homo sapiens
aatgctttaattgcatgtagtg

SEQ ID NO: 9000241 - DNA, 22 bp, Homo sapiens
aatgctttagcagtgattagtg

SEQ ID NO: 9000242 - DNA, 22 bp, Homo sapiens
aatgctttagaaaaccagcttt

SEQ ID NO: 9000243 - DNA, 22 bp, Homo sapiens
aatgctttaattgcatgtagtg

SEQ ID NO: 9000244 - DNA, 22 bp, Homo sapiens
aatgctttaaatcctagtgtaa

SEQ ID NO: 9000245 - DNA, 22 bp, Homo sapiens
aatgctttaaatcctagtgtaa

SEQ ID NO: 9000246 - DNA, 22 bp, Homo sapiens
aatgcttccaaaataccaagcc

SEQ ID NO: 9000247 - DNA, 22 bp, Homo sapiens
aatgcttattattaatagaatg

SEQ ID NO: 9000248 - DNA, 22 bp, Homo sapiens
aatgcttcaacctcccacatgt

SEQ ID NO: 9000249 - DNA, 22 bp, Homo sapiens
aatgcttccaaaataccaagcc

SEQ ID NO: 9000250 - DNA, 22 bp, Homo sapiens
aatgcttcctcctcacctcagg

SEQ ID NO: 9000251 - DNA, 22 bp, Homo sapiens
aatgcttcctcctcacctcagg

SEQ ID NO: 9000252 - DNA, 22 bp, Homo sapiens
aatgcttattattaatagaatg

SEQ ID NO: 9000253 - DNA, 22 bp, Homo sapiens
aatgcttattattaatagaatg

SEQ ID NO: 9000254 - DNA, 22 bp, Homo sapiens
aatgcttattattaatagaatg

SEQ ID NO: 9000255 - DNA, 22 bp, Homo sapiens
aatgcttatgggttccataata

SEQ ID NO: 9000256 - DNA, 22 bp, Homo sapiens
aacttggtaaattgtgtcagat

SEQ ID NO: 9000257 - DNA, 22 bp, Homo sapiens
aacttccaacccagaagcctaa

SEQ ID NO: 9000258 - DNA, 22 bp, Homo sapiens
aacttggtaaattgtgtcagat

SEQ ID NO: 9000259 - DNA, 22 bp, Homo sapiens
aacttggttgttggcaatttgc

SEQ ID NO: 9000260 - DNA, 22 bp, Homo sapiens
aacttgtaatgaaaggcaatag

SEQ ID NO: 9000261 - DNA, 22 bp, Homo sapiens
aacttggtaccaccttctgaag

SEQ ID NO: 9000262 - DNA, 22 bp, Homo sapiens
aacttggtaccaccttctgaag

SEQ ID NO: 9000263 - DNA, 22 bp, Homo sapiens
aatgctttagcagtgattagtg

SEQ ID NO: 9000264 - DNA, 22 bp, Homo sapiens
aatgctttcaaaaatgtgcagt

SEQ ID NO: 9000265 - DNA, 22 bp, Homo sapiens
aatgctttcaaaaatgtgcagt

SEQ ID NO: 9000266 - DNA, 22 bp, Homo sapiens
aacttcatttataatgtcatta

SEQ ID NO: 9000267 - DNA, 22 bp, Homo sapiens
aatgtacaaaagtcagccaact

SEQ ID NO: 9000268 - DNA, 22 bp, Homo sapiens
aatgtacaaaagtcagccaact

SEQ ID NO: 9000269 - DNA, 22 bp, Homo sapiens
aatgtacaaaagtcagccaact

SEQ ID NO: 9000270 - DNA, 22 bp, Homo sapiens
aatgtacaaaagtcagccaact

SEQ ID NO: 9000271 - DNA, 22 bp, Homo sapiens
aatgtaacagcaacaacaatgg

SEQ ID NO: 9000272 - DNA, 22 bp, Homo sapiens
aatgtacaaaagtcagccaact

SEQ ID NO: 9000273 - DNA, 22 bp, Homo sapiens
aatgtaacagcaacaacaatgg

SEQ ID NO: 9000274 - DNA, 22 bp, Homo sapiens
aatgtaacagcaacaacaatgg

SEQ ID NO: 9000275 - DNA, 22 bp, Homo sapiens
aatgtacaaaccttctttgtag

SEQ ID NO: 9000276 - DNA, 22 bp, Homo sapiens
aatgtacaaaccttctttgtag

SEQ ID NO: 9000277 - DNA, 22 bp, Homo sapiens
aatgtacaaaccttctttgtag

SEQ ID NO: 9000278 - DNA, 22 bp, Homo sapiens
aatgtacaaaccttctttgtag

SEQ ID NO: 9000279 - DNA, 22 bp, Homo sapiens
aatgtaaacagcaagagaaggg

SEQ ID NO: 9000280 - DNA, 22 bp, Homo sapiens
aatgtaaacagcaagagaaggg

SEQ ID NO: 9000281 - DNA, 22 bp, Homo sapiens
aatgtaaagttgggcacaaatg

SEQ ID NO: 9000282 - DNA, 22 bp, Homo sapiens
aatgtaaagttgggcacaaatg

SEQ ID NO: 9000283 - DNA, 22 bp, Homo sapiens
aatgtaaagctcaggtcaggag

SEQ ID NO: 9000284 - DNA, 22 bp, Homo sapiens
aatgtaaagctcaggtcaggag

SEQ ID NO: 9000285 - DNA, 22 bp, Homo sapiens
aatgtaaagttgggcacaaatg

SEQ ID NO: 9000286 - DNA, 22 bp, Homo sapiens
aacttgtaggactgcactgtag

SEQ ID NO: 9000287 - DNA, 22 bp, Homo sapiens
aacttgtatatgttattcagag

SEQ ID NO: 9000288 - DNA, 21 bp, Homo sapiens
aacttgtatttctccttattc

SEQ ID NO: 9000289 - DNA, 21 bp, Homo sapiens
aacttgtatttctccttattc

SEQ ID NO: 9000290 - DNA, 21 bp, Homo sapiens
aacttgtatttctccttattc

SEQ ID NO: 9000291 - DNA, 22 bp, Homo sapiens
aacttgtgggctcaagcaattt

SEQ ID NO: 9000292 - DNA, 20 bp, Homo sapiens
aacttgttttgttttctaat

SEQ ID NO: 9000293 - DNA, 22 bp, Homo sapiens
aacttgtttcttccattcaaca

SEQ ID NO: 9000294 - DNA, 22 bp, Homo sapiens
aacttgtttcttccattcaaca

SEQ ID NO: 9000295 - DNA, 20 bp, Homo sapiens
aacttgttttgttttctaat

SEQ ID NO: 9000296 - DNA, 22 bp, Homo sapiens
aactttaaaaaatatgtctgtt

SEQ ID NO: 9000297 - DNA, 22 bp, Homo sapiens
aactttaaaaaatatgtctgtt

SEQ ID NO: 9000298 - DNA, 22 bp, Homo sapiens
aactttaaggctataaattatg

SEQ ID NO: 9000299 - DNA, 22 bp, Homo sapiens
aactttaaggctataaattatg

SEQ ID NO: 9000300 - DNA, 22 bp, Homo sapiens
aactttaaggctataaattatg

SEQ ID NO: 9000301 - DNA, 22 bp, Homo sapiens
aactttaaggctataaattatg

SEQ ID NO: 9000302 - DNA, 22 bp, Homo sapiens
aactttaaagaggaggcttggg

SEQ ID NO: 9000303 - DNA, 22 bp, Homo sapiens
aactttaaagaggaggcttggg

SEQ ID NO: 9000304 - DNA, 22 bp, Homo sapiens
aactttaaagaggaggcttggg

SEQ ID NO: 9000305 - DNA, 22 bp, Homo sapiens
aactttaaggctataaattatg

SEQ ID NO: 9000306 - DNA, 22 bp, Homo sapiens
aactttaaggctataaattatg

SEQ ID NO: 9000307 - DNA, 22 bp, Homo sapiens
aactttaaggctataaattatg

SEQ ID NO: 9000308 - DNA, 22 bp, Homo sapiens
aactttacactgctttacatga

SEQ ID NO: 9000309 - DNA, 22 bp, Homo sapiens
aatgatgacaggataaagaaca

SEQ ID NO: 9000310 - DNA, 18 bp, Homo sapiens
aatgcacacatttactcc

SEQ ID NO: 9000311 - DNA, 22 bp, Homo sapiens
aatgcacaaaggtgtctattgc

SEQ ID NO: 9000312 - DNA, 22 bp, Homo sapiens
aatgaacaaatggtgctgcttg

SEQ ID NO: 9000313 - DNA, 22 bp, Homo sapiens
aatgatgaactcagagggaacc

SEQ ID NO: 9000314 - DNA, 22 bp, Homo sapiens
aatgaacaaaatatgctttgca

SEQ ID NO: 9000315 - DNA, 22 bp, Homo sapiens
aatgaaatgtagcttatccata

SEQ ID NO: 9000316 - DNA, 22 bp, Homo sapiens
aatgaaatgtagcttatccata

SEQ ID NO: 9000317 - DNA, 18 bp, Homo sapiens
aatgaaatgtacaccttt

SEQ ID NO: 9000318 - DNA, 18 bp, Homo sapiens
aatgaaatgtacaccttt

SEQ ID NO: 9000319 - DNA, 18 bp, Homo sapiens
aatgaaatgtacaccttt

SEQ ID NO: 9000320 - DNA, 22 bp, Homo sapiens
aatgaaatgtagcttatccata

SEQ ID NO: 9000321 - DNA, 22 bp, Homo sapiens
aatgaaatgtagcttatccata

SEQ ID NO: 9000322 - DNA, 18 bp, Homo sapiens
aatgaaatgtacaccttt

SEQ ID NO: 9000323 - DNA, 18 bp, Homo sapiens
aatgaaatgtacaccttt

SEQ ID NO: 9000324 - DNA, 22 bp, Homo sapiens
aatgaaatgaagatatgatcag

SEQ ID NO: 9000325 - DNA, 22 bp, Homo sapiens
aatgaaatgaagatatgatcag

SEQ ID NO: 9000326 - DNA, 22 bp, Homo sapiens
aatgaaatgaagatatgatcag

SEQ ID NO: 9000327 - DNA, 22 bp, Homo sapiens
aatgaaatgaagatatgatcag

SEQ ID NO: 9000328 - DNA, 22 bp, Homo sapiens
aatgaaatgaagatatgatcag

SEQ ID NO: 9000329 - DNA, 22 bp, Homo sapiens
aatgcacacatttggtactgaa

SEQ ID NO: 9000330 - DNA, 18 bp, Homo sapiens
aatgcacacatttactcc

SEQ ID NO: 9000331 - DNA, 22 bp, Homo sapiens
aatgcacatatatttccttatt

SEQ ID NO: 9000332 - DNA, 22 bp, Homo sapiens
aatgcacatgccacatgtggta

SEQ ID NO: 9000333 - DNA, 22 bp, Homo sapiens
aatgcacatatatgtgtataca

SEQ ID NO: 9000334 - DNA, 22 bp, Homo sapiens
aatgcacatatatttccttatt

SEQ ID NO: 9000335 - DNA, 22 bp, Homo sapiens
aatgcacataaatatggtctta

SEQ ID NO: 9000336 - DNA, 22 bp, Homo sapiens
aatgcacataaatatggtctta

SEQ ID NO: 9000337 - DNA, 22 bp, Homo sapiens
aatgcacatgttgtaataaata

SEQ ID NO: 9000338 - DNA, 22 bp, Homo sapiens
aatgcacatgtcttggcctcac

SEQ ID NO: 9000339 - DNA, 22 bp, Homo sapiens
aatgcaccttggcagggattca

SEQ ID NO: 9000340 - DNA, 22 bp, Homo sapiens
aatgcacatgttgtaataaata

SEQ ID NO: 9000341 - DNA, 22 bp, Homo sapiens
aatgcacctaccttgattctgc

SEQ ID NO: 9000342 - DNA, 22 bp, Homo sapiens
aatgcagattcttattctgtag

SEQ ID NO: 9000343 - DNA, 22 bp, Homo sapiens
aatgcagattcttattctgtag

SEQ ID NO: 9000344 - DNA, 22 bp, Homo sapiens
aatgcagaccagtatgaaaaac

SEQ ID NO: 9000345 - DNA, 22 bp, Homo sapiens
aatgcactgtcagtattgttga

SEQ ID NO: 9000346 - DNA, 22 bp, Homo sapiens
aatgcacttagtatgaatgcct

SEQ ID NO: 9000347 - DNA, 22 bp, Homo sapiens
aatctggacttgtctgtgaaga

SEQ ID NO: 9000348 - DNA, 22 bp, Homo sapiens
aatctggagagtcatctctgac

SEQ ID NO: 9000349 - DNA, 22 bp, Homo sapiens
aatctggaatatttgcattgta

SEQ ID NO: 9000350 - DNA, 22 bp, Homo sapiens
aatctggacacagttctcatgc

SEQ ID NO: 9000351 - DNA, 22 bp, Homo sapiens
aatctggagttaatgttttcgc

SEQ ID NO: 9000352 - DNA, 22 bp, Homo sapiens
aatctggagagtcatctctgac

SEQ ID NO: 9000353 - DNA, 22 bp, Homo sapiens
aatctggaatatttgcattgta

SEQ ID NO: 9000354 - DNA, 22 bp, Homo sapiens
aatctggacacagttctcatgc

SEQ ID NO: 9000355 - DNA, 22 bp, Homo sapiens
aatctggacacagttctcatgc

SEQ ID NO: 9000356 - DNA, 22 bp, Homo sapiens
aatctggcatttgagagtagga

SEQ ID NO: 9000357 - DNA, 22 bp, Homo sapiens
aatctggcatgtaagcttagag

SEQ ID NO: 9000358 - DNA, 22 bp, Homo sapiens
aatctgtagggaacaactgtac

SEQ ID NO: 9000359 - DNA, 22 bp, Homo sapiens
aatctgtagggaacaactgtac

SEQ ID NO: 9000360 - DNA, 22 bp, Homo sapiens
aatctgtattgctcatacttga

SEQ ID NO: 9000361 - DNA, 22 bp, Homo sapiens
aatctgtattgctcatacttga

SEQ ID NO: 9000362 - DNA, 22 bp, Homo sapiens
aatgaaactgtatatagactgt

SEQ ID NO: 9000363 - DNA, 22 bp, Homo sapiens
aatgaaactgtatatagactgt

SEQ ID NO: 9000364 - DNA, 22 bp, Homo sapiens
aatgaaactgtatatagactgt

SEQ ID NO: 9000365 - DNA, 22 bp, Homo sapiens
aatgaaatagttggctgtagag

SEQ ID NO: 9000366 - DNA, 22 bp, Homo sapiens
aatgaaatctgctgggtaaaga

SEQ ID NO: 9000367 - DNA, 22 bp, Homo sapiens
aatctcttcccagtaaaaatgg

SEQ ID NO: 9000368 - DNA, 22 bp, Homo sapiens
aatctccatttaccctgcatct

SEQ ID NO: 9000369 - DNA, 22 bp, Homo sapiens
aatctcatttttagtttaggtg

SEQ ID NO: 9000370 - DNA, 22 bp, Homo sapiens
aatctcttggttcagaagcctc

SEQ ID NO: 9000371 - DNA, 22 bp, Homo sapiens
aatctcttgtatttcctttgac

SEQ ID NO: 9000372 - DNA, 22 bp, Homo sapiens
aatctcttgggaggaatgaatt

SEQ ID NO: 9000373 - DNA, 22 bp, Homo sapiens
aatctcttgggaggaatgaatt

SEQ ID NO: 9000374 - DNA, 22 bp, Homo sapiens
aatctcttggttcagaagcctc

SEQ ID NO: 9000375 - DNA, 17 bp, Homo sapiens
aatctcagtggcttaag

SEQ ID NO: 9000376 - DNA, 17 bp, Homo sapiens
aatctcagtggcttaag

SEQ ID NO: 9000377 - DNA, 22 bp, Homo sapiens
aatctcatgagcttcttgtccc

SEQ ID NO: 9000378 - DNA, 22 bp, Homo sapiens
aatctcagagatatctgtgtcc

SEQ ID NO: 9000379 - DNA, 22 bp, Homo sapiens
aatctcagaaactggtggattt

SEQ ID NO: 9000380 - DNA, 22 bp, Homo sapiens
aatctcacctcccgctcctggt

SEQ ID NO: 9000381 - DNA, 22 bp, Homo sapiens
aatctgaatatttatgtgtatt

SEQ ID NO: 9000382 - DNA, 22 bp, Homo sapiens
aatctgaatatttatgtgtatt

SEQ ID NO: 9000383 - DNA, 22 bp, Homo sapiens
aatctgaatatttatgtgtatt

SEQ ID NO: 9000384 - DNA, 20 bp, Homo sapiens
aatctgaatcccagtcctag

SEQ ID NO: 9000385 - DNA, 22 bp, Homo sapiens
aatctgacagctaggcaggcac

SEQ ID NO: 9000386 - DNA, 22 bp, Homo sapiens
aatctgaaagtatggagcagta

SEQ ID NO: 9000387 - DNA, 22 bp, Homo sapiens
aatctctttggctcaaggatcc

SEQ ID NO: 9000388 - DNA, 22 bp, Homo sapiens
aatctctttggctcaaggatcc

SEQ ID NO: 9000389 - DNA, 22 bp, Homo sapiens
aatctctttggctcaaggatcc

SEQ ID NO: 9000390 - DNA, 22 bp, Homo sapiens
aatctctttggctcaaggatcc

SEQ ID NO: 9000391 - DNA, 22 bp, Homo sapiens
aatctgcacccactgaaaatgc

SEQ ID NO: 9000392 - DNA, 22 bp, Homo sapiens
aatctgcacccactgaaaatgc

SEQ ID NO: 9000393 - DNA, 22 bp, Homo sapiens
aatctgagggaacttgaactcc

SEQ ID NO: 9000394 - DNA, 22 bp, Homo sapiens
aatctgagggaacttgaactcc

SEQ ID NO: 9000395 - DNA, 22 bp, Homo sapiens
aatctgcacaattcagtttcag

SEQ ID NO: 9000396 - DNA, 22 bp, Homo sapiens
aatatttatgacaggaagtagc

SEQ ID NO: 9000397 - DNA, 22 bp, Homo sapiens
aatatttcaaaaggaaacacag

SEQ ID NO: 9000398 - DNA, 22 bp, Homo sapiens
aatatttccaaggcctgtcagg

SEQ ID NO: 9000399 - DNA, 22 bp, Homo sapiens
aatatttcaaaaggaaacacag

SEQ ID NO: 9000400 - DNA, 22 bp, Homo sapiens
aatatttcgttgcgtggctaga

SEQ ID NO: 9000401 - DNA, 22 bp, Homo sapiens
aatatttctccttcgttatagc

SEQ ID NO: 9000402 - DNA, 22 bp, Homo sapiens
aatatttctccttcgttatagc

SEQ ID NO: 9000403 - DNA, 22 bp, Homo sapiens
aatatttctgcagaatggtttt

SEQ ID NO: 9000404 - DNA, 22 bp, Homo sapiens
aatatttctgcagaatggtttt

SEQ ID NO: 9000405 - DNA, 22 bp, Homo sapiens
aatatttctgcagaatggtttt

SEQ ID NO: 9000406 - DNA, 22 bp, Homo sapiens
aatatttctgcagaatggtttt

SEQ ID NO: 9000407 - DNA, 22 bp, Homo sapiens
aatatttctccttcgttatagc

SEQ ID NO: 9000408 - DNA, 22 bp, Homo sapiens
aatatttctccttcgttatagc

SEQ ID NO: 9000409 - DNA, 22 bp, Homo sapiens
aatatttctccttcgttatagc

SEQ ID NO: 9000410 - DNA, 22 bp, Homo sapiens
aatatttctgtagctatgttct

SEQ ID NO: 9000411 - DNA, 22 bp, Homo sapiens
aatatttctggtgcttctcact

SEQ ID NO: 9000412 - DNA, 22 bp, Homo sapiens
aatatttctggtgcttctcact

SEQ ID NO: 9000413 - DNA, 22 bp, Homo sapiens
aatccagatgagcaatcatact

SEQ ID NO: 9000414 - DNA, 22 bp, Homo sapiens
aatatttctgtagctatgttct

SEQ ID NO: 9000415 - DNA, 22 bp, Homo sapiens
aatccagatgagcaatcatact

SEQ ID NO: 9000416 - DNA, 22 bp, Homo sapiens
aatccagatgagcaatcatact

SEQ ID NO: 9000417 - DNA, 22 bp, Homo sapiens
aatccagattccagaaaatcgc

SEQ ID NO: 9000418 - DNA, 22 bp, Homo sapiens
aatccagattccagaaaatcgc

SEQ ID NO: 9000419 - DNA, 22 bp, Homo sapiens
aatccagatgagcaatcatact

SEQ ID NO: 9000420 - DNA, 22 bp, Homo sapiens
aatccagcacatggacacagtc

SEQ ID NO: 9000421 - DNA, 22 bp, Homo sapiens
aatattgtttcaagatcacaga

SEQ ID NO: 9000422 - DNA, 22 bp, Homo sapiens
aatatttatatttctcttccct

SEQ ID NO: 9000423 - DNA, 22 bp, Homo sapiens
aatatttatatttctcttccct

SEQ ID NO: 9000424 - DNA, 22 bp, Homo sapiens
aatatttatatttctcttccct

SEQ ID NO: 9000425 - DNA, 22 bp, Homo sapiens
aatatttatgacaggaagtagc

SEQ ID NO: 9000426 - DNA, 22 bp, Homo sapiens
aatatttatgacaggaagtagc

SEQ ID NO: 9000427 - DNA, 22 bp, Homo sapiens
aatatttatgacaggaagtagc

SEQ ID NO: 9000428 - DNA, 22 bp, Homo sapiens
aatatttatgacaggaagtagc

SEQ ID NO: 9000429 - DNA, 22 bp, Homo sapiens
aatatttatgacaggaagtagc

SEQ ID NO: 9000430 - DNA, 22 bp, Homo sapiens
aatatttatgacaggaagtagc

SEQ ID NO: 9000431 - DNA, 22 bp, Homo sapiens
aatatctgtggccatacaattt

SEQ ID NO: 9000432 - DNA, 22 bp, Homo sapiens
aatatctgtggccatacaattt

SEQ ID NO: 9000433 - DNA, 22 bp, Homo sapiens
aatatctgttgttctaagccac

SEQ ID NO: 9000434 - DNA, 22 bp, Homo sapiens
aatatctgtggccatacaattt

SEQ ID NO: 9000435 - DNA, 22 bp, Homo sapiens
aatatctgtggccatacaattt

SEQ ID NO: 9000436 - DNA, 22 bp, Homo sapiens
aatatctgtctctaatgcatat

SEQ ID NO: 9000437 - DNA, 22 bp, Homo sapiens
aatatctggagatgctttttgt

SEQ ID NO: 9000438 - DNA, 22 bp, Homo sapiens
aatatctgtctctaatgcatat

SEQ ID NO: 9000439 - DNA, 22 bp, Homo sapiens
aatatctgtggccatacaattt

SEQ ID NO: 9000440 - DNA, 22 bp, Homo sapiens
aatatctgtggccatacaattt

SEQ ID NO: 9000441 - DNA, 22 bp, Homo sapiens
aatatctgtctctaatgcatat

SEQ ID NO: 9000442 - DNA, 22 bp, Homo sapiens
aatatctcaccatgacaaagca

SEQ ID NO: 9000443 - DNA, 22 bp, Homo sapiens
aatatctcaccatgacaaagca

SEQ ID NO: 9000444 - DNA, 22 bp, Homo sapiens
aatatcctttccagagtacagt

SEQ ID NO: 9000445 - DNA, 22 bp, Homo sapiens
aatatcctgaccagtaaactaa

SEQ ID NO: 9000446 - DNA, 22 bp, Homo sapiens
aatatcctgaccagtaaactaa

SEQ ID NO: 9000447 - DNA, 22 bp, Homo sapiens
aatatctagcctttagcagctt

SEQ ID NO: 9000448 - DNA, 22 bp, Homo sapiens
aatatcctttccagagtacagt

SEQ ID NO: 9000449 - DNA, 22 bp, Homo sapiens
aatatccattgggagcaaatgg

SEQ ID NO: 9000450 - DNA, 22 bp, Homo sapiens
aatatccattgggagcaaatgg

SEQ ID NO: 9000451 - DNA, 22 bp, Homo sapiens
aatatccattgggagcaaatgg

SEQ ID NO: 9000452 - DNA, 22 bp, Homo sapiens
aatatccattgggagcaaatgg

SEQ ID NO: 9000453 - DNA, 22 bp, Homo sapiens
aatatccattgggagcaaatgg

SEQ ID NO: 9000454 - DNA, 22 bp, Homo sapiens
aatatccaggtagatgtcttct

SEQ ID NO: 9000455 - DNA, 22 bp, Homo sapiens
aatatccaggtagatgtcttct

SEQ ID NO: 9000456 - DNA, 22 bp, Homo sapiens
aatatccaggtagatgtcttct

SEQ ID NO: 9000457 - DNA, 22 bp, Homo sapiens
aatatccaggtagatgtcttct

SEQ ID NO: 9000458 - DNA, 22 bp, Homo sapiens
aatatccaggtagatgtcttct

SEQ ID NO: 9000459 - DNA, 21 bp, Homo sapiens
aatatccaaatgattagatct

SEQ ID NO: 9000460 - DNA, 21 bp, Homo sapiens
aatatccaaatgattagatct

SEQ ID NO: 9000461 - DNA, 21 bp, Homo sapiens
aatatccaaatgattagatct

SEQ ID NO: 9000462 - DNA, 22 bp, Homo sapiens
aatatcagtatattgtatcagt

SEQ ID NO: 9000463 - DNA, 22 bp, Homo sapiens
aatatcagtatattgtatcagt

SEQ ID NO: 9000464 - DNA, 22 bp, Homo sapiens
aatatcagtatattgtatcagt

SEQ ID NO: 9000465 - DNA, 22 bp, Homo sapiens
aatatccacttcaatacaggca

SEQ ID NO: 9000466 - DNA, 22 bp, Homo sapiens
aatatccacttcaatacaggca

SEQ ID NO: 9000467 - DNA, 22 bp, Homo sapiens
aatatccacactgtgtccctgc

SEQ ID NO: 9000468 - DNA, 21 bp, Homo sapiens
aatatccaaatgattagatct

SEQ ID NO: 9000469 - DNA, 22 bp, Homo sapiens
aatataattttattcctagagt

SEQ ID NO: 9000470 - DNA, 20 bp, Homo sapiens
aatataattctctgaattta

SEQ ID NO: 9000471 - DNA, 20 bp, Homo sapiens
aatataattctctgaattta

SEQ ID NO: 9000472 - DNA, 22 bp, Homo sapiens
aatacatatggaattccatgtt

SEQ ID NO: 9000473 - DNA, 20 bp, Homo sapiens
aatataattctctgaattta

SEQ ID NO: 9000474 - DNA, 19 bp, Homo sapiens
aatacagtgttatagaatt

SEQ ID NO: 9000475 - DNA, 21 bp, Homo sapiens
aatacagtgaagaatttcttt

SEQ ID NO: 9000476 - DNA, 19 bp, Homo sapiens
aatacagtgttatagaatt

SEQ ID NO: 9000477 - DNA, 19 bp, Homo sapiens
aatacagtgttatagaatt

SEQ ID NO: 9000478 - DNA, 19 bp, Homo sapiens
aatacagtgttatagaatt

SEQ ID NO: 9000479 - DNA, 22 bp, Homo sapiens
aatacataataagttttgtctg

SEQ ID NO: 9000480 - DNA, 22 bp, Homo sapiens
aatacataataagttttgtctg

SEQ ID NO: 9000481 - DNA, 22 bp, Homo sapiens
aatacatatggaattccatgtt

SEQ ID NO: 9000482 - DNA, 22 bp, Homo sapiens
aatacatatggaattccatgtt

SEQ ID NO: 9000483 - DNA, 22 bp, Homo sapiens
aatacagcagatggagacaaat

SEQ ID NO: 9000484 - DNA, 22 bp, Homo sapiens
aatacagcagatggagacaaat

SEQ ID NO: 9000485 - DNA, 22 bp, Homo sapiens
aatacagcagatggagacaaat

SEQ ID NO: 9000486 - DNA, 22 bp, Homo sapiens
aatacagtaattttgatgagtt

SEQ ID NO: 9000487 - DNA, 22 bp, Homo sapiens
aatacagtaattttgatgagtt

SEQ ID NO: 9000488 - DNA, 22 bp, Homo sapiens
aatacagtaggtaatagttcat

SEQ ID NO: 9000489 - DNA, 22 bp, Homo sapiens
aatacagtaggtaatagttcat

SEQ ID NO: 9000490 - DNA, 22 bp, Homo sapiens
aatacagtcttactagaaaatc

SEQ ID NO: 9000491 - DNA, 22 bp, Homo sapiens
aatacagtgaaagtgagcaagg

SEQ ID NO: 9000492 - DNA, 22 bp, Homo sapiens
aatacagtgaaagtgagcaagg

SEQ ID NO: 9000493 - DNA, 22 bp, Homo sapiens
aatacagtgaaagtgagcaagg

SEQ ID NO: 9000494 - DNA, 22 bp, Homo sapiens
aatacagtcttactagaaaatc

SEQ ID NO: 9000495 - DNA, 22 bp, Homo sapiens
aataatctcactttatgtggaa

SEQ ID NO: 9000496 - DNA, 22 bp, Homo sapiens
aataatatttgaagcttcaaag

SEQ ID NO: 9000497 - DNA, 22 bp, Homo sapiens
aataatatttgaagcttcaaag

SEQ ID NO: 9000498 - DNA, 22 bp, Homo sapiens
aataatatttgaagcttcaaag

SEQ ID NO: 9000499 - DNA, 22 bp, Homo sapiens
aataatctccctttttgtatgt

SEQ ID NO: 9000500 - DNA, 22 bp, Homo sapiens
aataatctccctttttgtatgt

SEQ ID NO: 9000501 - DNA, 22 bp, Homo sapiens
aataagaattgccagatttgaa

SEQ ID NO: 9000502 - DNA, 22 bp, Homo sapiens
aataagaattgccagatttgaa

SEQ ID NO: 9000503 - DNA, 22 bp, Homo sapiens
aataatattcctctgtgtgcgt

SEQ ID NO: 9000504 - DNA, 22 bp, Homo sapiens
aataatatttgaagcttcaaag

SEQ ID NO: 9000505 - DNA, 22 bp, Homo sapiens
aataatatttgaagcttcaaag

SEQ ID NO: 9000506 - DNA, 19 bp, Homo sapiens
aataatgccagatgtctgt

SEQ ID NO: 9000507 - DNA, 22 bp, Homo sapiens
aataatgtacatacatatttcg

SEQ ID NO: 9000508 - DNA, 22 bp, Homo sapiens
aataatgagcttgtctaattgt

SEQ ID NO: 9000509 - DNA, 22 bp, Homo sapiens
aataatgagcttgtctaattgt

SEQ ID NO: 9000510 - DNA, 22 bp, Homo sapiens
aataatgagacagcttatttaa

SEQ ID NO: 9000511 - DNA, 22 bp, Homo sapiens
aataatgagcttgtctaattgt

SEQ ID NO: 9000512 - DNA, 22 bp, Homo sapiens
aataatgagacagcttatttaa

SEQ ID NO: 9000513 - DNA, 22 bp, Homo sapiens
aataatgagacagcttatttaa

SEQ ID NO: 9000514 - DNA, 22 bp, Homo sapiens
aatacagaggggtcacaattca

SEQ ID NO: 9000515 - DNA, 22 bp, Homo sapiens
aatacagaggggtcacaattca

SEQ ID NO: 9000516 - DNA, 22 bp, Homo sapiens
aatacagaggggtcacaattca

SEQ ID NO: 9000517 - DNA, 22 bp, Homo sapiens
aatacagatgagcttctgcctc

SEQ ID NO: 9000518 - DNA, 22 bp, Homo sapiens
aatacagatggcatgtgaagat

SEQ ID NO: 9000519 - DNA, 22 bp, Homo sapiens
aatacagatggcatgtgaagat

SEQ ID NO: 9000520 - DNA, 22 bp, Homo sapiens
aatacagcagatggagacaaat

SEQ ID NO: 9000521 - DNA, 22 bp, Homo sapiens
aataatgtctatggttccaaaa

SEQ ID NO: 9000522 - DNA, 23 bp, Homo sapiens
aataatgtcttgtgctctcactt

SEQ ID NO: 9000523 - DNA, 22 bp, Homo sapiens
aataatgtctgctattttaaaa

SEQ ID NO: 9000524 - DNA, 22 bp, Homo sapiens
aataatgtctgctattttaaaa

SEQ ID NO: 9000525 - DNA, 22 bp, Homo sapiens
aataatgtaggatgataaatga

SEQ ID NO: 9000526 - DNA, 22 bp, Homo sapiens
aataatgtacatacatatttcg

SEQ ID NO: 9000527 - DNA, 22 bp, Homo sapiens
aataatgtacatacatatttcg

SEQ ID NO: 9000528 - DNA, 22 bp, Homo sapiens
aagttacaggagaaagagatca

SEQ ID NO: 9000529 - DNA, 22 bp, Homo sapiens
aagttacagtcagaggttaaca

SEQ ID NO: 9000530 - DNA, 22 bp, Homo sapiens
aagttacagtcagaggttaaca

SEQ ID NO: 9000531 - DNA, 22 bp, Homo sapiens
aagttacagtcagaggttaaca

SEQ ID NO: 9000532 - DNA, 22 bp, Homo sapiens
aagttacagttacagaatggag

SEQ ID NO: 9000533 - DNA, 22 bp, Homo sapiens
aagttacagttatgaaactcac

SEQ ID NO: 9000534 - DNA, 22 bp, Homo sapiens
aagttacagttatgaaactcac

SEQ ID NO: 9000535 - DNA, 22 bp, Homo sapiens
aagttacagttatgaaactcac

SEQ ID NO: 9000536 - DNA, 22 bp, Homo sapiens
aagttacagttattatttaaaa

SEQ ID NO: 9000537 - DNA, 22 bp, Homo sapiens
aagttacagttattatttaaaa

SEQ ID NO: 9000538 - DNA, 22 bp, Homo sapiens
aagttacagttattatttaaaa

SEQ ID NO: 9000539 - DNA, 22 bp, Homo sapiens
aagttacagttggaactgtgaa

SEQ ID NO: 9000540 - DNA, 22 bp, Homo sapiens
aagttacagttggaactgtgaa

SEQ ID NO: 9000541 - DNA, 22 bp, Homo sapiens
aagttacagttggaactgtgaa

SEQ ID NO: 9000542 - DNA, 22 bp, Homo sapiens
aataagaacttgtctctggcag

SEQ ID NO: 9000543 - DNA, 22 bp, Homo sapiens
aataagaattgccagatttgaa

SEQ ID NO: 9000544 - DNA, 22 bp, Homo sapiens
aataagaattgccagatttgaa

SEQ ID NO: 9000545 - DNA, 22 bp, Homo sapiens
aataagaattgccagatttgaa

SEQ ID NO: 9000546 - DNA, 22 bp, Homo sapiens
aagttacataaatgtcctctag

SEQ ID NO: 9000547 - DNA, 22 bp, Homo sapiens
aagttacataaatgtcctctag

SEQ ID NO: 9000548 - DNA, 22 bp, Homo sapiens
aacagtttatgagatatgctat

SEQ ID NO: 9000549 - DNA, 22 bp, Homo sapiens
aacagtttatgagatatgctat

SEQ ID NO: 9000550 - DNA, 22 bp, Homo sapiens
aacagtttatgagatatgctat

SEQ ID NO: 9000551 - DNA, 22 bp, Homo sapiens
aacagtttatgataaattctta

SEQ ID NO: 9000552 - DNA, 22 bp, Homo sapiens
aacagtttatgataaattctta

SEQ ID NO: 9000553 - DNA, 22 bp, Homo sapiens
aacagtttatgagatatgctat

SEQ ID NO: 9000554 - DNA, 22 bp, Homo sapiens
aacagtttatgataaattctta

SEQ ID NO: 9000555 - DNA, 22 bp, Homo sapiens
aacagttattatcacattagtg

SEQ ID NO: 9000556 - DNA, 21 bp, Homo sapiens
aacagttctctttgaaggtgt

SEQ ID NO: 9000557 - DNA, 22 bp, Homo sapiens
aacagttgatgtagctttggag

SEQ ID NO: 9000558 - DNA, 22 bp, Homo sapiens
aacagttgatgtagctttggag

SEQ ID NO: 9000559 - DNA, 22 bp, Homo sapiens
aacagtttatcaagtttttaca

SEQ ID NO: 9000560 - DNA, 22 bp, Homo sapiens
aacagtttatcaagtttttaca

SEQ ID NO: 9000561 - DNA, 22 bp, Homo sapiens
aacagtttatcaagtttttaca

SEQ ID NO: 9000562 - DNA, 22 bp, Homo sapiens
aacagtttatcaagtttttaca

SEQ ID NO: 9000563 - DNA, 22 bp, Homo sapiens
aacagtttatcaagtttttaca

SEQ ID NO: 9000564 - DNA, 22 bp, Homo sapiens
aagttaaggaagtcatactatg

SEQ ID NO: 9000565 - DNA, 22 bp, Homo sapiens
aagttaaggcacatgctttgga

SEQ ID NO: 9000566 - DNA, 22 bp, Homo sapiens
aagttaaggcacatgctttgga

SEQ ID NO: 9000567 - DNA, 22 bp, Homo sapiens
aagttaacccagtatttctttt

SEQ ID NO: 9000568 - DNA, 22 bp, Homo sapiens
aagttacaagactaaatggaag

SEQ ID NO: 9000569 - DNA, 22 bp, Homo sapiens
aagttacaagactaaatggaag

SEQ ID NO: 9000570 - DNA, 22 bp, Homo sapiens
aagttacacattttcattgtaa

SEQ ID NO: 9000571 - DNA, 22 bp, Homo sapiens
aagttacacattttcattgtaa

SEQ ID NO: 9000572 - DNA, 22 bp, Homo sapiens
aagttacacagagttggaggct

SEQ ID NO: 9000573 - DNA, 22 bp, Homo sapiens
aaaattttcagcttgacttgat

SEQ ID NO: 9000574 - DNA, 22 bp, Homo sapiens
aaaattttcagcttgacttgat

SEQ ID NO: 9000575 - DNA, 22 bp, Homo sapiens
aaaattttcagcttgacttgat

SEQ ID NO: 9000576 - DNA, 22 bp, Homo sapiens
aaaattttgccctatccttcat

SEQ ID NO: 9000577 - DNA, 22 bp, Homo sapiens
aaaattttcagcttgacttgat

SEQ ID NO: 9000578 - DNA, 22 bp, Homo sapiens
aaaattttcagcttgacttgat

SEQ ID NO: 9000579 - DNA, 22 bp, Homo sapiens
aaaattttactggtgtttcctt

SEQ ID NO: 9000580 - DNA, 22 bp, Homo sapiens
aaaattttactggtgtttcctt

SEQ ID NO: 9000581 - DNA, 22 bp, Homo sapiens
aaaattttactggtgtttcctt

SEQ ID NO: 9000582 - DNA, 22 bp, Homo sapiens
aaaattttactggtgtttcctt

SEQ ID NO: 9000583 - DNA, 22 bp, Homo sapiens
aaaattttactggtgtttcctt

SEQ ID NO: 9000584 - DNA, 22 bp, Homo sapiens
aaaattttactggtgtttcctt

SEQ ID NO: 9000585 - DNA, 22 bp, Homo sapiens
aaaatttccaccatctttgtgt

SEQ ID NO: 9000586 - DNA, 22 bp, Homo sapiens
aaaatttccaccatctttgtgt

SEQ ID NO: 9000587 - DNA, 22 bp, Homo sapiens
aaaattgtgaaggtttctgaaa

SEQ ID NO: 9000588 - DNA, 22 bp, Homo sapiens
aaaattgtgaaggtttctgaaa

SEQ ID NO: 9000589 - DNA, 22 bp, Homo sapiens
aaaattgtcgaacagtagtaac

SEQ ID NO: 9000590 - DNA, 22 bp, Homo sapiens
aaaattgtgaaggtttctgaaa

SEQ ID NO: 9000591 - DNA, 22 bp, Homo sapiens
aaaatttccaccatctttgtgt

SEQ ID NO: 9000592 - DNA, 22 bp, Homo sapiens
aaaatttccaccatctttgtgt

SEQ ID NO: 9000593 - DNA, 22 bp, Homo sapiens
aaaattgtcagaagttgatctt

SEQ ID NO: 9000594 - DNA, 22 bp, Homo sapiens
aaaattgtcgaacagtagtaac

SEQ ID NO: 9000595 - DNA, 22 bp, Homo sapiens
aaaattgtcgaacagtagtaac

SEQ ID NO: 9000596 - DNA, 22 bp, Homo sapiens
aaaattgtcgaacagtagtaac

SEQ ID NO: 9000597 - DNA, 22 bp, Homo sapiens
aaagccagggacagtgtgcatg

SEQ ID NO: 9000598 - DNA, 22 bp, Homo sapiens
aaagctagaaggaaattttatg

SEQ ID NO: 9000599 - DNA, 22 bp, Homo sapiens
aaagctagaaggaaattttatg

SEQ ID NO: 9000600 - DNA, 22 bp, Homo sapiens
aaagccagggacagtgtgcatg

SEQ ID NO: 9000601 - DNA, 22 bp, Homo sapiens
aaaattttgccctatccttcat

SEQ ID NO: 9000602 - DNA, 22 bp, Homo sapiens
aaagccagggacagtgtgcatg

SEQ ID NO: 9000603 - DNA, 22 bp, Homo sapiens
aaagctagagaagctgctgtca

SEQ ID NO: 9000604 - DNA, 22 bp, Homo sapiens
aaagctatagggtcaagcattt

SEQ ID NO: 9000605 - DNA, 22 bp, Homo sapiens
aaagctatagggtcaagcattt

SEQ ID NO: 9000606 - DNA, 22 bp, Homo sapiens
aaagctatcatcaatgcaactt

SEQ ID NO: 9000607 - DNA, 22 bp, Homo sapiens
aaagctatagggtcaagcattt

SEQ ID NO: 9000608 - DNA, 22 bp, Homo sapiens
aaagctatagggtcaagcattt

SEQ ID NO: 9000609 - DNA, 22 bp, Homo sapiens
aaagctagagaagctgctgtca

SEQ ID NO: 9000610 - DNA, 22 bp, Homo sapiens
aaagctagtaatattttaatcc

SEQ ID NO: 9000611 - DNA, 22 bp, Homo sapiens
aaagctagtaatattttaatcc

SEQ ID NO: 9000612 - DNA, 22 bp, Homo sapiens
aaagctagtaatattttaatcc

SEQ ID NO: 9000613 - DNA, 22 bp, Homo sapiens
aaagctattcaacacgaacatg

SEQ ID NO: 9000614 - DNA, 22 bp, Homo sapiens
aaagctattcaacacgaacatg

SEQ ID NO: 9000615 - DNA, 22 bp, Homo sapiens
aaagctattcaacacgaacatg

SEQ ID NO: 9000616 - DNA, 22 bp, Homo sapiens
aaagctattcaacacgaacatg

SEQ ID NO: 9000617 - DNA, 22 bp, Homo sapiens
aaagctatttattacagagaat

SEQ ID NO: 9000618 - DNA, 22 bp, Homo sapiens
aaagctatgaggcatgcatttc

SEQ ID NO: 9000619 - DNA, 22 bp, Homo sapiens
aaagctatgaggcatgcatttc

SEQ ID NO: 9000620 - DNA, 22 bp, Homo sapiens
aaagctatttgttatgagagaa

SEQ ID NO: 9000621 - DNA, 22 bp, Homo sapiens
aaagctattttattgcagctct

SEQ ID NO: 9000622 - DNA, 22 bp, Homo sapiens
aaagctattttattgcagctct

SEQ ID NO: 9000623 - DNA, 22 bp, Homo sapiens
aaagctatttgttatgagagaa

SEQ ID NO: 9000624 - DNA, 22 bp, Homo sapiens
aaagctatttgtgagttataga

SEQ ID NO: 9000625 - DNA, 22 bp, Homo sapiens
aaagctatttgtgagttataga

SEQ ID NO: 9000626 - DNA, 22 bp, Homo sapiens
aaagctatttattacagagaat

SEQ ID NO: 9000627 - DNA, 22 bp, Homo sapiens
aaagctatttattacagagaat

SEQ ID NO: 9000628 - DNA, 22 bp, Homo sapiens
aaagctatttattacagagaat

SEQ ID NO: 9000629 - DNA, 22 bp, Homo sapiens
aaaggacatgtcaatatcaggc

SEQ ID NO: 9000630 - DNA, 22 bp, Homo sapiens
aaaggacacacaggaggtgtct

SEQ ID NO: 9000631 - DNA, 22 bp, Homo sapiens
aaaggaatgagcttctgttagg

SEQ ID NO: 9000632 - DNA, 22 bp, Homo sapiens
aaaggacatgtcaatatcaggc

SEQ ID NO: 9000633 - DNA, 22 bp, Homo sapiens
aaaggacatgtcaatatcaggc

SEQ ID NO: 9000634 - DNA, 22 bp, Homo sapiens
aaagctcttaatgagattatcc

SEQ ID NO: 9000635 - DNA, 22 bp, Homo sapiens
aaagctcttaatgagattatcc

SEQ ID NO: 9000636 - DNA, 22 bp, Homo sapiens
aaagctctggtttggagcattt

SEQ ID NO: 9000637 - DNA, 22 bp, Homo sapiens
aaaggaatattcaaaacagtca

SEQ ID NO: 9000638 - DNA, 22 bp, Homo sapiens
aaagctcttactgtactagtga

SEQ ID NO: 9000639 - DNA, 22 bp, Homo sapiens
aaaggaatgagcttctgttagg

SEQ ID NO: 9000640 - DNA, 22 bp, Homo sapiens
aaaggaatgagcttctgttagg

SEQ ID NO: 9000641 - DNA, 22 bp, Homo sapiens
aaagctctgagaagcactgcaa

SEQ ID NO: 9000642 - DNA, 22 bp, Homo sapiens
aaagctctgagaagcactgcaa

SEQ ID NO: 9000643 - DNA, 22 bp, Homo sapiens
aaagctctctgaacaccagacc

SEQ ID NO: 9000644 - DNA, 22 bp, Homo sapiens
aaagctcacagtaatacaaggc

SEQ ID NO: 9000645 - DNA, 22 bp, Homo sapiens
aaaggagacttcagatctcctt

SEQ ID NO: 9000646 - DNA, 22 bp, Homo sapiens
aaaggagacttcagatctcctt

SEQ ID NO: 9000647 - DNA, 22 bp, Homo sapiens
aaaggagagtaggttactccat

SEQ ID NO: 9000648 - DNA, 22 bp, Homo sapiens
aaaggagagtgagtcagatgcc

SEQ ID NO: 9000649 - DNA, 22 bp, Homo sapiens
aaaggagagtgagtcagatgcc

SEQ ID NO: 9000650 - DNA, 22 bp, Homo sapiens
aaaggagagtgagtcagatgcc

SEQ ID NO: 9000651 - DNA, 22 bp, Homo sapiens
aaaggagagtgagtcagatgcc

SEQ ID NO: 9000652 - DNA, 22 bp, Homo sapiens
aaaggagataaagggcccttca

SEQ ID NO: 9000653 - DNA, 22 bp, Homo sapiens
aaaggttaaggtgttcaagaaa

SEQ ID NO: 9000654 - DNA, 22 bp, Homo sapiens
aaaggttaaggtgttcaagaaa

SEQ ID NO: 9000655 - DNA, 22 bp, Homo sapiens
aaaggaggaatggagagatgct

SEQ ID NO: 9000656 - DNA, 22 bp, Homo sapiens
aaaggaggaatggagagatgct

SEQ ID NO: 9000657 - DNA, 22 bp, Homo sapiens
aaaggagacagtcttacctgga

SEQ ID NO: 9000658 - DNA, 22 bp, Homo sapiens
aaaggagacagtcttacctgga

SEQ ID NO: 9000659 - DNA, 22 bp, Homo sapiens
aaaggagaaaacatacaggact

SEQ ID NO: 9000660 - DNA, 22 bp, Homo sapiens
aaaggagaaaacatacaggact

SEQ ID NO: 9000661 - DNA, 22 bp, Homo sapiens
aaaggagaaaacatacaggact

SEQ ID NO: 9000662 - DNA, 22 bp, Homo sapiens
aaaggagaaaacatacaggact

SEQ ID NO: 9000663 - DNA, 22 bp, Homo sapiens
aaaggagaaaacatacaggact

SEQ ID NO: 9000664 - DNA, 22 bp, Homo sapiens
aaagttctaaaactctttgtga

SEQ ID NO: 9000665 - DNA, 22 bp, Homo sapiens
aaagttctaaaactctttgtga

SEQ ID NO: 9000666 - DNA, 23 bp, Homo sapiens
aaagttctagaatgacttcctgt

SEQ ID NO: 9000667 - DNA, 22 bp, Homo sapiens
aaagttttattcaagcattagt

SEQ ID NO: 9000668 - DNA, 22 bp, Homo sapiens
aaagttctagagttgcaagaga

SEQ ID NO: 9000669 - DNA, 22 bp, Homo sapiens
aaagttttattcaagcattagt

SEQ ID NO: 9000670 - DNA, 19 bp, Homo sapiens
aaagttttattctcatttg

SEQ ID NO: 9000671 - DNA, 22 bp, Homo sapiens
aaagttttctgccttcattaga

SEQ ID NO: 9000672 - DNA, 19 bp, Homo sapiens
aaagttttattctcatttg

SEQ ID NO: 9000673 - DNA, 22 bp, Homo sapiens
aaagttttctgccttcattaga

SEQ ID NO: 9000674 - DNA, 22 bp, Homo sapiens
aaagttttctgccttcattaga

SEQ ID NO: 9000675 - DNA, 22 bp, Homo sapiens
aaagttttctgccttcattaga

SEQ ID NO: 9000676 - DNA, 22 bp, Homo sapiens
aaagttttgttgattgtggaat

SEQ ID NO: 9000677 - DNA, 22 bp, Homo sapiens
aaagttttgttgattgtggaat

SEQ ID NO: 9000678 - DNA, 22 bp, Homo sapiens
aaataaactgaagcacagagag

SEQ ID NO: 9000679 - DNA, 22 bp, Homo sapiens
aaagtttttaagcaagaccctt

SEQ ID NO: 9000680 - DNA, 22 bp, Homo sapiens
aaagtttttaagcaagaccctt

SEQ ID NO: 9000681 - DNA, 22 bp, Homo sapiens
aaataaactgaagcacagagag

SEQ ID NO: 9000682 - DNA, 22 bp, Homo sapiens
aaataaactgaagcacagagag

SEQ ID NO: 9000683 - DNA, 22 bp, Homo sapiens
aaagttccttttatagacatga

SEQ ID NO: 9000684 - DNA, 22 bp, Homo sapiens
aaagtcattgtaatatatgcta

SEQ ID NO: 9000685 - DNA, 22 bp, Homo sapiens
aaagtcattggaatattaatga

SEQ ID NO: 9000686 - DNA, 22 bp, Homo sapiens
aaagtcattgctgttatcaatg

SEQ ID NO: 9000687 - DNA, 22 bp, Homo sapiens
aaagtcattgctgttatcaatg

SEQ ID NO: 9000688 - DNA, 22 bp, Homo sapiens
aaagtcattggaatattaatga

SEQ ID NO: 9000689 - DNA, 22 bp, Homo sapiens
aaagtcatctaggagcagattt

SEQ ID NO: 9000690 - DNA, 22 bp, Homo sapiens
aaagtcatctaggagcagattt

SEQ ID NO: 9000691 - DNA, 22 bp, Homo sapiens
aaagtcatctaggagcagattt

SEQ ID NO: 9000692 - DNA, 22 bp, Homo sapiens
aaagtcatgtaatgatatgatt

SEQ ID NO: 9000693 - DNA, 22 bp, Homo sapiens
aaagtcatgcagttgaactttt

SEQ ID NO: 9000694 - DNA, 22 bp, Homo sapiens
aaagtcatctgtcctaggctct

SEQ ID NO: 9000695 - DNA, 22 bp, Homo sapiens
aaagtcatctaggagcagattt

SEQ ID NO: 9000696 - DNA, 22 bp, Homo sapiens
aaagtcatctgtcctaggctct

SEQ ID NO: 9000697 - DNA, 22 bp, Homo sapiens
aaagtacagccacatccaagta

SEQ ID NO: 9000698 - DNA, 22 bp, Homo sapiens
aaagtacagccacatccaagta

SEQ ID NO: 9000699 - DNA, 22 bp, Homo sapiens
aaagtacagccacatccaagta

SEQ ID NO: 9000700 - DNA, 22 bp, Homo sapiens
aaagtacagccacatccaagta

SEQ ID NO: 9000701 - DNA, 22 bp, Homo sapiens
aaagtacagccacatccaagta

SEQ ID NO: 9000702 - DNA, 22 bp, Homo sapiens
aaagtacagccacatccaagta

SEQ ID NO: 9000703 - DNA, 22 bp, Homo sapiens
aaagtacaggaaagcctagcca

SEQ ID NO: 9000704 - DNA, 22 bp, Homo sapiens
aaagtacaggaaagcctagcca

SEQ ID NO: 9000705 - DNA, 22 bp, Homo sapiens
aaagtacaggaaagcctagcca

SEQ ID NO: 9000706 - DNA, 22 bp, Homo sapiens
aaagtacaggaaagcctagcca

SEQ ID NO: 9000707 - DNA, 22 bp, Homo sapiens
aaagtacagggttgtggggtga

SEQ ID NO: 9000708 - DNA, 22 bp, Homo sapiens
aaagtacagggttgtggggtga

SEQ ID NO: 9000709 - DNA, 22 bp, Homo sapiens
aaagtacagatggtgaggttgg

SEQ ID NO: 9000710 - DNA, 22 bp, Homo sapiens
aaagtacagatggtgaggttgg

SEQ ID NO: 9000711 - DNA, 22 bp, Homo sapiens
aaagtacacatttatcccttat

SEQ ID NO: 9000712 - DNA, 22 bp, Homo sapiens
aaagtacacatttatcccttat

SEQ ID NO: 9000713 - DNA, 22 bp, Homo sapiens
aaagtacagatggtgaggttgg

SEQ ID NO: 9000714 - DNA, 22 bp, Homo sapiens
aaagtacagatggtgaggttgg

SEQ ID NO: 9000715 - DNA, 22 bp, Homo sapiens
aaagtacagatggtgaggttgg

SEQ ID NO: 9000716 - DNA, 22 bp, Homo sapiens
aaagtacagatggtgaggttgg

SEQ ID NO: 9000717 - DNA, 22 bp, Homo sapiens
aaagtacagccacatccaagta

SEQ ID NO: 9000718 - DNA, 22 bp, Homo sapiens
aaagtacacacagagccaagaa

SEQ ID NO: 9000719 - DNA, 22 bp, Homo sapiens
aaagtacacacagagccaagaa

SEQ ID NO: 9000720 - DNA, 22 bp, Homo sapiens
aaagtacacacagagccaagaa

SEQ ID NO: 9000721 - DNA, 22 bp, Homo sapiens
aaagtacacacagagccaagaa

SEQ ID NO: 9000722 - DNA, 22 bp, Homo sapiens
aaagtacacacagagccaagaa

SEQ ID NO: 9000723 - DNA, 22 bp, Homo sapiens
aaagtacaatattgagattgat

SEQ ID NO: 9000724 - DNA, 22 bp, Homo sapiens
aaagtacaatattgagattgat

SEQ ID NO: 9000725 - DNA, 22 bp, Homo sapiens
aaagtacaatattgagattgat

SEQ ID NO: 9000726 - DNA, 22 bp, Homo sapiens
aaagtacaatattgagattgat

SEQ ID NO: 9000727 - DNA, 22 bp, Homo sapiens
aaagtacaatattgagattgat

SEQ ID NO: 9000728 - DNA, 22 bp, Homo sapiens
aaagtacaatattgagattgat

SEQ ID NO: 9000729 - DNA, 22 bp, Homo sapiens
aaaggttagttcttagaagtgc

SEQ ID NO: 9000730 - DNA, 22 bp, Homo sapiens
aaaggttagttcttagaagtgc

SEQ ID NO: 9000731 - DNA, 22 bp, Homo sapiens
aaaggttagacagctctgcata

SEQ ID NO: 9000732 - DNA, 22 bp, Homo sapiens
aaaggttagacagctctgcata

SEQ ID NO: 9000733 - DNA, 22 bp, Homo sapiens
aaaggttagacagctctgcata

SEQ ID NO: 9000734 - DNA, 22 bp, Homo sapiens
aaaggttaatgttgtcatgtta

SEQ ID NO: 9000735 - DNA, 22 bp, Homo sapiens
aaaggttaatgttgtcatgtta

SEQ ID NO: 9000736 - DNA, 22 bp, Homo sapiens
aaagtacaaggaaaggatctga

SEQ ID NO: 9000737 - DNA, 22 bp, Homo sapiens
aaagtacaaggaaaggatctga

SEQ ID NO: 9000738 - DNA, 22 bp, Homo sapiens
aaagtacaaggaaaggatctga

SEQ ID NO: 9000739 - DNA, 22 bp, Homo sapiens
aaagtacatgcaattcttctga

SEQ ID NO: 9000740 - DNA, 22 bp, Homo sapiens
aaagtacatgcaattcttctga

SEQ ID NO: 9000741 - DNA, 22 bp, Homo sapiens
aaagtacatgtttggccatttg

SEQ ID NO: 9000742 - DNA, 22 bp, Homo sapiens
aaagtacatgtttggccatttg

SEQ ID NO: 9000743 - DNA, 22 bp, Homo sapiens
aaagtacatgtttggccatttg

SEQ ID NO: 9000744 - DNA, 22 bp, Homo sapiens
aaagtacatgtttggccatttg

SEQ ID NO: 9000745 - DNA, 22 bp, Homo sapiens
aaagtacatgcaattcttctga

SEQ ID NO: 9000746 - DNA, 22 bp, Homo sapiens
aaagtacatgcaattcttctga

SEQ ID NO: 9000747 - DNA, 22 bp, Homo sapiens
aaagtacatgcaattcttctga

SEQ ID NO: 9000748 - DNA, 22 bp, Homo sapiens
aaagtacatgagattcaagggg

SEQ ID NO: 9000749 - DNA, 22 bp, Homo sapiens
aaagtacatagcatattccaac

SEQ ID NO: 9000750 - DNA, 22 bp, Homo sapiens
aaagtacatgagattcaagggg

SEQ ID NO: 9000751 - DNA, 22 bp, Homo sapiens
aaagtacatgagattcaagggg

SEQ ID NO: 9000752 - DNA, 22 bp, Homo sapiens
aaagtacatgagattcaagggg

SEQ ID NO: 9000753 - DNA, 22 bp, Homo sapiens
aaagtacatagcatattccaac

SEQ ID NO: 9000754 - DNA, 22 bp, Homo sapiens
aaagtacatagcatattccaac

SEQ ID NO: 9000755 - DNA, 22 bp, Homo sapiens
aaagtacatagcatattccaac

SEQ ID NO: 9000756 - DNA, 22 bp, Homo sapiens
aaagtacatagcatattccaac

SEQ ID NO: 9000757 - DNA, 22 bp, Homo sapiens
aaagtacatagcatattccaac

SEQ ID NO: 9000758 - DNA, 22 bp, Homo sapiens
aaagtcagttggccagatcact

SEQ ID NO: 9000759 - DNA, 22 bp, Homo sapiens
aaagtcagttggccagatcact

SEQ ID NO: 9000760 - DNA, 22 bp, Homo sapiens
aaagtcatacatggtgcttact

SEQ ID NO: 9000761 - DNA, 22 bp, Homo sapiens
aaagtcaggctgtgtacctaac

SEQ ID NO: 9000762 - DNA, 22 bp, Homo sapiens
aaagtcagttggccagatcact

SEQ ID NO: 9000763 - DNA, 22 bp, Homo sapiens
aaagtcaggctgtgtacctaac

SEQ ID NO: 9000764 - DNA, 22 bp, Homo sapiens
aaagtcacttacagctcttttg

SEQ ID NO: 9000765 - DNA, 22 bp, Homo sapiens
aaagtcacttccttctgtcagc

SEQ ID NO: 9000766 - DNA, 22 bp, Homo sapiens
aaactgtgagctagtaaatagg

SEQ ID NO: 9000767 - DNA, 22 bp, Homo sapiens
aaactgtgagctagtaaatagg

SEQ ID NO: 9000768 - DNA, 22 bp, Homo sapiens
aaactgtgagctagtaaatagg

SEQ ID NO: 9000769 - DNA, 23 bp, Homo sapiens
aaatgacatatggtttctgaagg

SEQ ID NO: 9000770 - DNA, 22 bp, Homo sapiens
aaactgtgtatgcagagagcat

SEQ ID NO: 9000771 - DNA, 22 bp, Homo sapiens
aaactgtgcttcccaaatgccc

SEQ ID NO: 9000772 - DNA, 23 bp, Homo sapiens
aaatgacatatggtttctgaagg

SEQ ID NO: 9000773 - DNA, 23 bp, Homo sapiens
aaatgacatatggtttctgaagg

SEQ ID NO: 9000774 - DNA, 22 bp, Homo sapiens
aaacttagatgtttttagagtt

SEQ ID NO: 9000775 - DNA, 22 bp, Homo sapiens
aaactgtttccctccataacct

SEQ ID NO: 9000776 - DNA, 22 bp, Homo sapiens
aaactgtttccctccataacct

SEQ ID NO: 9000777 - DNA, 22 bp, Homo sapiens
aaactgttgtggtttatcatta

SEQ ID NO: 9000778 - DNA, 22 bp, Homo sapiens
aaactgttatagcagaaaggac

SEQ ID NO: 9000779 - DNA, 22 bp, Homo sapiens
aaatgacagagtaagctgttta

SEQ ID NO: 9000780 - DNA, 22 bp, Homo sapiens
aaatgacagagtaagctgttta

SEQ ID NO: 9000781 - DNA, 22 bp, Homo sapiens
aaatgacagagtaagctgttta

SEQ ID NO: 9000782 - DNA, 22 bp, Homo sapiens
aaatgacagagtaagctgttta

SEQ ID NO: 9000783 - DNA, 22 bp, Homo sapiens
aaatgacagagtaagctgttta

SEQ ID NO: 9000784 - DNA, 22 bp, Homo sapiens
aaatgacagttctctctgagta

SEQ ID NO: 9000785 - DNA, 22 bp, Homo sapiens
aaatgacactcattcagtgtca

SEQ ID NO: 9000786 - DNA, 22 bp, Homo sapiens
aaatgacactcattcagtgtca

SEQ ID NO: 9000787 - DNA, 22 bp, Homo sapiens
aaatgacactcattcagtgtca

SEQ ID NO: 9000788 - DNA, 22 bp, Homo sapiens
aaatgacagagctgggactagt

SEQ ID NO: 9000789 - DNA, 22 bp, Homo sapiens
aaatgacactcattcagtgtca

SEQ ID NO: 9000790 - DNA, 22 bp, Homo sapiens
aaatgacactcattcagtgtca

SEQ ID NO: 9000791 - DNA, 22 bp, Homo sapiens
aaatgacaataaaagtccatgc

SEQ ID NO: 9000792 - DNA, 22 bp, Homo sapiens
aaatgacaataaaagtccatgc

SEQ ID NO: 9000793 - DNA, 22 bp, Homo sapiens
aaatgacaataaaagtccatgc

SEQ ID NO: 9000794 - DNA, 22 bp, Homo sapiens
aaatgacaataaaagtccatgc

SEQ ID NO: 9000795 - DNA, 22 bp, Homo sapiens
aaatgacaataaaagtccatgc

SEQ ID NO: 9000796 - DNA, 22 bp, Homo sapiens
aaatgacaataaaagtccatgc

SEQ ID NO: 9000797 - DNA, 22 bp, Homo sapiens
aaatgacaataaaagtccatgc

SEQ ID NO: 9000798 - DNA, 22 bp, Homo sapiens
aaatgacaataaaagtccatgc

SEQ ID NO: 9000799 - DNA, 22 bp, Homo sapiens
aaatgacactaggctttttgca

SEQ ID NO: 9000800 - DNA, 22 bp, Homo sapiens
aaatgacactaggctttttgca

SEQ ID NO: 9000801 - DNA, 22 bp, Homo sapiens
aaatgacactaggctttttgca

SEQ ID NO: 9000802 - DNA, 22 bp, Homo sapiens
aaatgacactaggctttttgca

SEQ ID NO: 9000803 - DNA, 21 bp, Homo sapiens
aaatgaatgtggtagtgcaag

SEQ ID NO: 9000804 - DNA, 21 bp, Homo sapiens
aaatgaatgtggtagtgcaag

SEQ ID NO: 9000805 - DNA, 21 bp, Homo sapiens
aaatgaatgtggtagtgcaag

SEQ ID NO: 9000806 - DNA, 21 bp, Homo sapiens
aaatgaatgtggtagtgcaag

SEQ ID NO: 9000807 - DNA, 21 bp, Homo sapiens
aaatgaatgtggtagtgcaag

SEQ ID NO: 9000808 - DNA, 21 bp, Homo sapiens
aaatgaatgtggtagtgcaag

SEQ ID NO: 9000809 - DNA, 21 bp, Homo sapiens
aaatgaatgtggtagtgcaag

SEQ ID NO: 9000810 - DNA, 21 bp, Homo sapiens
aaatgaatgtggtagtgcaag

SEQ ID NO: 9000811 - DNA, 22 bp, Homo sapiens
aaatgaacatcaagaatagcct

SEQ ID NO: 9000812 - DNA, 22 bp, Homo sapiens
aaatgaactcttcctgcatccc

SEQ ID NO: 9000813 - DNA, 22 bp, Homo sapiens
aaatgaactcttcctgcatccc

SEQ ID NO: 9000814 - DNA, 22 bp, Homo sapiens
aaatgaactcaatgatctccca

SEQ ID NO: 9000815 - DNA, 22 bp, Homo sapiens
aaatccagtgttcaaagtttga

SEQ ID NO: 9000816 - DNA, 22 bp, Homo sapiens
aaatccagtgttcaaagtttga

SEQ ID NO: 9000817 - DNA, 22 bp, Homo sapiens
aaatccagtttgtcatttccca

SEQ ID NO: 9000818 - DNA, 22 bp, Homo sapiens
aaatacaatttcaggctgtaat

SEQ ID NO: 9000819 - DNA, 22 bp, Homo sapiens
aaatacagagttatggacctca

SEQ ID NO: 9000820 - DNA, 22 bp, Homo sapiens
aaatacagagttgcttaaaagc

SEQ ID NO: 9000821 - DNA, 22 bp, Homo sapiens
aaatacagagttgcttaaaagc

SEQ ID NO: 9000822 - DNA, 22 bp, Homo sapiens
aaatacagagttgcttaaaagc

SEQ ID NO: 9000823 - DNA, 22 bp, Homo sapiens
aaatacagagttgcttaaaagc

SEQ ID NO: 9000824 - DNA, 22 bp, Homo sapiens
aaatacagagttgcttaaaagc

SEQ ID NO: 9000825 - DNA, 22 bp, Homo sapiens
aaatacagagttgcttaaaagc

SEQ ID NO: 9000826 - DNA, 20 bp, Homo sapiens
aaatccagtgtgtattttac

SEQ ID NO: 9000827 - DNA, 20 bp, Homo sapiens
aaatccagtgtgtattttac

SEQ ID NO: 9000828 - DNA, 22 bp, Homo sapiens
aaatccagtgggtcctcatgag

SEQ ID NO: 9000829 - DNA, 22 bp, Homo sapiens
aaatacagattccagggtctta

SEQ ID NO: 9000830 - DNA, 21 bp, Homo sapiens
aaatacagatgcaaatctgtt

SEQ ID NO: 9000831 - DNA, 21 bp, Homo sapiens
aaatacagatgcaaatctgtt

SEQ ID NO: 9000832 - DNA, 22 bp, Homo sapiens
aaatacagatagatttaaccca

SEQ ID NO: 9000833 - DNA, 21 bp, Homo sapiens
aaatacagatgcaaatctgtt

SEQ ID NO: 9000834 - DNA, 21 bp, Homo sapiens
aaatacagatgcaaatctgtt

SEQ ID NO: 9000835 - DNA, 21 bp, Homo sapiens
aaatacagatgcaaatctgtt

SEQ ID NO: 9000836 - DNA, 21 bp, Homo sapiens
aaatacagatgcaaatctgtt

SEQ ID NO: 9000837 - DNA, 22 bp, Homo sapiens
aaataaaggaactgttttccca

SEQ ID NO: 9000838 - DNA, 22 bp, Homo sapiens
aaataaaggaactgttttccca

SEQ ID NO: 9000839 - DNA, 22 bp, Homo sapiens
aaataaaggaactgttttccca

SEQ ID NO: 9000840 - DNA, 22 bp, Homo sapiens
aaataaaggtccactttagggc

SEQ ID NO: 9000841 - DNA, 22 bp, Homo sapiens
aaataacagtcagggacaacat

SEQ ID NO: 9000842 - DNA, 22 bp, Homo sapiens
aaataacagtcagggacaacat

SEQ ID NO: 9000843 - DNA, 22 bp, Homo sapiens
aaataacagtcagggacaacat

SEQ ID NO: 9000844 - DNA, 22 bp, Homo sapiens
aaataacagtcagggacaacat

SEQ ID NO: 9000845 - DNA, 22 bp, Homo sapiens
aaataacagtcagggacaacat

SEQ ID NO: 9000846 - DNA, 22 bp, Homo sapiens
aaataaaggtccactttagggc

SEQ ID NO: 9000847 - DNA, 22 bp, Homo sapiens
aaataaaggtccactttagggc

SEQ ID NO: 9000848 - DNA, 22 bp, Homo sapiens
aaatacacgtacatgtgtaaaa

SEQ ID NO: 9000849 - DNA, 22 bp, Homo sapiens
aaatacacgtacatgtgtaaaa

SEQ ID NO: 9000850 - DNA, 22 bp, Homo sapiens
aaatacacgtacatgtgtaaaa

SEQ ID NO: 9000851 - DNA, 22 bp, Homo sapiens
aaatacaatttcaggctgtaat

SEQ ID NO: 9000852 - DNA, 22 bp, Homo sapiens
aaatacaatttcaggctgtaat

SEQ ID NO: 9000853 - DNA, 22 bp, Homo sapiens
aaatacaatttcaggctgtaat

SEQ ID NO: 9000854 - DNA, 22 bp, Homo sapiens
aaatacaatttcaggctgtaat

SEQ ID NO: 9000855 - DNA, 22 bp, Homo sapiens
aaagacacacagccagcaagtg

SEQ ID NO: 9000856 - DNA, 22 bp, Homo sapiens
aaagacacacagccagcaagtg

SEQ ID NO: 9000857 - DNA, 22 bp, Homo sapiens
aaagacacacagtgcttcagtt

SEQ ID NO: 9000858 - DNA, 22 bp, Homo sapiens
aaatgtgagttatagcaataga

SEQ ID NO: 9000859 - DNA, 22 bp, Homo sapiens
aaatgtgacagatgcagtacag

SEQ ID NO: 9000860 - DNA, 22 bp, Homo sapiens
aaatgtgacagatgcagtacag

SEQ ID NO: 9000861 - DNA, 22 bp, Homo sapiens
aaatgtctttcaatagagaaat

SEQ ID NO: 9000862 - DNA, 22 bp, Homo sapiens
aaatgtctttcaatagagaaat

SEQ ID NO: 9000863 - DNA, 22 bp, Homo sapiens
aaatgtctttcaatagagaaat

SEQ ID NO: 9000864 - DNA, 22 bp, Homo sapiens
aaatgtctttatctcatgtaac

SEQ ID NO: 9000865 - DNA, 22 bp, Homo sapiens
aaatgtctttcttctgctacgt

SEQ ID NO: 9000866 - DNA, 22 bp, Homo sapiens
aaatgtctttgagtatttctgc

SEQ ID NO: 9000867 - DNA, 22 bp, Homo sapiens
aaatgtctttgagtatttctgc

SEQ ID NO: 9000868 - DNA, 22 bp, Homo sapiens
aaatgtgacagatgcagtacag

SEQ ID NO: 9000869 - DNA, 22 bp, Homo sapiens
aaatgtctttgagtttttataa

SEQ ID NO: 9000870 - DNA, 22 bp, Homo sapiens
aaagacagacggaaacctgagg

SEQ ID NO: 9000871 - DNA, 22 bp, Homo sapiens
aaagacacatgtctcttagatt

SEQ ID NO: 9000872 - DNA, 22 bp, Homo sapiens
aaagacacatgtctcttagatt

SEQ ID NO: 9000873 - DNA, 22 bp, Homo sapiens
aaagacagatggcaaggatgat

SEQ ID NO: 9000874 - DNA, 22 bp, Homo sapiens
aaagacagatggcaaggatgat

SEQ ID NO: 9000875 - DNA, 22 bp, Homo sapiens
aaagacagagctgtaggggaaa

SEQ ID NO: 9000876 - DNA, 22 bp, Homo sapiens
aaagacagtggattcaaaatcc

SEQ ID NO: 9000877 - DNA, 22 bp, Homo sapiens
aaagacagtggattcaaaatcc

SEQ ID NO: 9000878 - DNA, 22 bp, Homo sapiens
aaagacagatggcaaggatgat

SEQ ID NO: 9000879 - DNA, 22 bp, Homo sapiens
aaagacagtggattcaaaatcc

SEQ ID NO: 9000880 - DNA, 22 bp, Homo sapiens
aaagacatatttctaagtttat

SEQ ID NO: 9000881 - DNA, 22 bp, Homo sapiens
aaagacatatttctaagtttat

SEQ ID NO: 9000882 - DNA, 22 bp, Homo sapiens
aaagacatcagaaccagctgag

SEQ ID NO: 9000883 - DNA, 22 bp, Homo sapiens
aaatgtctgagacttctgaact

SEQ ID NO: 9000884 - DNA, 22 bp, Homo sapiens
aaatgtctgtatgagaaagaga

SEQ ID NO: 9000885 - DNA, 22 bp, Homo sapiens
aaatgtctgtatgagaaagaga

SEQ ID NO: 9000886 - DNA, 22 bp, Homo sapiens
aaatggtgtttctaatgctaga

SEQ ID NO: 9000887 - DNA, 22 bp, Homo sapiens
aaatggtgtttctaatgctaga

SEQ ID NO: 9000888 - DNA, 22 bp, Homo sapiens
aaatgtctatctggcatattcc

SEQ ID NO: 9000889 - DNA, 22 bp, Homo sapiens
aaatgtctgagacttctgaact

SEQ ID NO: 9000890 - DNA, 22 bp, Homo sapiens
aaatgtctctattgcctctggt

SEQ ID NO: 9000891 - DNA, 22 bp, Homo sapiens
aaatgtctatctggcatattcc

SEQ ID NO: 9000892 - DNA, 22 bp, Homo sapiens
aaatgtctgttagtcatatcat

SEQ ID NO: 9000893 - DNA, 22 bp, Homo sapiens
aaatgtctgtctcatgaggaaa

SEQ ID NO: 9000894 - DNA, 22 bp, Homo sapiens
aaatgtctgtctcatgaggaaa

SEQ ID NO: 9000895 - DNA, 22 bp, Homo sapiens
aaatgtctgttagtcatatcat

SEQ ID NO: 9000896 - DNA, 22 bp, Homo sapiens
aaatgtctgtatgagaaagaga

SEQ ID NO: 9000897 - DNA, 22 bp, Homo sapiens
aaatgtctgtctcatgaggaaa

SEQ ID NO: 9000898 - DNA, 22 bp, Homo sapiens
aaatgtctgtatgagaaagaga

SEQ ID NO: 9000899 - DNA, 22 bp, Homo sapiens
aaatgtctttatctcatgtaac

SEQ ID NO: 9000900 - DNA, 22 bp, Homo sapiens
aaatgtctttatctcatgtaac

SEQ ID NO: 9000901 - DNA, 23 bp, Homo sapiens
aaatgtcttctagctcttgagaa

SEQ ID NO: 9000902 - DNA, 22 bp, Homo sapiens
aaacttcagactccccacttct

SEQ ID NO: 9000903 - DNA, 22 bp, Homo sapiens
aaacttcaaggatttgcaaatc

SEQ ID NO: 9000904 - DNA, 22 bp, Homo sapiens
aaacttcaaggatttgcaaatc

SEQ ID NO: 9000905 - DNA, 22 bp, Homo sapiens
aaacttagtagagttcatatta

SEQ ID NO: 9000906 - DNA, 22 bp, Homo sapiens
aaacttagttaagcatattatt

SEQ ID NO: 9000907 - DNA, 22 bp, Homo sapiens
aaacttcaactggaatgggcta

SEQ ID NO: 9000908 - DNA, 22 bp, Homo sapiens
aaacttcaagattcaagcctgg

SEQ ID NO: 9000909 - DNA, 22 bp, Homo sapiens
aaacttcatggataatataaag

SEQ ID NO: 9000910 - DNA, 22 bp, Homo sapiens
aaacttcatggataatataaag

SEQ ID NO: 9000911 - DNA, 22 bp, Homo sapiens
aaacttcagtgaatgacttatg

SEQ ID NO: 9000912 - DNA, 22 bp, Homo sapiens
aaacttcagtgaatgacttatg

SEQ ID NO: 9000913 - DNA, 22 bp, Homo sapiens
aaacttcagggaataaaagagt

SEQ ID NO: 9000914 - DNA, 22 bp, Homo sapiens
aaacttcagtaggagccaacct

SEQ ID NO: 9000915 - DNA, 22 bp, Homo sapiens
aaacttcagtgaatgacttatg

SEQ ID NO: 9000916 - DNA, 22 bp, Homo sapiens
aaaaccacaaaagtggcttggt

SEQ ID NO: 9000917 - DNA, 22 bp, Homo sapiens
aaaaccacaatgacttttgcac

SEQ ID NO: 9000918 - DNA, 22 bp, Homo sapiens
aaaaccacaatgacttttgcag

SEQ ID NO: 9000919 - DNA, 22 bp, Homo sapiens
aaaaccacaatgacttttgcac

SEQ ID NO: 9000920 - DNA, 22 bp, Homo sapiens
aaaaccacaattacttttgcac

SEQ ID NO: 9000921 - DNA, 22 bp, Homo sapiens
aaaaccacaatgacttttgcag

SEQ ID NO: 9000922 - DNA, 22 bp, Homo sapiens
aaaaccagacactgtttctggg

SEQ ID NO: 9000923 - DNA, 22 bp, Homo sapiens
aaaaccacttccttgctattgg

SEQ ID NO: 9000924 - DNA, 22 bp, Homo sapiens
aaaaccacttccttgctattgg

SEQ ID NO: 9000925 - DNA, 22 bp, Homo sapiens
aaaaccacagttacttttgcac

SEQ ID NO: 9000926 - DNA, 22 bp, Homo sapiens
aaaaccacagttacttttgcac

SEQ ID NO: 9000927 - DNA, 22 bp, Homo sapiens
aaaaccacaattatttttgcac

SEQ ID NO: 9000928 - DNA, 22 bp, Homo sapiens
aaaaccacaattacttttgcac

SEQ ID NO: 9000929 - DNA, 22 bp, Homo sapiens
aaaaccaggcgtttcctattat

SEQ ID NO: 9000930 - DNA, 22 bp, Homo sapiens
aaaaccagacactgtttctggg

SEQ ID NO: 9000931 - DNA, 22 bp, Homo sapiens
aaaaccaggcgtttcctattat

SEQ ID NO: 9000932 - DNA, 22 bp, Homo sapiens
aaaagaggttaaccaggtgtgt

SEQ ID NO: 9000933 - DNA, 22 bp, Homo sapiens
aaaagaggttaaccaggtgtgt

SEQ ID NO: 9000934 - DNA, 22 bp, Homo sapiens
aaaagagtgactgataagtata

SEQ ID NO: 9000935 - DNA, 22 bp, Homo sapiens
aaaagagtgactgataagtata

SEQ ID NO: 9000936 - DNA, 22 bp, Homo sapiens
aaaagagtgactgataagtata

SEQ ID NO: 9000937 - DNA, 22 bp, Homo sapiens
aaaagagtgactgataagtata

SEQ ID NO: 9000938 - DNA, 22 bp, Homo sapiens
aaaagagtgactgataagtata

SEQ ID NO: 9000939 - DNA, 22 bp, Homo sapiens
aaaagagtcttaggcagtcata

SEQ ID NO: 9000940 - DNA, 22 bp, Homo sapiens
aaaagagtcttaggcagtcata

SEQ ID NO: 9000941 - DNA, 22 bp, Homo sapiens
aaaagagtcttaggcagtcata

SEQ ID NO: 9000942 - DNA, 22 bp, Homo sapiens
aaaagagtcttaggcagtcata

SEQ ID NO: 9000943 - DNA, 22 bp, Homo sapiens
aaaacattttactgccatctca

SEQ ID NO: 9000944 - DNA, 22 bp, Homo sapiens
aaaacattgaattgcacactat

SEQ ID NO: 9000945 - DNA, 22 bp, Homo sapiens
aaaacattttactgccatctca

SEQ ID NO: 9000946 - DNA, 22 bp, Homo sapiens
aaaaccaagttttccttagtct

SEQ ID NO: 9000947 - DNA, 22 bp, Homo sapiens
aaaaccaagttttccttagtct

SEQ ID NO: 9000948 - DNA, 22 bp, Homo sapiens
aaaacattgaattgcacactat

SEQ ID NO: 9000949 - DNA, 22 bp, Homo sapiens
aaaacattgaattgcacactat

SEQ ID NO: 9000950 - DNA, 22 bp, Homo sapiens
aaaacattctgtgaactctcaa

SEQ ID NO: 9000951 - DNA, 22 bp, Homo sapiens
aaaacattgaattgcacactat

SEQ ID NO: 9000952 - DNA, 22 bp, Homo sapiens
aaaacattgaattgcacactat

SEQ ID NO: 9000953 - DNA, 22 bp, Homo sapiens
aaaacattgaattgcacactat

SEQ ID NO: 9000954 - DNA, 22 bp, Homo sapiens
aaaacatgtccatacagaaact

SEQ ID NO: 9000955 - DNA, 22 bp, Homo sapiens
aaaacatgtccatacagaaact

SEQ ID NO: 9000956 - DNA, 22 bp, Homo sapiens
aaaacatgtccatacagaaact

SEQ ID NO: 9000957 - DNA, 22 bp, Homo sapiens
aaaacatgtccatacagaaact

SEQ ID NO: 9000958 - DNA, 22 bp, Homo sapiens
aaaacatgtccatacagaaact

SEQ ID NO: 9000959 - DNA, 22 bp, Homo sapiens
aaaacatgtccatacagaaact

SEQ ID NO: 9000960 - DNA, 22 bp, Homo sapiens
aaaacatgtccatacagaaact

SEQ ID NO: 9000961 - DNA, 22 bp, Homo sapiens
aaaacattctgtgaactctcaa

SEQ ID NO: 9000962 - DNA, 22 bp, Homo sapiens
aaaacattctgtgaactctcaa

SEQ ID NO: 9000963 - DNA, 22 bp, Homo sapiens
aaaaatctatgactgcttctcc

SEQ ID NO: 9000964 - DNA, 22 bp, Homo sapiens
aaaaatctatgactgcttctcc

SEQ ID NO: 9000965 - DNA, 22 bp, Homo sapiens
aaaaatgaaacggctggttggc

SEQ ID NO: 9000966 - DNA, 22 bp, Homo sapiens
aaaaatgaaacggctggttggc

SEQ ID NO: 9000967 - DNA, 22 bp, Homo sapiens
aaaaatgaaacggctggttggc

SEQ ID NO: 9000968 - DNA, 22 bp, Homo sapiens
aaaaatgtgaccacagggtgtt

SEQ ID NO: 9000969 - DNA, 22 bp, Homo sapiens
aaaaatgtgaccacagggtgtt

SEQ ID NO: 9000970 - DNA, 22 bp, Homo sapiens
aaaaatgttatctactgtccga

SEQ ID NO: 9000971 - DNA, 22 bp, Homo sapiens
aaaaatgttatctactgtccga

SEQ ID NO: 9000972 - DNA, 22 bp, Homo sapiens
aaaaatgttatctactgtccga

SEQ ID NO: 9000973 - DNA, 22 bp, Homo sapiens
aaaaatgttatctactgtccga

SEQ ID NO: 9000974 - DNA, 22 bp, Homo sapiens
aaaaatgttatctactgtccga

SEQ ID NO: 9000975 - DNA, 22 bp, Homo sapiens
aaaaatgttatctactgtccga

SEQ ID NO: 9000976 - DNA, 22 bp, Homo sapiens
aaaaattgctgagaacggaatt

SEQ ID NO: 9000977 - DNA, 22 bp, Homo sapiens
aaaaattgctgagaacggaatt

SEQ ID NO: 9000978 - DNA, 20 bp, Homo sapiens
aaaaattgatatcgcttcct

SEQ ID NO: 9000979 - DNA, 22 bp, Homo sapiens
aaaaatttatggttcttctctg

SEQ ID NO: 9000980 - DNA, 22 bp, Homo sapiens
aaaaatttatggttcttctctg

SEQ ID NO: 9000981 - DNA, 22 bp, Homo sapiens
aaaacacaagaagcagggtaca

SEQ ID NO: 9000982 - DNA, 22 bp, Homo sapiens
aaaaatttatggttcttctctg

SEQ ID NO: 9000983 - DNA, 22 bp, Homo sapiens
aaaacacaagaagcagggtaca

SEQ ID NO: 9000984 - DNA, 22 bp, Homo sapiens
aaaaatttatggttcttctctg

SEQ ID NO: 9000985 - DNA, 22 bp, Homo sapiens
aaaagcaaggcagtctgtctga

SEQ ID NO: 9000986 - DNA, 22 bp, Homo sapiens
aaaagcaaggcagtctgtctga

SEQ ID NO: 9000987 - DNA, 22 bp, Homo sapiens
aaaagcaagaggctggattaaa

SEQ ID NO: 9000988 - DNA, 22 bp, Homo sapiens
aaaagcaagaggctggattaaa

SEQ ID NO: 9000989 - DNA, 22 bp, Homo sapiens
aaaagcaaggcagtctgtctga

SEQ ID NO: 9000990 - DNA, 22 bp, Homo sapiens
aaaagcaaggcagtctgtctga

SEQ ID NO: 9000991 - DNA, 22 bp, Homo sapiens
aaaagcaaggcagtctgtctga

SEQ ID NO: 9000992 - DNA, 22 bp, Homo sapiens
aaaagcaaggcagtctgtctga

SEQ ID NO: 9000993 - DNA, 22 bp, Homo sapiens
aaaagcaaggcagtctgtctga

SEQ ID NO: 9000994 - DNA, 22 bp, Homo sapiens
aaaagcaagttgcctaggttga

SEQ ID NO: 9000995 - DNA, 22 bp, Homo sapiens
aaaagcaagttgcctaggttga

SEQ ID NO: 9000996 - DNA, 22 bp, Homo sapiens
aaaagcaagttgcctaggttga

SEQ ID NO: 9000997 - DNA, 22 bp, Homo sapiens
aaaagagtgtttcaactttggc

SEQ ID NO: 9000998 - DNA, 22 bp, Homo sapiens
aaaagagtgtttcaactttggc

SEQ ID NO: 9000999 - DNA, 22 bp, Homo sapiens
aaaagatgaaatggtgtcttgg

SEQ ID NO: 9001000 - DNA, 22 bp, Homo sapiens
aaaagatgaaatggtgtcttgg

SEQ ID NO: 9001001 - DNA, 20 bp, Homo sapiens
aaaagagtgcttcaactgct

SEQ ID NO: 9001002 - DNA, 20 bp, Homo sapiens
aaaagagtgcttcaactgct

SEQ ID NO: 9001003 - DNA, 22 bp, Homo sapiens
aaaagcaagaggctggattaaa

SEQ ID NO: 9001004 - DNA, 22 bp, Homo sapiens
aaaagcaagaggctggattaaa

SEQ ID NO: 9001005 - DNA, 22 bp, Homo sapiens
aaaagcaagaggctggattaaa

SEQ ID NO: 9001006 - DNA, 22 bp, Homo sapiens
aaaagcaagaggctggattaaa

SEQ ID NO: 9001007 - DNA, 22 bp, Homo sapiens
aaaagattgttagggagaatgt

SEQ ID NO: 9001008 - DNA, 22 bp, Homo sapiens
aaaagattgttagggagaatgt

SEQ ID NO: 9001009 - DNA, 22 bp, Homo sapiens
aaaagattgttagggagaatgt

SEQ ID NO: 9001010 - DNA, 22 bp, Homo sapiens
aaaagagtgtttcaactttggc

SEQ ID NO: 9001011 - DNA, 22 bp, Homo sapiens
aaaagcaagttgcctaggttga

SEQ ID NO: 9001012 - DNA, 22 bp, Homo sapiens
aaaagagccacttatgacctca

SEQ ID NO: 9001013 - DNA, 22 bp, Homo sapiens
aaaagagccacttatgacctca

SEQ ID NO: 9001014 - DNA, 22 bp, Homo sapiens
aaaagaggaactcttatatact

SEQ ID NO: 9001015 - DNA, 22 bp, Homo sapiens
aaaagaggaactcttatatact

SEQ ID NO: 9001016 - DNA, 22 bp, Homo sapiens
aaaacagtttttgctaactgct

SEQ ID NO: 9001017 - DNA, 22 bp, Homo sapiens
aaaacagtttttgctaactgct

SEQ ID NO: 9001018 - DNA, 22 bp, Homo sapiens
aaaagagccacttatgacctca

SEQ ID NO: 9001019 - DNA, 22 bp, Homo sapiens
aaaagagcttggttgattttgc

SEQ ID NO: 9001020 - DNA, 22 bp, Homo sapiens
aaaagagcttggttgattttgc

SEQ ID NO: 9001021 - DNA, 22 bp, Homo sapiens
aaaacagtttttgctaactgct

SEQ ID NO: 9001022 - DNA, 22 bp, Homo sapiens
aaaacagtttaggcatcacagt

SEQ ID NO: 9001023 - DNA, 22 bp, Homo sapiens
aaaacagtttaggcatcacagt

SEQ ID NO: 9001024 - DNA, 22 bp, Homo sapiens
aaaacagtttaggcatcacagt

SEQ ID NO: 9001025 - DNA, 22 bp, Homo sapiens
aaaacagtttaggcatcacagt

SEQ ID NO: 9001026 - DNA, 22 bp, Homo sapiens
aaaacagtttaggcatcacagt

SEQ ID NO: 9001027 - DNA, 22 bp, Homo sapiens
aaaacaggagttttggtaggct

SEQ ID NO: 9001028 - DNA, 22 bp, Homo sapiens
aaaacaggagttttggtaggct

SEQ ID NO: 9001029 - DNA, 22 bp, Homo sapiens
aaaacaggtgtcagcaaactat

SEQ ID NO: 9001030 - DNA, 22 bp, Homo sapiens
aaaacagttataaacagagtca

SEQ ID NO: 9001031 - DNA, 22 bp, Homo sapiens
aaaacagttataaacagagtca

SEQ ID NO: 9001032 - DNA, 22 bp, Homo sapiens
aaaacagtttaggcatcacagt

SEQ ID NO: 9001033 - DNA, 22 bp, Homo sapiens
aaaacagttataaacagagtca

SEQ ID NO: 9001034 - DNA, 22 bp, Homo sapiens
aaaacagttataaacagagtca

SEQ ID NO: 9001035 - DNA, 22 bp, Homo sapiens
aaaacagttataaacagagtca

SEQ ID NO: 9001036 - DNA, 22 bp, Homo sapiens
aaaacactgcctgcttgactga

SEQ ID NO: 9001037 - DNA, 22 bp, Homo sapiens
aaaacactgcctgcttgactga

SEQ ID NO: 9001038 - DNA, 22 bp, Homo sapiens
aaaacacaagaagcagggtaca

SEQ ID NO: 9001039 - DNA, 22 bp, Homo sapiens
aaaacactgcctgcttgactga

SEQ ID NO: 9001040 - DNA, 22 bp, Homo sapiens
aaaacagacagccagtgtagag

SEQ ID NO: 9001041 - DNA, 22 bp, Homo sapiens
aaaacagacagccagtgtagag

SEQ ID NO: 9001042 - DNA, 22 bp, Homo sapiens
aaaacagacagccagtgtagag

SEQ ID NO: 9001043 - DNA, 22 bp, Homo sapiens
aaaacagacagccagtgtagag

SEQ ID NO: 9001044 - DNA, 22 bp, Homo sapiens
aaaacagacagccagtgtagag

SEQ ID NO: 9001045 - DNA, 22 bp, Homo sapiens
aaaacagacagccagtgtagag

SEQ ID NO: 9001046 - DNA, 23 bp, Homo sapiens
aaaacagcttcctccagtggctc

SEQ ID NO: 9001047 - DNA, 23 bp, Homo sapiens
aaaacagcttcctccagtggctc

SEQ ID NO: 9001048 - DNA, 23 bp, Homo sapiens
aaaacagcttcctccagtggctc

SEQ ID NO: 9001049 - DNA, 23 bp, Homo sapiens
aaaacagcttcctccagtggctc

SEQ ID NO: 9001050 - DNA, 22 bp, Homo sapiens
aaaacactgcaaagctgattgg

SEQ ID NO: 9001051 - DNA, 22 bp, Homo sapiens
aaaacactgcaaagctgattgg

SEQ ID NO: 9001052 - DNA, 22 bp, Homo sapiens
aaaacacactggaccaatttaa

SEQ ID NO: 9001053 - DNA, 22 bp, Homo sapiens
aaaacacactggaccaatttaa

SEQ ID NO: 9001054 - DNA, 22 bp, Homo sapiens
aaaacacactggaccaatttaa

SEQ ID NO: 9001055 - DNA, 22 bp, Homo sapiens
aaaacacactggaccaatttaa

SEQ ID NO: 9001056 - DNA, 22 bp, Homo sapiens
aaaacacactggaccaatttaa

SEQ ID NO: 9001057 - DNA, 22 bp, Homo sapiens
aaaacacactggaccaatttaa

SEQ ID NO: 9001058 - DNA, 22 bp, Homo sapiens
aaaacacaagaagcagggtaca

SEQ ID NO: 9001059 - DNA, 22 bp, Homo sapiens
aaaacacaagaagcagggtaca

SEQ ID NO: 9001060 - DNA, 22 bp, Homo sapiens
aaaacacaagaagcagggtaca

SEQ ID NO: 9001061 - DNA, 22 bp, Homo sapiens
aaaacacaagaagcagggtaca

SEQ ID NO: 9001062 - DNA, 22 bp, Homo sapiens
aaaagcaagttgcctaggttga

SEQ ID NO: 9001063 - DNA, 22 bp, Homo sapiens
aaaagcaagttgcctaggttga

SEQ ID NO: 9001064 - DNA, 22 bp, Homo sapiens
aaaagcaagttgcctaggttga

SEQ ID NO: 9001065 - DNA, 22 bp, Homo sapiens
aaaagcaagttgcctaggttga

SEQ ID NO: 9001066 - DNA, 22 bp, Homo sapiens
aaaagcaagttgcctaggttga

SEQ ID NO: 9001067 - DNA, 22 bp, Homo sapiens
aaaagcaattgcagttcttgcc

SEQ ID NO: 9001068 - DNA, 22 bp, Homo sapiens
aaaagcaattgcagttcttgcc

SEQ ID NO: 9001069 - DNA, 22 bp, Homo sapiens
aaaagcaattgcagttcttgcc

SEQ ID NO: 9001070 - DNA, 22 bp, Homo sapiens
aaaagcaattgcagttcttgcc

SEQ ID NO: 9001071 - DNA, 22 bp, Homo sapiens
aaaagcaattgcagttcttgcc

SEQ ID NO: 9001072 - DNA, 22 bp, Homo sapiens
aaaagcaattgcgggttttgcc

SEQ ID NO: 9001073 - DNA, 22 bp, Homo sapiens
aaaagcaattgcgggttttgcc

SEQ ID NO: 9001074 - DNA, 22 bp, Homo sapiens
aaaagcaattgcgggttttgcc

SEQ ID NO: 9001075 - DNA, 22 bp, Homo sapiens
aaaagcaattgcgggttttgcc

SEQ ID NO: 9001076 - DNA, 22 bp, Homo sapiens
aaaagcaattgcgggttttgcc

SEQ ID NO: 9001077 - DNA, 22 bp, Homo sapiens
aaaagcagatctccaaagtcta

SEQ ID NO: 9001078 - DNA, 22 bp, Homo sapiens
aaaagcagatctccaaagtcta

SEQ ID NO: 9001079 - DNA, 22 bp, Homo sapiens
aaaagcagatctccaaagtcta

SEQ ID NO: 9001080 - DNA, 20 bp, Homo sapiens
aaaagcagccagagatggta

SEQ ID NO: 9001081 - DNA, 22 bp, Homo sapiens
aaaagcagagactctggagcta

SEQ ID NO: 9001082 - DNA, 22 bp, Homo sapiens
aaaagcagagactctggagcta

SEQ ID NO: 9001083 - DNA, 22 bp, Homo sapiens
aaaagcagaccacgctttgtgg

SEQ ID NO: 9001084 - DNA, 22 bp, Homo sapiens
aaaagcagagactctggagcta

SEQ ID NO: 9001085 - DNA, 22 bp, Homo sapiens
aaaagcagaccacgctttgtgg

SEQ ID NO: 9001086 - DNA, 22 bp, Homo sapiens
aaaagcactacaatttcgcttc

SEQ ID NO: 9001087 - DNA, 22 bp, Homo sapiens
aaaagcattacatggtacgtat

SEQ ID NO: 9001088 - DNA, 22 bp, Homo sapiens
aaaagcatctcaaaggagcttc

SEQ ID NO: 9001089 - DNA, 22 bp, Homo sapiens
aaaagcattacatggtacgtat

SEQ ID NO: 9001090 - DNA, 22 bp, Homo sapiens
aaaagcatctcaaaggagcttc

SEQ ID NO: 9001091 - DNA, 22 bp, Homo sapiens
aaaagcagtttatagtcagttg

SEQ ID NO: 9001092 - DNA, 22 bp, Homo sapiens
aaaagccaaggtcctcttcaga

SEQ ID NO: 9001093 - DNA, 22 bp, Homo sapiens
aaaagccaaggtcctcttcaga

SEQ ID NO: 9001094 - DNA, 22 bp, Homo sapiens
aaaagccatgcatacctaagag

SEQ ID NO: 9001095 - DNA, 22 bp, Homo sapiens
aaaagccatgcatacctaagag

SEQ ID NO: 9001096 - DNA, 22 bp, Homo sapiens
aaaagcagttatctgggaggaa

SEQ ID NO: 9001097 - DNA, 22 bp, Homo sapiens
aaaagcagtaaatgtatgacct

SEQ ID NO: 9001098 - DNA, 22 bp, Homo sapiens
aaaagcagtttatagtcagttg

SEQ ID NO: 9001099 - DNA, 22 bp, Homo sapiens
aaaagcagttatctgggaggaa

SEQ ID NO: 9001100 - DNA, 22 bp, Homo sapiens
aaaagcagtaaatgtatgacct

SEQ ID NO: 9001101 - DNA, 20 bp, Homo sapiens
aaaagcagccagagatggta

SEQ ID NO: 9001102 - DNA, 20 bp, Homo sapiens
aaaagcagccagagatggta

SEQ ID NO: 9001103 - DNA, 22 bp, Homo sapiens
aaaagcaggtactcagcttggg

SEQ ID NO: 9001104 - DNA, 22 bp, Homo sapiens
aaaagcaggtactcagcttggg

SEQ ID NO: 9001105 - DNA, 22 bp, Homo sapiens
aaaagtgttcaggaagaataat

SEQ ID NO: 9001106 - DNA, 22 bp, Homo sapiens
aaaagtgttcaggaagaataat

SEQ ID NO: 9001107 - DNA, 22 bp, Homo sapiens
aaaagtgttcaggaagaataat

SEQ ID NO: 9001108 - DNA, 22 bp, Homo sapiens
aaaagtgtccagattatgaaga

SEQ ID NO: 9001109 - DNA, 22 bp, Homo sapiens
aaaagtattttgagcactttat

SEQ ID NO: 9001110 - DNA, 22 bp, Homo sapiens
aaaagtattttgagcactttat

SEQ ID NO: 9001111 - DNA, 22 bp, Homo sapiens
aaaagtatttatggctatgtaa

SEQ ID NO: 9001112 - DNA, 22 bp, Homo sapiens
aaaagtatttatggctatgtaa

SEQ ID NO: 9001113 - DNA, 22 bp, Homo sapiens
aaaagtatttatggctatgtaa

SEQ ID NO: 9001114 - DNA, 22 bp, Homo sapiens
aaaagtattttgagcactttat

SEQ ID NO: 9001115 - DNA, 19 bp, Homo sapiens
aaaaggaatattctttggg

SEQ ID NO: 9001116 - DNA, 22 bp, Homo sapiens
aaaagctagtcaatgatgtatt

SEQ ID NO: 9001117 - DNA, 22 bp, Homo sapiens
aaaagctagtcaatgatgtatt

SEQ ID NO: 9001118 - DNA, 22 bp, Homo sapiens
aaaagctagtcaatgatgtatt

SEQ ID NO: 9001119 - DNA, 22 bp, Homo sapiens
aaaagctttgttaataggtttg

SEQ ID NO: 9001120 - DNA, 21 bp, Homo sapiens
aaaaggaaggtctgtttgggg

SEQ ID NO: 9001121 - DNA, 19 bp, Homo sapiens
aaaaggaatattctttggg

SEQ ID NO: 9001122 - DNA, 21 bp, Homo sapiens
aaaaggaaggtctgtttgggg

SEQ ID NO: 9001123 - DNA, 21 bp, Homo sapiens
aaaaggaaggtctgtttgggg

SEQ ID NO: 9001124 - DNA, 22 bp, Homo sapiens
aaaagctttgttaataggtttg

SEQ ID NO: 9001125 - DNA, 22 bp, Homo sapiens
aaaagttacctctgtaatataa

SEQ ID NO: 9001126 - DNA, 22 bp, Homo sapiens
aaaagttacctctgtaatataa

SEQ ID NO: 9001127 - DNA, 22 bp, Homo sapiens
aaaagttaactgtgttcatgca

SEQ ID NO: 9001128 - DNA, 22 bp, Homo sapiens
aaaagttacctctgtaatataa

SEQ ID NO: 9001129 - DNA, 22 bp, Homo sapiens
aaaagttagctattagtaggtg

SEQ ID NO: 9001130 - DNA, 22 bp, Homo sapiens
aaaagttacctctgtaatataa

SEQ ID NO: 9001131 - DNA, 22 bp, Homo sapiens
aaaagttattgatgcaggacaa

SEQ ID NO: 9001132 - DNA, 22 bp, Homo sapiens
aaaagttagctattagtaggtg

SEQ ID NO: 9001133 - DNA, 22 bp, Homo sapiens
aaaagttcattagtgagcttct

SEQ ID NO: 9001134 - DNA, 22 bp, Homo sapiens
aaaagttcattagtgagcttct

SEQ ID NO: 9001135 - DNA, 22 bp, Homo sapiens
aaaagttccctggttagaaaag

SEQ ID NO: 9001136 - DNA, 22 bp, Homo sapiens
aaaagttccctggttagaaaag

SEQ ID NO: 9001137 - DNA, 22 bp, Homo sapiens
aaaagtttaagactcattctag

SEQ ID NO: 9001138 - DNA, 22 bp, Homo sapiens
aaaagtttaagactcattctag

SEQ ID NO: 9001139 - DNA, 22 bp, Homo sapiens
aaaagtttaagactcattctag

SEQ ID NO: 9001140 - DNA, 22 bp, Homo sapiens
aaaagtttaagactcattctag

SEQ ID NO: 9001141 - DNA, 22 bp, Homo sapiens
aaaagtttaagactcattctag

SEQ ID NO: 9001142 - DNA, 22 bp, Homo sapiens
aaaagtttaagactcattctag

SEQ ID NO: 9001143 - DNA, 21 bp, Homo sapiens
aaaagtttgacaggaaaggga

SEQ ID NO: 9001144 - DNA, 22 bp, Homo sapiens
aaaagtttaagactcattctag

SEQ ID NO: 9001145 - DNA, 22 bp, Homo sapiens
aaaagtttaagactcattctag

SEQ ID NO: 9001146 - DNA, 22 bp, Homo sapiens
aaaagtttgtgcaaacactcag

SEQ ID NO: 9001147 - DNA, 22 bp, Homo sapiens
aaaagtttgtgcaaacactcag

SEQ ID NO: 9001148 - DNA, 18 bp, Homo sapiens
aaaataacaaagttggct

SEQ ID NO: 9001149 - DNA, 21 bp, Homo sapiens
aaaagtttgacaggaaaggga

SEQ ID NO: 9001150 - DNA, 22 bp, Homo sapiens
aaaagtttgtgcaaacactcag

SEQ ID NO: 9001151 - DNA, 18 bp, Homo sapiens
aaaataacaaagttggct

SEQ ID NO: 9001152 - DNA, 18 bp, Homo sapiens
aaaataacaaagttggct

SEQ ID NO: 9001153 - DNA, 18 bp, Homo sapiens
aaaataacaaagttggct

SEQ ID NO: 9001154 - DNA, 22 bp, Homo sapiens
aaaataacttctactatttgca

SEQ ID NO: 9001155 - DNA, 22 bp, Homo sapiens
aaaataacttctactatttgca

SEQ ID NO: 9001156 - DNA, 22 bp, Homo sapiens
aaaataacttctactatttgca

SEQ ID NO: 9001157 - DNA, 22 bp, Homo sapiens
aaaataacttctactatttgca

SEQ ID NO: 9001158 - DNA, 22 bp, Homo sapiens
aaaataacttctactatttgca

SEQ ID NO: 9001159 - DNA, 22 bp, Homo sapiens
aaaataacttctactatttgca

SEQ ID NO: 9001160 - DNA, 22 bp, Homo sapiens
aaaataacttctactatttgca

SEQ ID NO: 9001161 - DNA, 22 bp, Homo sapiens
aaaataacttctactatttgca

SEQ ID NO: 9001162 - DNA, 22 bp, Homo sapiens
aaaataacttctactatttgca

SEQ ID NO: 9001163 - DNA, 22 bp, Homo sapiens
aaaatacacatactaggggaaa

SEQ ID NO: 9001164 - DNA, 22 bp, Homo sapiens
aaaatacacatactaggggaaa

SEQ ID NO: 9001165 - DNA, 22 bp, Homo sapiens
aaaatacacatactaggggaaa

SEQ ID NO: 9001166 - DNA, 22 bp, Homo sapiens
aaaatacacatactaggggaaa

SEQ ID NO: 9001167 - DNA, 22 bp, Homo sapiens
aaaataagttggtcctgtcctt

SEQ ID NO: 9001168 - DNA, 22 bp, Homo sapiens
aaaatactgtggagtgttgaaa

SEQ ID NO: 9001169 - DNA, 22 bp, Homo sapiens
aaaatactgtggagtgttgaaa

SEQ ID NO: 9001170 - DNA, 22 bp, Homo sapiens
aaaatactactgtcttcttccc

SEQ ID NO: 9001171 - DNA, 22 bp, Homo sapiens
aaaatactactgtcttcttccc

SEQ ID NO: 9001172 - DNA, 22 bp, Homo sapiens
aaaatacacatactaggggaaa

SEQ ID NO: 9001173 - DNA, 22 bp, Homo sapiens
aaaatactactgtcttcttccc

SEQ ID NO: 9001174 - DNA, 22 bp, Homo sapiens
aaaatactactgtcttcttccc

SEQ ID NO: 9001175 - DNA, 22 bp, Homo sapiens
aaaatctgcttccttttacaga

SEQ ID NO: 9001176 - DNA, 22 bp, Homo sapiens
aaaatctgcttccttttacaga

SEQ ID NO: 9001177 - DNA, 22 bp, Homo sapiens
aaaatctgcttccttttacaga

SEQ ID NO: 9001178 - DNA, 22 bp, Homo sapiens
aaaatctggcaacactaagttt

SEQ ID NO: 9001179 - DNA, 22 bp, Homo sapiens
aaaatgacattccagtgatatt

SEQ ID NO: 9001180 - DNA, 22 bp, Homo sapiens
aaaatctggcaacactaagttt

SEQ ID NO: 9001181 - DNA, 22 bp, Homo sapiens
aaaatgagacacatgtgactcc

SEQ ID NO: 9001182 - DNA, 22 bp, Homo sapiens
aaaatgagacacatgtgactcc

SEQ ID NO: 9001183 - DNA, 22 bp, Homo sapiens
aaaatgagatacagtttgaaag

SEQ ID NO: 9001184 - DNA, 22 bp, Homo sapiens
aaaatgagacacatgtgactcc

SEQ ID NO: 9001185 - DNA, 22 bp, Homo sapiens
aaaatgagatacagtttgaaag

SEQ ID NO: 9001186 - DNA, 22 bp, Homo sapiens
aaaatgagcatattgatccttt

SEQ ID NO: 9001187 - DNA, 22 bp, Homo sapiens
aaaatgagcatattgatccttt

SEQ ID NO: 9001188 - DNA, 22 bp, Homo sapiens
aaagcagcctgctcatcctgga

SEQ ID NO: 9001189 - DNA, 22 bp, Homo sapiens
aaagcagccacagagagagcgt

SEQ ID NO: 9001190 - DNA, 22 bp, Homo sapiens
aaagcagccacagagagagcgt

SEQ ID NO: 9001191 - DNA, 22 bp, Homo sapiens
aaagcagccactctctctgcct

SEQ ID NO: 9001192 - DNA, 22 bp, Homo sapiens
aaagcagccacagagagagcgt

SEQ ID NO: 9001193 - DNA, 22 bp, Homo sapiens
aaagcagcagcacctgcatttc

SEQ ID NO: 9001194 - DNA, 22 bp, Homo sapiens
aaagcagcagcacgtggaagag

SEQ ID NO: 9001195 - DNA, 22 bp, Homo sapiens
aaagcagcagcacgtggaagag

SEQ ID NO: 9001196 - DNA, 22 bp, Homo sapiens
aaagcagcagaatctctcaggg

SEQ ID NO: 9001197 - DNA, 22 bp, Homo sapiens
aaagcagcagcacctgcatttc

SEQ ID NO: 9001198 - DNA, 22 bp, Homo sapiens
aaagcagcagcacgtggaagag

SEQ ID NO: 9001199 - DNA, 22 bp, Homo sapiens
aaagcagcagcacctgcatttc

SEQ ID NO: 9001200 - DNA, 22 bp, Homo sapiens
aaagcagcagaatctctcaggg

SEQ ID NO: 9001201 - DNA, 22 bp, Homo sapiens
aaagcagcagaatctctcaggg

SEQ ID NO: 9001202 - DNA, 22 bp, Homo sapiens
aaagcaatggatgagaatctgt

SEQ ID NO: 9001203 - DNA, 22 bp, Homo sapiens
aaagcaatggatgagaatctgt

SEQ ID NO: 9001204 - DNA, 22 bp, Homo sapiens
aaagcaatggatgagaatctgt

SEQ ID NO: 9001205 - DNA, 22 bp, Homo sapiens
aaagcaatggcacatgatggta

SEQ ID NO: 9001206 - DNA, 22 bp, Homo sapiens
aaagcagcagaaagctggcccc

SEQ ID NO: 9001207 - DNA, 22 bp, Homo sapiens
aaagcaatggatgagaatctgt

SEQ ID NO: 9001208 - DNA, 22 bp, Homo sapiens
aaaatgtatgatggaggtgcta

SEQ ID NO: 9001209 - DNA, 22 bp, Homo sapiens
aaaatgtatgatggaggtgcta

SEQ ID NO: 9001210 - DNA, 22 bp, Homo sapiens
aaaatgtctgctgttggtttat

SEQ ID NO: 9001211 - DNA, 21 bp, Homo sapiens
aaaatgtagacttttccctga

SEQ ID NO: 9001212 - DNA, 22 bp, Homo sapiens
aaagcagcggtgtctttactgc

SEQ ID NO: 9001213 - DNA, 22 bp, Homo sapiens
aaagcagcggtgtctttactgc

SEQ ID NO: 9001214 - DNA, 22 bp, Homo sapiens
aaagcagcctgctcatcctgga

SEQ ID NO: 9001215 - DNA, 22 bp, Homo sapiens
aaagcagcctgctcatcctgga

SEQ ID NO: 9001216 - DNA, 22 bp, Homo sapiens
aaagcagctgatctcagagcct

SEQ ID NO: 9001217 - DNA, 22 bp, Homo sapiens
aaagcagctgatctcagagcct

SEQ ID NO: 9001218 - DNA, 22 bp, Homo sapiens
aaagcagctgatagtctcatct

SEQ ID NO: 9001219 - DNA, 22 bp, Homo sapiens
aaagcagctgatagtctcatct

SEQ ID NO: 9001220 - DNA, 22 bp, Homo sapiens
aaagcagcggtgtctttactgc

SEQ ID NO: 9001221 - DNA, 22 bp, Homo sapiens
aaagcagctgatagtctcatct

SEQ ID NO: 9001222 - DNA, 22 bp, Homo sapiens
aaagcagctttcggccctcggg

SEQ ID NO: 9001223 - DNA, 22 bp, Homo sapiens
aaagcagctgtttgactttcca

SEQ ID NO: 9001224 - DNA, 22 bp, Homo sapiens
aaagcaggcagcaggctggatt

SEQ ID NO: 9001225 - DNA, 22 bp, Homo sapiens
aaagcagctgtttgactttcca

SEQ ID NO: 9001226 - DNA, 22 bp, Homo sapiens
aaagcagctgctctggccttga

SEQ ID NO: 9001227 - DNA, 22 bp, Homo sapiens
aaagcagctgctctggccttga

SEQ ID NO: 9001228 - DNA, 22 bp, Homo sapiens
aaagcagggtccaaggagatgt

SEQ ID NO: 9001229 - DNA, 22 bp, Homo sapiens
aaagcagggtccaaggagatgt

SEQ ID NO: 9001230 - DNA, 22 bp, Homo sapiens
aaagcagggtccaaggagatgt

SEQ ID NO: 9001231 - DNA, 22 bp, Homo sapiens
aaagcaggcagcaggctggatt

SEQ ID NO: 9001232 - DNA, 22 bp, Homo sapiens
aaagcagggatgaggctagagg

SEQ ID NO: 9001233 - DNA, 22 bp, Homo sapiens
aaaatgcaaacctacctacata

SEQ ID NO: 9001234 - DNA, 20 bp, Homo sapiens
aaaatgatgggcagggcagg

SEQ ID NO: 9001235 - DNA, 20 bp, Homo sapiens
aaaatgatgggcagggcagg

SEQ ID NO: 9001236 - DNA, 20 bp, Homo sapiens
aaaatgatgggcagggcagg

SEQ ID NO: 9001237 - DNA, 22 bp, Homo sapiens
aaaatgatgctgtaatttggca

SEQ ID NO: 9001238 - DNA, 22 bp, Homo sapiens
aaaatgatgctgtaatttggca

SEQ ID NO: 9001239 - DNA, 22 bp, Homo sapiens
aaaatgatatcctgacttttat

SEQ ID NO: 9001240 - DNA, 22 bp, Homo sapiens
aaaatgatatcctgacttttat

SEQ ID NO: 9001241 - DNA, 22 bp, Homo sapiens
aaaatgatatcctgacttttat

SEQ ID NO: 9001242 - DNA, 22 bp, Homo sapiens
aaaatgatatcctgacttttat

SEQ ID NO: 9001243 - DNA, 22 bp, Homo sapiens
aaaatgaggtcaatatcctttt

SEQ ID NO: 9001244 - DNA, 22 bp, Homo sapiens
aaaatgatatcctgacttttat

SEQ ID NO: 9001245 - DNA, 22 bp, Homo sapiens
aaaatgatatcctgacttttat

SEQ ID NO: 9001246 - DNA, 22 bp, Homo sapiens
aaaatgagccatgaaccaacca

SEQ ID NO: 9001247 - DNA, 22 bp, Homo sapiens
aaaatgagccatgaaccaacca

SEQ ID NO: 9001248 - DNA, 22 bp, Homo sapiens
aaaatgagccatgaaccaacca

SEQ ID NO: 9001249 - DNA, 22 bp, Homo sapiens
aaaatgaggaacggatcatggc

SEQ ID NO: 9001250 - DNA, 22 bp, Homo sapiens
aaaatggtctcagctggcacca

SEQ ID NO: 9001251 - DNA, 22 bp, Homo sapiens
aaaatgtaaagcttgagtgtag

SEQ ID NO: 9001252 - DNA, 22 bp, Homo sapiens
aaaatgtaaagcttgagtgtag

SEQ ID NO: 9001253 - DNA, 22 bp, Homo sapiens
aaaatgctgggaaagttggaat

SEQ ID NO: 9001254 - DNA, 22 bp, Homo sapiens
aaaatggcttaataggcaataa

SEQ ID NO: 9001255 - DNA, 22 bp, Homo sapiens
aaaatggatagtgcgtcttctc

SEQ ID NO: 9001256 - DNA, 20 bp, Homo sapiens
aaaatggccttgtattaaaa

SEQ ID NO: 9001257 - DNA, 22 bp, Homo sapiens
aaaatggctgtggtctggcaag

SEQ ID NO: 9001258 - DNA, 22 bp, Homo sapiens
aaaatgcatgagaatgtgctcg

SEQ ID NO: 9001259 - DNA, 22 bp, Homo sapiens
aaaatgcatgagaatgtgctcg

SEQ ID NO: 9001260 - DNA, 22 bp, Homo sapiens
aaaatgcatgagaatgtgctcg

SEQ ID NO: 9001261 - DNA, 22 bp, Homo sapiens
aaaatgctatttcatggaggag

SEQ ID NO: 9001262 - DNA, 18 bp, Homo sapiens
aaaatgcaggcgacatgg

SEQ ID NO: 9001263 - DNA, 18 bp, Homo sapiens
aaaatgcaggcgacatgg

SEQ ID NO: 9001264 - DNA, 22 bp, Homo sapiens
aaaatgcaaacctacctacata

SEQ ID NO: 9001265 - DNA, 18 bp, Homo sapiens
aaaatgcaggcgacatgg

SEQ ID NO: 9001266 - DNA, 18 bp, Homo sapiens
aaaatgcaggcgacatgg

SEQ ID NO: 9001267 - DNA, 18 bp, Homo sapiens
aaaatgcaggcgacatgg

SEQ ID NO: 9001268 - DNA, 22 bp, Homo sapiens
aaattccagaaactcagtatat

SEQ ID NO: 9001269 - DNA, 22 bp, Homo sapiens
aaattccagaaactcagtatat

SEQ ID NO: 9001270 - DNA, 22 bp, Homo sapiens
aaattccagaaactcagtatat

SEQ ID NO: 9001271 - DNA, 22 bp, Homo sapiens
aaattccagttcttttacctgc

SEQ ID NO: 9001272 - DNA, 22 bp, Homo sapiens
aaattccagttcttttacctgc

SEQ ID NO: 9001273 - DNA, 22 bp, Homo sapiens
aaattccagcaacaccttttta

SEQ ID NO: 9001274 - DNA, 22 bp, Homo sapiens
aaattccattaggaaacttcca

SEQ ID NO: 9001275 - DNA, 22 bp, Homo sapiens
aaattccattaggaaacttcca

SEQ ID NO: 9001276 - DNA, 22 bp, Homo sapiens
aaattccattatgataatttcg

SEQ ID NO: 9001277 - DNA, 22 bp, Homo sapiens
aaattccattatgataatttcg

SEQ ID NO: 9001278 - DNA, 22 bp, Homo sapiens
aaattccattatgataatttcg

SEQ ID NO: 9001279 - DNA, 22 bp, Homo sapiens
aaattccattatgataatttcg

SEQ ID NO: 9001280 - DNA, 22 bp, Homo sapiens
aaattgcttataaagatgaatg

SEQ ID NO: 9001281 - DNA, 22 bp, Homo sapiens
aaattgctgaccaagtatattc

SEQ ID NO: 9001282 - DNA, 22 bp, Homo sapiens
aaattgctgaccaagtatattc

SEQ ID NO: 9001283 - DNA, 22 bp, Homo sapiens
aaattccattttgtgactattc

SEQ ID NO: 9001284 - DNA, 22 bp, Homo sapiens
aaattgctgacacttgaccatt

SEQ ID NO: 9001285 - DNA, 22 bp, Homo sapiens
aaattcatatgttgaaatgcta

SEQ ID NO: 9001286 - DNA, 22 bp, Homo sapiens
aaattcagttttaataatcact

SEQ ID NO: 9001287 - DNA, 22 bp, Homo sapiens
aaattcatatgttgaaatgcta

SEQ ID NO: 9001288 - DNA, 22 bp, Homo sapiens
aaattcatatgttgaaatgcta

SEQ ID NO: 9001289 - DNA, 22 bp, Homo sapiens
aaattcatatgttgaaatgcta

SEQ ID NO: 9001290 - DNA, 22 bp, Homo sapiens
aaattcatatgttgaaatgcta

SEQ ID NO: 9001291 - DNA, 22 bp, Homo sapiens
aaattcatttttcttagtgtgc

SEQ ID NO: 9001292 - DNA, 22 bp, Homo sapiens
aaattcatttttcttagtgtgc

SEQ ID NO: 9001293 - DNA, 22 bp, Homo sapiens
aaattcatttttcttagtgtgc

SEQ ID NO: 9001294 - DNA, 22 bp, Homo sapiens
aaattcatttttcttagtgtgc

SEQ ID NO: 9001295 - DNA, 22 bp, Homo sapiens
aaattcatttttcttagtgtgc

SEQ ID NO: 9001296 - DNA, 22 bp, Homo sapiens
aaattccaccagaatcagtaat

SEQ ID NO: 9001297 - DNA, 22 bp, Homo sapiens
aaattcatttttcttagtgtgc

SEQ ID NO: 9001298 - DNA, 22 bp, Homo sapiens
aaattcagtttctgtcctggga

SEQ ID NO: 9001299 - DNA, 22 bp, Homo sapiens
aaattcagttcctcagccacat

SEQ ID NO: 9001300 - DNA, 23 bp, Homo sapiens
aaattcagtccttcaactctgag

SEQ ID NO: 9001301 - DNA, 22 bp, Homo sapiens
aaattcagcatcctgcactgga

SEQ ID NO: 9001302 - DNA, 22 bp, Homo sapiens
aaattagatcagtggattttct

SEQ ID NO: 9001303 - DNA, 22 bp, Homo sapiens
aaattagatcagtggattttct

SEQ ID NO: 9001304 - DNA, 22 bp, Homo sapiens
aaattcagatggctttcttttc

SEQ ID NO: 9001305 - DNA, 22 bp, Homo sapiens
aaattagaccagttcaggtcca

SEQ ID NO: 9001306 - DNA, 22 bp, Homo sapiens
aaagacatgacacattggagag

SEQ ID NO: 9001307 - DNA, 22 bp, Homo sapiens
aaattagatatgtgtgagactc

SEQ ID NO: 9001308 - DNA, 22 bp, Homo sapiens
aaagcagtctcagacttaagca

SEQ ID NO: 9001309 - DNA, 22 bp, Homo sapiens
aaagcagtctgttttaacctga

SEQ ID NO: 9001310 - DNA, 22 bp, Homo sapiens
aaagcagtctgttttaacctga

SEQ ID NO: 9001311 - DNA, 22 bp, Homo sapiens
aaagcagtgcaccttaattgat

SEQ ID NO: 9001312 - DNA, 22 bp, Homo sapiens
aaagcagtgcaccttaattgat

SEQ ID NO: 9001313 - DNA, 22 bp, Homo sapiens
aaagcagtccttcccttaaggt

SEQ ID NO: 9001314 - DNA, 22 bp, Homo sapiens
aaagcagtctcagacttaagca

SEQ ID NO: 9001315 - DNA, 22 bp, Homo sapiens
aaagcaggttatgaccatggcc

SEQ ID NO: 9001316 - DNA, 22 bp, Homo sapiens
aaagcagcacatggatatcagt

SEQ ID NO: 9001317 - DNA, 22 bp, Homo sapiens
aaagcagcacatggatatcagt

SEQ ID NO: 9001318 - DNA, 22 bp, Homo sapiens
aaagcagcaagtatttgttact

SEQ ID NO: 9001319 - DNA, 22 bp, Homo sapiens
aaagcagcacatggatatcagt

SEQ ID NO: 9001320 - DNA, 22 bp, Homo sapiens
aaagcaggttatgaccatggcc

SEQ ID NO: 9001321 - DNA, 22 bp, Homo sapiens
aaagcagtataagtaacggaag

SEQ ID NO: 9001322 - DNA, 22 bp, Homo sapiens
aaagcagtagttttcaaatagt

SEQ ID NO: 9001323 - DNA, 22 bp, Homo sapiens
aaagcagtagttttcaaatagt

SEQ ID NO: 9001324 - DNA, 22 bp, Homo sapiens
aaagcagtatattggtagttgt

SEQ ID NO: 9001325 - DNA, 22 bp, Homo sapiens
aaagcagcaacagctgttagaa

SEQ ID NO: 9001326 - DNA, 22 bp, Homo sapiens
aaagcagcaacagctgttagaa

SEQ ID NO: 9001327 - DNA, 22 bp, Homo sapiens
aaagcagcaacagctgttagaa

SEQ ID NO: 9001328 - DNA, 22 bp, Homo sapiens
aaagcagcacatggatatcagt

SEQ ID NO: 9001329 - DNA, 22 bp, Homo sapiens
aaagcagcaagtatttgttact

SEQ ID NO: 9001330 - DNA, 22 bp, Homo sapiens
aaagcagcaacgtgcatataac

SEQ ID NO: 9001331 - DNA, 22 bp, Homo sapiens
aaattgtatattccatttgtat

SEQ ID NO: 9001332 - DNA, 22 bp, Homo sapiens
aaattgtatattccatttgtat

SEQ ID NO: 9001333 - DNA, 22 bp, Homo sapiens
aaattgtataatgttccagctg

SEQ ID NO: 9001334 - DNA, 22 bp, Homo sapiens
aaattgtcagaattcagaaagt

SEQ ID NO: 9001335 - DNA, 22 bp, Homo sapiens
aaattgtccttttaagaaacag

SEQ ID NO: 9001336 - DNA, 22 bp, Homo sapiens
aaattggattttaaactgttgg

SEQ ID NO: 9001337 - DNA, 22 bp, Homo sapiens
aaattgtagagatcgctttgtg

SEQ ID NO: 9001338 - DNA, 22 bp, Homo sapiens
aaattgtaggatcacatgacct

SEQ ID NO: 9001339 - DNA, 22 bp, Homo sapiens
aaattgtaggatcacatgacct

SEQ ID NO: 9001340 - DNA, 22 bp, Homo sapiens
aaattgtaatgacttcacttga

SEQ ID NO: 9001341 - DNA, 22 bp, Homo sapiens
aaattgtaatgacttcacttga

SEQ ID NO: 9001342 - DNA, 20 bp, Homo sapiens
aaaggaatatatgaagtata

SEQ ID NO: 9001343 - DNA, 22 bp, Homo sapiens
aaaggaatattcaaaacagtca

SEQ ID NO: 9001344 - DNA, 22 bp, Homo sapiens
aaaggaatattcaaaacagtca

SEQ ID NO: 9001345 - DNA, 22 bp, Homo sapiens
aaaggaatattcaaaacagtca

SEQ ID NO: 9001346 - DNA, 22 bp, Homo sapiens
aaaggaatattcaaaacagtca

SEQ ID NO: 9001347 - DNA, 22 bp, Homo sapiens
aaaggaggccacatggctagga

SEQ ID NO: 9001348 - DNA, 22 bp, Homo sapiens
aaaggagttactcataaagctt

SEQ ID NO: 9001349 - DNA, 22 bp, Homo sapiens
aaaggagttactcataaagctt

SEQ ID NO: 9001350 - DNA, 22 bp, Homo sapiens
aaaggataaggttatcaatttt

SEQ ID NO: 9001351 - DNA, 22 bp, Homo sapiens
aaaggataaggttatcaatttt

SEQ ID NO: 9001352 - DNA, 22 bp, Homo sapiens
aaaggattaaataaatgtgctg

SEQ ID NO: 9001353 - DNA, 22 bp, Homo sapiens
aaaggattaaataaatgtgctg

SEQ ID NO: 9001354 - DNA, 22 bp, Homo sapiens
aaaggcacagaagggaaaccaa

SEQ ID NO: 9001355 - DNA, 22 bp, Homo sapiens
aaaggcacacactccttgttat

SEQ ID NO: 9001356 - DNA, 22 bp, Homo sapiens
aaaggcacagaagggaaaccaa

SEQ ID NO: 9001357 - DNA, 22 bp, Homo sapiens
aaaggcacacactccttgttat

SEQ ID NO: 9001358 - DNA, 22 bp, Homo sapiens
aaaggcacaaattcagcatttt

SEQ ID NO: 9001359 - DNA, 22 bp, Homo sapiens
aaaggcacaaattcagcatttt

SEQ ID NO: 9001360 - DNA, 22 bp, Homo sapiens
aaaggcacaaattcagcatttt

SEQ ID NO: 9001361 - DNA, 22 bp, Homo sapiens
aaaggcacacactccttgttat

SEQ ID NO: 9001362 - DNA, 22 bp, Homo sapiens
aaaggcaagcatttatatagga

SEQ ID NO: 9001363 - DNA, 22 bp, Homo sapiens
aaaggcaagcatttatatagga

SEQ ID NO: 9001364 - DNA, 22 bp, Homo sapiens
aaaggcaagcatttatatagga

SEQ ID NO: 9001365 - DNA, 22 bp, Homo sapiens
aaaggcaaaattcttagcagga

SEQ ID NO: 9001366 - DNA, 22 bp, Homo sapiens
aaaggattctcttgatttcagt

SEQ ID NO: 9001367 - DNA, 22 bp, Homo sapiens
aaaggattagagataccatgcc

SEQ ID NO: 9001368 - DNA, 22 bp, Homo sapiens
aaaggattagagataccatgcc

SEQ ID NO: 9001369 - DNA, 22 bp, Homo sapiens
aaaggattagagataccatgcc

SEQ ID NO: 9001370 - DNA, 22 bp, Homo sapiens
aaaggcactggatagctgggga

SEQ ID NO: 9001371 - DNA, 22 bp, Homo sapiens
aaaggcactgatcttatccagt

SEQ ID NO: 9001372 - DNA, 22 bp, Homo sapiens
aaaggcactgatcttatccagt

SEQ ID NO: 9001373 - DNA, 22 bp, Homo sapiens
aaaggcactgatcttatccagt

SEQ ID NO: 9001374 - DNA, 22 bp, Homo sapiens
aaaggcagagtgctcagctggc

SEQ ID NO: 9001375 - DNA, 22 bp, Homo sapiens
aaaggcactggatagctgggga

SEQ ID NO: 9001376 - DNA, 22 bp, Homo sapiens
aaaggcactggatagctgggga

SEQ ID NO: 9001377 - DNA, 20 bp, Homo sapiens
aaaggcacagcaacagagct

SEQ ID NO: 9001378 - DNA, 23 bp, Homo sapiens
aaaggcacagcattgtctagcag

SEQ ID NO: 9001379 - DNA, 20 bp, Homo sapiens
aaaggcacagcaacagagct

SEQ ID NO: 9001380 - DNA, 20 bp, Homo sapiens
aaaggcacagcaacagagct

SEQ ID NO: 9001381 - DNA, 20 bp, Homo sapiens
aaaggcacagcaacagagct

SEQ ID NO: 9001382 - DNA, 22 bp, Homo sapiens
aaaggcactagaagttaccttt

SEQ ID NO: 9001383 - DNA, 22 bp, Homo sapiens
aaaggcactagaagttaccttt

SEQ ID NO: 9001384 - DNA, 23 bp, Homo sapiens
aaaggcacagcattgtctagcag

SEQ ID NO: 9001385 - DNA, 22 bp, Homo sapiens
aacatgaaacccaaacagaata

SEQ ID NO: 9001386 - DNA, 22 bp, Homo sapiens
aacatgaaacccaaacagaata

SEQ ID NO: 9001387 - DNA, 22 bp, Homo sapiens
aacatgaaagttgctaagtgca

SEQ ID NO: 9001388 - DNA, 22 bp, Homo sapiens
aacatgaaacccaaacagaata

SEQ ID NO: 9001389 - DNA, 22 bp, Homo sapiens
aacatgaaagttgctaagtgca

SEQ ID NO: 9001390 - DNA, 22 bp, Homo sapiens
aacatgaaggtaggatggtttt

SEQ ID NO: 9001391 - DNA, 22 bp, Homo sapiens
aacatgaaggtaggatggtttt

SEQ ID NO: 9001392 - DNA, 22 bp, Homo sapiens
aacatgaagttttctatagtga

SEQ ID NO: 9001393 - DNA, 22 bp, Homo sapiens
aacatgaagttttctatagtga

SEQ ID NO: 9001394 - DNA, 22 bp, Homo sapiens
aaagcatgtgaatagaatatgg

SEQ ID NO: 9001395 - DNA, 22 bp, Homo sapiens
aaagcatgtgaatagaatatgg

SEQ ID NO: 9001396 - DNA, 22 bp, Homo sapiens
aaagcatgttctgggaatagta

SEQ ID NO: 9001397 - DNA, 22 bp, Homo sapiens
aaagcatgtgaatagaatatgg

SEQ ID NO: 9001398 - DNA, 22 bp, Homo sapiens
aaagcatgttctgggaatagta

SEQ ID NO: 9001399 - DNA, 22 bp, Homo sapiens
aaagcatgttgggtccctcttt

SEQ ID NO: 9001400 - DNA, 22 bp, Homo sapiens
aaagcatgtgaatagaatatgg

SEQ ID NO: 9001401 - DNA, 22 bp, Homo sapiens
aaagcatggttaaagacagtgg

SEQ ID NO: 9001402 - DNA, 22 bp, Homo sapiens
aaagcatggttaaagacagtgg

SEQ ID NO: 9001403 - DNA, 22 bp, Homo sapiens
aaagcatggcatgaagaacatg

SEQ ID NO: 9001404 - DNA, 22 bp, Homo sapiens
aaagcatgattagatagatgat

SEQ ID NO: 9001405 - DNA, 22 bp, Homo sapiens
aaagcatgattagatagatgat

SEQ ID NO: 9001406 - DNA, 22 bp, Homo sapiens
aaagcatgctactttatatagg

SEQ ID NO: 9001407 - DNA, 22 bp, Homo sapiens
aaagcatgattagatagatgat

SEQ ID NO: 9001408 - DNA, 22 bp, Homo sapiens
aaagcatgattagatagatgat

SEQ ID NO: 9001409 - DNA, 22 bp, Homo sapiens
aaagcatagaattagagttagg

SEQ ID NO: 9001410 - DNA, 22 bp, Homo sapiens
aaagcatagaattagagttagg

SEQ ID NO: 9001411 - DNA, 22 bp, Homo sapiens
aaagcatattaggactgaatta

SEQ ID NO: 9001412 - DNA, 22 bp, Homo sapiens
aaagcatattaggactgaatta

SEQ ID NO: 9001413 - DNA, 22 bp, Homo sapiens
aaagcatgactcaagaattact

SEQ ID NO: 9001414 - DNA, 22 bp, Homo sapiens
aaagcatgactcaagaattact

SEQ ID NO: 9001415 - DNA, 22 bp, Homo sapiens
aaagcatgactcaagaattact

SEQ ID NO: 9001416 - DNA, 22 bp, Homo sapiens
aaagccaaatgaaagatggttc

SEQ ID NO: 9001417 - DNA, 22 bp, Homo sapiens
aaagccaaatgaaagatggttc

SEQ ID NO: 9001418 - DNA, 22 bp, Homo sapiens
aaagccaaatgaaagatggttc

SEQ ID NO: 9001419 - DNA, 22 bp, Homo sapiens
aaagccaagctgggaaggcagg

SEQ ID NO: 9001420 - DNA, 22 bp, Homo sapiens
aaagccaaatgaaagatggttc

SEQ ID NO: 9001421 - DNA, 22 bp, Homo sapiens
aaagccaagctgggaaggcagg

SEQ ID NO: 9001422 - DNA, 22 bp, Homo sapiens
aaagccaagctgggaaggcagg

SEQ ID NO: 9001423 - DNA, 22 bp, Homo sapiens
aaaggaagattgagcttttcca

SEQ ID NO: 9001424 - DNA, 22 bp, Homo sapiens
aaaggaagattgagcttttcca

SEQ ID NO: 9001425 - DNA, 23 bp, Homo sapiens
aaagccaagtcagtctactggaa

SEQ ID NO: 9001426 - DNA, 23 bp, Homo sapiens
aaagccaagtcagtctactggaa

SEQ ID NO: 9001427 - DNA, 23 bp, Homo sapiens
aaagccaagtcagtctactggaa

SEQ ID NO: 9001428 - DNA, 23 bp, Homo sapiens
aaagccaagtcagtctactggaa

SEQ ID NO: 9001429 - DNA, 22 bp, Homo sapiens
aaaggaagtgccactcttcttc

SEQ ID NO: 9001430 - DNA, 22 bp, Homo sapiens
aaaggaagtgccactcttcttc

SEQ ID NO: 9001431 - DNA, 22 bp, Homo sapiens
aaaggaagtgccactcttcttc

SEQ ID NO: 9001432 - DNA, 22 bp, Homo sapiens
aaaggaagtgccactcttcttc

SEQ ID NO: 9001433 - DNA, 20 bp, Homo sapiens
aaagcatttacttgtgattg

SEQ ID NO: 9001434 - DNA, 22 bp, Homo sapiens
aaagcatttcatgtctagaaag

SEQ ID NO: 9001435 - DNA, 20 bp, Homo sapiens
aaagcatttacttgtgattg

SEQ ID NO: 9001436 - DNA, 22 bp, Homo sapiens
aaagcatttcatgtctagaaag

SEQ ID NO: 9001437 - DNA, 22 bp, Homo sapiens
aaagcattattctgtggaaaaa

SEQ ID NO: 9001438 - DNA, 22 bp, Homo sapiens
aaagcattactagactggattt

SEQ ID NO: 9001439 - DNA, 22 bp, Homo sapiens
aaagcattactagactggattt

SEQ ID NO: 9001440 - DNA, 18 bp, Homo sapiens
aaaggctgaatatagaag

SEQ ID NO: 9001441 - DNA, 22 bp, Homo sapiens
aaaggctgcaaagctgtaagtg

SEQ ID NO: 9001442 - DNA, 22 bp, Homo sapiens
aaaggctgacagggtcctaagt

SEQ ID NO: 9001443 - DNA, 22 bp, Homo sapiens
aaaggctgccaggtaaaatatt

SEQ ID NO: 9001444 - DNA, 22 bp, Homo sapiens
aaaggctgccaggtaaaatatt

SEQ ID NO: 9001445 - DNA, 22 bp, Homo sapiens
aaaggctctaacaaggagagag

SEQ ID NO: 9001446 - DNA, 18 bp, Homo sapiens
aaaggctgaatatagaag

SEQ ID NO: 9001447 - DNA, 22 bp, Homo sapiens
aaaggctccttctcccatgacc

SEQ ID NO: 9001448 - DNA, 22 bp, Homo sapiens
aaaggctcatacagaaaataca

SEQ ID NO: 9001449 - DNA, 22 bp, Homo sapiens
aaaggctcacgcagttagtgat

SEQ ID NO: 9001450 - DNA, 22 bp, Homo sapiens
aaaggctatttttagatgtttg

SEQ ID NO: 9001451 - DNA, 22 bp, Homo sapiens
aaaggctatttttagatgtttg

SEQ ID NO: 9001452 - DNA, 22 bp, Homo sapiens
aaaggctatttttagatgtttg

SEQ ID NO: 9001453 - DNA, 22 bp, Homo sapiens
aaaggctatttcagggtcagta

SEQ ID NO: 9001454 - DNA, 22 bp, Homo sapiens
aaaggctattgctgataatgtt

SEQ ID NO: 9001455 - DNA, 22 bp, Homo sapiens
aaaggctattcagggacttgcc

SEQ ID NO: 9001456 - DNA, 22 bp, Homo sapiens
aaaggctattcagggacttgcc

SEQ ID NO: 9001457 - DNA, 22 bp, Homo sapiens
aaaggctattcagggacttgcc

SEQ ID NO: 9001458 - DNA, 22 bp, Homo sapiens
aaaggctatgatagtccagtgg

SEQ ID NO: 9001459 - DNA, 22 bp, Homo sapiens
aaaggctattcagggacttgcc

SEQ ID NO: 9001460 - DNA, 23 bp, Homo sapiens
aaaggctatcaaagttttgctga

SEQ ID NO: 9001461 - DNA, 22 bp, Homo sapiens
aaaggctatgatagtccagtgg

SEQ ID NO: 9001462 - DNA, 22 bp, Homo sapiens
aaaggctatgagatagaagata

SEQ ID NO: 9001463 - DNA, 22 bp, Homo sapiens
aaaggctatgagatagaagata

SEQ ID NO: 9001464 - DNA, 22 bp, Homo sapiens
aaaggctatgagatagaagata

SEQ ID NO: 9001465 - DNA, 22 bp, Homo sapiens
aacatgattggaaaatgctgtc

SEQ ID NO: 9001466 - DNA, 22 bp, Homo sapiens
aacatgattggaaaatgctgtc

SEQ ID NO: 9001467 - DNA, 22 bp, Homo sapiens
aacatgatttagtataatgcag

SEQ ID NO: 9001468 - DNA, 22 bp, Homo sapiens
aacatgatttagtataatgcag

SEQ ID NO: 9001469 - DNA, 22 bp, Homo sapiens
aacatgatttagtataatgcag

SEQ ID NO: 9001470 - DNA, 22 bp, Homo sapiens
aaaggcatgcatggtctgctcc

SEQ ID NO: 9001471 - DNA, 22 bp, Homo sapiens
aaaggcatgattaattctgtgt

SEQ ID NO: 9001472 - DNA, 22 bp, Homo sapiens
aaaggcatgcctccatttctat

SEQ ID NO: 9001473 - DNA, 22 bp, Homo sapiens
aaaggcatgctgctgaatgatg

SEQ ID NO: 9001474 - DNA, 22 bp, Homo sapiens
aaaggctatgagatagaagata

SEQ ID NO: 9001475 - DNA, 22 bp, Homo sapiens
aacatgatgtgaagcatgaact

SEQ ID NO: 9001476 - DNA, 22 bp, Homo sapiens
aacatgatgtgaagcatgaact

SEQ ID NO: 9001477 - DNA, 22 bp, Homo sapiens
aacatgagtctgtgtgaaagtg

SEQ ID NO: 9001478 - DNA, 22 bp, Homo sapiens
aacatgagtgataaaattacct

SEQ ID NO: 9001479 - DNA, 22 bp, Homo sapiens
aacatgagtgataaaattacct

SEQ ID NO: 9001480 - DNA, 22 bp, Homo sapiens
aaagggcagagttcactagaaa

SEQ ID NO: 9001481 - DNA, 22 bp, Homo sapiens
aaagtcacatataacaagggca

SEQ ID NO: 9001482 - DNA, 22 bp, Homo sapiens
aaagtcacatataacaagggca

SEQ ID NO: 9001483 - DNA, 22 bp, Homo sapiens
aaagggaggggcgataagccgg

SEQ ID NO: 9001484 - DNA, 22 bp, Homo sapiens
aaagggagcatggctgcaggga

SEQ ID NO: 9001485 - DNA, 22 bp, Homo sapiens
aaagggaggggcgataagccgg

SEQ ID NO: 9001486 - DNA, 22 bp, Homo sapiens
aaagggagcatggctgcaggga

SEQ ID NO: 9001487 - DNA, 22 bp, Homo sapiens
aaagggagcatggctgcaggga

SEQ ID NO: 9001488 - DNA, 22 bp, Homo sapiens
aaagggagcatggctgcaggga

SEQ ID NO: 9001489 - DNA, 22 bp, Homo sapiens
aaagggaatgtgtaggacatgt

SEQ ID NO: 9001490 - DNA, 22 bp, Homo sapiens
aaagggagcatggctgcaggga

SEQ ID NO: 9001491 - DNA, 22 bp, Homo sapiens
aaagggaatgtgtaggacatgt

SEQ ID NO: 9001492 - DNA, 22 bp, Homo sapiens
aaagggaagttgcacatgttcc

SEQ ID NO: 9001493 - DNA, 22 bp, Homo sapiens
aaagggaagttgcacatgttcc

SEQ ID NO: 9001494 - DNA, 22 bp, Homo sapiens
aaagggaagttgcacatgttcc

SEQ ID NO: 9001495 - DNA, 22 bp, Homo sapiens
aaagggaatgtgtaggacatgt

SEQ ID NO: 9001496 - DNA, 22 bp, Homo sapiens
aaagggaatgtgtaggacatgt

SEQ ID NO: 9001497 - DNA, 22 bp, Homo sapiens
aaagggaatgtgtaggacatgt

SEQ ID NO: 9001498 - DNA, 22 bp, Homo sapiens
aaagggaactctaattatcttc

SEQ ID NO: 9001499 - DNA, 22 bp, Homo sapiens
aaagggaactctaattatcttc

SEQ ID NO: 9001500 - DNA, 22 bp, Homo sapiens
aaagggaaaatatttagacata

SEQ ID NO: 9001501 - DNA, 22 bp, Homo sapiens
aaaggcttttggtatataggag

SEQ ID NO: 9001502 - DNA, 22 bp, Homo sapiens
aaagggaactctaattatcttc

SEQ ID NO: 9001503 - DNA, 22 bp, Homo sapiens
aaaggctttgagaagtcctgca

SEQ ID NO: 9001504 - DNA, 22 bp, Homo sapiens
aaaggctttaaagaaccagaac

SEQ ID NO: 9001505 - DNA, 22 bp, Homo sapiens
aaaggctttccagcgcgcggac

SEQ ID NO: 9001506 - DNA, 22 bp, Homo sapiens
aaaggctggggactgaggaagg

SEQ ID NO: 9001507 - DNA, 22 bp, Homo sapiens
aaaggctggattcagagaggtg

SEQ ID NO: 9001508 - DNA, 22 bp, Homo sapiens
aaaggctggggactgaggaagg

SEQ ID NO: 9001509 - DNA, 22 bp, Homo sapiens
aaaggctggattcagagaggtg

SEQ ID NO: 9001510 - DNA, 22 bp, Homo sapiens
aaaggctggaaactgaagataa

SEQ ID NO: 9001511 - DNA, 22 bp, Homo sapiens
aaaggctggaaactgaagataa

SEQ ID NO: 9001512 - DNA, 22 bp, Homo sapiens
aaaggcttagacacagaactgt

SEQ ID NO: 9001513 - DNA, 22 bp, Homo sapiens
aaaggcttcacttatttatttt

SEQ ID NO: 9001514 - DNA, 22 bp, Homo sapiens
aaaggcttcacttatttatttt

SEQ ID NO: 9001515 - DNA, 22 bp, Homo sapiens
aaaggcttaacagaagaccttt

SEQ ID NO: 9001516 - DNA, 22 bp, Homo sapiens
aaaggcttaatgttgttgtaat

SEQ ID NO: 9001517 - DNA, 22 bp, Homo sapiens
aaaggcttcggatcagaaggta

SEQ ID NO: 9001518 - DNA, 22 bp, Homo sapiens
aaaggcttcagtgagtgggtat

SEQ ID NO: 9001519 - DNA, 22 bp, Homo sapiens
aaaggcttctcagaaaggcctt

SEQ ID NO: 9001520 - DNA, 22 bp, Homo sapiens
aaaggcttgtttgaggactggt

SEQ ID NO: 9001521 - DNA, 22 bp, Homo sapiens
aaaggctttaaaatgtacatat

SEQ ID NO: 9001522 - DNA, 22 bp, Homo sapiens
aaaggctttaaaatgtacatat

SEQ ID NO: 9001523 - DNA, 22 bp, Homo sapiens
aaaggctttaaagaaccagaac

SEQ ID NO: 9001524 - DNA, 22 bp, Homo sapiens
aaaggcttggttctttgatgac

SEQ ID NO: 9001525 - DNA, 22 bp, Homo sapiens
aaaggcttgtacagcagccttc

SEQ ID NO: 9001526 - DNA, 22 bp, Homo sapiens
aaaggcttgtttgaggactggt

SEQ ID NO: 9001527 - DNA, 22 bp, Homo sapiens
aaaggcttgtccagtaagggga

SEQ ID NO: 9001528 - DNA, 22 bp, Homo sapiens
aaaggcttctttgctccatgtc

SEQ ID NO: 9001529 - DNA, 22 bp, Homo sapiens
aaaggcttctattggacgttgc

SEQ ID NO: 9001530 - DNA, 22 bp, Homo sapiens
aaaggcttctttgctccatgtc

SEQ ID NO: 9001531 - DNA, 22 bp, Homo sapiens
aaaggcttctttgctccatgtc

SEQ ID NO: 9001532 - DNA, 22 bp, Homo sapiens
aaaggcttgactagaagggaga

SEQ ID NO: 9001533 - DNA, 22 bp, Homo sapiens
aaaggcttgagcatttgttgaa

SEQ ID NO: 9001534 - DNA, 22 bp, Homo sapiens
aaaggcttggtattttggagtt

SEQ ID NO: 9001535 - DNA, 22 bp, Homo sapiens
aaaggcttgcgattccttgtaa

SEQ ID NO: 9001536 - DNA, 22 bp, Homo sapiens
aaagtcttgttacgttccattg

SEQ ID NO: 9001537 - DNA, 20 bp, Homo sapiens
aaagtcttatggttaatttt

SEQ ID NO: 9001538 - DNA, 20 bp, Homo sapiens
aaagtcttatggttaatttt

SEQ ID NO: 9001539 - DNA, 22 bp, Homo sapiens
aaagtctgaaagataagagtga

SEQ ID NO: 9001540 - DNA, 22 bp, Homo sapiens
aaagtctgaaagataagagtga

SEQ ID NO: 9001541 - DNA, 22 bp, Homo sapiens
aaagtctgaaagatgctaacat

SEQ ID NO: 9001542 - DNA, 22 bp, Homo sapiens
aaagtcttaatgtaagtttagt

SEQ ID NO: 9001543 - DNA, 20 bp, Homo sapiens
aaagtctgtttatctctgga

SEQ ID NO: 9001544 - DNA, 22 bp, Homo sapiens
aaagtctttattttgtatcttt

SEQ ID NO: 9001545 - DNA, 22 bp, Homo sapiens
aaagtctttattttgtatcttt

SEQ ID NO: 9001546 - DNA, 22 bp, Homo sapiens
aaagtcttgcattgatcttgaa

SEQ ID NO: 9001547 - DNA, 22 bp, Homo sapiens
aaagtcttgttacgttccattg

SEQ ID NO: 9001548 - DNA, 22 bp, Homo sapiens
aaagtctttctcattggccatg

SEQ ID NO: 9001549 - DNA, 22 bp, Homo sapiens
aaagtctttattttgtatcttt

SEQ ID NO: 9001550 - DNA, 22 bp, Homo sapiens
aacttccttctagttcatatgt

SEQ ID NO: 9001551 - DNA, 22 bp, Homo sapiens
aacttccttctagttcatatgt

SEQ ID NO: 9001552 - DNA, 22 bp, Homo sapiens
aacttccaggccttgaattatt

SEQ ID NO: 9001553 - DNA, 22 bp, Homo sapiens
aacttccaccaaatagtatata

SEQ ID NO: 9001554 - DNA, 22 bp, Homo sapiens
aaagtcctagcgatccacagaa

SEQ ID NO: 9001555 - DNA, 22 bp, Homo sapiens
aaagtcctgactgcaggggatg

SEQ ID NO: 9001556 - DNA, 22 bp, Homo sapiens
aaagtcctagcgatccacagaa

SEQ ID NO: 9001557 - DNA, 22 bp, Homo sapiens
aaagtcacgctgatgggaaatg

SEQ ID NO: 9001558 - DNA, 22 bp, Homo sapiens
aaagtcacgctgatgggaaatg

SEQ ID NO: 9001559 - DNA, 22 bp, Homo sapiens
aaagtccagggaaagagcgtct

SEQ ID NO: 9001560 - DNA, 22 bp, Homo sapiens
aaagtcctgttaactgttaaca

SEQ ID NO: 9001561 - DNA, 22 bp, Homo sapiens
aaagtcctgttaactgttaaca

SEQ ID NO: 9001562 - DNA, 22 bp, Homo sapiens
aaagtccttgcagtttcctctt

SEQ ID NO: 9001563 - DNA, 22 bp, Homo sapiens
aaagtccttgcagtttcctctt

SEQ ID NO: 9001564 - DNA, 22 bp, Homo sapiens
aaagtcctgtttgaaggacctg

SEQ ID NO: 9001565 - DNA, 22 bp, Homo sapiens
aaagtctaaattattcaataag

SEQ ID NO: 9001566 - DNA, 22 bp, Homo sapiens
aaagtcctttttgccatgcaag

SEQ ID NO: 9001567 - DNA, 22 bp, Homo sapiens
aaagtctccactgggaaccaaa

SEQ ID NO: 9001568 - DNA, 20 bp, Homo sapiens
aaagtctcaacagctgagaa

SEQ ID NO: 9001569 - DNA, 22 bp, Homo sapiens
aaagtctcaggcaaaccaggac

SEQ ID NO: 9001570 - DNA, 22 bp, Homo sapiens
aaagtctaaattattcaataag

SEQ ID NO: 9001571 - DNA, 22 bp, Homo sapiens
aacttctaatctgtacagtttt

SEQ ID NO: 9001572 - DNA, 22 bp, Homo sapiens
aaagtctttctcatagtcacgc

SEQ ID NO: 9001573 - DNA, 22 bp, Homo sapiens
aacttctaatctgtacagtttt

SEQ ID NO: 9001574 - DNA, 22 bp, Homo sapiens
aacttctggatgtttcaaatgt

SEQ ID NO: 9001575 - DNA, 22 bp, Homo sapiens
aacttctgggctgtccaaaact

SEQ ID NO: 9001576 - DNA, 22 bp, Homo sapiens
aacttctgcagaaaagtgcatg

SEQ ID NO: 9001577 - DNA, 22 bp, Homo sapiens
aacttctgccaaacagctgtta

SEQ ID NO: 9001578 - DNA, 22 bp, Homo sapiens
aacttgaagttgcagaaagtac

SEQ ID NO: 9001579 - DNA, 22 bp, Homo sapiens
aacttgaagaggctttttggca

SEQ ID NO: 9001580 - DNA, 22 bp, Homo sapiens
aacttgaactgatgagtgttag

SEQ ID NO: 9001581 - DNA, 22 bp, Homo sapiens
aacttgaaccacagaagctgcc

SEQ ID NO: 9001582 - DNA, 22 bp, Homo sapiens
aacttgaatgagaacttttgcc

SEQ ID NO: 9001583 - DNA, 22 bp, Homo sapiens
aaagttacacatctagtaagtg

SEQ ID NO: 9001584 - DNA, 22 bp, Homo sapiens
aaagttacacatctagtaagtg

SEQ ID NO: 9001585 - DNA, 22 bp, Homo sapiens
aaagtgtttttgagctgtagtt

SEQ ID NO: 9001586 - DNA, 22 bp, Homo sapiens
aacttctttgagctccagtttt

SEQ ID NO: 9001587 - DNA, 22 bp, Homo sapiens
aacttgaaactgttccagaaaa

SEQ ID NO: 9001588 - DNA, 22 bp, Homo sapiens
aacttgaaaacctcatgaattg

SEQ ID NO: 9001589 - DNA, 22 bp, Homo sapiens
aacttgaaactgttccagaaaa

SEQ ID NO: 9001590 - DNA, 22 bp, Homo sapiens
aacttgaaaacctcatgaattg

SEQ ID NO: 9001591 - DNA, 22 bp, Homo sapiens
aaagttcttcatttttattgga

SEQ ID NO: 9001592 - DNA, 22 bp, Homo sapiens
aaagttcttcatttttattgga

SEQ ID NO: 9001593 - DNA, 22 bp, Homo sapiens
aaagttcttagattaatcactg

SEQ ID NO: 9001594 - DNA, 22 bp, Homo sapiens
aaagttcttagattaatcactg

SEQ ID NO: 9001595 - DNA, 22 bp, Homo sapiens
aaagttctttctcttatttggt

SEQ ID NO: 9001596 - DNA, 22 bp, Homo sapiens
aaagttctttctcttatttggt

SEQ ID NO: 9001597 - DNA, 22 bp, Homo sapiens
aaagttctgtagtgcactgact

SEQ ID NO: 9001598 - DNA, 22 bp, Homo sapiens
aaagttctgggggtgtttctgg

SEQ ID NO: 9001599 - DNA, 22 bp, Homo sapiens
aaagttctgggggagaagaacg

SEQ ID NO: 9001600 - DNA, 22 bp, Homo sapiens
aaagttctggagaaaataatga

SEQ ID NO: 9001601 - DNA, 22 bp, Homo sapiens
aaagttctggcattttctgtct

SEQ ID NO: 9001602 - DNA, 22 bp, Homo sapiens
aaagttctgggggagaagaacg

SEQ ID NO: 9001603 - DNA, 22 bp, Homo sapiens
aaagttctgagactgatggcta

SEQ ID NO: 9001604 - DNA, 22 bp, Homo sapiens
aaagttctgatgctgatcaaag

SEQ ID NO: 9001605 - DNA, 22 bp, Homo sapiens
aaagttctgatgctgatcaaag

SEQ ID NO: 9001606 - DNA, 22 bp, Homo sapiens
aaagttctgatgctgatcaaag

SEQ ID NO: 9001607 - DNA, 23 bp, Homo sapiens
aaagttctcttgcgtgtgggaaa

SEQ ID NO: 9001608 - DNA, 19 bp, Homo sapiens
aaagttctgactgtagagc

SEQ ID NO: 9001609 - DNA, 19 bp, Homo sapiens
aaagttctgactgtagagc

SEQ ID NO: 9001610 - DNA, 19 bp, Homo sapiens
aaagttctgactgtagagc

SEQ ID NO: 9001611 - DNA, 23 bp, Homo sapiens
aaagttctcttgcgtgtgggaaa

SEQ ID NO: 9001612 - DNA, 22 bp, Homo sapiens
aaagttctgagaagcagtttac

SEQ ID NO: 9001613 - DNA, 22 bp, Homo sapiens
aaagttctcctggattgtgctg

SEQ ID NO: 9001614 - DNA, 22 bp, Homo sapiens
aaagttctcctggattgtgctg

SEQ ID NO: 9001615 - DNA, 22 bp, Homo sapiens
aaagttctcctggattgtgctg

SEQ ID NO: 9001616 - DNA, 22 bp, Homo sapiens
aaagttctctatggtgtaaaaa

SEQ ID NO: 9001617 - DNA, 22 bp, Homo sapiens
aaagttctagagttgcaagaga

SEQ ID NO: 9001618 - DNA, 22 bp, Homo sapiens
aaagttctattggatagtgctg

SEQ ID NO: 9001619 - DNA, 22 bp, Homo sapiens
aaagttctattggatagtgctg

SEQ ID NO: 9001620 - DNA, 22 bp, Homo sapiens
aaagttctatgtaatgtttttt

SEQ ID NO: 9001621 - DNA, 22 bp, Homo sapiens
aaagttctatgtaatgtttttt

SEQ ID NO: 9001622 - DNA, 22 bp, Homo sapiens
aaagttacacgactatttatgt

SEQ ID NO: 9001623 - DNA, 22 bp, Homo sapiens
aaagttacacatctagtaagtg

SEQ ID NO: 9001624 - DNA, 22 bp, Homo sapiens
aaagttacacatctagtaagtg

SEQ ID NO: 9001625 - DNA, 21 bp, Homo sapiens
aaatgctttgtatatatctgt

SEQ ID NO: 9001626 - DNA, 21 bp, Homo sapiens
aaatgctttgtatatatctgt

SEQ ID NO: 9001627 - DNA, 20 bp, Homo sapiens
aaatgcttttgacacatatt

SEQ ID NO: 9001628 - DNA, 20 bp, Homo sapiens
aaatgcttttgacacatatt

SEQ ID NO: 9001629 - DNA, 21 bp, Homo sapiens
aaatgctttgtatatatctgt

SEQ ID NO: 9001630 - DNA, 20 bp, Homo sapiens
aaatgcttttgacacatatt

SEQ ID NO: 9001631 - DNA, 22 bp, Homo sapiens
aaatggaactgggctactaggt

SEQ ID NO: 9001632 - DNA, 22 bp, Homo sapiens
aaatggaactgggctactaggt

SEQ ID NO: 9001633 - DNA, 22 bp, Homo sapiens
aaatggaactgttgtgcatttg

SEQ ID NO: 9001634 - DNA, 22 bp, Homo sapiens
aaatggaactgggctactaggt

SEQ ID NO: 9001635 - DNA, 22 bp, Homo sapiens
aaatggaaaatgctgttttggt

SEQ ID NO: 9001636 - DNA, 22 bp, Homo sapiens
aaatggaaaatgctgttttggt

SEQ ID NO: 9001637 - DNA, 21 bp, Homo sapiens
aaatgctttgtatatatctgt

SEQ ID NO: 9001638 - DNA, 22 bp, Homo sapiens
aaatgctttggtgctggtacag

SEQ ID NO: 9001639 - DNA, 22 bp, Homo sapiens
aaatgcttgtatatttcttggt

SEQ ID NO: 9001640 - DNA, 22 bp, Homo sapiens
aaatgctttggtgctggtacag

SEQ ID NO: 9001641 - DNA, 22 bp, Homo sapiens
aaatgcttgtaaattttccatg

SEQ ID NO: 9001642 - DNA, 22 bp, Homo sapiens
aaatgcttgtaaattttccatg

SEQ ID NO: 9001643 - DNA, 22 bp, Homo sapiens
aaatgcttgtaaattttccatg

SEQ ID NO: 9001644 - DNA, 22 bp, Homo sapiens
aaatgcttgtatatttcttggt

SEQ ID NO: 9001645 - DNA, 22 bp, Homo sapiens
aaatgcttcacctcattaaact

SEQ ID NO: 9001646 - DNA, 22 bp, Homo sapiens
aaatgcttgcaacatcccaggt

SEQ ID NO: 9001647 - DNA, 22 bp, Homo sapiens
aaatgcttgcaacatcccaggt

SEQ ID NO: 9001648 - DNA, 22 bp, Homo sapiens
aaatgcttgctcttgattattt

SEQ ID NO: 9001649 - DNA, 22 bp, Homo sapiens
aaatgcttgctcttgattattt

SEQ ID NO: 9001650 - DNA, 22 bp, Homo sapiens
aaatgcttgcaacatcccaggt

SEQ ID NO: 9001651 - DNA, 22 bp, Homo sapiens
aaatgcttgctcttgattattt

SEQ ID NO: 9001652 - DNA, 22 bp, Homo sapiens
aaatgcttgctcttgattattt

SEQ ID NO: 9001653 - DNA, 22 bp, Homo sapiens
aaatgctgggaaccattggatc

SEQ ID NO: 9001654 - DNA, 22 bp, Homo sapiens
aaatgccaggattattagaggc

SEQ ID NO: 9001655 - DNA, 23 bp, Homo sapiens
aaatgccagggagacaggaacca

SEQ ID NO: 9001656 - DNA, 22 bp, Homo sapiens
aaatgctgagtgtttagagatc

SEQ ID NO: 9001657 - DNA, 18 bp, Homo sapiens
aaatgctgctcaaattcc

SEQ ID NO: 9001658 - DNA, 22 bp, Homo sapiens
aaatgctgagtgtttagagatc

SEQ ID NO: 9001659 - DNA, 22 bp, Homo sapiens
aaatgcttattagtgtcacaaa

SEQ ID NO: 9001660 - DNA, 22 bp, Homo sapiens
aaatgcttagaggtgttcaaat

SEQ ID NO: 9001661 - DNA, 22 bp, Homo sapiens
aaatgcttagaggtgttcaaat

SEQ ID NO: 9001662 - DNA, 22 bp, Homo sapiens
aaatgcttattagtgtcacaaa

SEQ ID NO: 9001663 - DNA, 22 bp, Homo sapiens
aaatgcttattagtgtcacaaa

SEQ ID NO: 9001664 - DNA, 22 bp, Homo sapiens
aaatgcttattagtgtcacaaa

SEQ ID NO: 9001665 - DNA, 22 bp, Homo sapiens
aaatgcttattagtgtcacaaa

SEQ ID NO: 9001666 - DNA, 22 bp, Homo sapiens
aaatgcttattagtgtcacaaa

SEQ ID NO: 9001667 - DNA, 22 bp, Homo sapiens
aaatgcttcacctcattaaact

SEQ ID NO: 9001668 - DNA, 22 bp, Homo sapiens
aaatgcttagaggtgttcaaat

SEQ ID NO: 9001669 - DNA, 22 bp, Homo sapiens
aaatgctgtgttttaacataga

SEQ ID NO: 9001670 - DNA, 22 bp, Homo sapiens
aaatgctgtcagtgttattgga

SEQ ID NO: 9001671 - DNA, 22 bp, Homo sapiens
aaatgctgtgttttaacataga

SEQ ID NO: 9001672 - DNA, 20 bp, Homo sapiens
aaatgatgggaataatctat

SEQ ID NO: 9001673 - DNA, 20 bp, Homo sapiens
aaatgatgggaataatctat

SEQ ID NO: 9001674 - DNA, 22 bp, Homo sapiens
aaatgatggaaatgaggctgaa

SEQ ID NO: 9001675 - DNA, 22 bp, Homo sapiens
aaatgatgtggagtgaaattgt

SEQ ID NO: 9001676 - DNA, 22 bp, Homo sapiens
aaatgatggtactcatgtttag

SEQ ID NO: 9001677 - DNA, 22 bp, Homo sapiens
aaatgatgtggagtgaaattgt

SEQ ID NO: 9001678 - DNA, 22 bp, Homo sapiens
aaatgattgtcaaagttctgtt

SEQ ID NO: 9001679 - DNA, 22 bp, Homo sapiens
aaatgcaacgggctttccttat

SEQ ID NO: 9001680 - DNA, 22 bp, Homo sapiens
aaatgcaaggccatgtgaagga

SEQ ID NO: 9001681 - DNA, 22 bp, Homo sapiens
aaatgcaaggccatgtgaagga

SEQ ID NO: 9001682 - DNA, 22 bp, Homo sapiens
aaatgcaaggccatgtgaagga

SEQ ID NO: 9001683 - DNA, 22 bp, Homo sapiens
aaatgcaaggattttgttaggc

SEQ ID NO: 9001684 - DNA, 22 bp, Homo sapiens
aaatgcacaataaagtaaaggc

SEQ ID NO: 9001685 - DNA, 22 bp, Homo sapiens
aaatgcacaataaagtaaaggc

SEQ ID NO: 9001686 - DNA, 22 bp, Homo sapiens
aaatgcacaaagattttgcact

SEQ ID NO: 9001687 - DNA, 22 bp, Homo sapiens
aaatgcacaaagattttgcact

SEQ ID NO: 9001688 - DNA, 22 bp, Homo sapiens
aaatgcacaaagtaagtgtaat

SEQ ID NO: 9001689 - DNA, 22 bp, Homo sapiens
aaatgcacaaagattttgcact

SEQ ID NO: 9001690 - DNA, 22 bp, Homo sapiens
aaatgcaattgtatgtactcca

SEQ ID NO: 9001691 - DNA, 22 bp, Homo sapiens
aaatgcaattgtatgtactcca

SEQ ID NO: 9001692 - DNA, 22 bp, Homo sapiens
aaatgcaattgtatgtactcca

SEQ ID NO: 9001693 - DNA, 22 bp, Homo sapiens
aaatgcaattgtatgtactcca

SEQ ID NO: 9001694 - DNA, 22 bp, Homo sapiens
aaatgcaattcaggaagacaag

SEQ ID NO: 9001695 - DNA, 22 bp, Homo sapiens
aaatgcaattcaggaagacaag

SEQ ID NO: 9001696 - DNA, 22 bp, Homo sapiens
aaatgcaattcaggaagacaag

SEQ ID NO: 9001697 - DNA, 22 bp, Homo sapiens
aaatgcaattcaggaagacaag

SEQ ID NO: 9001698 - DNA, 22 bp, Homo sapiens
aaatgcaattcaggaagacaag

SEQ ID NO: 9001699 - DNA, 22 bp, Homo sapiens
aaatgcacagaaaggatgtgga

SEQ ID NO: 9001700 - DNA, 22 bp, Homo sapiens
aaatgcacagagccttagagat

SEQ ID NO: 9001701 - DNA, 22 bp, Homo sapiens
aaatgcacagagccttagagat

SEQ ID NO: 9001702 - DNA, 22 bp, Homo sapiens
aaatgcacagaggccagagagg

SEQ ID NO: 9001703 - DNA, 22 bp, Homo sapiens
aaatgcacaataaagtaaaggc

SEQ ID NO: 9001704 - DNA, 22 bp, Homo sapiens
aaatgcacaataaagtaaaggc

SEQ ID NO: 9001705 - DNA, 22 bp, Homo sapiens
aaatgcacacaccaggaaacta

SEQ ID NO: 9001706 - DNA, 22 bp, Homo sapiens
aaatgcacacaccaggaaacta

SEQ ID NO: 9001707 - DNA, 22 bp, Homo sapiens
aaatgcacaggagaaccaattc

SEQ ID NO: 9001708 - DNA, 22 bp, Homo sapiens
aaatgcacaggagaaccaattc

SEQ ID NO: 9001709 - DNA, 22 bp, Homo sapiens
aaatgcacagaggccagagagg

SEQ ID NO: 9001710 - DNA, 22 bp, Homo sapiens
aaatgccaaggagagactgtta

SEQ ID NO: 9001711 - DNA, 22 bp, Homo sapiens
aaatgccaaggagagactgtta

SEQ ID NO: 9001712 - DNA, 22 bp, Homo sapiens
aaatcaaggagggattatattt

SEQ ID NO: 9001713 - DNA, 22 bp, Homo sapiens
aaatcaaggagggattatattt

SEQ ID NO: 9001714 - DNA, 22 bp, Homo sapiens
aaatcaaggagggattatattt

SEQ ID NO: 9001715 - DNA, 22 bp, Homo sapiens
aaatcaaggagggattatattt

SEQ ID NO: 9001716 - DNA, 22 bp, Homo sapiens
aaatcacagggtctctaagtat

SEQ ID NO: 9001717 - DNA, 22 bp, Homo sapiens
aaatcacagggtctctaagtat

SEQ ID NO: 9001718 - DNA, 22 bp, Homo sapiens
aaatcacagggtctctaagtat

SEQ ID NO: 9001719 - DNA, 22 bp, Homo sapiens
aaatcactaagttatagtgtgg

SEQ ID NO: 9001720 - DNA, 22 bp, Homo sapiens
aaatcactaagttatagtgtgg

SEQ ID NO: 9001721 - DNA, 22 bp, Homo sapiens
aaatcactaagttatagtgtgg

SEQ ID NO: 9001722 - DNA, 22 bp, Homo sapiens
aaatcagaaaatatggagagga

SEQ ID NO: 9001723 - DNA, 22 bp, Homo sapiens
aaatcagaaaatatggagagga

SEQ ID NO: 9001724 - DNA, 22 bp, Homo sapiens
aaatcagaaaatatggagagga

SEQ ID NO: 9001725 - DNA, 22 bp, Homo sapiens
aaatcagaaaatatggagagga

SEQ ID NO: 9001726 - DNA, 22 bp, Homo sapiens
aaatcacttaaatggcttattt

SEQ ID NO: 9001727 - DNA, 22 bp, Homo sapiens
aaatcagaaaatatggagagga

SEQ ID NO: 9001728 - DNA, 22 bp, Homo sapiens
aaatcactgttattgatcttaa

SEQ ID NO: 9001729 - DNA, 22 bp, Homo sapiens
aaatcactgttattgatcttaa

SEQ ID NO: 9001730 - DNA, 21 bp, Homo sapiens
aaatcactgtccaatcttggt

SEQ ID NO: 9001731 - DNA, 22 bp, Homo sapiens
aaatcactgattaaagttagaa

SEQ ID NO: 9001732 - DNA, 22 bp, Homo sapiens
aaatcactgattaaagttagaa

SEQ ID NO: 9001733 - DNA, 17 bp, Homo sapiens
aaatcactgtcagttca

SEQ ID NO: 9001734 - DNA, 22 bp, Homo sapiens
aaatcactgattaaagttagaa

SEQ ID NO: 9001735 - DNA, 23 bp, Homo sapiens
aaatattcttttttagtaagtgc

SEQ ID NO: 9001736 - DNA, 23 bp, Homo sapiens
aaatattcttttttagtaagtgc

SEQ ID NO: 9001737 - DNA, 23 bp, Homo sapiens
aaatattcttttttagtaagtgc

SEQ ID NO: 9001738 - DNA, 23 bp, Homo sapiens
aaatattcttttttagtaagtgc

SEQ ID NO: 9001739 - DNA, 23 bp, Homo sapiens
aaatattcttttttagtaagtgc

SEQ ID NO: 9001740 - DNA, 22 bp, Homo sapiens
aaatattggtaggatgcttgtt

SEQ ID NO: 9001741 - DNA, 22 bp, Homo sapiens
aaatattggtaggatgcttgtt

SEQ ID NO: 9001742 - DNA, 22 bp, Homo sapiens
aaatattgttttggtaagcttc

SEQ ID NO: 9001743 - DNA, 22 bp, Homo sapiens
aaatattgttttggtaagcttc

SEQ ID NO: 9001744 - DNA, 22 bp, Homo sapiens
aaatatttgtctgaggcggttg

SEQ ID NO: 9001745 - DNA, 22 bp, Homo sapiens
aaatcaaaagacatgtgtttta

SEQ ID NO: 9001746 - DNA, 22 bp, Homo sapiens
aaatatttgtctgaggcggttg

SEQ ID NO: 9001747 - DNA, 22 bp, Homo sapiens
aaatatttgtctgaggcggttg

SEQ ID NO: 9001748 - DNA, 22 bp, Homo sapiens
aaatcaaaagacatgtgtttta

SEQ ID NO: 9001749 - DNA, 22 bp, Homo sapiens
aaatcaaaagacatgtgtttta

SEQ ID NO: 9001750 - DNA, 22 bp, Homo sapiens
aaatcaaaagacatgtgtttta

SEQ ID NO: 9001751 - DNA, 22 bp, Homo sapiens
aaatcaaaagacatgtgtttta

SEQ ID NO: 9001752 - DNA, 19 bp, Homo sapiens
aaatcagaatctgcatttt

SEQ ID NO: 9001753 - DNA, 22 bp, Homo sapiens
aaatcagacacagtgaaagtta

SEQ ID NO: 9001754 - DNA, 22 bp, Homo sapiens
aaatcagaggcaacaactactt

SEQ ID NO: 9001755 - DNA, 22 bp, Homo sapiens
aaatcagaggtcagctgtacca

SEQ ID NO: 9001756 - DNA, 22 bp, Homo sapiens
aaatcagacttgaattttcatc

SEQ ID NO: 9001757 - DNA, 22 bp, Homo sapiens
aaatcagacttgaattttcatc

SEQ ID NO: 9001758 - DNA, 22 bp, Homo sapiens
aaatctttccctttactatcca

SEQ ID NO: 9001759 - DNA, 22 bp, Homo sapiens
aaatcagagtctgattttaagg

SEQ ID NO: 9001760 - DNA, 22 bp, Homo sapiens
aaatcagagtctgattttaagg

SEQ ID NO: 9001761 - DNA, 22 bp, Homo sapiens
aaatcagagtctgattttaagg

SEQ ID NO: 9001762 - DNA, 22 bp, Homo sapiens
aaatcagagtagaattgagcca

SEQ ID NO: 9001763 - DNA, 22 bp, Homo sapiens
aaatcagagtagaattgagcca

SEQ ID NO: 9001764 - DNA, 22 bp, Homo sapiens
aaatcagagtagaattgagcca

SEQ ID NO: 9001765 - DNA, 22 bp, Homo sapiens
aaatgaacatcaagaatagcct

SEQ ID NO: 9001766 - DNA, 23 bp, Homo sapiens
aaatgacatatggtttctgaagg

SEQ ID NO: 9001767 - DNA, 22 bp, Homo sapiens
aaatgaacatcaagaatagcct

SEQ ID NO: 9001768 - DNA, 22 bp, Homo sapiens
aaatgaacagttgcattctctg

SEQ ID NO: 9001769 - DNA, 22 bp, Homo sapiens
aaatgaaatgagtgcctggagg

SEQ ID NO: 9001770 - DNA, 22 bp, Homo sapiens
aaatgaaatgagtgcctggagg

SEQ ID NO: 9001771 - DNA, 23 bp, Homo sapiens
aaatgacatatggtttctgaagg

SEQ ID NO: 9001772 - DNA, 23 bp, Homo sapiens
aaatgacatatggtttctgaagg

SEQ ID NO: 9001773 - DNA, 22 bp, Homo sapiens
aaatgacattaggatcctgcat

SEQ ID NO: 9001774 - DNA, 23 bp, Homo sapiens
aaatgacatatggtttctgaagg

SEQ ID NO: 9001775 - DNA, 23 bp, Homo sapiens
aaatgactaaatgttcttataga

SEQ ID NO: 9001776 - DNA, 23 bp, Homo sapiens
aaatgactaaatgttcttataga

SEQ ID NO: 9001777 - DNA, 22 bp, Homo sapiens
aaatgaggttaatacagtgctt

SEQ ID NO: 9001778 - DNA, 22 bp, Homo sapiens
aaatgaggccagatcatgcaga

SEQ ID NO: 9001779 - DNA, 23 bp, Homo sapiens
aaatgactaaatgttcttataga

SEQ ID NO: 9001780 - DNA, 22 bp, Homo sapiens
aaatgaggccagatcatgcaga

SEQ ID NO: 9001781 - DNA, 22 bp, Homo sapiens
aaatgatgattaaaatgaggta

SEQ ID NO: 9001782 - DNA, 22 bp, Homo sapiens
aaatgatgattaaaatgaggta

SEQ ID NO: 9001783 - DNA, 22 bp, Homo sapiens
aaatgatcatgtaatttcagaa

SEQ ID NO: 9001784 - DNA, 22 bp, Homo sapiens
aaatgatagtatggaactagga

SEQ ID NO: 9001785 - DNA, 22 bp, Homo sapiens
aaatgatagtatggaactagga

SEQ ID NO: 9001786 - DNA, 22 bp, Homo sapiens
aaatgatagtatggaactagga

SEQ ID NO: 9001787 - DNA, 22 bp, Homo sapiens
aaatgatagtatggaactagga

SEQ ID NO: 9001788 - DNA, 22 bp, Homo sapiens
aaatgatagtatggaactagga

SEQ ID NO: 9001789 - DNA, 22 bp, Homo sapiens
aaatgatcatgtaatttcagaa

SEQ ID NO: 9001790 - DNA, 22 bp, Homo sapiens
aaatgatagtatggaactagga

SEQ ID NO: 9001791 - DNA, 22 bp, Homo sapiens
aaatgatagtatggaactagga

SEQ ID NO: 9001792 - DNA, 22 bp, Homo sapiens
aaatgagtttcctcaatgtcct

SEQ ID NO: 9001793 - DNA, 22 bp, Homo sapiens
aaatgagtagcgatgcacatta

SEQ ID NO: 9001794 - DNA, 22 bp, Homo sapiens
aaatgagtagcgatgcacatta

SEQ ID NO: 9001795 - DNA, 22 bp, Homo sapiens
aaatgagtttgcctctagatag

SEQ ID NO: 9001796 - DNA, 22 bp, Homo sapiens
aaatgagtttcctcaatgtcct

SEQ ID NO: 9001797 - DNA, 22 bp, Homo sapiens
aaatacaggagtttggacttct

SEQ ID NO: 9001798 - DNA, 22 bp, Homo sapiens
aaatacagattctgactcagag

SEQ ID NO: 9001799 - DNA, 22 bp, Homo sapiens
aaatacagcagactcctgttgt

SEQ ID NO: 9001800 - DNA, 22 bp, Homo sapiens
aagaaggcttcagagcccagga

SEQ ID NO: 9001801 - DNA, 22 bp, Homo sapiens
aagaaggtgtggaaagatgctc

SEQ ID NO: 9001802 - DNA, 22 bp, Homo sapiens
aagaagtggtccttttctttct

SEQ ID NO: 9001803 - DNA, 22 bp, Homo sapiens
aagaagtggtccttttctttct

SEQ ID NO: 9001804 - DNA, 22 bp, Homo sapiens
aagaagtggttggaagaagcat

SEQ ID NO: 9001805 - DNA, 22 bp, Homo sapiens
aagaagtggttggaagaagcat

SEQ ID NO: 9001806 - DNA, 22 bp, Homo sapiens
aaatacaaaaattagccaggca

SEQ ID NO: 9001807 - DNA, 22 bp, Homo sapiens
aaatacaaaaattagccaggca

SEQ ID NO: 9001808 - DNA, 22 bp, Homo sapiens
aagaagttaaataaatggacca

SEQ ID NO: 9001809 - DNA, 22 bp, Homo sapiens
aaatacaaaaattagccaggca

SEQ ID NO: 9001810 - DNA, 22 bp, Homo sapiens
aagaagttaaataaatggacca

SEQ ID NO: 9001811 - DNA, 22 bp, Homo sapiens
aagaagtggttggaagaagcat

SEQ ID NO: 9001812 - DNA, 22 bp, Homo sapiens
aagaagttaaataaatggacca

SEQ ID NO: 9001813 - DNA, 22 bp, Homo sapiens
aaatacaaaaattagccaggca

SEQ ID NO: 9001814 - DNA, 22 bp, Homo sapiens
aaatacataaaggttgtaccag

SEQ ID NO: 9001815 - DNA, 22 bp, Homo sapiens
aaatacataaaggttgtaccag

SEQ ID NO: 9001816 - DNA, 22 bp, Homo sapiens
aaatacagtggcagcagataat

SEQ ID NO: 9001817 - DNA, 22 bp, Homo sapiens
aaatacagtggcagcagataat

SEQ ID NO: 9001818 - DNA, 22 bp, Homo sapiens
aaatacagtggcagcagataat

SEQ ID NO: 9001819 - DNA, 22 bp, Homo sapiens
aaatacagtggcagcagataat

SEQ ID NO: 9001820 - DNA, 22 bp, Homo sapiens
aaatacagtggcagcagataat

SEQ ID NO: 9001821 - DNA, 22 bp, Homo sapiens
aaatacagtggcagcagataat

SEQ ID NO: 9001822 - DNA, 22 bp, Homo sapiens
aaatacagtgtgtgttctttga

SEQ ID NO: 9001823 - DNA, 22 bp, Homo sapiens
aaatacatacactgtacgtggc

SEQ ID NO: 9001824 - DNA, 22 bp, Homo sapiens
aaatacatacactgtacgtggc

SEQ ID NO: 9001825 - DNA, 22 bp, Homo sapiens
aaatacatacactgtacgtggc

SEQ ID NO: 9001826 - DNA, 22 bp, Homo sapiens
aaatacataaaggttgtaccag

SEQ ID NO: 9001827 - DNA, 22 bp, Homo sapiens
aaatacataaaggttgtaccag

SEQ ID NO: 9001828 - DNA, 22 bp, Homo sapiens
aaatacataaaggttgtaccag

SEQ ID NO: 9001829 - DNA, 22 bp, Homo sapiens
aaatacatacactgtacgtggc

SEQ ID NO: 9001830 - DNA, 22 bp, Homo sapiens
aagagagaagtctctctggttc

SEQ ID NO: 9001831 - DNA, 22 bp, Homo sapiens
aagaagcaggtcacagacaggg

SEQ ID NO: 9001832 - DNA, 22 bp, Homo sapiens
aagaagcaggtcacagacaggg

SEQ ID NO: 9001833 - DNA, 22 bp, Homo sapiens
aagaagcaggtcacagacaggg

SEQ ID NO: 9001834 - DNA, 22 bp, Homo sapiens
aagaagcagctgccaggccagt

SEQ ID NO: 9001835 - DNA, 22 bp, Homo sapiens
aagaagcaggtcacagacaggg

SEQ ID NO: 9001836 - DNA, 22 bp, Homo sapiens
aagaagcaggtcacagacaggg

SEQ ID NO: 9001837 - DNA, 22 bp, Homo sapiens
aagaagctaagactatctgggt

SEQ ID NO: 9001838 - DNA, 20 bp, Homo sapiens
aagaagccgggaaggcaggc

SEQ ID NO: 9001839 - DNA, 22 bp, Homo sapiens
aagaagcattctttcattggtt

SEQ ID NO: 9001840 - DNA, 22 bp, Homo sapiens
aagaagcatggctgtagattcc

SEQ ID NO: 9001841 - DNA, 22 bp, Homo sapiens
aagaagcatggctgtagattcc

SEQ ID NO: 9001842 - DNA, 22 bp, Homo sapiens
aagaagcatggctgtagattcc

SEQ ID NO: 9001843 - DNA, 22 bp, Homo sapiens
aagaaggcggaccagaagggag

SEQ ID NO: 9001844 - DNA, 22 bp, Homo sapiens
aagaaggaagtgtggacatcac

SEQ ID NO: 9001845 - DNA, 22 bp, Homo sapiens
aagaagctgtagggattaactc

SEQ ID NO: 9001846 - DNA, 22 bp, Homo sapiens
aagaagctatacataatttggg

SEQ ID NO: 9001847 - DNA, 22 bp, Homo sapiens
aagaagctgcgtggtatgtgaa

SEQ ID NO: 9001848 - DNA, 22 bp, Homo sapiens
aagaagctgtagggattaactc

SEQ ID NO: 9001849 - DNA, 22 bp, Homo sapiens
aagaagctgcgtggtatgtgaa

SEQ ID NO: 9001850 - DNA, 22 bp, Homo sapiens
aagaagctatacataatttggg

SEQ ID NO: 9001851 - DNA, 22 bp, Homo sapiens
aagaagctatacataatttggg

SEQ ID NO: 9001852 - DNA, 22 bp, Homo sapiens
aaagttgagtgctgatctgatt

SEQ ID NO: 9001853 - DNA, 19 bp, Homo sapiens
aaagttgagaaacaatgga

SEQ ID NO: 9001854 - DNA, 19 bp, Homo sapiens
aaagttgagaaacaatgga

SEQ ID NO: 9001855 - DNA, 22 bp, Homo sapiens
aaagttgataaggtatcgtagt

SEQ ID NO: 9001856 - DNA, 22 bp, Homo sapiens
aaagttgagttttatgtgttac

SEQ ID NO: 9001857 - DNA, 22 bp, Homo sapiens
aaagttgaccgaaagattttga

SEQ ID NO: 9001858 - DNA, 22 bp, Homo sapiens
aaagttgactactaaggaatgt

SEQ ID NO: 9001859 - DNA, 22 bp, Homo sapiens
aaagttctttttctataaatcc

SEQ ID NO: 9001860 - DNA, 22 bp, Homo sapiens
aaagttctttttctataaatcc

SEQ ID NO: 9001861 - DNA, 22 bp, Homo sapiens
aaagttctttgcatctttgctc

SEQ ID NO: 9001862 - DNA, 22 bp, Homo sapiens
aaagttctttgcatctttgctc

SEQ ID NO: 9001863 - DNA, 22 bp, Homo sapiens
aaagttgatttggagggatatt

SEQ ID NO: 9001864 - DNA, 23 bp, Homo sapiens
aaagttgatttgcagtttaagag

SEQ ID NO: 9001865 - DNA, 22 bp, Homo sapiens
aaagttgctgtcctagctggct

SEQ ID NO: 9001866 - DNA, 22 bp, Homo sapiens
aagaagcagctgccaggccagt

SEQ ID NO: 9001867 - DNA, 22 bp, Homo sapiens
aaagttgttcagtaagaaactc

SEQ ID NO: 9001868 - DNA, 22 bp, Homo sapiens
aaagttgttcagtaagaaactc

SEQ ID NO: 9001869 - DNA, 22 bp, Homo sapiens
aagaagcagagctgtgggtgtt

SEQ ID NO: 9001870 - DNA, 22 bp, Homo sapiens
aaagttgtaatggaagaaatgc

SEQ ID NO: 9001871 - DNA, 22 bp, Homo sapiens
aaagttgtaatggaagaaatgc

SEQ ID NO: 9001872 - DNA, 22 bp, Homo sapiens
aaagttgtgaaaccgaacatgt

SEQ ID NO: 9001873 - DNA, 22 bp, Homo sapiens
aaagttgttcagtaagaaactc

SEQ ID NO: 9001874 - DNA, 22 bp, Homo sapiens
aaagttgtggtttgatgcagtt

SEQ ID NO: 9001875 - DNA, 22 bp, Homo sapiens
aaatatagcaattatgcctact

SEQ ID NO: 9001876 - DNA, 22 bp, Homo sapiens
aaatatagcaattatgcctact

SEQ ID NO: 9001877 - DNA, 22 bp, Homo sapiens
aaatatagtaaatgcatagttc

SEQ ID NO: 9001878 - DNA, 22 bp, Homo sapiens
aaatatagtaaatgcatagttc

SEQ ID NO: 9001879 - DNA, 22 bp, Homo sapiens
aaatatagtaaatgcatagttc

SEQ ID NO: 9001880 - DNA, 22 bp, Homo sapiens
aaatatacggtccctaacagtc

SEQ ID NO: 9001881 - DNA, 22 bp, Homo sapiens
aaatatactagatgatgaccca

SEQ ID NO: 9001882 - DNA, 22 bp, Homo sapiens
aaatatacggtccctaacagtc

SEQ ID NO: 9001883 - DNA, 22 bp, Homo sapiens
aaatatacggtccctaacagtc

SEQ ID NO: 9001884 - DNA, 22 bp, Homo sapiens
aaatatactagatgatgaccca

SEQ ID NO: 9001885 - DNA, 22 bp, Homo sapiens
aaatatactagatgatgaccca

SEQ ID NO: 9001886 - DNA, 22 bp, Homo sapiens
aaatatacggtccctaacagtc

SEQ ID NO: 9001887 - DNA, 22 bp, Homo sapiens
aaatatacggtccctaacagtc

SEQ ID NO: 9001888 - DNA, 22 bp, Homo sapiens
aaatatacggtccctaacagtc

SEQ ID NO: 9001889 - DNA, 22 bp, Homo sapiens
aaatataccagttgcctgcatc

SEQ ID NO: 9001890 - DNA, 22 bp, Homo sapiens
aaatataccagttgcctgcatc

SEQ ID NO: 9001891 - DNA, 22 bp, Homo sapiens
aaatataatttctgcctcaata

SEQ ID NO: 9001892 - DNA, 22 bp, Homo sapiens
aaatataatttctgcctcaata

SEQ ID NO: 9001893 - DNA, 22 bp, Homo sapiens
aagagagagttcctaggcaaaa

SEQ ID NO: 9001894 - DNA, 22 bp, Homo sapiens
aaatagtaaagtggtagccatc

SEQ ID NO: 9001895 - DNA, 22 bp, Homo sapiens
aaatagtaaagtggtagccatc

SEQ ID NO: 9001896 - DNA, 22 bp, Homo sapiens
aaatataatttctgcctcaata

SEQ ID NO: 9001897 - DNA, 22 bp, Homo sapiens
aaatataatttctgcctcaata

SEQ ID NO: 9001898 - DNA, 22 bp, Homo sapiens
aaatataatttctgcctcaata

SEQ ID NO: 9001899 - DNA, 22 bp, Homo sapiens
aaatagtcctgggaatagtact

SEQ ID NO: 9001900 - DNA, 22 bp, Homo sapiens
aagagagagttcctaggcaaaa

SEQ ID NO: 9001901 - DNA, 22 bp, Homo sapiens
aaataggggaccaggaaaggag

SEQ ID NO: 9001902 - DNA, 22 bp, Homo sapiens
aagagagagcattcttctgtta

SEQ ID NO: 9001903 - DNA, 22 bp, Homo sapiens
aagagagagcattcttctgtta

SEQ ID NO: 9001904 - DNA, 22 bp, Homo sapiens
aagagagagcattcttctgtta

SEQ ID NO: 9001905 - DNA, 22 bp, Homo sapiens
aagagagacaataggtagcatt

SEQ ID NO: 9001906 - DNA, 22 bp, Homo sapiens
aagagagacaataggtagcatt

SEQ ID NO: 9001907 - DNA, 22 bp, Homo sapiens
aagagagacaataggtagcatt

SEQ ID NO: 9001908 - DNA, 22 bp, Homo sapiens
aagagagaagtctctctggttc

SEQ ID NO: 9001909 - DNA, 22 bp, Homo sapiens
aagagagacaataggtagcatt

SEQ ID NO: 9001910 - DNA, 22 bp, Homo sapiens
aagagagaagtctctctggttc

SEQ ID NO: 9001911 - DNA, 22 bp, Homo sapiens
aagagagacaataggtagcatt

SEQ ID NO: 9001912 - DNA, 22 bp, Homo sapiens
aaatatgagatgttctctttcg

SEQ ID NO: 9001913 - DNA, 22 bp, Homo sapiens
aaatatgagagtaggagtttgg

SEQ ID NO: 9001914 - DNA, 22 bp, Homo sapiens
aaatatgagatgttctctttcg

SEQ ID NO: 9001915 - DNA, 22 bp, Homo sapiens
aaatatgagagtaggagtttgg

SEQ ID NO: 9001916 - DNA, 22 bp, Homo sapiens
aaatatgactagaatgccaggt

SEQ ID NO: 9001917 - DNA, 22 bp, Homo sapiens
aaatatgactagaatgccaggt

SEQ ID NO: 9001918 - DNA, 22 bp, Homo sapiens
aagagtttttggagtgtgagtt

SEQ ID NO: 9001919 - DNA, 22 bp, Homo sapiens
aagataaactcttgatttctga

SEQ ID NO: 9001920 - DNA, 22 bp, Homo sapiens
aagagtttttggagtgtgagtt

SEQ ID NO: 9001921 - DNA, 22 bp, Homo sapiens
aagagttttctctgatggcatt

SEQ ID NO: 9001922 - DNA, 22 bp, Homo sapiens
aagagtttttaatgggtactgg

SEQ ID NO: 9001923 - DNA, 22 bp, Homo sapiens
aagagtttgggcaagtcataaa

SEQ ID NO: 9001924 - DNA, 22 bp, Homo sapiens
aagagtttgtcagatctgcacg

SEQ ID NO: 9001925 - DNA, 22 bp, Homo sapiens
aagagtttgacctgtgccatcc

SEQ ID NO: 9001926 - DNA, 22 bp, Homo sapiens
aagagtttctttattaaccttt

SEQ ID NO: 9001927 - DNA, 22 bp, Homo sapiens
aagagtttgtcagatctgcacg

SEQ ID NO: 9001928 - DNA, 22 bp, Homo sapiens
aagagtttgtcagatctgcacg

SEQ ID NO: 9001929 - DNA, 22 bp, Homo sapiens
aagagttttctataatcttggc

SEQ ID NO: 9001930 - DNA, 22 bp, Homo sapiens
aagagttttagacaaactgatt

SEQ ID NO: 9001931 - DNA, 22 bp, Homo sapiens
aagagttttagacaaactgatt

SEQ ID NO: 9001932 - DNA, 22 bp, Homo sapiens
aaatatagtgacacttatagtc

SEQ ID NO: 9001933 - DNA, 22 bp, Homo sapiens
aaatatagtgacacttatagtc

SEQ ID NO: 9001934 - DNA, 22 bp, Homo sapiens
aaatatagtgacacttatagtc

SEQ ID NO: 9001935 - DNA, 22 bp, Homo sapiens
aaatatagtaaatgcatagttc

SEQ ID NO: 9001936 - DNA, 22 bp, Homo sapiens
aaatatagtaaatgcatagttc

SEQ ID NO: 9001937 - DNA, 22 bp, Homo sapiens
aaatatagtaaatgcatagttc

SEQ ID NO: 9001938 - DNA, 22 bp, Homo sapiens
aaatatagtgacacttatagtc

SEQ ID NO: 9001939 - DNA, 22 bp, Homo sapiens
aaatatagtgacacttatagtc

SEQ ID NO: 9001940 - DNA, 19 bp, Homo sapiens
aaatatcagagagatgata

SEQ ID NO: 9001941 - DNA, 22 bp, Homo sapiens
aaatatagtgacacttatagtc

SEQ ID NO: 9001942 - DNA, 22 bp, Homo sapiens
aaatatagtgacacttatagtc

SEQ ID NO: 9001943 - DNA, 22 bp, Homo sapiens
aaatatagtgacacttatagtc

SEQ ID NO: 9001944 - DNA, 22 bp, Homo sapiens
aaatatagtgacacttatagtc

SEQ ID NO: 9001945 - DNA, 22 bp, Homo sapiens
aagagtttccatgctctgtgct

SEQ ID NO: 9001946 - DNA, 22 bp, Homo sapiens
aagagtttccatgctctgtgct

SEQ ID NO: 9001947 - DNA, 19 bp, Homo sapiens
aaatatcagagagatgata

SEQ ID NO: 9001948 - DNA, 19 bp, Homo sapiens
aaatatcagagagatgata

SEQ ID NO: 9001949 - DNA, 22 bp, Homo sapiens
aagagtttctgattcagtaggt

SEQ ID NO: 9001950 - DNA, 22 bp, Homo sapiens
aagagtttcttactggcatcta

SEQ ID NO: 9001951 - DNA, 22 bp, Homo sapiens
aagagtttctgggtcaaggatt

SEQ ID NO: 9001952 - DNA, 22 bp, Homo sapiens
aagagtttctttattaaccttt

SEQ ID NO: 9001953 - DNA, 22 bp, Homo sapiens
cagccttttcttaaaatgcaag

SEQ ID NO: 9001954 - DNA, 22 bp, Homo sapiens
cagcctttgtgaacatcaggtg

SEQ ID NO: 9001955 - DNA, 22 bp, Homo sapiens
cagcctttgtgaacatcaggtg

SEQ ID NO: 9001956 - DNA, 22 bp, Homo sapiens
cagcgaggtgaagggtacaagc

SEQ ID NO: 9001957 - DNA, 22 bp, Homo sapiens
cagcgaggtgaagggtacaagc

SEQ ID NO: 9001958 - DNA, 22 bp, Homo sapiens
cagcgagagacaaagagctgtg

SEQ ID NO: 9001959 - DNA, 22 bp, Homo sapiens
cagcgcaggcgtgtgaaggcgc

SEQ ID NO: 9001960 - DNA, 22 bp, Homo sapiens
cagcgctggggtaggagcacct

SEQ ID NO: 9001961 - DNA, 22 bp, Homo sapiens
cagcgctgtgggaacagggcta

SEQ ID NO: 9001962 - DNA, 22 bp, Homo sapiens
cagcggaggacagatgggagct

SEQ ID NO: 9001963 - DNA, 22 bp, Homo sapiens
cagcggaggacagatgggagct

SEQ ID NO: 9001964 - DNA, 22 bp, Homo sapiens
cagcggaggacagatgggagct

SEQ ID NO: 9001965 - DNA, 22 bp, Homo sapiens
cagcggccggtgaggaagggga

SEQ ID NO: 9001966 - DNA, 22 bp, Homo sapiens
cagctgagagtagaaatggagg

SEQ ID NO: 9001967 - DNA, 22 bp, Homo sapiens
cagcgtctcgttgtgggcctcg

SEQ ID NO: 9001968 - DNA, 22 bp, Homo sapiens
cagcggtggcaaggtgactgtg

SEQ ID NO: 9001969 - DNA, 22 bp, Homo sapiens
cagcctctgtggctgccacacc

SEQ ID NO: 9001970 - DNA, 22 bp, Homo sapiens
cagcctctgtggctgccacacc

SEQ ID NO: 9001971 - DNA, 22 bp, Homo sapiens
cagcctctgtggctgccacacc

SEQ ID NO: 9001972 - DNA, 18 bp, Homo sapiens
cagcctctgattggttgc

SEQ ID NO: 9001973 - DNA, 22 bp, Homo sapiens
cagcctctgtggctgccacacc

SEQ ID NO: 9001974 - DNA, 22 bp, Homo sapiens
cagcctctgagccttggcagat

SEQ ID NO: 9001975 - DNA, 22 bp, Homo sapiens
cagcctctgagccttggcagat

SEQ ID NO: 9001976 - DNA, 22 bp, Homo sapiens
cagcctctgagccttggcagat

SEQ ID NO: 9001977 - DNA, 22 bp, Homo sapiens
cagcctctctgtatctcaggat

SEQ ID NO: 9001978 - DNA, 22 bp, Homo sapiens
cagcctctctgtatctcaggat

SEQ ID NO: 9001979 - DNA, 22 bp, Homo sapiens
cagcctctgacaccacagtcgt

SEQ ID NO: 9001980 - DNA, 22 bp, Homo sapiens
cagcctctctgtatctcaggat

SEQ ID NO: 9001981 - DNA, 22 bp, Homo sapiens
cagcctctgacaccacagtcgt

SEQ ID NO: 9001982 - DNA, 22 bp, Homo sapiens
cagcctctgacaccacagtcgt

SEQ ID NO: 9001983 - DNA, 22 bp, Homo sapiens
cagcctctgacaccacagtcgt

SEQ ID NO: 9001984 - DNA, 22 bp, Homo sapiens
cagcctctgacaccacagtcgt

SEQ ID NO: 9001985 - DNA, 22 bp, Homo sapiens
cagcctcttgcactttgaaggc

SEQ ID NO: 9001986 - DNA, 22 bp, Homo sapiens
cagccttcgacagttggagtag

SEQ ID NO: 9001987 - DNA, 22 bp, Homo sapiens
cagcctttatggaaaggcctgg

SEQ ID NO: 9001988 - DNA, 22 bp, Homo sapiens
cagcctttctgtttcctaaggt

SEQ ID NO: 9001989 - DNA, 22 bp, Homo sapiens
cagcctttctgtttcctaaggt

SEQ ID NO: 9001990 - DNA, 22 bp, Homo sapiens
cagcctttagcattaattccaa

SEQ ID NO: 9001991 - DNA, 22 bp, Homo sapiens
cagctgcccatcctgggaaatg

SEQ ID NO: 9001992 - DNA, 22 bp, Homo sapiens
cagctgcccatcctgggaaatg

SEQ ID NO: 9001993 - DNA, 22 bp, Homo sapiens
cagctgccccataaatcacagt

SEQ ID NO: 9001994 - DNA, 22 bp, Homo sapiens
cagctgccccataaatcacagt

SEQ ID NO: 9001995 - DNA, 22 bp, Homo sapiens
cagctgccccgctggctgacca

SEQ ID NO: 9001996 - DNA, 22 bp, Homo sapiens
cagctgcccatcctgggaaatg

SEQ ID NO: 9001997 - DNA, 22 bp, Homo sapiens
cagctgcccaggccacctggag

SEQ ID NO: 9001998 - DNA, 22 bp, Homo sapiens
cagctgccccgctggctgacca

SEQ ID NO: 9001999 - DNA, 22 bp, Homo sapiens
cagctgcccctccagggctggg

SEQ ID NO: 9002000 - DNA, 22 bp, Homo sapiens
cagctgccccgctggctgacca

SEQ ID NO: 9002001 - DNA, 22 bp, Homo sapiens
cagctgccccgctggctgacca

SEQ ID NO: 9002002 - DNA, 22 bp, Homo sapiens
agctctggagccggaggatttc

SEQ ID NO: 9002003 - DNA, 22 bp, Homo sapiens
agctctggagccggaggatttc

SEQ ID NO: 9002004 - DNA, 21 bp, Homo sapiens
agctctggagcagcaatcaag

SEQ ID NO: 9002005 - DNA, 21 bp, Homo sapiens
agctctggagcagcaatcaag

SEQ ID NO: 9002006 - DNA, 21 bp, Homo sapiens
agctctggagcagcaatcaag

SEQ ID NO: 9002007 - DNA, 22 bp, Homo sapiens
agctctggaataatgatgtgat

SEQ ID NO: 9002008 - DNA, 22 bp, Homo sapiens
agctctggaataatgatgtgat

SEQ ID NO: 9002009 - DNA, 22 bp, Homo sapiens
agctctggacctgacatctggt

SEQ ID NO: 9002010 - DNA, 21 bp, Homo sapiens
agctctggagcagcaatcaag

SEQ ID NO: 9002011 - DNA, 22 bp, Homo sapiens
cagctgccagcttctctccatc

SEQ ID NO: 9002012 - DNA, 22 bp, Homo sapiens
cagctgccagcttctctccatc

SEQ ID NO: 9002013 - DNA, 22 bp, Homo sapiens
cagctgccagcttctctccatc

SEQ ID NO: 9002014 - DNA, 22 bp, Homo sapiens
cagctgccatgacatgtcctgc

SEQ ID NO: 9002015 - DNA, 22 bp, Homo sapiens
cagctgccagcttctctccatc

SEQ ID NO: 9002016 - DNA, 22 bp, Homo sapiens
cagctgccatgacatgtcctgc

SEQ ID NO: 9002017 - DNA, 22 bp, Homo sapiens
cagctgccatgacatgtcctgc

SEQ ID NO: 9002018 - DNA, 22 bp, Homo sapiens
cagctgccatgacatgtcctgc

SEQ ID NO: 9002019 - DNA, 22 bp, Homo sapiens
cagctgcccaggccacctggag

SEQ ID NO: 9002020 - DNA, 22 bp, Homo sapiens
cagctgcccaggccacctggag

SEQ ID NO: 9002021 - DNA, 22 bp, Homo sapiens
cagctgcccaggccacctggag

SEQ ID NO: 9002022 - DNA, 22 bp, Homo sapiens
cagctgcccaagccccagatgt

SEQ ID NO: 9002023 - DNA, 22 bp, Homo sapiens
cagctgcccaagccccagatgt

SEQ ID NO: 9002024 - DNA, 22 bp, Homo sapiens
cagctgcccaagccccagatgt

SEQ ID NO: 9002025 - DNA, 22 bp, Homo sapiens
cagctgagagtagaaatggagg

SEQ ID NO: 9002026 - DNA, 22 bp, Homo sapiens
cagctgccacttgctctcggct

SEQ ID NO: 9002027 - DNA, 18 bp, Homo sapiens
cagctgccagctcatgga

SEQ ID NO: 9002028 - DNA, 18 bp, Homo sapiens
cagctgccagctcatgga

SEQ ID NO: 9002029 - DNA, 18 bp, Homo sapiens
cagctgccagctcatgga

SEQ ID NO: 9002030 - DNA, 18 bp, Homo sapiens
cagctgccagctcatgga

SEQ ID NO: 9002031 - DNA, 18 bp, Homo sapiens
cagctgccagctcatgga

SEQ ID NO: 9002032 - DNA, 18 bp, Homo sapiens
cagctgccagctcatgga

SEQ ID NO: 9002033 - DNA, 22 bp, Homo sapiens
cagctgccagcttctctccatc

SEQ ID NO: 9002034 - DNA, 22 bp, Homo sapiens
cagctgccagcttctctccatc

SEQ ID NO: 9002035 - DNA, 22 bp, Homo sapiens
agctgaggacgtgaagggcggc

SEQ ID NO: 9002036 - DNA, 22 bp, Homo sapiens
agctgaggacgtgaagggcggc

SEQ ID NO: 9002037 - DNA, 22 bp, Homo sapiens
agctgaggaataataacaaggt

SEQ ID NO: 9002038 - DNA, 22 bp, Homo sapiens
agctgaggaggaatgatgggta

SEQ ID NO: 9002039 - DNA, 22 bp, Homo sapiens
agctgaggaggaatgatgggta

SEQ ID NO: 9002040 - DNA, 22 bp, Homo sapiens
agctgaggaggaatgatgggta

SEQ ID NO: 9002041 - DNA, 22 bp, Homo sapiens
agctgaggaggaatgatgggta

SEQ ID NO: 9002042 - DNA, 22 bp, Homo sapiens
agctgaggaggaatgatgggta

SEQ ID NO: 9002043 - DNA, 22 bp, Homo sapiens
agctgaggaggaatgatgggta

SEQ ID NO: 9002044 - DNA, 21 bp, Homo sapiens
agctgagcccagaagactggt

SEQ ID NO: 9002045 - DNA, 21 bp, Homo sapiens
agctgagcccagaagactggt

SEQ ID NO: 9002046 - DNA, 22 bp, Homo sapiens
agctgagctcaggctgatgtaa

SEQ ID NO: 9002047 - DNA, 22 bp, Homo sapiens
agctgagctagtagttccagtg

SEQ ID NO: 9002048 - DNA, 17 bp, Homo sapiens
agctgagctggccaggg

SEQ ID NO: 9002049 - DNA, 17 bp, Homo sapiens
agctgagctggccaggg

SEQ ID NO: 9002050 - DNA, 22 bp, Homo sapiens
agctgagctgcagatgactgta

SEQ ID NO: 9002051 - DNA, 17 bp, Homo sapiens
agctgagctggccaggg

SEQ ID NO: 9002052 - DNA, 20 bp, Homo sapiens
agctgaagatctggatgggg

SEQ ID NO: 9002053 - DNA, 22 bp, Homo sapiens
agctgagccagcagcaacagga

SEQ ID NO: 9002054 - DNA, 22 bp, Homo sapiens
agctgagcatttgatccacctc

SEQ ID NO: 9002055 - DNA, 22 bp, Homo sapiens
agctctgggagtagttccacct

SEQ ID NO: 9002056 - DNA, 22 bp, Homo sapiens
agctctgggagtagttccacct

SEQ ID NO: 9002057 - DNA, 22 bp, Homo sapiens
agctctgggagtagttccacct

SEQ ID NO: 9002058 - DNA, 22 bp, Homo sapiens
agctctgggagtagttccacct

SEQ ID NO: 9002059 - DNA, 22 bp, Homo sapiens
agctctgggagtagttccacct

SEQ ID NO: 9002060 - DNA, 22 bp, Homo sapiens
agctctgggattctcaggccac

SEQ ID NO: 9002061 - DNA, 22 bp, Homo sapiens
agctctggcactggcgcgggat

SEQ ID NO: 9002062 - DNA, 22 bp, Homo sapiens
agctctggcactggcgcgggat

SEQ ID NO: 9002063 - DNA, 23 bp, Homo sapiens
agctctggcgttggggaggtagt

SEQ ID NO: 9002064 - DNA, 18 bp, Homo sapiens
agctctggcatacttgaa

SEQ ID NO: 9002065 - DNA, 23 bp, Homo sapiens
agctctggcgttggggaggtagt

SEQ ID NO: 9002066 - DNA, 22 bp, Homo sapiens
agctctggctaagctgataaat

SEQ ID NO: 9002067 - DNA, 22 bp, Homo sapiens
agctctgggagtagttccacct

SEQ ID NO: 9002068 - DNA, 22 bp, Homo sapiens
cagctgctttcagcaggaggga

SEQ ID NO: 9002069 - DNA, 22 bp, Homo sapiens
cagctgctttcagcaggaggga

SEQ ID NO: 9002070 - DNA, 22 bp, Homo sapiens
cagctgctttagttttccatcc

SEQ ID NO: 9002071 - DNA, 22 bp, Homo sapiens
cagctgctttcagcaggaggga

SEQ ID NO: 9002072 - DNA, 20 bp, Homo sapiens
agctgaggcacctgaggtta

SEQ ID NO: 9002073 - DNA, 20 bp, Homo sapiens
agctgaggcacctgaggtta

SEQ ID NO: 9002074 - DNA, 20 bp, Homo sapiens
agctgaggcacctgaggtta

SEQ ID NO: 9002075 - DNA, 22 bp, Homo sapiens
cagctgctttagttttccatcc

SEQ ID NO: 9002076 - DNA, 22 bp, Homo sapiens
cagctggatctgcctcgagcca

SEQ ID NO: 9002077 - DNA, 22 bp, Homo sapiens
cagctggatccctgcagaactt

SEQ ID NO: 9002078 - DNA, 22 bp, Homo sapiens
cagctggacttttgatagaagt

SEQ ID NO: 9002079 - DNA, 22 bp, Homo sapiens
cagctggacttttgatagaagt

SEQ ID NO: 9002080 - DNA, 19 bp, Homo sapiens
cagctggaatcatctgagg

SEQ ID NO: 9002081 - DNA, 19 bp, Homo sapiens
cagctggaatcatctgagg

SEQ ID NO: 9002082 - DNA, 22 bp, Homo sapiens
cagctgggtggctcttctgctc

SEQ ID NO: 9002083 - DNA, 22 bp, Homo sapiens
cagctgggtggctcttctgctc

SEQ ID NO: 9002084 - DNA, 22 bp, Homo sapiens
cagctgggtgatcttgggcagg

SEQ ID NO: 9002085 - DNA, 22 bp, Homo sapiens
cagctgggtgatcttgggcagg

SEQ ID NO: 9002086 - DNA, 22 bp, Homo sapiens
cagctgggtggctcttctgctc

SEQ ID NO: 9002087 - DNA, 22 bp, Homo sapiens
cagctggcagccctggccctgc

SEQ ID NO: 9002088 - DNA, 22 bp, Homo sapiens
cagctggcagccctggccctgc

SEQ ID NO: 9002089 - DNA, 22 bp, Homo sapiens
cagctggcagccctggccctgc

SEQ ID NO: 9002090 - DNA, 22 bp, Homo sapiens
cagctggcagccctggccctgc

SEQ ID NO: 9002091 - DNA, 22 bp, Homo sapiens
cagctggcagccctggccctgc

SEQ ID NO: 9002092 - DNA, 22 bp, Homo sapiens
cagctggcatacctgggcccgg

SEQ ID NO: 9002093 - DNA, 22 bp, Homo sapiens
cagctggcatacctgggcccgg

SEQ ID NO: 9002094 - DNA, 22 bp, Homo sapiens
cagctggcatacctgggcccgg

SEQ ID NO: 9002095 - DNA, 22 bp, Homo sapiens
cagctggatgggagaccatgtt

SEQ ID NO: 9002096 - DNA, 22 bp, Homo sapiens
cagctggatgggagaccatgtt

SEQ ID NO: 9002097 - DNA, 22 bp, Homo sapiens
cagctggatgggagaccatgtt

SEQ ID NO: 9002098 - DNA, 22 bp, Homo sapiens
cagctggcaagtggagcagggt

SEQ ID NO: 9002099 - DNA, 22 bp, Homo sapiens
cagctggcaagtggagcagggt

SEQ ID NO: 9002100 - DNA, 22 bp, Homo sapiens
cagctggcaagtggagcagggt

SEQ ID NO: 9002101 - DNA, 22 bp, Homo sapiens
cagctggcaagtggagcagggt

SEQ ID NO: 9002102 - DNA, 22 bp, Homo sapiens
cagctggcagaacctgcatcca

SEQ ID NO: 9002103 - DNA, 22 bp, Homo sapiens
cagctggcagaacctgcatcca

SEQ ID NO: 9002104 - DNA, 22 bp, Homo sapiens
cagcccatttctgggacctgag

SEQ ID NO: 9002105 - DNA, 22 bp, Homo sapiens
cagcccattcctgccatgccgc

SEQ ID NO: 9002106 - DNA, 22 bp, Homo sapiens
cagccccacacggtctagctct

SEQ ID NO: 9002107 - DNA, 22 bp, Homo sapiens
cagccccacacggtctagctct

SEQ ID NO: 9002108 - DNA, 22 bp, Homo sapiens
cagccctggtgaggttggctat

SEQ ID NO: 9002109 - DNA, 22 bp, Homo sapiens
cagccctggtgaggttggctat

SEQ ID NO: 9002110 - DNA, 20 bp, Homo sapiens
cagcctccactcactcagct

SEQ ID NO: 9002111 - DNA, 22 bp, Homo sapiens
cagccctggtgaggttggctat

SEQ ID NO: 9002112 - DNA, 22 bp, Homo sapiens
cagccctggtgaggttggctat

SEQ ID NO: 9002113 - DNA, 22 bp, Homo sapiens
cagcctctaagcacagcctctc

SEQ ID NO: 9002114 - DNA, 22 bp, Homo sapiens
cagcctctaagcacagcctctc

SEQ ID NO: 9002115 - DNA, 22 bp, Homo sapiens
cagcctctaagcacagcctctc

SEQ ID NO: 9002116 - DNA, 22 bp, Homo sapiens
cagcctctaagcacagcctctc

SEQ ID NO: 9002117 - DNA, 22 bp, Homo sapiens
cagcctctctgtatctcaggat

SEQ ID NO: 9002118 - DNA, 22 bp, Homo sapiens
cagcctctctgtatctcaggat

SEQ ID NO: 9002119 - DNA, 22 bp, Homo sapiens
cagcctcctgggacactcaccg

SEQ ID NO: 9002120 - DNA, 22 bp, Homo sapiens
cagcctcctgggacactcaccg

SEQ ID NO: 9002121 - DNA, 22 bp, Homo sapiens
cagcctcctgggacactcaccg

SEQ ID NO: 9002122 - DNA, 22 bp, Homo sapiens
cagcctcctgggacactcaccg

SEQ ID NO: 9002123 - DNA, 22 bp, Homo sapiens
cagcctcctgggacactcaccg

SEQ ID NO: 9002124 - DNA, 22 bp, Homo sapiens
cagcctcctgggacactcaccg

SEQ ID NO: 9002125 - DNA, 22 bp, Homo sapiens
cagcctctaagcacagcctctc

SEQ ID NO: 9002126 - DNA, 22 bp, Homo sapiens
cagcccagtgcacgcccgtttc

SEQ ID NO: 9002127 - DNA, 22 bp, Homo sapiens
cagcccagtgcacgcccgtttc

SEQ ID NO: 9002128 - DNA, 22 bp, Homo sapiens
cagcccagtgcacgcccgtttc

SEQ ID NO: 9002129 - DNA, 22 bp, Homo sapiens
cagcccagtaccaagcagttgg

SEQ ID NO: 9002130 - DNA, 22 bp, Homo sapiens
cagcccaggtggcggaggttgc

SEQ ID NO: 9002131 - DNA, 22 bp, Homo sapiens
cagcccagtaccaagcagttgg

SEQ ID NO: 9002132 - DNA, 22 bp, Homo sapiens
cagcccagtgcatttgtgtact

SEQ ID NO: 9002133 - DNA, 22 bp, Homo sapiens
cagcccagtgcacgcccgtttc

SEQ ID NO: 9002134 - DNA, 22 bp, Homo sapiens
cagcccagtgcacgcccgtttc

SEQ ID NO: 9002135 - DNA, 22 bp, Homo sapiens
cagcccatccaaggcttggcat

SEQ ID NO: 9002136 - DNA, 22 bp, Homo sapiens
cagcccatggtttgtggccagt

SEQ ID NO: 9002137 - DNA, 22 bp, Homo sapiens
cagcccaggtctctcttccagt

SEQ ID NO: 9002138 - DNA, 22 bp, Homo sapiens
cagcccaggtctctcttccagt

SEQ ID NO: 9002139 - DNA, 19 bp, Homo sapiens
cagcccagggtgctaccaa

SEQ ID NO: 9002140 - DNA, 19 bp, Homo sapiens
cagcccagggtgctaccaa

SEQ ID NO: 9002141 - DNA, 19 bp, Homo sapiens
cagcccagggtgctaccaa

SEQ ID NO: 9002142 - DNA, 19 bp, Homo sapiens
cagcccagggtgctaccaa

SEQ ID NO: 9002143 - DNA, 22 bp, Homo sapiens
cagcccaggtctctcttccagt

SEQ ID NO: 9002144 - DNA, 22 bp, Homo sapiens
cagcccaggtctctcttccagt

SEQ ID NO: 9002145 - DNA, 22 bp, Homo sapiens
cagcccaggtctctcttccagt

SEQ ID NO: 9002146 - DNA, 22 bp, Homo sapiens
cagcccaggtctctcttccagt

SEQ ID NO: 9002147 - DNA, 22 bp, Homo sapiens
cagcccaggtctctcttccagt

SEQ ID NO: 9002148 - DNA, 22 bp, Homo sapiens
cagcccaggtctctcttccagt

SEQ ID NO: 9002149 - DNA, 22 bp, Homo sapiens
cagcccaggtctctcttccagt

SEQ ID NO: 9002150 - DNA, 22 bp, Homo sapiens
cagcccaggtggcggaggttgc

SEQ ID NO: 9002151 - DNA, 22 bp, Homo sapiens
cagcccacgtcagggccactca

SEQ ID NO: 9002152 - DNA, 22 bp, Homo sapiens
cagcccacgtcagggccactca

SEQ ID NO: 9002153 - DNA, 22 bp, Homo sapiens
cagcccactgcctctgtggtag

SEQ ID NO: 9002154 - DNA, 22 bp, Homo sapiens
cagcccacgtcagggccactca

SEQ ID NO: 9002155 - DNA, 22 bp, Homo sapiens
cagccatcagtaaagacagctt

SEQ ID NO: 9002156 - DNA, 22 bp, Homo sapiens
cagcccaaagccccaggctaga

SEQ ID NO: 9002157 - DNA, 22 bp, Homo sapiens
cagcccaaagccccaggctaga

SEQ ID NO: 9002158 - DNA, 22 bp, Homo sapiens
cagccatcagtaaagacagctt

SEQ ID NO: 9002159 - DNA, 22 bp, Homo sapiens
cagccatcccagcctgtggttc

SEQ ID NO: 9002160 - DNA, 22 bp, Homo sapiens
cagccatcagtaaagacagctt

SEQ ID NO: 9002161 - DNA, 22 bp, Homo sapiens
agcgctgtgggcgtgcgaggag

SEQ ID NO: 9002162 - DNA, 22 bp, Homo sapiens
agcgctgtgggcgtgcgaggag

SEQ ID NO: 9002163 - DNA, 22 bp, Homo sapiens
cagccagctggcactgtgagta

SEQ ID NO: 9002164 - DNA, 22 bp, Homo sapiens
agcgctgtgggcgtgcgaggag

SEQ ID NO: 9002165 - DNA, 22 bp, Homo sapiens
cagccagctggcactgtgagta

SEQ ID NO: 9002166 - DNA, 22 bp, Homo sapiens
agcggaaggcctggctgatccg

SEQ ID NO: 9002167 - DNA, 22 bp, Homo sapiens
cagccagtgtgaccgaggagga

SEQ ID NO: 9002168 - DNA, 22 bp, Homo sapiens
cagccagtggttgaagatgcag

SEQ ID NO: 9002169 - DNA, 22 bp, Homo sapiens
cagccagtgtgaccgaggagga

SEQ ID NO: 9002170 - DNA, 22 bp, Homo sapiens
cagccagctggcactgtgagta

SEQ ID NO: 9002171 - DNA, 21 bp, Homo sapiens
cagcccagagcagtggggcca

SEQ ID NO: 9002172 - DNA, 21 bp, Homo sapiens
cagcccagagcagtggggcca

SEQ ID NO: 9002173 - DNA, 21 bp, Homo sapiens
cagcccagagcagtggggcca

SEQ ID NO: 9002174 - DNA, 19 bp, Homo sapiens
cagcccagggtgctaccaa

SEQ ID NO: 9002175 - DNA, 16 bp, Homo sapiens
cagcccaggggcgggc

SEQ ID NO: 9002176 - DNA, 16 bp, Homo sapiens
cagcccaggggcgggc

SEQ ID NO: 9002177 - DNA, 22 bp, Homo sapiens
cagcccagagaaggggcccgtg

SEQ ID NO: 9002178 - DNA, 22 bp, Homo sapiens
cagcccagagaaggggcccgtg

SEQ ID NO: 9002179 - DNA, 22 bp, Homo sapiens
cagcccagagaaggggcccgtg

SEQ ID NO: 9002180 - DNA, 22 bp, Homo sapiens
cagcccagagaaggggcccgtg

SEQ ID NO: 9002181 - DNA, 22 bp, Homo sapiens
cagcccagagaaggggcccgtg

SEQ ID NO: 9002182 - DNA, 22 bp, Homo sapiens
cagcccagagaaggggcccgtg

SEQ ID NO: 9002183 - DNA, 22 bp, Homo sapiens
cagcccagaactcacgtctcca

SEQ ID NO: 9002184 - DNA, 22 bp, Homo sapiens
cagcccagaactcacgtctcca

SEQ ID NO: 9002185 - DNA, 22 bp, Homo sapiens
cagcccagaactcacgtctcca

SEQ ID NO: 9002186 - DNA, 22 bp, Homo sapiens
cagcccagaactcacgtctcca

SEQ ID NO: 9002187 - DNA, 22 bp, Homo sapiens
cagcccagagaaggggcccgtg

SEQ ID NO: 9002188 - DNA, 22 bp, Homo sapiens
cagcccagacaccatcattcta

SEQ ID NO: 9002189 - DNA, 22 bp, Homo sapiens
cagcccagaactcacgtctcca

SEQ ID NO: 9002190 - DNA, 22 bp, Homo sapiens
cagcccacttcccagcacctac

SEQ ID NO: 9002191 - DNA, 22 bp, Homo sapiens
cagcccacttcccagcacctac

SEQ ID NO: 9002192 - DNA, 22 bp, Homo sapiens
cagcccacttcccagcacctac

SEQ ID NO: 9002193 - DNA, 22 bp, Homo sapiens
cagcccacttcccagcacctac

SEQ ID NO: 9002194 - DNA, 22 bp, Homo sapiens
cagcccacttcccagcacctac

SEQ ID NO: 9002195 - DNA, 22 bp, Homo sapiens
cagcccacttcccagcacctac

SEQ ID NO: 9002196 - DNA, 22 bp, Homo sapiens
cagcatggcttgagtgtttcct

SEQ ID NO: 9002197 - DNA, 22 bp, Homo sapiens
cagcatggcttgagtgtttcct

SEQ ID NO: 9002198 - DNA, 22 bp, Homo sapiens
cagcatggggatcactgtaggc

SEQ ID NO: 9002199 - DNA, 22 bp, Homo sapiens
cagcatggggatcactgtaggc

SEQ ID NO: 9002200 - DNA, 22 bp, Homo sapiens
cagcatggggatcactgtaggc

SEQ ID NO: 9002201 - DNA, 22 bp, Homo sapiens
cagcatggacccatcgctgagt

SEQ ID NO: 9002202 - DNA, 22 bp, Homo sapiens
cagcatggacccatcgctgagt

SEQ ID NO: 9002203 - DNA, 22 bp, Homo sapiens
cagcatggagacaaagtgggca

SEQ ID NO: 9002204 - DNA, 22 bp, Homo sapiens
cagcatggagacaaagtgggca

SEQ ID NO: 9002205 - DNA, 22 bp, Homo sapiens
cagcatggagacaaagtgggca

SEQ ID NO: 9002206 - DNA, 22 bp, Homo sapiens
cagcatggagacaaagtgggca

SEQ ID NO: 9002207 - DNA, 22 bp, Homo sapiens
cagcagaaaatacctgtaactc

SEQ ID NO: 9002208 - DNA, 22 bp, Homo sapiens
cagcagaaaatacctgtaactc

SEQ ID NO: 9002209 - DNA, 22 bp, Homo sapiens
cagcagaaaatacctgtaactc

SEQ ID NO: 9002210 - DNA, 22 bp, Homo sapiens
cagcagaaaatacctgtaactc

SEQ ID NO: 9002211 - DNA, 22 bp, Homo sapiens
cagcagaaacccagcaaagcca

SEQ ID NO: 9002212 - DNA, 22 bp, Homo sapiens
cagcagaaaatgtgggtgattt

SEQ ID NO: 9002213 - DNA, 22 bp, Homo sapiens
cagcatcagcctggctcaggcc

SEQ ID NO: 9002214 - DNA, 22 bp, Homo sapiens
cagcatcatactacctaaatga

SEQ ID NO: 9002215 - DNA, 22 bp, Homo sapiens
cagcatggacaggggtggcgtt

SEQ ID NO: 9002216 - DNA, 22 bp, Homo sapiens
cagcatggacaggggtggcgtt

SEQ ID NO: 9002217 - DNA, 22 bp, Homo sapiens
cagcactgggaccactagaaca

SEQ ID NO: 9002218 - DNA, 22 bp, Homo sapiens
cagcactggggccactggagtt

SEQ ID NO: 9002219 - DNA, 22 bp, Homo sapiens
cagcactgcttcgcagccaggg

SEQ ID NO: 9002220 - DNA, 22 bp, Homo sapiens
cagcactgcttcgcagccaggg

SEQ ID NO: 9002221 - DNA, 22 bp, Homo sapiens
cagcactgcttcgcagccaggg

SEQ ID NO: 9002222 - DNA, 22 bp, Homo sapiens
cagcactgtgataactgagcca

SEQ ID NO: 9002223 - DNA, 22 bp, Homo sapiens
cagcactggggccactggagtt

SEQ ID NO: 9002224 - DNA, 22 bp, Homo sapiens
cagcacttcaatgagcatttca

SEQ ID NO: 9002225 - DNA, 22 bp, Homo sapiens
cagcactgttcccagaccactg

SEQ ID NO: 9002226 - DNA, 22 bp, Homo sapiens
cagcactgtgataactgagcca

SEQ ID NO: 9002227 - DNA, 22 bp, Homo sapiens
cagcactgttcccagaccactg

SEQ ID NO: 9002228 - DNA, 22 bp, Homo sapiens
cagcacttggtgccattgagtg

SEQ ID NO: 9002229 - DNA, 22 bp, Homo sapiens
cagcatgggttccgggggcctg

SEQ ID NO: 9002230 - DNA, 22 bp, Homo sapiens
cagcatgggggcaattcaggtg

SEQ ID NO: 9002231 - DNA, 22 bp, Homo sapiens
cagcatgggttccgggggcctg

SEQ ID NO: 9002232 - DNA, 22 bp, Homo sapiens
cagcatggtgccagtgagtcca

SEQ ID NO: 9002233 - DNA, 22 bp, Homo sapiens
cagcatggtgccagtgagtcca

SEQ ID NO: 9002234 - DNA, 22 bp, Homo sapiens
cagcatggggcttggagtcagc

SEQ ID NO: 9002235 - DNA, 22 bp, Homo sapiens
cagcatggggcttggagtcagc

SEQ ID NO: 9002236 - DNA, 22 bp, Homo sapiens
cagcatggggcttggagtcagc

SEQ ID NO: 9002237 - DNA, 22 bp, Homo sapiens
cagcatggggcttggagtcagc

SEQ ID NO: 9002238 - DNA, 22 bp, Homo sapiens
cagcatggggcttggagtcagc

SEQ ID NO: 9002239 - DNA, 22 bp, Homo sapiens
agccttttggagttattctggg

SEQ ID NO: 9002240 - DNA, 22 bp, Homo sapiens
agccttttggagttattctggg

SEQ ID NO: 9002241 - DNA, 22 bp, Homo sapiens
agcgagagattcaacagcaagt

SEQ ID NO: 9002242 - DNA, 22 bp, Homo sapiens
agcgagcacattgagtgaagaa

SEQ ID NO: 9002243 - DNA, 22 bp, Homo sapiens
agcgagcacattgagtgaagaa

SEQ ID NO: 9002244 - DNA, 22 bp, Homo sapiens
agcgagggaggtctgaggacag

SEQ ID NO: 9002245 - DNA, 22 bp, Homo sapiens
cagcatggtggagctgctcttt

SEQ ID NO: 9002246 - DNA, 22 bp, Homo sapiens
cagcatggtggagctgctcttt

SEQ ID NO: 9002247 - DNA, 22 bp, Homo sapiens
agcgccactgcactccagcctg

SEQ ID NO: 9002248 - DNA, 22 bp, Homo sapiens
agcgccactgcactccagcctg

SEQ ID NO: 9002249 - DNA, 22 bp, Homo sapiens
agcgccactgcactccagcctg

SEQ ID NO: 9002250 - DNA, 22 bp, Homo sapiens
agcgcaggaacacgtctgcctt

SEQ ID NO: 9002251 - DNA, 22 bp, Homo sapiens
agcgccactgcactccagcctg

SEQ ID NO: 9002252 - DNA, 22 bp, Homo sapiens
agcgagtgggtcagcgttgcag

SEQ ID NO: 9002253 - DNA, 22 bp, Homo sapiens
agcgaggtgagtcctccagctc

SEQ ID NO: 9002254 - DNA, 22 bp, Homo sapiens
agcgagtgggtcagcgttgcag

SEQ ID NO: 9002255 - DNA, 22 bp, Homo sapiens
agcgagtgggtcagcgttgcag

SEQ ID NO: 9002256 - DNA, 22 bp, Homo sapiens
agcgagggaggtctgaggacag

SEQ ID NO: 9002257 - DNA, 22 bp, Homo sapiens
agcgagggaggtctgaggacag

SEQ ID NO: 9002258 - DNA, 22 bp, Homo sapiens
agcgctggctggcgctccttcc

SEQ ID NO: 9002259 - DNA, 22 bp, Homo sapiens
agcgcgctcgatggtttccgcg

SEQ ID NO: 9002260 - DNA, 22 bp, Homo sapiens
agcgcgctgtcagactggctcg

SEQ ID NO: 9002261 - DNA, 22 bp, Homo sapiens
agcgcgctctaggacaccgcgg

SEQ ID NO: 9002262 - DNA, 22 bp, Homo sapiens
agcgcctgcggtgtgagcctgc

SEQ ID NO: 9002263 - DNA, 22 bp, Homo sapiens
agcgccgcccctgctggtgttg

SEQ ID NO: 9002264 - DNA, 21 bp, Homo sapiens
agcgcctgcaacaaggcagat

SEQ ID NO: 9002265 - DNA, 22 bp, Homo sapiens
agcgcctgcaccactctgcggc

SEQ ID NO: 9002266 - DNA, 21 bp, Homo sapiens
agcgcctgcaacaaggcagat

SEQ ID NO: 9002267 - DNA, 22 bp, Homo sapiens
agcgccctgtgaggttggcagg

SEQ ID NO: 9002268 - DNA, 22 bp, Homo sapiens
agcgccactgcactccagcctg

SEQ ID NO: 9002269 - DNA, 22 bp, Homo sapiens
agcgccactgcactccagcctg

SEQ ID NO: 9002270 - DNA, 22 bp, Homo sapiens
agcgccactgcactccagcctg

SEQ ID NO: 9002271 - DNA, 22 bp, Homo sapiens
agcgccactgcactccagcctg

SEQ ID NO: 9002272 - DNA, 21 bp, Homo sapiens
cagagctgtccaaaccctgac

SEQ ID NO: 9002273 - DNA, 21 bp, Homo sapiens
cagagctgtccaaaccctgac

SEQ ID NO: 9002274 - DNA, 21 bp, Homo sapiens
cagagctgtccaaaccctgac

SEQ ID NO: 9002275 - DNA, 22 bp, Homo sapiens
cagagctgtcatttgccagtga

SEQ ID NO: 9002276 - DNA, 21 bp, Homo sapiens
cagagctgtccaaaccctgac

SEQ ID NO: 9002277 - DNA, 22 bp, Homo sapiens
cagagccatggtatgggcttgt

SEQ ID NO: 9002278 - DNA, 22 bp, Homo sapiens
cagagccatcccagcctgtggt

SEQ ID NO: 9002279 - DNA, 23 bp, Homo sapiens
cagagctggctcagagctgcctg

SEQ ID NO: 9002280 - DNA, 23 bp, Homo sapiens
cagagctggctcagagctgcctg

SEQ ID NO: 9002281 - DNA, 23 bp, Homo sapiens
cagagctggctcagagctgcctg

SEQ ID NO: 9002282 - DNA, 22 bp, Homo sapiens
cagagccatcccagcctgtggt

SEQ ID NO: 9002283 - DNA, 22 bp, Homo sapiens
cagagccatcccagcctgtggt

SEQ ID NO: 9002284 - DNA, 22 bp, Homo sapiens
cagagccatcccagcctgtggt

SEQ ID NO: 9002285 - DNA, 22 bp, Homo sapiens
cagagccatccaggtgcctgtt

SEQ ID NO: 9002286 - DNA, 22 bp, Homo sapiens
cagagccatcccagcctgtggt

SEQ ID NO: 9002287 - DNA, 22 bp, Homo sapiens
cagagccatccaggtgcctgtt

SEQ ID NO: 9002288 - DNA, 22 bp, Homo sapiens
cagagccatcatgatatggagt

SEQ ID NO: 9002289 - DNA, 22 bp, Homo sapiens
cagagccagtcagtcagaaact

SEQ ID NO: 9002290 - DNA, 22 bp, Homo sapiens
cagagccatcatgatatggagt

SEQ ID NO: 9002291 - DNA, 22 bp, Homo sapiens
cagagccatccaggtgcctgtt

SEQ ID NO: 9002292 - DNA, 22 bp, Homo sapiens
cagagccatccaggtgcctgtt

SEQ ID NO: 9002293 - DNA, 22 bp, Homo sapiens
cagagccatcatgatatggagt

SEQ ID NO: 9002294 - DNA, 22 bp, Homo sapiens
cagagctgtgataaatagatat

SEQ ID NO: 9002295 - DNA, 22 bp, Homo sapiens
cagagctgtgataaatagatat

SEQ ID NO: 9002296 - DNA, 22 bp, Homo sapiens
cagagctgtgataaatagatat

SEQ ID NO: 9002297 - DNA, 22 bp, Homo sapiens
cagagctgttactattcatgaa

SEQ ID NO: 9002298 - DNA, 22 bp, Homo sapiens
cagagctgttactattcatgaa

SEQ ID NO: 9002299 - DNA, 22 bp, Homo sapiens
cagagctgttactattcatgaa

SEQ ID NO: 9002300 - DNA, 22 bp, Homo sapiens
cagagctgttactattcatgaa

SEQ ID NO: 9002301 - DNA, 22 bp, Homo sapiens
cagagctgtccaaaccctgaca

SEQ ID NO: 9002302 - DNA, 22 bp, Homo sapiens
cagagctgtccaaaccctgaca

SEQ ID NO: 9002303 - DNA, 22 bp, Homo sapiens
cagagctgtccaaaccctgaca

SEQ ID NO: 9002304 - DNA, 22 bp, Homo sapiens
cagagctgtccaaaccctgaca

SEQ ID NO: 9002305 - DNA, 22 bp, Homo sapiens
cagagctgttgcggggcttggc

SEQ ID NO: 9002306 - DNA, 20 bp, Homo sapiens
cagagctgttatggatgatg

SEQ ID NO: 9002307 - DNA, 22 bp, Homo sapiens
cagagctgttgcggggcttggc

SEQ ID NO: 9002308 - DNA, 22 bp, Homo sapiens
cagagctgttgcggggcttggc

SEQ ID NO: 9002309 - DNA, 22 bp, Homo sapiens
cagagctgttgcggggcttggc

SEQ ID NO: 9002310 - DNA, 22 bp, Homo sapiens
cagagctgttgcggggcttggc

SEQ ID NO: 9002311 - DNA, 20 bp, Homo sapiens
cagagctgttatggatgatg

SEQ ID NO: 9002312 - DNA, 20 bp, Homo sapiens
cagagctgttatggatgatg

SEQ ID NO: 9002313 - DNA, 20 bp, Homo sapiens
cagagctgttatggatgatg

SEQ ID NO: 9002314 - DNA, 22 bp, Homo sapiens
cagagctgttactattcatgaa

SEQ ID NO: 9002315 - DNA, 22 bp, Homo sapiens
cagagcagtaaatctggggcac

SEQ ID NO: 9002316 - DNA, 22 bp, Homo sapiens
cagagcagtaaatctggggcac

SEQ ID NO: 9002317 - DNA, 22 bp, Homo sapiens
cagagcagtaaatctggggcac

SEQ ID NO: 9002318 - DNA, 22 bp, Homo sapiens
cagagcaggtatctttggtgaa

SEQ ID NO: 9002319 - DNA, 22 bp, Homo sapiens
cagagcaggtatctttggtgaa

SEQ ID NO: 9002320 - DNA, 22 bp, Homo sapiens
cagagcagtaaatctggggcac

SEQ ID NO: 9002321 - DNA, 22 bp, Homo sapiens
cagagcagtagaaaacagcctt

SEQ ID NO: 9002322 - DNA, 22 bp, Homo sapiens
cagagcagtagaaaacagcctt

SEQ ID NO: 9002323 - DNA, 22 bp, Homo sapiens
cagagcagtaaatctggggcac

SEQ ID NO: 9002324 - DNA, 18 bp, Homo sapiens
cagagcagtatgaatgtt

SEQ ID NO: 9002325 - DNA, 22 bp, Homo sapiens
cagagcagtagaaaacagcctt

SEQ ID NO: 9002326 - DNA, 22 bp, Homo sapiens
cagagcagtagaaaacagcctt

SEQ ID NO: 9002327 - DNA, 18 bp, Homo sapiens
cagagcagtatgaatgtt

SEQ ID NO: 9002328 - DNA, 22 bp, Homo sapiens
cagagcagtccttgtcaatcag

SEQ ID NO: 9002329 - DNA, 22 bp, Homo sapiens
cagagcagtccttgtcaatcag

SEQ ID NO: 9002330 - DNA, 22 bp, Homo sapiens
cagagcagtctggagatccagc

SEQ ID NO: 9002331 - DNA, 22 bp, Homo sapiens
cagagcagtctggagatccagc

SEQ ID NO: 9002332 - DNA, 22 bp, Homo sapiens
cagagcagtccttgtcaatcag

SEQ ID NO: 9002333 - DNA, 22 bp, Homo sapiens
cagagcagtccttgtcaatcag

SEQ ID NO: 9002334 - DNA, 20 bp, Homo sapiens
cagagccagggttttgtttt

SEQ ID NO: 9002335 - DNA, 20 bp, Homo sapiens
cagagccagggttttgtttt

SEQ ID NO: 9002336 - DNA, 22 bp, Homo sapiens
cagagccagggttgcacccctg

SEQ ID NO: 9002337 - DNA, 22 bp, Homo sapiens
cagagccagggttgcacccctg

SEQ ID NO: 9002338 - DNA, 22 bp, Homo sapiens
cagagccaggtctaggagtctc

SEQ ID NO: 9002339 - DNA, 22 bp, Homo sapiens
cagagccaggtctaggagtctc

SEQ ID NO: 9002340 - DNA, 22 bp, Homo sapiens
cagagccaggtctaggagtctc

SEQ ID NO: 9002341 - DNA, 22 bp, Homo sapiens
cagagccaggtggtgttggggc

SEQ ID NO: 9002342 - DNA, 22 bp, Homo sapiens
cagagccaggtctaggagtctc

SEQ ID NO: 9002343 - DNA, 22 bp, Homo sapiens
cagagccaggtctaggagtctc

SEQ ID NO: 9002344 - DNA, 22 bp, Homo sapiens
cagagccaggtctaggagtctc

SEQ ID NO: 9002345 - DNA, 22 bp, Homo sapiens
cagagccaggtcttgaactcag

SEQ ID NO: 9002346 - DNA, 22 bp, Homo sapiens
cagagccaggtctaggagtctc

SEQ ID NO: 9002347 - DNA, 22 bp, Homo sapiens
cagagccaggtctaggagtctc

SEQ ID NO: 9002348 - DNA, 19 bp, Homo sapiens
cagagccaggcctttggcc

SEQ ID NO: 9002349 - DNA, 22 bp, Homo sapiens
cagagccagggttgcacccctg

SEQ ID NO: 9002350 - DNA, 22 bp, Homo sapiens
cagagccaggcctgccctcttt

SEQ ID NO: 9002351 - DNA, 22 bp, Homo sapiens
cagagccaggcctgccctcttt

SEQ ID NO: 9002352 - DNA, 22 bp, Homo sapiens
cagagccaggcctgccctcttt

SEQ ID NO: 9002353 - DNA, 22 bp, Homo sapiens
cagagccaggcctgccctcttt

SEQ ID NO: 9002354 - DNA, 22 bp, Homo sapiens
cagagcagtctggagatccagc

SEQ ID NO: 9002355 - DNA, 22 bp, Homo sapiens
cagagcagtccttgtcaatcag

SEQ ID NO: 9002356 - DNA, 22 bp, Homo sapiens
cagagcagtctggagatccagc

SEQ ID NO: 9002357 - DNA, 22 bp, Homo sapiens
cagagccaggcctgccctcttt

SEQ ID NO: 9002358 - DNA, 22 bp, Homo sapiens
cagagcagtctggagatccagc

SEQ ID NO: 9002359 - DNA, 22 bp, Homo sapiens
agccaggggagtcagctgctgg

SEQ ID NO: 9002360 - DNA, 22 bp, Homo sapiens
agccaggggagtcagctgctgg

SEQ ID NO: 9002361 - DNA, 22 bp, Homo sapiens
cagagcaccagtgggagacaag

SEQ ID NO: 9002362 - DNA, 22 bp, Homo sapiens
agccaggggagtcagctgctgg

SEQ ID NO: 9002363 - DNA, 22 bp, Homo sapiens
cagagcaccagtgggagacaag

SEQ ID NO: 9002364 - DNA, 22 bp, Homo sapiens
cagagcaggggtttcccaggtt

SEQ ID NO: 9002365 - DNA, 22 bp, Homo sapiens
cagagcacccaaggagcatttg

SEQ ID NO: 9002366 - DNA, 22 bp, Homo sapiens
cagagcagggtgcaccttgggc

SEQ ID NO: 9002367 - DNA, 22 bp, Homo sapiens
cagagcaggggtttcccaggtt

SEQ ID NO: 9002368 - DNA, 22 bp, Homo sapiens
cagagcaggggtttcccaggtt

SEQ ID NO: 9002369 - DNA, 22 bp, Homo sapiens
cagagcagggtgcaccttgggc

SEQ ID NO: 9002370 - DNA, 22 bp, Homo sapiens
cagagcagggtgcaccttgggc

SEQ ID NO: 9002371 - DNA, 22 bp, Homo sapiens
agccagggctgcgagcagacag

SEQ ID NO: 9002372 - DNA, 22 bp, Homo sapiens
agccagggctgcgagcagacag

SEQ ID NO: 9002373 - DNA, 22 bp, Homo sapiens
agccagggctgcaggttccttg

SEQ ID NO: 9002374 - DNA, 22 bp, Homo sapiens
agccagggctgcgagcagacag

SEQ ID NO: 9002375 - DNA, 22 bp, Homo sapiens
agccagggctgcgagcagacag

SEQ ID NO: 9002376 - DNA, 22 bp, Homo sapiens
agccagggctgcaggttccttg

SEQ ID NO: 9002377 - DNA, 22 bp, Homo sapiens
agccagggctgcaggttccttg

SEQ ID NO: 9002378 - DNA, 22 bp, Homo sapiens
agccagggctgcgagcagacag

SEQ ID NO: 9002379 - DNA, 22 bp, Homo sapiens
agccagggctgcgagcagacag

SEQ ID NO: 9002380 - DNA, 22 bp, Homo sapiens
agccaggggagtcagctgctgg

SEQ ID NO: 9002381 - DNA, 22 bp, Homo sapiens
agccaggggagtcagctgctgg

SEQ ID NO: 9002382 - DNA, 22 bp, Homo sapiens
agccaggggagtcagctgctgg

SEQ ID NO: 9002383 - DNA, 22 bp, Homo sapiens
agccaggggagtcagctgctgg

SEQ ID NO: 9002384 - DNA, 22 bp, Homo sapiens
agccaggggagtcagctgctgg

SEQ ID NO: 9002385 - DNA, 22 bp, Homo sapiens
agccagggctgcgagcagacag

SEQ ID NO: 9002386 - DNA, 22 bp, Homo sapiens
agccagggacgctgcaggctac

SEQ ID NO: 9002387 - DNA, 22 bp, Homo sapiens
agccagggaggattacacccca

SEQ ID NO: 9002388 - DNA, 22 bp, Homo sapiens
agccagggaggtggaggttgca

SEQ ID NO: 9002389 - DNA, 22 bp, Homo sapiens
agccagggacgctgcaggctac

SEQ ID NO: 9002390 - DNA, 22 bp, Homo sapiens
agccagggacgctgcaggctac

SEQ ID NO: 9002391 - DNA, 22 bp, Homo sapiens
agccagggacgctgcaggctac

SEQ ID NO: 9002392 - DNA, 22 bp, Homo sapiens
agccagggacgctgcaggctac

SEQ ID NO: 9002393 - DNA, 22 bp, Homo sapiens
agccagggaggtggaggttgca

SEQ ID NO: 9002394 - DNA, 22 bp, Homo sapiens
agccagggaggtggaggttgca

SEQ ID NO: 9002395 - DNA, 22 bp, Homo sapiens
agccagggaggtggaggttgca

SEQ ID NO: 9002396 - DNA, 22 bp, Homo sapiens
agccagggatgcagcacagtga

SEQ ID NO: 9002397 - DNA, 22 bp, Homo sapiens
agccagggatgcagcacagtga

SEQ ID NO: 9002398 - DNA, 22 bp, Homo sapiens
agccagggatgcagcacagtga

SEQ ID NO: 9002399 - DNA, 23 bp, Homo sapiens
agccagggcactggtggagattg

SEQ ID NO: 9002400 - DNA, 23 bp, Homo sapiens
agccagggcactggtggagattg

SEQ ID NO: 9002401 - DNA, 22 bp, Homo sapiens
agccagggctctccttcgcgtg

SEQ ID NO: 9002402 - DNA, 23 bp, Homo sapiens
agccagggcactggtggagattg

SEQ ID NO: 9002403 - DNA, 23 bp, Homo sapiens
agccagggcactggtggagattg

SEQ ID NO: 9002404 - DNA, 23 bp, Homo sapiens
agccagggcactggtggagattg

SEQ ID NO: 9002405 - DNA, 22 bp, Homo sapiens
agccagggatggcagtgcccag

SEQ ID NO: 9002406 - DNA, 22 bp, Homo sapiens
agccagggatgcagcacagtga

SEQ ID NO: 9002407 - DNA, 22 bp, Homo sapiens
agccagggatgcagcacagtga

SEQ ID NO: 9002408 - DNA, 22 bp, Homo sapiens
agccagggatggcagtgcccag

SEQ ID NO: 9002409 - DNA, 22 bp, Homo sapiens
agccagggatggcagtgcccag

SEQ ID NO: 9002410 - DNA, 22 bp, Homo sapiens
agccagggatggcagtgcccag

SEQ ID NO: 9002411 - DNA, 22 bp, Homo sapiens
agccagggatggcagtgcccag

SEQ ID NO: 9002412 - DNA, 22 bp, Homo sapiens
agccaagaagtgagtaatagta

SEQ ID NO: 9002413 - DNA, 22 bp, Homo sapiens
agccaagaagtgagtaatagta

SEQ ID NO: 9002414 - DNA, 20 bp, Homo sapiens
agccaagaacaggcagaacc

SEQ ID NO: 9002415 - DNA, 20 bp, Homo sapiens
agccaagaacaggcagaacc

SEQ ID NO: 9002416 - DNA, 20 bp, Homo sapiens
agccaagaacaggcagaacc

SEQ ID NO: 9002417 - DNA, 22 bp, Homo sapiens
agccaagaatcatgagctaata

SEQ ID NO: 9002418 - DNA, 22 bp, Homo sapiens
agccaagaatcatgagctaata

SEQ ID NO: 9002419 - DNA, 22 bp, Homo sapiens
agccaagaatcatgagctaata

SEQ ID NO: 9002420 - DNA, 22 bp, Homo sapiens
agccaacttagaagaaatttga

SEQ ID NO: 9002421 - DNA, 22 bp, Homo sapiens
agccaacttggaaagtcagatt

SEQ ID NO: 9002422 - DNA, 22 bp, Homo sapiens
agccaactaggagattaaggta

SEQ ID NO: 9002423 - DNA, 22 bp, Homo sapiens
agccaagagatgaggctgcagg

SEQ ID NO: 9002424 - DNA, 22 bp, Homo sapiens
agccaagagatgaggctgcagg

SEQ ID NO: 9002425 - DNA, 22 bp, Homo sapiens
agccaagagatgaggctgcagg

SEQ ID NO: 9002426 - DNA, 22 bp, Homo sapiens
agccaagagctcacctcgtgtg

SEQ ID NO: 9002427 - DNA, 22 bp, Homo sapiens
agccaagacatttagaaaagct

SEQ ID NO: 9002428 - DNA, 22 bp, Homo sapiens
agccaagacatttagaaaagct

SEQ ID NO: 9002429 - DNA, 22 bp, Homo sapiens
agccaagagacagatgcccacc

SEQ ID NO: 9002430 - DNA, 22 bp, Homo sapiens
agccaagagacagatgcccacc

SEQ ID NO: 9002431 - DNA, 22 bp, Homo sapiens
agccaagcactcaactcctgga

SEQ ID NO: 9002432 - DNA, 22 bp, Homo sapiens
agccaagcactcaactcctgga

SEQ ID NO: 9002433 - DNA, 22 bp, Homo sapiens
agccaagcactcaactcctgga

SEQ ID NO: 9002434 - DNA, 22 bp, Homo sapiens
agccaagcactcaactcctgga

SEQ ID NO: 9002435 - DNA, 22 bp, Homo sapiens
agccaagcaccactggcactcg

SEQ ID NO: 9002436 - DNA, 22 bp, Homo sapiens
agccaagaggagcctaaagcga

SEQ ID NO: 9002437 - DNA, 22 bp, Homo sapiens
agccaagcaccactggcactcg

SEQ ID NO: 9002438 - DNA, 22 bp, Homo sapiens
agccaagaggagcctaaagcga

SEQ ID NO: 9002439 - DNA, 22 bp, Homo sapiens
agccaagaggagcctaaagcga

SEQ ID NO: 9002440 - DNA, 22 bp, Homo sapiens
agccaggctcaaggcctgctcc

SEQ ID NO: 9002441 - DNA, 22 bp, Homo sapiens
agccaggctcaaggcctgctcc

SEQ ID NO: 9002442 - DNA, 22 bp, Homo sapiens
agccaggccttttctcaaggtt

SEQ ID NO: 9002443 - DNA, 22 bp, Homo sapiens
agccagggaagaggcctacctc

SEQ ID NO: 9002444 - DNA, 22 bp, Homo sapiens
agccagggaagaggcctacctc

SEQ ID NO: 9002445 - DNA, 22 bp, Homo sapiens
agccagggaaggataacaagaa

SEQ ID NO: 9002446 - DNA, 22 bp, Homo sapiens
agccagggaaggataacaagaa

SEQ ID NO: 9002447 - DNA, 22 bp, Homo sapiens
agccagggacgctgcaggctac

SEQ ID NO: 9002448 - DNA, 22 bp, Homo sapiens
agccagggacgctgcaggctac

SEQ ID NO: 9002449 - DNA, 22 bp, Homo sapiens
agccagggacgctgcaggctac

SEQ ID NO: 9002450 - DNA, 22 bp, Homo sapiens
agccagggaaggataacaagaa

SEQ ID NO: 9002451 - DNA, 22 bp, Homo sapiens
agccagggacgctgcaggctac

SEQ ID NO: 9002452 - DNA, 22 bp, Homo sapiens
agccagggacgctgcaggctac

SEQ ID NO: 9002453 - DNA, 22 bp, Homo sapiens
agccagggacgctgcaggctac

SEQ ID NO: 9002454 - DNA, 22 bp, Homo sapiens
agccagggacgctgcaggctac

SEQ ID NO: 9002455 - DNA, 22 bp, Homo sapiens
agccagggacgctgcaggctac

SEQ ID NO: 9002456 - DNA, 22 bp, Homo sapiens
agccagggaagaggcctacctc

SEQ ID NO: 9002457 - DNA, 16 bp, Homo sapiens
agccaggctgcctcgg

SEQ ID NO: 9002458 - DNA, 16 bp, Homo sapiens
agccaggctgcctcgg

SEQ ID NO: 9002459 - DNA, 16 bp, Homo sapiens
agccaggctgcctcgg

SEQ ID NO: 9002460 - DNA, 22 bp, Homo sapiens
agccaggctgcagttggctggc

SEQ ID NO: 9002461 - DNA, 16 bp, Homo sapiens
agccaggctgcctcgg

SEQ ID NO: 9002462 - DNA, 22 bp, Homo sapiens
agccaggctgcagttggctggc

SEQ ID NO: 9002463 - DNA, 22 bp, Homo sapiens
agccaggctgcagttggctggc

SEQ ID NO: 9002464 - DNA, 22 bp, Homo sapiens
agccaggctcaaggcctgctcc

SEQ ID NO: 9002465 - DNA, 22 bp, Homo sapiens
agccaggctgcagttggctggc

SEQ ID NO: 9002466 - DNA, 22 bp, Homo sapiens
agccaggctgcagttggctggc

SEQ ID NO: 9002467 - DNA, 22 bp, Homo sapiens
agcccttgcagactgtcagcat

SEQ ID NO: 9002468 - DNA, 22 bp, Homo sapiens
agccgcaagaagtacagcagca

SEQ ID NO: 9002469 - DNA, 22 bp, Homo sapiens
agccgagctctgagcagggcct

SEQ ID NO: 9002470 - DNA, 17 bp, Homo sapiens
agccgcctgggtcctgt

SEQ ID NO: 9002471 - DNA, 22 bp, Homo sapiens
agcccttggtattttccgatcc

SEQ ID NO: 9002472 - DNA, 22 bp, Homo sapiens
agcctagaagaagtggctactt

SEQ ID NO: 9002473 - DNA, 22 bp, Homo sapiens
agcctagaagaagtggctactt

SEQ ID NO: 9002474 - DNA, 22 bp, Homo sapiens
agcctaatgcttttcccaaagt

SEQ ID NO: 9002475 - DNA, 22 bp, Homo sapiens
agccgcgccccatctgagtggg

SEQ ID NO: 9002476 - DNA, 22 bp, Homo sapiens
agccggccatgtggtcttgtgc

SEQ ID NO: 9002477 - DNA, 22 bp, Homo sapiens
agcctagggggtcctgggccac

SEQ ID NO: 9002478 - DNA, 22 bp, Homo sapiens
agcctagggggtcctgggccac

SEQ ID NO: 9002479 - DNA, 22 bp, Homo sapiens
agcctagggggtcctgggccac

SEQ ID NO: 9002480 - DNA, 22 bp, Homo sapiens
agcctagggggtcctgggccac

SEQ ID NO: 9002481 - DNA, 22 bp, Homo sapiens
agcctaggaggttggggctgca

SEQ ID NO: 9002482 - DNA, 22 bp, Homo sapiens
agcctaggaggttggggctgca

SEQ ID NO: 9002483 - DNA, 22 bp, Homo sapiens
agcctagactaagacttgctct

SEQ ID NO: 9002484 - DNA, 22 bp, Homo sapiens
agcctagactaagacttgctct

SEQ ID NO: 9002485 - DNA, 22 bp, Homo sapiens
agcctagctgtgtgaggccatc

SEQ ID NO: 9002486 - DNA, 22 bp, Homo sapiens
agcctagctgtgtgaggccatc

SEQ ID NO: 9002487 - DNA, 22 bp, Homo sapiens
agcctaggtctgggtctagcag

SEQ ID NO: 9002488 - DNA, 22 bp, Homo sapiens
agcctaggtctgggtctagcag

SEQ ID NO: 9002489 - DNA, 22 bp, Homo sapiens
agcctattccaggatgagctca

SEQ ID NO: 9002490 - DNA, 22 bp, Homo sapiens
agcctagggttctgatgtcact

SEQ ID NO: 9002491 - DNA, 22 bp, Homo sapiens
agcctagggttctgatgtcact

SEQ ID NO: 9002492 - DNA, 22 bp, Homo sapiens
agcctagggttctgatgtcact

SEQ ID NO: 9002493 - DNA, 22 bp, Homo sapiens
agcctaggtctgggtctagcag

SEQ ID NO: 9002494 - DNA, 22 bp, Homo sapiens
cagatatgtggattctattagc

SEQ ID NO: 9002495 - DNA, 22 bp, Homo sapiens
agcctattccaggatgagctca

SEQ ID NO: 9002496 - DNA, 22 bp, Homo sapiens
agcctattccaggatgagctca

SEQ ID NO: 9002497 - DNA, 22 bp, Homo sapiens
cagatcaagctgtatggtcaga

SEQ ID NO: 9002498 - DNA, 22 bp, Homo sapiens
cagatcaaacaaaatgggttag

SEQ ID NO: 9002499 - DNA, 23 bp, Homo sapiens
cagatcatatatccagctgtaag

SEQ ID NO: 9002500 - DNA, 22 bp, Homo sapiens
cagatcataacagatacataga

SEQ ID NO: 9002501 - DNA, 22 bp, Homo sapiens
cagatccatagagttctggaga

SEQ ID NO: 9002502 - DNA, 22 bp, Homo sapiens
cagatccacccttgtagtgaca

SEQ ID NO: 9002503 - DNA, 22 bp, Homo sapiens
cagatccagccgctcctgggaa

SEQ ID NO: 9002504 - DNA, 22 bp, Homo sapiens
cagatccacccttgtagtgaca

SEQ ID NO: 9002505 - DNA, 18 bp, Homo sapiens
cagatccaggcagctatt

SEQ ID NO: 9002506 - DNA, 19 bp, Homo sapiens
agcctggagggctggtcac

SEQ ID NO: 9002507 - DNA, 19 bp, Homo sapiens
agcctggagggctggtcac

SEQ ID NO: 9002508 - DNA, 22 bp, Homo sapiens
agcctggaggaggagttgagca

SEQ ID NO: 9002509 - DNA, 22 bp, Homo sapiens
agcctggaggccaggagacagt

SEQ ID NO: 9002510 - DNA, 22 bp, Homo sapiens
agcctggaggccaggagacagt

SEQ ID NO: 9002511 - DNA, 19 bp, Homo sapiens
agcctggagggctggtcac

SEQ ID NO: 9002512 - DNA, 22 bp, Homo sapiens
cagcactgcttcgcagccaggg

SEQ ID NO: 9002513 - DNA, 22 bp, Homo sapiens
agcctggaggccaggagacagt

SEQ ID NO: 9002514 - DNA, 22 bp, Homo sapiens
agcctggaggtaatgaggaaac

SEQ ID NO: 9002515 - DNA, 18 bp, Homo sapiens
agcctggagggttgaagt

SEQ ID NO: 9002516 - DNA, 18 bp, Homo sapiens
agcctggagggttgaagt

SEQ ID NO: 9002517 - DNA, 18 bp, Homo sapiens
agcctggagggttgaagt

SEQ ID NO: 9002518 - DNA, 22 bp, Homo sapiens
agcctggaccaggggcctcaga

SEQ ID NO: 9002519 - DNA, 22 bp, Homo sapiens
agcctggagaagatgtgtattg

SEQ ID NO: 9002520 - DNA, 22 bp, Homo sapiens
agcctggagaggcgccatacac

SEQ ID NO: 9002521 - DNA, 22 bp, Homo sapiens
agcctggaggaggagttgagca

SEQ ID NO: 9002522 - DNA, 22 bp, Homo sapiens
agcctggaggaggagttgagca

SEQ ID NO: 9002523 - DNA, 22 bp, Homo sapiens
agcctggagcttgagttatgag

SEQ ID NO: 9002524 - DNA, 22 bp, Homo sapiens
agcctggacagctacggagaac

SEQ ID NO: 9002525 - DNA, 22 bp, Homo sapiens
agcctggacagctacggagaac

SEQ ID NO: 9002526 - DNA, 22 bp, Homo sapiens
agcctggaattaaggaaatgca

SEQ ID NO: 9002527 - DNA, 22 bp, Homo sapiens
agcctggagaagatgtgtattg

SEQ ID NO: 9002528 - DNA, 22 bp, Homo sapiens
agcctggaccaggggcctcaga

SEQ ID NO: 9002529 - DNA, 22 bp, Homo sapiens
agcctggacagctacggagaac

SEQ ID NO: 9002530 - DNA, 22 bp, Homo sapiens
agcctggacagctacggagaac

SEQ ID NO: 9002531 - DNA, 22 bp, Homo sapiens
agcctgagtgcttaggactgtt

SEQ ID NO: 9002532 - DNA, 22 bp, Homo sapiens
agcctgagtgcttaggactgtt

SEQ ID NO: 9002533 - DNA, 22 bp, Homo sapiens
agcctgagtgcttaggactgtt

SEQ ID NO: 9002534 - DNA, 22 bp, Homo sapiens
agcctgagtgcttaggactgtt

SEQ ID NO: 9002535 - DNA, 22 bp, Homo sapiens
cagatgaagatcatagaatagt

SEQ ID NO: 9002536 - DNA, 22 bp, Homo sapiens
agcctggaattaaggaaatgca

SEQ ID NO: 9002537 - DNA, 22 bp, Homo sapiens
agcctggaagaacctgaagtct

SEQ ID NO: 9002538 - DNA, 22 bp, Homo sapiens
agcctggaagaacctgaagtct

SEQ ID NO: 9002539 - DNA, 22 bp, Homo sapiens
agcctgcttgagagtcctggct

SEQ ID NO: 9002540 - DNA, 22 bp, Homo sapiens
cagatctgagccaagctcgatg

SEQ ID NO: 9002541 - DNA, 22 bp, Homo sapiens
cagatctgctcctctgtccatg

SEQ ID NO: 9002542 - DNA, 22 bp, Homo sapiens
cagatctatctgttgatggtgc

SEQ ID NO: 9002543 - DNA, 21 bp, Homo sapiens
cagatctgtaggtactaccat

SEQ ID NO: 9002544 - DNA, 22 bp, Homo sapiens
cagatctgtagtaaaagatctc

SEQ ID NO: 9002545 - DNA, 22 bp, Homo sapiens
cagatctgctcctctgtccatg

SEQ ID NO: 9002546 - DNA, 21 bp, Homo sapiens
cagatctgtaggtactaccat

SEQ ID NO: 9002547 - DNA, 22 bp, Homo sapiens
cagatgaactgtgactgaaaat

SEQ ID NO: 9002548 - DNA, 22 bp, Homo sapiens
cagatgaactgtgactgaaaat

SEQ ID NO: 9002549 - DNA, 22 bp, Homo sapiens
cagatgaactgtgactgaaaat

SEQ ID NO: 9002550 - DNA, 22 bp, Homo sapiens
cagatcttgtactcattattga

SEQ ID NO: 9002551 - DNA, 22 bp, Homo sapiens
cagatctgtttgccagatcagc

SEQ ID NO: 9002552 - DNA, 22 bp, Homo sapiens
cagagtggcactctgctggatg

SEQ ID NO: 9002553 - DNA, 22 bp, Homo sapiens
cagagtggcatgaatgaagcct

SEQ ID NO: 9002554 - DNA, 22 bp, Homo sapiens
cagagtggcatgaatgaagcct

SEQ ID NO: 9002555 - DNA, 22 bp, Homo sapiens
cagagtggcagtcccaggccca

SEQ ID NO: 9002556 - DNA, 22 bp, Homo sapiens
cagagtggcagtcccaggccca

SEQ ID NO: 9002557 - DNA, 22 bp, Homo sapiens
cagagtggagtttttcagcggg

SEQ ID NO: 9002558 - DNA, 22 bp, Homo sapiens
cagagtggagatgtgtgtggaa

SEQ ID NO: 9002559 - DNA, 22 bp, Homo sapiens
cagagtggagtttttcagcggg

SEQ ID NO: 9002560 - DNA, 22 bp, Homo sapiens
cagagtggcactctgctggatg

SEQ ID NO: 9002561 - DNA, 22 bp, Homo sapiens
cagagtggagaaacgcttcgtc

SEQ ID NO: 9002562 - DNA, 22 bp, Homo sapiens
cagagtggagaaagcatttagt

SEQ ID NO: 9002563 - DNA, 22 bp, Homo sapiens
cagagtggagatgtgtgtggaa

SEQ ID NO: 9002564 - DNA, 22 bp, Homo sapiens
cagagtggagatgtgtgtggaa

SEQ ID NO: 9002565 - DNA, 22 bp, Homo sapiens
cagagtggagatgtgtgtggaa

SEQ ID NO: 9002566 - DNA, 18 bp, Homo sapiens
cagagtgggccaagagac

SEQ ID NO: 9002567 - DNA, 22 bp, Homo sapiens
agccctcctggggccacgctgg

SEQ ID NO: 9002568 - DNA, 22 bp, Homo sapiens
cagagtggcgaccccctcagct

SEQ ID NO: 9002569 - DNA, 22 bp, Homo sapiens
cagagtggcgaccccctcagct

SEQ ID NO: 9002570 - DNA, 18 bp, Homo sapiens
cagagtgggccaagagac

SEQ ID NO: 9002571 - DNA, 22 bp, Homo sapiens
cagagtggcgaccccctcagct

SEQ ID NO: 9002572 - DNA, 22 bp, Homo sapiens
cagagtggcgaccccctcagct

SEQ ID NO: 9002573 - DNA, 22 bp, Homo sapiens
agccctcgtttctgcatcctgt

SEQ ID NO: 9002574 - DNA, 22 bp, Homo sapiens
agccctcgtttctgcatcctgt

SEQ ID NO: 9002575 - DNA, 22 bp, Homo sapiens
agccctcctttgttcatgctgc

SEQ ID NO: 9002576 - DNA, 22 bp, Homo sapiens
agccctcctttgttcatgctgc

SEQ ID NO: 9002577 - DNA, 22 bp, Homo sapiens
agccctcctttgttcatgctgc

SEQ ID NO: 9002578 - DNA, 22 bp, Homo sapiens
agccctcctggggccacgctgg

SEQ ID NO: 9002579 - DNA, 22 bp, Homo sapiens
agccctcttccagccagcacag

SEQ ID NO: 9002580 - DNA, 22 bp, Homo sapiens
agcccttagtacatttctcaag

SEQ ID NO: 9002581 - DNA, 22 bp, Homo sapiens
agccctgggctgtagataagca

SEQ ID NO: 9002582 - DNA, 22 bp, Homo sapiens
agccctgggctgtagataagca

SEQ ID NO: 9002583 - DNA, 22 bp, Homo sapiens
agccctgggctgtagataagca

SEQ ID NO: 9002584 - DNA, 22 bp, Homo sapiens
agccctcttcccagatgcctca

SEQ ID NO: 9002585 - DNA, 22 bp, Homo sapiens
agccctgaagctggccatgtcc

SEQ ID NO: 9002586 - DNA, 22 bp, Homo sapiens
agccctgagccagcctggtcag

SEQ ID NO: 9002587 - DNA, 22 bp, Homo sapiens
agccctcttccagccagcacag

SEQ ID NO: 9002588 - DNA, 22 bp, Homo sapiens
agccctcttccagccagcacag

SEQ ID NO: 9002589 - DNA, 22 bp, Homo sapiens
agccctctctttagagatctga

SEQ ID NO: 9002590 - DNA, 22 bp, Homo sapiens
agccctctaagcaagagaggaa

SEQ ID NO: 9002591 - DNA, 22 bp, Homo sapiens
agccctctctatggccctcttg

SEQ ID NO: 9002592 - DNA, 22 bp, Homo sapiens
agccctctgagctagtcaccat

SEQ ID NO: 9002593 - DNA, 22 bp, Homo sapiens
agccctctgagctagtcaccat

SEQ ID NO: 9002594 - DNA, 22 bp, Homo sapiens
agccctctgctgttctagtctc

SEQ ID NO: 9002595 - DNA, 22 bp, Homo sapiens
agccctctgctgttctagtctc

SEQ ID NO: 9002596 - DNA, 17 bp, Homo sapiens
cagaggagctttggggg

SEQ ID NO: 9002597 - DNA, 17 bp, Homo sapiens
cagaggagctttggggg

SEQ ID NO: 9002598 - DNA, 17 bp, Homo sapiens
cagaggagctttggggg

SEQ ID NO: 9002599 - DNA, 22 bp, Homo sapiens
cagaggaggccaccgcataggc

SEQ ID NO: 9002600 - DNA, 22 bp, Homo sapiens
cagaggaggccaccgcataggc

SEQ ID NO: 9002601 - DNA, 22 bp, Homo sapiens
cagaggaggccaccgcataggc

SEQ ID NO: 9002602 - DNA, 22 bp, Homo sapiens
cagaggaggcggtatacactgc

SEQ ID NO: 9002603 - DNA, 22 bp, Homo sapiens
cagaggaggcggtatacactgc

SEQ ID NO: 9002604 - DNA, 22 bp, Homo sapiens
cagaggaggccaccgcataggc

SEQ ID NO: 9002605 - DNA, 17 bp, Homo sapiens
cagaggagctttggggg

SEQ ID NO: 9002606 - DNA, 18 bp, Homo sapiens
cagaggagagacattcag

SEQ ID NO: 9002607 - DNA, 18 bp, Homo sapiens
cagaggagagacattcag

SEQ ID NO: 9002608 - DNA, 18 bp, Homo sapiens
cagaggagagacattcag

SEQ ID NO: 9002609 - DNA, 22 bp, Homo sapiens
cagaggagaattgcgggatcat

SEQ ID NO: 9002610 - DNA, 22 bp, Homo sapiens
cagaggagaattgcgggatcat

SEQ ID NO: 9002611 - DNA, 22 bp, Homo sapiens
cagaggagaattgcgggatcat

SEQ ID NO: 9002612 - DNA, 22 bp, Homo sapiens
cagagcttaaaactccatggaa

SEQ ID NO: 9002613 - DNA, 22 bp, Homo sapiens
cagagtgattatggaggattgc

SEQ ID NO: 9002614 - DNA, 22 bp, Homo sapiens
cagagtgcatggtgctgttcat

SEQ ID NO: 9002615 - DNA, 22 bp, Homo sapiens
cagagtgatttgatgagttgca

SEQ ID NO: 9002616 - DNA, 22 bp, Homo sapiens
cagagtggagaaacgcttcgtc

SEQ ID NO: 9002617 - DNA, 22 bp, Homo sapiens
cagagtgcatggtgctgttcat

SEQ ID NO: 9002618 - DNA, 22 bp, Homo sapiens
cagagtgatggcacctgctggg

SEQ ID NO: 9002619 - DNA, 22 bp, Homo sapiens
cagagtgagggcctgcacctgc

SEQ ID NO: 9002620 - DNA, 22 bp, Homo sapiens
cagagtgataaatatagaaatt

SEQ ID NO: 9002621 - DNA, 22 bp, Homo sapiens
cagagtgaaataggggatcaag

SEQ ID NO: 9002622 - DNA, 22 bp, Homo sapiens
cagagtgaaataggggatcaag

SEQ ID NO: 9002623 - DNA, 22 bp, Homo sapiens
cagagtgaacagtgggatgtgc

SEQ ID NO: 9002624 - DNA, 22 bp, Homo sapiens
cagaggagtgggccgttatggt

SEQ ID NO: 9002625 - DNA, 20 bp, Homo sapiens
cagaggagtacatatgttca

SEQ ID NO: 9002626 - DNA, 22 bp, Homo sapiens
cagaggagttcagtacacagcc

SEQ ID NO: 9002627 - DNA, 22 bp, Homo sapiens
cagaggtgctggagtgagtcct

SEQ ID NO: 9002628 - DNA, 22 bp, Homo sapiens
cagaggtgctggagtgagtcct

SEQ ID NO: 9002629 - DNA, 21 bp, Homo sapiens
cagaggtggcctgacctctga

SEQ ID NO: 9002630 - DNA, 21 bp, Homo sapiens
cagaggtggcctgacctctga

SEQ ID NO: 9002631 - DNA, 22 bp, Homo sapiens
cagagtgaaataggggatcaag

SEQ ID NO: 9002632 - DNA, 22 bp, Homo sapiens
cactagaaaggtacagattatg

SEQ ID NO: 9002633 - DNA, 22 bp, Homo sapiens
cactagaaaggtacagattatg

SEQ ID NO: 9002634 - DNA, 22 bp, Homo sapiens
cactagaaaggtacagattatg

SEQ ID NO: 9002635 - DNA, 22 bp, Homo sapiens
cactagaaaggtacagattatg

SEQ ID NO: 9002636 - DNA, 22 bp, Homo sapiens
cactagaaccaatgacatttct

SEQ ID NO: 9002637 - DNA, 22 bp, Homo sapiens
cactagaaaggtacagattatg

SEQ ID NO: 9002638 - DNA, 22 bp, Homo sapiens
cactagaggttgatgagaggtg

SEQ ID NO: 9002639 - DNA, 22 bp, Homo sapiens
cactagaaccaatgacatttct

SEQ ID NO: 9002640 - DNA, 22 bp, Homo sapiens
agcaggtggacagaggaagaaa

SEQ ID NO: 9002641 - DNA, 22 bp, Homo sapiens
cactaggctggagtgcagtggc

SEQ ID NO: 9002642 - DNA, 22 bp, Homo sapiens
cactaggcgccgggtggctgtg

SEQ ID NO: 9002643 - DNA, 22 bp, Homo sapiens
cactaggcgccgggtggctgtg

SEQ ID NO: 9002644 - DNA, 22 bp, Homo sapiens
cactaggctggagtgcagtggc

SEQ ID NO: 9002645 - DNA, 22 bp, Homo sapiens
cactaggaagggatcagcctca

SEQ ID NO: 9002646 - DNA, 22 bp, Homo sapiens
cactagctccatttctgggagg

SEQ ID NO: 9002647 - DNA, 22 bp, Homo sapiens
cactaattacaaagagatggga

SEQ ID NO: 9002648 - DNA, 22 bp, Homo sapiens
cactacagaatcaaatacgggc

SEQ ID NO: 9002649 - DNA, 22 bp, Homo sapiens
cactacaggggtccacagctga

SEQ ID NO: 9002650 - DNA, 22 bp, Homo sapiens
cactacaggggtccacagctga

SEQ ID NO: 9002651 - DNA, 22 bp, Homo sapiens
cactaattctggagacaactca

SEQ ID NO: 9002652 - DNA, 22 bp, Homo sapiens
cactacaggggtccacagctga

SEQ ID NO: 9002653 - DNA, 20 bp, Homo sapiens
cactaactgctcatgactcc

SEQ ID NO: 9002654 - DNA, 19 bp, Homo sapiens
cactaagaagcaggggagc

SEQ ID NO: 9002655 - DNA, 22 bp, Homo sapiens
cactaattaatgaaattccagg

SEQ ID NO: 9002656 - DNA, 22 bp, Homo sapiens
cactaagttggtgttaattagt

SEQ ID NO: 9002657 - DNA, 22 bp, Homo sapiens
agcaggtggatttagacgggag

SEQ ID NO: 9002658 - DNA, 22 bp, Homo sapiens
agcaggtggatttagacgggag

SEQ ID NO: 9002659 - DNA, 22 bp, Homo sapiens
agcaggtggccacgaggaggag

SEQ ID NO: 9002660 - DNA, 22 bp, Homo sapiens
agcaggtggccacgaggaggag

SEQ ID NO: 9002661 - DNA, 22 bp, Homo sapiens
agcaggtggcctcctgtctgtc

SEQ ID NO: 9002662 - DNA, 22 bp, Homo sapiens
agcaggtggccacgaggaggag

SEQ ID NO: 9002663 - DNA, 22 bp, Homo sapiens
agcaggtggccacgaggaggag

SEQ ID NO: 9002664 - DNA, 22 bp, Homo sapiens
agcaggtggccacgaggaggag

SEQ ID NO: 9002665 - DNA, 22 bp, Homo sapiens
agcaggtgggatcaagctggca

SEQ ID NO: 9002666 - DNA, 18 bp, Homo sapiens
agcaggtggcgtctgcag

SEQ ID NO: 9002667 - DNA, 22 bp, Homo sapiens
agcaggtggcctcctgtctgtc

SEQ ID NO: 9002668 - DNA, 22 bp, Homo sapiens
agcaggtgggatcaagctggca

SEQ ID NO: 9002669 - DNA, 22 bp, Homo sapiens
agcaggtgggatcaagctggca

SEQ ID NO: 9002670 - DNA, 22 bp, Homo sapiens
agcaggtgggcatgaaagctga

SEQ ID NO: 9002671 - DNA, 22 bp, Homo sapiens
cactgaaatcgaaaaatgtagg

SEQ ID NO: 9002672 - DNA, 22 bp, Homo sapiens
cactgaaatcgaaaaatgtagg

SEQ ID NO: 9002673 - DNA, 22 bp, Homo sapiens
cactgaaatcgaaaaatgtagg

SEQ ID NO: 9002674 - DNA, 22 bp, Homo sapiens
cacattgcagacgtatattatt

SEQ ID NO: 9002675 - DNA, 22 bp, Homo sapiens
cacattgattcagtcctgtgtg

SEQ ID NO: 9002676 - DNA, 22 bp, Homo sapiens
cacattgggatgaagtctaaaa

SEQ ID NO: 9002677 - DNA, 22 bp, Homo sapiens
cacattggcaaacggggttgca

SEQ ID NO: 9002678 - DNA, 22 bp, Homo sapiens
cacattgctccacagggttaac

SEQ ID NO: 9002679 - DNA, 22 bp, Homo sapiens
cacattgtagagattagaaaga

SEQ ID NO: 9002680 - DNA, 22 bp, Homo sapiens
cacattgtagagattagaaaga

SEQ ID NO: 9002681 - DNA, 22 bp, Homo sapiens
cacattgtattgtggaaagtta

SEQ ID NO: 9002682 - DNA, 21 bp, Homo sapiens
cacattgaatacagagatgga

SEQ ID NO: 9002683 - DNA, 22 bp, Homo sapiens
cacattgataattaaggcctcc

SEQ ID NO: 9002684 - DNA, 21 bp, Homo sapiens
cacattgaatacagagatgga

SEQ ID NO: 9002685 - DNA, 22 bp, Homo sapiens
cacattgaacttgtctggtggg

SEQ ID NO: 9002686 - DNA, 22 bp, Homo sapiens
cacattgataattaaggcctcc

SEQ ID NO: 9002687 - DNA, 23 bp, Homo sapiens
cacattgaacactctctttcctg

SEQ ID NO: 9002688 - DNA, 22 bp, Homo sapiens
cacattgaaatgacccaataat

SEQ ID NO: 9002689 - DNA, 23 bp, Homo sapiens
cacattgaacactctctttcctg

SEQ ID NO: 9002690 - DNA, 22 bp, Homo sapiens
cacattgaaccatatattagtg

SEQ ID NO: 9002691 - DNA, 22 bp, Homo sapiens
cacattctttcacagttctgaa

SEQ ID NO: 9002692 - DNA, 17 bp, Homo sapiens
cacatgtctacatggat

SEQ ID NO: 9002693 - DNA, 22 bp, Homo sapiens
cacatttaaaggttgaagctga

SEQ ID NO: 9002694 - DNA, 22 bp, Homo sapiens
cacatttaaaggttgaagctga

SEQ ID NO: 9002695 - DNA, 22 bp, Homo sapiens
cacatttaagcagatgtggacc

SEQ ID NO: 9002696 - DNA, 22 bp, Homo sapiens
cacatttaagcagatgtggacc

SEQ ID NO: 9002697 - DNA, 22 bp, Homo sapiens
cacatttaagcagatgtggacc

SEQ ID NO: 9002698 - DNA, 22 bp, Homo sapiens
cacatttaaaaaatccacgatc

SEQ ID NO: 9002699 - DNA, 22 bp, Homo sapiens
cacatttaaaaaatccacgatc

SEQ ID NO: 9002700 - DNA, 22 bp, Homo sapiens
cacattgtattgtggaaagtta

SEQ ID NO: 9002701 - DNA, 22 bp, Homo sapiens
cacatttaaaaaatccacgatc

SEQ ID NO: 9002702 - DNA, 22 bp, Homo sapiens
cacatttaaaggttgaagctga

SEQ ID NO: 9002703 - DNA, 22 bp, Homo sapiens
cacatttaagtgcttgttcaga

SEQ ID NO: 9002704 - DNA, 22 bp, Homo sapiens
cacatttaagtgcttgttcaga

SEQ ID NO: 9002705 - DNA, 22 bp, Homo sapiens
cacatttaagtgcttgttcaga

SEQ ID NO: 9002706 - DNA, 22 bp, Homo sapiens
cacatttaagtgcttgttcaga

SEQ ID NO: 9002707 - DNA, 22 bp, Homo sapiens
cacatttaagcagatgtggacc

SEQ ID NO: 9002708 - DNA, 22 bp, Homo sapiens
cacctgccaaatggggatgctg

SEQ ID NO: 9002709 - DNA, 22 bp, Homo sapiens
cacctgccaaatggggatgctg

SEQ ID NO: 9002710 - DNA, 22 bp, Homo sapiens
cacggcctgtaaggacccagga

SEQ ID NO: 9002711 - DNA, 22 bp, Homo sapiens
cacatttaagtgcttgttcaga

SEQ ID NO: 9002712 - DNA, 22 bp, Homo sapiens
cacctgagtgtcagtattctca

SEQ ID NO: 9002713 - DNA, 22 bp, Homo sapiens
cacctgcaaggagctttcattt

SEQ ID NO: 9002714 - DNA, 22 bp, Homo sapiens
cactaaaactacattggaaaca

SEQ ID NO: 9002715 - DNA, 22 bp, Homo sapiens
cactaaatgtttcaatgtggga

SEQ ID NO: 9002716 - DNA, 22 bp, Homo sapiens
cacgttaacagctaacagatga

SEQ ID NO: 9002717 - DNA, 22 bp, Homo sapiens
cacgtccacccaggctgcccag

SEQ ID NO: 9002718 - DNA, 22 bp, Homo sapiens
cacgtccacccaggctgcccag

SEQ ID NO: 9002719 - DNA, 22 bp, Homo sapiens
cacggtggcccacaggtgcaag

SEQ ID NO: 9002720 - DNA, 22 bp, Homo sapiens
cacggtggaaagtagttagttg

SEQ ID NO: 9002721 - DNA, 22 bp, Homo sapiens
cacgggtggaatcagggactcc

SEQ ID NO: 9002722 - DNA, 22 bp, Homo sapiens
cacgggcagtgagcacagcctg

SEQ ID NO: 9002723 - DNA, 22 bp, Homo sapiens
agcaggcctcatgcaccagcta

SEQ ID NO: 9002724 - DNA, 22 bp, Homo sapiens
agcaggcctgccacctcggggt

SEQ ID NO: 9002725 - DNA, 22 bp, Homo sapiens
agcaggcccagggcttctcagc

SEQ ID NO: 9002726 - DNA, 19 bp, Homo sapiens
agcaggccaggcaggtggc

SEQ ID NO: 9002727 - DNA, 19 bp, Homo sapiens
agcaggccaggcaggtggc

SEQ ID NO: 9002728 - DNA, 22 bp, Homo sapiens
agcaggcccaagctggggggaa

SEQ ID NO: 9002729 - DNA, 21 bp, Homo sapiens
agcaggcccaatggagggggc

SEQ ID NO: 9002730 - DNA, 22 bp, Homo sapiens
agcaggctaatcttgctgaaca

SEQ ID NO: 9002731 - DNA, 22 bp, Homo sapiens
agcaggctaatcttgctgaaca

SEQ ID NO: 9002732 - DNA, 22 bp, Homo sapiens
agcaggctaaataataatacat

SEQ ID NO: 9002733 - DNA, 22 bp, Homo sapiens
agcaggctaagggacctgttta

SEQ ID NO: 9002734 - DNA, 22 bp, Homo sapiens
agcaggctaatcttgctgaaca

SEQ ID NO: 9002735 - DNA, 22 bp, Homo sapiens
agcaggctaatcttgctgaaca

SEQ ID NO: 9002736 - DNA, 22 bp, Homo sapiens
agcaggcctgccacctcggggt

SEQ ID NO: 9002737 - DNA, 20 bp, Homo sapiens
agcaggccttggggagagga

SEQ ID NO: 9002738 - DNA, 20 bp, Homo sapiens
agcaggccttggggagagga

SEQ ID NO: 9002739 - DNA, 18 bp, Homo sapiens
agcaggcgttgcctggga

SEQ ID NO: 9002740 - DNA, 20 bp, Homo sapiens
agcaggccttggggagagga

SEQ ID NO: 9002741 - DNA, 19 bp, Homo sapiens
agcaggctaggctgcctct

SEQ ID NO: 9002742 - DNA, 22 bp, Homo sapiens
agcaggctaggaacctcactgc

SEQ ID NO: 9002743 - DNA, 19 bp, Homo sapiens
agcaggctaggctgcctct

SEQ ID NO: 9002744 - DNA, 22 bp, Homo sapiens
agcaggctactcctgtgttcgt

SEQ ID NO: 9002745 - DNA, 22 bp, Homo sapiens
agcaggctaggaacctcactgc

SEQ ID NO: 9002746 - DNA, 22 bp, Homo sapiens
agcaggctaggaacctcactgc

SEQ ID NO: 9002747 - DNA, 20 bp, Homo sapiens
cacaggctatatgagagcca

SEQ ID NO: 9002748 - DNA, 20 bp, Homo sapiens
cacaggctatatgagagcca

SEQ ID NO: 9002749 - DNA, 19 bp, Homo sapiens
agcaggctaggctgcctct

SEQ ID NO: 9002750 - DNA, 18 bp, Homo sapiens
cacaggctcccagtgagg

SEQ ID NO: 9002751 - DNA, 18 bp, Homo sapiens
cacaggctcccagtgagg

SEQ ID NO: 9002752 - DNA, 20 bp, Homo sapiens
cacaggctatatgagagcca

SEQ ID NO: 9002753 - DNA, 22 bp, Homo sapiens
cacaggctccggccttgcagcc

SEQ ID NO: 9002754 - DNA, 22 bp, Homo sapiens
cacaggctccggccttgcagcc

SEQ ID NO: 9002755 - DNA, 22 bp, Homo sapiens
cacatgtagtaagcaggcaatg

SEQ ID NO: 9002756 - DNA, 22 bp, Homo sapiens
cacatgtcctgggaaaataact

SEQ ID NO: 9002757 - DNA, 22 bp, Homo sapiens
cacatgtcctggcgctgagccc

SEQ ID NO: 9002758 - DNA, 22 bp, Homo sapiens
cacatgtcctggcgctgagccc

SEQ ID NO: 9002759 - DNA, 17 bp, Homo sapiens
cacatgtctacatggat

SEQ ID NO: 9002760 - DNA, 22 bp, Homo sapiens
cacattctttcacagttctgaa

SEQ ID NO: 9002761 - DNA, 17 bp, Homo sapiens
cacatgtctacatggat

SEQ ID NO: 9002762 - DNA, 22 bp, Homo sapiens
cacatgtacagaagcaggctgg

SEQ ID NO: 9002763 - DNA, 22 bp, Homo sapiens
cacatgtagtaagcaggcaatg

SEQ ID NO: 9002764 - DNA, 22 bp, Homo sapiens
cacatgtacagaagcaggctgg

SEQ ID NO: 9002765 - DNA, 22 bp, Homo sapiens
cacatgggtgtgcctggaggaa

SEQ ID NO: 9002766 - DNA, 22 bp, Homo sapiens
cacatgggtgtgcctggaggaa

SEQ ID NO: 9002767 - DNA, 22 bp, Homo sapiens
cacatgggtggatggatgcatg

SEQ ID NO: 9002768 - DNA, 22 bp, Homo sapiens
cacatggggcgctgcattggcc

SEQ ID NO: 9002769 - DNA, 22 bp, Homo sapiens
cacatgggcttagcaggcaggg

SEQ ID NO: 9002770 - DNA, 22 bp, Homo sapiens
cacatgggcttagcaggcaggg

SEQ ID NO: 9002771 - DNA, 22 bp, Homo sapiens
cacatggcctgtgtggccagac

SEQ ID NO: 9002772 - DNA, 22 bp, Homo sapiens
cacatggcctgtgtggccagac

SEQ ID NO: 9002773 - DNA, 23 bp, Homo sapiens
cacatggattaaatgagaccaca

SEQ ID NO: 9002774 - DNA, 23 bp, Homo sapiens
cacatggattaaatgagaccaca

SEQ ID NO: 9002775 - DNA, 22 bp, Homo sapiens
cacatggcagaatcatgcatct

SEQ ID NO: 9002776 - DNA, 22 bp, Homo sapiens
cacatgcttcttttgattatga

SEQ ID NO: 9002777 - DNA, 22 bp, Homo sapiens
cacatggaagagatacagtgag

SEQ ID NO: 9002778 - DNA, 23 bp, Homo sapiens
cacatggaggaccgttcttataa

SEQ ID NO: 9002779 - DNA, 22 bp, Homo sapiens
cacatgcttagatttcagtgga

SEQ ID NO: 9002780 - DNA, 22 bp, Homo sapiens
cacatggaagagatacagtgag

SEQ ID NO: 9002781 - DNA, 22 bp, Homo sapiens
cacatgcttcttttgattatga

SEQ ID NO: 9002782 - DNA, 22 bp, Homo sapiens
cacatgaagacctaattggatt

SEQ ID NO: 9002783 - DNA, 22 bp, Homo sapiens
cacatgcttagatttcagtgga

SEQ ID NO: 9002784 - DNA, 22 bp, Homo sapiens
cacatgaagagagtctagtaat

SEQ ID NO: 9002785 - DNA, 22 bp, Homo sapiens
cacaggctcttctcacttgatt

SEQ ID NO: 9002786 - DNA, 22 bp, Homo sapiens
cacaggctctccagggcctgga

SEQ ID NO: 9002787 - DNA, 22 bp, Homo sapiens
cacaggctctccagggcctgga

SEQ ID NO: 9002788 - DNA, 22 bp, Homo sapiens
cacaggctctccagggcctgga

SEQ ID NO: 9002789 - DNA, 22 bp, Homo sapiens
cacaggctgcccgcagctggga

SEQ ID NO: 9002790 - DNA, 22 bp, Homo sapiens
cacaggctgcccgcagctggga

SEQ ID NO: 9002791 - DNA, 22 bp, Homo sapiens
agcattaggtgtgtttcagagg

SEQ ID NO: 9002792 - DNA, 22 bp, Homo sapiens
agcattatgtccatgctaaatt

SEQ ID NO: 9002793 - DNA, 22 bp, Homo sapiens
cactgcacttcagcctgggtga

SEQ ID NO: 9002794 - DNA, 22 bp, Homo sapiens
cactgcacttcagcctgggtga

SEQ ID NO: 9002795 - DNA, 22 bp, Homo sapiens
cactgcacttcagcctgggtga

SEQ ID NO: 9002796 - DNA, 22 bp, Homo sapiens
cactgcacttcagcctgggtga

SEQ ID NO: 9002797 - DNA, 22 bp, Homo sapiens
cactgcacttcagcctgggtga

SEQ ID NO: 9002798 - DNA, 21 bp, Homo sapiens
agcattcaaaagatgccataa

SEQ ID NO: 9002799 - DNA, 21 bp, Homo sapiens
agcattcaaaagatgccataa

SEQ ID NO: 9002800 - DNA, 21 bp, Homo sapiens
agcattcaaaagatgccataa

SEQ ID NO: 9002801 - DNA, 21 bp, Homo sapiens
agcattcaaaagatgccataa

SEQ ID NO: 9002802 - DNA, 22 bp, Homo sapiens
agcattcaagtaattcacttgg

SEQ ID NO: 9002803 - DNA, 22 bp, Homo sapiens
agcatttaggagaatttgagaa

SEQ ID NO: 9002804 - DNA, 22 bp, Homo sapiens
cactgcacttcagcctgggtga

SEQ ID NO: 9002805 - DNA, 22 bp, Homo sapiens
cactgcacttcagcctgggtga

SEQ ID NO: 9002806 - DNA, 22 bp, Homo sapiens
cactgcactccatcctgggaaa

SEQ ID NO: 9002807 - DNA, 22 bp, Homo sapiens
cactgcacttcagcctgggtga

SEQ ID NO: 9002808 - DNA, 22 bp, Homo sapiens
cactgcacttcagcctgggtga

SEQ ID NO: 9002809 - DNA, 22 bp, Homo sapiens
cactgcacttcagcctgggtga

SEQ ID NO: 9002810 - DNA, 22 bp, Homo sapiens
cactgcacttcagcctgggtga

SEQ ID NO: 9002811 - DNA, 22 bp, Homo sapiens
cactgcacttcagcctgggtga

SEQ ID NO: 9002812 - DNA, 22 bp, Homo sapiens
agcatttatttcttagaaattg

SEQ ID NO: 9002813 - DNA, 22 bp, Homo sapiens
agcatttattgacctgctgctg

SEQ ID NO: 9002814 - DNA, 20 bp, Homo sapiens
agcatttgaaatatgactat

SEQ ID NO: 9002815 - DNA, 20 bp, Homo sapiens
agcatttgaaatatgactat

SEQ ID NO: 9002816 - DNA, 22 bp, Homo sapiens
agcatttcttggcccattgtag

SEQ ID NO: 9002817 - DNA, 22 bp, Homo sapiens
agcatttccgccctcttctgcc

SEQ ID NO: 9002818 - DNA, 22 bp, Homo sapiens
agcatttatttcttagaaattg

SEQ ID NO: 9002819 - DNA, 22 bp, Homo sapiens
agcatttatgactaatgtaaaa

SEQ ID NO: 9002820 - DNA, 22 bp, Homo sapiens
agcatttatcttttgtttgagt

SEQ ID NO: 9002821 - DNA, 22 bp, Homo sapiens
agcatttagttagtaaatgttt

SEQ ID NO: 9002822 - DNA, 22 bp, Homo sapiens
agcatttaggagaatttgagaa

SEQ ID NO: 9002823 - DNA, 22 bp, Homo sapiens
agcatttagtctttattgcagc

SEQ ID NO: 9002824 - DNA, 22 bp, Homo sapiens
cactgcactccatcctgggaaa

SEQ ID NO: 9002825 - DNA, 22 bp, Homo sapiens
cactgcactccatcctgggaaa

SEQ ID NO: 9002826 - DNA, 22 bp, Homo sapiens
cactgcactccatcctgggaaa

SEQ ID NO: 9002827 - DNA, 22 bp, Homo sapiens
cactgcactccatcctgggaaa

SEQ ID NO: 9002828 - DNA, 22 bp, Homo sapiens
cactgcactccatcctgggaaa

SEQ ID NO: 9002829 - DNA, 22 bp, Homo sapiens
cactgcactccatcctgggaaa

SEQ ID NO: 9002830 - DNA, 22 bp, Homo sapiens
cactgcactccatcctgggaaa

SEQ ID NO: 9002831 - DNA, 22 bp, Homo sapiens
cactgcactccatcctgggaaa

SEQ ID NO: 9002832 - DNA, 22 bp, Homo sapiens
cactgcactccatcctgggaaa

SEQ ID NO: 9002833 - DNA, 22 bp, Homo sapiens
cactgcactccatcctgggaaa

SEQ ID NO: 9002834 - DNA, 22 bp, Homo sapiens
cactgcactccagcccgggcaa

SEQ ID NO: 9002835 - DNA, 22 bp, Homo sapiens
cactgcactccagcccgggcaa

SEQ ID NO: 9002836 - DNA, 22 bp, Homo sapiens
cactgcactccagcccgggcaa

SEQ ID NO: 9002837 - DNA, 22 bp, Homo sapiens
cactgcactccagcccgggcaa

SEQ ID NO: 9002838 - DNA, 22 bp, Homo sapiens
cactgcactccagcccgggcaa

SEQ ID NO: 9002839 - DNA, 22 bp, Homo sapiens
cactgcactccagcccgggcaa

SEQ ID NO: 9002840 - DNA, 22 bp, Homo sapiens
cactgcactccagcccgggcaa

SEQ ID NO: 9002841 - DNA, 22 bp, Homo sapiens
cactgcactccagcccgggcaa

SEQ ID NO: 9002842 - DNA, 22 bp, Homo sapiens
cactgcactccagcccgggcaa

SEQ ID NO: 9002843 - DNA, 22 bp, Homo sapiens
cactgcactccagcactccagc

SEQ ID NO: 9002844 - DNA, 22 bp, Homo sapiens
cactgcactccagcccgggcaa

SEQ ID NO: 9002845 - DNA, 22 bp, Homo sapiens
cactgcactccagcccgggcaa

SEQ ID NO: 9002846 - DNA, 22 bp, Homo sapiens
cactgcactccagcccgggcaa

SEQ ID NO: 9002847 - DNA, 22 bp, Homo sapiens
cactgcactccagcccgggcaa

SEQ ID NO: 9002848 - DNA, 22 bp, Homo sapiens
cactgcacaatgtagcaaagaa

SEQ ID NO: 9002849 - DNA, 22 bp, Homo sapiens
cactgcaagctctgccacctgg

SEQ ID NO: 9002850 - DNA, 22 bp, Homo sapiens
cactgcacaggtgagatgtggg

SEQ ID NO: 9002851 - DNA, 22 bp, Homo sapiens
cactgcacaggtgagatgtggg

SEQ ID NO: 9002852 - DNA, 22 bp, Homo sapiens
cactgcaccctcaaactcctgg

SEQ ID NO: 9002853 - DNA, 22 bp, Homo sapiens
cactgcaacctccacctcctgg

SEQ ID NO: 9002854 - DNA, 22 bp, Homo sapiens
cactgcaacctccatcttctgg

SEQ ID NO: 9002855 - DNA, 22 bp, Homo sapiens
cactgcaacctctgccacctgg

SEQ ID NO: 9002856 - DNA, 22 bp, Homo sapiens
cactgaactggtcttaggaggt

SEQ ID NO: 9002857 - DNA, 22 bp, Homo sapiens
cactgcaacctccacctcctgg

SEQ ID NO: 9002858 - DNA, 22 bp, Homo sapiens
cactgcaacctccacctcctgg

SEQ ID NO: 9002859 - DNA, 22 bp, Homo sapiens
cactgcaacctccacctcctgg

SEQ ID NO: 9002860 - DNA, 22 bp, Homo sapiens
cactgcaacctccacctcctgg

SEQ ID NO: 9002861 - DNA, 22 bp, Homo sapiens
cactgcaacctccacctcctgg

SEQ ID NO: 9002862 - DNA, 22 bp, Homo sapiens
cagaaactgcttgtggtcatct

SEQ ID NO: 9002863 - DNA, 22 bp, Homo sapiens
cagaaactatgtaagaaagtga

SEQ ID NO: 9002864 - DNA, 22 bp, Homo sapiens
cagaaactatgtaagaaagtga

SEQ ID NO: 9002865 - DNA, 22 bp, Homo sapiens
cagaaactagatttagacacaa

SEQ ID NO: 9002866 - DNA, 22 bp, Homo sapiens
cagaaactagatttagacacaa

SEQ ID NO: 9002867 - DNA, 22 bp, Homo sapiens
cagaaactagatttagacacaa

SEQ ID NO: 9002868 - DNA, 22 bp, Homo sapiens
cagaaacatgtataaagttgta

SEQ ID NO: 9002869 - DNA, 22 bp, Homo sapiens
cagaaacatgtataaagttgta

SEQ ID NO: 9002870 - DNA, 22 bp, Homo sapiens
cagaaaccaaatgggatgggga

SEQ ID NO: 9002871 - DNA, 22 bp, Homo sapiens
cagaaaccaaatgggatgggga

SEQ ID NO: 9002872 - DNA, 22 bp, Homo sapiens
cagaaacctgtctggagtggga

SEQ ID NO: 9002873 - DNA, 22 bp, Homo sapiens
cagaaactagatttagacacaa

SEQ ID NO: 9002874 - DNA, 22 bp, Homo sapiens
cagaaacctgtctggagtggga

SEQ ID NO: 9002875 - DNA, 22 bp, Homo sapiens
cagaaacctccctgaatatttt

SEQ ID NO: 9002876 - DNA, 21 bp, Homo sapiens
cagaaacttgctttgccttct

SEQ ID NO: 9002877 - DNA, 22 bp, Homo sapiens
cagaaacttctggtgtcaaata

SEQ ID NO: 9002878 - DNA, 22 bp, Homo sapiens
cagaaacttctggtgtcaaata

SEQ ID NO: 9002879 - DNA, 22 bp, Homo sapiens
cagaaactgcttgtggtcatct

SEQ ID NO: 9002880 - DNA, 22 bp, Homo sapiens
cagaaactgtttgttaatattt

SEQ ID NO: 9002881 - DNA, 22 bp, Homo sapiens
cagaaactgtttgttaatattt

SEQ ID NO: 9002882 - DNA, 20 bp, Homo sapiens
cagaaagaaggtagattttt

SEQ ID NO: 9002883 - DNA, 22 bp, Homo sapiens
cagaaacttttgatgagtgtat

SEQ ID NO: 9002884 - DNA, 22 bp, Homo sapiens
cagaaactttctttactgagca

SEQ ID NO: 9002885 - DNA, 22 bp, Homo sapiens
cagaaactttctttactgagca

SEQ ID NO: 9002886 - DNA, 22 bp, Homo sapiens
cagaaagacctgggctcaagag

SEQ ID NO: 9002887 - DNA, 22 bp, Homo sapiens
cagaaagacctgggctcaagag

SEQ ID NO: 9002888 - DNA, 22 bp, Homo sapiens
agccaaagatcagtgtgcaagt

SEQ ID NO: 9002889 - DNA, 22 bp, Homo sapiens
cagaaagacctgggctcaagag

SEQ ID NO: 9002890 - DNA, 22 bp, Homo sapiens
cagaaagacctgggctcaagag

SEQ ID NO: 9002891 - DNA, 20 bp, Homo sapiens
cagaaagaaggtagattttt

SEQ ID NO: 9002892 - DNA, 20 bp, Homo sapiens
cagaaagaaggtagattttt

SEQ ID NO: 9002893 - DNA, 22 bp, Homo sapiens
cagaaagacctgattggcagtt

SEQ ID NO: 9002894 - DNA, 22 bp, Homo sapiens
agccaaatacaaactggggtgg

SEQ ID NO: 9002895 - DNA, 23 bp, Homo sapiens
agccaaatcttaacttctgttac

SEQ ID NO: 9002896 - DNA, 22 bp, Homo sapiens
agccaaatctaaagtgaatatt

SEQ ID NO: 9002897 - DNA, 22 bp, Homo sapiens
agccaaagtccaaatgcagtgt

SEQ ID NO: 9002898 - DNA, 22 bp, Homo sapiens
agccaacagccagcatcaacca

SEQ ID NO: 9002899 - DNA, 20 bp, Homo sapiens
agccaaaggagaacagtgct

SEQ ID NO: 9002900 - DNA, 22 bp, Homo sapiens
agccaaaggcaccagagacact

SEQ ID NO: 9002901 - DNA, 22 bp, Homo sapiens
agccaaagatcagtgtgcaagt

SEQ ID NO: 9002902 - DNA, 22 bp, Homo sapiens
agccaaagatcagtgtgcaagt

SEQ ID NO: 9002903 - DNA, 22 bp, Homo sapiens
cactggtagcagttaagttagg

SEQ ID NO: 9002904 - DNA, 22 bp, Homo sapiens
cactggtagtttcagcaaccag

SEQ ID NO: 9002905 - DNA, 22 bp, Homo sapiens
cactggtcagcatggtagacca

SEQ ID NO: 9002906 - DNA, 22 bp, Homo sapiens
cactggtatttgaaaatagatg

SEQ ID NO: 9002907 - DNA, 22 bp, Homo sapiens
cactttgatgcagggctcagta

SEQ ID NO: 9002908 - DNA, 22 bp, Homo sapiens
cactttgatgcagggctcagta

SEQ ID NO: 9002909 - DNA, 22 bp, Homo sapiens
cactttgatttgtgatgtgaga

SEQ ID NO: 9002910 - DNA, 22 bp, Homo sapiens
cactttgatgcagggctcagta

SEQ ID NO: 9002911 - DNA, 22 bp, Homo sapiens
cactttgatgcagggctcagta

SEQ ID NO: 9002912 - DNA, 22 bp, Homo sapiens
cactttgaagagctttttgaca

SEQ ID NO: 9002913 - DNA, 22 bp, Homo sapiens
cactttgaagagctttttgaca

SEQ ID NO: 9002914 - DNA, 22 bp, Homo sapiens
cactggtctttggctaggtgtg

SEQ ID NO: 9002915 - DNA, 22 bp, Homo sapiens
cagaaacatgtataaagttgta

SEQ ID NO: 9002916 - DNA, 22 bp, Homo sapiens
cactttgcttagagaacaaggc

SEQ ID NO: 9002917 - DNA, 22 bp, Homo sapiens
cactggtacgtaggttggggca

SEQ ID NO: 9002918 - DNA, 22 bp, Homo sapiens
cactggtagagagaagacaagg

SEQ ID NO: 9002919 - DNA, 21 bp, Homo sapiens
cactggtagatggcccgcagg

SEQ ID NO: 9002920 - DNA, 22 bp, Homo sapiens
cactgggtcaggatagagccca

SEQ ID NO: 9002921 - DNA, 22 bp, Homo sapiens
cactgggtaaatttgaggctga

SEQ ID NO: 9002922 - DNA, 22 bp, Homo sapiens
cactggtacactgaatggcgtt

SEQ ID NO: 9002923 - DNA, 22 bp, Homo sapiens
cactgggtaaatttgaggctga

SEQ ID NO: 9002924 - DNA, 22 bp, Homo sapiens
cactggggtgggcctggtagag

SEQ ID NO: 9002925 - DNA, 22 bp, Homo sapiens
cactgggcgccagctgctgagc

SEQ ID NO: 9002926 - DNA, 23 bp, Homo sapiens
cactgggcccagggtgtggaggc

SEQ ID NO: 9002927 - DNA, 22 bp, Homo sapiens
cactgggcgtgtcctgggtgag

SEQ ID NO: 9002928 - DNA, 22 bp, Homo sapiens
cactgggcgtgtcctgggtgag

SEQ ID NO: 9002929 - DNA, 22 bp, Homo sapiens
cactgggcgtgtcctgggtgag

SEQ ID NO: 9002930 - DNA, 20 bp, Homo sapiens
cactgggctggagtcagggc

SEQ ID NO: 9002931 - DNA, 20 bp, Homo sapiens
cactgggctggagtcagggc

SEQ ID NO: 9002932 - DNA, 22 bp, Homo sapiens
cactgggctgataccaggcttc

SEQ ID NO: 9002933 - DNA, 22 bp, Homo sapiens
cactgggctgataccaggcttc

SEQ ID NO: 9002934 - DNA, 22 bp, Homo sapiens
cactgggctgataccaggcttc

SEQ ID NO: 9002935 - DNA, 17 bp, Homo sapiens
agcatttgtgttaacag

SEQ ID NO: 9002936 - DNA, 20 bp, Homo sapiens
agcattttatggtaggaaac

SEQ ID NO: 9002937 - DNA, 20 bp, Homo sapiens
agcattttatggtaggaaac

SEQ ID NO: 9002938 - DNA, 20 bp, Homo sapiens
agcattttatggtaggaaac

SEQ ID NO: 9002939 - DNA, 22 bp, Homo sapiens
agcattttctgagagtatagat

SEQ ID NO: 9002940 - DNA, 22 bp, Homo sapiens
agcattttctgagagtatagat

SEQ ID NO: 9002941 - DNA, 22 bp, Homo sapiens
agcattttctgagagtatagat

SEQ ID NO: 9002942 - DNA, 22 bp, Homo sapiens
cactgggcaattctgagcctaa

SEQ ID NO: 9002943 - DNA, 22 bp, Homo sapiens
cactgggcaattctgagcctaa

SEQ ID NO: 9002944 - DNA, 22 bp, Homo sapiens
cactgggcacttgggttgcttc

SEQ ID NO: 9002945 - DNA, 22 bp, Homo sapiens
cactgggcacttgggttgcttc

SEQ ID NO: 9002946 - DNA, 22 bp, Homo sapiens
agccaaaacatgtgagttttga

SEQ ID NO: 9002947 - DNA, 22 bp, Homo sapiens
cacaggaacttactggccactt

SEQ ID NO: 9002948 - DNA, 22 bp, Homo sapiens
cacaggaacaaagaagacaatt

SEQ ID NO: 9002949 - DNA, 22 bp, Homo sapiens
cacaggaacaaagaagacaatt

SEQ ID NO: 9002950 - DNA, 22 bp, Homo sapiens
cacaggaacaaagaagacaatt

SEQ ID NO: 9002951 - DNA, 22 bp, Homo sapiens
cacaggaaatgattctgcagca

SEQ ID NO: 9002952 - DNA, 22 bp, Homo sapiens
cacaggaaatgattctgcagca

SEQ ID NO: 9002953 - DNA, 22 bp, Homo sapiens
cacaggaaatgattctgcagca

SEQ ID NO: 9002954 - DNA, 22 bp, Homo sapiens
cacaggaaatgattctgcagca

SEQ ID NO: 9002955 - DNA, 22 bp, Homo sapiens
cacaggaaatattaggagggat

SEQ ID NO: 9002956 - DNA, 22 bp, Homo sapiens
cacaggaagatctcccagaggt

SEQ ID NO: 9002957 - DNA, 22 bp, Homo sapiens
cacaggaagatctcccagaggt

SEQ ID NO: 9002958 - DNA, 22 bp, Homo sapiens
cacaggaagatctcccagaggt

SEQ ID NO: 9002959 - DNA, 22 bp, Homo sapiens
cacaggaagatctcccagaggt

SEQ ID NO: 9002960 - DNA, 22 bp, Homo sapiens
cacaggaagaggtatacaattc

SEQ ID NO: 9002961 - DNA, 22 bp, Homo sapiens
agcaggcaggcccagcggctgg

SEQ ID NO: 9002962 - DNA, 22 bp, Homo sapiens
agcaggcaggcccagcggctgg

SEQ ID NO: 9002963 - DNA, 22 bp, Homo sapiens
cacaggaaagtcagccagaaga

SEQ ID NO: 9002964 - DNA, 22 bp, Homo sapiens
cacaggaaagtcagccagaaga

SEQ ID NO: 9002965 - DNA, 20 bp, Homo sapiens
cacaggaaagctactcagtt

SEQ ID NO: 9002966 - DNA, 20 bp, Homo sapiens
cacaggaaagctactcagtt

SEQ ID NO: 9002967 - DNA, 20 bp, Homo sapiens
cacaggaaagctactcagtt

SEQ ID NO: 9002968 - DNA, 20 bp, Homo sapiens
cacaggaaagctactcagtt

SEQ ID NO: 9002969 - DNA, 22 bp, Homo sapiens
cacaggaaaataaaagatctaa

SEQ ID NO: 9002970 - DNA, 22 bp, Homo sapiens
cacaggaaaataaaagatctaa

SEQ ID NO: 9002971 - DNA, 22 bp, Homo sapiens
cacaggaaaataaaagatctaa

SEQ ID NO: 9002972 - DNA, 20 bp, Homo sapiens
cacaggaaagctactcagtt

SEQ ID NO: 9002973 - DNA, 20 bp, Homo sapiens
cacaggaaagctactcagtt

SEQ ID NO: 9002974 - DNA, 22 bp, Homo sapiens
cacaggaaaaatgggtccttta

SEQ ID NO: 9002975 - DNA, 22 bp, Homo sapiens
cacaggaaaaatgggtccttta

SEQ ID NO: 9002976 - DNA, 22 bp, Homo sapiens
cacaggaaaaatgggtccttta

SEQ ID NO: 9002977 - DNA, 22 bp, Homo sapiens
cacagctggtgacagagcccag

SEQ ID NO: 9002978 - DNA, 22 bp, Homo sapiens
cacagctggggaagctgaggcc

SEQ ID NO: 9002979 - DNA, 22 bp, Homo sapiens
cacagctggggaagctgaggcc

SEQ ID NO: 9002980 - DNA, 22 bp, Homo sapiens
cacagctggggaagctgaggcc

SEQ ID NO: 9002981 - DNA, 19 bp, Homo sapiens
cacagctggcgctgaccgc

SEQ ID NO: 9002982 - DNA, 19 bp, Homo sapiens
cacagctggcgctgaccgc

SEQ ID NO: 9002983 - DNA, 22 bp, Homo sapiens
cacagctggaatggggtacctg

SEQ ID NO: 9002984 - DNA, 22 bp, Homo sapiens
cacagctggaatggggtacctg

SEQ ID NO: 9002985 - DNA, 22 bp, Homo sapiens
cacagctggaatggggtacctg

SEQ ID NO: 9002986 - DNA, 22 bp, Homo sapiens
cacagctggggaagctgaggcc

SEQ ID NO: 9002987 - DNA, 22 bp, Homo sapiens
cacagctgggaaaatttgtaca

SEQ ID NO: 9002988 - DNA, 22 bp, Homo sapiens
cacagaaattattaggatgctt

SEQ ID NO: 9002989 - DNA, 22 bp, Homo sapiens
cacagaaattattaggatgctt

SEQ ID NO: 9002990 - DNA, 22 bp, Homo sapiens
cacagaaattattaggatgctt

SEQ ID NO: 9002991 - DNA, 22 bp, Homo sapiens
cacagaaatattgtgtcccttg

SEQ ID NO: 9002992 - DNA, 22 bp, Homo sapiens
cacagaaatattgtgtcccttg

SEQ ID NO: 9002993 - DNA, 22 bp, Homo sapiens
cacagaaatattgtgtcccttg

SEQ ID NO: 9002994 - DNA, 22 bp, Homo sapiens
cacagaaatattgtgtcccttg

SEQ ID NO: 9002995 - DNA, 22 bp, Homo sapiens
cacagaaatattgtgtcccttg

SEQ ID NO: 9002996 - DNA, 20 bp, Homo sapiens
cacagaacaaattgcaggac

SEQ ID NO: 9002997 - DNA, 22 bp, Homo sapiens
cacagaacaccaaagaaccttc

SEQ ID NO: 9002998 - DNA, 22 bp, Homo sapiens
cacagaacaccaaagaaccttc

SEQ ID NO: 9002999 - DNA, 22 bp, Homo sapiens
cacagaacaccaaagaaccttc

SEQ ID NO: 9003000 - DNA, 22 bp, Homo sapiens
cacagcagcatcatttatctgg

SEQ ID NO: 9003001 - DNA, 22 bp, Homo sapiens
cacagcagccagaacatttttg

SEQ ID NO: 9003002 - DNA, 22 bp, Homo sapiens
cacagcagccagaacatttttg

SEQ ID NO: 9003003 - DNA, 22 bp, Homo sapiens
cacagcagcgttcctccgtgtg

SEQ ID NO: 9003004 - DNA, 22 bp, Homo sapiens
cacagcagcgttcctccgtgtg

SEQ ID NO: 9003005 - DNA, 22 bp, Homo sapiens
cacagctgaccaccctgctccc

SEQ ID NO: 9003006 - DNA, 22 bp, Homo sapiens
cacagctgaccaccctgctccc

SEQ ID NO: 9003007 - DNA, 22 bp, Homo sapiens
cacagctgaccaccctgctccc

SEQ ID NO: 9003008 - DNA, 22 bp, Homo sapiens
cacagctgcttgttagaatagc

SEQ ID NO: 9003009 - DNA, 22 bp, Homo sapiens
cacagctgcttgttagaatagc

SEQ ID NO: 9003010 - DNA, 22 bp, Homo sapiens
cacagctgcttgttagaatagc

SEQ ID NO: 9003011 - DNA, 22 bp, Homo sapiens
cacagctgccctactccatgtg

SEQ ID NO: 9003012 - DNA, 22 bp, Homo sapiens
cacagctgccctactccatgtg

SEQ ID NO: 9003013 - DNA, 22 bp, Homo sapiens
cacagctgccctaactgtactc

SEQ ID NO: 9003014 - DNA, 22 bp, Homo sapiens
cacagctgccccctctctaact

SEQ ID NO: 9003015 - DNA, 22 bp, Homo sapiens
cacagctgccccctctctaact

SEQ ID NO: 9003016 - DNA, 22 bp, Homo sapiens
cacagctgccctactccatgtg

SEQ ID NO: 9003017 - DNA, 22 bp, Homo sapiens
cacagctgccctaactgtactc

SEQ ID NO: 9003018 - DNA, 22 bp, Homo sapiens
cacagctgcacagaggaggtgc

SEQ ID NO: 9003019 - DNA, 22 bp, Homo sapiens
cacagctgccatgcagtcagtg

SEQ ID NO: 9003020 - DNA, 22 bp, Homo sapiens
cacagctgccatgcagtcagtg

SEQ ID NO: 9003021 - DNA, 22 bp, Homo sapiens
cacagctgccatgcagtcagtg

SEQ ID NO: 9003022 - DNA, 22 bp, Homo sapiens
cacagctgccatggctgcactt

SEQ ID NO: 9003023 - DNA, 22 bp, Homo sapiens
cacagctgccatggctgcactt

SEQ ID NO: 9003024 - DNA, 22 bp, Homo sapiens
cacagctgccatggctgcactt

SEQ ID NO: 9003025 - DNA, 22 bp, Homo sapiens
cacagctgccatggctgcactt

SEQ ID NO: 9003026 - DNA, 22 bp, Homo sapiens
cacagaaaaaggcttgaaaatc

SEQ ID NO: 9003027 - DNA, 22 bp, Homo sapiens
cacagaaaaaggcttgaaaatc

SEQ ID NO: 9003028 - DNA, 22 bp, Homo sapiens
cacagaaaaaggcttgaaaatc

SEQ ID NO: 9003029 - DNA, 22 bp, Homo sapiens
cacagaaaggctcaaatcccaa

SEQ ID NO: 9003030 - DNA, 22 bp, Homo sapiens
cacactttgtgctaatctattt

SEQ ID NO: 9003031 - DNA, 22 bp, Homo sapiens
cacactttgtgctaatctattt

SEQ ID NO: 9003032 - DNA, 22 bp, Homo sapiens
cacactttgtgctaatctattt

SEQ ID NO: 9003033 - DNA, 22 bp, Homo sapiens
cacactttcaggtcctctttgc

SEQ ID NO: 9003034 - DNA, 22 bp, Homo sapiens
cacacttttggcatgtttggtt

SEQ ID NO: 9003035 - DNA, 22 bp, Homo sapiens
cacacttttctggctcaggctc

SEQ ID NO: 9003036 - DNA, 22 bp, Homo sapiens
cacacatgtgggatccgcaggg

SEQ ID NO: 9003037 - DNA, 22 bp, Homo sapiens
cacacatgtgagcagagaggcg

SEQ ID NO: 9003038 - DNA, 22 bp, Homo sapiens
cacacatgtctctccatgctct

SEQ ID NO: 9003039 - DNA, 22 bp, Homo sapiens
cacacatgtgagcagagaggcg

SEQ ID NO: 9003040 - DNA, 22 bp, Homo sapiens
cacacatgtgtgcagcttagaa

SEQ ID NO: 9003041 - DNA, 22 bp, Homo sapiens
cacacatgtgtgcagcttagaa

SEQ ID NO: 9003042 - DNA, 22 bp, Homo sapiens
cacactgttgaggacgagatgt

SEQ ID NO: 9003043 - DNA, 22 bp, Homo sapiens
cacactgttgaggacgagatgt

SEQ ID NO: 9003044 - DNA, 22 bp, Homo sapiens
cacacatggtcagtggctactc

SEQ ID NO: 9003045 - DNA, 22 bp, Homo sapiens
cacacatggttccgcaggatgc

SEQ ID NO: 9003046 - DNA, 22 bp, Homo sapiens
cacacatggttccgcaggatgc

SEQ ID NO: 9003047 - DNA, 22 bp, Homo sapiens
cacacatgtctctccatgctct

SEQ ID NO: 9003048 - DNA, 22 bp, Homo sapiens
cacacatgtctctccatgctct

SEQ ID NO: 9003049 - DNA, 22 bp, Homo sapiens
cacacatggtagcaggtacaag

SEQ ID NO: 9003050 - DNA, 22 bp, Homo sapiens
cacacatggtagcaggtacaag

SEQ ID NO: 9003051 - DNA, 22 bp, Homo sapiens
cacacatggtagcaggtacaag

SEQ ID NO: 9003052 - DNA, 22 bp, Homo sapiens
cacacatggtagcaggtacaag

SEQ ID NO: 9003053 - DNA, 22 bp, Homo sapiens
cacacatggtagcaggtacaag

SEQ ID NO: 9003054 - DNA, 22 bp, Homo sapiens
cacacatggtagcaggtacaag

SEQ ID NO: 9003055 - DNA, 22 bp, Homo sapiens
cacacatggtagcaggtacaag

SEQ ID NO: 9003056 - DNA, 22 bp, Homo sapiens
cacacatgcatgtaagacctct

SEQ ID NO: 9003057 - DNA, 22 bp, Homo sapiens
cacacatgcatgtaagacctct

SEQ ID NO: 9003058 - DNA, 22 bp, Homo sapiens
cacacatggctgccagggaggt

SEQ ID NO: 9003059 - DNA, 22 bp, Homo sapiens
cacacatgaatccctagtacct

SEQ ID NO: 9003060 - DNA, 22 bp, Homo sapiens
cacacatgaatccctagtacct

SEQ ID NO: 9003061 - DNA, 22 bp, Homo sapiens
cacacatgaatccctagtacct

SEQ ID NO: 9003062 - DNA, 22 bp, Homo sapiens
cacacatgaatccctagtacct

SEQ ID NO: 9003063 - DNA, 22 bp, Homo sapiens
cacacatgaagttgctgagcta

SEQ ID NO: 9003064 - DNA, 22 bp, Homo sapiens
cacacatgaagttgctgagcta

SEQ ID NO: 9003065 - DNA, 22 bp, Homo sapiens
cacacatgaagttgctgagcta

SEQ ID NO: 9003066 - DNA, 18 bp, Homo sapiens
caattttacccagtccct

SEQ ID NO: 9003067 - DNA, 19 bp, Homo sapiens
caatttggcagattctccc

SEQ ID NO: 9003068 - DNA, 22 bp, Homo sapiens
caatttggttacttccttagaa

SEQ ID NO: 9003069 - DNA, 22 bp, Homo sapiens
caatttggtttatgtgttcaga

SEQ ID NO: 9003070 - DNA, 22 bp, Homo sapiens
caatttgattaataccatactt

SEQ ID NO: 9003071 - DNA, 22 bp, Homo sapiens
caatttgattaataccatactt

SEQ ID NO: 9003072 - DNA, 22 bp, Homo sapiens
caatttgacaagttgcatgttt

SEQ ID NO: 9003073 - DNA, 22 bp, Homo sapiens
caatttgacaagttgcatgttt

SEQ ID NO: 9003074 - DNA, 22 bp, Homo sapiens
caatttcttgttaattctcagg

SEQ ID NO: 9003075 - DNA, 22 bp, Homo sapiens
caatttcttgttaattctcagg

SEQ ID NO: 9003076 - DNA, 22 bp, Homo sapiens
caatttcttgttaattctcagg

SEQ ID NO: 9003077 - DNA, 22 bp, Homo sapiens
caatttctggaactaattctga

SEQ ID NO: 9003078 - DNA, 22 bp, Homo sapiens
caatttctgggcctcacacaag

SEQ ID NO: 9003079 - DNA, 22 bp, Homo sapiens
caattcaacttgcctttgtagc

SEQ ID NO: 9003080 - DNA, 22 bp, Homo sapiens
caattattcagtgacttaagag

SEQ ID NO: 9003081 - DNA, 22 bp, Homo sapiens
caattcaaaccagtctgtctct

SEQ ID NO: 9003082 - DNA, 22 bp, Homo sapiens
caattcaaaccagtctgtctct

SEQ ID NO: 9003083 - DNA, 22 bp, Homo sapiens
caattcaaatgcatagttcaca

SEQ ID NO: 9003084 - DNA, 22 bp, Homo sapiens
caattcaagttgagtacagctt

SEQ ID NO: 9003085 - DNA, 22 bp, Homo sapiens
caattcaatggcaaagtattgt

SEQ ID NO: 9003086 - DNA, 22 bp, Homo sapiens
caattcaatggcaaagtattgt

SEQ ID NO: 9003087 - DNA, 22 bp, Homo sapiens
caatttctggaactaattctga

SEQ ID NO: 9003088 - DNA, 22 bp, Homo sapiens
caatttctggaactaattctga

SEQ ID NO: 9003089 - DNA, 22 bp, Homo sapiens
cacacatcttatcccagttatt

SEQ ID NO: 9003090 - DNA, 22 bp, Homo sapiens
caatttttgtacttatagtact

SEQ ID NO: 9003091 - DNA, 22 bp, Homo sapiens
caatttttgtacttatagtact

SEQ ID NO: 9003092 - DNA, 22 bp, Homo sapiens
cacacagaaccgctcgccactt

SEQ ID NO: 9003093 - DNA, 22 bp, Homo sapiens
caatttttgtacttatagtact

SEQ ID NO: 9003094 - DNA, 22 bp, Homo sapiens
caattttattggtccaaataca

SEQ ID NO: 9003095 - DNA, 22 bp, Homo sapiens
caattttattggtccaaataca

SEQ ID NO: 9003096 - DNA, 22 bp, Homo sapiens
caattttattggtccaaataca

SEQ ID NO: 9003097 - DNA, 22 bp, Homo sapiens
caatttttaaactatgaagttg

SEQ ID NO: 9003098 - DNA, 22 bp, Homo sapiens
caatttttaaactatgaagttg

SEQ ID NO: 9003099 - DNA, 18 bp, Homo sapiens
caattttacccagtccct

SEQ ID NO: 9003100 - DNA, 22 bp, Homo sapiens
caattttactcttcctcttcca

SEQ ID NO: 9003101 - DNA, 22 bp, Homo sapiens
caattttattggtccaaataca

SEQ ID NO: 9003102 - DNA, 22 bp, Homo sapiens
caattttattggtccaaataca

SEQ ID NO: 9003103 - DNA, 22 bp, Homo sapiens
caattttattggtccaaataca

SEQ ID NO: 9003104 - DNA, 22 bp, Homo sapiens
caattttactcttcctcttcca

SEQ ID NO: 9003105 - DNA, 22 bp, Homo sapiens
caaggaagacccacgcagatat

SEQ ID NO: 9003106 - DNA, 22 bp, Homo sapiens
caaggaagacccacgcagatat

SEQ ID NO: 9003107 - DNA, 22 bp, Homo sapiens
caaggaaacatgaaatgcattg

SEQ ID NO: 9003108 - DNA, 22 bp, Homo sapiens
caaggaaggagagatgatgggt

SEQ ID NO: 9003109 - DNA, 22 bp, Homo sapiens
caaggaagacccacgcagatat

SEQ ID NO: 9003110 - DNA, 22 bp, Homo sapiens
caaggaaggagagatgatgggt

SEQ ID NO: 9003111 - DNA, 22 bp, Homo sapiens
caaggaaggagagatgatgggt

SEQ ID NO: 9003112 - DNA, 22 bp, Homo sapiens
caaggaaggagagatgatgggt

SEQ ID NO: 9003113 - DNA, 22 bp, Homo sapiens
caaggaagttttaggagaggaa

SEQ ID NO: 9003114 - DNA, 21 bp, Homo sapiens
agcagacagatgcacgcacac

SEQ ID NO: 9003115 - DNA, 22 bp, Homo sapiens
caaggaagttttaggagaggaa

SEQ ID NO: 9003116 - DNA, 22 bp, Homo sapiens
caaggaagttttaggagaggaa

SEQ ID NO: 9003117 - DNA, 22 bp, Homo sapiens
caaggaaggagagatgatgggt

SEQ ID NO: 9003118 - DNA, 21 bp, Homo sapiens
agcagacagcccaagaaaatc

SEQ ID NO: 9003119 - DNA, 22 bp, Homo sapiens
agcagacaggctgccacagtgc

SEQ ID NO: 9003120 - DNA, 22 bp, Homo sapiens
agcagacaggctgccacagtgc

SEQ ID NO: 9003121 - DNA, 22 bp, Homo sapiens
agcagacaggtaggaggataaa

SEQ ID NO: 9003122 - DNA, 22 bp, Homo sapiens
agcagacaggctgccacagtgc

SEQ ID NO: 9003123 - DNA, 22 bp, Homo sapiens
agcagacatatctcatgtcaca

SEQ ID NO: 9003124 - DNA, 22 bp, Homo sapiens
agcagacatatctcatgtcaca

SEQ ID NO: 9003125 - DNA, 22 bp, Homo sapiens
agcagacatatctcatgtcaca

SEQ ID NO: 9003126 - DNA, 22 bp, Homo sapiens
agcagagaccatatagcccaga

SEQ ID NO: 9003127 - DNA, 22 bp, Homo sapiens
agcagagacatgaaatatgctt

SEQ ID NO: 9003128 - DNA, 22 bp, Homo sapiens
agcagagacatgaaatatgctt

SEQ ID NO: 9003129 - DNA, 22 bp, Homo sapiens
agcagagacatgaaatatgctt

SEQ ID NO: 9003130 - DNA, 22 bp, Homo sapiens
agcagagacatgaaatatgctt

SEQ ID NO: 9003131 - DNA, 22 bp, Homo sapiens
caaggcatgtaacaatggcttt

SEQ ID NO: 9003132 - DNA, 22 bp, Homo sapiens
caaggcattgtgtaagcacttg

SEQ ID NO: 9003133 - DNA, 22 bp, Homo sapiens
caaggcattgtgtaagcacttg

SEQ ID NO: 9003134 - DNA, 22 bp, Homo sapiens
caaggcattcttgcaggtaggg

SEQ ID NO: 9003135 - DNA, 22 bp, Homo sapiens
caaggcattctcaccaactctc

SEQ ID NO: 9003136 - DNA, 22 bp, Homo sapiens
caaggcattaccatggctagag

SEQ ID NO: 9003137 - DNA, 22 bp, Homo sapiens
caaggcatttcgcttagagaga

SEQ ID NO: 9003138 - DNA, 22 bp, Homo sapiens
caaggccaaagggccactgtca

SEQ ID NO: 9003139 - DNA, 22 bp, Homo sapiens
caaggcatttcgcttagagaga

SEQ ID NO: 9003140 - DNA, 22 bp, Homo sapiens
caaggcatgtaacaatggcttt

SEQ ID NO: 9003141 - DNA, 22 bp, Homo sapiens
caagggaagaggacagggacct

SEQ ID NO: 9003142 - DNA, 22 bp, Homo sapiens
caagggaaggctaagggcaaca

SEQ ID NO: 9003143 - DNA, 22 bp, Homo sapiens
caagggaaggctaagggcaaca

SEQ ID NO: 9003144 - DNA, 22 bp, Homo sapiens
agcagactccattgagtgagtc

SEQ ID NO: 9003145 - DNA, 22 bp, Homo sapiens
agcagactcttctcctggggct

SEQ ID NO: 9003146 - DNA, 22 bp, Homo sapiens
agcagacatggcttggatgtgg

SEQ ID NO: 9003147 - DNA, 22 bp, Homo sapiens
agcagaccaggagtgcacaggt

SEQ ID NO: 9003148 - DNA, 22 bp, Homo sapiens
agcagaccaggagtgcacaggt

SEQ ID NO: 9003149 - DNA, 22 bp, Homo sapiens
agcagacatggcttggatgtgg

SEQ ID NO: 9003150 - DNA, 22 bp, Homo sapiens
agcagagacatgaaatatgctt

SEQ ID NO: 9003151 - DNA, 22 bp, Homo sapiens
agcagagaagacacaggcttca

SEQ ID NO: 9003152 - DNA, 22 bp, Homo sapiens
agcagagacatgaaatatgctt

SEQ ID NO: 9003153 - DNA, 22 bp, Homo sapiens
agcagagaagacacaggcttca

SEQ ID NO: 9003154 - DNA, 22 bp, Homo sapiens
agcagagaagacacaggcttca

SEQ ID NO: 9003155 - DNA, 22 bp, Homo sapiens
agcagagaagacacaggcttca

SEQ ID NO: 9003156 - DNA, 22 bp, Homo sapiens
agcagagaagacacaggcttca

SEQ ID NO: 9003157 - DNA, 22 bp, Homo sapiens
agcagagaagacacaggcttca

SEQ ID NO: 9003158 - DNA, 22 bp, Homo sapiens
caagctgggtgcgggcagtata

SEQ ID NO: 9003159 - DNA, 22 bp, Homo sapiens
caagctggctgggagaggcacg

SEQ ID NO: 9003160 - DNA, 22 bp, Homo sapiens
caagctggctgggagaggcacg

SEQ ID NO: 9003161 - DNA, 22 bp, Homo sapiens
caagctgggtcccaacaattac

SEQ ID NO: 9003162 - DNA, 22 bp, Homo sapiens
caagctggctcttatgcaaaaa

SEQ ID NO: 9003163 - DNA, 22 bp, Homo sapiens
caagctggagttcctcagagtg

SEQ ID NO: 9003164 - DNA, 22 bp, Homo sapiens
caagcagaggtttatgtattag

SEQ ID NO: 9003165 - DNA, 22 bp, Homo sapiens
caagcagagaggttagaacaca

SEQ ID NO: 9003166 - DNA, 22 bp, Homo sapiens
caagcagagaggttagaacaca

SEQ ID NO: 9003167 - DNA, 22 bp, Homo sapiens
caagcagatattttagtcaaga

SEQ ID NO: 9003168 - DNA, 22 bp, Homo sapiens
caagctggaggttggagctact

SEQ ID NO: 9003169 - DNA, 22 bp, Homo sapiens
caagctggaggttggagctact

SEQ ID NO: 9003170 - DNA, 22 bp, Homo sapiens
caagctggaggttggagctact

SEQ ID NO: 9003171 - DNA, 22 bp, Homo sapiens
agcaattttctaagcaaaatac

SEQ ID NO: 9003172 - DNA, 22 bp, Homo sapiens
agcaattttcccttagtctttg

SEQ ID NO: 9003173 - DNA, 22 bp, Homo sapiens
agcaattttctaagcaaaatac

SEQ ID NO: 9003174 - DNA, 22 bp, Homo sapiens
agcaatttcccatctcttctgc

SEQ ID NO: 9003175 - DNA, 22 bp, Homo sapiens
agcaatttcccatctcttctgc

SEQ ID NO: 9003176 - DNA, 22 bp, Homo sapiens
agcaatttctcgcaccagacgc

SEQ ID NO: 9003177 - DNA, 22 bp, Homo sapiens
agcaattttcccttagtctttg

SEQ ID NO: 9003178 - DNA, 22 bp, Homo sapiens
agcaatttctcgcaccagacgc

SEQ ID NO: 9003179 - DNA, 21 bp, Homo sapiens
agcaatttcatttggtttaac

SEQ ID NO: 9003180 - DNA, 21 bp, Homo sapiens
agcaatttcatttggtttaac

SEQ ID NO: 9003181 - DNA, 21 bp, Homo sapiens
agcaatttcatttggtttaac

SEQ ID NO: 9003182 - DNA, 22 bp, Homo sapiens
agcaattattgtataagaacaa

SEQ ID NO: 9003183 - DNA, 22 bp, Homo sapiens
agcaattattgtataagaacaa

SEQ ID NO: 9003184 - DNA, 22 bp, Homo sapiens
agcaattatggagttgttgacg

SEQ ID NO: 9003185 - DNA, 22 bp, Homo sapiens
agcaattatgataaggccgctg

SEQ ID NO: 9003186 - DNA, 22 bp, Homo sapiens
caagctttccattacacacatt

SEQ ID NO: 9003187 - DNA, 22 bp, Homo sapiens
caaggaaaaagcgagctcgggg

SEQ ID NO: 9003188 - DNA, 22 bp, Homo sapiens
caaggaaaaagcgagctcgggg

SEQ ID NO: 9003189 - DNA, 22 bp, Homo sapiens
caagctggtatcagctagagcg

SEQ ID NO: 9003190 - DNA, 22 bp, Homo sapiens
caagctttatccgccatgtagg

SEQ ID NO: 9003191 - DNA, 22 bp, Homo sapiens
caagcttgtttctcctgggggt

SEQ ID NO: 9003192 - DNA, 22 bp, Homo sapiens
caaggaaacatgaaatgcattg

SEQ ID NO: 9003193 - DNA, 22 bp, Homo sapiens
caaggaaacatgaaatgcattg

SEQ ID NO: 9003194 - DNA, 22 bp, Homo sapiens
caaggaaaagaagtatttcaga

SEQ ID NO: 9003195 - DNA, 22 bp, Homo sapiens
caaggaaaagaagtatttcaga

SEQ ID NO: 9003196 - DNA, 22 bp, Homo sapiens
caaggaaacatgaaatgcattg

SEQ ID NO: 9003197 - DNA, 22 bp, Homo sapiens
caaggaaaacagatgatcaaca

SEQ ID NO: 9003198 - DNA, 22 bp, Homo sapiens
caaggaaaacagatgatcaaca

SEQ ID NO: 9003199 - DNA, 22 bp, Homo sapiens
caagggcagcagcctcaagcgg

SEQ ID NO: 9003200 - DNA, 22 bp, Homo sapiens
caagggcaggagaggatggatg

SEQ ID NO: 9003201 - DNA, 21 bp, Homo sapiens
caagggccagtgagatgggat

SEQ ID NO: 9003202 - DNA, 21 bp, Homo sapiens
caagggccagtgagatgggat

SEQ ID NO: 9003203 - DNA, 22 bp, Homo sapiens
caagggccatctgagggcactg

SEQ ID NO: 9003204 - DNA, 22 bp, Homo sapiens
caagggccatctgagggcactg

SEQ ID NO: 9003205 - DNA, 22 bp, Homo sapiens
caagggccctcggatgatgatg

SEQ ID NO: 9003206 - DNA, 22 bp, Homo sapiens
caagggccctcggatgatgatg

SEQ ID NO: 9003207 - DNA, 22 bp, Homo sapiens
caagggcctccaccttgctcgt

SEQ ID NO: 9003208 - DNA, 22 bp, Homo sapiens
caagggccctgtctatgtatcc

SEQ ID NO: 9003209 - DNA, 22 bp, Homo sapiens
caagggcctccaccttgctcgt

SEQ ID NO: 9003210 - DNA, 22 bp, Homo sapiens
caagggctcacggtctgctggg

SEQ ID NO: 9003211 - DNA, 22 bp, Homo sapiens
caagggctcacggtctgctggg

SEQ ID NO: 9003212 - DNA, 22 bp, Homo sapiens
caagggagttactgagggcggg

SEQ ID NO: 9003213 - DNA, 22 bp, Homo sapiens
caagggagttgctgcatgcagg

SEQ ID NO: 9003214 - DNA, 22 bp, Homo sapiens
caagggagttgctgcatgcagg

SEQ ID NO: 9003215 - DNA, 22 bp, Homo sapiens
caagggagttgctgcatgcagg

SEQ ID NO: 9003216 - DNA, 22 bp, Homo sapiens
caagggagttgctgcatgcagg

SEQ ID NO: 9003217 - DNA, 22 bp, Homo sapiens
caagggacatttctcataggag

SEQ ID NO: 9003218 - DNA, 22 bp, Homo sapiens
caagggacagttatgagaccct

SEQ ID NO: 9003219 - DNA, 22 bp, Homo sapiens
caagggaaggctaagggcaaca

SEQ ID NO: 9003220 - DNA, 22 bp, Homo sapiens
caagggaattgtgtgtgagagg

SEQ ID NO: 9003221 - DNA, 22 bp, Homo sapiens
caagggaattgtgtgtgagagg

SEQ ID NO: 9003222 - DNA, 22 bp, Homo sapiens
caagggaattgtgtgtgagagg

SEQ ID NO: 9003223 - DNA, 22 bp, Homo sapiens
caagggaaggctaagggcaaca

SEQ ID NO: 9003224 - DNA, 22 bp, Homo sapiens
caagggaaggctaagggcaaca

SEQ ID NO: 9003225 - DNA, 22 bp, Homo sapiens
caagtccaggtgggcaaataaa

SEQ ID NO: 9003226 - DNA, 22 bp, Homo sapiens
caagtccaggtgggcaaataaa

SEQ ID NO: 9003227 - DNA, 22 bp, Homo sapiens
caagtccatcctactgccttct

SEQ ID NO: 9003228 - DNA, 22 bp, Homo sapiens
caagtccatcagataagcaaga

SEQ ID NO: 9003229 - DNA, 22 bp, Homo sapiens
caagtccatcctactgccttct

SEQ ID NO: 9003230 - DNA, 22 bp, Homo sapiens
caagtccaagatcaagaagcca

SEQ ID NO: 9003231 - DNA, 22 bp, Homo sapiens
caagtccaacagtttttcagac

SEQ ID NO: 9003232 - DNA, 22 bp, Homo sapiens
caagtcattgtttagtcatgtt

SEQ ID NO: 9003233 - DNA, 22 bp, Homo sapiens
caagtccaagatcaagaagcca

SEQ ID NO: 9003234 - DNA, 22 bp, Homo sapiens
caagtccaacagtttttcagac

SEQ ID NO: 9003235 - DNA, 22 bp, Homo sapiens
caagggctctaagtcacaagat

SEQ ID NO: 9003236 - DNA, 22 bp, Homo sapiens
caagggctgctatcagctactg

SEQ ID NO: 9003237 - DNA, 22 bp, Homo sapiens
caagggctgaacacaggtttca

SEQ ID NO: 9003238 - DNA, 22 bp, Homo sapiens
caagggctgctatcagctactg

SEQ ID NO: 9003239 - DNA, 22 bp, Homo sapiens
caagggctgctatcagctactg

SEQ ID NO: 9003240 - DNA, 22 bp, Homo sapiens
caagggcttcaagtggccaaga

SEQ ID NO: 9003241 - DNA, 20 bp, Homo sapiens
caaggggagtagtatgggcc

SEQ ID NO: 9003242 - DNA, 22 bp, Homo sapiens
caagtcacttatgtgcagatat

SEQ ID NO: 9003243 - DNA, 22 bp, Homo sapiens
caagtcacttatgtgcagatat

SEQ ID NO: 9003244 - DNA, 22 bp, Homo sapiens
caagtcattactgaaatgtcac

SEQ ID NO: 9003245 - DNA, 22 bp, Homo sapiens
caagtcatcatagaagttcccc

SEQ ID NO: 9003246 - DNA, 22 bp, Homo sapiens
caattaaagaagacctgcctca

SEQ ID NO: 9003247 - DNA, 22 bp, Homo sapiens
caatgtttttccttccttaata

SEQ ID NO: 9003248 - DNA, 22 bp, Homo sapiens
caatgtttttccttccttaata

SEQ ID NO: 9003249 - DNA, 21 bp, Homo sapiens
caattacagatggctcagggg

SEQ ID NO: 9003250 - DNA, 22 bp, Homo sapiens
caattacatttattgagcattc

SEQ ID NO: 9003251 - DNA, 21 bp, Homo sapiens
caattacagatggctcagggg

SEQ ID NO: 9003252 - DNA, 22 bp, Homo sapiens
caattacatttattgagcattc

SEQ ID NO: 9003253 - DNA, 22 bp, Homo sapiens
caattacatttattgagcattc

SEQ ID NO: 9003254 - DNA, 22 bp, Homo sapiens
caattacatttattgagcattc

SEQ ID NO: 9003255 - DNA, 22 bp, Homo sapiens
caattacatttattgagcattc

SEQ ID NO: 9003256 - DNA, 22 bp, Homo sapiens
caattactggtccacagaaatt

SEQ ID NO: 9003257 - DNA, 22 bp, Homo sapiens
caattattcagtgacttaagag

SEQ ID NO: 9003258 - DNA, 22 bp, Homo sapiens
caattatatttagaatgataca

SEQ ID NO: 9003259 - DNA, 22 bp, Homo sapiens
caattatatttagaatgataca

SEQ ID NO: 9003260 - DNA, 22 bp, Homo sapiens
caattatatttagaatgataca

SEQ ID NO: 9003261 - DNA, 22 bp, Homo sapiens
caattatatttagaatgataca

SEQ ID NO: 9003262 - DNA, 22 bp, Homo sapiens
caattatatttagaatgataca

SEQ ID NO: 9003263 - DNA, 21 bp, Homo sapiens
caattactatgaaccagttga

SEQ ID NO: 9003264 - DNA, 22 bp, Homo sapiens
caattacttttgcaccaatata

SEQ ID NO: 9003265 - DNA, 22 bp, Homo sapiens
caattatatttagaatgataca

SEQ ID NO: 9003266 - DNA, 22 bp, Homo sapiens
caattagaggaggaagctcata

SEQ ID NO: 9003267 - DNA, 21 bp, Homo sapiens
caattacttttgcaccgactt

SEQ ID NO: 9003268 - DNA, 22 bp, Homo sapiens
caattatatttagaatgataca

SEQ ID NO: 9003269 - DNA, 22 bp, Homo sapiens
caattatatttagaatgataca

SEQ ID NO: 9003270 - DNA, 22 bp, Homo sapiens
caattatatttagaatgataca

SEQ ID NO: 9003271 - DNA, 22 bp, Homo sapiens
caattatatttagaatgataca

SEQ ID NO: 9003272 - DNA, 22 bp, Homo sapiens
caattatatttagaatgataca

SEQ ID NO: 9003273 - DNA, 22 bp, Homo sapiens
caagtcctctggtttcaaatag

SEQ ID NO: 9003274 - DNA, 21 bp, Homo sapiens
caagtcctttgccaaagtgct

SEQ ID NO: 9003275 - DNA, 22 bp, Homo sapiens
caagtcctaggtctgattgaac

SEQ ID NO: 9003276 - DNA, 22 bp, Homo sapiens
caagtcctcaaagggctctgct

SEQ ID NO: 9003277 - DNA, 22 bp, Homo sapiens
caagtcctccatgtgactaggt

SEQ ID NO: 9003278 - DNA, 22 bp, Homo sapiens
caagtctgacctctgggtgaag

SEQ ID NO: 9003279 - DNA, 22 bp, Homo sapiens
caagtctgacctctgggtgaag

SEQ ID NO: 9003280 - DNA, 22 bp, Homo sapiens
caagtccttttcttggctcagg

SEQ ID NO: 9003281 - DNA, 22 bp, Homo sapiens
caagtctagcttggtcacttgg

SEQ ID NO: 9003282 - DNA, 22 bp, Homo sapiens
caatgttttgttgaatgaatag

SEQ ID NO: 9003283 - DNA, 22 bp, Homo sapiens
caatgatgtttagataaaatcc

SEQ ID NO: 9003284 - DNA, 22 bp, Homo sapiens
caatgatagattttacaaatta

SEQ ID NO: 9003285 - DNA, 22 bp, Homo sapiens
caatgatgtttagataaaatcc

SEQ ID NO: 9003286 - DNA, 22 bp, Homo sapiens
caagtgaagatatacagaaaat

SEQ ID NO: 9003287 - DNA, 22 bp, Homo sapiens
caagtctgtctgctcctgtgtg

SEQ ID NO: 9003288 - DNA, 22 bp, Homo sapiens
caagtctgtctgctcctgtgtg

SEQ ID NO: 9003289 - DNA, 22 bp, Homo sapiens
caatgatagattttacaaatta

SEQ ID NO: 9003290 - DNA, 19 bp, Homo sapiens
caagtgaagcctgggatgg

SEQ ID NO: 9003291 - DNA, 22 bp, Homo sapiens
caaacattgggggcttcaacac

SEQ ID NO: 9003292 - DNA, 22 bp, Homo sapiens
caaacattgggggcttcaacac

SEQ ID NO: 9003293 - DNA, 22 bp, Homo sapiens
caaacattgggggcttcaacac

SEQ ID NO: 9003294 - DNA, 22 bp, Homo sapiens
caaacattgggggcttcaacac

SEQ ID NO: 9003295 - DNA, 22 bp, Homo sapiens
caaacattgctaccagaggttt

SEQ ID NO: 9003296 - DNA, 22 bp, Homo sapiens
caaacattgctaccagaggttt

SEQ ID NO: 9003297 - DNA, 22 bp, Homo sapiens
caaacattgctaccagaggttt

SEQ ID NO: 9003298 - DNA, 22 bp, Homo sapiens
caaacatttgacttctctcagg

SEQ ID NO: 9003299 - DNA, 22 bp, Homo sapiens
caaacatttgacttctctcagg

SEQ ID NO: 9003300 - DNA, 22 bp, Homo sapiens
caaacatttaggaggagggagg

SEQ ID NO: 9003301 - DNA, 22 bp, Homo sapiens
caaacattgggggcttcaacac

SEQ ID NO: 9003302 - DNA, 22 bp, Homo sapiens
caaacatttgacttctctcagg

SEQ ID NO: 9003303 - DNA, 22 bp, Homo sapiens
caaacatttgacttctctcagg

SEQ ID NO: 9003304 - DNA, 22 bp, Homo sapiens
caaacatttgacttctctcagg

SEQ ID NO: 9003305 - DNA, 22 bp, Homo sapiens
agcaatcagcttctttgtgttt

SEQ ID NO: 9003306 - DNA, 22 bp, Homo sapiens
caaacattgcactttctgctat

SEQ ID NO: 9003307 - DNA, 22 bp, Homo sapiens
caaacattgctaccagaggttt

SEQ ID NO: 9003308 - DNA, 22 bp, Homo sapiens
agcaatcagcttctttgtgttt

SEQ ID NO: 9003309 - DNA, 22 bp, Homo sapiens
agcaatagataaaacatttacc

SEQ ID NO: 9003310 - DNA, 22 bp, Homo sapiens
agcaatagataaaacatttacc

SEQ ID NO: 9003311 - DNA, 22 bp, Homo sapiens
agcaatatgacattgctacatc

SEQ ID NO: 9003312 - DNA, 22 bp, Homo sapiens
agcaatatgacattgctacatc

SEQ ID NO: 9003313 - DNA, 22 bp, Homo sapiens
agcaataagggatcctctataa

SEQ ID NO: 9003314 - DNA, 22 bp, Homo sapiens
agcaatagacacaagatggata

SEQ ID NO: 9003315 - DNA, 22 bp, Homo sapiens
caaacattttctacttccagga

SEQ ID NO: 9003316 - DNA, 22 bp, Homo sapiens
caaacattttaaataagggata

SEQ ID NO: 9003317 - DNA, 22 bp, Homo sapiens
caaacatttgttggaacccctg

SEQ ID NO: 9003318 - DNA, 22 bp, Homo sapiens
caaacatttgttggaacccctg

SEQ ID NO: 9003319 - DNA, 22 bp, Homo sapiens
caaacatttgttggaacccctg

SEQ ID NO: 9003320 - DNA, 22 bp, Homo sapiens
caaacattttgagtggtttctg

SEQ ID NO: 9003321 - DNA, 22 bp, Homo sapiens
caaacattttctacttccagga

SEQ ID NO: 9003322 - DNA, 22 bp, Homo sapiens
caaacattttctacttccagga

SEQ ID NO: 9003323 - DNA, 22 bp, Homo sapiens
caaacattttgagtggtttctg

SEQ ID NO: 9003324 - DNA, 22 bp, Homo sapiens
caaacattttgagtggtttctg

SEQ ID NO: 9003325 - DNA, 22 bp, Homo sapiens
caaacattttgagtggtttctg

SEQ ID NO: 9003326 - DNA, 22 bp, Homo sapiens
caaacattttgagtggtttctg

SEQ ID NO: 9003327 - DNA, 22 bp, Homo sapiens
caaagtgctgggattacaggct

SEQ ID NO: 9003328 - DNA, 22 bp, Homo sapiens
caaagtgctgggattacaggtg

SEQ ID NO: 9003329 - DNA, 22 bp, Homo sapiens
caaagtgctgggattacaggct

SEQ ID NO: 9003330 - DNA, 22 bp, Homo sapiens
caaagtgctgggattacaggct

SEQ ID NO: 9003331 - DNA, 22 bp, Homo sapiens
caaagtgctgggattataggca

SEQ ID NO: 9003332 - DNA, 22 bp, Homo sapiens
caaagtgctgggattataggca

SEQ ID NO: 9003333 - DNA, 22 bp, Homo sapiens
caaagtgctgggattagtgctg

SEQ ID NO: 9003334 - DNA, 22 bp, Homo sapiens
caaagtgctgggattagtgctg

SEQ ID NO: 9003335 - DNA, 22 bp, Homo sapiens
caaagtgctgggattagtgctg

SEQ ID NO: 9003336 - DNA, 22 bp, Homo sapiens
caaagtgctgggattacaggtg

SEQ ID NO: 9003337 - DNA, 22 bp, Homo sapiens
caaagtgctgggattacaggtg

SEQ ID NO: 9003338 - DNA, 22 bp, Homo sapiens
caaagtgctgggattacaggtg

SEQ ID NO: 9003339 - DNA, 22 bp, Homo sapiens
agcaatgaaaacaataaggtga

SEQ ID NO: 9003340 - DNA, 23 bp, Homo sapiens
agcaatctgtgtttcagcaagcc

SEQ ID NO: 9003341 - DNA, 22 bp, Homo sapiens
agcaatcatgacaaattatctt

SEQ ID NO: 9003342 - DNA, 22 bp, Homo sapiens
agcaatcatgacaaattatctt

SEQ ID NO: 9003343 - DNA, 22 bp, Homo sapiens
caaataattactatcctcactt

SEQ ID NO: 9003344 - DNA, 22 bp, Homo sapiens
agcaatgaaatgaaatcagtct

SEQ ID NO: 9003345 - DNA, 22 bp, Homo sapiens
agcaatgaccagtgatcttgta

SEQ ID NO: 9003346 - DNA, 22 bp, Homo sapiens
agcaatgaccagtgatcttgta

SEQ ID NO: 9003347 - DNA, 22 bp, Homo sapiens
agcaatgaaatgaaatcagtct

SEQ ID NO: 9003348 - DNA, 22 bp, Homo sapiens
agcaatgaccagtgatcttgta

SEQ ID NO: 9003349 - DNA, 22 bp, Homo sapiens
agcaatgactttgaaatcatga

SEQ ID NO: 9003350 - DNA, 22 bp, Homo sapiens
agcaatgactggctatatgatt

SEQ ID NO: 9003351 - DNA, 22 bp, Homo sapiens
agcaatgactttgaaatcatga

SEQ ID NO: 9003352 - DNA, 22 bp, Homo sapiens
agcaatgactttgaaatcatga

SEQ ID NO: 9003353 - DNA, 22 bp, Homo sapiens
agcaatgactttgaaatcatga

SEQ ID NO: 9003354 - DNA, 22 bp, Homo sapiens
agcaatgactttgaaatcatga

SEQ ID NO: 9003355 - DNA, 22 bp, Homo sapiens
agcaatgcttattgctgactat

SEQ ID NO: 9003356 - DNA, 22 bp, Homo sapiens
agcaatgatgttttcaagtagg

SEQ ID NO: 9003357 - DNA, 22 bp, Homo sapiens
agcaatgatgttttcaagtagg

SEQ ID NO: 9003358 - DNA, 22 bp, Homo sapiens
agcaatgcaatcttaaccttga

SEQ ID NO: 9003359 - DNA, 22 bp, Homo sapiens
agcaatgcaatcttaaccttga

SEQ ID NO: 9003360 - DNA, 22 bp, Homo sapiens
agcaatgctaccgggtgattcg

SEQ ID NO: 9003361 - DNA, 23 bp, Homo sapiens
agcaatgctgggagactctgtaa

SEQ ID NO: 9003362 - DNA, 22 bp, Homo sapiens
agcaatgcttattgctgactat

SEQ ID NO: 9003363 - DNA, 23 bp, Homo sapiens
agcaatgctgggagactctgtaa

SEQ ID NO: 9003364 - DNA, 22 bp, Homo sapiens
caaagttatgaatgataagatt

SEQ ID NO: 9003365 - DNA, 22 bp, Homo sapiens
caaagttatcaactgcaacatt

SEQ ID NO: 9003366 - DNA, 22 bp, Homo sapiens
caaagtggagagcctgtggttg

SEQ ID NO: 9003367 - DNA, 22 bp, Homo sapiens
caaagttatgaatgataagatt

SEQ ID NO: 9003368 - DNA, 22 bp, Homo sapiens
caaagtttaaagtagatttcag

SEQ ID NO: 9003369 - DNA, 22 bp, Homo sapiens
caaagttctcggctcaagtcct

SEQ ID NO: 9003370 - DNA, 22 bp, Homo sapiens
caaagtttggctctcatgacat

SEQ ID NO: 9003371 - DNA, 22 bp, Homo sapiens
caaagtttaaagtagatttcag

SEQ ID NO: 9003372 - DNA, 22 bp, Homo sapiens
caaataagaaccacaggggagt

SEQ ID NO: 9003373 - DNA, 22 bp, Homo sapiens
caaataagcaattccattcttc

SEQ ID NO: 9003374 - DNA, 22 bp, Homo sapiens
caaataagcaattccattcttc

SEQ ID NO: 9003375 - DNA, 22 bp, Homo sapiens
caaagttttagtaaacatatat

SEQ ID NO: 9003376 - DNA, 22 bp, Homo sapiens
caaagtttggctctcatgacat

SEQ ID NO: 9003377 - DNA, 22 bp, Homo sapiens
caaagttttagtaaacatatat

SEQ ID NO: 9003378 - DNA, 22 bp, Homo sapiens
caaagttttagtaaacatatat

SEQ ID NO: 9003379 - DNA, 22 bp, Homo sapiens
caaagttttagtaaacatatat

SEQ ID NO: 9003380 - DNA, 22 bp, Homo sapiens
caaagtttggctctcatgacat

SEQ ID NO: 9003381 - DNA, 22 bp, Homo sapiens
attttgtggcagatgcagaacc

SEQ ID NO: 9003382 - DNA, 22 bp, Homo sapiens
attttgtggcagatgcagaacc

SEQ ID NO: 9003383 - DNA, 22 bp, Homo sapiens
attttgtgaaccctcaagcaat

SEQ ID NO: 9003384 - DNA, 22 bp, Homo sapiens
attttgtgaaccctcaagcaat

SEQ ID NO: 9003385 - DNA, 21 bp, Homo sapiens
attttgtacatagaatttgtc

SEQ ID NO: 9003386 - DNA, 22 bp, Homo sapiens
attttgtgggttctgctgatgt

SEQ ID NO: 9003387 - DNA, 22 bp, Homo sapiens
attttgttatagaactctgtga

SEQ ID NO: 9003388 - DNA, 22 bp, Homo sapiens
attttgttatagaactctgtga

SEQ ID NO: 9003389 - DNA, 22 bp, Homo sapiens
attttgttatagaactctgtga

SEQ ID NO: 9003390 - DNA, 22 bp, Homo sapiens
attttgttataggagctgaaat

SEQ ID NO: 9003391 - DNA, 22 bp, Homo sapiens
attttgttataggagctgaaat

SEQ ID NO: 9003392 - DNA, 22 bp, Homo sapiens
attttgttataggagctgaaat

SEQ ID NO: 9003393 - DNA, 22 bp, Homo sapiens
attttgttatcagggctttgca

SEQ ID NO: 9003394 - DNA, 22 bp, Homo sapiens
attttgttatagaactctgtga

SEQ ID NO: 9003395 - DNA, 22 bp, Homo sapiens
attttgttataggagctgaaat

SEQ ID NO: 9003396 - DNA, 22 bp, Homo sapiens
attttgttatcagggctttgca

SEQ ID NO: 9003397 - DNA, 22 bp, Homo sapiens
attttgttgaggtaattgtcaa

SEQ ID NO: 9003398 - DNA, 22 bp, Homo sapiens
attttgttgaggtaattgtcaa

SEQ ID NO: 9003399 - DNA, 22 bp, Homo sapiens
attttgttgaggtaattgtcaa

SEQ ID NO: 9003400 - DNA, 22 bp, Homo sapiens
attttgttgaggtaattgtcaa

SEQ ID NO: 9003401 - DNA, 22 bp, Homo sapiens
attttgttgaggtaattgtcaa

SEQ ID NO: 9003402 - DNA, 22 bp, Homo sapiens
attttttatataccaaggtggg

SEQ ID NO: 9003403 - DNA, 22 bp, Homo sapiens
attttttatataccaaggtggg

SEQ ID NO: 9003404 - DNA, 22 bp, Homo sapiens
attttttatataccaaggtggg

SEQ ID NO: 9003405 - DNA, 22 bp, Homo sapiens
attttttagccaagactctgca

SEQ ID NO: 9003406 - DNA, 22 bp, Homo sapiens
attttttagccaagactctgca

SEQ ID NO: 9003407 - DNA, 22 bp, Homo sapiens
attttttatataccaaggtggg

SEQ ID NO: 9003408 - DNA, 22 bp, Homo sapiens
attttttcagattgagtgttaa

SEQ ID NO: 9003409 - DNA, 22 bp, Homo sapiens
attttttcagattgagtgttaa

SEQ ID NO: 9003410 - DNA, 22 bp, Homo sapiens
attttttcagattgagtgttaa

SEQ ID NO: 9003411 - DNA, 22 bp, Homo sapiens
attttttatataccaaggtggg

SEQ ID NO: 9003412 - DNA, 22 bp, Homo sapiens
attttttcagattgagtgttaa

SEQ ID NO: 9003413 - DNA, 22 bp, Homo sapiens
attttttcagattgagtgttaa

SEQ ID NO: 9003414 - DNA, 22 bp, Homo sapiens
attttttcagattgagtgttaa

SEQ ID NO: 9003415 - DNA, 22 bp, Homo sapiens
attttgttgatggtggagtagc

SEQ ID NO: 9003416 - DNA, 20 bp, Homo sapiens
attttgtttatgttcctctc

SEQ ID NO: 9003417 - DNA, 22 bp, Homo sapiens
attttttagccaagactctgca

SEQ ID NO: 9003418 - DNA, 22 bp, Homo sapiens
attttttagccaagactctgca

SEQ ID NO: 9003419 - DNA, 22 bp, Homo sapiens
attttttagccaagactctgca

SEQ ID NO: 9003420 - DNA, 22 bp, Homo sapiens
attttttagccaagactctgca

SEQ ID NO: 9003421 - DNA, 23 bp, Homo sapiens
agcaataagaagggatacatgtg

SEQ ID NO: 9003422 - DNA, 23 bp, Homo sapiens
agcaataagaagggatacatgtg

SEQ ID NO: 9003423 - DNA, 23 bp, Homo sapiens
agcaataagaagggatacatgtg

SEQ ID NO: 9003424 - DNA, 23 bp, Homo sapiens
agcaataagaagggatacatgtg

SEQ ID NO: 9003425 - DNA, 22 bp, Homo sapiens
agcaataaccactctaatttat

SEQ ID NO: 9003426 - DNA, 22 bp, Homo sapiens
agcaataaccactctaatttat

SEQ ID NO: 9003427 - DNA, 22 bp, Homo sapiens
agcaataacagaaaactttcct

SEQ ID NO: 9003428 - DNA, 22 bp, Homo sapiens
agcaataacagaaaactttcct

SEQ ID NO: 9003429 - DNA, 22 bp, Homo sapiens
agcaataaatgtaaaggttaag

SEQ ID NO: 9003430 - DNA, 22 bp, Homo sapiens
agcaataaatgtaaaggttaag

SEQ ID NO: 9003431 - DNA, 22 bp, Homo sapiens
agcaataaatgtaaaggttaag

SEQ ID NO: 9003432 - DNA, 22 bp, Homo sapiens
agcaagtagtaccaagtagctc

SEQ ID NO: 9003433 - DNA, 22 bp, Homo sapiens
agcaagtgtaagaatgcagaat

SEQ ID NO: 9003434 - DNA, 22 bp, Homo sapiens
agcaagttgaatgataatactc

SEQ ID NO: 9003435 - DNA, 22 bp, Homo sapiens
agcaaggtctccctgcacctgg

SEQ ID NO: 9003436 - DNA, 22 bp, Homo sapiens
agcaaggggcagtgaaagtgtg

SEQ ID NO: 9003437 - DNA, 22 bp, Homo sapiens
agcaaggggcagtgaaagtgtg

SEQ ID NO: 9003438 - DNA, 22 bp, Homo sapiens
agcaaggggcagtgaaagtgtg

SEQ ID NO: 9003439 - DNA, 22 bp, Homo sapiens
agcaaggtggagaaggatgggt

SEQ ID NO: 9003440 - DNA, 22 bp, Homo sapiens
agcaaggtggagaaggatgggt

SEQ ID NO: 9003441 - DNA, 22 bp, Homo sapiens
agcaaggctgggtctaatgggg

SEQ ID NO: 9003442 - DNA, 20 bp, Homo sapiens
agcaaggctggagcttatgg

SEQ ID NO: 9003443 - DNA, 22 bp, Homo sapiens
agcaaggctgggtctaatgggg

SEQ ID NO: 9003444 - DNA, 22 bp, Homo sapiens
agcaaggctgggtctaatgggg

SEQ ID NO: 9003445 - DNA, 22 bp, Homo sapiens
agcaaggctgggtctaatgggg

SEQ ID NO: 9003446 - DNA, 22 bp, Homo sapiens
agcaaggctcttaatgcccaaa

SEQ ID NO: 9003447 - DNA, 22 bp, Homo sapiens
agcaaggctcttaatgcccaaa

SEQ ID NO: 9003448 - DNA, 22 bp, Homo sapiens
agcaaggcttcagagctgtctg

SEQ ID NO: 9003449 - DNA, 22 bp, Homo sapiens
agcaaggcttcagagctgtctg

SEQ ID NO: 9003450 - DNA, 22 bp, Homo sapiens
agcaaggcttcagagctgtctg

SEQ ID NO: 9003451 - DNA, 17 bp, Homo sapiens
agcaaggcttaagtaaa

SEQ ID NO: 9003452 - DNA, 22 bp, Homo sapiens
agcaaggcttcagagctgtctg

SEQ ID NO: 9003453 - DNA, 22 bp, Homo sapiens
agcaaggccgagaggatgctat

SEQ ID NO: 9003454 - DNA, 22 bp, Homo sapiens
agcaagatgcattatttcttat

SEQ ID NO: 9003455 - DNA, 22 bp, Homo sapiens
agcaagatgaaggattcaagac

SEQ ID NO: 9003456 - DNA, 20 bp, Homo sapiens
agcaagagtgtacctggcca

SEQ ID NO: 9003457 - DNA, 22 bp, Homo sapiens
agcaaggctcggtcagggtgat

SEQ ID NO: 9003458 - DNA, 22 bp, Homo sapiens
agcaaggctaaatttcagttat

SEQ ID NO: 9003459 - DNA, 22 bp, Homo sapiens
agcaaggctcggtcagggtgat

SEQ ID NO: 9003460 - DNA, 22 bp, Homo sapiens
agcaaggctcggtcagggtgat

SEQ ID NO: 9003461 - DNA, 22 bp, Homo sapiens
agcaaggctcttaatgcccaaa

SEQ ID NO: 9003462 - DNA, 20 bp, Homo sapiens
agcaaggctaaatcatgatt

SEQ ID NO: 9003463 - DNA, 22 bp, Homo sapiens
agcaaggcctacagagaggggc

SEQ ID NO: 9003464 - DNA, 22 bp, Homo sapiens
attttttctgtaaactggcctt

SEQ ID NO: 9003465 - DNA, 22 bp, Homo sapiens
attttttctgtaaactggcctt

SEQ ID NO: 9003466 - DNA, 22 bp, Homo sapiens
attttttctgtaaactggcctt

SEQ ID NO: 9003467 - DNA, 22 bp, Homo sapiens
attttttctgtaaactggcctt

SEQ ID NO: 9003468 - DNA, 22 bp, Homo sapiens
attttttcccagttagccagga

SEQ ID NO: 9003469 - DNA, 22 bp, Homo sapiens
attttttcccagttagccagga

SEQ ID NO: 9003470 - DNA, 22 bp, Homo sapiens
attttttcccagttagccagga

SEQ ID NO: 9003471 - DNA, 22 bp, Homo sapiens
attttttcccagttagccagga

SEQ ID NO: 9003472 - DNA, 22 bp, Homo sapiens
attttttcccagttagccagga

SEQ ID NO: 9003473 - DNA, 22 bp, Homo sapiens
attttttcccagttagccagga

SEQ ID NO: 9003474 - DNA, 23 bp, Homo sapiens
attttttgtctttgtaactagat

SEQ ID NO: 9003475 - DNA, 23 bp, Homo sapiens
attttttgtctttgtaactagat

SEQ ID NO: 9003476 - DNA, 22 bp, Homo sapiens
attttttgttaactcaggatag

SEQ ID NO: 9003477 - DNA, 23 bp, Homo sapiens
attttttgtctttgtaactagat

SEQ ID NO: 9003478 - DNA, 22 bp, Homo sapiens
agatgacatggttcaagtttcc

SEQ ID NO: 9003479 - DNA, 22 bp, Homo sapiens
agatgacatggttcaagtttcc

SEQ ID NO: 9003480 - DNA, 22 bp, Homo sapiens
agatgacatgggagcaagcact

SEQ ID NO: 9003481 - DNA, 22 bp, Homo sapiens
agatgacagccaaggagatgaa

SEQ ID NO: 9003482 - DNA, 22 bp, Homo sapiens
agatgacagctacgggatgaaa

SEQ ID NO: 9003483 - DNA, 22 bp, Homo sapiens
agatgacaatgaggttgttatt

SEQ ID NO: 9003484 - DNA, 22 bp, Homo sapiens
agatgacacaccatttttactt

SEQ ID NO: 9003485 - DNA, 22 bp, Homo sapiens
agatgacacacacgcacccgga

SEQ ID NO: 9003486 - DNA, 22 bp, Homo sapiens
agatgaggggtagaaaggactt

SEQ ID NO: 9003487 - DNA, 22 bp, Homo sapiens
agatgagtaaatggagtcttcc

SEQ ID NO: 9003488 - DNA, 22 bp, Homo sapiens
agatgaggggtagaaaggactt

SEQ ID NO: 9003489 - DNA, 23 bp, Homo sapiens
agatgaggcttctccatgttggt

SEQ ID NO: 9003490 - DNA, 22 bp, Homo sapiens
agatgaggggtagaaaggactt

SEQ ID NO: 9003491 - DNA, 21 bp, Homo sapiens
agatgaggatactgaggccta

SEQ ID NO: 9003492 - DNA, 21 bp, Homo sapiens
agatgaggatactgaggccta

SEQ ID NO: 9003493 - DNA, 21 bp, Homo sapiens
agatgaggatactgaggccta

SEQ ID NO: 9003494 - DNA, 23 bp, Homo sapiens
agatgagccaacacctccatgcc

SEQ ID NO: 9003495 - DNA, 22 bp, Homo sapiens
agatgagaatttttagagtgct

SEQ ID NO: 9003496 - DNA, 22 bp, Homo sapiens
atttgaatgcaggtagctgagt

SEQ ID NO: 9003497 - DNA, 22 bp, Homo sapiens
atttgaatgcaggtagctgagt

SEQ ID NO: 9003498 - DNA, 22 bp, Homo sapiens
atttgaatggcttaacacaacg

SEQ ID NO: 9003499 - DNA, 22 bp, Homo sapiens
agatgacaagagcttgctgcag

SEQ ID NO: 9003500 - DNA, 22 bp, Homo sapiens
agatgacaatgaaggaaaatgt

SEQ ID NO: 9003501 - DNA, 22 bp, Homo sapiens
atttgaagaaagttttctagat

SEQ ID NO: 9003502 - DNA, 22 bp, Homo sapiens
atttgaagtcttcatgatttct

SEQ ID NO: 9003503 - DNA, 22 bp, Homo sapiens
atttgaagtcttcatgatttct

SEQ ID NO: 9003504 - DNA, 22 bp, Homo sapiens
atttgaagtaagtaatgagtat

SEQ ID NO: 9003505 - DNA, 22 bp, Homo sapiens
atttgaatgcaggtagctgagt

SEQ ID NO: 9003506 - DNA, 22 bp, Homo sapiens
atttgaagtaagtaatgagtat

SEQ ID NO: 9003507 - DNA, 22 bp, Homo sapiens
atttgaaccactcagaactcat

SEQ ID NO: 9003508 - DNA, 22 bp, Homo sapiens
atttgaagaaagttttctagat

SEQ ID NO: 9003509 - DNA, 22 bp, Homo sapiens
atttgaagaaagttttctagat

SEQ ID NO: 9003510 - DNA, 22 bp, Homo sapiens
atttgaaatctgggttactctg

SEQ ID NO: 9003511 - DNA, 22 bp, Homo sapiens
atttgaaatctgggttactctg

SEQ ID NO: 9003512 - DNA, 22 bp, Homo sapiens
atttgaaatcccttctactgta

SEQ ID NO: 9003513 - DNA, 22 bp, Homo sapiens
atttgaaatcccttctactgta

SEQ ID NO: 9003514 - DNA, 22 bp, Homo sapiens
atttgaaatctgggttactctg

SEQ ID NO: 9003515 - DNA, 19 bp, Homo sapiens
atttgaaagctgtgcttgc

SEQ ID NO: 9003516 - DNA, 19 bp, Homo sapiens
atttgaaagctgtgcttgc

SEQ ID NO: 9003517 - DNA, 19 bp, Homo sapiens
atttgaaagctgtgcttgc

SEQ ID NO: 9003518 - DNA, 19 bp, Homo sapiens
atttgaaagctgtgcttgc

SEQ ID NO: 9003519 - DNA, 22 bp, Homo sapiens
atttgaaatcccttctactgta

SEQ ID NO: 9003520 - DNA, 22 bp, Homo sapiens
atttgaaatcccttctactgta

SEQ ID NO: 9003521 - DNA, 22 bp, Homo sapiens
atttgaaatcccttctactgta

SEQ ID NO: 9003522 - DNA, 22 bp, Homo sapiens
atttgaaatcccttctactgta

SEQ ID NO: 9003523 - DNA, 22 bp, Homo sapiens
atttctgataaacgtaagctgc

SEQ ID NO: 9003524 - DNA, 22 bp, Homo sapiens
atttctcttcctcctagggttg

SEQ ID NO: 9003525 - DNA, 22 bp, Homo sapiens
atttctcttcctcctagggttg

SEQ ID NO: 9003526 - DNA, 22 bp, Homo sapiens
atttctcttcctcctagggttg

SEQ ID NO: 9003527 - DNA, 22 bp, Homo sapiens
atttctcttagcaagacattac

SEQ ID NO: 9003528 - DNA, 22 bp, Homo sapiens
atttctcttagcaagacattac

SEQ ID NO: 9003529 - DNA, 22 bp, Homo sapiens
atttacaggtagaattttaagt

SEQ ID NO: 9003530 - DNA, 22 bp, Homo sapiens
atttacaggtagaattttaagt

SEQ ID NO: 9003531 - DNA, 22 bp, Homo sapiens
atttacaggtagaattttaagt

SEQ ID NO: 9003532 - DNA, 22 bp, Homo sapiens
atttcttttcaagagggtgctt

SEQ ID NO: 9003533 - DNA, 22 bp, Homo sapiens
atttcttttcaagagggtgctt

SEQ ID NO: 9003534 - DNA, 22 bp, Homo sapiens
atttgaaaacctgagcctcccg

SEQ ID NO: 9003535 - DNA, 22 bp, Homo sapiens
atttgaaaacctgagcctcccg

SEQ ID NO: 9003536 - DNA, 23 bp, Homo sapiens
atttgaaactttcttgtttccag

SEQ ID NO: 9003537 - DNA, 23 bp, Homo sapiens
atttgaaactttcttgtttccag

SEQ ID NO: 9003538 - DNA, 23 bp, Homo sapiens
atttgaaactttcttgtttccag

SEQ ID NO: 9003539 - DNA, 22 bp, Homo sapiens
atttctttctggccacggtttt

SEQ ID NO: 9003540 - DNA, 22 bp, Homo sapiens
atttcttttcaagagggtgctt

SEQ ID NO: 9003541 - DNA, 22 bp, Homo sapiens
atttacaggacagcttggcatt

SEQ ID NO: 9003542 - DNA, 22 bp, Homo sapiens
atttacaggacagcttggcatt

SEQ ID NO: 9003543 - DNA, 22 bp, Homo sapiens
atttacaggacagcttggcatt

SEQ ID NO: 9003544 - DNA, 22 bp, Homo sapiens
atttacaggacagcttggcatt

SEQ ID NO: 9003545 - DNA, 22 bp, Homo sapiens
atttacaggtagaattttaagt

SEQ ID NO: 9003546 - DNA, 22 bp, Homo sapiens
atttacaggacagcttggcatt

SEQ ID NO: 9003547 - DNA, 22 bp, Homo sapiens
atttacaggtagaattttaagt

SEQ ID NO: 9003548 - DNA, 22 bp, Homo sapiens
atttacaggacagcttggcatt

SEQ ID NO: 9003549 - DNA, 23 bp, Homo sapiens
atttacagctgtgtgagcaagtt

SEQ ID NO: 9003550 - DNA, 23 bp, Homo sapiens
atttacagctgtgtgagcaagtt

SEQ ID NO: 9003551 - DNA, 22 bp, Homo sapiens
atttacagccttgccatctata

SEQ ID NO: 9003552 - DNA, 22 bp, Homo sapiens
atttacagccttgccatctata

SEQ ID NO: 9003553 - DNA, 22 bp, Homo sapiens
atttacagccttgaaaacagca

SEQ ID NO: 9003554 - DNA, 22 bp, Homo sapiens
atttacagccttgccatctata

SEQ ID NO: 9003555 - DNA, 22 bp, Homo sapiens
atttacagccttgaaaacagca

SEQ ID NO: 9003556 - DNA, 22 bp, Homo sapiens
atttacagccttgaaaacagca

SEQ ID NO: 9003557 - DNA, 22 bp, Homo sapiens
atttacagccttgaaaacagca

SEQ ID NO: 9003558 - DNA, 22 bp, Homo sapiens
atttacagccttgaaaacagca

SEQ ID NO: 9003559 - DNA, 22 bp, Homo sapiens
atttacagatgatgctatttga

SEQ ID NO: 9003560 - DNA, 22 bp, Homo sapiens
atttacagatgatgctatttga

SEQ ID NO: 9003561 - DNA, 22 bp, Homo sapiens
agatgatgaccatgggaatgga

SEQ ID NO: 9003562 - DNA, 22 bp, Homo sapiens
agatgatcccaagaagatgctg

SEQ ID NO: 9003563 - DNA, 22 bp, Homo sapiens
agatgagtaggtagcattagta

SEQ ID NO: 9003564 - DNA, 22 bp, Homo sapiens
agatgatgttggagtctgtgct

SEQ ID NO: 9003565 - DNA, 22 bp, Homo sapiens
agatgatggccatgtcctctcc

SEQ ID NO: 9003566 - DNA, 22 bp, Homo sapiens
agatgtttataactcatgagtg

SEQ ID NO: 9003567 - DNA, 22 bp, Homo sapiens
agatgtttcagtaatttatctt

SEQ ID NO: 9003568 - DNA, 22 bp, Homo sapiens
agatgtttcagtaatttatctt

SEQ ID NO: 9003569 - DNA, 22 bp, Homo sapiens
agatgtttgtaaacacactgct

SEQ ID NO: 9003570 - DNA, 22 bp, Homo sapiens
agattcatgggaaagctttagg

SEQ ID NO: 9003571 - DNA, 21 bp, Homo sapiens
agattcataatctgtaaaatg

SEQ ID NO: 9003572 - DNA, 22 bp, Homo sapiens
agattcagttaaggctggtaga

SEQ ID NO: 9003573 - DNA, 22 bp, Homo sapiens
agattcaggactggccacagcc

SEQ ID NO: 9003574 - DNA, 22 bp, Homo sapiens
agattcaggcatgtcttcattt

SEQ ID NO: 9003575 - DNA, 22 bp, Homo sapiens
agattcaggcatgtcttcattt

SEQ ID NO: 9003576 - DNA, 22 bp, Homo sapiens
agattcattatcttctttgtac

SEQ ID NO: 9003577 - DNA, 22 bp, Homo sapiens
agattcattgtggatattttct

SEQ ID NO: 9003578 - DNA, 22 bp, Homo sapiens
agattcatgggtctaaccagtg

SEQ ID NO: 9003579 - DNA, 22 bp, Homo sapiens
agattcaggactggccacagcc

SEQ ID NO: 9003580 - DNA, 22 bp, Homo sapiens
agattcatgggaaagctttagg

SEQ ID NO: 9003581 - DNA, 22 bp, Homo sapiens
agattctcaacaaagagtagca

SEQ ID NO: 9003582 - DNA, 22 bp, Homo sapiens
agattctactctagatccatgg

SEQ ID NO: 9003583 - DNA, 22 bp, Homo sapiens
agattctaccagagctagtttg

SEQ ID NO: 9003584 - DNA, 22 bp, Homo sapiens
agattctcggtccgggcagccc

SEQ ID NO: 9003585 - DNA, 22 bp, Homo sapiens
agattctaaacttgattctgct

SEQ ID NO: 9003586 - DNA, 22 bp, Homo sapiens
agattcgaaacctttaggtctt

SEQ ID NO: 9003587 - DNA, 22 bp, Homo sapiens
agattccaggcctggggccaag

SEQ ID NO: 9003588 - DNA, 22 bp, Homo sapiens
agattccagatcccaaaaatga

SEQ ID NO: 9003589 - DNA, 23 bp, Homo sapiens
agattggtgtgtgcatcaaattg

SEQ ID NO: 9003590 - DNA, 22 bp, Homo sapiens
agattggtgttgcagaaccatg

SEQ ID NO: 9003591 - DNA, 22 bp, Homo sapiens
agattggtgaatgaaaagtaga

SEQ ID NO: 9003592 - DNA, 22 bp, Homo sapiens
agattggggtccagactcctga

SEQ ID NO: 9003593 - DNA, 22 bp, Homo sapiens
agattggtttcccacatagctg

SEQ ID NO: 9003594 - DNA, 22 bp, Homo sapiens
agattgtagaaactgtagcatt

SEQ ID NO: 9003595 - DNA, 22 bp, Homo sapiens
agattggttatttgataaggaa

SEQ ID NO: 9003596 - DNA, 22 bp, Homo sapiens
agattggttccttgctttgaaa

SEQ ID NO: 9003597 - DNA, 20 bp, Homo sapiens
agattggatgttaagactgg

SEQ ID NO: 9003598 - DNA, 22 bp, Homo sapiens
agattgggctccagttaaaacg

SEQ ID NO: 9003599 - DNA, 22 bp, Homo sapiens
agattgctttccaaaagcgttg

SEQ ID NO: 9003600 - DNA, 22 bp, Homo sapiens
agattgaatatagagattcttg

SEQ ID NO: 9003601 - DNA, 22 bp, Homo sapiens
agattgaataaccacctttttc

SEQ ID NO: 9003602 - DNA, 22 bp, Homo sapiens
agattgatagatgtttctaaaa

SEQ ID NO: 9003603 - DNA, 22 bp, Homo sapiens
agatttactgagaactgattac

SEQ ID NO: 9003604 - DNA, 22 bp, Homo sapiens
agatttactggagtctttggtg

SEQ ID NO: 9003605 - DNA, 22 bp, Homo sapiens
agatttatgtggtcacactcag

SEQ ID NO: 9003606 - DNA, 22 bp, Homo sapiens
agatttagctgtgaacagcttg

SEQ ID NO: 9003607 - DNA, 22 bp, Homo sapiens
agatttactccctgcttccgcc

SEQ ID NO: 9003608 - DNA, 22 bp, Homo sapiens
agatttactcagctcctggaaa

SEQ ID NO: 9003609 - DNA, 20 bp, Homo sapiens
agatttacctttgagccttc

SEQ ID NO: 9003610 - DNA, 22 bp, Homo sapiens
agatttacaaaggatttgcttt

SEQ ID NO: 9003611 - DNA, 22 bp, Homo sapiens
agatttacaaaggatttgcttt

SEQ ID NO: 9003612 - DNA, 19 bp, Homo sapiens
agatttacctcatatagtt

SEQ ID NO: 9003613 - DNA, 22 bp, Homo sapiens
agattgtagaaactgtagcatt

SEQ ID NO: 9003614 - DNA, 22 bp, Homo sapiens
agattgtatcctcggagacttc

SEQ ID NO: 9003615 - DNA, 18 bp, Homo sapiens
agattgtgtctacaaatc

SEQ ID NO: 9003616 - DNA, 18 bp, Homo sapiens
agattgtgtctacaaatc

SEQ ID NO: 9003617 - DNA, 23 bp, Homo sapiens
agattgttattcccagttcatgt

SEQ ID NO: 9003618 - DNA, 23 bp, Homo sapiens
agatttaatgttatattctgggc

SEQ ID NO: 9003619 - DNA, 23 bp, Homo sapiens
agatttaatgttatattctgggc

SEQ ID NO: 9003620 - DNA, 22 bp, Homo sapiens
agatttaaatttgctacaattc

SEQ ID NO: 9003621 - DNA, 22 bp, Homo sapiens
agatttaaatttgctacaattc

SEQ ID NO: 9003622 - DNA, 22 bp, Homo sapiens
agatttaaatttgctacaattc

SEQ ID NO: 9003623 - DNA, 22 bp, Homo sapiens
agatttaaagcagtattcgcaa

SEQ ID NO: 9003624 - DNA, 22 bp, Homo sapiens
agatttaaagcagtattcgcaa

SEQ ID NO: 9003625 - DNA, 22 bp, Homo sapiens
agatttaaagcagtattcgcaa

SEQ ID NO: 9003626 - DNA, 22 bp, Homo sapiens
agatttaaatttgctacaattc

SEQ ID NO: 9003627 - DNA, 22 bp, Homo sapiens
attttggcaacagccatgagcc

SEQ ID NO: 9003628 - DNA, 22 bp, Homo sapiens
attttgctttatgtaaatatgt

SEQ ID NO: 9003629 - DNA, 22 bp, Homo sapiens
attttctgtaactatttctata

SEQ ID NO: 9003630 - DNA, 22 bp, Homo sapiens
attttctgtaactatttctata

SEQ ID NO: 9003631 - DNA, 21 bp, Homo sapiens
attttgtacatagaatttgtc

SEQ ID NO: 9003632 - DNA, 21 bp, Homo sapiens
attttgtacatagaatttgtc

SEQ ID NO: 9003633 - DNA, 21 bp, Homo sapiens
attttgtacatagaatttgtc

SEQ ID NO: 9003634 - DNA, 22 bp, Homo sapiens
agatttcaatggatattgcaag

SEQ ID NO: 9003635 - DNA, 22 bp, Homo sapiens
agatttatgtggtcacactcag

SEQ ID NO: 9003636 - DNA, 22 bp, Homo sapiens
agatttatgtggtcacactcag

SEQ ID NO: 9003637 - DNA, 22 bp, Homo sapiens
agatttatgtggtcacactcag

SEQ ID NO: 9003638 - DNA, 22 bp, Homo sapiens
agatttatgtggtcacactcag

SEQ ID NO: 9003639 - DNA, 22 bp, Homo sapiens
agatttatgtggtcacactcag

SEQ ID NO: 9003640 - DNA, 22 bp, Homo sapiens
agatttatgtggtcacactcag

SEQ ID NO: 9003641 - DNA, 22 bp, Homo sapiens
agatttatgtggtcacactcag

SEQ ID NO: 9003642 - DNA, 22 bp, Homo sapiens
agatttatgtggtcacactcag

SEQ ID NO: 9003643 - DNA, 22 bp, Homo sapiens
agatttatgtggtcacactcag

SEQ ID NO: 9003644 - DNA, 22 bp, Homo sapiens
agatttatgtggtcacactcag

SEQ ID NO: 9003645 - DNA, 22 bp, Homo sapiens
agatttatgtggtcacactcag

SEQ ID NO: 9003646 - DNA, 22 bp, Homo sapiens
attctaatgccctggccccagc

SEQ ID NO: 9003647 - DNA, 22 bp, Homo sapiens
attctaatggcagagactcctg

SEQ ID NO: 9003648 - DNA, 22 bp, Homo sapiens
attctaattagttctacatgtt

SEQ ID NO: 9003649 - DNA, 22 bp, Homo sapiens
attctaatgccctggccccagc

SEQ ID NO: 9003650 - DNA, 22 bp, Homo sapiens
attctaatggcagagactcctg

SEQ ID NO: 9003651 - DNA, 22 bp, Homo sapiens
attctaagcacgctgaagtctt

SEQ ID NO: 9003652 - DNA, 22 bp, Homo sapiens
attctacaaaagaactggatct

SEQ ID NO: 9003653 - DNA, 22 bp, Homo sapiens
attctacaacccaataataatt

SEQ ID NO: 9003654 - DNA, 22 bp, Homo sapiens
attctacaaaagaactggatct

SEQ ID NO: 9003655 - DNA, 22 bp, Homo sapiens
attctaattagttctacatgtt

SEQ ID NO: 9003656 - DNA, 22 bp, Homo sapiens
attctacaaaagaactggatct

SEQ ID NO: 9003657 - DNA, 22 bp, Homo sapiens
attctaattagttctacatgtt

SEQ ID NO: 9003658 - DNA, 22 bp, Homo sapiens
attctaaatgtaatttagaatt

SEQ ID NO: 9003659 - DNA, 22 bp, Homo sapiens
attctaaatgtaatttagaatt

SEQ ID NO: 9003660 - DNA, 22 bp, Homo sapiens
attctaaatcagagagctctgt

SEQ ID NO: 9003661 - DNA, 22 bp, Homo sapiens
attctaaatcagagagctctgt

SEQ ID NO: 9003662 - DNA, 22 bp, Homo sapiens
attctaaatcagagagctctgt

SEQ ID NO: 9003663 - DNA, 22 bp, Homo sapiens
attctaaatgtaatttagaatt

SEQ ID NO: 9003664 - DNA, 22 bp, Homo sapiens
attctaaatcagagagctctgt

SEQ ID NO: 9003665 - DNA, 20 bp, Homo sapiens
attctaaagctctgctcttt

SEQ ID NO: 9003666 - DNA, 22 bp, Homo sapiens
attctaaagcttgtggagctta

SEQ ID NO: 9003667 - DNA, 22 bp, Homo sapiens
attctaaatcagagagctctgt

SEQ ID NO: 9003668 - DNA, 22 bp, Homo sapiens
attctaaagcttgtggagctta

SEQ ID NO: 9003669 - DNA, 22 bp, Homo sapiens
attctaaagcttgtggagctta

SEQ ID NO: 9003670 - DNA, 22 bp, Homo sapiens
attcgctgacttgcacatttgg

SEQ ID NO: 9003671 - DNA, 20 bp, Homo sapiens
attctaaagctctgctcttt

SEQ ID NO: 9003672 - DNA, 22 bp, Homo sapiens
attcaaactgtgttaggcagca

SEQ ID NO: 9003673 - DNA, 22 bp, Homo sapiens
attcaaacctcatttattgttc

SEQ ID NO: 9003674 - DNA, 22 bp, Homo sapiens
attcaaaccccatagacaactt

SEQ ID NO: 9003675 - DNA, 22 bp, Homo sapiens
attcaaacaggccaattgacct

SEQ ID NO: 9003676 - DNA, 22 bp, Homo sapiens
attcaaaccccatagacaactt

SEQ ID NO: 9003677 - DNA, 22 bp, Homo sapiens
attcaaacactttgagaagttc

SEQ ID NO: 9003678 - DNA, 22 bp, Homo sapiens
attcaaacaggaagaaatcatt

SEQ ID NO: 9003679 - DNA, 22 bp, Homo sapiens
attcaaacaggaagaaatcatt

SEQ ID NO: 9003680 - DNA, 22 bp, Homo sapiens
attcaaacaggccaattgacct

SEQ ID NO: 9003681 - DNA, 22 bp, Homo sapiens
attcaaacaggaagaaatcatt

SEQ ID NO: 9003682 - DNA, 22 bp, Homo sapiens
attcaaaagaccatgcagactc

SEQ ID NO: 9003683 - DNA, 22 bp, Homo sapiens
attcaaaagaccatgcagactc

SEQ ID NO: 9003684 - DNA, 22 bp, Homo sapiens
attcaaaagaccatgcagactc

SEQ ID NO: 9003685 - DNA, 22 bp, Homo sapiens
attcaaaagaccatgcagactc

SEQ ID NO: 9003686 - DNA, 22 bp, Homo sapiens
attcaaaagaccatgcagactc

SEQ ID NO: 9003687 - DNA, 22 bp, Homo sapiens
attcaaaagaccatgcagactc

SEQ ID NO: 9003688 - DNA, 22 bp, Homo sapiens
attcaaaagaccatgcagactc

SEQ ID NO: 9003689 - DNA, 22 bp, Homo sapiens
attcaaaagaccatgcagactc

SEQ ID NO: 9003690 - DNA, 22 bp, Homo sapiens
attcaaagaacctttagcattg

SEQ ID NO: 9003691 - DNA, 22 bp, Homo sapiens
attcccaggtaaaagtagagct

SEQ ID NO: 9003692 - DNA, 22 bp, Homo sapiens
attcccatatatgtttgtcgct

SEQ ID NO: 9003693 - DNA, 22 bp, Homo sapiens
attcccataggcaatgcgtgat

SEQ ID NO: 9003694 - DNA, 22 bp, Homo sapiens
attcccatagccatccggagag

SEQ ID NO: 9003695 - DNA, 22 bp, Homo sapiens
attcccaggtaaaagtagagct

SEQ ID NO: 9003696 - DNA, 22 bp, Homo sapiens
attcccatctctgagtggaagg

SEQ ID NO: 9003697 - DNA, 22 bp, Homo sapiens
attcccatctctgagtggaagg

SEQ ID NO: 9003698 - DNA, 22 bp, Homo sapiens
attcccatgtctttacctgttg

SEQ ID NO: 9003699 - DNA, 22 bp, Homo sapiens
attcctttggactcctccttgc

SEQ ID NO: 9003700 - DNA, 22 bp, Homo sapiens
attcctttggactcctccttgc

SEQ ID NO: 9003701 - DNA, 22 bp, Homo sapiens
attctctcttctgctgcccgtg

SEQ ID NO: 9003702 - DNA, 22 bp, Homo sapiens
attctctctctatgaaaactga

SEQ ID NO: 9003703 - DNA, 22 bp, Homo sapiens
attctctctagaagctgagatg

SEQ ID NO: 9003704 - DNA, 22 bp, Homo sapiens
attctctctagaagctgagatg

SEQ ID NO: 9003705 - DNA, 22 bp, Homo sapiens
attctctcatttatctgtccta

SEQ ID NO: 9003706 - DNA, 22 bp, Homo sapiens
attctctagtctcttccataaa

SEQ ID NO: 9003707 - DNA, 22 bp, Homo sapiens
attctctagtctcttccataaa

SEQ ID NO: 9003708 - DNA, 22 bp, Homo sapiens
attctccctgttcctcgacacc

SEQ ID NO: 9003709 - DNA, 22 bp, Homo sapiens
attctccttattctgaaaaaag

SEQ ID NO: 9003710 - DNA, 22 bp, Homo sapiens
attctccttctattaagttatt

SEQ ID NO: 9003711 - DNA, 22 bp, Homo sapiens
attctacaacccaataataatt

SEQ ID NO: 9003712 - DNA, 20 bp, Homo sapiens
attctacaagaataagcatg

SEQ ID NO: 9003713 - DNA, 20 bp, Homo sapiens
attctacaagaataagcatg

SEQ ID NO: 9003714 - DNA, 20 bp, Homo sapiens
attctacaagaataagcatg

SEQ ID NO: 9003715 - DNA, 22 bp, Homo sapiens
attctacaatcatgtagatcct

SEQ ID NO: 9003716 - DNA, 22 bp, Homo sapiens
attctacaatcatgtagatcct

SEQ ID NO: 9003717 - DNA, 22 bp, Homo sapiens
attctctggctaaaacctgaag

SEQ ID NO: 9003718 - DNA, 22 bp, Homo sapiens
attctctgggttccagtaaatg

SEQ ID NO: 9003719 - DNA, 22 bp, Homo sapiens
attctctggtcattgagtataa

SEQ ID NO: 9003720 - DNA, 22 bp, Homo sapiens
attctctggtcattgagcatat

SEQ ID NO: 9003721 - DNA, 20 bp, Homo sapiens
attctctgacaccgcccccg

SEQ ID NO: 9003722 - DNA, 22 bp, Homo sapiens
attctctgaagtctttcagggc

SEQ ID NO: 9003723 - DNA, 19 bp, Homo sapiens
attcttctcttcctgctgt

SEQ ID NO: 9003724 - DNA, 19 bp, Homo sapiens
attcttctcttcctgctgt

SEQ ID NO: 9003725 - DNA, 22 bp, Homo sapiens
attctctgtgcagatttaagac

SEQ ID NO: 9003726 - DNA, 19 bp, Homo sapiens
attcttctcttcctgctgt

SEQ ID NO: 9003727 - DNA, 22 bp, Homo sapiens
attctctgtgcagatttaagac

SEQ ID NO: 9003728 - DNA, 22 bp, Homo sapiens
attcttctgcctactttcatcc

SEQ ID NO: 9003729 - DNA, 22 bp, Homo sapiens
attcttctgcctactttcatcc

SEQ ID NO: 9003730 - DNA, 22 bp, Homo sapiens
attcttctgcctactttcatcc

SEQ ID NO: 9003731 - DNA, 22 bp, Homo sapiens
attcttctgcctactttcatcc

SEQ ID NO: 9003732 - DNA, 22 bp, Homo sapiens
attcttctgcctactttcatcc

SEQ ID NO: 9003733 - DNA, 22 bp, Homo sapiens
attgaaaaatgactattgctta

SEQ ID NO: 9003734 - DNA, 22 bp, Homo sapiens
attgaaaaatgactattgctta

SEQ ID NO: 9003735 - DNA, 22 bp, Homo sapiens
agagcttcactggagagcacat

SEQ ID NO: 9003736 - DNA, 23 bp, Homo sapiens
agagcttagggaattcacatgag

SEQ ID NO: 9003737 - DNA, 22 bp, Homo sapiens
agagcttatatcttggccatcc

SEQ ID NO: 9003738 - DNA, 22 bp, Homo sapiens
attaatacattatagggattgt

SEQ ID NO: 9003739 - DNA, 22 bp, Homo sapiens
agagcttagaatttcagatgat

SEQ ID NO: 9003740 - DNA, 22 bp, Homo sapiens
agagcttagaatttcagatgat

SEQ ID NO: 9003741 - DNA, 22 bp, Homo sapiens
attaataaaataccactttgtt

SEQ ID NO: 9003742 - DNA, 22 bp, Homo sapiens
attaataaaataccactttgtt

SEQ ID NO: 9003743 - DNA, 22 bp, Homo sapiens
attaataaaataccactttgtt

SEQ ID NO: 9003744 - DNA, 22 bp, Homo sapiens
attaataaaataccactttgtt

SEQ ID NO: 9003745 - DNA, 22 bp, Homo sapiens
attaataaaataccactttgtt

SEQ ID NO: 9003746 - DNA, 22 bp, Homo sapiens
attaataaaataccactttgtt

SEQ ID NO: 9003747 - DNA, 22 bp, Homo sapiens
attaatacattatagggattgt

SEQ ID NO: 9003748 - DNA, 22 bp, Homo sapiens
attaatacattatagggattgt

SEQ ID NO: 9003749 - DNA, 22 bp, Homo sapiens
agagctttgtttgattgtcaga

SEQ ID NO: 9003750 - DNA, 22 bp, Homo sapiens
agagctttgtttgattgtcaga

SEQ ID NO: 9003751 - DNA, 22 bp, Homo sapiens
agagcttttacttacattctat

SEQ ID NO: 9003752 - DNA, 22 bp, Homo sapiens
agagcttttacttacattctat

SEQ ID NO: 9003753 - DNA, 22 bp, Homo sapiens
agagcttttctgtaataacatc

SEQ ID NO: 9003754 - DNA, 22 bp, Homo sapiens
agagcttttgggaattcaggta

SEQ ID NO: 9003755 - DNA, 22 bp, Homo sapiens
agagcttttctgtaataacatc

SEQ ID NO: 9003756 - DNA, 22 bp, Homo sapiens
agagctttagctgctggtctgg

SEQ ID NO: 9003757 - DNA, 22 bp, Homo sapiens
agagcttgtaattgagtcaggt

SEQ ID NO: 9003758 - DNA, 23 bp, Homo sapiens
agagctttctaaaatgtaaatct

SEQ ID NO: 9003759 - DNA, 23 bp, Homo sapiens
agagctttccagtttcttggtga

SEQ ID NO: 9003760 - DNA, 23 bp, Homo sapiens
agagctttctaaaatgtaaatct

SEQ ID NO: 9003761 - DNA, 22 bp, Homo sapiens
agagctttgggacatttgctag

SEQ ID NO: 9003762 - DNA, 22 bp, Homo sapiens
agagctttgggacatttgctag

SEQ ID NO: 9003763 - DNA, 22 bp, Homo sapiens
agaggaaacataggtttttaaa

SEQ ID NO: 9003764 - DNA, 22 bp, Homo sapiens
agaggaaacataggtttttaaa

SEQ ID NO: 9003765 - DNA, 22 bp, Homo sapiens
agaggaaaatgagttccagaat

SEQ ID NO: 9003766 - DNA, 22 bp, Homo sapiens
agagctttttgacatctctcta

SEQ ID NO: 9003767 - DNA, 22 bp, Homo sapiens
agagcttttgggaattcaggta

SEQ ID NO: 9003768 - DNA, 21 bp, Homo sapiens
agaggaagaagagtgtattat

SEQ ID NO: 9003769 - DNA, 21 bp, Homo sapiens
agaggaagaagagtgtattat

SEQ ID NO: 9003770 - DNA, 21 bp, Homo sapiens
agaggaagaagagtgtattat

SEQ ID NO: 9003771 - DNA, 22 bp, Homo sapiens
agaggaacccagacagggcttt

SEQ ID NO: 9003772 - DNA, 22 bp, Homo sapiens
agaggaacccagacagggcttt

SEQ ID NO: 9003773 - DNA, 22 bp, Homo sapiens
agaggaaatggataaagggtga

SEQ ID NO: 9003774 - DNA, 22 bp, Homo sapiens
agaggccagggacactgctcaa

SEQ ID NO: 9003775 - DNA, 22 bp, Homo sapiens
agaggaagccattgcttactga

SEQ ID NO: 9003776 - DNA, 22 bp, Homo sapiens
agaggaagccattgcttactga

SEQ ID NO: 9003777 - DNA, 22 bp, Homo sapiens
agaggaagccattgcttactga

SEQ ID NO: 9003778 - DNA, 22 bp, Homo sapiens
agaggccctctctgctcagtct

SEQ ID NO: 9003779 - DNA, 22 bp, Homo sapiens
agaggccctggctagagcagct

SEQ ID NO: 9003780 - DNA, 22 bp, Homo sapiens
agaggccctggctagagcagct

SEQ ID NO: 9003781 - DNA, 22 bp, Homo sapiens
agaggccctctctgctcagtct

SEQ ID NO: 9003782 - DNA, 22 bp, Homo sapiens
agaggccaggtccagagtttgt

SEQ ID NO: 9003783 - DNA, 22 bp, Homo sapiens
agaggccagggacactgctcaa

SEQ ID NO: 9003784 - DNA, 22 bp, Homo sapiens
agaggccagggacactgctcaa

SEQ ID NO: 9003785 - DNA, 22 bp, Homo sapiens
agaggccagggacactgctcaa

SEQ ID NO: 9003786 - DNA, 22 bp, Homo sapiens
agaggccagggacactgctcaa

SEQ ID NO: 9003787 - DNA, 22 bp, Homo sapiens
agaggccggccgagcccatggg

SEQ ID NO: 9003788 - DNA, 22 bp, Homo sapiens
agaggccggccgagcccatggg

SEQ ID NO: 9003789 - DNA, 22 bp, Homo sapiens
agaggccggccgagcccatggg

SEQ ID NO: 9003790 - DNA, 22 bp, Homo sapiens
agaggccggccgagcccatggg

SEQ ID NO: 9003791 - DNA, 22 bp, Homo sapiens
agaggccgggtgcctgctcaga

SEQ ID NO: 9003792 - DNA, 22 bp, Homo sapiens
agaggccggccgagcccatggg

SEQ ID NO: 9003793 - DNA, 22 bp, Homo sapiens
agaggccgggtgcctgctcaga

SEQ ID NO: 9003794 - DNA, 22 bp, Homo sapiens
agaggccctggctagagcagct

SEQ ID NO: 9003795 - DNA, 22 bp, Homo sapiens
agaggccctggctagagcagct

SEQ ID NO: 9003796 - DNA, 22 bp, Homo sapiens
agaggccctggctagagcagct

SEQ ID NO: 9003797 - DNA, 22 bp, Homo sapiens
agaggccctgggctggtgtgct

SEQ ID NO: 9003798 - DNA, 22 bp, Homo sapiens
agaggccctgggctggtgtgct

SEQ ID NO: 9003799 - DNA, 22 bp, Homo sapiens
agaggcctaaccaagatgtcct

SEQ ID NO: 9003800 - DNA, 22 bp, Homo sapiens
agaggcctaaccaagatgtcct

SEQ ID NO: 9003801 - DNA, 22 bp, Homo sapiens
agaggcctaattgctacccttt

SEQ ID NO: 9003802 - DNA, 22 bp, Homo sapiens
agaggcctcaaaccagacctga

SEQ ID NO: 9003803 - DNA, 19 bp, Homo sapiens
agaggcctcagcagctggc

SEQ ID NO: 9003804 - DNA, 19 bp, Homo sapiens
agaggcctcagcagctggc

SEQ ID NO: 9003805 - DNA, 22 bp, Homo sapiens
attatttgcttggctcatctaa

SEQ ID NO: 9003806 - DNA, 22 bp, Homo sapiens
attatttgcttggctcatctaa

SEQ ID NO: 9003807 - DNA, 22 bp, Homo sapiens
attatttgacttgagaacaggt

SEQ ID NO: 9003808 - DNA, 22 bp, Homo sapiens
attatttgagttcctctctacc

SEQ ID NO: 9003809 - DNA, 22 bp, Homo sapiens
attatttgtgtccacagaatac

SEQ ID NO: 9003810 - DNA, 22 bp, Homo sapiens
attatttgtgtccacagaatac

SEQ ID NO: 9003811 - DNA, 15 bp, Homo sapiens
attatttgtgctcag

SEQ ID NO: 9003812 - DNA, 22 bp, Homo sapiens
attatttggaataggcattgca

SEQ ID NO: 9003813 - DNA, 22 bp, Homo sapiens
attattttatgtgcggcctgat

SEQ ID NO: 9003814 - DNA, 22 bp, Homo sapiens
attattttatgtgcggcctgat

SEQ ID NO: 9003815 - DNA, 22 bp, Homo sapiens
attattttatgtgcggcctgat

SEQ ID NO: 9003816 - DNA, 22 bp, Homo sapiens
attattttatgtgcggcctgat

SEQ ID NO: 9003817 - DNA, 22 bp, Homo sapiens
agaggcctccgaaaggtgggct

SEQ ID NO: 9003818 - DNA, 22 bp, Homo sapiens
agaggcctctttgcaagtaggt

SEQ ID NO: 9003819 - DNA, 22 bp, Homo sapiens
attatttctcactcacataata

SEQ ID NO: 9003820 - DNA, 22 bp, Homo sapiens
attatttctcactcacataata

SEQ ID NO: 9003821 - DNA, 22 bp, Homo sapiens
attatttgacttgagaacaggt

SEQ ID NO: 9003822 - DNA, 22 bp, Homo sapiens
attatttctcactcacataata

SEQ ID NO: 9003823 - DNA, 22 bp, Homo sapiens
attatttctcactcacataata

SEQ ID NO: 9003824 - DNA, 22 bp, Homo sapiens
attatttctcactcacataata

SEQ ID NO: 9003825 - DNA, 22 bp, Homo sapiens
attgtatcccccaggtgtttaa

SEQ ID NO: 9003826 - DNA, 22 bp, Homo sapiens
attgtatacaagcttaattgtt

SEQ ID NO: 9003827 - DNA, 22 bp, Homo sapiens
attgtatacaagcttaattgtt

SEQ ID NO: 9003828 - DNA, 22 bp, Homo sapiens
attgtatacaagcttaattgtt

SEQ ID NO: 9003829 - DNA, 22 bp, Homo sapiens
attgtataagtctatttacaat

SEQ ID NO: 9003830 - DNA, 22 bp, Homo sapiens
attgtataagtctatttacaat

SEQ ID NO: 9003831 - DNA, 22 bp, Homo sapiens
attgtataagtctatttacaat

SEQ ID NO: 9003832 - DNA, 22 bp, Homo sapiens
attgtataagtctatttacaat

SEQ ID NO: 9003833 - DNA, 22 bp, Homo sapiens
attgtataattgtattgccaaa

SEQ ID NO: 9003834 - DNA, 22 bp, Homo sapiens
attgtataatcagttactggaa

SEQ ID NO: 9003835 - DNA, 22 bp, Homo sapiens
attggtgctctggcacattcct

SEQ ID NO: 9003836 - DNA, 22 bp, Homo sapiens
attggtggtgaggacatgccag

SEQ ID NO: 9003837 - DNA, 22 bp, Homo sapiens
attggtgcatgtaggtgatgct

SEQ ID NO: 9003838 - DNA, 22 bp, Homo sapiens
attggtgctctggcacattcct

SEQ ID NO: 9003839 - DNA, 22 bp, Homo sapiens
attggtgcattttacaaaactc

SEQ ID NO: 9003840 - DNA, 22 bp, Homo sapiens
attgtataacagcatgtatttt

SEQ ID NO: 9003841 - DNA, 22 bp, Homo sapiens
attgtataagtctatttacaat

SEQ ID NO: 9003842 - DNA, 22 bp, Homo sapiens
attgtataagtctatttacaat

SEQ ID NO: 9003843 - DNA, 22 bp, Homo sapiens
attgtataagtctatttacaat

SEQ ID NO: 9003844 - DNA, 22 bp, Homo sapiens
attgtataacagcatgtatttt

SEQ ID NO: 9003845 - DNA, 22 bp, Homo sapiens
attgtataacagcatgtatttt

SEQ ID NO: 9003846 - DNA, 22 bp, Homo sapiens
attgagcacctactatgtgcta

SEQ ID NO: 9003847 - DNA, 22 bp, Homo sapiens
attgagcacatgctatgtgcca

SEQ ID NO: 9003848 - DNA, 22 bp, Homo sapiens
attgagcacctacagtattacc

SEQ ID NO: 9003849 - DNA, 22 bp, Homo sapiens
attgagatctgcatcataagct

SEQ ID NO: 9003850 - DNA, 22 bp, Homo sapiens
attggtctgtgagctgttgaca

SEQ ID NO: 9003851 - DNA, 22 bp, Homo sapiens
attggtgcaatagtcaggagct

SEQ ID NO: 9003852 - DNA, 22 bp, Homo sapiens
attggtgcaattatgagggtgt

SEQ ID NO: 9003853 - DNA, 22 bp, Homo sapiens
attggtctggggaaatgaagag

SEQ ID NO: 9003854 - DNA, 22 bp, Homo sapiens
attgaggagcagagatggggta

SEQ ID NO: 9003855 - DNA, 22 bp, Homo sapiens
attgaggcagcatagttcaggg

SEQ ID NO: 9003856 - DNA, 22 bp, Homo sapiens
attgaggactggtggggagagc

SEQ ID NO: 9003857 - DNA, 22 bp, Homo sapiens
attgaggagcagagatggggta

SEQ ID NO: 9003858 - DNA, 22 bp, Homo sapiens
attgagaatccatttgagatga

SEQ ID NO: 9003859 - DNA, 22 bp, Homo sapiens
attgagaatatgatttagtata

SEQ ID NO: 9003860 - DNA, 22 bp, Homo sapiens
attgagaattgtgagtttggag

SEQ ID NO: 9003861 - DNA, 22 bp, Homo sapiens
attgaaagtcctatctaaggga

SEQ ID NO: 9003862 - DNA, 22 bp, Homo sapiens
attgaaatacataaaattgcca

SEQ ID NO: 9003863 - DNA, 22 bp, Homo sapiens
attgaaatacataaaattgcca

SEQ ID NO: 9003864 - DNA, 21 bp, Homo sapiens
attgaaagtcaacaatcagtt

SEQ ID NO: 9003865 - DNA, 22 bp, Homo sapiens
attgaaaggcaaagtaggaagc

SEQ ID NO: 9003866 - DNA, 22 bp, Homo sapiens
attgaaaggttttgagcagata

SEQ ID NO: 9003867 - DNA, 22 bp, Homo sapiens
attgaaaggttttgagcagata

SEQ ID NO: 9003868 - DNA, 22 bp, Homo sapiens
attgaaagcatggatttggatt

SEQ ID NO: 9003869 - DNA, 22 bp, Homo sapiens
attgaaagcatggatttggatt

SEQ ID NO: 9003870 - DNA, 22 bp, Homo sapiens
attgaaagcatggatttggatt

SEQ ID NO: 9003871 - DNA, 22 bp, Homo sapiens
attgaaagcacaaagaacaagt

SEQ ID NO: 9003872 - DNA, 22 bp, Homo sapiens
attgaaagcacaaagaacaagt

SEQ ID NO: 9003873 - DNA, 22 bp, Homo sapiens
attgaaagcacaaagaacaagt

SEQ ID NO: 9003874 - DNA, 22 bp, Homo sapiens
attgaaagatatactgttctca

SEQ ID NO: 9003875 - DNA, 22 bp, Homo sapiens
attgaaagattttgggctcatg

SEQ ID NO: 9003876 - DNA, 22 bp, Homo sapiens
attgaaagatatactgttctca

SEQ ID NO: 9003877 - DNA, 22 bp, Homo sapiens
attgaaagataggctactgtgg

SEQ ID NO: 9003878 - DNA, 22 bp, Homo sapiens
attgagaaaattcgagcaagtt

SEQ ID NO: 9003879 - DNA, 22 bp, Homo sapiens
attgaaattgatgaaattcttg

SEQ ID NO: 9003880 - DNA, 22 bp, Homo sapiens
attgaaatccctacctcagagg

SEQ ID NO: 9003881 - DNA, 22 bp, Homo sapiens
attgagaaaggcttatgtttgc

SEQ ID NO: 9003882 - DNA, 22 bp, Homo sapiens
attgagaaatataatctggaaa

SEQ ID NO: 9003883 - DNA, 22 bp, Homo sapiens
attgagaaaggcttatgtttgc

SEQ ID NO: 9003884 - DNA, 22 bp, Homo sapiens
attgagaagcttgcagattttt

SEQ ID NO: 9003885 - DNA, 22 bp, Homo sapiens
attgagaagaaaatctaatata

SEQ ID NO: 9003886 - DNA, 22 bp, Homo sapiens
attgagaagaaaatctaatata

SEQ ID NO: 9003887 - DNA, 22 bp, Homo sapiens
attgagaaatataatctggaaa

SEQ ID NO: 9003888 - DNA, 22 bp, Homo sapiens
attgagaagaaaatctaatata

SEQ ID NO: 9003889 - DNA, 22 bp, Homo sapiens
attgaaagagaatgtagctctt

SEQ ID NO: 9003890 - DNA, 22 bp, Homo sapiens
attgaaagagttttctgctgca

SEQ ID NO: 9003891 - DNA, 22 bp, Homo sapiens
attgaaagataggctactgtgg

SEQ ID NO: 9003892 - DNA, 22 bp, Homo sapiens
attgaaagataggctactgtgg

SEQ ID NO: 9003893 - DNA, 22 bp, Homo sapiens
attgaaacaagttgctttctat

SEQ ID NO: 9003894 - DNA, 22 bp, Homo sapiens
attgaaaatgacatttgtgccc

SEQ ID NO: 9003895 - DNA, 22 bp, Homo sapiens
attgaaaatgacatttgtgccc

SEQ ID NO: 9003896 - DNA, 22 bp, Homo sapiens
attgaaaatataattctaggag

SEQ ID NO: 9003897 - DNA, 22 bp, Homo sapiens
attgaaaataaggccagaaaca

SEQ ID NO: 9003898 - DNA, 22 bp, Homo sapiens
attgaaaatataattctaggag

SEQ ID NO: 9003899 - DNA, 22 bp, Homo sapiens
attgaaaatataattctaggag

SEQ ID NO: 9003900 - DNA, 22 bp, Homo sapiens
attgaaaatataattctaggag

SEQ ID NO: 9003901 - DNA, 22 bp, Homo sapiens
attgaaaaattcacaattctgg

SEQ ID NO: 9003902 - DNA, 22 bp, Homo sapiens
attgaaaaattcacaattctgg

SEQ ID NO: 9003903 - DNA, 22 bp, Homo sapiens
attgaaaataaggccagaaaca

SEQ ID NO: 9003904 - DNA, 22 bp, Homo sapiens
attgaaaataaggccagaaaca

SEQ ID NO: 9003905 - DNA, 22 bp, Homo sapiens
attgaaaataaggccagaaaca

SEQ ID NO: 9003906 - DNA, 22 bp, Homo sapiens
attgaaaataaggccagaaaca

SEQ ID NO: 9003907 - DNA, 22 bp, Homo sapiens
attgaaaataaggccagaaaca

SEQ ID NO: 9003908 - DNA, 22 bp, Homo sapiens
attgaaaaatgactattgctta

SEQ ID NO: 9003909 - DNA, 22 bp, Homo sapiens
attgaaaaatgactattgctta

SEQ ID NO: 9003910 - DNA, 22 bp, Homo sapiens
attgaaaaatgactattgctta

SEQ ID NO: 9003911 - DNA, 22 bp, Homo sapiens
attgaaaaattcacaattctgg

SEQ ID NO: 9003912 - DNA, 22 bp, Homo sapiens
attgaaaaatgactattgctta

SEQ ID NO: 9003913 - DNA, 22 bp, Homo sapiens
attgaaaaattcacaattctgg

SEQ ID NO: 9003914 - DNA, 22 bp, Homo sapiens
attgtggtgtcagttataggca

SEQ ID NO: 9003915 - DNA, 22 bp, Homo sapiens
attgtggtgtcagttataggca

SEQ ID NO: 9003916 - DNA, 22 bp, Homo sapiens
attgtggtgtcagttataggca

SEQ ID NO: 9003917 - DNA, 22 bp, Homo sapiens
attgtggtgtcagttataggca

SEQ ID NO: 9003918 - DNA, 22 bp, Homo sapiens
attgtggtgtcagttataggca

SEQ ID NO: 9003919 - DNA, 22 bp, Homo sapiens
attgtggaccaggtagagcttt

SEQ ID NO: 9003920 - DNA, 22 bp, Homo sapiens
attgtggccacagagatccaat

SEQ ID NO: 9003921 - DNA, 22 bp, Homo sapiens
attgtgtcctcattgaccttca

SEQ ID NO: 9003922 - DNA, 22 bp, Homo sapiens
attgtgtcctcattgaccttca

SEQ ID NO: 9003923 - DNA, 22 bp, Homo sapiens
attgtgtcctcattgaccttca

SEQ ID NO: 9003924 - DNA, 22 bp, Homo sapiens
attgtgtaggggcagtctggga

SEQ ID NO: 9003925 - DNA, 22 bp, Homo sapiens
attgttaaagtaataaccatgg

SEQ ID NO: 9003926 - DNA, 22 bp, Homo sapiens
attgttaataactattacattg

SEQ ID NO: 9003927 - DNA, 22 bp, Homo sapiens
attgttaaagtaataaccatgg

SEQ ID NO: 9003928 - DNA, 22 bp, Homo sapiens
attgttaaagtaataaccatgg

SEQ ID NO: 9003929 - DNA, 22 bp, Homo sapiens
attgttaaagtaataaccatgg

SEQ ID NO: 9003930 - DNA, 22 bp, Homo sapiens
attgttaaagtaataaccatgg

SEQ ID NO: 9003931 - DNA, 22 bp, Homo sapiens
attgttaaaaaggtggaaatgc

SEQ ID NO: 9003932 - DNA, 22 bp, Homo sapiens
attgttaaaaaggtggaaatgc

SEQ ID NO: 9003933 - DNA, 22 bp, Homo sapiens
attgtgtggtgaatgatcagct

SEQ ID NO: 9003934 - DNA, 22 bp, Homo sapiens
attgttaaaaaggtggaaatgc

SEQ ID NO: 9003935 - DNA, 22 bp, Homo sapiens
attgttaaactgaagcattact

SEQ ID NO: 9003936 - DNA, 22 bp, Homo sapiens
attgttaaactgaagcattact

SEQ ID NO: 9003937 - DNA, 22 bp, Homo sapiens
attgttaaactgaagcattact

SEQ ID NO: 9003938 - DNA, 22 bp, Homo sapiens
attgttaaactgaagcattact

SEQ ID NO: 9003939 - DNA, 22 bp, Homo sapiens
attgtgctgcctcatggaagca

SEQ ID NO: 9003940 - DNA, 22 bp, Homo sapiens
attgtgctttagatcacagtct

SEQ ID NO: 9003941 - DNA, 22 bp, Homo sapiens
attgtatttccagcttgaatgt

SEQ ID NO: 9003942 - DNA, 22 bp, Homo sapiens
attgtatttccagcttgaatgt

SEQ ID NO: 9003943 - DNA, 22 bp, Homo sapiens
attgtatttccagcttgaatgt

SEQ ID NO: 9003944 - DNA, 22 bp, Homo sapiens
attgtatttccagcttgaatgt

SEQ ID NO: 9003945 - DNA, 22 bp, Homo sapiens
attgtatttccagcttgaatgt

SEQ ID NO: 9003946 - DNA, 22 bp, Homo sapiens
attgtatttccagcttgaatgt

SEQ ID NO: 9003947 - DNA, 22 bp, Homo sapiens
attgtatttccagcttgaatgt

SEQ ID NO: 9003948 - DNA, 22 bp, Homo sapiens
attgtatttaggagaaaagggt

SEQ ID NO: 9003949 - DNA, 22 bp, Homo sapiens
attgtattctgcacctttgtta

SEQ ID NO: 9003950 - DNA, 22 bp, Homo sapiens
attgtattctgcacctttgtta

SEQ ID NO: 9003951 - DNA, 22 bp, Homo sapiens
attgtattcagttacaggtctt

SEQ ID NO: 9003952 - DNA, 22 bp, Homo sapiens
attgtattagcacaatacaatt

SEQ ID NO: 9003953 - DNA, 22 bp, Homo sapiens
attgtattagcacaatacaatt

SEQ ID NO: 9003954 - DNA, 22 bp, Homo sapiens
attgtattataattaggccaaa

SEQ ID NO: 9003955 - DNA, 22 bp, Homo sapiens
attgtattagcacaatacaatt

SEQ ID NO: 9003956 - DNA, 22 bp, Homo sapiens
attgtattagcacaatacaatt

SEQ ID NO: 9003957 - DNA, 22 bp, Homo sapiens
attgtattagcacaatacaatt

SEQ ID NO: 9003958 - DNA, 22 bp, Homo sapiens
agataatttgagtaaattaatt

SEQ ID NO: 9003959 - DNA, 22 bp, Homo sapiens
agataatttgagtaaattaatt

SEQ ID NO: 9003960 - DNA, 22 bp, Homo sapiens
agatacaaaaagggagaagatt

SEQ ID NO: 9003961 - DNA, 22 bp, Homo sapiens
agatacaaaaagggagaagatt

SEQ ID NO: 9003962 - DNA, 22 bp, Homo sapiens
agatacaaaaagggagaagatt

SEQ ID NO: 9003963 - DNA, 22 bp, Homo sapiens
agatacaaaaagggagaagatt

SEQ ID NO: 9003964 - DNA, 22 bp, Homo sapiens
agatacaaaagataagatttag

SEQ ID NO: 9003965 - DNA, 22 bp, Homo sapiens
agatacaaaagataagatttag

SEQ ID NO: 9003966 - DNA, 22 bp, Homo sapiens
agatacaaaagataagatttag

SEQ ID NO: 9003967 - DNA, 22 bp, Homo sapiens
agatacaaaagataagatttag

SEQ ID NO: 9003968 - DNA, 22 bp, Homo sapiens
agatacaaaggcctacagagca

SEQ ID NO: 9003969 - DNA, 22 bp, Homo sapiens
agatacaaaggcctacagagca

SEQ ID NO: 9003970 - DNA, 22 bp, Homo sapiens
agatacaactcagaagtgtggt

SEQ ID NO: 9003971 - DNA, 22 bp, Homo sapiens
agatacaaaggcctacagagca

SEQ ID NO: 9003972 - DNA, 22 bp, Homo sapiens
agatacaaaggcctacagagca

SEQ ID NO: 9003973 - DNA, 22 bp, Homo sapiens
agatacaaaggcctacagagca

SEQ ID NO: 9003974 - DNA, 22 bp, Homo sapiens
agatacaactcagaagtgtggt

SEQ ID NO: 9003975 - DNA, 22 bp, Homo sapiens
agatacaactcagaagtgtggt

SEQ ID NO: 9003976 - DNA, 22 bp, Homo sapiens
agatacaactcagaagtgtggt

SEQ ID NO: 9003977 - DNA, 22 bp, Homo sapiens
agatacaactcagaagtgtggt

SEQ ID NO: 9003978 - DNA, 22 bp, Homo sapiens
agatacaactgtttaaacatta

SEQ ID NO: 9003979 - DNA, 22 bp, Homo sapiens
agatacaactgtttaaacatta

SEQ ID NO: 9003980 - DNA, 22 bp, Homo sapiens
attgttaataactattacattg

SEQ ID NO: 9003981 - DNA, 22 bp, Homo sapiens
attgttaataactattacattg

SEQ ID NO: 9003982 - DNA, 22 bp, Homo sapiens
attgttaaagtaataaccatgg

SEQ ID NO: 9003983 - DNA, 22 bp, Homo sapiens
attgttaataactattacattg

SEQ ID NO: 9003984 - DNA, 22 bp, Homo sapiens
agataaattcctaagatttcag

SEQ ID NO: 9003985 - DNA, 22 bp, Homo sapiens
agataattatttacttcaaagt

SEQ ID NO: 9003986 - DNA, 22 bp, Homo sapiens
agataattatttacttcaaagt

SEQ ID NO: 9003987 - DNA, 22 bp, Homo sapiens
agataattatttacttcaaagt

SEQ ID NO: 9003988 - DNA, 22 bp, Homo sapiens
agataattatttacttcaaagt

SEQ ID NO: 9003989 - DNA, 22 bp, Homo sapiens
agataattatttacttcaaagt

SEQ ID NO: 9003990 - DNA, 22 bp, Homo sapiens
agataaattcctaagatttcag

SEQ ID NO: 9003991 - DNA, 22 bp, Homo sapiens
agataaattcctaagatttcag

SEQ ID NO: 9003992 - DNA, 22 bp, Homo sapiens
agataaattcctaagatttcag

SEQ ID NO: 9003993 - DNA, 22 bp, Homo sapiens
agataattatttacttcaaagt

SEQ ID NO: 9003994 - DNA, 22 bp, Homo sapiens
agataattatttacttcaaagt

SEQ ID NO: 9003995 - DNA, 22 bp, Homo sapiens
agataattatgtcaatttcttg

SEQ ID NO: 9003996 - DNA, 22 bp, Homo sapiens
agatacacagaggtaaagatga

SEQ ID NO: 9003997 - DNA, 22 bp, Homo sapiens
agatacacagaggtaaagatga

SEQ ID NO: 9003998 - DNA, 22 bp, Homo sapiens
agatacacagccctgccatcac

SEQ ID NO: 9003999 - DNA, 22 bp, Homo sapiens
agatacaccggaacctgaggct

SEQ ID NO: 9004000 - DNA, 22 bp, Homo sapiens
agatacacagccctgccatcac

SEQ ID NO: 9004001 - DNA, 22 bp, Homo sapiens
agatacacttgttccttccact

SEQ ID NO: 9004002 - DNA, 22 bp, Homo sapiens
agatacaccggaacctgaggct

SEQ ID NO: 9004003 - DNA, 22 bp, Homo sapiens
atttacagacgtggattagtgc

SEQ ID NO: 9004004 - DNA, 22 bp, Homo sapiens
agatacagcctgccaggttctt

SEQ ID NO: 9004005 - DNA, 23 bp, Homo sapiens
agatacagatctacgtgtcaatg

SEQ ID NO: 9004006 - DNA, 22 bp, Homo sapiens
agatacagcctgccaggttctt

SEQ ID NO: 9004007 - DNA, 22 bp, Homo sapiens
atttacagatgatgctatttga

SEQ ID NO: 9004008 - DNA, 22 bp, Homo sapiens
atttacagacgtggattagtgc

SEQ ID NO: 9004009 - DNA, 22 bp, Homo sapiens
agatacaagttaagagaaagga

SEQ ID NO: 9004010 - DNA, 22 bp, Homo sapiens
agatacaaggcagagatgtgca

SEQ ID NO: 9004011 - DNA, 22 bp, Homo sapiens
agatacaaggcagagatgtgca

SEQ ID NO: 9004012 - DNA, 22 bp, Homo sapiens
agatacaaggcagagatgtgca

SEQ ID NO: 9004013 - DNA, 22 bp, Homo sapiens
agatacaaggcagagatgtgca

SEQ ID NO: 9004014 - DNA, 22 bp, Homo sapiens
agatacaagttaagagaaagga

SEQ ID NO: 9004015 - DNA, 22 bp, Homo sapiens
agatacaagttaagagaaagga

SEQ ID NO: 9004016 - DNA, 22 bp, Homo sapiens
agatacacagagcatcttcaga

SEQ ID NO: 9004017 - DNA, 22 bp, Homo sapiens
agatacaagttaagagaaagga

SEQ ID NO: 9004018 - DNA, 22 bp, Homo sapiens
agatacaagttaagagaaagga

SEQ ID NO: 9004019 - DNA, 22 bp, Homo sapiens
agatacaactgtttaaacatta

SEQ ID NO: 9004020 - DNA, 22 bp, Homo sapiens
agatacaactgtttaaacatta

SEQ ID NO: 9004021 - DNA, 22 bp, Homo sapiens
agatacaactgtttaaacatta

SEQ ID NO: 9004022 - DNA, 22 bp, Homo sapiens
agatacaactgtttaaacatta

SEQ ID NO: 9004023 - DNA, 22 bp, Homo sapiens
agatacaagaggcctgacgtgt

SEQ ID NO: 9004024 - DNA, 22 bp, Homo sapiens
atgcttcagtgctaccttcaaa

SEQ ID NO: 9004025 - DNA, 22 bp, Homo sapiens
atgcttccctcacatatcctgg

SEQ ID NO: 9004026 - DNA, 22 bp, Homo sapiens
atgcttccctttgctccacatg

SEQ ID NO: 9004027 - DNA, 22 bp, Homo sapiens
atgcttcctaaccatggccgtg

SEQ ID NO: 9004028 - DNA, 22 bp, Homo sapiens
atgcttccctttgctccacatg

SEQ ID NO: 9004029 - DNA, 18 bp, Homo sapiens
atgcttctgatagaagca

SEQ ID NO: 9004030 - DNA, 22 bp, Homo sapiens
atgcttctgaagaagaaaagac

SEQ ID NO: 9004031 - DNA, 22 bp, Homo sapiens
atgcttctggtataagaaaaat

SEQ ID NO: 9004032 - DNA, 22 bp, Homo sapiens
atgcttctgctcatatttcatt

SEQ ID NO: 9004033 - DNA, 22 bp, Homo sapiens
atgcttctgctcatatttcatt

SEQ ID NO: 9004034 - DNA, 18 bp, Homo sapiens
atgcttctgatagaagca

SEQ ID NO: 9004035 - DNA, 22 bp, Homo sapiens
atgcttctcctgaacatccctg

SEQ ID NO: 9004036 - DNA, 22 bp, Homo sapiens
atgcttcctcccttccactcaa

SEQ ID NO: 9004037 - DNA, 22 bp, Homo sapiens
atgcttcctcccttccactcaa

SEQ ID NO: 9004038 - DNA, 22 bp, Homo sapiens
atgcttcctcccttccactcaa

SEQ ID NO: 9004039 - DNA, 22 bp, Homo sapiens
atgcttcctctacggcctctga

SEQ ID NO: 9004040 - DNA, 22 bp, Homo sapiens
atgcttccttaccagaagatga

SEQ ID NO: 9004041 - DNA, 22 bp, Homo sapiens
agagaacaaattaaaggtggtt

SEQ ID NO: 9004042 - DNA, 22 bp, Homo sapiens
agagaaaagccatcccagccaa

SEQ ID NO: 9004043 - DNA, 22 bp, Homo sapiens
agagaaaagccatcccagccaa

SEQ ID NO: 9004044 - DNA, 22 bp, Homo sapiens
agagaaacaggtcagctgggag

SEQ ID NO: 9004045 - DNA, 22 bp, Homo sapiens
atgcttctggtataagaaaaat

SEQ ID NO: 9004046 - DNA, 22 bp, Homo sapiens
atgcttcttgagatagaaacac

SEQ ID NO: 9004047 - DNA, 22 bp, Homo sapiens
atgcttctgttgcttaggaggt

SEQ ID NO: 9004048 - DNA, 22 bp, Homo sapiens
atgcttcttgagatagaaacac

SEQ ID NO: 9004049 - DNA, 22 bp, Homo sapiens
agagaacaaattaaaggtggtt

SEQ ID NO: 9004050 - DNA, 22 bp, Homo sapiens
agagaacacgtgcatctgcaat

SEQ ID NO: 9004051 - DNA, 22 bp, Homo sapiens
agagaacagcattgcagctttg

SEQ ID NO: 9004052 - DNA, 22 bp, Homo sapiens
agagaacagacagatgcaatga

SEQ ID NO: 9004053 - DNA, 22 bp, Homo sapiens
agagaacagacagatgcaatga

SEQ ID NO: 9004054 - DNA, 22 bp, Homo sapiens
atgctgaaatttattggtaagg

SEQ ID NO: 9004055 - DNA, 22 bp, Homo sapiens
atgctgaaatttattggtaagg

SEQ ID NO: 9004056 - DNA, 22 bp, Homo sapiens
atgctgaaatttattggtaagg

SEQ ID NO: 9004057 - DNA, 22 bp, Homo sapiens
atgctgaaaattggatttgaat

SEQ ID NO: 9004058 - DNA, 22 bp, Homo sapiens
atgctgaagaatcacagggact

SEQ ID NO: 9004059 - DNA, 22 bp, Homo sapiens
atgctgaagagagaactactca

SEQ ID NO: 9004060 - DNA, 22 bp, Homo sapiens
atgctgaagaatcacagggact

SEQ ID NO: 9004061 - DNA, 22 bp, Homo sapiens
atgctgaagagagaactactca

SEQ ID NO: 9004062 - DNA, 22 bp, Homo sapiens
atgctgaactgagatgtaactt

SEQ ID NO: 9004063 - DNA, 22 bp, Homo sapiens
atgctgaaccttaacttggagc

SEQ ID NO: 9004064 - DNA, 22 bp, Homo sapiens
atgctgaactgagatgtaactt

SEQ ID NO: 9004065 - DNA, 22 bp, Homo sapiens
agacatatattgcaattcactg

SEQ ID NO: 9004066 - DNA, 22 bp, Homo sapiens
atgcgtgcaggggtcctcctgg

SEQ ID NO: 9004067 - DNA, 22 bp, Homo sapiens
atgcgtgtgtgcaaaccattgc

SEQ ID NO: 9004068 - DNA, 22 bp, Homo sapiens
atgcgtgtaggaacagtgtcta

SEQ ID NO: 9004069 - DNA, 22 bp, Homo sapiens
atgcgtgtttgtatacacacaa

SEQ ID NO: 9004070 - DNA, 22 bp, Homo sapiens
atgctgaagagttcatgattat

SEQ ID NO: 9004071 - DNA, 22 bp, Homo sapiens
atgctgaagagtgcacaggcta

SEQ ID NO: 9004072 - DNA, 22 bp, Homo sapiens
atgctgaagagtgcacaggcta

SEQ ID NO: 9004073 - DNA, 22 bp, Homo sapiens
atgctgaagagagaactactca

SEQ ID NO: 9004074 - DNA, 22 bp, Homo sapiens
atgctgaagagtgcacaggcta

SEQ ID NO: 9004075 - DNA, 22 bp, Homo sapiens
atgctgaaggccatcctgcatc

SEQ ID NO: 9004076 - DNA, 22 bp, Homo sapiens
atgctgaaggtgaattgacaat

SEQ ID NO: 9004077 - DNA, 22 bp, Homo sapiens
atgctgaagagttcatgattat

SEQ ID NO: 9004078 - DNA, 22 bp, Homo sapiens
atgctgaaggccatcctgcatc

SEQ ID NO: 9004079 - DNA, 22 bp, Homo sapiens
atgctgaaggtgaattgacaat

SEQ ID NO: 9004080 - DNA, 22 bp, Homo sapiens
atgctgaaggtgaattgacaat

SEQ ID NO: 9004081 - DNA, 22 bp, Homo sapiens
atgctgaatagttcactcttct

SEQ ID NO: 9004082 - DNA, 22 bp, Homo sapiens
atgctgaagtgtgtttgaagta

SEQ ID NO: 9004083 - DNA, 21 bp, Homo sapiens
atgctgaatcttgttgtgctc

SEQ ID NO: 9004084 - DNA, 21 bp, Homo sapiens
atgctgaatcttgttgtgctc

SEQ ID NO: 9004085 - DNA, 22 bp, Homo sapiens
atgctgaatgaaagaaattagt

SEQ ID NO: 9004086 - DNA, 22 bp, Homo sapiens
atgctgaatattagcctcatga

SEQ ID NO: 9004087 - DNA, 22 bp, Homo sapiens
atgctgaatattagcctcatga

SEQ ID NO: 9004088 - DNA, 22 bp, Homo sapiens
atgctgaatagttcactcttct

SEQ ID NO: 9004089 - DNA, 22 bp, Homo sapiens
atgctgaccaagcaggacatgg

SEQ ID NO: 9004090 - DNA, 22 bp, Homo sapiens
atgctgaattgatgcgagggag

SEQ ID NO: 9004091 - DNA, 22 bp, Homo sapiens
atgctgaatgaaagaaattagt

SEQ ID NO: 9004092 - DNA, 22 bp, Homo sapiens
atgctgaattgatgcgagggag

SEQ ID NO: 9004093 - DNA, 22 bp, Homo sapiens
atgctgataactttcagtgaca

SEQ ID NO: 9004094 - DNA, 22 bp, Homo sapiens
atgctgaggtgtgtttaattta

SEQ ID NO: 9004095 - DNA, 22 bp, Homo sapiens
atgctgaggttgttgtcctatt

SEQ ID NO: 9004096 - DNA, 22 bp, Homo sapiens
atgctgaggacaaagagatcaa

SEQ ID NO: 9004097 - DNA, 22 bp, Homo sapiens
atgctgagcagagctgacatgc

SEQ ID NO: 9004098 - DNA, 22 bp, Homo sapiens
atgctgagactggagcagctgg

SEQ ID NO: 9004099 - DNA, 22 bp, Homo sapiens
atgctgagactggagcagctgg

SEQ ID NO: 9004100 - DNA, 22 bp, Homo sapiens
atgctgagaaacctgtctggca

SEQ ID NO: 9004101 - DNA, 22 bp, Homo sapiens
atgctgattttatagaataaag

SEQ ID NO: 9004102 - DNA, 22 bp, Homo sapiens
atgctgattcctgggctccacc

SEQ ID NO: 9004103 - DNA, 22 bp, Homo sapiens
atgctgatgtcagccccatctc

SEQ ID NO: 9004104 - DNA, 22 bp, Homo sapiens
atgctgatgctgcttttgccct

SEQ ID NO: 9004105 - DNA, 22 bp, Homo sapiens
atgctgatgaggtcaggaagac

SEQ ID NO: 9004106 - DNA, 22 bp, Homo sapiens
atgctgatgctgttaaccctaa

SEQ ID NO: 9004107 - DNA, 22 bp, Homo sapiens
atgctgatgaggtcaggaagac

SEQ ID NO: 9004108 - DNA, 22 bp, Homo sapiens
atgctgataggagttaatggtg

SEQ ID NO: 9004109 - DNA, 22 bp, Homo sapiens
atgctgatctgtaataagattt

SEQ ID NO: 9004110 - DNA, 18 bp, Homo sapiens
atgctgccctctgagggt

SEQ ID NO: 9004111 - DNA, 18 bp, Homo sapiens
atgctgccctctgagggt

SEQ ID NO: 9004112 - DNA, 22 bp, Homo sapiens
atgcttaggttaaatttgtaat

SEQ ID NO: 9004113 - DNA, 22 bp, Homo sapiens
atgcttaatgagggtatatatg

SEQ ID NO: 9004114 - DNA, 22 bp, Homo sapiens
atgcttaatgagggtatatatg

SEQ ID NO: 9004115 - DNA, 22 bp, Homo sapiens
atgcttaatgagggtatatatg

SEQ ID NO: 9004116 - DNA, 22 bp, Homo sapiens
agacagtgctatcccatctgtg

SEQ ID NO: 9004117 - DNA, 19 bp, Homo sapiens
agacagtggctaggactta

SEQ ID NO: 9004118 - DNA, 23 bp, Homo sapiens
agacagtggccgagaggtactag

SEQ ID NO: 9004119 - DNA, 22 bp, Homo sapiens
agacagtgctatcccatctgtg

SEQ ID NO: 9004120 - DNA, 22 bp, Homo sapiens
agacagtgctatcccatctgtg

SEQ ID NO: 9004121 - DNA, 22 bp, Homo sapiens
agacagtgctatcccatctgtg

SEQ ID NO: 9004122 - DNA, 22 bp, Homo sapiens
atgccattgctttaaaattaag

SEQ ID NO: 9004123 - DNA, 22 bp, Homo sapiens
atgccattgtatattcattgat

SEQ ID NO: 9004124 - DNA, 22 bp, Homo sapiens
atgccagggtcatcccctgggt

SEQ ID NO: 9004125 - DNA, 22 bp, Homo sapiens
atgccaggctgtttggcctcag

SEQ ID NO: 9004126 - DNA, 22 bp, Homo sapiens
atgccagggtcatcccctgggt

SEQ ID NO: 9004127 - DNA, 22 bp, Homo sapiens
atgccagtaagtctcagctagg

SEQ ID NO: 9004128 - DNA, 22 bp, Homo sapiens
atgccaggtacaggggtagggt

SEQ ID NO: 9004129 - DNA, 22 bp, Homo sapiens
atgccaggtacaggggtagggt

SEQ ID NO: 9004130 - DNA, 22 bp, Homo sapiens
atgccaggtacaggggtagggt

SEQ ID NO: 9004131 - DNA, 22 bp, Homo sapiens
atgccaggtacaggggtagggt

SEQ ID NO: 9004132 - DNA, 22 bp, Homo sapiens
atgccagtgttataaatagata

SEQ ID NO: 9004133 - DNA, 22 bp, Homo sapiens
agacagtgtgtgtatatatggt

SEQ ID NO: 9004134 - DNA, 22 bp, Homo sapiens
agacagttgatatactataaaa

SEQ ID NO: 9004135 - DNA, 22 bp, Homo sapiens
agacagttgatatactataaaa

SEQ ID NO: 9004136 - DNA, 22 bp, Homo sapiens
agacagttgatatactataaaa

SEQ ID NO: 9004137 - DNA, 19 bp, Homo sapiens
agacataaagagtttgcaa

SEQ ID NO: 9004138 - DNA, 22 bp, Homo sapiens
agacataaacttactgaaatac

SEQ ID NO: 9004139 - DNA, 22 bp, Homo sapiens
agacataaacttactgaaatac

SEQ ID NO: 9004140 - DNA, 22 bp, Homo sapiens
agacagtgtggttggtggttcc

SEQ ID NO: 9004141 - DNA, 22 bp, Homo sapiens
agacagtgtgagttcagggtgg

SEQ ID NO: 9004142 - DNA, 20 bp, Homo sapiens
agacagtggggagctcctag

SEQ ID NO: 9004143 - DNA, 22 bp, Homo sapiens
agacagtgtaatgtaattgtta

SEQ ID NO: 9004144 - DNA, 22 bp, Homo sapiens
agacataagtgctatgacattg

SEQ ID NO: 9004145 - DNA, 22 bp, Homo sapiens
agacataagtgctatgacattg

SEQ ID NO: 9004146 - DNA, 22 bp, Homo sapiens
agacataagtgctatgacattg

SEQ ID NO: 9004147 - DNA, 22 bp, Homo sapiens
agacataagccagtcactcact

SEQ ID NO: 9004148 - DNA, 19 bp, Homo sapiens
agacataaagagtttgcaa

SEQ ID NO: 9004149 - DNA, 22 bp, Homo sapiens
agacataagcgagcatcacagg

SEQ ID NO: 9004150 - DNA, 22 bp, Homo sapiens
agacataagtgctatgacattg

SEQ ID NO: 9004151 - DNA, 22 bp, Homo sapiens
agacatagataggcactgattg

SEQ ID NO: 9004152 - DNA, 22 bp, Homo sapiens
agacatagactttctactgtgt

SEQ ID NO: 9004153 - DNA, 22 bp, Homo sapiens
agacataattaattagttctac

SEQ ID NO: 9004154 - DNA, 22 bp, Homo sapiens
atgcaacagctgggaatatgta

SEQ ID NO: 9004155 - DNA, 22 bp, Homo sapiens
atgcaacagtcagtacatccgg

SEQ ID NO: 9004156 - DNA, 22 bp, Homo sapiens
atgcaacacccctatggatgga

SEQ ID NO: 9004157 - DNA, 22 bp, Homo sapiens
atgcaacaaatgctacgaatcg

SEQ ID NO: 9004158 - DNA, 19 bp, Homo sapiens
atgcaacaaaagtgtaaga

SEQ ID NO: 9004159 - DNA, 19 bp, Homo sapiens
atgcaacaaaagtgtaaga

SEQ ID NO: 9004160 - DNA, 22 bp, Homo sapiens
atgcaaattgccataaagtggg

SEQ ID NO: 9004161 - DNA, 22 bp, Homo sapiens
atgcaaattgccataaagtggg

SEQ ID NO: 9004162 - DNA, 22 bp, Homo sapiens
atgcaaattgccataaagtggg

SEQ ID NO: 9004163 - DNA, 22 bp, Homo sapiens
atgcaaattgccataaagtggg

SEQ ID NO: 9004164 - DNA, 22 bp, Homo sapiens
atgcaaattctttgcttcttct

SEQ ID NO: 9004165 - DNA, 22 bp, Homo sapiens
atgcaaattctttgcttcttct

SEQ ID NO: 9004166 - DNA, 22 bp, Homo sapiens
atgcaaattcttaggctccatc

SEQ ID NO: 9004167 - DNA, 22 bp, Homo sapiens
atgcaaattctttgcttcttct

SEQ ID NO: 9004168 - DNA, 22 bp, Homo sapiens
atgcaaattctttgcttcttct

SEQ ID NO: 9004169 - DNA, 22 bp, Homo sapiens
atgccactgcactccagcctag

SEQ ID NO: 9004170 - DNA, 22 bp, Homo sapiens
atgccactgacatggacaattt

SEQ ID NO: 9004171 - DNA, 22 bp, Homo sapiens
atgccacttcattccagcctcg

SEQ ID NO: 9004172 - DNA, 22 bp, Homo sapiens
atgccacttcattccagcctcg

SEQ ID NO: 9004173 - DNA, 22 bp, Homo sapiens
atgccactgcactccagcctag

SEQ ID NO: 9004174 - DNA, 22 bp, Homo sapiens
atgccacttcattccagcctcg

SEQ ID NO: 9004175 - DNA, 22 bp, Homo sapiens
atgccactgcactccagcctag

SEQ ID NO: 9004176 - DNA, 22 bp, Homo sapiens
atgccacttctctaagtcatgt

SEQ ID NO: 9004177 - DNA, 22 bp, Homo sapiens
atgccagaaggcagaatttatc

SEQ ID NO: 9004178 - DNA, 22 bp, Homo sapiens
atgccagaaaatgatggctgca

SEQ ID NO: 9004179 - DNA, 22 bp, Homo sapiens
atgccaggagatggagcagagt

SEQ ID NO: 9004180 - DNA, 22 bp, Homo sapiens
atgccaggaacaaacagtggtg

SEQ ID NO: 9004181 - DNA, 22 bp, Homo sapiens
atgccaggaacaaacagtggtg

SEQ ID NO: 9004182 - DNA, 22 bp, Homo sapiens
atgccaggaacaaacagtggtg

SEQ ID NO: 9004183 - DNA, 22 bp, Homo sapiens
atgccagcctctaagcacttta

SEQ ID NO: 9004184 - DNA, 22 bp, Homo sapiens
atgccagacattaacgactatg

SEQ ID NO: 9004185 - DNA, 22 bp, Homo sapiens
atgccaggagatggagcagagt

SEQ ID NO: 9004186 - DNA, 22 bp, Homo sapiens
atgccaggccccacgctgggca

SEQ ID NO: 9004187 - DNA, 22 bp, Homo sapiens
atgccaggctgtttggcctcag

SEQ ID NO: 9004188 - DNA, 23 bp, Homo sapiens
atgccaggctgcctggccagcct

SEQ ID NO: 9004189 - DNA, 22 bp, Homo sapiens
atctggcttacgaagcactggt

SEQ ID NO: 9004190 - DNA, 22 bp, Homo sapiens
atctggcttacgaagcactggt

SEQ ID NO: 9004191 - DNA, 22 bp, Homo sapiens
atctggctttcttaatgactta

SEQ ID NO: 9004192 - DNA, 22 bp, Homo sapiens
atctggctgactttgtgggaca

SEQ ID NO: 9004193 - DNA, 22 bp, Homo sapiens
atctggaaaacacagtgtagac

SEQ ID NO: 9004194 - DNA, 22 bp, Homo sapiens
agaagctgcctacatgaccagc

SEQ ID NO: 9004195 - DNA, 22 bp, Homo sapiens
atctggctcttcctggagttcc

SEQ ID NO: 9004196 - DNA, 17 bp, Homo sapiens
atctggctgcttctaga

SEQ ID NO: 9004197 - DNA, 22 bp, Homo sapiens
atctgggagtcttggctctgct

SEQ ID NO: 9004198 - DNA, 22 bp, Homo sapiens
atctgggtaaagtggtatattt

SEQ ID NO: 9004199 - DNA, 22 bp, Homo sapiens
atctgggggagctgctcatgga

SEQ ID NO: 9004200 - DNA, 22 bp, Homo sapiens
atctgggggagctgctcatgga

SEQ ID NO: 9004201 - DNA, 22 bp, Homo sapiens
atctggggcctgggctagccat

SEQ ID NO: 9004202 - DNA, 22 bp, Homo sapiens
atctgttcttgtgtcagtaatt

SEQ ID NO: 9004203 - DNA, 22 bp, Homo sapiens
atctgggtgtggaatatatagg

SEQ ID NO: 9004204 - DNA, 22 bp, Homo sapiens
atctgggtgtggaatatatagg

SEQ ID NO: 9004205 - DNA, 22 bp, Homo sapiens
atctgggtgaagtttaaaaatc

SEQ ID NO: 9004206 - DNA, 22 bp, Homo sapiens
atctgttgttttctcatatgtt

SEQ ID NO: 9004207 - DNA, 22 bp, Homo sapiens
atctgttgtttttcaccaccca

SEQ ID NO: 9004208 - DNA, 21 bp, Homo sapiens
atcttaaaaggtcttaacttt

SEQ ID NO: 9004209 - DNA, 21 bp, Homo sapiens
atcttaaaaggtcttaacttt

SEQ ID NO: 9004210 - DNA, 22 bp, Homo sapiens
atcttaaacagaggaatgactt

SEQ ID NO: 9004211 - DNA, 21 bp, Homo sapiens
atcttaaaaggtcttaacttt

SEQ ID NO: 9004212 - DNA, 21 bp, Homo sapiens
atcttaaaaggtcttaacttt

SEQ ID NO: 9004213 - DNA, 22 bp, Homo sapiens
atgacccaagctcatggctccc

SEQ ID NO: 9004214 - DNA, 22 bp, Homo sapiens
atgaccagtgttgctggccccg

SEQ ID NO: 9004215 - DNA, 22 bp, Homo sapiens
atgaccagccgagataaacaga

SEQ ID NO: 9004216 - DNA, 22 bp, Homo sapiens
atgaccagccgagataaacaga

SEQ ID NO: 9004217 - DNA, 22 bp, Homo sapiens
atgaccagccgagataaacaga

SEQ ID NO: 9004218 - DNA, 22 bp, Homo sapiens
atgaccagactctcagtggggt

SEQ ID NO: 9004219 - DNA, 22 bp, Homo sapiens
atgaccacattccagctgtcca

SEQ ID NO: 9004220 - DNA, 22 bp, Homo sapiens
atgacatttatacagtgagctt

SEQ ID NO: 9004221 - DNA, 22 bp, Homo sapiens
atgacatttatacagtgagctt

SEQ ID NO: 9004222 - DNA, 22 bp, Homo sapiens
atgacatttatacagtgagctt

SEQ ID NO: 9004223 - DNA, 22 bp, Homo sapiens
atgacattgacagacctgctgc

SEQ ID NO: 9004224 - DNA, 22 bp, Homo sapiens
atgacattgacagacctgctgc

SEQ ID NO: 9004225 - DNA, 22 bp, Homo sapiens
atgacaatatagctttgatttt

SEQ ID NO: 9004226 - DNA, 22 bp, Homo sapiens
atgactaatggaaaatacaatg

SEQ ID NO: 9004227 - DNA, 22 bp, Homo sapiens
atgactaatggaaaatacaatg

SEQ ID NO: 9004228 - DNA, 22 bp, Homo sapiens
atgactcagaagatattttcca

SEQ ID NO: 9004229 - DNA, 22 bp, Homo sapiens
atgacccttactgcatcataca

SEQ ID NO: 9004230 - DNA, 22 bp, Homo sapiens
atgacccccaagggcagcgtga

SEQ ID NO: 9004231 - DNA, 22 bp, Homo sapiens
atgacctgaggccttactctag

SEQ ID NO: 9004232 - DNA, 21 bp, Homo sapiens
atgacctgggaagatgctcaa

SEQ ID NO: 9004233 - DNA, 22 bp, Homo sapiens
atgactgctctgggctcccatg

SEQ ID NO: 9004234 - DNA, 22 bp, Homo sapiens
atgactctgctgaggcacccgg

SEQ ID NO: 9004235 - DNA, 19 bp, Homo sapiens
atgactcttattgtctgaa

SEQ ID NO: 9004236 - DNA, 19 bp, Homo sapiens
atgactcttattgtctgaa

SEQ ID NO: 9004237 - DNA, 22 bp, Homo sapiens
atgacttattacaagtcatatt

SEQ ID NO: 9004238 - DNA, 22 bp, Homo sapiens
atcttacagcagcaaggaagta

SEQ ID NO: 9004239 - DNA, 19 bp, Homo sapiens
atcttacagagcagagtac

SEQ ID NO: 9004240 - DNA, 19 bp, Homo sapiens
atcttacagagcagagtac

SEQ ID NO: 9004241 - DNA, 22 bp, Homo sapiens
atcttacactgttgggtttctc

SEQ ID NO: 9004242 - DNA, 22 bp, Homo sapiens
atcttacactgttgggtttctc

SEQ ID NO: 9004243 - DNA, 22 bp, Homo sapiens
atcttacacgataactgttagt

SEQ ID NO: 9004244 - DNA, 22 bp, Homo sapiens
atcttacacgataactgttagt

SEQ ID NO: 9004245 - DNA, 22 bp, Homo sapiens
atcttacacgataactgttagt

SEQ ID NO: 9004246 - DNA, 22 bp, Homo sapiens
atcttaaacagaggaatgactt

SEQ ID NO: 9004247 - DNA, 18 bp, Homo sapiens
atcttaacttgatggagt

SEQ ID NO: 9004248 - DNA, 22 bp, Homo sapiens
atcttaaacagaggaatgactt

SEQ ID NO: 9004249 - DNA, 22 bp, Homo sapiens
atcttacaattacaagacactc

SEQ ID NO: 9004250 - DNA, 22 bp, Homo sapiens
atcttacaattacaagacactc

SEQ ID NO: 9004251 - DNA, 22 bp, Homo sapiens
atcttagacccttggtagaaaa

SEQ ID NO: 9004252 - DNA, 22 bp, Homo sapiens
atcttagacccttggtagaaaa

SEQ ID NO: 9004253 - DNA, 22 bp, Homo sapiens
atcttagaagtttgataaaatc

SEQ ID NO: 9004254 - DNA, 22 bp, Homo sapiens
atcttagaagtttgataaaatc

SEQ ID NO: 9004255 - DNA, 23 bp, Homo sapiens
atcttacatatttagcacctgaa

SEQ ID NO: 9004256 - DNA, 23 bp, Homo sapiens
atcttacatatttagcacctgaa

SEQ ID NO: 9004257 - DNA, 22 bp, Homo sapiens
atcttacattccctcaccattt

SEQ ID NO: 9004258 - DNA, 23 bp, Homo sapiens
atcttacatatttagcacctgaa

SEQ ID NO: 9004259 - DNA, 22 bp, Homo sapiens
atcttagagagtcgtgttttgt

SEQ ID NO: 9004260 - DNA, 22 bp, Homo sapiens
atgacaagggttgacacatgtc

SEQ ID NO: 9004261 - DNA, 22 bp, Homo sapiens
atgacaatacttcaataagctg

SEQ ID NO: 9004262 - DNA, 22 bp, Homo sapiens
atgacaatacttcaataagctg

SEQ ID NO: 9004263 - DNA, 22 bp, Homo sapiens
atgacaatacttcaataagctg

SEQ ID NO: 9004264 - DNA, 22 bp, Homo sapiens
atgacaatatagctttgatttt

SEQ ID NO: 9004265 - DNA, 22 bp, Homo sapiens
atgacaatatagctttgatttt

SEQ ID NO: 9004266 - DNA, 22 bp, Homo sapiens
atgaggaggccagtaagagcct

SEQ ID NO: 9004267 - DNA, 22 bp, Homo sapiens
atgaggagccctcatttaggtt

SEQ ID NO: 9004268 - DNA, 22 bp, Homo sapiens
atgaggagctccttgaaatgag

SEQ ID NO: 9004269 - DNA, 22 bp, Homo sapiens
atgaggagctccttgaaatgag

SEQ ID NO: 9004270 - DNA, 22 bp, Homo sapiens
atgagaaagagttgtatctaga

SEQ ID NO: 9004271 - DNA, 22 bp, Homo sapiens
atgactttcctggcaaaagttg

SEQ ID NO: 9004272 - DNA, 22 bp, Homo sapiens
atgacttttaggagcagtgctc

SEQ ID NO: 9004273 - DNA, 22 bp, Homo sapiens
atgagaaaattcattccatcca

SEQ ID NO: 9004274 - DNA, 22 bp, Homo sapiens
atgagaaaattcattccatcca

SEQ ID NO: 9004275 - DNA, 22 bp, Homo sapiens
atgagaaaattgaggcccatag

SEQ ID NO: 9004276 - DNA, 22 bp, Homo sapiens
atgagaaaattgaggcccatag

SEQ ID NO: 9004277 - DNA, 22 bp, Homo sapiens
atgacttcacctctgtgaagca

SEQ ID NO: 9004278 - DNA, 22 bp, Homo sapiens
atgacttattacaagtcatatt

SEQ ID NO: 9004279 - DNA, 22 bp, Homo sapiens
atgacttattacaagtcatatt

SEQ ID NO: 9004280 - DNA, 22 bp, Homo sapiens
atgacttcgttttctctctgca

SEQ ID NO: 9004281 - DNA, 22 bp, Homo sapiens
atgaggcaatagaatattgaat

SEQ ID NO: 9004282 - DNA, 22 bp, Homo sapiens
atgaggcaatcatggtccagtt

SEQ ID NO: 9004283 - DNA, 22 bp, Homo sapiens
atgaggcaatcatggtccagtt

SEQ ID NO: 9004284 - DNA, 22 bp, Homo sapiens
atgaggcacatcacagccaatg

SEQ ID NO: 9004285 - DNA, 22 bp, Homo sapiens
atgatatagagagtagattaaa

SEQ ID NO: 9004286 - DNA, 22 bp, Homo sapiens
atgatatagagagtagattaaa

SEQ ID NO: 9004287 - DNA, 22 bp, Homo sapiens
atgatatatgtgttgagcttgc

SEQ ID NO: 9004288 - DNA, 22 bp, Homo sapiens
atgaggcaaaggtggaggtggg

SEQ ID NO: 9004289 - DNA, 22 bp, Homo sapiens
atgaggcaaaggtggaggtggg

SEQ ID NO: 9004290 - DNA, 22 bp, Homo sapiens
atgcaaatggcaatgagtgacc

SEQ ID NO: 9004291 - DNA, 22 bp, Homo sapiens
atgcaaatgctagagaatgttg

SEQ ID NO: 9004292 - DNA, 22 bp, Homo sapiens
atgattttctgataaagaactg

SEQ ID NO: 9004293 - DNA, 22 bp, Homo sapiens
atgcaaatgctagagaatgttg

SEQ ID NO: 9004294 - DNA, 22 bp, Homo sapiens
atgcaaatgtcaccacttctaa

SEQ ID NO: 9004295 - DNA, 22 bp, Homo sapiens
atgcaaatgtcaccacttctaa

SEQ ID NO: 9004296 - DNA, 22 bp, Homo sapiens
atgcaaatgtttaagttactat

SEQ ID NO: 9004297 - DNA, 22 bp, Homo sapiens
atgcaaatgtttaagttactat

SEQ ID NO: 9004298 - DNA, 22 bp, Homo sapiens
atgcaaatgtttaagttactat

SEQ ID NO: 9004299 - DNA, 22 bp, Homo sapiens
atgcaaattaacatatagtaga

SEQ ID NO: 9004300 - DNA, 22 bp, Homo sapiens
atgcaaattaacatatagtaga

SEQ ID NO: 9004301 - DNA, 22 bp, Homo sapiens
atgcaaattaacatatagtaga

SEQ ID NO: 9004302 - DNA, 22 bp, Homo sapiens
atgcaaattcttaggctccatc

SEQ ID NO: 9004303 - DNA, 22 bp, Homo sapiens
atgcaaattaacatatagtaga

SEQ ID NO: 9004304 - DNA, 22 bp, Homo sapiens
atgcaaattaacatatagtaga

SEQ ID NO: 9004305 - DNA, 22 bp, Homo sapiens
atgattttctgataaagaactg

SEQ ID NO: 9004306 - DNA, 22 bp, Homo sapiens
atgattttctgataaagaactg

SEQ ID NO: 9004307 - DNA, 22 bp, Homo sapiens
atgattttctgataaagaactg

SEQ ID NO: 9004308 - DNA, 22 bp, Homo sapiens
atgatttaaagtcattgtgaac

SEQ ID NO: 9004309 - DNA, 22 bp, Homo sapiens
atgatttaaagtcattgtgaac

SEQ ID NO: 9004310 - DNA, 22 bp, Homo sapiens
atgattgtctataaaggaaggg

SEQ ID NO: 9004311 - DNA, 22 bp, Homo sapiens
atgattgaccatctgctgggct

SEQ ID NO: 9004312 - DNA, 22 bp, Homo sapiens
atgattgagaaaacttgcaatt

SEQ ID NO: 9004313 - DNA, 22 bp, Homo sapiens
atgatttaaagtcattgtgaac

SEQ ID NO: 9004314 - DNA, 22 bp, Homo sapiens
atgatttaaagtcattgtgaac

SEQ ID NO: 9004315 - DNA, 22 bp, Homo sapiens
atgatttaaagtcattgtgaac

SEQ ID NO: 9004316 - DNA, 19 bp, Homo sapiens
atgattgtctatggaggaa

SEQ ID NO: 9004317 - DNA, 20 bp, Homo sapiens
atgattctgggctacactgg

SEQ ID NO: 9004318 - DNA, 22 bp, Homo sapiens
atgattgaccatctgctgggct

SEQ ID NO: 9004319 - DNA, 22 bp, Homo sapiens
atgattgaccatctgctgggct

SEQ ID NO: 9004320 - DNA, 22 bp, Homo sapiens
atgattgaaaatgacattgcca

SEQ ID NO: 9004321 - DNA, 22 bp, Homo sapiens
atgattgaaaatgacattgcca

SEQ ID NO: 9004322 - DNA, 22 bp, Homo sapiens
atgattgaaaatgacattgcca

SEQ ID NO: 9004323 - DNA, 22 bp, Homo sapiens
atgattcagcccaatttttcta

SEQ ID NO: 9004324 - DNA, 22 bp, Homo sapiens
atgattcagggagttttcagga

SEQ ID NO: 9004325 - DNA, 22 bp, Homo sapiens
atgattccttgaagcctcatga

SEQ ID NO: 9004326 - DNA, 19 bp, Homo sapiens
atgattcccagggaggggg

SEQ ID NO: 9004327 - DNA, 17 bp, Homo sapiens
atgattccatcaggatt

SEQ ID NO: 9004328 - DNA, 20 bp, Homo sapiens
atgattcatgatgatgtctc

SEQ ID NO: 9004329 - DNA, 21 bp, Homo sapiens
atgattctgcaaatgagtagt

SEQ ID NO: 9004330 - DNA, 22 bp, Homo sapiens
atgattctcattttataaactt

SEQ ID NO: 9004331 - DNA, 22 bp, Homo sapiens
atgattctcattttataaactt

SEQ ID NO: 9004332 - DNA, 22 bp, Homo sapiens
agagccagcatttgggccctgc

SEQ ID NO: 9004333 - DNA, 22 bp, Homo sapiens
agagccagcatttgggccctgc

SEQ ID NO: 9004334 - DNA, 22 bp, Homo sapiens
agagccagccttctcagcttac

SEQ ID NO: 9004335 - DNA, 22 bp, Homo sapiens
agagccaggaagtggcgtgggg

SEQ ID NO: 9004336 - DNA, 22 bp, Homo sapiens
agagccagccttctcagcttac

SEQ ID NO: 9004337 - DNA, 22 bp, Homo sapiens
agagccaggaagtggcgtgggg

SEQ ID NO: 9004338 - DNA, 22 bp, Homo sapiens
agagccaggaagtggcgtgggg

SEQ ID NO: 9004339 - DNA, 22 bp, Homo sapiens
agagccagcatttgacactggc

SEQ ID NO: 9004340 - DNA, 22 bp, Homo sapiens
agagccagcatttgacactggc

SEQ ID NO: 9004341 - DNA, 22 bp, Homo sapiens
agagccagcatttgacactggc

SEQ ID NO: 9004342 - DNA, 22 bp, Homo sapiens
agagccagcatttgacactggc

SEQ ID NO: 9004343 - DNA, 22 bp, Homo sapiens
agagccagcatttgacactggc

SEQ ID NO: 9004344 - DNA, 22 bp, Homo sapiens
agagccagcatttgacactggc

SEQ ID NO: 9004345 - DNA, 22 bp, Homo sapiens
agagccaggatgtcttctgggg

SEQ ID NO: 9004346 - DNA, 22 bp, Homo sapiens
agagccaggatgtcttctgggg

SEQ ID NO: 9004347 - DNA, 22 bp, Homo sapiens
agagccaggcaggcaatgttga

SEQ ID NO: 9004348 - DNA, 22 bp, Homo sapiens
atgttacagaaactaagaggct

SEQ ID NO: 9004349 - DNA, 22 bp, Homo sapiens
atgttacactgtttcacgttcc

SEQ ID NO: 9004350 - DNA, 22 bp, Homo sapiens
atgttacacataggcataaatg

SEQ ID NO: 9004351 - DNA, 22 bp, Homo sapiens
atgttacagaaagcaaagatga

SEQ ID NO: 9004352 - DNA, 22 bp, Homo sapiens
atgttacagaaagcaaagatga

SEQ ID NO: 9004353 - DNA, 22 bp, Homo sapiens
atgttattttggaaaatacaaa

SEQ ID NO: 9004354 - DNA, 22 bp, Homo sapiens
agagccaggactgtgtctcact

SEQ ID NO: 9004355 - DNA, 22 bp, Homo sapiens
agagccaggaagtggcgtgggg

SEQ ID NO: 9004356 - DNA, 22 bp, Homo sapiens
agagccaggatgtcttctgggg

SEQ ID NO: 9004357 - DNA, 22 bp, Homo sapiens
agagccaggatgtcttctgggg

SEQ ID NO: 9004358 - DNA, 22 bp, Homo sapiens
agagccaggatctgttttgggg

SEQ ID NO: 9004359 - DNA, 22 bp, Homo sapiens
agagccaggactgtgtctcact

SEQ ID NO: 9004360 - DNA, 22 bp, Homo sapiens
agagccaggactgtgtctcact

SEQ ID NO: 9004361 - DNA, 22 bp, Homo sapiens
agagccaggactgtgtctcact

SEQ ID NO: 9004362 - DNA, 22 bp, Homo sapiens
agagccaggactgtgtctcact

SEQ ID NO: 9004363 - DNA, 18 bp, Homo sapiens
agagatggtgtagagttt

SEQ ID NO: 9004364 - DNA, 18 bp, Homo sapiens
agagatggtgtagagttt

SEQ ID NO: 9004365 - DNA, 18 bp, Homo sapiens
agagatggtgtagagttt

SEQ ID NO: 9004366 - DNA, 22 bp, Homo sapiens
agagatggtagaacagtcataa

SEQ ID NO: 9004367 - DNA, 18 bp, Homo sapiens
agagatggtgtagagttt

SEQ ID NO: 9004368 - DNA, 22 bp, Homo sapiens
agagatgtcgccttgcccaggg

SEQ ID NO: 9004369 - DNA, 22 bp, Homo sapiens
agagatgtcgccttgcccaggg

SEQ ID NO: 9004370 - DNA, 22 bp, Homo sapiens
agagatgtagcaaagaaccaca

SEQ ID NO: 9004371 - DNA, 22 bp, Homo sapiens
agagattaatactctataattt

SEQ ID NO: 9004372 - DNA, 22 bp, Homo sapiens
agagattagcctggattatgca

SEQ ID NO: 9004373 - DNA, 22 bp, Homo sapiens
agagatgttcattcagcatgtt

SEQ ID NO: 9004374 - DNA, 22 bp, Homo sapiens
agagatgttcattcagcatgtt

SEQ ID NO: 9004375 - DNA, 22 bp, Homo sapiens
agagattcatgtttactgtagg

SEQ ID NO: 9004376 - DNA, 22 bp, Homo sapiens
atgtcttgatattttactgttt

SEQ ID NO: 9004377 - DNA, 22 bp, Homo sapiens
atgtcttgggtttcagtttact

SEQ ID NO: 9004378 - DNA, 22 bp, Homo sapiens
atgtgagtgctatgatagacag

SEQ ID NO: 9004379 - DNA, 22 bp, Homo sapiens
atgtctttaaacttgagttgtt

SEQ ID NO: 9004380 - DNA, 22 bp, Homo sapiens
atgtgattcccactgaatcact

SEQ ID NO: 9004381 - DNA, 22 bp, Homo sapiens
atgtgcaggatccaggctccta

SEQ ID NO: 9004382 - DNA, 22 bp, Homo sapiens
atgtgcagttggtggccaggag

SEQ ID NO: 9004383 - DNA, 22 bp, Homo sapiens
atgtgcagcttttctagagaag

SEQ ID NO: 9004384 - DNA, 22 bp, Homo sapiens
atgtgcagttggtggccaggag

SEQ ID NO: 9004385 - DNA, 23 bp, Homo sapiens
atgtgcacatctccttgtccacc

SEQ ID NO: 9004386 - DNA, 18 bp, Homo sapiens
atgtgcaattttgtattt

SEQ ID NO: 9004387 - DNA, 21 bp, Homo sapiens
atgtgcagcaagcagcatgct

SEQ ID NO: 9004388 - DNA, 21 bp, Homo sapiens
atgtgcagcaagcagcatgct

SEQ ID NO: 9004389 - DNA, 21 bp, Homo sapiens
atgtgcagcaagcagcatgct

SEQ ID NO: 9004390 - DNA, 22 bp, Homo sapiens
atgtgcagcttttctagagaag

SEQ ID NO: 9004391 - DNA, 18 bp, Homo sapiens
atgtgcaattttgtattt

SEQ ID NO: 9004392 - DNA, 22 bp, Homo sapiens
atgtgcaattattaagaagaga

SEQ ID NO: 9004393 - DNA, 22 bp, Homo sapiens
atgtgcaattattaagaagaga

SEQ ID NO: 9004394 - DNA, 22 bp, Homo sapiens
atgtgcaattattaagaagaga

SEQ ID NO: 9004395 - DNA, 22 bp, Homo sapiens
atgtgcacacagtgtcatgcaa

SEQ ID NO: 9004396 - DNA, 22 bp, Homo sapiens
atgtgcacacagtgtcatgcaa

SEQ ID NO: 9004397 - DNA, 22 bp, Homo sapiens
atgtgcaacttcagcagaaagg

SEQ ID NO: 9004398 - DNA, 22 bp, Homo sapiens
atgtgcaacttttctgtctttt

SEQ ID NO: 9004399 - DNA, 22 bp, Homo sapiens
atgtgcaaggagtggctgttgt

SEQ ID NO: 9004400 - DNA, 23 bp, Homo sapiens
atgtgcaaagtgctacagtatag

SEQ ID NO: 9004401 - DNA, 22 bp, Homo sapiens
atgtgcaaagtaaagtaatttt

SEQ ID NO: 9004402 - DNA, 22 bp, Homo sapiens
atgtgcaaagggacttgcacat

SEQ ID NO: 9004403 - DNA, 22 bp, Homo sapiens
atgtgcaaatccaatgtgaatg

SEQ ID NO: 9004404 - DNA, 23 bp, Homo sapiens
atgtgcaaagtgctacagtatag

SEQ ID NO: 9004405 - DNA, 22 bp, Homo sapiens
atgtgcaacttcagcagaaagg

SEQ ID NO: 9004406 - DNA, 22 bp, Homo sapiens
agagctctgtgtctctttgggt

SEQ ID NO: 9004407 - DNA, 22 bp, Homo sapiens
agagctctgcagctggcctcag

SEQ ID NO: 9004408 - DNA, 22 bp, Homo sapiens
agagctctgcagctggcctcag

SEQ ID NO: 9004409 - DNA, 22 bp, Homo sapiens
agagctctgcagctggcctcag

SEQ ID NO: 9004410 - DNA, 22 bp, Homo sapiens
agagctctcctagaccgcagag

SEQ ID NO: 9004411 - DNA, 22 bp, Homo sapiens
agagctctcaatggtcaatgct

SEQ ID NO: 9004412 - DNA, 22 bp, Homo sapiens
agagctcctgcattcttccctg

SEQ ID NO: 9004413 - DNA, 22 bp, Homo sapiens
attaaatactgcaggctaagca

SEQ ID NO: 9004414 - DNA, 22 bp, Homo sapiens
attaaatactgcaggctaagca

SEQ ID NO: 9004415 - DNA, 22 bp, Homo sapiens
attaaatactgcaggctaagca

SEQ ID NO: 9004416 - DNA, 22 bp, Homo sapiens
attaaatactgcaggctaagca

SEQ ID NO: 9004417 - DNA, 22 bp, Homo sapiens
attaagctggtccagacaagtt

SEQ ID NO: 9004418 - DNA, 22 bp, Homo sapiens
attaaggaagcctattctctcc

SEQ ID NO: 9004419 - DNA, 22 bp, Homo sapiens
agagctccagggttttgtagtg

SEQ ID NO: 9004420 - DNA, 22 bp, Homo sapiens
agagctccagggttttgtagtg

SEQ ID NO: 9004421 - DNA, 22 bp, Homo sapiens
agagctccaagaagtcctgcag

SEQ ID NO: 9004422 - DNA, 22 bp, Homo sapiens
agagctcccgagacaatgtatt

SEQ ID NO: 9004423 - DNA, 22 bp, Homo sapiens
agagctccgtgcctggctgcca

SEQ ID NO: 9004424 - DNA, 22 bp, Homo sapiens
agagctcctaaatgtagccaac

SEQ ID NO: 9004425 - DNA, 22 bp, Homo sapiens
agagctccgtgcctggctgcca

SEQ ID NO: 9004426 - DNA, 22 bp, Homo sapiens
agagctccgtgcctggctgcca

SEQ ID NO: 9004427 - DNA, 22 bp, Homo sapiens
agagctcctcacttcgggttca

SEQ ID NO: 9004428 - DNA, 22 bp, Homo sapiens
agagctctcaatggtcaatgct

SEQ ID NO: 9004429 - DNA, 22 bp, Homo sapiens
agagctcagtgtgttatggtta

SEQ ID NO: 9004430 - DNA, 21 bp, Homo sapiens
agagctcaaggcaaaaataat

SEQ ID NO: 9004431 - DNA, 22 bp, Homo sapiens
agagctcaagacgctcacagta

SEQ ID NO: 9004432 - DNA, 22 bp, Homo sapiens
agagctaggaatgaccactctc

SEQ ID NO: 9004433 - DNA, 22 bp, Homo sapiens
attaaggaagcctattctctcc

SEQ ID NO: 9004434 - DNA, 22 bp, Homo sapiens
attaaggcgttggcgtgcttat

SEQ ID NO: 9004435 - DNA, 22 bp, Homo sapiens
attaaggcacttgagcatgatg

SEQ ID NO: 9004436 - DNA, 18 bp, Homo sapiens
attaaggctttgatagta

SEQ ID NO: 9004437 - DNA, 22 bp, Homo sapiens
attaaggctgcactggccttaa

SEQ ID NO: 9004438 - DNA, 22 bp, Homo sapiens
attaagtgactaaagtaatgct

SEQ ID NO: 9004439 - DNA, 22 bp, Homo sapiens
attaaggtgtcaatgtatttgg

SEQ ID NO: 9004440 - DNA, 22 bp, Homo sapiens
attaagtgactaaagtaatgct

SEQ ID NO: 9004441 - DNA, 22 bp, Homo sapiens
attaagtgactaaagtaatgct

SEQ ID NO: 9004442 - DNA, 22 bp, Homo sapiens
attaagtgactaaagtaatgct

SEQ ID NO: 9004443 - DNA, 22 bp, Homo sapiens
attaagtgactaaagtaatgct

SEQ ID NO: 9004444 - DNA, 22 bp, Homo sapiens
attaagtgactaaagtaatgct

SEQ ID NO: 9004445 - DNA, 22 bp, Homo sapiens
attaagtgtgacatgctgctct

SEQ ID NO: 9004446 - DNA, 22 bp, Homo sapiens
attaagtgttttacatacatta

SEQ ID NO: 9004447 - DNA, 22 bp, Homo sapiens
attaagtgactaaagtaatgct

SEQ ID NO: 9004448 - DNA, 22 bp, Homo sapiens
agagccttgcctggggccctgt

SEQ ID NO: 9004449 - DNA, 20 bp, Homo sapiens
agagccttgaggaagatgat

SEQ ID NO: 9004450 - DNA, 20 bp, Homo sapiens
agagccttgaggaagatgat

SEQ ID NO: 9004451 - DNA, 22 bp, Homo sapiens
agagcctttggagctgctatta

SEQ ID NO: 9004452 - DNA, 22 bp, Homo sapiens
agagccttgctctaaatttctc

SEQ ID NO: 9004453 - DNA, 23 bp, Homo sapiens
agagccttttcacacttcaatgt

SEQ ID NO: 9004454 - DNA, 22 bp, Homo sapiens
agagctaagaaacagaattgct

SEQ ID NO: 9004455 - DNA, 22 bp, Homo sapiens
agagcggggatagttaatattc

SEQ ID NO: 9004456 - DNA, 22 bp, Homo sapiens
agagctactgtccagttgctac

SEQ ID NO: 9004457 - DNA, 22 bp, Homo sapiens
agagctaagaaacagaattgct

SEQ ID NO: 9004458 - DNA, 22 bp, Homo sapiens
agagctaaatcagactttcttt

SEQ ID NO: 9004459 - DNA, 22 bp, Homo sapiens
atgttctacagatggaaagggg

SEQ ID NO: 9004460 - DNA, 22 bp, Homo sapiens
atgttctacagatggaaagggg

SEQ ID NO: 9004461 - DNA, 22 bp, Homo sapiens
atgttctacagatggaaagggg

SEQ ID NO: 9004462 - DNA, 22 bp, Homo sapiens
atgttcctttaaaatatagatt

SEQ ID NO: 9004463 - DNA, 22 bp, Homo sapiens
atgttctacagatggaaagggg

SEQ ID NO: 9004464 - DNA, 22 bp, Homo sapiens
atgttctaatccctgctatgta

SEQ ID NO: 9004465 - DNA, 22 bp, Homo sapiens
agagcctgttttgtgggagatg

SEQ ID NO: 9004466 - DNA, 22 bp, Homo sapiens
agagccttgaagatctggaaaa

SEQ ID NO: 9004467 - DNA, 22 bp, Homo sapiens
agagcctgttttgtgggagatg

SEQ ID NO: 9004468 - DNA, 22 bp, Homo sapiens
atgttctatatcattattgtga

SEQ ID NO: 9004469 - DNA, 22 bp, Homo sapiens
atgttctatatcattattgtga

SEQ ID NO: 9004470 - DNA, 19 bp, Homo sapiens
atgttctatcctccaagtt

SEQ ID NO: 9004471 - DNA, 22 bp, Homo sapiens
atgttcctgatcctcgttctat

SEQ ID NO: 9004472 - DNA, 22 bp, Homo sapiens
atgttcctcattcttgcaaccc

SEQ ID NO: 9004473 - DNA, 22 bp, Homo sapiens
atgttccttccagagagcagaa

SEQ ID NO: 9004474 - DNA, 22 bp, Homo sapiens
atgttcctggtatatcatgacc

SEQ ID NO: 9004475 - DNA, 22 bp, Homo sapiens
atgttcatgattggttttggcg

SEQ ID NO: 9004476 - DNA, 22 bp, Homo sapiens
atgttcatgtggctgctggcag

SEQ ID NO: 9004477 - DNA, 22 bp, Homo sapiens
atgttcatccatgtcgtagcag

SEQ ID NO: 9004478 - DNA, 22 bp, Homo sapiens
atgttcatctacaaggcattgt

SEQ ID NO: 9004479 - DNA, 22 bp, Homo sapiens
atgttcatcaacacattacaag

SEQ ID NO: 9004480 - DNA, 22 bp, Homo sapiens
atgttcatcaacacattacaag

SEQ ID NO: 9004481 - DNA, 22 bp, Homo sapiens
atgttcatttgacaagtagtga

SEQ ID NO: 9004482 - DNA, 22 bp, Homo sapiens
atgttcattttcttaatgtgcc

SEQ ID NO: 9004483 - DNA, 22 bp, Homo sapiens
atgttcattttatggcgatgcc

SEQ ID NO: 9004484 - DNA, 22 bp, Homo sapiens
atgttcattagtcaacatttct

SEQ ID NO: 9004485 - DNA, 18 bp, Homo sapiens
atgttcatatttttaggg

SEQ ID NO: 9004486 - DNA, 22 bp, Homo sapiens
atgttcatatccccattctgat

SEQ ID NO: 9004487 - DNA, 22 bp, Homo sapiens
atgttcatagcatcggtattca

SEQ ID NO: 9004488 - DNA, 22 bp, Homo sapiens
atgttcagttagcactgaagtc

SEQ ID NO: 9004489 - DNA, 22 bp, Homo sapiens
atgttcagcattctataaatat

SEQ ID NO: 9004490 - DNA, 22 bp, Homo sapiens
atgttcagcattctataaatat

SEQ ID NO: 9004491 - DNA, 22 bp, Homo sapiens
atgttcacaaagactctgtaag

SEQ ID NO: 9004492 - DNA, 21 bp, Homo sapiens
atgttcactgggtcaattaga

SEQ ID NO: 9004493 - DNA, 22 bp, Homo sapiens
atgttcaaacaagttaatgcca

SEQ ID NO: 9004494 - DNA, 22 bp, Homo sapiens
atgttcaaactttttacacacc

SEQ ID NO: 9004495 - DNA, 22 bp, Homo sapiens
atgttcaaactttttacacacc

SEQ ID NO: 9004496 - DNA, 22 bp, Homo sapiens
atgttcaaactttttacacacc

SEQ ID NO: 9004497 - DNA, 22 bp, Homo sapiens
atgttcaacagtttgcacacat

SEQ ID NO: 9004498 - DNA, 22 bp, Homo sapiens
atgttcaagtacctttgtgtct

SEQ ID NO: 9004499 - DNA, 22 bp, Homo sapiens
atgttcaaactttttacacacc

SEQ ID NO: 9004500 - DNA, 22 bp, Homo sapiens
atgttcaaagatcgtgctatcc

SEQ ID NO: 9004501 - DNA, 22 bp, Homo sapiens
atgttcaaagatcgtgctatcc

SEQ ID NO: 9004502 - DNA, 22 bp, Homo sapiens
agagactgtgtccatcgtgcct

SEQ ID NO: 9004503 - DNA, 22 bp, Homo sapiens
agagactgtgtccatcgtgcct

SEQ ID NO: 9004504 - DNA, 22 bp, Homo sapiens
agagactgtggctctttgaagg

SEQ ID NO: 9004505 - DNA, 22 bp, Homo sapiens
agagactttgtctattttgttc

SEQ ID NO: 9004506 - DNA, 17 bp, Homo sapiens
agagagaaaagggccat

SEQ ID NO: 9004507 - DNA, 22 bp, Homo sapiens
agagacttctgccttagcaaga

SEQ ID NO: 9004508 - DNA, 21 bp, Homo sapiens
agagactgtcactgcagtacc

SEQ ID NO: 9004509 - DNA, 21 bp, Homo sapiens
agagactgtcactgcagtacc

SEQ ID NO: 9004510 - DNA, 22 bp, Homo sapiens
agagactgtgccagccccatgc

SEQ ID NO: 9004511 - DNA, 22 bp, Homo sapiens
agagactgtgccagccccatgc

SEQ ID NO: 9004512 - DNA, 22 bp, Homo sapiens
agagactgtacgtggcaagtat

SEQ ID NO: 9004513 - DNA, 22 bp, Homo sapiens
agagactgtacgtggcaagtat

SEQ ID NO: 9004514 - DNA, 22 bp, Homo sapiens
agagactgtcacataacagagg

SEQ ID NO: 9004515 - DNA, 22 bp, Homo sapiens
agagactgtcacataacagagg

SEQ ID NO: 9004516 - DNA, 21 bp, Homo sapiens
agagactgtcactgcagtacc

SEQ ID NO: 9004517 - DNA, 22 bp, Homo sapiens
atgtacatactgcattttcaaa

SEQ ID NO: 9004518 - DNA, 22 bp, Homo sapiens
agagagaacaccctcggcatgg

SEQ ID NO: 9004519 - DNA, 17 bp, Homo sapiens
agagagaaaagggccat

SEQ ID NO: 9004520 - DNA, 22 bp, Homo sapiens
atgtacatactgcattttcaaa

SEQ ID NO: 9004521 - DNA, 22 bp, Homo sapiens
atgtacatagcatcatctagga

SEQ ID NO: 9004522 - DNA, 22 bp, Homo sapiens
atgtagggaactaaattcactg

SEQ ID NO: 9004523 - DNA, 22 bp, Homo sapiens
atgggctcggcgctgctgggat

SEQ ID NO: 9004524 - DNA, 22 bp, Homo sapiens
atgggctcggcgctgctgggat

SEQ ID NO: 9004525 - DNA, 22 bp, Homo sapiens
atgggctctatgtctaggagat

SEQ ID NO: 9004526 - DNA, 22 bp, Homo sapiens
atgggccttgacacatggagtg

SEQ ID NO: 9004527 - DNA, 22 bp, Homo sapiens
atgggctaaacttagaggatat

SEQ ID NO: 9004528 - DNA, 22 bp, Homo sapiens
atgggccttgacacatggagtg

SEQ ID NO: 9004529 - DNA, 22 bp, Homo sapiens
atgggctatcaaatggaggtat

SEQ ID NO: 9004530 - DNA, 22 bp, Homo sapiens
agagactgcaatgagtggtagg

SEQ ID NO: 9004531 - DNA, 22 bp, Homo sapiens
agagactgcaaatcataagaat

SEQ ID NO: 9004532 - DNA, 22 bp, Homo sapiens
agagactgcaaatcataagaat

SEQ ID NO: 9004533 - DNA, 22 bp, Homo sapiens
agagactgcaatgagtggtagg

SEQ ID NO: 9004534 - DNA, 22 bp, Homo sapiens
agagactgcaatgagtggtagg

SEQ ID NO: 9004535 - DNA, 22 bp, Homo sapiens
agagactgcaatgagtggtagg

SEQ ID NO: 9004536 - DNA, 22 bp, Homo sapiens
agagactgcaatgagtggtagg

SEQ ID NO: 9004537 - DNA, 22 bp, Homo sapiens
atgggctctatgtctaggagat

SEQ ID NO: 9004538 - DNA, 22 bp, Homo sapiens
atgggctctatgtctaggagat

SEQ ID NO: 9004539 - DNA, 22 bp, Homo sapiens
agagactgatggagctcactct

SEQ ID NO: 9004540 - DNA, 22 bp, Homo sapiens
agagactgatggatcaccaaat

SEQ ID NO: 9004541 - DNA, 22 bp, Homo sapiens
agagactgatggatcaccaaat

SEQ ID NO: 9004542 - DNA, 22 bp, Homo sapiens
agagactgcaaatcataagaat

SEQ ID NO: 9004543 - DNA, 19 bp, Homo sapiens
agagactgccaccagctgt

SEQ ID NO: 9004544 - DNA, 19 bp, Homo sapiens
agagactgccaccagctgt

SEQ ID NO: 9004545 - DNA, 22 bp, Homo sapiens
agagactgcgtgtcagcgctgg

SEQ ID NO: 9004546 - DNA, 22 bp, Homo sapiens
agagactggagatgggcagtgt

SEQ ID NO: 9004547 - DNA, 22 bp, Homo sapiens
agagactggagatgggcagtgt

SEQ ID NO: 9004548 - DNA, 22 bp, Homo sapiens
agagactgtaatgagaggtaca

SEQ ID NO: 9004549 - DNA, 22 bp, Homo sapiens
agagactgtaatgagaggtaca

SEQ ID NO: 9004550 - DNA, 22 bp, Homo sapiens
agagactgtaatgagaggtaca

SEQ ID NO: 9004551 - DNA, 22 bp, Homo sapiens
agagactgtacgtggcaagtat

SEQ ID NO: 9004552 - DNA, 22 bp, Homo sapiens
agagactgtaatgagaggtaca

SEQ ID NO: 9004553 - DNA, 22 bp, Homo sapiens
agagactggcttctaaaatggc

SEQ ID NO: 9004554 - DNA, 22 bp, Homo sapiens
agagactggagttacgagttca

SEQ ID NO: 9004555 - DNA, 22 bp, Homo sapiens
agagactggagttacgagttca

SEQ ID NO: 9004556 - DNA, 22 bp, Homo sapiens
agagactggagttacgagttca

SEQ ID NO: 9004557 - DNA, 20 bp, Homo sapiens
agagatggggtatcaccgta

SEQ ID NO: 9004558 - DNA, 20 bp, Homo sapiens
agagatggggtatcaccgta

SEQ ID NO: 9004559 - DNA, 20 bp, Homo sapiens
agagatggggtatcaccgta

SEQ ID NO: 9004560 - DNA, 22 bp, Homo sapiens
agagatggtagaacagtcataa

SEQ ID NO: 9004561 - DNA, 22 bp, Homo sapiens
agagatggtagaacagtcataa

SEQ ID NO: 9004562 - DNA, 22 bp, Homo sapiens
agagatgggcgggggcttctgc

SEQ ID NO: 9004563 - DNA, 22 bp, Homo sapiens
agagatgggcgggggcttctgc

SEQ ID NO: 9004564 - DNA, 22 bp, Homo sapiens
agagatgggcgggggcttctgc

SEQ ID NO: 9004565 - DNA, 18 bp, Homo sapiens
agagatgggagttggaaa

SEQ ID NO: 9004566 - DNA, 22 bp, Homo sapiens
agagatgggaaggcagacttca

SEQ ID NO: 9004567 - DNA, 22 bp, Homo sapiens
agagatgggaaggcagacttca

SEQ ID NO: 9004568 - DNA, 22 bp, Homo sapiens
agagatgggaaggcagacttca

SEQ ID NO: 9004569 - DNA, 18 bp, Homo sapiens
agagatgggagttggaaa

SEQ ID NO: 9004570 - DNA, 18 bp, Homo sapiens
agagatgggagttggaaa

SEQ ID NO: 9004571 - DNA, 22 bp, Homo sapiens
atgtatatgcatgcattcaaag

SEQ ID NO: 9004572 - DNA, 22 bp, Homo sapiens
atgtatatgtgaaagatgttta

SEQ ID NO: 9004573 - DNA, 22 bp, Homo sapiens
atgtatatgcatgcattcaaag

SEQ ID NO: 9004574 - DNA, 22 bp, Homo sapiens
atgtatatgcatgcattcaaag

SEQ ID NO: 9004575 - DNA, 22 bp, Homo sapiens
atgtatatgtgaaagatgttta

SEQ ID NO: 9004576 - DNA, 22 bp, Homo sapiens
atgtatatgtgtgcacgcacag

SEQ ID NO: 9004577 - DNA, 20 bp, Homo sapiens
atgtatattactggctgtga

SEQ ID NO: 9004578 - DNA, 22 bp, Homo sapiens
agagatggcgtctcagagcctg

SEQ ID NO: 9004579 - DNA, 17 bp, Homo sapiens
atgtatattaactctga

SEQ ID NO: 9004580 - DNA, 17 bp, Homo sapiens
atgtatattaactctga

SEQ ID NO: 9004581 - DNA, 17 bp, Homo sapiens
atgtatattaactctga

SEQ ID NO: 9004582 - DNA, 22 bp, Homo sapiens
agagatggcgtctcagagcctg

SEQ ID NO: 9004583 - DNA, 22 bp, Homo sapiens
agagatggcgtctcagagcctg

SEQ ID NO: 9004584 - DNA, 22 bp, Homo sapiens
agagatggcgtctcagagcctg

SEQ ID NO: 9004585 - DNA, 22 bp, Homo sapiens
agagatggcgtctcagagcctg

SEQ ID NO: 9004586 - DNA, 22 bp, Homo sapiens
agagatggcgtctcagagcctg

SEQ ID NO: 9004587 - DNA, 22 bp, Homo sapiens
atgtagtttggggctagattta

SEQ ID NO: 9004588 - DNA, 22 bp, Homo sapiens
atgtagtttggggctagattta

SEQ ID NO: 9004589 - DNA, 22 bp, Homo sapiens
atgtagttttggatggttgctg

SEQ ID NO: 9004590 - DNA, 22 bp, Homo sapiens
atgtataagtacacagtcggaa

SEQ ID NO: 9004591 - DNA, 22 bp, Homo sapiens
atgtagttagaagattcaaaca

SEQ ID NO: 9004592 - DNA, 22 bp, Homo sapiens
atgtagttgaagtgctataaag

SEQ ID NO: 9004593 - DNA, 22 bp, Homo sapiens
atgtagttagaagattcaaaca

SEQ ID NO: 9004594 - DNA, 21 bp, Homo sapiens
atgtagggtttgccttctcta

SEQ ID NO: 9004595 - DNA, 22 bp, Homo sapiens
atgtagtactgggtatgtttct

SEQ ID NO: 9004596 - DNA, 21 bp, Homo sapiens
atgtagtgacttcattccttc

SEQ ID NO: 9004597 - DNA, 22 bp, Homo sapiens
atgtagtatttggaaatgtaaa

SEQ ID NO: 9004598 - DNA, 22 bp, Homo sapiens
atgtagtgccctttgtcatcta

SEQ ID NO: 9004599 - DNA, 22 bp, Homo sapiens
atgtagtgtagagattagtctc

SEQ ID NO: 9004600 - DNA, 22 bp, Homo sapiens
atgtagtgccctttgtcatcta

SEQ ID NO: 9004601 - DNA, 22 bp, Homo sapiens
atgtatatacttacatgtgtgg

SEQ ID NO: 9004602 - DNA, 22 bp, Homo sapiens
atgtatatacttacatgtgtgg

SEQ ID NO: 9004603 - DNA, 22 bp, Homo sapiens
atgtatatgaagctagtatttt

SEQ ID NO: 9004604 - DNA, 22 bp, Homo sapiens
atgtatatgaagctagtatttt

SEQ ID NO: 9004605 - DNA, 22 bp, Homo sapiens
atgtatatgaagctagtatttt

SEQ ID NO: 9004606 - DNA, 22 bp, Homo sapiens
atgtatacgtgcaagtcacagg

SEQ ID NO: 9004607 - DNA, 22 bp, Homo sapiens
atgtatacgtgcaggtcacagg

SEQ ID NO: 9004608 - DNA, 22 bp, Homo sapiens
atgtatagtggtgatgattaca

SEQ ID NO: 9004609 - DNA, 22 bp, Homo sapiens
atgtatactaacacatgcagtt

SEQ ID NO: 9004610 - DNA, 22 bp, Homo sapiens
atgtataatgctaattagctag

SEQ ID NO: 9004611 - DNA, 22 bp, Homo sapiens
atgtataatgctaattagctag

SEQ ID NO: 9004612 - DNA, 18 bp, Homo sapiens
atgggaggggccaagaga

SEQ ID NO: 9004613 - DNA, 18 bp, Homo sapiens
atgggaggggccaagaga

SEQ ID NO: 9004614 - DNA, 22 bp, Homo sapiens
atggacaggtggataggtggat

SEQ ID NO: 9004615 - DNA, 22 bp, Homo sapiens
atgggcagtaacagtggcagtc

SEQ ID NO: 9004616 - DNA, 22 bp, Homo sapiens
atgggcagtaacagtggcagtc

SEQ ID NO: 9004617 - DNA, 22 bp, Homo sapiens
atgggcagtaacagtggcagtc

SEQ ID NO: 9004618 - DNA, 18 bp, Homo sapiens
atgggaggggccaagaga

SEQ ID NO: 9004619 - DNA, 22 bp, Homo sapiens
atgggcagtaacagtggcagtc

SEQ ID NO: 9004620 - DNA, 22 bp, Homo sapiens
atggacaggcttataacagcaa

SEQ ID NO: 9004621 - DNA, 22 bp, Homo sapiens
atggacaggtactgcagtgggt

SEQ ID NO: 9004622 - DNA, 23 bp, Homo sapiens
atggacagggtttcagggtcaca

SEQ ID NO: 9004623 - DNA, 23 bp, Homo sapiens
atggacagggtttcagggtcaca

SEQ ID NO: 9004624 - DNA, 22 bp, Homo sapiens
atggacaggtactgcagtgggt

SEQ ID NO: 9004625 - DNA, 16 bp, Homo sapiens
atgggcagtgaggaag

SEQ ID NO: 9004626 - DNA, 22 bp, Homo sapiens
atgggcagtaacagtggcagtc

SEQ ID NO: 9004627 - DNA, 22 bp, Homo sapiens
atgggcagtaacagtggcagtc

SEQ ID NO: 9004628 - DNA, 22 bp, Homo sapiens
atgggcagtgtattggaaggaa

SEQ ID NO: 9004629 - DNA, 22 bp, Homo sapiens
atgggcagtgtattggaaggaa

SEQ ID NO: 9004630 - DNA, 22 bp, Homo sapiens
atgggcagttaggaggccagga

SEQ ID NO: 9004631 - DNA, 22 bp, Homo sapiens
atgggcagttaggaggccagga

SEQ ID NO: 9004632 - DNA, 22 bp, Homo sapiens
atgggcagttaggaggccagga

SEQ ID NO: 9004633 - DNA, 22 bp, Homo sapiens
atgggcagtgtattggaaggaa

SEQ ID NO: 9004634 - DNA, 22 bp, Homo sapiens
atgggcagtgtattggaaggaa

SEQ ID NO: 9004635 - DNA, 22 bp, Homo sapiens
atgggcagtgtattggaaggaa

SEQ ID NO: 9004636 - DNA, 22 bp, Homo sapiens
atgggcagttaggaggccagga

SEQ ID NO: 9004637 - DNA, 22 bp, Homo sapiens
atgggcagttaggaggccagga

SEQ ID NO: 9004638 - DNA, 23 bp, Homo sapiens
atgggccaagcaagacccatgac

SEQ ID NO: 9004639 - DNA, 22 bp, Homo sapiens
atgggccaagtaaacattctca

SEQ ID NO: 9004640 - DNA, 22 bp, Homo sapiens
atgggcctgttcctatgctggt

SEQ ID NO: 9004641 - DNA, 22 bp, Homo sapiens
atgggcctgttcctatgctggt

SEQ ID NO: 9004642 - DNA, 21 bp, Homo sapiens
atgggccagggatacagagag

SEQ ID NO: 9004643 - DNA, 22 bp, Homo sapiens
atgggccacacacgattgggtg

SEQ ID NO: 9004644 - DNA, 22 bp, Homo sapiens
agagaacattagcaaaaacagc

SEQ ID NO: 9004645 - DNA, 22 bp, Homo sapiens
agagaactactttttatatgtg

SEQ ID NO: 9004646 - DNA, 22 bp, Homo sapiens
agagaactactttttatatgtg

SEQ ID NO: 9004647 - DNA, 22 bp, Homo sapiens
agagaagacttacagccacagt

SEQ ID NO: 9004648 - DNA, 22 bp, Homo sapiens
agagaagacttacagccacagt

SEQ ID NO: 9004649 - DNA, 22 bp, Homo sapiens
agagaagacttacagccacagt

SEQ ID NO: 9004650 - DNA, 22 bp, Homo sapiens
agagaagacttacagccacagt

SEQ ID NO: 9004651 - DNA, 22 bp, Homo sapiens
agagaagacttacagccacagt

SEQ ID NO: 9004652 - DNA, 22 bp, Homo sapiens
agagaacagcctcctagagaaa

SEQ ID NO: 9004653 - DNA, 22 bp, Homo sapiens
agagaacagcctcctagagaaa

SEQ ID NO: 9004654 - DNA, 22 bp, Homo sapiens
agagaacagcctcctagagaaa

SEQ ID NO: 9004655 - DNA, 22 bp, Homo sapiens
agagaacagcctcctagagaaa

SEQ ID NO: 9004656 - DNA, 22 bp, Homo sapiens
agagaacagcctcctagagaaa

SEQ ID NO: 9004657 - DNA, 22 bp, Homo sapiens
agagaacatattttgtatgatt

SEQ ID NO: 9004658 - DNA, 22 bp, Homo sapiens
atggacagattaacacagtaga

SEQ ID NO: 9004659 - DNA, 22 bp, Homo sapiens
atggacagattaacacagtaga

SEQ ID NO: 9004660 - DNA, 21 bp, Homo sapiens
atggacaattgagtgtctgtc

SEQ ID NO: 9004661 - DNA, 22 bp, Homo sapiens
atggacagcaactggaagcttc

SEQ ID NO: 9004662 - DNA, 22 bp, Homo sapiens
atggacagctcttatgtgggca

SEQ ID NO: 9004663 - DNA, 22 bp, Homo sapiens
atggaatgtttatacacagttg

SEQ ID NO: 9004664 - DNA, 22 bp, Homo sapiens
atggaatgtttatacacagttg

SEQ ID NO: 9004665 - DNA, 22 bp, Homo sapiens
atggacaaatgtaaggcataat

SEQ ID NO: 9004666 - DNA, 22 bp, Homo sapiens
atggacaatgccaatacagttt

SEQ ID NO: 9004667 - DNA, 22 bp, Homo sapiens
atggacaatgccaatacagttt

SEQ ID NO: 9004668 - DNA, 22 bp, Homo sapiens
atggacaatgtgaaactacaag

SEQ ID NO: 9004669 - DNA, 21 bp, Homo sapiens
atggacaattgagtgtctgtc

SEQ ID NO: 9004670 - DNA, 22 bp, Homo sapiens
agggcactccttggcagctctg

SEQ ID NO: 9004671 - DNA, 22 bp, Homo sapiens
agggcactgaacagctgtagca

SEQ ID NO: 9004672 - DNA, 23 bp, Homo sapiens
agggcactgaagctggaattggg

SEQ ID NO: 9004673 - DNA, 22 bp, Homo sapiens
agggcactgcaagggttgaagg

SEQ ID NO: 9004674 - DNA, 22 bp, Homo sapiens
agggcactggcttgcaaactca

SEQ ID NO: 9004675 - DNA, 23 bp, Homo sapiens
agggcactgaagctggaattggg

SEQ ID NO: 9004676 - DNA, 23 bp, Homo sapiens
agggcactgaagctggaattggg

SEQ ID NO: 9004677 - DNA, 22 bp, Homo sapiens
agggcatgctggaggagagaca

SEQ ID NO: 9004678 - DNA, 23 bp, Homo sapiens
agggcactgttgggtgttgagga

SEQ ID NO: 9004679 - DNA, 22 bp, Homo sapiens
agggcatgctggaggagagaca

SEQ ID NO: 9004680 - DNA, 23 bp, Homo sapiens
agggcactgttgggtgttgagga

SEQ ID NO: 9004681 - DNA, 22 bp, Homo sapiens
agggccagcactcctggcagga

SEQ ID NO: 9004682 - DNA, 22 bp, Homo sapiens
agggccagcactcctggcagga

SEQ ID NO: 9004683 - DNA, 22 bp, Homo sapiens
agggccagatgaagccacaagc

SEQ ID NO: 9004684 - DNA, 22 bp, Homo sapiens
agggccagatgaagccacaagc

SEQ ID NO: 9004685 - DNA, 22 bp, Homo sapiens
agggccagatgaagccacaagc

SEQ ID NO: 9004686 - DNA, 22 bp, Homo sapiens
agggccagatgaagccacaagc

SEQ ID NO: 9004687 - DNA, 22 bp, Homo sapiens
agggccagatgaagccacaagc

SEQ ID NO: 9004688 - DNA, 21 bp, Homo sapiens
agggccagatcaccaaggagc

SEQ ID NO: 9004689 - DNA, 21 bp, Homo sapiens
agggccagatcaccaaggagc

SEQ ID NO: 9004690 - DNA, 21 bp, Homo sapiens
agggccagatcaccaaggagc

SEQ ID NO: 9004691 - DNA, 21 bp, Homo sapiens
agggccagatcaccaaggagc

SEQ ID NO: 9004692 - DNA, 22 bp, Homo sapiens
agggcatgctggaggagagaca

SEQ ID NO: 9004693 - DNA, 22 bp, Homo sapiens
agggcatgctggaggagagaca

SEQ ID NO: 9004694 - DNA, 22 bp, Homo sapiens
agggccagcccataatgccaaa

SEQ ID NO: 9004695 - DNA, 22 bp, Homo sapiens
agggccagcccataatgccaaa

SEQ ID NO: 9004696 - DNA, 22 bp, Homo sapiens
agggccagcccataatgccaaa

SEQ ID NO: 9004697 - DNA, 22 bp, Homo sapiens
agggccagcccataatgccaaa

SEQ ID NO: 9004698 - DNA, 22 bp, Homo sapiens
agggccagccaggccctacaaa

SEQ ID NO: 9004699 - DNA, 22 bp, Homo sapiens
agggccagcccataatgccaaa

SEQ ID NO: 9004700 - DNA, 22 bp, Homo sapiens
agggccagcccataatgccaaa

SEQ ID NO: 9004701 - DNA, 22 bp, Homo sapiens
agggccagcccataatgccaaa

SEQ ID NO: 9004702 - DNA, 22 bp, Homo sapiens
agggccagccaggccctacaaa

SEQ ID NO: 9004703 - DNA, 22 bp, Homo sapiens
agggccagcagcttggccaacc

SEQ ID NO: 9004704 - DNA, 22 bp, Homo sapiens
agggccagcagcttggccaacc

SEQ ID NO: 9004705 - DNA, 22 bp, Homo sapiens
agggccagccaggccctacaaa

SEQ ID NO: 9004706 - DNA, 22 bp, Homo sapiens
agggccagcccataatgccaaa

SEQ ID NO: 9004707 - DNA, 22 bp, Homo sapiens
agggccagccaggccctacaaa

SEQ ID NO: 9004708 - DNA, 22 bp, Homo sapiens
agggccagcagcttggccaacc

SEQ ID NO: 9004709 - DNA, 22 bp, Homo sapiens
agggccagcactcctggcagga

SEQ ID NO: 9004710 - DNA, 22 bp, Homo sapiens
agggccagcagcttggccaacc

SEQ ID NO: 9004711 - DNA, 22 bp, Homo sapiens
agggccagcactcctggcagga

SEQ ID NO: 9004712 - DNA, 22 bp, Homo sapiens
agggccagcactcctggcagga

SEQ ID NO: 9004713 - DNA, 22 bp, Homo sapiens
agggccagcactcctggcagga

SEQ ID NO: 9004714 - DNA, 22 bp, Homo sapiens
agggccagcactcctggcagga

SEQ ID NO: 9004715 - DNA, 22 bp, Homo sapiens
agggccagcactcctggcagga

SEQ ID NO: 9004716 - DNA, 22 bp, Homo sapiens
agggccagttcagaggacatgg

SEQ ID NO: 9004717 - DNA, 22 bp, Homo sapiens
agggccagttcagaggacatgg

SEQ ID NO: 9004718 - DNA, 22 bp, Homo sapiens
agggccagttcagaggacatgg

SEQ ID NO: 9004719 - DNA, 22 bp, Homo sapiens
agggccagtgggttgaaaggca

SEQ ID NO: 9004720 - DNA, 22 bp, Homo sapiens
agggccagtgggttgaaaggca

SEQ ID NO: 9004721 - DNA, 22 bp, Homo sapiens
agggccagtgggttgaaaggca

SEQ ID NO: 9004722 - DNA, 22 bp, Homo sapiens
agggccagtgggttgaaaggca

SEQ ID NO: 9004723 - DNA, 22 bp, Homo sapiens
agggccagtgggttgaaaggca

SEQ ID NO: 9004724 - DNA, 22 bp, Homo sapiens
agggccagtgggttgaaaggca

SEQ ID NO: 9004725 - DNA, 22 bp, Homo sapiens
agggccagtgggttgaaaggca

SEQ ID NO: 9004726 - DNA, 22 bp, Homo sapiens
agggccagtcgtgtattactgt

SEQ ID NO: 9004727 - DNA, 22 bp, Homo sapiens
agggccagtcgtgtattactgt

SEQ ID NO: 9004728 - DNA, 22 bp, Homo sapiens
agggccagtcgtgtattactgt

SEQ ID NO: 9004729 - DNA, 22 bp, Homo sapiens
agggccagtattaaggtaatta

SEQ ID NO: 9004730 - DNA, 22 bp, Homo sapiens
agggccagtaccaggtgggtgg

SEQ ID NO: 9004731 - DNA, 22 bp, Homo sapiens
agggccagtaaatgtttcctca

SEQ ID NO: 9004732 - DNA, 22 bp, Homo sapiens
agggccagtaaatgtttcctca

SEQ ID NO: 9004733 - DNA, 22 bp, Homo sapiens
agggccagccccaccctctctg

SEQ ID NO: 9004734 - DNA, 22 bp, Homo sapiens
agggccagtaaatgtttcctca

SEQ ID NO: 9004735 - DNA, 22 bp, Homo sapiens
agggccagtaccaggtgggtgg

SEQ ID NO: 9004736 - DNA, 22 bp, Homo sapiens
agggccagtaccaggtgggtgg

SEQ ID NO: 9004737 - DNA, 22 bp, Homo sapiens
agggccagtaccaggtgggtgg

SEQ ID NO: 9004738 - DNA, 22 bp, Homo sapiens
agggccagtaccaggtgggtgg

SEQ ID NO: 9004739 - DNA, 22 bp, Homo sapiens
agggccagtattaaggtaatta

SEQ ID NO: 9004740 - DNA, 22 bp, Homo sapiens
agggccagtattaaggtaatta

SEQ ID NO: 9004741 - DNA, 22 bp, Homo sapiens
agggccagtattaaggtaatta

SEQ ID NO: 9004742 - DNA, 22 bp, Homo sapiens
agggccagtattaaggtaatta

SEQ ID NO: 9004743 - DNA, 22 bp, Homo sapiens
agggctcaatggtgggcatgta

SEQ ID NO: 9004744 - DNA, 22 bp, Homo sapiens
agggctcaatggtgggcatgta

SEQ ID NO: 9004745 - DNA, 22 bp, Homo sapiens
agggctcaatggtgggcatgta

SEQ ID NO: 9004746 - DNA, 22 bp, Homo sapiens
agggctcaatggtgggcatgta

SEQ ID NO: 9004747 - DNA, 22 bp, Homo sapiens
agggctcaccactgtgcactcc

SEQ ID NO: 9004748 - DNA, 22 bp, Homo sapiens
agggctcaccactgtgcactcc

SEQ ID NO: 9004749 - DNA, 22 bp, Homo sapiens
agggctcaccactgtgcactcc

SEQ ID NO: 9004750 - DNA, 22 bp, Homo sapiens
agggctcaccactgtgcactcc

SEQ ID NO: 9004751 - DNA, 22 bp, Homo sapiens
agggctcaagggcatgctacgt

SEQ ID NO: 9004752 - DNA, 21 bp, Homo sapiens
agggctcaaatgtgcttgctg

SEQ ID NO: 9004753 - DNA, 22 bp, Homo sapiens
agggctcaagggcatgctacgt

SEQ ID NO: 9004754 - DNA, 22 bp, Homo sapiens
agggctcaatggtgggcatgta

SEQ ID NO: 9004755 - DNA, 22 bp, Homo sapiens
agggctcaatggtgggcatgta

SEQ ID NO: 9004756 - DNA, 22 bp, Homo sapiens
agggccagttctacctctgaat

SEQ ID NO: 9004757 - DNA, 22 bp, Homo sapiens
agggccagttctacctctgaat

SEQ ID NO: 9004758 - DNA, 22 bp, Homo sapiens
agggccagttctacctctgaat

SEQ ID NO: 9004759 - DNA, 22 bp, Homo sapiens
agggccagttctacctctgaat

SEQ ID NO: 9004760 - DNA, 22 bp, Homo sapiens
agggcctggttctgtgtaggga

SEQ ID NO: 9004761 - DNA, 22 bp, Homo sapiens
agggcctggttctgtgtaggga

SEQ ID NO: 9004762 - DNA, 22 bp, Homo sapiens
agggcctgtcagcggtgtcctg

SEQ ID NO: 9004763 - DNA, 22 bp, Homo sapiens
agggccagttcagaggacatgg

SEQ ID NO: 9004764 - DNA, 22 bp, Homo sapiens
agggccagttcagaggacatgg

SEQ ID NO: 9004765 - DNA, 22 bp, Homo sapiens
agggccagttcagaggacatgg

SEQ ID NO: 9004766 - DNA, 22 bp, Homo sapiens
agggccagttctacctctgaat

SEQ ID NO: 9004767 - DNA, 22 bp, Homo sapiens
agggccagttctacctctgaat

SEQ ID NO: 9004768 - DNA, 22 bp, Homo sapiens
agggccagttcagaggacatgg

SEQ ID NO: 9004769 - DNA, 22 bp, Homo sapiens
agggccagttctacctctgaat

SEQ ID NO: 9004770 - DNA, 22 bp, Homo sapiens
accagagaaaacacagcaggct

SEQ ID NO: 9004771 - DNA, 22 bp, Homo sapiens
accagagaatttagccaagaaa

SEQ ID NO: 9004772 - DNA, 22 bp, Homo sapiens
accagagaatgtgcatctctaa

SEQ ID NO: 9004773 - DNA, 22 bp, Homo sapiens
accagagaaaacacagcaggct

SEQ ID NO: 9004774 - DNA, 22 bp, Homo sapiens
accagagaaaacacagcaggct

SEQ ID NO: 9004775 - DNA, 22 bp, Homo sapiens
accagacactgtgaagacaggc

SEQ ID NO: 9004776 - DNA, 20 bp, Homo sapiens
accagagactggggacaagt

SEQ ID NO: 9004777 - DNA, 20 bp, Homo sapiens
accagagactggggacaagt

SEQ ID NO: 9004778 - DNA, 20 bp, Homo sapiens
accagagactggggacaagt

SEQ ID NO: 9004779 - DNA, 22 bp, Homo sapiens
accagagactgcatttctctga

SEQ ID NO: 9004780 - DNA, 22 bp, Homo sapiens
accagagactctttctagtcct

SEQ ID NO: 9004781 - DNA, 20 bp, Homo sapiens
accagagacctgaatcagtt

SEQ ID NO: 9004782 - DNA, 20 bp, Homo sapiens
accagagacctgaatcagtt

SEQ ID NO: 9004783 - DNA, 22 bp, Homo sapiens
accagagaatttagccaagaaa

SEQ ID NO: 9004784 - DNA, 20 bp, Homo sapiens
accagagatagcaatagtgc

SEQ ID NO: 9004785 - DNA, 20 bp, Homo sapiens
accagagatagcaatagtgc

SEQ ID NO: 9004786 - DNA, 22 bp, Homo sapiens
accagagcagactactggaggt

SEQ ID NO: 9004787 - DNA, 22 bp, Homo sapiens
accagagatggggcttctctgt

SEQ ID NO: 9004788 - DNA, 22 bp, Homo sapiens
accagagagcctaggctgggca

SEQ ID NO: 9004789 - DNA, 22 bp, Homo sapiens
accagagagcctaggctgggca

SEQ ID NO: 9004790 - DNA, 22 bp, Homo sapiens
accagagagcctaggctgggca

SEQ ID NO: 9004791 - DNA, 22 bp, Homo sapiens
accagagagagacagggttgtg

SEQ ID NO: 9004792 - DNA, 22 bp, Homo sapiens
accagagaggctgcagtgtgtg

SEQ ID NO: 9004793 - DNA, 22 bp, Homo sapiens
accagagaggctgcagtgtgtg

SEQ ID NO: 9004794 - DNA, 22 bp, Homo sapiens
accagagaggctgcagtgtgtg

SEQ ID NO: 9004795 - DNA, 22 bp, Homo sapiens
accagagagcctaggctgggca

SEQ ID NO: 9004796 - DNA, 22 bp, Homo sapiens
accagagagcctaggctgggca

SEQ ID NO: 9004797 - DNA, 22 bp, Homo sapiens
accagagctcttcagcacagga

SEQ ID NO: 9004798 - DNA, 20 bp, Homo sapiens
accagagctctcagtatgtg

SEQ ID NO: 9004799 - DNA, 20 bp, Homo sapiens
accagagctctcagtatgtg

SEQ ID NO: 9004800 - DNA, 22 bp, Homo sapiens
agggagctgactggctgccatt

SEQ ID NO: 9004801 - DNA, 22 bp, Homo sapiens
accagagcgctcaagccttccc

SEQ ID NO: 9004802 - DNA, 22 bp, Homo sapiens
agggagctgactggctgccatt

SEQ ID NO: 9004803 - DNA, 22 bp, Homo sapiens
accagagatgtctaataggggc

SEQ ID NO: 9004804 - DNA, 22 bp, Homo sapiens
accagagcccatctgctcctag

SEQ ID NO: 9004805 - DNA, 22 bp, Homo sapiens
accagagcagactactggaggt

SEQ ID NO: 9004806 - DNA, 22 bp, Homo sapiens
accagagcgctcaagccttccc

SEQ ID NO: 9004807 - DNA, 18 bp, Homo sapiens
accagagccctgttctgg

SEQ ID NO: 9004808 - DNA, 20 bp, Homo sapiens
accagagctctcagtatgtg

SEQ ID NO: 9004809 - DNA, 20 bp, Homo sapiens
accagagctctcagtatgtg

SEQ ID NO: 9004810 - DNA, 22 bp, Homo sapiens
agggagctgactggctgccatt

SEQ ID NO: 9004811 - DNA, 22 bp, Homo sapiens
agggaggatagtagtcagttta

SEQ ID NO: 9004812 - DNA, 22 bp, Homo sapiens
agggaggatctgctccttgtct

SEQ ID NO: 9004813 - DNA, 22 bp, Homo sapiens
agggaggatctgctccttgtct

SEQ ID NO: 9004814 - DNA, 22 bp, Homo sapiens
agggaggatctgctccttgtct

SEQ ID NO: 9004815 - DNA, 22 bp, Homo sapiens
agggaggatctgctccttgtct

SEQ ID NO: 9004816 - DNA, 22 bp, Homo sapiens
agggaggcaggaaagttgtctg

SEQ ID NO: 9004817 - DNA, 22 bp, Homo sapiens
agggaggcaggaaagttgtctg

SEQ ID NO: 9004818 - DNA, 20 bp, Homo sapiens
agggaggtgctgggcctgag

SEQ ID NO: 9004819 - DNA, 20 bp, Homo sapiens
agggaggtgctgggcctgag

SEQ ID NO: 9004820 - DNA, 22 bp, Homo sapiens
agggaggtctttgaggggctta

SEQ ID NO: 9004821 - DNA, 22 bp, Homo sapiens
agggaggtctggctgccctgag

SEQ ID NO: 9004822 - DNA, 22 bp, Homo sapiens
agggaggtctttgaggggctta

SEQ ID NO: 9004823 - DNA, 22 bp, Homo sapiens
agggaggtctggctgccctgag

SEQ ID NO: 9004824 - DNA, 22 bp, Homo sapiens
agggaggtctggctgccctgag

SEQ ID NO: 9004825 - DNA, 20 bp, Homo sapiens
agggaggtgctgggcctgag

SEQ ID NO: 9004826 - DNA, 20 bp, Homo sapiens
agggaggtgctgggcctgag

SEQ ID NO: 9004827 - DNA, 20 bp, Homo sapiens
agggaggtgctgggcctgag

SEQ ID NO: 9004828 - DNA, 22 bp, Homo sapiens
agggatgtgacattacagaagc

SEQ ID NO: 9004829 - DNA, 22 bp, Homo sapiens
agggaggtggttccccagtgga

SEQ ID NO: 9004830 - DNA, 22 bp, Homo sapiens
agggaggtggttccccagtgga

SEQ ID NO: 9004831 - DNA, 22 bp, Homo sapiens
agggaggtctggctgccctgag

SEQ ID NO: 9004832 - DNA, 22 bp, Homo sapiens
agggaggtctggctgccctgag

SEQ ID NO: 9004833 - DNA, 22 bp, Homo sapiens
agggaggtccatccctgcagag

SEQ ID NO: 9004834 - DNA, 22 bp, Homo sapiens
agggaggtccatccctgcagag

SEQ ID NO: 9004835 - DNA, 22 bp, Homo sapiens
agggaggcattagctactgcga

SEQ ID NO: 9004836 - DNA, 22 bp, Homo sapiens
agggaggcattagctactgcga

SEQ ID NO: 9004837 - DNA, 19 bp, Homo sapiens
agggaggtagcattggaaa

SEQ ID NO: 9004838 - DNA, 19 bp, Homo sapiens
agggaggtagcattggaaa

SEQ ID NO: 9004839 - DNA, 22 bp, Homo sapiens
agggaggcattagctactgcga

SEQ ID NO: 9004840 - DNA, 22 bp, Homo sapiens
agggcacaggctccgggtccag

SEQ ID NO: 9004841 - DNA, 22 bp, Homo sapiens
agggcacaggctccgggtccag

SEQ ID NO: 9004842 - DNA, 22 bp, Homo sapiens
agggcacagcctaaagcctatg

SEQ ID NO: 9004843 - DNA, 22 bp, Homo sapiens
agggcacaagactctgagcccc

SEQ ID NO: 9004844 - DNA, 22 bp, Homo sapiens
agggcacagcctaaagcctatg

SEQ ID NO: 9004845 - DNA, 22 bp, Homo sapiens
agggcacaagactctgagcccc

SEQ ID NO: 9004846 - DNA, 21 bp, Homo sapiens
agggcacccccgctgcctacc

SEQ ID NO: 9004847 - DNA, 21 bp, Homo sapiens
agggcacccccgctgcctacc

SEQ ID NO: 9004848 - DNA, 22 bp, Homo sapiens
agggcacctgttttagcttggt

SEQ ID NO: 9004849 - DNA, 19 bp, Homo sapiens
agggcacagggacagaagg

SEQ ID NO: 9004850 - DNA, 22 bp, Homo sapiens
agggcacatctgctgggaatgg

SEQ ID NO: 9004851 - DNA, 19 bp, Homo sapiens
agggcacagggacagaagg

SEQ ID NO: 9004852 - DNA, 22 bp, Homo sapiens
agggcaatggactacaaaaggt

SEQ ID NO: 9004853 - DNA, 22 bp, Homo sapiens
agggcaatccagccagctgatc

SEQ ID NO: 9004854 - DNA, 22 bp, Homo sapiens
agggatgttgtcaaggatgtgg

SEQ ID NO: 9004855 - DNA, 22 bp, Homo sapiens
agggcaagggttgaagataaga

SEQ ID NO: 9004856 - DNA, 22 bp, Homo sapiens
agggatgttagttgtgagctca

SEQ ID NO: 9004857 - DNA, 22 bp, Homo sapiens
agggatgtggtgggagagaaag

SEQ ID NO: 9004858 - DNA, 22 bp, Homo sapiens
agggatgttgtcaaggatgtgg

SEQ ID NO: 9004859 - DNA, 22 bp, Homo sapiens
agggatgttcattttgtggctg

SEQ ID NO: 9004860 - DNA, 22 bp, Homo sapiens
agggatgttagttgtgagctca

SEQ ID NO: 9004861 - DNA, 22 bp, Homo sapiens
agggatgtgggaactgcaggtt

SEQ ID NO: 9004862 - DNA, 22 bp, Homo sapiens
agggatgtgggaactgcaggtt

SEQ ID NO: 9004863 - DNA, 22 bp, Homo sapiens
agggatgtgggaactgcaggtt

SEQ ID NO: 9004864 - DNA, 22 bp, Homo sapiens
agggatgtgcagcatccagaca

SEQ ID NO: 9004865 - DNA, 22 bp, Homo sapiens
agggatgtgcagcatccagaca

SEQ ID NO: 9004866 - DNA, 22 bp, Homo sapiens
agggatgtgacattacagaagc

SEQ ID NO: 9004867 - DNA, 22 bp, Homo sapiens
aggggccacctgtggcaccctg

SEQ ID NO: 9004868 - DNA, 22 bp, Homo sapiens
aggggccaccaccaaggaaggt

SEQ ID NO: 9004869 - DNA, 22 bp, Homo sapiens
aggggcatcagttgcacatttt

SEQ ID NO: 9004870 - DNA, 22 bp, Homo sapiens
aggggccacctgtggcaccctg

SEQ ID NO: 9004871 - DNA, 21 bp, Homo sapiens
aggggcccttgccaggacgcc

SEQ ID NO: 9004872 - DNA, 22 bp, Homo sapiens
aggggcctcagcctcctggtca

SEQ ID NO: 9004873 - DNA, 21 bp, Homo sapiens
aggggcccttgccaggacgcc

SEQ ID NO: 9004874 - DNA, 22 bp, Homo sapiens
aggggccattgttctgcccgct

SEQ ID NO: 9004875 - DNA, 22 bp, Homo sapiens
aggggccattgttctgcccgct

SEQ ID NO: 9004876 - DNA, 22 bp, Homo sapiens
aggggccatgtaagtgtatcac

SEQ ID NO: 9004877 - DNA, 22 bp, Homo sapiens
aggggcctcgcaggaccgctcc

SEQ ID NO: 9004878 - DNA, 22 bp, Homo sapiens
aggggcctcctcattggagtgt

SEQ ID NO: 9004879 - DNA, 22 bp, Homo sapiens
aggggcctcgcaggaccgctcc

SEQ ID NO: 9004880 - DNA, 20 bp, Homo sapiens
aggggcctggaacaggcctt

SEQ ID NO: 9004881 - DNA, 20 bp, Homo sapiens
aggggcctggaacaggcctt

SEQ ID NO: 9004882 - DNA, 20 bp, Homo sapiens
aggggcctggaacaggcctt

SEQ ID NO: 9004883 - DNA, 20 bp, Homo sapiens
accctttgccggatgccaag

SEQ ID NO: 9004884 - DNA, 22 bp, Homo sapiens
accctttgcctagaggggcttt

SEQ ID NO: 9004885 - DNA, 22 bp, Homo sapiens
accctttgtcaagcacagaaga

SEQ ID NO: 9004886 - DNA, 22 bp, Homo sapiens
accctttgtccaatagaaatga

SEQ ID NO: 9004887 - DNA, 22 bp, Homo sapiens
accctttgtcaagcacagaaga

SEQ ID NO: 9004888 - DNA, 22 bp, Homo sapiens
accctttgtccaatagaaatga

SEQ ID NO: 9004889 - DNA, 21 bp, Homo sapiens
acctcaagcaacaaccaaggt

SEQ ID NO: 9004890 - DNA, 22 bp, Homo sapiens
accctttgttggataagttggc

SEQ ID NO: 9004891 - DNA, 22 bp, Homo sapiens
acctcaagtgatccactcacct

SEQ ID NO: 9004892 - DNA, 22 bp, Homo sapiens
acctcacaagtctctgtcagct

SEQ ID NO: 9004893 - DNA, 22 bp, Homo sapiens
acctcacaagtctctgtcagct

SEQ ID NO: 9004894 - DNA, 22 bp, Homo sapiens
acctcagaggaggctcctggct

SEQ ID NO: 9004895 - DNA, 22 bp, Homo sapiens
acctcagagatacaaaccatgg

SEQ ID NO: 9004896 - DNA, 22 bp, Homo sapiens
acctccagctttttagagacat

SEQ ID NO: 9004897 - DNA, 22 bp, Homo sapiens
acctcagctatttcaaaacaga

SEQ ID NO: 9004898 - DNA, 22 bp, Homo sapiens
acctcagattgtggctccgctg

SEQ ID NO: 9004899 - DNA, 22 bp, Homo sapiens
acctcagaggaggctcctggct

SEQ ID NO: 9004900 - DNA, 22 bp, Homo sapiens
acctcagaacggcgttcttgaa

SEQ ID NO: 9004901 - DNA, 22 bp, Homo sapiens
acctcagaggccagggatctag

SEQ ID NO: 9004902 - DNA, 22 bp, Homo sapiens
acctcagagggatgttacaggc

SEQ ID NO: 9004903 - DNA, 19 bp, Homo sapiens
agggtacacgagagaagag

SEQ ID NO: 9004904 - DNA, 22 bp, Homo sapiens
agggtaaagtacatccttctca

SEQ ID NO: 9004905 - DNA, 20 bp, Homo sapiens
agggtcagtagcacagagct

SEQ ID NO: 9004906 - DNA, 20 bp, Homo sapiens
agggtcagtagcacagagct

SEQ ID NO: 9004907 - DNA, 20 bp, Homo sapiens
agggtcagtagcacagagct

SEQ ID NO: 9004908 - DNA, 22 bp, Homo sapiens
agggtcagtgatgagggagccc

SEQ ID NO: 9004909 - DNA, 22 bp, Homo sapiens
agggtcagtgatgagggagccc

SEQ ID NO: 9004910 - DNA, 22 bp, Homo sapiens
agggtcagtgatgagggagccc

SEQ ID NO: 9004911 - DNA, 22 bp, Homo sapiens
agggtcagtagtgatgcgtgaa

SEQ ID NO: 9004912 - DNA, 22 bp, Homo sapiens
agggtcagtagtgatgcgtgaa

SEQ ID NO: 9004913 - DNA, 22 bp, Homo sapiens
aggggtgtgcatcctggaggat

SEQ ID NO: 9004914 - DNA, 22 bp, Homo sapiens
aggggttggacataagacagaa

SEQ ID NO: 9004915 - DNA, 22 bp, Homo sapiens
aggggtgtgcatcctggaggat

SEQ ID NO: 9004916 - DNA, 22 bp, Homo sapiens
aggggtgtgcatcctggaggat

SEQ ID NO: 9004917 - DNA, 23 bp, Homo sapiens
aggggtggtcagtacccgcagtg

SEQ ID NO: 9004918 - DNA, 23 bp, Homo sapiens
aggggtggtcagtacccgcagtg

SEQ ID NO: 9004919 - DNA, 23 bp, Homo sapiens
aggggtggtcagtacccgcagtg

SEQ ID NO: 9004920 - DNA, 23 bp, Homo sapiens
aggggtggtcagtacccgcagtg

SEQ ID NO: 9004921 - DNA, 23 bp, Homo sapiens
aggggtggtcagtacccgcagtg

SEQ ID NO: 9004922 - DNA, 23 bp, Homo sapiens
aggggtggtcagtacccgcagtg

SEQ ID NO: 9004923 - DNA, 22 bp, Homo sapiens
acctcccagaaagttttgcagg

SEQ ID NO: 9004924 - DNA, 22 bp, Homo sapiens
aggggtgacacatatcagtgca

SEQ ID NO: 9004925 - DNA, 22 bp, Homo sapiens
acctccatggctcagtttcaga

SEQ ID NO: 9004926 - DNA, 22 bp, Homo sapiens
acctcccagaaagttttgcagg

SEQ ID NO: 9004927 - DNA, 16 bp, Homo sapiens
acctccagtcaagggt

SEQ ID NO: 9004928 - DNA, 22 bp, Homo sapiens
aggggtgatttgggacaggaca

SEQ ID NO: 9004929 - DNA, 20 bp, Homo sapiens
aggggtgatcgggtgacact

SEQ ID NO: 9004930 - DNA, 20 bp, Homo sapiens
aggggtgatcgggtgacact

SEQ ID NO: 9004931 - DNA, 22 bp, Homo sapiens
aggggtggagagtgttgccagt

SEQ ID NO: 9004932 - DNA, 22 bp, Homo sapiens
aggggtggagagtgttgccagt

SEQ ID NO: 9004933 - DNA, 22 bp, Homo sapiens
aggggtggcctgccttactccc

SEQ ID NO: 9004934 - DNA, 22 bp, Homo sapiens
aggggtggcctgccttactccc

SEQ ID NO: 9004935 - DNA, 22 bp, Homo sapiens
aggggtgatttgggacaggaca

SEQ ID NO: 9004936 - DNA, 22 bp, Homo sapiens
aggggtgatttgggacaggaca

SEQ ID NO: 9004937 - DNA, 22 bp, Homo sapiens
aggggtggagagtgttgccagt

SEQ ID NO: 9004938 - DNA, 22 bp, Homo sapiens
aggggtggagagtgttgccagt

SEQ ID NO: 9004939 - DNA, 22 bp, Homo sapiens
aggggtggagagtgttgccagt

SEQ ID NO: 9004940 - DNA, 22 bp, Homo sapiens
aggggtggagagtgttgccagt

SEQ ID NO: 9004941 - DNA, 22 bp, Homo sapiens
agggctcagaacaatgagtgta

SEQ ID NO: 9004942 - DNA, 22 bp, Homo sapiens
agggctcagaaagcaggttttc

SEQ ID NO: 9004943 - DNA, 22 bp, Homo sapiens
agggctcagaaatgtctacggg

SEQ ID NO: 9004944 - DNA, 22 bp, Homo sapiens
agggctcagagcaaaagggcac

SEQ ID NO: 9004945 - DNA, 22 bp, Homo sapiens
agggctcagaacaatgagtgta

SEQ ID NO: 9004946 - DNA, 22 bp, Homo sapiens
agggctcagagcaaaagggcac

SEQ ID NO: 9004947 - DNA, 22 bp, Homo sapiens
agggctcactacaaccctggga

SEQ ID NO: 9004948 - DNA, 22 bp, Homo sapiens
agggctcaccactgtgcactcc

SEQ ID NO: 9004949 - DNA, 22 bp, Homo sapiens
agggctcaccactgtgcactcc

SEQ ID NO: 9004950 - DNA, 22 bp, Homo sapiens
agggctcaagggcatgctacgt

SEQ ID NO: 9004951 - DNA, 22 bp, Homo sapiens
agggctcactgggaggctataa

SEQ ID NO: 9004952 - DNA, 22 bp, Homo sapiens
agggctcactgggaggctataa

SEQ ID NO: 9004953 - DNA, 22 bp, Homo sapiens
agggctcactgggaggctataa

SEQ ID NO: 9004954 - DNA, 22 bp, Homo sapiens
agggctcactgggaggctataa

SEQ ID NO: 9004955 - DNA, 22 bp, Homo sapiens
agggctcactgggaggctataa

SEQ ID NO: 9004956 - DNA, 22 bp, Homo sapiens
agggctcactgggaggctataa

SEQ ID NO: 9004957 - DNA, 22 bp, Homo sapiens
agggctcagaaatgtctacggg

SEQ ID NO: 9004958 - DNA, 22 bp, Homo sapiens
agggctcagaaatgtctacggg

SEQ ID NO: 9004959 - DNA, 22 bp, Homo sapiens
agggctcagggcacgtcatcca

SEQ ID NO: 9004960 - DNA, 22 bp, Homo sapiens
agggctcagggcacgtcatcca

SEQ ID NO: 9004961 - DNA, 22 bp, Homo sapiens
agggctcagggcacgtcatcca

SEQ ID NO: 9004962 - DNA, 22 bp, Homo sapiens
agggctcaggggccccaagctg

SEQ ID NO: 9004963 - DNA, 22 bp, Homo sapiens
agggctcaggggccccaagctg

SEQ ID NO: 9004964 - DNA, 22 bp, Homo sapiens
agggctcagcctcctcctcagc

SEQ ID NO: 9004965 - DNA, 22 bp, Homo sapiens
agggctcagcctcctcctcagc

SEQ ID NO: 9004966 - DNA, 22 bp, Homo sapiens
agggctcagggcacgtcatcca

SEQ ID NO: 9004967 - DNA, 22 bp, Homo sapiens
agggctcagcctcctcctcagc

SEQ ID NO: 9004968 - DNA, 22 bp, Homo sapiens
agggctcagcctcctcctcagc

SEQ ID NO: 9004969 - DNA, 22 bp, Homo sapiens
agggctcagcatctcattctgt

SEQ ID NO: 9004970 - DNA, 22 bp, Homo sapiens
agggctcagagtagttcggttt

SEQ ID NO: 9004971 - DNA, 22 bp, Homo sapiens
agggctcagccagcctgtgtgc

SEQ ID NO: 9004972 - DNA, 22 bp, Homo sapiens
agggctcagcatctcattctgt

SEQ ID NO: 9004973 - DNA, 22 bp, Homo sapiens
agggctcagcatctcattctgt

SEQ ID NO: 9004974 - DNA, 22 bp, Homo sapiens
agggctcagagcaaaagggcac

SEQ ID NO: 9004975 - DNA, 22 bp, Homo sapiens
agggctcagcctcctcctcagc

SEQ ID NO: 9004976 - DNA, 22 bp, Homo sapiens
agggctcagccagcctgtgtgc

SEQ ID NO: 9004977 - DNA, 22 bp, Homo sapiens
agggctcagccagcctgtgtgc

SEQ ID NO: 9004978 - DNA, 22 bp, Homo sapiens
agggctcagccagcctgtgtgc

SEQ ID NO: 9004979 - DNA, 22 bp, Homo sapiens
agggctgacaaatggcagtgac

SEQ ID NO: 9004980 - DNA, 22 bp, Homo sapiens
agggctgacacaccttatcctc

SEQ ID NO: 9004981 - DNA, 22 bp, Homo sapiens
agggctgacagtaaaagtatga

SEQ ID NO: 9004982 - DNA, 22 bp, Homo sapiens
agggctgacagtgaggagtcaa

SEQ ID NO: 9004983 - DNA, 23 bp, Homo sapiens
agggctgaatgcagagaagcaga

SEQ ID NO: 9004984 - DNA, 23 bp, Homo sapiens
agggctgaatgcagagaagcaga

SEQ ID NO: 9004985 - DNA, 22 bp, Homo sapiens
agggctgacaaatggcagtgac

SEQ ID NO: 9004986 - DNA, 23 bp, Homo sapiens
agggctgaatgcagagaagcaga

SEQ ID NO: 9004987 - DNA, 22 bp, Homo sapiens
agggctgacaaatggcagtgac

SEQ ID NO: 9004988 - DNA, 22 bp, Homo sapiens
agggctgaagggaggtgctcat

SEQ ID NO: 9004989 - DNA, 22 bp, Homo sapiens
agggctgaagttatggctgagc

SEQ ID NO: 9004990 - DNA, 22 bp, Homo sapiens
agggctgaaacataatccttct

SEQ ID NO: 9004991 - DNA, 22 bp, Homo sapiens
agggctgaagggaggtgctcat

SEQ ID NO: 9004992 - DNA, 22 bp, Homo sapiens
agggctcagtaaacggtggatt

SEQ ID NO: 9004993 - DNA, 22 bp, Homo sapiens
agggctcaggggccccaagctg

SEQ ID NO: 9004994 - DNA, 22 bp, Homo sapiens
agggctcagggtcaccatctgt

SEQ ID NO: 9004995 - DNA, 22 bp, Homo sapiens
agggctcagtaaacggtggatt

SEQ ID NO: 9004996 - DNA, 22 bp, Homo sapiens
agggctcagtaaacggtggatt

SEQ ID NO: 9004997 - DNA, 22 bp, Homo sapiens
agggctcagttgcctggagccc

SEQ ID NO: 9004998 - DNA, 22 bp, Homo sapiens
agggctcagttgcctggagccc

SEQ ID NO: 9004999 - DNA, 22 bp, Homo sapiens
aggggagcttgcctggtcaccc

SEQ ID NO: 9005000 - DNA, 22 bp, Homo sapiens
aggggagcttgcctggtcaccc

SEQ ID NO: 9005001 - DNA, 22 bp, Homo sapiens
aggggagcttgcctggtcaccc

SEQ ID NO: 9005002 - DNA, 22 bp, Homo sapiens
aggggagcttgcctggtcaccc

SEQ ID NO: 9005003 - DNA, 22 bp, Homo sapiens
aggggagcttgaggcatggcct

SEQ ID NO: 9005004 - DNA, 22 bp, Homo sapiens
aggggagcttgaggcatggcct

SEQ ID NO: 9005005 - DNA, 22 bp, Homo sapiens
aggggagcttgaggcatggcct

SEQ ID NO: 9005006 - DNA, 22 bp, Homo sapiens
aggggagcttgcctggtcaccc

SEQ ID NO: 9005007 - DNA, 22 bp, Homo sapiens
aggggagcttgcctggtcaccc

SEQ ID NO: 9005008 - DNA, 22 bp, Homo sapiens
aggggagctaacaccagagccc

SEQ ID NO: 9005009 - DNA, 22 bp, Homo sapiens
aggggagcgacattccgtgccg

SEQ ID NO: 9005010 - DNA, 22 bp, Homo sapiens
aggggagctaacaccagagccc

SEQ ID NO: 9005011 - DNA, 22 bp, Homo sapiens
aggggcaggtgctgcacttaga

SEQ ID NO: 9005012 - DNA, 22 bp, Homo sapiens
aggggcaggtgctgcacttaga

SEQ ID NO: 9005013 - DNA, 22 bp, Homo sapiens
aggggcaggtgctgcacttaga

SEQ ID NO: 9005014 - DNA, 22 bp, Homo sapiens
aggggcaggtgctgcacttaga

SEQ ID NO: 9005015 - DNA, 22 bp, Homo sapiens
aggggcagttccaagttttgtg

SEQ ID NO: 9005016 - DNA, 22 bp, Homo sapiens
aggggcagttccaagttttgtg

SEQ ID NO: 9005017 - DNA, 22 bp, Homo sapiens
aggggcagttccaagttttgtg

SEQ ID NO: 9005018 - DNA, 22 bp, Homo sapiens
aggggagccgaggggcatctgt

SEQ ID NO: 9005019 - DNA, 22 bp, Homo sapiens
aggggagccgaggggcatctgt

SEQ ID NO: 9005020 - DNA, 22 bp, Homo sapiens
aggggagccgaggggcatctgt

SEQ ID NO: 9005021 - DNA, 22 bp, Homo sapiens
aggggagccgaggggcatctgt

SEQ ID NO: 9005022 - DNA, 22 bp, Homo sapiens
aggggagccgaggggcatctgt

SEQ ID NO: 9005023 - DNA, 22 bp, Homo sapiens
aggggagcgacattccgtgccg

SEQ ID NO: 9005024 - DNA, 22 bp, Homo sapiens
aggggagccgaggggcatctgt

SEQ ID NO: 9005025 - DNA, 22 bp, Homo sapiens
aggggagccgaggggcatctgt

SEQ ID NO: 9005026 - DNA, 22 bp, Homo sapiens
aggggagcatctgtgatggtta

SEQ ID NO: 9005027 - DNA, 22 bp, Homo sapiens
aggggagccagggctgcgagtt

SEQ ID NO: 9005028 - DNA, 22 bp, Homo sapiens
aggggagccagggctgcgagtt

SEQ ID NO: 9005029 - DNA, 22 bp, Homo sapiens
aggggagccgaggggcatctgt

SEQ ID NO: 9005030 - DNA, 22 bp, Homo sapiens
aggggagcccctggtcctggtg

SEQ ID NO: 9005031 - DNA, 22 bp, Homo sapiens
aggggagcccctggtcctggtg

SEQ ID NO: 9005032 - DNA, 22 bp, Homo sapiens
aggggagcccctggtcctggtg

SEQ ID NO: 9005033 - DNA, 22 bp, Homo sapiens
aggggagcccctggtcctggtg

SEQ ID NO: 9005034 - DNA, 22 bp, Homo sapiens
aggggagcccctggtcctggtg

SEQ ID NO: 9005035 - DNA, 22 bp, Homo sapiens
aggggagcaaggccgtggtgta

SEQ ID NO: 9005036 - DNA, 22 bp, Homo sapiens
aggggagcaaggccgtggtgta

SEQ ID NO: 9005037 - DNA, 22 bp, Homo sapiens
aggggagcatctgtgatggtta

SEQ ID NO: 9005038 - DNA, 22 bp, Homo sapiens
aggggagcaaggccgtggtgta

SEQ ID NO: 9005039 - DNA, 22 bp, Homo sapiens
aggggagcaaggccgtggtgta

SEQ ID NO: 9005040 - DNA, 22 bp, Homo sapiens
aggggagcaaggccgtggtgta

SEQ ID NO: 9005041 - DNA, 22 bp, Homo sapiens
aggggagcatctgtgatggtta

SEQ ID NO: 9005042 - DNA, 22 bp, Homo sapiens
aggggagcaacatagtcactct

SEQ ID NO: 9005043 - DNA, 22 bp, Homo sapiens
aggggagcaacatagtcactct

SEQ ID NO: 9005044 - DNA, 22 bp, Homo sapiens
aggggagcaacatagtcactct

SEQ ID NO: 9005045 - DNA, 22 bp, Homo sapiens
agggctttgagaatagtggaac

SEQ ID NO: 9005046 - DNA, 20 bp, Homo sapiens
aggctcagggtgtttaggaa

SEQ ID NO: 9005047 - DNA, 20 bp, Homo sapiens
aggctcagggtgtttaggaa

SEQ ID NO: 9005048 - DNA, 20 bp, Homo sapiens
aggctcagggtgtttaggaa

SEQ ID NO: 9005049 - DNA, 22 bp, Homo sapiens
aggctcaggtctcaggtctggc

SEQ ID NO: 9005050 - DNA, 20 bp, Homo sapiens
aggctcagggtgtttaggaa

SEQ ID NO: 9005051 - DNA, 22 bp, Homo sapiens
aggctcaggtctcaggtctggc

SEQ ID NO: 9005052 - DNA, 22 bp, Homo sapiens
aggctcaggtctcaggtctggc

SEQ ID NO: 9005053 - DNA, 19 bp, Homo sapiens
acatgttttgcagaacagc

SEQ ID NO: 9005054 - DNA, 22 bp, Homo sapiens
aggctcaggtctcaggtctggc

SEQ ID NO: 9005055 - DNA, 22 bp, Homo sapiens
aggctcaggtctcaggtctggc

SEQ ID NO: 9005056 - DNA, 22 bp, Homo sapiens
acattaaaatggagaattttga

SEQ ID NO: 9005057 - DNA, 22 bp, Homo sapiens
acattaaaatggagaattttga

SEQ ID NO: 9005058 - DNA, 22 bp, Homo sapiens
acatgttttgtgccttgactag

SEQ ID NO: 9005059 - DNA, 19 bp, Homo sapiens
acatgttttgcagaacagc

SEQ ID NO: 9005060 - DNA, 19 bp, Homo sapiens
acatgttttgcagaacagc

SEQ ID NO: 9005061 - DNA, 22 bp, Homo sapiens
acattaaaaaatgttgcatgaa

SEQ ID NO: 9005062 - DNA, 22 bp, Homo sapiens
aggctcgcatgccctgcaccac

SEQ ID NO: 9005063 - DNA, 22 bp, Homo sapiens
aggctctataccgctgggagtt

SEQ ID NO: 9005064 - DNA, 22 bp, Homo sapiens
aggctcgcatgccctgcaccac

SEQ ID NO: 9005065 - DNA, 22 bp, Homo sapiens
aggctccagtctcctctggcag

SEQ ID NO: 9005066 - DNA, 22 bp, Homo sapiens
aggctccttgttcatcatccat

SEQ ID NO: 9005067 - DNA, 22 bp, Homo sapiens
aggctccttgttcatcatccat

SEQ ID NO: 9005068 - DNA, 22 bp, Homo sapiens
aggctcctttaccattctggag

SEQ ID NO: 9005069 - DNA, 22 bp, Homo sapiens
acattaacaccataagtgtgtt

SEQ ID NO: 9005070 - DNA, 22 bp, Homo sapiens
acattaacaccataagtgtgtt

SEQ ID NO: 9005071 - DNA, 22 bp, Homo sapiens
acattaacaccgtgagtttggt

SEQ ID NO: 9005072 - DNA, 22 bp, Homo sapiens
acattaacaccgtgagtttggt

SEQ ID NO: 9005073 - DNA, 22 bp, Homo sapiens
aggctccagtctcctctggcag

SEQ ID NO: 9005074 - DNA, 22 bp, Homo sapiens
aggctccagtctcctctggcag

SEQ ID NO: 9005075 - DNA, 22 bp, Homo sapiens
acattaaagagtaaggttagtt

SEQ ID NO: 9005076 - DNA, 22 bp, Homo sapiens
acattaaagagtaaggttagtt

SEQ ID NO: 9005077 - DNA, 22 bp, Homo sapiens
acattaaatttcatagtgatta

SEQ ID NO: 9005078 - DNA, 22 bp, Homo sapiens
acattaaagagtaaggttagtt

SEQ ID NO: 9005079 - DNA, 22 bp, Homo sapiens
acattaaatttcatagtgatta

SEQ ID NO: 9005080 - DNA, 22 bp, Homo sapiens
acattaaatttcatagtgatta

SEQ ID NO: 9005081 - DNA, 22 bp, Homo sapiens
acattaaatttcatagtgatta

SEQ ID NO: 9005082 - DNA, 22 bp, Homo sapiens
aggctctctagaaactgtgcct

SEQ ID NO: 9005083 - DNA, 22 bp, Homo sapiens
aggctctgaagcaaccctttga

SEQ ID NO: 9005084 - DNA, 22 bp, Homo sapiens
aggctctgaagcaaccctttga

SEQ ID NO: 9005085 - DNA, 22 bp, Homo sapiens
aggctctgaaggagaacctgtt

SEQ ID NO: 9005086 - DNA, 22 bp, Homo sapiens
aggctctgaaggagaacctgtt

SEQ ID NO: 9005087 - DNA, 22 bp, Homo sapiens
aggctctgacccatgggaccca

SEQ ID NO: 9005088 - DNA, 22 bp, Homo sapiens
aggctctgaaggagaacctgtt

SEQ ID NO: 9005089 - DNA, 22 bp, Homo sapiens
aggctctccagagagctgcttt

SEQ ID NO: 9005090 - DNA, 22 bp, Homo sapiens
aggctctcaatatgatccagtc

SEQ ID NO: 9005091 - DNA, 22 bp, Homo sapiens
aggctctcaccctctgaccaga

SEQ ID NO: 9005092 - DNA, 22 bp, Homo sapiens
aggctctcaccctctgaccaga

SEQ ID NO: 9005093 - DNA, 22 bp, Homo sapiens
aggctctggagtgtggtgctgg

SEQ ID NO: 9005094 - DNA, 22 bp, Homo sapiens
aggctctggagtgtggtgctgg

SEQ ID NO: 9005095 - DNA, 22 bp, Homo sapiens
aggctctggagttagccaggca

SEQ ID NO: 9005096 - DNA, 22 bp, Homo sapiens
aggctctggagtgtggtgctgg

SEQ ID NO: 9005097 - DNA, 22 bp, Homo sapiens
aggctctggagttagccaggca

SEQ ID NO: 9005098 - DNA, 22 bp, Homo sapiens
aggctctggagtgtggtgctgg

SEQ ID NO: 9005099 - DNA, 22 bp, Homo sapiens
aggctctggagttagccaggca

SEQ ID NO: 9005100 - DNA, 22 bp, Homo sapiens
aggctctggacagtgaggagtt

SEQ ID NO: 9005101 - DNA, 22 bp, Homo sapiens
aggctctggacagtgaggagtt

SEQ ID NO: 9005102 - DNA, 22 bp, Homo sapiens
aggctctgcttttctggatata

SEQ ID NO: 9005103 - DNA, 22 bp, Homo sapiens
aggctctggacagtgaggagtt

SEQ ID NO: 9005104 - DNA, 19 bp, Homo sapiens
aggctctgagctcctggag

SEQ ID NO: 9005105 - DNA, 22 bp, Homo sapiens
aggctctgcttttctggatata

SEQ ID NO: 9005106 - DNA, 22 bp, Homo sapiens
aggctctgacgtcacacgtggc

SEQ ID NO: 9005107 - DNA, 22 bp, Homo sapiens
aggctctgacccatgggaccca

SEQ ID NO: 9005108 - DNA, 22 bp, Homo sapiens
aggctctgacccatgggaccca

SEQ ID NO: 9005109 - DNA, 22 bp, Homo sapiens
acatgtctccacccatcttaaa

SEQ ID NO: 9005110 - DNA, 22 bp, Homo sapiens
acatgtctccacccatcttaaa

SEQ ID NO: 9005111 - DNA, 22 bp, Homo sapiens
acatgtctacacattctgcaat

SEQ ID NO: 9005112 - DNA, 22 bp, Homo sapiens
acatgtattgacattatattct

SEQ ID NO: 9005113 - DNA, 22 bp, Homo sapiens
acatgtcaatttagtactctta

SEQ ID NO: 9005114 - DNA, 22 bp, Homo sapiens
acatgtctacacattctgcaat

SEQ ID NO: 9005115 - DNA, 21 bp, Homo sapiens
acatgtcccctatgcttaagg

SEQ ID NO: 9005116 - DNA, 22 bp, Homo sapiens
acatgtctaagtactcaacaaa

SEQ ID NO: 9005117 - DNA, 22 bp, Homo sapiens
acatgtattgacattatattct

SEQ ID NO: 9005118 - DNA, 22 bp, Homo sapiens
acatgtattgacattatattct

SEQ ID NO: 9005119 - DNA, 22 bp, Homo sapiens
acatgtatgctttatgaagtag

SEQ ID NO: 9005120 - DNA, 22 bp, Homo sapiens
acatgtatgctttatgaagtag

SEQ ID NO: 9005121 - DNA, 22 bp, Homo sapiens
acatgtatacaatgtgtaatga

SEQ ID NO: 9005122 - DNA, 22 bp, Homo sapiens
acatgtatacaatgtgtaatga

SEQ ID NO: 9005123 - DNA, 20 bp, Homo sapiens
acatgtactaatgaatacag

SEQ ID NO: 9005124 - DNA, 20 bp, Homo sapiens
acatgtactaatgaatacag

SEQ ID NO: 9005125 - DNA, 20 bp, Homo sapiens
acatgtactaatgaatacag

SEQ ID NO: 9005126 - DNA, 22 bp, Homo sapiens
acatgtactgttggtgaagagg

SEQ ID NO: 9005127 - DNA, 22 bp, Homo sapiens
acatgtactgttggtgaagagg

SEQ ID NO: 9005128 - DNA, 22 bp, Homo sapiens
acatgtaggagagtcacaatgc

SEQ ID NO: 9005129 - DNA, 20 bp, Homo sapiens
acatgtacagacaggtttct

SEQ ID NO: 9005130 - DNA, 20 bp, Homo sapiens
acatgtacagacaggtttct

SEQ ID NO: 9005131 - DNA, 22 bp, Homo sapiens
acatgtacatacacatatgtaa

SEQ ID NO: 9005132 - DNA, 21 bp, Homo sapiens
acatgtacacatgtatgcaca

SEQ ID NO: 9005133 - DNA, 22 bp, Homo sapiens
acatgtaatacatccagcaata

SEQ ID NO: 9005134 - DNA, 21 bp, Homo sapiens
acatgtaagagagtttcaaga

SEQ ID NO: 9005135 - DNA, 22 bp, Homo sapiens
acatgtacatacacatatgtaa

SEQ ID NO: 9005136 - DNA, 20 bp, Homo sapiens
acatgtactaatgaatacag

SEQ ID NO: 9005137 - DNA, 22 bp, Homo sapiens
acatgtacatacacatatgtaa

SEQ ID NO: 9005138 - DNA, 22 bp, Homo sapiens
acatgtacatacacatatgtaa

SEQ ID NO: 9005139 - DNA, 22 bp, Homo sapiens
acatgtaaaagataaattaaca

SEQ ID NO: 9005140 - DNA, 22 bp, Homo sapiens
acatgtaaaagataaattaaca

SEQ ID NO: 9005141 - DNA, 22 bp, Homo sapiens
acatgtaaaagataaattaaca

SEQ ID NO: 9005142 - DNA, 22 bp, Homo sapiens
acatggctcagtctcatgacag

SEQ ID NO: 9005143 - DNA, 22 bp, Homo sapiens
acatggctaaagcaagtctaga

SEQ ID NO: 9005144 - DNA, 22 bp, Homo sapiens
acatggctaaagcaagtctaga

SEQ ID NO: 9005145 - DNA, 22 bp, Homo sapiens
acatggcgggagtttcagatac

SEQ ID NO: 9005146 - DNA, 22 bp, Homo sapiens
aggcagtgtgtagctggaagag

SEQ ID NO: 9005147 - DNA, 22 bp, Homo sapiens
acatgtaagactagcttaaagt

SEQ ID NO: 9005148 - DNA, 22 bp, Homo sapiens
acatgtaacatatatgtagcat

SEQ ID NO: 9005149 - DNA, 21 bp, Homo sapiens
acatgtaagagagtttcaaga

SEQ ID NO: 9005150 - DNA, 22 bp, Homo sapiens
acatgtaagactagcttaaagt

SEQ ID NO: 9005151 - DNA, 22 bp, Homo sapiens
acatgtaaacatttacagtatt

SEQ ID NO: 9005152 - DNA, 22 bp, Homo sapiens
acatgtaaacatttacagtatt

SEQ ID NO: 9005153 - DNA, 22 bp, Homo sapiens
acatgtaaacatttacagtatt

SEQ ID NO: 9005154 - DNA, 22 bp, Homo sapiens
acatgtaaaaggaacatgcatg

SEQ ID NO: 9005155 - DNA, 22 bp, Homo sapiens
acatgtctcttctgaaagacaa

SEQ ID NO: 9005156 - DNA, 22 bp, Homo sapiens
acatgtctcttctgaaagacaa

SEQ ID NO: 9005157 - DNA, 21 bp, Homo sapiens
acatgtctggtcatttttagc

SEQ ID NO: 9005158 - DNA, 21 bp, Homo sapiens
acatgtctctaatctcagtga

SEQ ID NO: 9005159 - DNA, 21 bp, Homo sapiens
acatgtctctaatctcagtga

SEQ ID NO: 9005160 - DNA, 21 bp, Homo sapiens
acatgtctctaatctcagtga

SEQ ID NO: 9005161 - DNA, 22 bp, Homo sapiens
acatgtctccacccatcttaaa

SEQ ID NO: 9005162 - DNA, 22 bp, Homo sapiens
acatgtctgtaattattttagg

SEQ ID NO: 9005163 - DNA, 22 bp, Homo sapiens
acatgtcttttaaagtctaata

SEQ ID NO: 9005164 - DNA, 22 bp, Homo sapiens
acatgtcttttaaagtctaata

SEQ ID NO: 9005165 - DNA, 22 bp, Homo sapiens
acatgtgaggtgtgagtgatac

SEQ ID NO: 9005166 - DNA, 22 bp, Homo sapiens
acatgtgaaatctcatagttag

SEQ ID NO: 9005167 - DNA, 22 bp, Homo sapiens
acatgtcttttaaagtctaata

SEQ ID NO: 9005168 - DNA, 22 bp, Homo sapiens
acatgtcttttaaagtctaata

SEQ ID NO: 9005169 - DNA, 22 bp, Homo sapiens
aggctcagacaggaaaagtaac

SEQ ID NO: 9005170 - DNA, 22 bp, Homo sapiens
aggctcaagcactgatattttt

SEQ ID NO: 9005171 - DNA, 22 bp, Homo sapiens
acatgtggaggaggcgagggta

SEQ ID NO: 9005172 - DNA, 22 bp, Homo sapiens
acatgtgctcttgctgtacagc

SEQ ID NO: 9005173 - DNA, 22 bp, Homo sapiens
acatgtgctcttgctgtacagc

SEQ ID NO: 9005174 - DNA, 22 bp, Homo sapiens
acatgtgcagacagcaagcagg

SEQ ID NO: 9005175 - DNA, 22 bp, Homo sapiens
acatgtgagtaaatttaatgtt

SEQ ID NO: 9005176 - DNA, 22 bp, Homo sapiens
aggctcagggactccctccctc

SEQ ID NO: 9005177 - DNA, 22 bp, Homo sapiens
aggctcagggacggggcccctt

SEQ ID NO: 9005178 - DNA, 22 bp, Homo sapiens
aggctcagggactccctccctc

SEQ ID NO: 9005179 - DNA, 22 bp, Homo sapiens
aggctcagggacggggcccctt

SEQ ID NO: 9005180 - DNA, 22 bp, Homo sapiens
aggctcaggcaggaatggcgga

SEQ ID NO: 9005181 - DNA, 22 bp, Homo sapiens
aggctcagggacggggcccctt

SEQ ID NO: 9005182 - DNA, 22 bp, Homo sapiens
aggctcaggcaggaatggcgga

SEQ ID NO: 9005183 - DNA, 22 bp, Homo sapiens
aggctcaggcaggaatggcgga

SEQ ID NO: 9005184 - DNA, 22 bp, Homo sapiens
aggctcaggcaggaatggcgga

SEQ ID NO: 9005185 - DNA, 22 bp, Homo sapiens
aggctcaggcaggaatggcgga

SEQ ID NO: 9005186 - DNA, 22 bp, Homo sapiens
aggctcaggaggagctgccgga

SEQ ID NO: 9005187 - DNA, 22 bp, Homo sapiens
aggctcaggaggagctgccgga

SEQ ID NO: 9005188 - DNA, 22 bp, Homo sapiens
aggctcaggaggagctgccgga

SEQ ID NO: 9005189 - DNA, 22 bp, Homo sapiens
aggctcaggaggagctgccgga

SEQ ID NO: 9005190 - DNA, 22 bp, Homo sapiens
aggctcagctggtggtgatcgc

SEQ ID NO: 9005191 - DNA, 20 bp, Homo sapiens
aggctcagctgagctcttgg

SEQ ID NO: 9005192 - DNA, 22 bp, Homo sapiens
aggctcagctggtggtgatcgc

SEQ ID NO: 9005193 - DNA, 22 bp, Homo sapiens
aggctcagacaggaaaagtaac

SEQ ID NO: 9005194 - DNA, 20 bp, Homo sapiens
aggctcagctgagctcttgg

SEQ ID NO: 9005195 - DNA, 20 bp, Homo sapiens
aggctcagctgagctcttgg

SEQ ID NO: 9005196 - DNA, 20 bp, Homo sapiens
aggctcagctgagctcttgg

SEQ ID NO: 9005197 - DNA, 20 bp, Homo sapiens
aggctcagctgagctcttgg

SEQ ID NO: 9005198 - DNA, 20 bp, Homo sapiens
aggctcagctgagctcttgg

SEQ ID NO: 9005199 - DNA, 20 bp, Homo sapiens
aggctcagctgagctcttgg

SEQ ID NO: 9005200 - DNA, 22 bp, Homo sapiens
aggctgtgatgagcctcatgga

SEQ ID NO: 9005201 - DNA, 22 bp, Homo sapiens
aggctgtgatgagcctcatgga

SEQ ID NO: 9005202 - DNA, 22 bp, Homo sapiens
aggctgtgatgagcctcatgga

SEQ ID NO: 9005203 - DNA, 22 bp, Homo sapiens
aggctgtgatgagcctcatgga

SEQ ID NO: 9005204 - DNA, 22 bp, Homo sapiens
aggctgtgattccaccactctc

SEQ ID NO: 9005205 - DNA, 22 bp, Homo sapiens
aggctgtgattccaccactctc

SEQ ID NO: 9005206 - DNA, 22 bp, Homo sapiens
accacaggacccatgagtcagt

SEQ ID NO: 9005207 - DNA, 22 bp, Homo sapiens
accactgcccatggtgaaaact

SEQ ID NO: 9005208 - DNA, 22 bp, Homo sapiens
accacaggacccatgagtcagt

SEQ ID NO: 9005209 - DNA, 22 bp, Homo sapiens
accacaggacccatgagtcagt

SEQ ID NO: 9005210 - DNA, 22 bp, Homo sapiens
accactggctcaggagctggga

SEQ ID NO: 9005211 - DNA, 22 bp, Homo sapiens
accactgggcgggcagcctgct

SEQ ID NO: 9005212 - DNA, 22 bp, Homo sapiens
accactggatatcagagatgta

SEQ ID NO: 9005213 - DNA, 19 bp, Homo sapiens
accactggccacacactcc

SEQ ID NO: 9005214 - DNA, 21 bp, Homo sapiens
accactgcctccaaggttcag

SEQ ID NO: 9005215 - DNA, 22 bp, Homo sapiens
accactgcccatggtgaaaact

SEQ ID NO: 9005216 - DNA, 22 bp, Homo sapiens
accactgcccatggtgaaaact

SEQ ID NO: 9005217 - DNA, 22 bp, Homo sapiens
accactgcccatggtgaaaact

SEQ ID NO: 9005218 - DNA, 22 bp, Homo sapiens
accagacactgtgaagacaggc

SEQ ID NO: 9005219 - DNA, 22 bp, Homo sapiens
accagacactgtgaagacaggc

SEQ ID NO: 9005220 - DNA, 22 bp, Homo sapiens
accagaagttctccaaaaagat

SEQ ID NO: 9005221 - DNA, 22 bp, Homo sapiens
accagaagttctccaaaaagat

SEQ ID NO: 9005222 - DNA, 22 bp, Homo sapiens
accagaaggaccagaggcaagg

SEQ ID NO: 9005223 - DNA, 22 bp, Homo sapiens
accagaagacagaaatattatt

SEQ ID NO: 9005224 - DNA, 22 bp, Homo sapiens
accagaagacagaaatattatt

SEQ ID NO: 9005225 - DNA, 22 bp, Homo sapiens
accagaaaggaataatagaatt

SEQ ID NO: 9005226 - DNA, 22 bp, Homo sapiens
accagaaaggaataatagaatt

SEQ ID NO: 9005227 - DNA, 22 bp, Homo sapiens
accactgtctacacattgactc

SEQ ID NO: 9005228 - DNA, 22 bp, Homo sapiens
accacttatcatcactatctca

SEQ ID NO: 9005229 - DNA, 22 bp, Homo sapiens
accactttggtatttcaatttt

SEQ ID NO: 9005230 - DNA, 22 bp, Homo sapiens
accactggttttgcagaggcgc

SEQ ID NO: 9005231 - DNA, 22 bp, Homo sapiens
aggctggctttggtagcatggt

SEQ ID NO: 9005232 - DNA, 22 bp, Homo sapiens
aggctggctttggtagcatggt

SEQ ID NO: 9005233 - DNA, 22 bp, Homo sapiens
aggctgggaaacctgaagttgt

SEQ ID NO: 9005234 - DNA, 22 bp, Homo sapiens
aggctgggaaacctgaagttgt

SEQ ID NO: 9005235 - DNA, 22 bp, Homo sapiens
aggctgggaaacctgaagttgt

SEQ ID NO: 9005236 - DNA, 22 bp, Homo sapiens
aggctgggaaacctgaagttgt

SEQ ID NO: 9005237 - DNA, 22 bp, Homo sapiens
aggctgggaaacctgaagttgt

SEQ ID NO: 9005238 - DNA, 22 bp, Homo sapiens
aggctggctttggtagcatggt

SEQ ID NO: 9005239 - DNA, 22 bp, Homo sapiens
aggctggctttggtagcatggt

SEQ ID NO: 9005240 - DNA, 22 bp, Homo sapiens
aggctggcttggctctcctgtg

SEQ ID NO: 9005241 - DNA, 22 bp, Homo sapiens
aggctggcttggctctcctgtg

SEQ ID NO: 9005242 - DNA, 22 bp, Homo sapiens
aggctggctttggtagcatggt

SEQ ID NO: 9005243 - DNA, 22 bp, Homo sapiens
aggctgggaaatgtagtcttcc

SEQ ID NO: 9005244 - DNA, 22 bp, Homo sapiens
aggctgggaaatgtagtcttcc

SEQ ID NO: 9005245 - DNA, 22 bp, Homo sapiens
aggctgggaaacctgaagttgt

SEQ ID NO: 9005246 - DNA, 22 bp, Homo sapiens
aggctgggaaatgtagtcttcc

SEQ ID NO: 9005247 - DNA, 22 bp, Homo sapiens
aggctgggaaatgtagtcttcc

SEQ ID NO: 9005248 - DNA, 22 bp, Homo sapiens
aggctgggaaatgtagtcttcc

SEQ ID NO: 9005249 - DNA, 22 bp, Homo sapiens
aggctgggaaatgtagtcttcc

SEQ ID NO: 9005250 - DNA, 22 bp, Homo sapiens
aggctgggaaatgtagtcttcc

SEQ ID NO: 9005251 - DNA, 22 bp, Homo sapiens
aggctgggaaatgtattccagc

SEQ ID NO: 9005252 - DNA, 22 bp, Homo sapiens
aggctgggaaatgtattccagc

SEQ ID NO: 9005253 - DNA, 22 bp, Homo sapiens
aggctgggaaatgtattccagc

SEQ ID NO: 9005254 - DNA, 22 bp, Homo sapiens
aggctgggaaatgtattccagc

SEQ ID NO: 9005255 - DNA, 22 bp, Homo sapiens
aggctgggaaatgtattccagc

SEQ ID NO: 9005256 - DNA, 22 bp, Homo sapiens
aggctgggaaatgtattccagc

SEQ ID NO: 9005257 - DNA, 22 bp, Homo sapiens
aggctgggaaatgtagtcttcc

SEQ ID NO: 9005258 - DNA, 22 bp, Homo sapiens
aggctgggaaatgtagtcttcc

SEQ ID NO: 9005259 - DNA, 19 bp, Homo sapiens
aggctgtgaggggaaggaa

SEQ ID NO: 9005260 - DNA, 19 bp, Homo sapiens
aggctgtgaggggaaggaa

SEQ ID NO: 9005261 - DNA, 19 bp, Homo sapiens
aggctgtgaggggaaggaa

SEQ ID NO: 9005262 - DNA, 19 bp, Homo sapiens
aggctgtgagggaggactc

SEQ ID NO: 9005263 - DNA, 19 bp, Homo sapiens
aggctgtgagggaggactc

SEQ ID NO: 9005264 - DNA, 19 bp, Homo sapiens
aggctgtgagggaggactc

SEQ ID NO: 9005265 - DNA, 22 bp, Homo sapiens
aggctgtgagtagttcttgttg

SEQ ID NO: 9005266 - DNA, 22 bp, Homo sapiens
aggctgtgagttttgtctcaga

SEQ ID NO: 9005267 - DNA, 22 bp, Homo sapiens
aggctgtgagttttgtctcaga

SEQ ID NO: 9005268 - DNA, 22 bp, Homo sapiens
aggctgtgagaagtccttcagt

SEQ ID NO: 9005269 - DNA, 22 bp, Homo sapiens
aggctgtgagaggtggctccca

SEQ ID NO: 9005270 - DNA, 22 bp, Homo sapiens
aggctgtgagaggtggctccca

SEQ ID NO: 9005271 - DNA, 22 bp, Homo sapiens
aggctgtgagaagtccttcagt

SEQ ID NO: 9005272 - DNA, 22 bp, Homo sapiens
aggctgtgagaagtccttcagt

SEQ ID NO: 9005273 - DNA, 22 bp, Homo sapiens
aggctgtgagcaagaacaccta

SEQ ID NO: 9005274 - DNA, 19 bp, Homo sapiens
aggctgtgagggaggactc

SEQ ID NO: 9005275 - DNA, 22 bp, Homo sapiens
aggctgtgagaggtggctccca

SEQ ID NO: 9005276 - DNA, 22 bp, Homo sapiens
aggctgtgagcaagaacaccta

SEQ ID NO: 9005277 - DNA, 19 bp, Homo sapiens
aggctgtgagggaggactc

SEQ ID NO: 9005278 - DNA, 19 bp, Homo sapiens
aggctgtgagggaggactc

SEQ ID NO: 9005279 - DNA, 19 bp, Homo sapiens
aggctgtgagggaggactc

SEQ ID NO: 9005280 - DNA, 22 bp, Homo sapiens
aggctggcttcccaagcgtcct

SEQ ID NO: 9005281 - DNA, 22 bp, Homo sapiens
aggctggcttggctctcctgtg

SEQ ID NO: 9005282 - DNA, 22 bp, Homo sapiens
aggctggcttggctctcctgtg

SEQ ID NO: 9005283 - DNA, 23 bp, Homo sapiens
aggctggcttcaggagcctctcc

SEQ ID NO: 9005284 - DNA, 23 bp, Homo sapiens
aggctggcttcaggagcctctcc

SEQ ID NO: 9005285 - DNA, 23 bp, Homo sapiens
aggctggcttcaggagcctctcc

SEQ ID NO: 9005286 - DNA, 23 bp, Homo sapiens
aggctggcttcaggagcctctcc

SEQ ID NO: 9005287 - DNA, 23 bp, Homo sapiens
aggctggcttcaggagcctctcc

SEQ ID NO: 9005288 - DNA, 22 bp, Homo sapiens
aggctggcttcccaagcgtcct

SEQ ID NO: 9005289 - DNA, 22 bp, Homo sapiens
aggctggcttcccaagcgtcct

SEQ ID NO: 9005290 - DNA, 22 bp, Homo sapiens
aggctggccagtgctgcagtgg

SEQ ID NO: 9005291 - DNA, 22 bp, Homo sapiens
aggctggctggggatgcgtctt

SEQ ID NO: 9005292 - DNA, 23 bp, Homo sapiens
aggctggcttcaggagcctctcc

SEQ ID NO: 9005293 - DNA, 23 bp, Homo sapiens
aggctggcttcaggagcctctcc

SEQ ID NO: 9005294 - DNA, 22 bp, Homo sapiens
aggctggccagtgctgcagtgg

SEQ ID NO: 9005295 - DNA, 22 bp, Homo sapiens
aggctggccagtgctgcagtgg

SEQ ID NO: 9005296 - DNA, 22 bp, Homo sapiens
acatttctcaggtaagtcattt

SEQ ID NO: 9005297 - DNA, 22 bp, Homo sapiens
acatttctcaggtaagtcattt

SEQ ID NO: 9005298 - DNA, 22 bp, Homo sapiens
acatttctcaggtaagtcattt

SEQ ID NO: 9005299 - DNA, 22 bp, Homo sapiens
aggctgcttcaatggataagat

SEQ ID NO: 9005300 - DNA, 22 bp, Homo sapiens
acatttctcataggagagccac

SEQ ID NO: 9005301 - DNA, 22 bp, Homo sapiens
acatttctcaggtaagtcattt

SEQ ID NO: 9005302 - DNA, 22 bp, Homo sapiens
acatttctccctgcatgcctgc

SEQ ID NO: 9005303 - DNA, 22 bp, Homo sapiens
acatttctccctgcatgcctgc

SEQ ID NO: 9005304 - DNA, 22 bp, Homo sapiens
acatttctccctgcatgcctgc

SEQ ID NO: 9005305 - DNA, 22 bp, Homo sapiens
acatttctcattctcccctaac

SEQ ID NO: 9005306 - DNA, 22 bp, Homo sapiens
acatttctccctgcatgcctgc

SEQ ID NO: 9005307 - DNA, 18 bp, Homo sapiens
acatttctccttctgacc

SEQ ID NO: 9005308 - DNA, 18 bp, Homo sapiens
acatttctccttctgacc

SEQ ID NO: 9005309 - DNA, 18 bp, Homo sapiens
acatttctccttctgacc

SEQ ID NO: 9005310 - DNA, 22 bp, Homo sapiens
aggctgctgctctacagttgct

SEQ ID NO: 9005311 - DNA, 22 bp, Homo sapiens
aggctgctgccttggagagtgt

SEQ ID NO: 9005312 - DNA, 22 bp, Homo sapiens
aggctgctgctctacagttgct

SEQ ID NO: 9005313 - DNA, 22 bp, Homo sapiens
aggctgctggaggatttatgcc

SEQ ID NO: 9005314 - DNA, 22 bp, Homo sapiens
aggctgctggaggatttatgcc

SEQ ID NO: 9005315 - DNA, 22 bp, Homo sapiens
aggctgctggcaggcgtggacg

SEQ ID NO: 9005316 - DNA, 22 bp, Homo sapiens
aggctgctggaggatttatgcc

SEQ ID NO: 9005317 - DNA, 22 bp, Homo sapiens
aggctgctgccttggagagtgt

SEQ ID NO: 9005318 - DNA, 22 bp, Homo sapiens
aggctgctgccttggagagtgt

SEQ ID NO: 9005319 - DNA, 22 bp, Homo sapiens
aggctgctggcaggcgtggacg

SEQ ID NO: 9005320 - DNA, 22 bp, Homo sapiens
aggctgctggcaggcgtggacg

SEQ ID NO: 9005321 - DNA, 22 bp, Homo sapiens
aggctgctggctaagaataaga

SEQ ID NO: 9005322 - DNA, 21 bp, Homo sapiens
aggctgctggctcagggtcct

SEQ ID NO: 9005323 - DNA, 22 bp, Homo sapiens
aggctgctggctaagaataaga

SEQ ID NO: 9005324 - DNA, 22 bp, Homo sapiens
aggctgctggcaggcgtggacg

SEQ ID NO: 9005325 - DNA, 21 bp, Homo sapiens
aggctgctggctcagggtcct

SEQ ID NO: 9005326 - DNA, 22 bp, Homo sapiens
aggctgcttcagctgcagggag

SEQ ID NO: 9005327 - DNA, 22 bp, Homo sapiens
aggctgcttcagctgcagggag

SEQ ID NO: 9005328 - DNA, 22 bp, Homo sapiens
aggctgcttcagctgcagggag

SEQ ID NO: 9005329 - DNA, 22 bp, Homo sapiens
aggctgcttcagctgcagggag

SEQ ID NO: 9005330 - DNA, 22 bp, Homo sapiens
acatttctcagggagttttgct

SEQ ID NO: 9005331 - DNA, 22 bp, Homo sapiens
acatttctcagggagttttgct

SEQ ID NO: 9005332 - DNA, 22 bp, Homo sapiens
aggctgcttcagctgcagggag

SEQ ID NO: 9005333 - DNA, 21 bp, Homo sapiens
aggctgctggctcagggtcct

SEQ ID NO: 9005334 - DNA, 21 bp, Homo sapiens
aggctgctggctcagggtcct

SEQ ID NO: 9005335 - DNA, 17 bp, Homo sapiens
aggctgctgggccaggg

SEQ ID NO: 9005336 - DNA, 17 bp, Homo sapiens
aggctgctgggccaggg

SEQ ID NO: 9005337 - DNA, 23 bp, Homo sapiens
aggctgcttactggtatcagagc

SEQ ID NO: 9005338 - DNA, 17 bp, Homo sapiens
aggctgctgggccaggg

SEQ ID NO: 9005339 - DNA, 22 bp, Homo sapiens
aggctgcttcaatggataagat

SEQ ID NO: 9005340 - DNA, 17 bp, Homo sapiens
aggctgctgggccaggg

SEQ ID NO: 9005341 - DNA, 23 bp, Homo sapiens
aggctgcttactggtatcagagc

SEQ ID NO: 9005342 - DNA, 23 bp, Homo sapiens
aggctgcagaagaatagggtcat

SEQ ID NO: 9005343 - DNA, 22 bp, Homo sapiens
aggctgctctgcgaagtcagct

SEQ ID NO: 9005344 - DNA, 21 bp, Homo sapiens
aggctgctctttcttgtggta

SEQ ID NO: 9005345 - DNA, 22 bp, Homo sapiens
aggctgctctgcgaagtcagct

SEQ ID NO: 9005346 - DNA, 22 bp, Homo sapiens
aggctgctctgcgaagtcagct

SEQ ID NO: 9005347 - DNA, 21 bp, Homo sapiens
aggctgctctttcttgtggta

SEQ ID NO: 9005348 - DNA, 22 bp, Homo sapiens
aggctgctgaggccaccacgct

SEQ ID NO: 9005349 - DNA, 21 bp, Homo sapiens
aggctgctctttcttgtggta

SEQ ID NO: 9005350 - DNA, 22 bp, Homo sapiens
aggctgctgaggccaccacgct

SEQ ID NO: 9005351 - DNA, 23 bp, Homo sapiens
aggctgctgagatgggtgtgtca

SEQ ID NO: 9005352 - DNA, 23 bp, Homo sapiens
aggctgctgagatgggtgtgtca

SEQ ID NO: 9005353 - DNA, 21 bp, Homo sapiens
aggctgctctttcttgtggta

SEQ ID NO: 9005354 - DNA, 22 bp, Homo sapiens
aggctctggcaacagctggtgt

SEQ ID NO: 9005355 - DNA, 22 bp, Homo sapiens
aggctctggcaacagctggtgt

SEQ ID NO: 9005356 - DNA, 22 bp, Homo sapiens
aggctctggcaacagctggtgt

SEQ ID NO: 9005357 - DNA, 22 bp, Homo sapiens
aggctctggagttagccaggca

SEQ ID NO: 9005358 - DNA, 22 bp, Homo sapiens
aggctctggagttagccaggca

SEQ ID NO: 9005359 - DNA, 22 bp, Homo sapiens
aggctctggctactacagagct

SEQ ID NO: 9005360 - DNA, 22 bp, Homo sapiens
aggctgcagaacagtcaggtgc

SEQ ID NO: 9005361 - DNA, 22 bp, Homo sapiens
aggctgcagaacagtcaggtgc

SEQ ID NO: 9005362 - DNA, 22 bp, Homo sapiens
aggctctggcaacagctggtgt

SEQ ID NO: 9005363 - DNA, 22 bp, Homo sapiens
aggctctggctactacagagct

SEQ ID NO: 9005364 - DNA, 22 bp, Homo sapiens
acaggacaaggggaagaagata

SEQ ID NO: 9005365 - DNA, 22 bp, Homo sapiens
acaggacaggctgggctagact

SEQ ID NO: 9005366 - DNA, 22 bp, Homo sapiens
acaggacaactcagcagccagc

SEQ ID NO: 9005367 - DNA, 22 bp, Homo sapiens
acaggacaactcagcagccagc

SEQ ID NO: 9005368 - DNA, 22 bp, Homo sapiens
acaggacaaaaatctggatggc

SEQ ID NO: 9005369 - DNA, 22 bp, Homo sapiens
acaggacaaaaatctggatggc

SEQ ID NO: 9005370 - DNA, 22 bp, Homo sapiens
acaggaagtttggaaagcctca

SEQ ID NO: 9005371 - DNA, 22 bp, Homo sapiens
acaggaataaaaggaataagga

SEQ ID NO: 9005372 - DNA, 22 bp, Homo sapiens
acaggaagtttggaaagcctca

SEQ ID NO: 9005373 - DNA, 22 bp, Homo sapiens
acaggaagtgggaagaaacagg

SEQ ID NO: 9005374 - DNA, 22 bp, Homo sapiens
acaggaagtgggaagaaacagg

SEQ ID NO: 9005375 - DNA, 22 bp, Homo sapiens
acaggaagtttggaaagcctca

SEQ ID NO: 9005376 - DNA, 22 bp, Homo sapiens
acaggaagtttggaaagcctca

SEQ ID NO: 9005377 - DNA, 22 bp, Homo sapiens
acaggaagtttggaaagcctca

SEQ ID NO: 9005378 - DNA, 22 bp, Homo sapiens
acaggaagtgggaagaaacagg

SEQ ID NO: 9005379 - DNA, 22 bp, Homo sapiens
acaggaagtgggaagaaacagg

SEQ ID NO: 9005380 - DNA, 22 bp, Homo sapiens
acaggaagtgctggcacttaca

SEQ ID NO: 9005381 - DNA, 22 bp, Homo sapiens
acaggaagctggagacccttga

SEQ ID NO: 9005382 - DNA, 22 bp, Homo sapiens
acaggaagtgctggcacttaca

SEQ ID NO: 9005383 - DNA, 22 bp, Homo sapiens
acaggaagctggagacccttga

SEQ ID NO: 9005384 - DNA, 22 bp, Homo sapiens
acaggaagtgctggcacttaca

SEQ ID NO: 9005385 - DNA, 22 bp, Homo sapiens
acaggaagaaagtgcagtagat

SEQ ID NO: 9005386 - DNA, 22 bp, Homo sapiens
acaggaagaaagtgcagtagat

SEQ ID NO: 9005387 - DNA, 22 bp, Homo sapiens
acaggaagaaagtgcagtagat

SEQ ID NO: 9005388 - DNA, 22 bp, Homo sapiens
acaggaagaaagtgcagtagat

SEQ ID NO: 9005389 - DNA, 22 bp, Homo sapiens
acagcttctcctcgatgtcatg

SEQ ID NO: 9005390 - DNA, 22 bp, Homo sapiens
acagcttctctgaaattcatgt

SEQ ID NO: 9005391 - DNA, 22 bp, Homo sapiens
acagcttctcctcgatgtcatg

SEQ ID NO: 9005392 - DNA, 22 bp, Homo sapiens
acagcttctatttctctgtact

SEQ ID NO: 9005393 - DNA, 22 bp, Homo sapiens
acagcttctatttctctgtact

SEQ ID NO: 9005394 - DNA, 20 bp, Homo sapiens
acagccagaggaggcagaca

SEQ ID NO: 9005395 - DNA, 22 bp, Homo sapiens
acagcttcgaggatctcatccc

SEQ ID NO: 9005396 - DNA, 22 bp, Homo sapiens
acaggaagaaagtgcagtagat

SEQ ID NO: 9005397 - DNA, 22 bp, Homo sapiens
acaggaagaaagtgcagtagat

SEQ ID NO: 9005398 - DNA, 22 bp, Homo sapiens
acaggaacgaatgtacattgtt

SEQ ID NO: 9005399 - DNA, 22 bp, Homo sapiens
acaggaactgttatctcagatg

SEQ ID NO: 9005400 - DNA, 22 bp, Homo sapiens
acagcatcatatagtggaagaa

SEQ ID NO: 9005401 - DNA, 22 bp, Homo sapiens
acagcatcatatagtggaagaa

SEQ ID NO: 9005402 - DNA, 22 bp, Homo sapiens
acagcataatcacttctttctt

SEQ ID NO: 9005403 - DNA, 22 bp, Homo sapiens
acagcagtttagaggacagcca

SEQ ID NO: 9005404 - DNA, 22 bp, Homo sapiens
acagcagtttagaggacagcca

SEQ ID NO: 9005405 - DNA, 22 bp, Homo sapiens
acagcagtttagaggacagcca

SEQ ID NO: 9005406 - DNA, 22 bp, Homo sapiens
acagcatccttctaaagtagct

SEQ ID NO: 9005407 - DNA, 22 bp, Homo sapiens
acagcatcatatagtggaagaa

SEQ ID NO: 9005408 - DNA, 22 bp, Homo sapiens
acagcatccctgaagataacca

SEQ ID NO: 9005409 - DNA, 22 bp, Homo sapiens
acagcatctagtacagtctagt

SEQ ID NO: 9005410 - DNA, 22 bp, Homo sapiens
acagcatctagtacagtctagt

SEQ ID NO: 9005411 - DNA, 22 bp, Homo sapiens
acagcatgagagatgaacattc

SEQ ID NO: 9005412 - DNA, 22 bp, Homo sapiens
acagcatggataacaaggcact

SEQ ID NO: 9005413 - DNA, 22 bp, Homo sapiens
acagcatgtctagttaaatact

SEQ ID NO: 9005414 - DNA, 22 bp, Homo sapiens
acagcagttcaggccgcagagg

SEQ ID NO: 9005415 - DNA, 22 bp, Homo sapiens
acagcagtttagaggacagcca

SEQ ID NO: 9005416 - DNA, 22 bp, Homo sapiens
acagcagttactgaaataaagt

SEQ ID NO: 9005417 - DNA, 22 bp, Homo sapiens
acagcagttactgaaataaagt

SEQ ID NO: 9005418 - DNA, 22 bp, Homo sapiens
acagcagttaacgatcagactc

SEQ ID NO: 9005419 - DNA, 22 bp, Homo sapiens
acagcagttaacgatcagactc

SEQ ID NO: 9005420 - DNA, 22 bp, Homo sapiens
acagcagttaacgatcagactc

SEQ ID NO: 9005421 - DNA, 22 bp, Homo sapiens
acagcagttaacgatcagactc

SEQ ID NO: 9005422 - DNA, 22 bp, Homo sapiens
acagcagtgggttgccagtggg

SEQ ID NO: 9005423 - DNA, 22 bp, Homo sapiens
acagcagtggtgcactgagcca

SEQ ID NO: 9005424 - DNA, 22 bp, Homo sapiens
acagcagtggtgcactgagcca

SEQ ID NO: 9005425 - DNA, 22 bp, Homo sapiens
acagcagtggtgcactgagcca

SEQ ID NO: 9005426 - DNA, 22 bp, Homo sapiens
acagcagtgtctggtactgagt

SEQ ID NO: 9005427 - DNA, 22 bp, Homo sapiens
acagcagtgtctggtactgagt

SEQ ID NO: 9005428 - DNA, 22 bp, Homo sapiens
acagcagtgtctggtactgagt

SEQ ID NO: 9005429 - DNA, 20 bp, Homo sapiens
acagccagaggaggcagaca

SEQ ID NO: 9005430 - DNA, 22 bp, Homo sapiens
acagccagaggagccaggctgg

SEQ ID NO: 9005431 - DNA, 22 bp, Homo sapiens
acagccagaggagccaggctgg

SEQ ID NO: 9005432 - DNA, 22 bp, Homo sapiens
acagccagaggagccaggctgg

SEQ ID NO: 9005433 - DNA, 22 bp, Homo sapiens
acagccagaggagccaggctgg

SEQ ID NO: 9005434 - DNA, 22 bp, Homo sapiens
acagccagaggagccaggctgg

SEQ ID NO: 9005435 - DNA, 22 bp, Homo sapiens
acagccagaagtcagggtggga

SEQ ID NO: 9005436 - DNA, 22 bp, Homo sapiens
acagccagaagtcagggtggga

SEQ ID NO: 9005437 - DNA, 22 bp, Homo sapiens
acagccactcaaagggccgaag

SEQ ID NO: 9005438 - DNA, 22 bp, Homo sapiens
acagccaaggaattaggaaggg

SEQ ID NO: 9005439 - DNA, 22 bp, Homo sapiens
acagcattcaataaataataac

SEQ ID NO: 9005440 - DNA, 22 bp, Homo sapiens
acagcattcaataaataataac

SEQ ID NO: 9005441 - DNA, 22 bp, Homo sapiens
acagcattccctttggctgctt

SEQ ID NO: 9005442 - DNA, 22 bp, Homo sapiens
acagcattccctttggctgctt

SEQ ID NO: 9005443 - DNA, 21 bp, Homo sapiens
acagcatgtttgtgtgtttgc

SEQ ID NO: 9005444 - DNA, 21 bp, Homo sapiens
acagcatgtttgtgtgtttgc

SEQ ID NO: 9005445 - DNA, 22 bp, Homo sapiens
acagcattcaataaataataac

SEQ ID NO: 9005446 - DNA, 22 bp, Homo sapiens
acagcatttaaagaaaatgaac

SEQ ID NO: 9005447 - DNA, 22 bp, Homo sapiens
acagcatttaaagaaaatgaac

SEQ ID NO: 9005448 - DNA, 22 bp, Homo sapiens
acagcatttaaagaaaatgaac

SEQ ID NO: 9005449 - DNA, 22 bp, Homo sapiens
acagcatttaaagaaaatgaac

SEQ ID NO: 9005450 - DNA, 22 bp, Homo sapiens
acagcattgctccatctcaaga

SEQ ID NO: 9005451 - DNA, 22 bp, Homo sapiens
acagcattgctccatctcaaga

SEQ ID NO: 9005452 - DNA, 22 bp, Homo sapiens
acaggactagatgataaaatgt

SEQ ID NO: 9005453 - DNA, 22 bp, Homo sapiens
acaggactctctgaaaatgtac

SEQ ID NO: 9005454 - DNA, 22 bp, Homo sapiens
acaggacatgtaccaggtggtc

SEQ ID NO: 9005455 - DNA, 22 bp, Homo sapiens
acaggacatggcttctgtgacg

SEQ ID NO: 9005456 - DNA, 22 bp, Homo sapiens
acaggacaggtaggattcgcag

SEQ ID NO: 9005457 - DNA, 22 bp, Homo sapiens
acaggacaggctgggctagact

SEQ ID NO: 9005458 - DNA, 22 bp, Homo sapiens
acaggacaggctgggctagact

SEQ ID NO: 9005459 - DNA, 22 bp, Homo sapiens
acaggacagtctagtaacagta

SEQ ID NO: 9005460 - DNA, 22 bp, Homo sapiens
acaggacagtctagtaacagta

SEQ ID NO: 9005461 - DNA, 22 bp, Homo sapiens
acaggacagtctagtaacagta

SEQ ID NO: 9005462 - DNA, 22 bp, Homo sapiens
acaggacatggcttctgtgacg

SEQ ID NO: 9005463 - DNA, 22 bp, Homo sapiens
acaggacagtctagtaacagta

SEQ ID NO: 9005464 - DNA, 22 bp, Homo sapiens
acaggacatggcttctgtgacg

SEQ ID NO: 9005465 - DNA, 22 bp, Homo sapiens
agcttcttctgatttgtcagtc

SEQ ID NO: 9005466 - DNA, 22 bp, Homo sapiens
agcttcttctgatttgtcagtc

SEQ ID NO: 9005467 - DNA, 22 bp, Homo sapiens
agcttcttcttggtctttccca

SEQ ID NO: 9005468 - DNA, 22 bp, Homo sapiens
agcttcttcttggtctttccca

SEQ ID NO: 9005469 - DNA, 22 bp, Homo sapiens
agcttcttgggctttacacaaa

SEQ ID NO: 9005470 - DNA, 22 bp, Homo sapiens
agcttcttggctcagcacttgg

SEQ ID NO: 9005471 - DNA, 22 bp, Homo sapiens
agcttcttggctcagcacttgg

SEQ ID NO: 9005472 - DNA, 22 bp, Homo sapiens
agcttcttgaccaagcctgtaa

SEQ ID NO: 9005473 - DNA, 22 bp, Homo sapiens
agcttcttgacggatgttctgg

SEQ ID NO: 9005474 - DNA, 22 bp, Homo sapiens
agcttcttgacggatgttctgg

SEQ ID NO: 9005475 - DNA, 22 bp, Homo sapiens
acaggagaaatctggtcaaaag

SEQ ID NO: 9005476 - DNA, 22 bp, Homo sapiens
acaggagaaatctggtcaaaag

SEQ ID NO: 9005477 - DNA, 22 bp, Homo sapiens
acaggagaaatctggtcaaaag

SEQ ID NO: 9005478 - DNA, 22 bp, Homo sapiens
agcttccacatctgtcttcagt

SEQ ID NO: 9005479 - DNA, 22 bp, Homo sapiens
agcttccacatctgtcttcagt

SEQ ID NO: 9005480 - DNA, 22 bp, Homo sapiens
agcttccacatctgtcttcagt

SEQ ID NO: 9005481 - DNA, 22 bp, Homo sapiens
agcttccacatctgtcttcagt

SEQ ID NO: 9005482 - DNA, 21 bp, Homo sapiens
agcttccagagcacattccat

SEQ ID NO: 9005483 - DNA, 22 bp, Homo sapiens
agcttccatactaagacaaaag

SEQ ID NO: 9005484 - DNA, 22 bp, Homo sapiens
agcttcttcaaagcaggaggcc

SEQ ID NO: 9005485 - DNA, 22 bp, Homo sapiens
agcttcttagttcacttttaat

SEQ ID NO: 9005486 - DNA, 22 bp, Homo sapiens
agcttcttctattttggggcca

SEQ ID NO: 9005487 - DNA, 22 bp, Homo sapiens
agcttcttccaggcagtgactc

SEQ ID NO: 9005488 - DNA, 22 bp, Homo sapiens
acaggcaagtacacaggctcat

SEQ ID NO: 9005489 - DNA, 22 bp, Homo sapiens
acaggcaaggccagtgagaaat

SEQ ID NO: 9005490 - DNA, 22 bp, Homo sapiens
acaggcaagaggaaagcaagta

SEQ ID NO: 9005491 - DNA, 22 bp, Homo sapiens
acaggatttcaccatgttggcc

SEQ ID NO: 9005492 - DNA, 21 bp, Homo sapiens
acaggcaaattttagacaatg

SEQ ID NO: 9005493 - DNA, 22 bp, Homo sapiens
acaggcaacttcaaatctcact

SEQ ID NO: 9005494 - DNA, 22 bp, Homo sapiens
acaggcaaagggtcagtagcag

SEQ ID NO: 9005495 - DNA, 21 bp, Homo sapiens
acaggcaaattttagacaatg

SEQ ID NO: 9005496 - DNA, 22 bp, Homo sapiens
aggaaagaagtacattctcatg

SEQ ID NO: 9005497 - DNA, 18 bp, Homo sapiens
aggaaagaaaggcaggtg

SEQ ID NO: 9005498 - DNA, 22 bp, Homo sapiens
aggaaagaagtacattctcatg

SEQ ID NO: 9005499 - DNA, 22 bp, Homo sapiens
aggaaagaagtacattctcatg

SEQ ID NO: 9005500 - DNA, 18 bp, Homo sapiens
aggaaagaaaggcaggtg

SEQ ID NO: 9005501 - DNA, 22 bp, Homo sapiens
acaggcacaccttcctgcaggc

SEQ ID NO: 9005502 - DNA, 22 bp, Homo sapiens
acaggcacaactgagtagactc

SEQ ID NO: 9005503 - DNA, 22 bp, Homo sapiens
acaggcaattagcaagctgtta

SEQ ID NO: 9005504 - DNA, 22 bp, Homo sapiens
acaggcaagtcacacaacttgt

SEQ ID NO: 9005505 - DNA, 22 bp, Homo sapiens
agcttctttaattcagcatgat

SEQ ID NO: 9005506 - DNA, 19 bp, Homo sapiens
agcttctttggaaacattt

SEQ ID NO: 9005507 - DNA, 19 bp, Homo sapiens
agcttctttggaaacattt

SEQ ID NO: 9005508 - DNA, 22 bp, Homo sapiens
agcttctttgtgggctccagaa

SEQ ID NO: 9005509 - DNA, 22 bp, Homo sapiens
agcttcttttacagctcatgct

SEQ ID NO: 9005510 - DNA, 22 bp, Homo sapiens
acaggatcgccctgttgcccag

SEQ ID NO: 9005511 - DNA, 22 bp, Homo sapiens
acaggatgagaatatcatattt

SEQ ID NO: 9005512 - DNA, 22 bp, Homo sapiens
acaggatcgccctgttgcccag

SEQ ID NO: 9005513 - DNA, 22 bp, Homo sapiens
acaggatggccagctgatattg

SEQ ID NO: 9005514 - DNA, 22 bp, Homo sapiens
acaggatggagataatagaaaa

SEQ ID NO: 9005515 - DNA, 22 bp, Homo sapiens
acaggatgataaaggatggcca

SEQ ID NO: 9005516 - DNA, 22 bp, Homo sapiens
acaggatgataaaggatggcca

SEQ ID NO: 9005517 - DNA, 20 bp, Homo sapiens
acaggatgcctgccatttca

SEQ ID NO: 9005518 - DNA, 22 bp, Homo sapiens
acaggattactggattatgaca

SEQ ID NO: 9005519 - DNA, 22 bp, Homo sapiens
acaggattagcaagtaatcagg

SEQ ID NO: 9005520 - DNA, 22 bp, Homo sapiens
acaggatggccagctgatattg

SEQ ID NO: 9005521 - DNA, 22 bp, Homo sapiens
acaggatgggcgcacagagcta

SEQ ID NO: 9005522 - DNA, 22 bp, Homo sapiens
acaggctcagttcactggattt

SEQ ID NO: 9005523 - DNA, 22 bp, Homo sapiens
acaggctcagttcactggattt

SEQ ID NO: 9005524 - DNA, 22 bp, Homo sapiens
acaggctctcagccagttggca

SEQ ID NO: 9005525 - DNA, 22 bp, Homo sapiens
acaggctcgtgcgcgcacgtgt

SEQ ID NO: 9005526 - DNA, 21 bp, Homo sapiens
acaggctctggggatgctggg

SEQ ID NO: 9005527 - DNA, 22 bp, Homo sapiens
acaggctctctattgagtgcag

SEQ ID NO: 9005528 - DNA, 22 bp, Homo sapiens
acaggctctctattgagtgcag

SEQ ID NO: 9005529 - DNA, 22 bp, Homo sapiens
acaggctctctattgagtgcag

SEQ ID NO: 9005530 - DNA, 22 bp, Homo sapiens
acaggctctctattgagtgcag

SEQ ID NO: 9005531 - DNA, 22 bp, Homo sapiens
acagggcaggtggctactggtc

SEQ ID NO: 9005532 - DNA, 22 bp, Homo sapiens
acagggcaggtggctactggtc

SEQ ID NO: 9005533 - DNA, 22 bp, Homo sapiens
acagggcaggtggctactggtc

SEQ ID NO: 9005534 - DNA, 22 bp, Homo sapiens
acagggcacctgaggtaggaag

SEQ ID NO: 9005535 - DNA, 22 bp, Homo sapiens
acagggcacctgaggtaggaag

SEQ ID NO: 9005536 - DNA, 22 bp, Homo sapiens
acagggcacctgaggtaggaag

SEQ ID NO: 9005537 - DNA, 21 bp, Homo sapiens
acaggctctggggatgctggg

SEQ ID NO: 9005538 - DNA, 19 bp, Homo sapiens
acagggcagcaataggata

SEQ ID NO: 9005539 - DNA, 19 bp, Homo sapiens
acagggcagcaataggata

SEQ ID NO: 9005540 - DNA, 23 bp, Homo sapiens
acagggcattgctggcctcgagg

SEQ ID NO: 9005541 - DNA, 22 bp, Homo sapiens
acagggcatttcctctatgtgt

SEQ ID NO: 9005542 - DNA, 23 bp, Homo sapiens
acagggcattgctggcctcgagg

SEQ ID NO: 9005543 - DNA, 22 bp, Homo sapiens
acagggcatgtgcaagagacat

SEQ ID NO: 9005544 - DNA, 22 bp, Homo sapiens
acagggcatgtgcaagagacat

SEQ ID NO: 9005545 - DNA, 22 bp, Homo sapiens
acagggccacatgtaaacagat

SEQ ID NO: 9005546 - DNA, 22 bp, Homo sapiens
acagggccacatgtaaacagat

SEQ ID NO: 9005547 - DNA, 22 bp, Homo sapiens
acagggccacatgtaaacagat

SEQ ID NO: 9005548 - DNA, 22 bp, Homo sapiens
acagggccaatgttagcattga

SEQ ID NO: 9005549 - DNA, 22 bp, Homo sapiens
acagggccaatgttagcattga

SEQ ID NO: 9005550 - DNA, 22 bp, Homo sapiens
acagggccaagtaaaccctacc

SEQ ID NO: 9005551 - DNA, 22 bp, Homo sapiens
acagggccaagtaaaccctacc

SEQ ID NO: 9005552 - DNA, 22 bp, Homo sapiens
acagggcatttcctctatgtgt

SEQ ID NO: 9005553 - DNA, 22 bp, Homo sapiens
acagggcatttcctctatgtgt

SEQ ID NO: 9005554 - DNA, 21 bp, Homo sapiens
acagggcatgcagctggctgt

SEQ ID NO: 9005555 - DNA, 21 bp, Homo sapiens
acagggcatgcagctggctgt

SEQ ID NO: 9005556 - DNA, 22 bp, Homo sapiens
acagggcatgtgcaagagacat

SEQ ID NO: 9005557 - DNA, 22 bp, Homo sapiens
acagggcatgtgcaagagacat

SEQ ID NO: 9005558 - DNA, 22 bp, Homo sapiens
acagggcatgtgcaagagacat

SEQ ID NO: 9005559 - DNA, 22 bp, Homo sapiens
acagggcagtgtcttgaaaaat

SEQ ID NO: 9005560 - DNA, 21 bp, Homo sapiens
acagggcatgcagctggctgt

SEQ ID NO: 9005561 - DNA, 21 bp, Homo sapiens
acagggcatgcagctggctgt

SEQ ID NO: 9005562 - DNA, 21 bp, Homo sapiens
acagggcatgcagctggctgt

SEQ ID NO: 9005563 - DNA, 22 bp, Homo sapiens
aggaaataagggcacttcagat

SEQ ID NO: 9005564 - DNA, 22 bp, Homo sapiens
aggaaataagggacaagacaaa

SEQ ID NO: 9005565 - DNA, 22 bp, Homo sapiens
aggaaataagggcacttcagat

SEQ ID NO: 9005566 - DNA, 22 bp, Homo sapiens
aggaaataagggacaagacaaa

SEQ ID NO: 9005567 - DNA, 22 bp, Homo sapiens
aggaaataagggacaagacaaa

SEQ ID NO: 9005568 - DNA, 22 bp, Homo sapiens
aggaaagtggtgggaaatcagg

SEQ ID NO: 9005569 - DNA, 22 bp, Homo sapiens
aggaaataagggcacttcagat

SEQ ID NO: 9005570 - DNA, 22 bp, Homo sapiens
acaggcctgtgtgcacacgagg

SEQ ID NO: 9005571 - DNA, 22 bp, Homo sapiens
acaggccttggcaggcatgtga

SEQ ID NO: 9005572 - DNA, 22 bp, Homo sapiens
acaggccttggcaggcatgtga

SEQ ID NO: 9005573 - DNA, 22 bp, Homo sapiens
acaggccttaggagagatgggg

SEQ ID NO: 9005574 - DNA, 22 bp, Homo sapiens
acaggcctgtgtgcacacgagg

SEQ ID NO: 9005575 - DNA, 20 bp, Homo sapiens
acaggcgctggggagatggc

SEQ ID NO: 9005576 - DNA, 22 bp, Homo sapiens
acaggcgctggcagagagaaaa

SEQ ID NO: 9005577 - DNA, 22 bp, Homo sapiens
acaggctcacagtcatttcatt

SEQ ID NO: 9005578 - DNA, 22 bp, Homo sapiens
acaggccttggtcctgacctaa

SEQ ID NO: 9005579 - DNA, 22 bp, Homo sapiens
acaggccttggtcctgacctaa

SEQ ID NO: 9005580 - DNA, 22 bp, Homo sapiens
aggaaaggttcagtgattgaaa

SEQ ID NO: 9005581 - DNA, 22 bp, Homo sapiens
aggaaaggttcagtgattgaaa

SEQ ID NO: 9005582 - DNA, 17 bp, Homo sapiens
aggaaagtctgctgtcc

SEQ ID NO: 9005583 - DNA, 17 bp, Homo sapiens
aggaaagtctgctgtcc

SEQ ID NO: 9005584 - DNA, 22 bp, Homo sapiens
aggaaaggttcagtgattgaaa

SEQ ID NO: 9005585 - DNA, 22 bp, Homo sapiens
aggaaaggttcagtgattgaaa

SEQ ID NO: 9005586 - DNA, 22 bp, Homo sapiens
aggaaaggtgagagcggccgcg

SEQ ID NO: 9005587 - DNA, 19 bp, Homo sapiens
aggaaaggtggccttagca

SEQ ID NO: 9005588 - DNA, 19 bp, Homo sapiens
aggaaaggtggccttagca

SEQ ID NO: 9005589 - DNA, 19 bp, Homo sapiens
aggaaaggtggccttagca

SEQ ID NO: 9005590 - DNA, 19 bp, Homo sapiens
aggaaaggtggccttagca

SEQ ID NO: 9005591 - DNA, 22 bp, Homo sapiens
aggaaaggtagcgtgccagcag

SEQ ID NO: 9005592 - DNA, 22 bp, Homo sapiens
aggaaaggtgagagcggccgcg

SEQ ID NO: 9005593 - DNA, 22 bp, Homo sapiens
aggaaaggtagcgtgccagcag

SEQ ID NO: 9005594 - DNA, 22 bp, Homo sapiens
aggaaaggtagcgtgccagcag

SEQ ID NO: 9005595 - DNA, 22 bp, Homo sapiens
aggaaaggtagcgtgccagcag

SEQ ID NO: 9005596 - DNA, 22 bp, Homo sapiens
aggaaaggtagcgtgccagcag

SEQ ID NO: 9005597 - DNA, 22 bp, Homo sapiens
aggaaaggggtaggtgtggacg

SEQ ID NO: 9005598 - DNA, 22 bp, Homo sapiens
aggaaaggggtaggtgtggacg

SEQ ID NO: 9005599 - DNA, 22 bp, Homo sapiens
aggaaaggggtaggtgtggacg

SEQ ID NO: 9005600 - DNA, 22 bp, Homo sapiens
aggaaaggggtaggtgtggacg

SEQ ID NO: 9005601 - DNA, 22 bp, Homo sapiens
aggactggtgccagacaaggta

SEQ ID NO: 9005602 - DNA, 22 bp, Homo sapiens
aggactggtgccagacaaggta

SEQ ID NO: 9005603 - DNA, 22 bp, Homo sapiens
aggactggtgtgtgatcagcat

SEQ ID NO: 9005604 - DNA, 22 bp, Homo sapiens
aggactggtgtgtgatcagcat

SEQ ID NO: 9005605 - DNA, 22 bp, Homo sapiens
aggactgggtgcagagggcatc

SEQ ID NO: 9005606 - DNA, 22 bp, Homo sapiens
aggactgggtgcagagggcatc

SEQ ID NO: 9005607 - DNA, 22 bp, Homo sapiens
aggactgggtgcagagggcatc

SEQ ID NO: 9005608 - DNA, 22 bp, Homo sapiens
aggactgggtgcagagggcatc

SEQ ID NO: 9005609 - DNA, 22 bp, Homo sapiens
aggactgggtgcagagggcatc

SEQ ID NO: 9005610 - DNA, 22 bp, Homo sapiens
aggactggcagtgtgaggggtc

SEQ ID NO: 9005611 - DNA, 22 bp, Homo sapiens
aggactggccctgaggggaggc

SEQ ID NO: 9005612 - DNA, 22 bp, Homo sapiens
aggactggccctgaggggaggc

SEQ ID NO: 9005613 - DNA, 22 bp, Homo sapiens
aggactggccctgaggggaggc

SEQ ID NO: 9005614 - DNA, 22 bp, Homo sapiens
aggactggcagtgtgaggggtc

SEQ ID NO: 9005615 - DNA, 22 bp, Homo sapiens
aggactggcagtgtgaggggtc

SEQ ID NO: 9005616 - DNA, 22 bp, Homo sapiens
aggacagtggcaaggcaggaca

SEQ ID NO: 9005617 - DNA, 22 bp, Homo sapiens
aggacagtggacactagtccct

SEQ ID NO: 9005618 - DNA, 22 bp, Homo sapiens
aggacatgaagaaagggcaagg

SEQ ID NO: 9005619 - DNA, 22 bp, Homo sapiens
aggacagttagttaggaagttt

SEQ ID NO: 9005620 - DNA, 22 bp, Homo sapiens
aggacagtccggggtcctccac

SEQ ID NO: 9005621 - DNA, 23 bp, Homo sapiens
aggacagtggaatttagggattg

SEQ ID NO: 9005622 - DNA, 22 bp, Homo sapiens
aggacaggtgtagtgggctctg

SEQ ID NO: 9005623 - DNA, 22 bp, Homo sapiens
aggacagtataggctttaggag

SEQ ID NO: 9005624 - DNA, 22 bp, Homo sapiens
aggacaggtgtagtgggctctg

SEQ ID NO: 9005625 - DNA, 22 bp, Homo sapiens
aggacaggtgtagtgggctctg

SEQ ID NO: 9005626 - DNA, 22 bp, Homo sapiens
aggacaggtgtagtgggctctg

SEQ ID NO: 9005627 - DNA, 22 bp, Homo sapiens
aggacaggtgtagtgggctctg

SEQ ID NO: 9005628 - DNA, 22 bp, Homo sapiens
aggacaggtgtagtgggctctg

SEQ ID NO: 9005629 - DNA, 22 bp, Homo sapiens
aggacaggtgtagtgggctctg

SEQ ID NO: 9005630 - DNA, 22 bp, Homo sapiens
aggacaggtgtagtgggctctg

SEQ ID NO: 9005631 - DNA, 22 bp, Homo sapiens
aggacaggtgtagtgggctctg

SEQ ID NO: 9005632 - DNA, 22 bp, Homo sapiens
aggacagggattcaaactccca

SEQ ID NO: 9005633 - DNA, 22 bp, Homo sapiens
aggacacaggtaagccagtgga

SEQ ID NO: 9005634 - DNA, 22 bp, Homo sapiens
acagggctatattcctcagagt

SEQ ID NO: 9005635 - DNA, 22 bp, Homo sapiens
aggacacaggtaagccagtgga

SEQ ID NO: 9005636 - DNA, 23 bp, Homo sapiens
acagggctagctgacagtggtat

SEQ ID NO: 9005637 - DNA, 23 bp, Homo sapiens
acagggctagctgacagtggtat

SEQ ID NO: 9005638 - DNA, 23 bp, Homo sapiens
acagggctagctgacagtggtat

SEQ ID NO: 9005639 - DNA, 22 bp, Homo sapiens
acagggctatattcctcagagc

SEQ ID NO: 9005640 - DNA, 22 bp, Homo sapiens
acagggctatattcctcagagc

SEQ ID NO: 9005641 - DNA, 22 bp, Homo sapiens
acagggctatattcctcagagc

SEQ ID NO: 9005642 - DNA, 22 bp, Homo sapiens
acagggctatattcctcagagc

SEQ ID NO: 9005643 - DNA, 22 bp, Homo sapiens
acagggcctggctccaaaagat

SEQ ID NO: 9005644 - DNA, 22 bp, Homo sapiens
acagggcctggctccaaaagat

SEQ ID NO: 9005645 - DNA, 22 bp, Homo sapiens
acagggccttatatccagaagg

SEQ ID NO: 9005646 - DNA, 22 bp, Homo sapiens
acagggccttatatccagaagg

SEQ ID NO: 9005647 - DNA, 22 bp, Homo sapiens
acagggccttatatccagaagg

SEQ ID NO: 9005648 - DNA, 22 bp, Homo sapiens
acagggcctttgatggattata

SEQ ID NO: 9005649 - DNA, 22 bp, Homo sapiens
acagggcctttgatggattata

SEQ ID NO: 9005650 - DNA, 23 bp, Homo sapiens
acagggctagctgacagtggtat

SEQ ID NO: 9005651 - DNA, 22 bp, Homo sapiens
acagggcctttgatggattata

SEQ ID NO: 9005652 - DNA, 22 bp, Homo sapiens
acagggccttatatccagaagg

SEQ ID NO: 9005653 - DNA, 22 bp, Homo sapiens
acagggccattatctgttctag

SEQ ID NO: 9005654 - DNA, 22 bp, Homo sapiens
acagggccattggaggattata

SEQ ID NO: 9005655 - DNA, 22 bp, Homo sapiens
acagggccaggtgagaggtgct

SEQ ID NO: 9005656 - DNA, 22 bp, Homo sapiens
acagggccattatctgttctag

SEQ ID NO: 9005657 - DNA, 22 bp, Homo sapiens
acagggccctgtgggccccact

SEQ ID NO: 9005658 - DNA, 22 bp, Homo sapiens
acagggccctgtgggccccact

SEQ ID NO: 9005659 - DNA, 22 bp, Homo sapiens
acagggccattggaggattata

SEQ ID NO: 9005660 - DNA, 22 bp, Homo sapiens
acagggccattggaggattata

SEQ ID NO: 9005661 - DNA, 22 bp, Homo sapiens
acagggccagcctgggacctgg

SEQ ID NO: 9005662 - DNA, 22 bp, Homo sapiens
acagggccagcctgggacctgg

SEQ ID NO: 9005663 - DNA, 22 bp, Homo sapiens
acagggccagcctgggacctgg

SEQ ID NO: 9005664 - DNA, 22 bp, Homo sapiens
acagggccaggtgagaggtgct

SEQ ID NO: 9005665 - DNA, 22 bp, Homo sapiens
acagggccaggtgagaggtgct

SEQ ID NO: 9005666 - DNA, 22 bp, Homo sapiens
acagggccagcctgggacctgg

SEQ ID NO: 9005667 - DNA, 22 bp, Homo sapiens
acagggccaggtgagaggtgct

SEQ ID NO: 9005668 - DNA, 22 bp, Homo sapiens
acagggccaggtgagaggtgct

SEQ ID NO: 9005669 - DNA, 22 bp, Homo sapiens
acagggcccttgccagcacaag

SEQ ID NO: 9005670 - DNA, 22 bp, Homo sapiens
acagggcccttgccagcacaag

SEQ ID NO: 9005671 - DNA, 22 bp, Homo sapiens
acagggcctcagccagggcaga

SEQ ID NO: 9005672 - DNA, 22 bp, Homo sapiens
acagggcccttgccagcacaag

SEQ ID NO: 9005673 - DNA, 22 bp, Homo sapiens
acagggcccttagatcctttta

SEQ ID NO: 9005674 - DNA, 22 bp, Homo sapiens
acagggcccttagatcctttta

SEQ ID NO: 9005675 - DNA, 22 bp, Homo sapiens
acagggccctgtgggccccact

SEQ ID NO: 9005676 - DNA, 22 bp, Homo sapiens
acagggcctcagccagggcaga

SEQ ID NO: 9005677 - DNA, 22 bp, Homo sapiens
acagggcctcagccagggcaga

SEQ ID NO: 9005678 - DNA, 22 bp, Homo sapiens
acagggcctcagccagggcaga

SEQ ID NO: 9005679 - DNA, 22 bp, Homo sapiens
acagggcctcagccagggcaga

SEQ ID NO: 9005680 - DNA, 22 bp, Homo sapiens
acagggcctcagccagggcaga

SEQ ID NO: 9005681 - DNA, 22 bp, Homo sapiens
acagggcctcagctgattctgg

SEQ ID NO: 9005682 - DNA, 22 bp, Homo sapiens
acagggcctcagctgattctgg

SEQ ID NO: 9005683 - DNA, 22 bp, Homo sapiens
acagggcctggctccaaaagat

SEQ ID NO: 9005684 - DNA, 22 bp, Homo sapiens
aggcagcaaatgtctggaacag

SEQ ID NO: 9005685 - DNA, 22 bp, Homo sapiens
aggcagcaaagaaatgatgctg

SEQ ID NO: 9005686 - DNA, 22 bp, Homo sapiens
aggcagcaagattatttaatcc

SEQ ID NO: 9005687 - DNA, 22 bp, Homo sapiens
aggcagcaagattatttaatcc

SEQ ID NO: 9005688 - DNA, 22 bp, Homo sapiens
aggcagatttaggagaaaagaa

SEQ ID NO: 9005689 - DNA, 22 bp, Homo sapiens
aggcagattttctttactcagt

SEQ ID NO: 9005690 - DNA, 22 bp, Homo sapiens
aggcagattttctttactcagt

SEQ ID NO: 9005691 - DNA, 22 bp, Homo sapiens
aggcagcaaagaaatgatgctg

SEQ ID NO: 9005692 - DNA, 22 bp, Homo sapiens
aggcagcaaagaaatgatgctg

SEQ ID NO: 9005693 - DNA, 22 bp, Homo sapiens
aggcagcaaagaaatgatgctg

SEQ ID NO: 9005694 - DNA, 22 bp, Homo sapiens
aggcagcaatgaatgaaatgga

SEQ ID NO: 9005695 - DNA, 22 bp, Homo sapiens
aggcaggggagctggaagggta

SEQ ID NO: 9005696 - DNA, 22 bp, Homo sapiens
aggcaggggagctggaagggta

SEQ ID NO: 9005697 - DNA, 22 bp, Homo sapiens
aggcaggggagctggaagggta

SEQ ID NO: 9005698 - DNA, 22 bp, Homo sapiens
aggcaggggagctggaagggta

SEQ ID NO: 9005699 - DNA, 18 bp, Homo sapiens
aggcaggtgctggaagtc

SEQ ID NO: 9005700 - DNA, 18 bp, Homo sapiens
aggcaggtgctggaagtc

SEQ ID NO: 9005701 - DNA, 18 bp, Homo sapiens
aggcaggtgctggaagtc

SEQ ID NO: 9005702 - DNA, 18 bp, Homo sapiens
aggcaggtgctggaagtc

SEQ ID NO: 9005703 - DNA, 22 bp, Homo sapiens
aggcaggtgttgggagacacca

SEQ ID NO: 9005704 - DNA, 22 bp, Homo sapiens
aggcaggtgttgggagacacca

SEQ ID NO: 9005705 - DNA, 22 bp, Homo sapiens
aggcaggtgttaaccctctgag

SEQ ID NO: 9005706 - DNA, 22 bp, Homo sapiens
aggcaggtgggtcacttgagtc

SEQ ID NO: 9005707 - DNA, 22 bp, Homo sapiens
aggcaggtgggtcacttgagtc

SEQ ID NO: 9005708 - DNA, 22 bp, Homo sapiens
aggcaggtgggtcacttgagtc

SEQ ID NO: 9005709 - DNA, 18 bp, Homo sapiens
aggcaggtgctggaagtc

SEQ ID NO: 9005710 - DNA, 22 bp, Homo sapiens
aggcaggtgcttatgacttgct

SEQ ID NO: 9005711 - DNA, 22 bp, Homo sapiens
aggcagatcacaggagggcctg

SEQ ID NO: 9005712 - DNA, 22 bp, Homo sapiens
aggcagatcacttgaggccagg

SEQ ID NO: 9005713 - DNA, 22 bp, Homo sapiens
aggcagatcagtacagggttaa

SEQ ID NO: 9005714 - DNA, 22 bp, Homo sapiens
aggcagatatttcagttcacat

SEQ ID NO: 9005715 - DNA, 22 bp, Homo sapiens
aggcagatatttcagttcacat

SEQ ID NO: 9005716 - DNA, 22 bp, Homo sapiens
aggcagatatttcagttcacat

SEQ ID NO: 9005717 - DNA, 22 bp, Homo sapiens
aggcagagaaaaaccagatatg

SEQ ID NO: 9005718 - DNA, 22 bp, Homo sapiens
aggcagagaaaaaccagatatg

SEQ ID NO: 9005719 - DNA, 22 bp, Homo sapiens
aggcagagaaaaaccagatatg

SEQ ID NO: 9005720 - DNA, 22 bp, Homo sapiens
aggcagatgggagctggaagtt

SEQ ID NO: 9005721 - DNA, 22 bp, Homo sapiens
aggcagatgaacctgggttgag

SEQ ID NO: 9005722 - DNA, 22 bp, Homo sapiens
aggcagatggatgggcatttgt

SEQ ID NO: 9005723 - DNA, 22 bp, Homo sapiens
aggcagattacttgaggccagg

SEQ ID NO: 9005724 - DNA, 22 bp, Homo sapiens
aggcagattaggattaggaaat

SEQ ID NO: 9005725 - DNA, 22 bp, Homo sapiens
aggcagatggtaactgtgatat

SEQ ID NO: 9005726 - DNA, 22 bp, Homo sapiens
aggcagatgtgattaatttcct

SEQ ID NO: 9005727 - DNA, 22 bp, Homo sapiens
aggcagatggtaactgtgatat

SEQ ID NO: 9005728 - DNA, 22 bp, Homo sapiens
aggcagatgtgtcttctaaaat

SEQ ID NO: 9005729 - DNA, 22 bp, Homo sapiens
aggcagacaaggtccctggtct

SEQ ID NO: 9005730 - DNA, 22 bp, Homo sapiens
aggcagacaagtccagaactgg

SEQ ID NO: 9005731 - DNA, 22 bp, Homo sapiens
aggcagacttaccttctgggga

SEQ ID NO: 9005732 - DNA, 22 bp, Homo sapiens
aggcagagaaaaaccagatatg

SEQ ID NO: 9005733 - DNA, 22 bp, Homo sapiens
aggcagaaccagctgggacttt

SEQ ID NO: 9005734 - DNA, 22 bp, Homo sapiens
aggcagaaccagctgggacttt

SEQ ID NO: 9005735 - DNA, 22 bp, Homo sapiens
aggcagaaccagctgggacttt

SEQ ID NO: 9005736 - DNA, 22 bp, Homo sapiens
aggcagaagccagccagggtcc

SEQ ID NO: 9005737 - DNA, 21 bp, Homo sapiens
aggcagaaagagcccaggctg

SEQ ID NO: 9005738 - DNA, 21 bp, Homo sapiens
aggcagaaagagcccaggctg

SEQ ID NO: 9005739 - DNA, 21 bp, Homo sapiens
aggcagaaagagcccaggctg

SEQ ID NO: 9005740 - DNA, 22 bp, Homo sapiens
aggcagaaccagctgggacttt

SEQ ID NO: 9005741 - DNA, 22 bp, Homo sapiens
aggcagaatgttggaaaggaag

SEQ ID NO: 9005742 - DNA, 22 bp, Homo sapiens
aggcagaatgttggaaaggaag

SEQ ID NO: 9005743 - DNA, 22 bp, Homo sapiens
aggcagaatgttggaaaggaag

SEQ ID NO: 9005744 - DNA, 22 bp, Homo sapiens
aggcagaagccagccagggtcc

SEQ ID NO: 9005745 - DNA, 22 bp, Homo sapiens
aggcagaagccagccagggtcc

SEQ ID NO: 9005746 - DNA, 22 bp, Homo sapiens
aggcagaagccagccagggtcc

SEQ ID NO: 9005747 - DNA, 22 bp, Homo sapiens
aggcagtgtgtagctggaagag

SEQ ID NO: 9005748 - DNA, 22 bp, Homo sapiens
aggcagtgtgtagctggaagag

SEQ ID NO: 9005749 - DNA, 22 bp, Homo sapiens
aggcagtgtgtagctggaagag

SEQ ID NO: 9005750 - DNA, 22 bp, Homo sapiens
aggcagtgtgtagctggaagag

SEQ ID NO: 9005751 - DNA, 22 bp, Homo sapiens
aggcagtgtgtagctggaagag

SEQ ID NO: 9005752 - DNA, 22 bp, Homo sapiens
aggcagtgtgtagctggaagag

SEQ ID NO: 9005753 - DNA, 22 bp, Homo sapiens
aggcagtgtggagggctgttgc

SEQ ID NO: 9005754 - DNA, 20 bp, Homo sapiens
aggcagtgtagagatgagta

SEQ ID NO: 9005755 - DNA, 20 bp, Homo sapiens
aggcagtgtagagatgagta

SEQ ID NO: 9005756 - DNA, 20 bp, Homo sapiens
aggcagtgtagagatgagta

SEQ ID NO: 9005757 - DNA, 20 bp, Homo sapiens
aggcagtgtagagatgagta

SEQ ID NO: 9005758 - DNA, 23 bp, Homo sapiens
aggcagtgtctcttatcctgtcc

SEQ ID NO: 9005759 - DNA, 22 bp, Homo sapiens
acatctgttcttctcttgtccc

SEQ ID NO: 9005760 - DNA, 22 bp, Homo sapiens
acatctgtttaacgaaggcatt

SEQ ID NO: 9005761 - DNA, 22 bp, Homo sapiens
acatcttcaaagtgctttgcaa

SEQ ID NO: 9005762 - DNA, 22 bp, Homo sapiens
acatctgtttgagaaaaagaag

SEQ ID NO: 9005763 - DNA, 22 bp, Homo sapiens
acatctgtttgagaaaaagaag

SEQ ID NO: 9005764 - DNA, 22 bp, Homo sapiens
acatctgtttgagaaaaagaag

SEQ ID NO: 9005765 - DNA, 22 bp, Homo sapiens
acatctgttcaaatatgcattt

SEQ ID NO: 9005766 - DNA, 22 bp, Homo sapiens
acatctgtcctctgcagagctc

SEQ ID NO: 9005767 - DNA, 22 bp, Homo sapiens
acatctgtaatctagtcaaccc

SEQ ID NO: 9005768 - DNA, 22 bp, Homo sapiens
acatctgggcctaaggctatat

SEQ ID NO: 9005769 - DNA, 22 bp, Homo sapiens
acatctgggcctaaggctatat

SEQ ID NO: 9005770 - DNA, 22 bp, Homo sapiens
acatctggagactacagtttgg

SEQ ID NO: 9005771 - DNA, 22 bp, Homo sapiens
acatctggagactacagtttgg

SEQ ID NO: 9005772 - DNA, 22 bp, Homo sapiens
aggcagtggtgtttgctggtgg

SEQ ID NO: 9005773 - DNA, 22 bp, Homo sapiens
aggcagtggtgtttgctggtgg

SEQ ID NO: 9005774 - DNA, 20 bp, Homo sapiens
aggcagtgtagagatgagta

SEQ ID NO: 9005775 - DNA, 22 bp, Homo sapiens
acatctttatactagtccttga

SEQ ID NO: 9005776 - DNA, 22 bp, Homo sapiens
acatctttatactagtccttga

SEQ ID NO: 9005777 - DNA, 22 bp, Homo sapiens
acatcttcactggtttctggaa

SEQ ID NO: 9005778 - DNA, 22 bp, Homo sapiens
acatcttcccacacttgcaaaa

SEQ ID NO: 9005779 - DNA, 22 bp, Homo sapiens
acatctttgctcttatagagct

SEQ ID NO: 9005780 - DNA, 23 bp, Homo sapiens
aggcagtggtggtaacatgtcaa

SEQ ID NO: 9005781 - DNA, 22 bp, Homo sapiens
acatctttatactagtccttga

SEQ ID NO: 9005782 - DNA, 22 bp, Homo sapiens
acatctttatactagtccttga

SEQ ID NO: 9005783 - DNA, 22 bp, Homo sapiens
acatatatgtaaagtactttgt

SEQ ID NO: 9005784 - DNA, 22 bp, Homo sapiens
acatatatgtaaagtactttgt

SEQ ID NO: 9005785 - DNA, 22 bp, Homo sapiens
acatataagggatcagtgacag

SEQ ID NO: 9005786 - DNA, 22 bp, Homo sapiens
acatataagggatcagtgacag

SEQ ID NO: 9005787 - DNA, 22 bp, Homo sapiens
acatataagggatcagtgacag

SEQ ID NO: 9005788 - DNA, 22 bp, Homo sapiens
acatataagggatcagtgacag

SEQ ID NO: 9005789 - DNA, 22 bp, Homo sapiens
acatatatgcgtgggctcatgg

SEQ ID NO: 9005790 - DNA, 22 bp, Homo sapiens
acatatatgtaaagtactttgt

SEQ ID NO: 9005791 - DNA, 22 bp, Homo sapiens
acatatatgtaaagtactttgt

SEQ ID NO: 9005792 - DNA, 22 bp, Homo sapiens
acatatatgtaaagtactttgt

SEQ ID NO: 9005793 - DNA, 22 bp, Homo sapiens
acatatatgtgcacatgtgcag

SEQ ID NO: 9005794 - DNA, 22 bp, Homo sapiens
acatatatgtaaagtactttgt

SEQ ID NO: 9005795 - DNA, 22 bp, Homo sapiens
acatatattactagtaaagaca

SEQ ID NO: 9005796 - DNA, 22 bp, Homo sapiens
acatatatgtgcacatgtgcag

SEQ ID NO: 9005797 - DNA, 22 bp, Homo sapiens
acatatattactagtaaagaca

SEQ ID NO: 9005798 - DNA, 22 bp, Homo sapiens
acatatattactagtaaagaca

SEQ ID NO: 9005799 - DNA, 22 bp, Homo sapiens
acatctgaccattacaagacat

SEQ ID NO: 9005800 - DNA, 22 bp, Homo sapiens
acatctgaccattacaagacat

SEQ ID NO: 9005801 - DNA, 22 bp, Homo sapiens
acatctgacatgatcttcagta

SEQ ID NO: 9005802 - DNA, 22 bp, Homo sapiens
acatctgaaagggattgcagaa

SEQ ID NO: 9005803 - DNA, 22 bp, Homo sapiens
acatctcttcttaaggctccag

SEQ ID NO: 9005804 - DNA, 22 bp, Homo sapiens
acatctgaaagggattgcagaa

SEQ ID NO: 9005805 - DNA, 22 bp, Homo sapiens
acatctgaaagggattgcagaa

SEQ ID NO: 9005806 - DNA, 22 bp, Homo sapiens
acatctgacatgatcttcagta

SEQ ID NO: 9005807 - DNA, 22 bp, Homo sapiens
acatctgagcaacagaacacta

SEQ ID NO: 9005808 - DNA, 22 bp, Homo sapiens
acatctgagcaacagaacacta

SEQ ID NO: 9005809 - DNA, 20 bp, Homo sapiens
acatctgagaaacacttaaa

SEQ ID NO: 9005810 - DNA, 22 bp, Homo sapiens
acatctgagcaacagaacacta

SEQ ID NO: 9005811 - DNA, 22 bp, Homo sapiens
acatctggaaagttacttgaga

SEQ ID NO: 9005812 - DNA, 22 bp, Homo sapiens
acatctggaaagttacttgaga

SEQ ID NO: 9005813 - DNA, 22 bp, Homo sapiens
acatctgattacatgagaatat

SEQ ID NO: 9005814 - DNA, 22 bp, Homo sapiens
acatctgattacatgagaatat

SEQ ID NO: 9005815 - DNA, 22 bp, Homo sapiens
acatctcatgaatgataaatca

SEQ ID NO: 9005816 - DNA, 22 bp, Homo sapiens
acatctcatgaatgataaatca

SEQ ID NO: 9005817 - DNA, 22 bp, Homo sapiens
acatctctccaaaggaaggtgc

SEQ ID NO: 9005818 - DNA, 22 bp, Homo sapiens
acatccatttgctttatttgct

SEQ ID NO: 9005819 - DNA, 22 bp, Homo sapiens
acatctcatgaatgataaatca

SEQ ID NO: 9005820 - DNA, 22 bp, Homo sapiens
acatctcatgaatgataaatca

SEQ ID NO: 9005821 - DNA, 22 bp, Homo sapiens
acatctcatgaatgataaatca

SEQ ID NO: 9005822 - DNA, 22 bp, Homo sapiens
acatctcttataaactctctga

SEQ ID NO: 9005823 - DNA, 22 bp, Homo sapiens
acatctcttcttaaggctccag

SEQ ID NO: 9005824 - DNA, 22 bp, Homo sapiens
acatctctgggtcctccatgca

SEQ ID NO: 9005825 - DNA, 22 bp, Homo sapiens
acatatattactagtaaagaca

SEQ ID NO: 9005826 - DNA, 22 bp, Homo sapiens
acatatattactagtaaagaca

SEQ ID NO: 9005827 - DNA, 22 bp, Homo sapiens
acatccatgttgtaatgttcct

SEQ ID NO: 9005828 - DNA, 22 bp, Homo sapiens
acatccatgttgtaatgttcct

SEQ ID NO: 9005829 - DNA, 22 bp, Homo sapiens
acatccatgcatgtctgtgcac

SEQ ID NO: 9005830 - DNA, 22 bp, Homo sapiens
acatccatgcatgtctgtgcac

SEQ ID NO: 9005831 - DNA, 23 bp, Homo sapiens
acatccatgaatcatctgctttc

SEQ ID NO: 9005832 - DNA, 22 bp, Homo sapiens
acatccatcttctgcctgtgaa

SEQ ID NO: 9005833 - DNA, 23 bp, Homo sapiens
acatccatgaatcatctgctttc

SEQ ID NO: 9005834 - DNA, 22 bp, Homo sapiens
acatatattactagtaaagaca

SEQ ID NO: 9005835 - DNA, 22 bp, Homo sapiens
acagtggaaagaacatggattt

SEQ ID NO: 9005836 - DNA, 22 bp, Homo sapiens
acagtggaaagaacatggattt

SEQ ID NO: 9005837 - DNA, 22 bp, Homo sapiens
acagtggaaagaacatggattt

SEQ ID NO: 9005838 - DNA, 22 bp, Homo sapiens
acagtggaaagaaacgaattag

SEQ ID NO: 9005839 - DNA, 22 bp, Homo sapiens
acagtgcttggcacacagtaat

SEQ ID NO: 9005840 - DNA, 22 bp, Homo sapiens
acagtgcttctgatatgatgcc

SEQ ID NO: 9005841 - DNA, 22 bp, Homo sapiens
acagtgcttttgttcctctcct

SEQ ID NO: 9005842 - DNA, 19 bp, Homo sapiens
acagtgcttctgagtgagg

SEQ ID NO: 9005843 - DNA, 19 bp, Homo sapiens
acagtgcttctgagtgagg

SEQ ID NO: 9005844 - DNA, 19 bp, Homo sapiens
acagtgcttctgagtgagg

SEQ ID NO: 9005845 - DNA, 22 bp, Homo sapiens
acagtgcttagcacagagtaga

SEQ ID NO: 9005846 - DNA, 19 bp, Homo sapiens
acagtgcttctgagtgagg

SEQ ID NO: 9005847 - DNA, 22 bp, Homo sapiens
acagtgcttctgatatgatgcc

SEQ ID NO: 9005848 - DNA, 22 bp, Homo sapiens
acagtgcttagcacagagtaga

SEQ ID NO: 9005849 - DNA, 22 bp, Homo sapiens
acagtgcttagcacagagtaga

SEQ ID NO: 9005850 - DNA, 22 bp, Homo sapiens
aggaggccgatttcagaggtcg

SEQ ID NO: 9005851 - DNA, 22 bp, Homo sapiens
aggaggccctagagctctagag

SEQ ID NO: 9005852 - DNA, 22 bp, Homo sapiens
aggaggccctagagctctagag

SEQ ID NO: 9005853 - DNA, 17 bp, Homo sapiens
aggaggccctggcgttt

SEQ ID NO: 9005854 - DNA, 17 bp, Homo sapiens
aggaggccctggcgttt

SEQ ID NO: 9005855 - DNA, 17 bp, Homo sapiens
aggaggccctggcgttt

SEQ ID NO: 9005856 - DNA, 22 bp, Homo sapiens
aggaggccgatttcagaggtcg

SEQ ID NO: 9005857 - DNA, 22 bp, Homo sapiens
aggaggccgatttcagaggtcg

SEQ ID NO: 9005858 - DNA, 22 bp, Homo sapiens
aggaggccattctctcagtagc

SEQ ID NO: 9005859 - DNA, 22 bp, Homo sapiens
aggaggccattctctcagtagc

SEQ ID NO: 9005860 - DNA, 19 bp, Homo sapiens
aggaggccatgccactaga

SEQ ID NO: 9005861 - DNA, 21 bp, Homo sapiens
aggaggccagtactgctgaac

SEQ ID NO: 9005862 - DNA, 19 bp, Homo sapiens
aggaggccatgccactaga

SEQ ID NO: 9005863 - DNA, 19 bp, Homo sapiens
aggaggccatgccactaga

SEQ ID NO: 9005864 - DNA, 22 bp, Homo sapiens
aggaggcccctcctgggttgct

SEQ ID NO: 9005865 - DNA, 22 bp, Homo sapiens
aggaggcccctcctgggttgct

SEQ ID NO: 9005866 - DNA, 22 bp, Homo sapiens
aggaggcccctcctgggttgct

SEQ ID NO: 9005867 - DNA, 22 bp, Homo sapiens
aggaggccctagagctctagag

SEQ ID NO: 9005868 - DNA, 22 bp, Homo sapiens
aggaggccctagagctctagag

SEQ ID NO: 9005869 - DNA, 22 bp, Homo sapiens
aggaggccctagagctctagag

SEQ ID NO: 9005870 - DNA, 22 bp, Homo sapiens
aggaggccctagagctctagag

SEQ ID NO: 9005871 - DNA, 22 bp, Homo sapiens
aggaggccctagagctctagag

SEQ ID NO: 9005872 - DNA, 22 bp, Homo sapiens
aggaggcagtctgtcccttagc

SEQ ID NO: 9005873 - DNA, 22 bp, Homo sapiens
aggaggcagtctgtcccttagc

SEQ ID NO: 9005874 - DNA, 22 bp, Homo sapiens
aggaggcagtctgtcccttagc

SEQ ID NO: 9005875 - DNA, 22 bp, Homo sapiens
aggaggcagtctgtcccttagc

SEQ ID NO: 9005876 - DNA, 20 bp, Homo sapiens
aggaggcatgaggggattta

SEQ ID NO: 9005877 - DNA, 21 bp, Homo sapiens
aggaggccagtactgctgaac

SEQ ID NO: 9005878 - DNA, 22 bp, Homo sapiens
aggaggccaggccctcaagcct

SEQ ID NO: 9005879 - DNA, 22 bp, Homo sapiens
aggaggccaggccctcaagcct

SEQ ID NO: 9005880 - DNA, 22 bp, Homo sapiens
aggaggccaggccctcaagcct

SEQ ID NO: 9005881 - DNA, 22 bp, Homo sapiens
aggaggcagtctgtcccttagc

SEQ ID NO: 9005882 - DNA, 22 bp, Homo sapiens
aggaggcaggaagtctatggga

SEQ ID NO: 9005883 - DNA, 22 bp, Homo sapiens
aggaggcaggaagtctatggga

SEQ ID NO: 9005884 - DNA, 22 bp, Homo sapiens
acagtgaggaagcagctgtgct

SEQ ID NO: 9005885 - DNA, 22 bp, Homo sapiens
acagtgagcggtagtgattgct

SEQ ID NO: 9005886 - DNA, 22 bp, Homo sapiens
acagtgagatccaagggcaggc

SEQ ID NO: 9005887 - DNA, 22 bp, Homo sapiens
acagtgagcccactccaggaga

SEQ ID NO: 9005888 - DNA, 22 bp, Homo sapiens
acagtgagcggtagtgattgct

SEQ ID NO: 9005889 - DNA, 21 bp, Homo sapiens
acagtgagaaataaatggaaa

SEQ ID NO: 9005890 - DNA, 17 bp, Homo sapiens
acagtgagaagtcatct

SEQ ID NO: 9005891 - DNA, 22 bp, Homo sapiens
acagtgagatccaagggcaggc

SEQ ID NO: 9005892 - DNA, 22 bp, Homo sapiens
acagtgaatgcccaagaaaagt

SEQ ID NO: 9005893 - DNA, 22 bp, Homo sapiens
acagtgaatgcccaagaaaagt

SEQ ID NO: 9005894 - DNA, 22 bp, Homo sapiens
acagtgaatgcccaagaaaagt

SEQ ID NO: 9005895 - DNA, 22 bp, Homo sapiens
acagtgacaacccaggataaat

SEQ ID NO: 9005896 - DNA, 22 bp, Homo sapiens
acagtgaatgcccaagaaaagt

SEQ ID NO: 9005897 - DNA, 22 bp, Homo sapiens
acagtgaatgagaatggagaaa

SEQ ID NO: 9005898 - DNA, 22 bp, Homo sapiens
acagtgaatgagaatggagaaa

SEQ ID NO: 9005899 - DNA, 22 bp, Homo sapiens
acagtgaatgagaatggagaaa

SEQ ID NO: 9005900 - DNA, 22 bp, Homo sapiens
acagtgaatgcccaagaaaagt

SEQ ID NO: 9005901 - DNA, 22 bp, Homo sapiens
aggacttagaacattatgtact

SEQ ID NO: 9005902 - DNA, 22 bp, Homo sapiens
acagtctggaggctgcttcatt

SEQ ID NO: 9005903 - DNA, 22 bp, Homo sapiens
acagtgaaaagaatattagaat

SEQ ID NO: 9005904 - DNA, 22 bp, Homo sapiens
acagtctttgcaggagaaagga

SEQ ID NO: 9005905 - DNA, 22 bp, Homo sapiens
acagtgaaaagaatattagaat

SEQ ID NO: 9005906 - DNA, 22 bp, Homo sapiens
acagtgaaaagaatattagaat

SEQ ID NO: 9005907 - DNA, 22 bp, Homo sapiens
acagtgaaaagaatattagaat

SEQ ID NO: 9005908 - DNA, 22 bp, Homo sapiens
acagtgaataagacatgtgctt

SEQ ID NO: 9005909 - DNA, 22 bp, Homo sapiens
acagtgaataagacatgtgctt

SEQ ID NO: 9005910 - DNA, 22 bp, Homo sapiens
acagtgaatccaaattcctacc

SEQ ID NO: 9005911 - DNA, 22 bp, Homo sapiens
acagtgaatccaaattcctacc

SEQ ID NO: 9005912 - DNA, 22 bp, Homo sapiens
acagtgaatgagaatggagaaa

SEQ ID NO: 9005913 - DNA, 23 bp, Homo sapiens
acagtgaaacacgcagtaagagt

SEQ ID NO: 9005914 - DNA, 23 bp, Homo sapiens
acagtgaaacacgcagtaagagt

SEQ ID NO: 9005915 - DNA, 22 bp, Homo sapiens
acagtgaaaagtagctaacaca

SEQ ID NO: 9005916 - DNA, 22 bp, Homo sapiens
acagtgaaaagtagctaacaca

SEQ ID NO: 9005917 - DNA, 22 bp, Homo sapiens
acagtgaaaataatatcttcaa

SEQ ID NO: 9005918 - DNA, 22 bp, Homo sapiens
acagtgaaaagtagctaacaca

SEQ ID NO: 9005919 - DNA, 22 bp, Homo sapiens
acagtgaaaagtagctaacaca

SEQ ID NO: 9005920 - DNA, 22 bp, Homo sapiens
acagtgaaaagaatattagaat

SEQ ID NO: 9005921 - DNA, 22 bp, Homo sapiens
acagtgaaaattctattgattt

SEQ ID NO: 9005922 - DNA, 22 bp, Homo sapiens
acagtgaaaataatatcttcaa

SEQ ID NO: 9005923 - DNA, 22 bp, Homo sapiens
acagtgaaaataatatcttcaa

SEQ ID NO: 9005924 - DNA, 22 bp, Homo sapiens
acagtgaaaattctattgattt

SEQ ID NO: 9005925 - DNA, 22 bp, Homo sapiens
acagtgaaaattctattgattt

SEQ ID NO: 9005926 - DNA, 22 bp, Homo sapiens
acagtggcagtattagggcaga

SEQ ID NO: 9005927 - DNA, 22 bp, Homo sapiens
acagtggatgtgatgtccaggt

SEQ ID NO: 9005928 - DNA, 22 bp, Homo sapiens
acagtggatgtgatgtccaggt

SEQ ID NO: 9005929 - DNA, 22 bp, Homo sapiens
acagtggatatattaaatgaga

SEQ ID NO: 9005930 - DNA, 22 bp, Homo sapiens
acagtggagttggggtagccct

SEQ ID NO: 9005931 - DNA, 22 bp, Homo sapiens
acagtggatgacatccttttgc

SEQ ID NO: 9005932 - DNA, 22 bp, Homo sapiens
acagtggatgtgatgtccaggt

SEQ ID NO: 9005933 - DNA, 22 bp, Homo sapiens
acagtggatgtgatgtccaggt

SEQ ID NO: 9005934 - DNA, 22 bp, Homo sapiens
acagtggatatattaaatgaga

SEQ ID NO: 9005935 - DNA, 22 bp, Homo sapiens
acagtggaggccatatggtcct

SEQ ID NO: 9005936 - DNA, 22 bp, Homo sapiens
acagtggagttggggtagccct

SEQ ID NO: 9005937 - DNA, 22 bp, Homo sapiens
acagtggagctcagatgaaaat

SEQ ID NO: 9005938 - DNA, 22 bp, Homo sapiens
acagtggagctcagatgaaaat

SEQ ID NO: 9005939 - DNA, 22 bp, Homo sapiens
acagtggaggccatatggtcct

SEQ ID NO: 9005940 - DNA, 22 bp, Homo sapiens
acagtggaagcatgatgctatc

SEQ ID NO: 9005941 - DNA, 20 bp, Homo sapiens
acagtggaaattgatgtctg

SEQ ID NO: 9005942 - DNA, 22 bp, Homo sapiens
acagtggaagaagcactgaact

SEQ ID NO: 9005943 - DNA, 20 bp, Homo sapiens
acagtggaaattgatgtctg

SEQ ID NO: 9005944 - DNA, 22 bp, Homo sapiens
acagtggaaatgtgggagggga

SEQ ID NO: 9005945 - DNA, 22 bp, Homo sapiens
acagtggaaatgtgggagggga

SEQ ID NO: 9005946 - DNA, 22 bp, Homo sapiens
acagtggaatggtgggcctgca

SEQ ID NO: 9005947 - DNA, 22 bp, Homo sapiens
acagtggaatttgtagatgtgt

SEQ ID NO: 9005948 - DNA, 22 bp, Homo sapiens
acagtggaatggtgggcctgca

SEQ ID NO: 9005949 - DNA, 22 bp, Homo sapiens
acagtggagaaggcatgaggct

SEQ ID NO: 9005950 - DNA, 22 bp, Homo sapiens
acagtggagaaggcatgaggct

SEQ ID NO: 9005951 - DNA, 22 bp, Homo sapiens
acagtggagaagcaaatgcagt

SEQ ID NO: 9005952 - DNA, 22 bp, Homo sapiens
acagtggagaagcaaatgcagt

SEQ ID NO: 9005953 - DNA, 22 bp, Homo sapiens
aggcaccaggttgtggtttgtc

SEQ ID NO: 9005954 - DNA, 22 bp, Homo sapiens
aggcaccagtaagagtagaact

SEQ ID NO: 9005955 - DNA, 19 bp, Homo sapiens
aggcaccgagggccactct

SEQ ID NO: 9005956 - DNA, 22 bp, Homo sapiens
aggcacctcttaggctgctact

SEQ ID NO: 9005957 - DNA, 22 bp, Homo sapiens
aggcacctcagctgagcctggg

SEQ ID NO: 9005958 - DNA, 22 bp, Homo sapiens
aggcacagcacacctggccccc

SEQ ID NO: 9005959 - DNA, 21 bp, Homo sapiens
aggcaccacatctccctcccc

SEQ ID NO: 9005960 - DNA, 22 bp, Homo sapiens
aggcacataatcatcctagcta

SEQ ID NO: 9005961 - DNA, 22 bp, Homo sapiens
aggcaccaggatcagttagaga

SEQ ID NO: 9005962 - DNA, 22 bp, Homo sapiens
aggcacagcacacctggccccc

SEQ ID NO: 9005963 - DNA, 22 bp, Homo sapiens
acagtggcctcaaagaaagaga

SEQ ID NO: 9005964 - DNA, 22 bp, Homo sapiens
acagtggctcatgcctgtcatc

SEQ ID NO: 9005965 - DNA, 22 bp, Homo sapiens
acagtggctcatgcctgtcatc

SEQ ID NO: 9005966 - DNA, 22 bp, Homo sapiens
acagtggcttttgtgtctgcag

SEQ ID NO: 9005967 - DNA, 22 bp, Homo sapiens
acagtggctcatgcctgtcatc

SEQ ID NO: 9005968 - DNA, 22 bp, Homo sapiens
acagtggcttttgtgtctgcag

SEQ ID NO: 9005969 - DNA, 22 bp, Homo sapiens
aggcaccttgagagcaggagct

SEQ ID NO: 9005970 - DNA, 22 bp, Homo sapiens
aggcaccttgagagcaggagct

SEQ ID NO: 9005971 - DNA, 22 bp, Homo sapiens
aggcaccttgagagcaggagct

SEQ ID NO: 9005972 - DNA, 20 bp, Homo sapiens
aggcacctgtcacaggtgag

SEQ ID NO: 9005973 - DNA, 22 bp, Homo sapiens
acagtgttacttgatagtgtat

SEQ ID NO: 9005974 - DNA, 22 bp, Homo sapiens
acagtgttacttgatagtgtat

SEQ ID NO: 9005975 - DNA, 22 bp, Homo sapiens
acagtgttacttgatagtgtat

SEQ ID NO: 9005976 - DNA, 23 bp, Homo sapiens
aggcactcgacagaaatattgga

SEQ ID NO: 9005977 - DNA, 22 bp, Homo sapiens
aggcactagagttcaaagatga

SEQ ID NO: 9005978 - DNA, 22 bp, Homo sapiens
aggcactaatccctactatgag

SEQ ID NO: 9005979 - DNA, 22 bp, Homo sapiens
aggcactaatggtagtggactg

SEQ ID NO: 9005980 - DNA, 22 bp, Homo sapiens
acagtgttctgaaagttgaggg

SEQ ID NO: 9005981 - DNA, 22 bp, Homo sapiens
aggcagaaaatagtcatccaaa

SEQ ID NO: 9005982 - DNA, 22 bp, Homo sapiens
aggcagaaaatagtcatccaaa

SEQ ID NO: 9005983 - DNA, 22 bp, Homo sapiens
aggcagaaaatagtcatccaaa

SEQ ID NO: 9005984 - DNA, 22 bp, Homo sapiens
aggcactttttgcattttagaa

SEQ ID NO: 9005985 - DNA, 22 bp, Homo sapiens
aggcactggtccattttctgca

SEQ ID NO: 9005986 - DNA, 22 bp, Homo sapiens
aggcactggtccattttctgca

SEQ ID NO: 9005987 - DNA, 22 bp, Homo sapiens
aggcactggtccattttctgca

SEQ ID NO: 9005988 - DNA, 22 bp, Homo sapiens
aggcactggtccattttctgca

SEQ ID NO: 9005989 - DNA, 22 bp, Homo sapiens
acagtgttctcttcctgtatag

SEQ ID NO: 9005990 - DNA, 22 bp, Homo sapiens
acagtgttctgaaagttgaggg

SEQ ID NO: 9005991 - DNA, 22 bp, Homo sapiens
aggcactgggtaattagtagct

SEQ ID NO: 9005992 - DNA, 22 bp, Homo sapiens
acagtgttatttctgagtaatg

SEQ ID NO: 9005993 - DNA, 22 bp, Homo sapiens
acagtgttcaaaccactaggct

SEQ ID NO: 9005994 - DNA, 22 bp, Homo sapiens
acagtgttcactaaggttagct

SEQ ID NO: 9005995 - DNA, 20 bp, Homo sapiens
acagtgttagttatcatctc

SEQ ID NO: 9005996 - DNA, 20 bp, Homo sapiens
acagtgttagttatcatctc

SEQ ID NO: 9005997 - DNA, 22 bp, Homo sapiens
acagtgttatttctgagtaatg

SEQ ID NO: 9005998 - DNA, 20 bp, Homo sapiens
acagtgttagttatcatctc

SEQ ID NO: 9005999 - DNA, 20 bp, Homo sapiens
acagtgttaggtttttcctt

SEQ ID NO: 9006000 - DNA, 20 bp, Homo sapiens
acagtgttaggtttttcctt

SEQ ID NO: 9006001 - DNA, 22 bp, Homo sapiens
acagtgttcacttaacaatgga

SEQ ID NO: 9006002 - DNA, 22 bp, Homo sapiens
acagtgttcacttaacaatgga

SEQ ID NO: 9006003 - DNA, 22 bp, Homo sapiens
acagtgttcacttaacaatgga

SEQ ID NO: 9006004 - DNA, 22 bp, Homo sapiens
acagtgttcacttaacaatgga

SEQ ID NO: 9006005 - DNA, 22 bp, Homo sapiens
acagtgttcactaaggttagct

SEQ ID NO: 9006006 - DNA, 22 bp, Homo sapiens
acagtgttcctttgttgtgact

SEQ ID NO: 9006007 - DNA, 22 bp, Homo sapiens
acagtgttcctttgttgtgact

SEQ ID NO: 9006008 - DNA, 22 bp, Homo sapiens
agtcctggtgacactcctcttc

SEQ ID NO: 9006009 - DNA, 22 bp, Homo sapiens
agtcctgggtgtgcaaggcaga

SEQ ID NO: 9006010 - DNA, 22 bp, Homo sapiens
agtcctgggtgtgcaaggcaga

SEQ ID NO: 9006011 - DNA, 22 bp, Homo sapiens
agtcctgggtgtgcaaggcaga

SEQ ID NO: 9006012 - DNA, 22 bp, Homo sapiens
agtccttagaacactgtatctg

SEQ ID NO: 9006013 - DNA, 22 bp, Homo sapiens
agtcctgtgcaaatgcatctga

SEQ ID NO: 9006014 - DNA, 22 bp, Homo sapiens
agtcctgttcctagagtttctg

SEQ ID NO: 9006015 - DNA, 22 bp, Homo sapiens
agtcctgttggttccagaggtg

SEQ ID NO: 9006016 - DNA, 22 bp, Homo sapiens
agtcctgtgaggggtgcagctt

SEQ ID NO: 9006017 - DNA, 22 bp, Homo sapiens
agtcctgtgcaaatgcatctga

SEQ ID NO: 9006018 - DNA, 22 bp, Homo sapiens
agtcctgtctctcccagggcca

SEQ ID NO: 9006019 - DNA, 22 bp, Homo sapiens
actctgggttctttcacttgac

SEQ ID NO: 9006020 - DNA, 22 bp, Homo sapiens
actctgggttctttcacttgac

SEQ ID NO: 9006021 - DNA, 22 bp, Homo sapiens
actctggggtgatgtctctgag

SEQ ID NO: 9006022 - DNA, 22 bp, Homo sapiens
actctgggtcctgccattcact

SEQ ID NO: 9006023 - DNA, 22 bp, Homo sapiens
actctggggtgatgtctctgag

SEQ ID NO: 9006024 - DNA, 22 bp, Homo sapiens
actctggtctttctgaaagcaa

SEQ ID NO: 9006025 - DNA, 20 bp, Homo sapiens
actctggggctcattagggg

SEQ ID NO: 9006026 - DNA, 22 bp, Homo sapiens
actctggggtgatgtctctgag

SEQ ID NO: 9006027 - DNA, 20 bp, Homo sapiens
actctggggctcattagggg

SEQ ID NO: 9006028 - DNA, 22 bp, Homo sapiens
actctgggctttgatttgttac

SEQ ID NO: 9006029 - DNA, 22 bp, Homo sapiens
actctgggctgttaggagctgt

SEQ ID NO: 9006030 - DNA, 22 bp, Homo sapiens
actctgggctgttaggagctgt

SEQ ID NO: 9006031 - DNA, 22 bp, Homo sapiens
actctgggccccaggtggagct

SEQ ID NO: 9006032 - DNA, 22 bp, Homo sapiens
actctggggcgctactccaact

SEQ ID NO: 9006033 - DNA, 22 bp, Homo sapiens
actctggggcgctactccaact

SEQ ID NO: 9006034 - DNA, 22 bp, Homo sapiens
actctgggctttgatttgttac

SEQ ID NO: 9006035 - DNA, 22 bp, Homo sapiens
actctggggcgctactccaact

SEQ ID NO: 9006036 - DNA, 22 bp, Homo sapiens
actctgggccccaggtggagct

SEQ ID NO: 9006037 - DNA, 22 bp, Homo sapiens
actctgggccccaggtggagct

SEQ ID NO: 9006038 - DNA, 22 bp, Homo sapiens
actctgggccccaggtggagct

SEQ ID NO: 9006039 - DNA, 22 bp, Homo sapiens
actctgggcccaccctcagagt

SEQ ID NO: 9006040 - DNA, 22 bp, Homo sapiens
actctgggctgttaggagctgt

SEQ ID NO: 9006041 - DNA, 22 bp, Homo sapiens
actctgggctgttaggagctgt

SEQ ID NO: 9006042 - DNA, 22 bp, Homo sapiens
agtccaggactgtttcagctga

SEQ ID NO: 9006043 - DNA, 22 bp, Homo sapiens
agtccaggaagcatcatggtct

SEQ ID NO: 9006044 - DNA, 22 bp, Homo sapiens
agtccaggaagcatcatggtct

SEQ ID NO: 9006045 - DNA, 22 bp, Homo sapiens
agtccaggaagcatcatggtct

SEQ ID NO: 9006046 - DNA, 22 bp, Homo sapiens
agtccaggaaaataagctaggt

SEQ ID NO: 9006047 - DNA, 22 bp, Homo sapiens
agtccaggaaaataagctaggt

SEQ ID NO: 9006048 - DNA, 22 bp, Homo sapiens
agtccaggaaaataagctaggt

SEQ ID NO: 9006049 - DNA, 22 bp, Homo sapiens
agtccagatcatgcagcaaacc

SEQ ID NO: 9006050 - DNA, 22 bp, Homo sapiens
agtccagccttcaatcttagtg

SEQ ID NO: 9006051 - DNA, 22 bp, Homo sapiens
agtccagagaggaggctgtgtg

SEQ ID NO: 9006052 - DNA, 22 bp, Homo sapiens
agtccagaccccggcagctggt

SEQ ID NO: 9006053 - DNA, 22 bp, Homo sapiens
agtccagaccccggcagctggt

SEQ ID NO: 9006054 - DNA, 21 bp, Homo sapiens
agtccaggaggaggccaggtt

SEQ ID NO: 9006055 - DNA, 21 bp, Homo sapiens
agtccaggaggaggccaggtt

SEQ ID NO: 9006056 - DNA, 21 bp, Homo sapiens
agtccaggaggaggccaggtt

SEQ ID NO: 9006057 - DNA, 22 bp, Homo sapiens
agtccaggcattccagccattc

SEQ ID NO: 9006058 - DNA, 22 bp, Homo sapiens
agtccaggcaagttgttgtgta

SEQ ID NO: 9006059 - DNA, 22 bp, Homo sapiens
agtccaggagttgggtgacatt

SEQ ID NO: 9006060 - DNA, 22 bp, Homo sapiens
agtccaggcattccagccattc

SEQ ID NO: 9006061 - DNA, 22 bp, Homo sapiens
agtccaggagttgggtgacatt

SEQ ID NO: 9006062 - DNA, 22 bp, Homo sapiens
agtccaggagttgggtgacatt

SEQ ID NO: 9006063 - DNA, 21 bp, Homo sapiens
agtccaggagtcacccaagcc

SEQ ID NO: 9006064 - DNA, 22 bp, Homo sapiens
agtccaggcctccctctcctgc

SEQ ID NO: 9006065 - DNA, 22 bp, Homo sapiens
agtccaggcctccctctcctgc

SEQ ID NO: 9006066 - DNA, 22 bp, Homo sapiens
agtccaggcctccctctcctgc

SEQ ID NO: 9006067 - DNA, 22 bp, Homo sapiens
agtccaggcctcctcttttcct

SEQ ID NO: 9006068 - DNA, 22 bp, Homo sapiens
agtccaggcctcctcttttcct

SEQ ID NO: 9006069 - DNA, 22 bp, Homo sapiens
agtccaggcattccagccattc

SEQ ID NO: 9006070 - DNA, 22 bp, Homo sapiens
agtccaggcattccagccattc

SEQ ID NO: 9006071 - DNA, 22 bp, Homo sapiens
agtccaggcctccctctcctgc

SEQ ID NO: 9006072 - DNA, 22 bp, Homo sapiens
actctgctcaaagtcctgaggc

SEQ ID NO: 9006073 - DNA, 21 bp, Homo sapiens
agtccaggcctgcccacttcc

SEQ ID NO: 9006074 - DNA, 22 bp, Homo sapiens
actctgggattgtttctggtat

SEQ ID NO: 9006075 - DNA, 22 bp, Homo sapiens
actctgggatcttgaaaagagt

SEQ ID NO: 9006076 - DNA, 22 bp, Homo sapiens
actctgggatgagaaaagggtt

SEQ ID NO: 9006077 - DNA, 22 bp, Homo sapiens
actctgggcccaccctcagagt

SEQ ID NO: 9006078 - DNA, 22 bp, Homo sapiens
actctgggattgtttctggtat

SEQ ID NO: 9006079 - DNA, 22 bp, Homo sapiens
actctgggattgtttctggtat

SEQ ID NO: 9006080 - DNA, 22 bp, Homo sapiens
actctgggcccaccctcagagt

SEQ ID NO: 9006081 - DNA, 22 bp, Homo sapiens
actctgggagaggacaaacaaa

SEQ ID NO: 9006082 - DNA, 22 bp, Homo sapiens
actctgggagaggacaaacaaa

SEQ ID NO: 9006083 - DNA, 22 bp, Homo sapiens
actctgggatgagaaaagggtt

SEQ ID NO: 9006084 - DNA, 22 bp, Homo sapiens
actctgggatcttgaaaagagt

SEQ ID NO: 9006085 - DNA, 18 bp, Homo sapiens
actctgggacctgttatt

SEQ ID NO: 9006086 - DNA, 18 bp, Homo sapiens
actctgggacctgttatt

SEQ ID NO: 9006087 - DNA, 22 bp, Homo sapiens
actcagaggcagctgctcaccc

SEQ ID NO: 9006088 - DNA, 22 bp, Homo sapiens
actcagaggcagctgctcaccc

SEQ ID NO: 9006089 - DNA, 22 bp, Homo sapiens
actcagaggctggaaatcaaag

SEQ ID NO: 9006090 - DNA, 22 bp, Homo sapiens
actcagaggaaagttgagattg

SEQ ID NO: 9006091 - DNA, 22 bp, Homo sapiens
actcagagtctgagataaatct

SEQ ID NO: 9006092 - DNA, 22 bp, Homo sapiens
actcagagtagaaaataggttc

SEQ ID NO: 9006093 - DNA, 22 bp, Homo sapiens
actcagaggggactggtgtggt

SEQ ID NO: 9006094 - DNA, 22 bp, Homo sapiens
actcagagtagaaaataggttc

SEQ ID NO: 9006095 - DNA, 22 bp, Homo sapiens
actcagaggaaaccctcctagg

SEQ ID NO: 9006096 - DNA, 22 bp, Homo sapiens
actcagaggaaagttgagattg

SEQ ID NO: 9006097 - DNA, 22 bp, Homo sapiens
actcagaggaccaaaaggaaag

SEQ ID NO: 9006098 - DNA, 22 bp, Homo sapiens
actcagaggaaagttgagattg

SEQ ID NO: 9006099 - DNA, 22 bp, Homo sapiens
actcagagcttggctccttgct

SEQ ID NO: 9006100 - DNA, 22 bp, Homo sapiens
actcagagcctcgagggactgc

SEQ ID NO: 9006101 - DNA, 22 bp, Homo sapiens
actcagagcttggctccttgct

SEQ ID NO: 9006102 - DNA, 22 bp, Homo sapiens
actcagagtctgtttggtacct

SEQ ID NO: 9006103 - DNA, 22 bp, Homo sapiens
actcagagtcaatgttaatggc

SEQ ID NO: 9006104 - DNA, 22 bp, Homo sapiens
actcagagtctgtttggtacct

SEQ ID NO: 9006105 - DNA, 22 bp, Homo sapiens
actcagagtgcatctcctattt

SEQ ID NO: 9006106 - DNA, 22 bp, Homo sapiens
actcagagttcctgtgcatagt

SEQ ID NO: 9006107 - DNA, 20 bp, Homo sapiens
actcagatgctcacaacagg

SEQ ID NO: 9006108 - DNA, 22 bp, Homo sapiens
actcagagttttacccagagac

SEQ ID NO: 9006109 - DNA, 22 bp, Homo sapiens
actcagagtttgcgttccatac

SEQ ID NO: 9006110 - DNA, 22 bp, Homo sapiens
actcagagttttacccagagac

SEQ ID NO: 9006111 - DNA, 22 bp, Homo sapiens
actcagctaaactcagtctatg

SEQ ID NO: 9006112 - DNA, 22 bp, Homo sapiens
agtaacatctttgacatttgtt

SEQ ID NO: 9006113 - DNA, 22 bp, Homo sapiens
agtaacatgagtttttctaatg

SEQ ID NO: 9006114 - DNA, 22 bp, Homo sapiens
agtaacatgagtttttctaatg

SEQ ID NO: 9006115 - DNA, 23 bp, Homo sapiens
agtaacatgcaaataacagtctg

SEQ ID NO: 9006116 - DNA, 23 bp, Homo sapiens
agtaacatgcaaataacagtctg

SEQ ID NO: 9006117 - DNA, 22 bp, Homo sapiens
agtaacatatagcacttttgga

SEQ ID NO: 9006118 - DNA, 22 bp, Homo sapiens
agtaacatctttgacatttgtt

SEQ ID NO: 9006119 - DNA, 22 bp, Homo sapiens
agtaacatatagcacttttgga

SEQ ID NO: 9006120 - DNA, 22 bp, Homo sapiens
agtaacatctttgacatttgtt

SEQ ID NO: 9006121 - DNA, 22 bp, Homo sapiens
agtaacatctttgacatttgtt

SEQ ID NO: 9006122 - DNA, 22 bp, Homo sapiens
agtaacatctttgacatttgtt

SEQ ID NO: 9006123 - DNA, 22 bp, Homo sapiens
actcagcttcctacagctagaa

SEQ ID NO: 9006124 - DNA, 22 bp, Homo sapiens
agtaactctcctttgacatatt

SEQ ID NO: 9006125 - DNA, 22 bp, Homo sapiens
agtaactcatgtaaacctcaca

SEQ ID NO: 9006126 - DNA, 22 bp, Homo sapiens
agtaactctcctttgacatatt

SEQ ID NO: 9006127 - DNA, 22 bp, Homo sapiens
agtaactatgcttgagaatcag

SEQ ID NO: 9006128 - DNA, 22 bp, Homo sapiens
agtaactatgcttgagaatcag

SEQ ID NO: 9006129 - DNA, 22 bp, Homo sapiens
agtaaccagtagtcattcattc

SEQ ID NO: 9006130 - DNA, 22 bp, Homo sapiens
agtaacatgctaatttgattat

SEQ ID NO: 9006131 - DNA, 22 bp, Homo sapiens
agtaacatttagcttctcactg

SEQ ID NO: 9006132 - DNA, 23 bp, Homo sapiens
agtaacatgcaaataacagtctg

SEQ ID NO: 9006133 - DNA, 23 bp, Homo sapiens
agtaacatgcaaataacagtctg

SEQ ID NO: 9006134 - DNA, 20 bp, Homo sapiens
agtaacttgcctaaggtcag

SEQ ID NO: 9006135 - DNA, 22 bp, Homo sapiens
agtaacttaggagatacatggg

SEQ ID NO: 9006136 - DNA, 22 bp, Homo sapiens
agtaagattcttctgaaaaatt

SEQ ID NO: 9006137 - DNA, 22 bp, Homo sapiens
agtaagcaatagagtgagaatt

SEQ ID NO: 9006138 - DNA, 22 bp, Homo sapiens
agtaagacccagtcacttgaga

SEQ ID NO: 9006139 - DNA, 22 bp, Homo sapiens
agtaagcaccgggatggtcaag

SEQ ID NO: 9006140 - DNA, 17 bp, Homo sapiens
agtaagtgtgtcacttc

SEQ ID NO: 9006141 - DNA, 22 bp, Homo sapiens
agtaagttccagtttcattatg

SEQ ID NO: 9006142 - DNA, 22 bp, Homo sapiens
agtaagtgagtcactgtgctgg

SEQ ID NO: 9006143 - DNA, 22 bp, Homo sapiens
agtaagtacctccacttgattg

SEQ ID NO: 9006144 - DNA, 22 bp, Homo sapiens
agtaagtgagtcactgtgctgg

SEQ ID NO: 9006145 - DNA, 22 bp, Homo sapiens
agtaagtgcagaaaagatgtgg

SEQ ID NO: 9006146 - DNA, 22 bp, Homo sapiens
agtaaggcatttttcatgttta

SEQ ID NO: 9006147 - DNA, 21 bp, Homo sapiens
agtaagggaggaaagaaattg

SEQ ID NO: 9006148 - DNA, 22 bp, Homo sapiens
agtcacttcgtgagcactgact

SEQ ID NO: 9006149 - DNA, 22 bp, Homo sapiens
agtaataatagctgtaaagtgc

SEQ ID NO: 9006150 - DNA, 22 bp, Homo sapiens
agtaataatagctgtaaagtgc

SEQ ID NO: 9006151 - DNA, 22 bp, Homo sapiens
agtcacttgggaagcaaagcct

SEQ ID NO: 9006152 - DNA, 22 bp, Homo sapiens
agtcagggttgtaggctcaccc

SEQ ID NO: 9006153 - DNA, 22 bp, Homo sapiens
agtcaggggttggacggggcca

SEQ ID NO: 9006154 - DNA, 22 bp, Homo sapiens
agtcaggtgggggctgcagtgg

SEQ ID NO: 9006155 - DNA, 19 bp, Homo sapiens
agtcaggtggctggtgcca

SEQ ID NO: 9006156 - DNA, 22 bp, Homo sapiens
agtcaggtggttctgctccact

SEQ ID NO: 9006157 - DNA, 19 bp, Homo sapiens
agtcaggtggctggtgcca

SEQ ID NO: 9006158 - DNA, 22 bp, Homo sapiens
agtcagtggatttaccatgcgt

SEQ ID NO: 9006159 - DNA, 22 bp, Homo sapiens
agtcagtggctccgagcctggt

SEQ ID NO: 9006160 - DNA, 22 bp, Homo sapiens
agtcagtggctccgagcctggt

SEQ ID NO: 9006161 - DNA, 22 bp, Homo sapiens
agtcagtggctccgagcctggt

SEQ ID NO: 9006162 - DNA, 22 bp, Homo sapiens
agtcagtggctccgagcctggt

SEQ ID NO: 9006163 - DNA, 22 bp, Homo sapiens
agtcagtgggagaagtgtgaag

SEQ ID NO: 9006164 - DNA, 22 bp, Homo sapiens
agtcagtgggagaagtgtgaag

SEQ ID NO: 9006165 - DNA, 23 bp, Homo sapiens
agtcagtgtaagtttggaatgca

SEQ ID NO: 9006166 - DNA, 22 bp, Homo sapiens
agtcagtgggcttggcacagaa

SEQ ID NO: 9006167 - DNA, 22 bp, Homo sapiens
agtcagtgtagaaagcccaggc

SEQ ID NO: 9006168 - DNA, 23 bp, Homo sapiens
agtcagtgtaagtttggaatgca

SEQ ID NO: 9006169 - DNA, 22 bp, Homo sapiens
agtcagtgaaggcattgctcaa

SEQ ID NO: 9006170 - DNA, 22 bp, Homo sapiens
agtcagtgaatctgaaggctaa

SEQ ID NO: 9006171 - DNA, 22 bp, Homo sapiens
agtcagtgaatggtgtatgcta

SEQ ID NO: 9006172 - DNA, 22 bp, Homo sapiens
agtcagtgaaaactagaatgtt

SEQ ID NO: 9006173 - DNA, 22 bp, Homo sapiens
agtcagtgaaaactagaatgtt

SEQ ID NO: 9006174 - DNA, 19 bp, Homo sapiens
aggtgggtaagcagttctc

SEQ ID NO: 9006175 - DNA, 22 bp, Homo sapiens
aggtggggttcagtctcagccg

SEQ ID NO: 9006176 - DNA, 22 bp, Homo sapiens
aggtggggttcagtctcagccg

SEQ ID NO: 9006177 - DNA, 22 bp, Homo sapiens
aggtgggtgccgtctgtcctct

SEQ ID NO: 9006178 - DNA, 22 bp, Homo sapiens
aggtgggtcctggctctgccat

SEQ ID NO: 9006179 - DNA, 22 bp, Homo sapiens
aggtgggtgccgtctgtcctct

SEQ ID NO: 9006180 - DNA, 22 bp, Homo sapiens
aggtgggtatcatgagagatta

SEQ ID NO: 9006181 - DNA, 22 bp, Homo sapiens
aggtgggtatcatgagagatta

SEQ ID NO: 9006182 - DNA, 19 bp, Homo sapiens
aggtgggtaagcagttctc

SEQ ID NO: 9006183 - DNA, 22 bp, Homo sapiens
aggtgggtatcatgagagatta

SEQ ID NO: 9006184 - DNA, 22 bp, Homo sapiens
aggtgggttccgcggcggcccg

SEQ ID NO: 9006185 - DNA, 22 bp, Homo sapiens
aggtgggttcccgactctggct

SEQ ID NO: 9006186 - DNA, 22 bp, Homo sapiens
aggtgggttccgcggcggcccg

SEQ ID NO: 9006187 - DNA, 17 bp, Homo sapiens
aggtgggtggatcacct

SEQ ID NO: 9006188 - DNA, 22 bp, Homo sapiens
aggtggtcttggcccacccagg

SEQ ID NO: 9006189 - DNA, 22 bp, Homo sapiens
aggtggaacgttcaggtgctag

SEQ ID NO: 9006190 - DNA, 22 bp, Homo sapiens
aggtggaacgttcaggtgctag

SEQ ID NO: 9006191 - DNA, 22 bp, Homo sapiens
aggtggaacgttcaggtgctag

SEQ ID NO: 9006192 - DNA, 22 bp, Homo sapiens
aggtggagaagagatgggcagt

SEQ ID NO: 9006193 - DNA, 22 bp, Homo sapiens
aggtggagaagagatgggcagt

SEQ ID NO: 9006194 - DNA, 22 bp, Homo sapiens
aggtggagaagagatgggcagt

SEQ ID NO: 9006195 - DNA, 22 bp, Homo sapiens
aggtggagaagagatgggcagt

SEQ ID NO: 9006196 - DNA, 22 bp, Homo sapiens
aggtggagaagagatgggcagt

SEQ ID NO: 9006197 - DNA, 22 bp, Homo sapiens
aggtggagaagagatgggcagt

SEQ ID NO: 9006198 - DNA, 22 bp, Homo sapiens
aggtggagacccagagaaggcg

SEQ ID NO: 9006199 - DNA, 22 bp, Homo sapiens
aggtggagacccagagaaggcg

SEQ ID NO: 9006200 - DNA, 22 bp, Homo sapiens
aggtggagacccagagaaggcg

SEQ ID NO: 9006201 - DNA, 16 bp, Homo sapiens
aggtggagaagttcac

SEQ ID NO: 9006202 - DNA, 22 bp, Homo sapiens
aggtggagacccagagaaggcg

SEQ ID NO: 9006203 - DNA, 22 bp, Homo sapiens
aggtggagacccagagaaggcg

SEQ ID NO: 9006204 - DNA, 22 bp, Homo sapiens
aggtggagacccagagaaggcg

SEQ ID NO: 9006205 - DNA, 22 bp, Homo sapiens
aggtggagacccagagaaggcg

SEQ ID NO: 9006206 - DNA, 22 bp, Homo sapiens
aggtggagacccagagaaggcg

SEQ ID NO: 9006207 - DNA, 22 bp, Homo sapiens
aggtggagacccagagaaggcg

SEQ ID NO: 9006208 - DNA, 22 bp, Homo sapiens
aggttcttgactctaccttcca

SEQ ID NO: 9006209 - DNA, 22 bp, Homo sapiens
aggttcttggtgagcatttggt

SEQ ID NO: 9006210 - DNA, 22 bp, Homo sapiens
aggttctgttttaaaagagctc

SEQ ID NO: 9006211 - DNA, 22 bp, Homo sapiens
actcacagggcctcagttttcc

SEQ ID NO: 9006212 - DNA, 22 bp, Homo sapiens
actcacagtccctgtaggagtg

SEQ ID NO: 9006213 - DNA, 22 bp, Homo sapiens
actcacagtccctgtaggagtg

SEQ ID NO: 9006214 - DNA, 22 bp, Homo sapiens
actcagagcctcgagggactgc

SEQ ID NO: 9006215 - DNA, 22 bp, Homo sapiens
actcaccacacccttgcacttg

SEQ ID NO: 9006216 - DNA, 22 bp, Homo sapiens
actcagagcctcgagggactgc

SEQ ID NO: 9006217 - DNA, 22 bp, Homo sapiens
actcagagcctcgagggactgc

SEQ ID NO: 9006218 - DNA, 22 bp, Homo sapiens
aggttccttatggggatggcta

SEQ ID NO: 9006219 - DNA, 22 bp, Homo sapiens
aggttccttatggggatggcta

SEQ ID NO: 9006220 - DNA, 22 bp, Homo sapiens
aggttccttatggggatggcta

SEQ ID NO: 9006221 - DNA, 22 bp, Homo sapiens
aggttctcacacgtctacaccc

SEQ ID NO: 9006222 - DNA, 20 bp, Homo sapiens
aggttcctttgtggagaatt

SEQ ID NO: 9006223 - DNA, 23 bp, Homo sapiens
aggttctcttatcatctctgccc

SEQ ID NO: 9006224 - DNA, 18 bp, Homo sapiens
aggttctgacagtccaaa

SEQ ID NO: 9006225 - DNA, 18 bp, Homo sapiens
aggttctgacagtccaaa

SEQ ID NO: 9006226 - DNA, 22 bp, Homo sapiens
aggttctggcattgctcagtaa

SEQ ID NO: 9006227 - DNA, 21 bp, Homo sapiens
aggttccagcagccagagaat

SEQ ID NO: 9006228 - DNA, 20 bp, Homo sapiens
aggttccagccacaaccagc

SEQ ID NO: 9006229 - DNA, 22 bp, Homo sapiens
aggttccagggattaggatgtg

SEQ ID NO: 9006230 - DNA, 22 bp, Homo sapiens
aggttcccaggatctgtctggg

SEQ ID NO: 9006231 - DNA, 22 bp, Homo sapiens
aggttcccaggatctgtctggg

SEQ ID NO: 9006232 - DNA, 22 bp, Homo sapiens
aggttcccagagatagagctgt

SEQ ID NO: 9006233 - DNA, 22 bp, Homo sapiens
aggtggtgatgacagaagacag

SEQ ID NO: 9006234 - DNA, 22 bp, Homo sapiens
aggtggtgtttggttacatgag

SEQ ID NO: 9006235 - DNA, 22 bp, Homo sapiens
aggtggtgtttggttacatgag

SEQ ID NO: 9006236 - DNA, 22 bp, Homo sapiens
aggtgtccaatcctggttggat

SEQ ID NO: 9006237 - DNA, 23 bp, Homo sapiens
aggtggtcttgtggatgctgcaa

SEQ ID NO: 9006238 - DNA, 20 bp, Homo sapiens
aggtgtccacgtggcagggt

SEQ ID NO: 9006239 - DNA, 20 bp, Homo sapiens
aggtgtccacgtggcagggt

SEQ ID NO: 9006240 - DNA, 22 bp, Homo sapiens
aggtgtctggacttgtgaagca

SEQ ID NO: 9006241 - DNA, 19 bp, Homo sapiens
agggtccaggccctgtgga

SEQ ID NO: 9006242 - DNA, 19 bp, Homo sapiens
agggtccaggccctgtgga

SEQ ID NO: 9006243 - DNA, 22 bp, Homo sapiens
agggtcagttctgtgaggtgtt

SEQ ID NO: 9006244 - DNA, 22 bp, Homo sapiens
agggtcagttctgtgaggtgtt

SEQ ID NO: 9006245 - DNA, 22 bp, Homo sapiens
agggtcagttctgtgaggtgtt

SEQ ID NO: 9006246 - DNA, 18 bp, Homo sapiens
agggtcagtgtcactggc

SEQ ID NO: 9006247 - DNA, 18 bp, Homo sapiens
agggtcagtgtcactggc

SEQ ID NO: 9006248 - DNA, 22 bp, Homo sapiens
agggtcagtgatgagggagccc

SEQ ID NO: 9006249 - DNA, 22 bp, Homo sapiens
agggtcagtgatgagggagccc

SEQ ID NO: 9006250 - DNA, 19 bp, Homo sapiens
agggtccagggagcggctc

SEQ ID NO: 9006251 - DNA, 19 bp, Homo sapiens
agggtccagggagcggctc

SEQ ID NO: 9006252 - DNA, 22 bp, Homo sapiens
agggtccagtaacagatgccag

SEQ ID NO: 9006253 - DNA, 22 bp, Homo sapiens
agggtccagtaacagatgccag

SEQ ID NO: 9006254 - DNA, 22 bp, Homo sapiens
agggtcccgaaggagacagcaa

SEQ ID NO: 9006255 - DNA, 22 bp, Homo sapiens
agggtcccgtccctctgcaccc

SEQ ID NO: 9006256 - DNA, 22 bp, Homo sapiens
agggtcccgtccctctgcaccc

SEQ ID NO: 9006257 - DNA, 22 bp, Homo sapiens
agggtccatgtttccagttaat

SEQ ID NO: 9006258 - DNA, 22 bp, Homo sapiens
agggtccagtaacagatgccag

SEQ ID NO: 9006259 - DNA, 22 bp, Homo sapiens
agggtgcagggacaggtgtgca

SEQ ID NO: 9006260 - DNA, 22 bp, Homo sapiens
agggtgcagggacaggtgtgca

SEQ ID NO: 9006261 - DNA, 22 bp, Homo sapiens
agggtgcagggacaggtgtgca

SEQ ID NO: 9006262 - DNA, 22 bp, Homo sapiens
agggtgcagaaggagcctagga

SEQ ID NO: 9006263 - DNA, 22 bp, Homo sapiens
agggtgcagaaggagcctagga

SEQ ID NO: 9006264 - DNA, 22 bp, Homo sapiens
agggtgcagaaggagcctagga

SEQ ID NO: 9006265 - DNA, 22 bp, Homo sapiens
agggtgcagaaggagcctagga

SEQ ID NO: 9006266 - DNA, 22 bp, Homo sapiens
agggtgcaggtgtggagtctag

SEQ ID NO: 9006267 - DNA, 22 bp, Homo sapiens
agggtgcaggggaagctgccct

SEQ ID NO: 9006268 - DNA, 22 bp, Homo sapiens
agggtgcaggggaagctgccct

SEQ ID NO: 9006269 - DNA, 22 bp, Homo sapiens
agggtgcaggggaagctgccct

SEQ ID NO: 9006270 - DNA, 22 bp, Homo sapiens
agggtgcaggggaagctgccct

SEQ ID NO: 9006271 - DNA, 22 bp, Homo sapiens
agggtgcaggtgtggagtctag

SEQ ID NO: 9006272 - DNA, 22 bp, Homo sapiens
agggtgcagtcacaggaaatgt

SEQ ID NO: 9006273 - DNA, 22 bp, Homo sapiens
agggtgcagaaggagcctagga

SEQ ID NO: 9006274 - DNA, 22 bp, Homo sapiens
agggtgcagaacaaattaagac

SEQ ID NO: 9006275 - DNA, 22 bp, Homo sapiens
agggtgcaaaagcaaggacagt

SEQ ID NO: 9006276 - DNA, 22 bp, Homo sapiens
agggtgcaaaagcaaggacagt

SEQ ID NO: 9006277 - DNA, 22 bp, Homo sapiens
agggtgagggtctggccttgag

SEQ ID NO: 9006278 - DNA, 22 bp, Homo sapiens
agggtgagggtctggccttgag

SEQ ID NO: 9006279 - DNA, 22 bp, Homo sapiens
agggtgcaaaagcaaggacagt

SEQ ID NO: 9006280 - DNA, 22 bp, Homo sapiens
agggtgcaaaagcaaggacagt

SEQ ID NO: 9006281 - DNA, 22 bp, Homo sapiens
agggtcctaagcctcagataag

SEQ ID NO: 9006282 - DNA, 23 bp, Homo sapiens
agggtgagcaagctatggagacc

SEQ ID NO: 9006283 - DNA, 21 bp, Homo sapiens
agggtcctacagggctcagga

SEQ ID NO: 9006284 - DNA, 22 bp, Homo sapiens
agggtgagggtctggccttgag

SEQ ID NO: 9006285 - DNA, 23 bp, Homo sapiens
agggtgagcaagctatggagacc

SEQ ID NO: 9006286 - DNA, 23 bp, Homo sapiens
agggtgagcaagctatggagacc

SEQ ID NO: 9006287 - DNA, 21 bp, Homo sapiens
agggtcctacagggctcagga

SEQ ID NO: 9006288 - DNA, 22 bp, Homo sapiens
aggtgcaggagctgtgcaggga

SEQ ID NO: 9006289 - DNA, 21 bp, Homo sapiens
aggtgcaggcctcaagcccca

SEQ ID NO: 9006290 - DNA, 22 bp, Homo sapiens
aggtgcaggagctgtgcaggga

SEQ ID NO: 9006291 - DNA, 22 bp, Homo sapiens
aggtgcaggagctgtgcaggga

SEQ ID NO: 9006292 - DNA, 19 bp, Homo sapiens
aggtgcaggtcacagggga

SEQ ID NO: 9006293 - DNA, 19 bp, Homo sapiens
aggtgcaggtcacagggga

SEQ ID NO: 9006294 - DNA, 22 bp, Homo sapiens
aggtgaggataggtggccaagg

SEQ ID NO: 9006295 - DNA, 22 bp, Homo sapiens
aggtgaggataggtggccaagg

SEQ ID NO: 9006296 - DNA, 19 bp, Homo sapiens
aggtgaggggcaccatgtc

SEQ ID NO: 9006297 - DNA, 22 bp, Homo sapiens
aggtgagaaaacgagggttgca

SEQ ID NO: 9006298 - DNA, 22 bp, Homo sapiens
agggtgcagtcacaggaaatgt

SEQ ID NO: 9006299 - DNA, 22 bp, Homo sapiens
agggtgcatgtttgcaagagtg

SEQ ID NO: 9006300 - DNA, 22 bp, Homo sapiens
agggtgccctggagccagttcc

SEQ ID NO: 9006301 - DNA, 22 bp, Homo sapiens
agggtgcccaccgcttctgccc

SEQ ID NO: 9006302 - DNA, 22 bp, Homo sapiens
agggtgccaggattcgctgcag

SEQ ID NO: 9006303 - DNA, 22 bp, Homo sapiens
aggtgccagatgcacagctgaa

SEQ ID NO: 9006304 - DNA, 21 bp, Homo sapiens
aggtgccaaggagaagcaggc

SEQ ID NO: 9006305 - DNA, 22 bp, Homo sapiens
aggtgccaattttcagtgaaca

SEQ ID NO: 9006306 - DNA, 22 bp, Homo sapiens
aggtgccagatgcacagctgaa

SEQ ID NO: 9006307 - DNA, 22 bp, Homo sapiens
aggtgccagatgcacagctgaa

SEQ ID NO: 9006308 - DNA, 22 bp, Homo sapiens
aggtggaaatggctttcctagg

SEQ ID NO: 9006309 - DNA, 22 bp, Homo sapiens
aggtgcagtgaaggaaaaggaa

SEQ ID NO: 9006310 - DNA, 22 bp, Homo sapiens
aggtgcagtggctcatgcctgt

SEQ ID NO: 9006311 - DNA, 22 bp, Homo sapiens
aggtgcagtgaaggaaaaggaa

SEQ ID NO: 9006312 - DNA, 22 bp, Homo sapiens
aggtgccaagatgtcacagaca

SEQ ID NO: 9006313 - DNA, 21 bp, Homo sapiens
aggtgccaaggagaagcaggc

SEQ ID NO: 9006314 - DNA, 23 bp, Homo sapiens
aggtgccaactgagagctgagag

SEQ ID NO: 9006315 - DNA, 23 bp, Homo sapiens
aggtgccaactgagagctgagag

SEQ ID NO: 9006316 - DNA, 20 bp, Homo sapiens
agtgggagagggcagactgc

SEQ ID NO: 9006317 - DNA, 22 bp, Homo sapiens
agtggctggaattgcaggtgcg

SEQ ID NO: 9006318 - DNA, 22 bp, Homo sapiens
agtgggagataacttaacagct

SEQ ID NO: 9006319 - DNA, 22 bp, Homo sapiens
agtgggagccagcagcttgggg

SEQ ID NO: 9006320 - DNA, 20 bp, Homo sapiens
agtgggagagggcagactgc

SEQ ID NO: 9006321 - DNA, 20 bp, Homo sapiens
agtgggagagggcagactgc

SEQ ID NO: 9006322 - DNA, 22 bp, Homo sapiens
agtggctggaattgcaggtgcg

SEQ ID NO: 9006323 - DNA, 22 bp, Homo sapiens
agtggctggaattgcaggtgcg

SEQ ID NO: 9006324 - DNA, 22 bp, Homo sapiens
agtggctggaattgcaggtgcg

SEQ ID NO: 9006325 - DNA, 22 bp, Homo sapiens
agtggcagagccaagtagagcc

SEQ ID NO: 9006326 - DNA, 22 bp, Homo sapiens
agtggcagagccaagtagagcc

SEQ ID NO: 9006327 - DNA, 22 bp, Homo sapiens
agtggcagagccaagtagagcc

SEQ ID NO: 9006328 - DNA, 22 bp, Homo sapiens
agtggcagagcaggtgctggaa

SEQ ID NO: 9006329 - DNA, 22 bp, Homo sapiens
agtggcagagcaggtgctggaa

SEQ ID NO: 9006330 - DNA, 22 bp, Homo sapiens
agtggcagagccaagatatgat

SEQ ID NO: 9006331 - DNA, 22 bp, Homo sapiens
agtggcagagccaagtagagcc

SEQ ID NO: 9006332 - DNA, 22 bp, Homo sapiens
agtgggaggcggctgacgggcg

SEQ ID NO: 9006333 - DNA, 22 bp, Homo sapiens
agtgggaggcggctgacgggcg

SEQ ID NO: 9006334 - DNA, 22 bp, Homo sapiens
agtgggaggcggctgacgggcg

SEQ ID NO: 9006335 - DNA, 22 bp, Homo sapiens
agtggggccgcggtcctgccct

SEQ ID NO: 9006336 - DNA, 22 bp, Homo sapiens
agtggggccgcggtcctgccct

SEQ ID NO: 9006337 - DNA, 22 bp, Homo sapiens
agtgggagcggcagtcggggac

SEQ ID NO: 9006338 - DNA, 22 bp, Homo sapiens
agtgggagcggcagtcggggac

SEQ ID NO: 9006339 - DNA, 22 bp, Homo sapiens
agtgggagccagcagcttgggg

SEQ ID NO: 9006340 - DNA, 22 bp, Homo sapiens
agtgggagccagcagcttgggg

SEQ ID NO: 9006341 - DNA, 22 bp, Homo sapiens
agtgggagcggcagtcggggac

SEQ ID NO: 9006342 - DNA, 22 bp, Homo sapiens
agtgggaggaagtggtgatatt

SEQ ID NO: 9006343 - DNA, 22 bp, Homo sapiens
agtgggaggaagtggtgatatt

SEQ ID NO: 9006344 - DNA, 22 bp, Homo sapiens
agtgctgttaggttaatatagt

SEQ ID NO: 9006345 - DNA, 22 bp, Homo sapiens
agtgctgttaggttaatatagt

SEQ ID NO: 9006346 - DNA, 22 bp, Homo sapiens
agtgctgttggataatgctgtc

SEQ ID NO: 9006347 - DNA, 22 bp, Homo sapiens
agtgcttataccaaagactctt

SEQ ID NO: 9006348 - DNA, 22 bp, Homo sapiens
agtgcttagttccatgctggaa

SEQ ID NO: 9006349 - DNA, 22 bp, Homo sapiens
agtgcttaaaaccctgcactag

SEQ ID NO: 9006350 - DNA, 22 bp, Homo sapiens
agtgcttaatagatgtccagca

SEQ ID NO: 9006351 - DNA, 22 bp, Homo sapiens
agtgcttaaaaccctgcactag

SEQ ID NO: 9006352 - DNA, 22 bp, Homo sapiens
agtgcttggcaaccttctgacc

SEQ ID NO: 9006353 - DNA, 22 bp, Homo sapiens
agtgcttggttcaatgaaggtt

SEQ ID NO: 9006354 - DNA, 22 bp, Homo sapiens
agtgcttggttcaatgaaggtt

SEQ ID NO: 9006355 - DNA, 20 bp, Homo sapiens
agtgcttattttcatggctg

SEQ ID NO: 9006356 - DNA, 22 bp, Homo sapiens
agtgcttgtgaaatactagagg

SEQ ID NO: 9006357 - DNA, 22 bp, Homo sapiens
agtgctttagaccttttggggt

SEQ ID NO: 9006358 - DNA, 22 bp, Homo sapiens
agtgctttacctagataatgtt

SEQ ID NO: 9006359 - DNA, 22 bp, Homo sapiens
agtgctttagaccttttggggt

SEQ ID NO: 9006360 - DNA, 22 bp, Homo sapiens
agtgctttagagaaatggtgct

SEQ ID NO: 9006361 - DNA, 22 bp, Homo sapiens
agtgctttcttgctccatcagt

SEQ ID NO: 9006362 - DNA, 22 bp, Homo sapiens
agtgctttccttcttgtgacat

SEQ ID NO: 9006363 - DNA, 22 bp, Homo sapiens
agtgctttccttcttgtgacat

SEQ ID NO: 9006364 - DNA, 22 bp, Homo sapiens
agtgctttccttcttgtgacat

SEQ ID NO: 9006365 - DNA, 22 bp, Homo sapiens
agtgctttccctgaaaccttcc

SEQ ID NO: 9006366 - DNA, 22 bp, Homo sapiens
agtgctttcagtgtgctctttt

SEQ ID NO: 9006367 - DNA, 22 bp, Homo sapiens
agtgctttccctgaaaccttcc

SEQ ID NO: 9006368 - DNA, 22 bp, Homo sapiens
agtgctttagagaaatggtgct

SEQ ID NO: 9006369 - DNA, 22 bp, Homo sapiens
agtgctttagcatccaactgtc

SEQ ID NO: 9006370 - DNA, 22 bp, Homo sapiens
agtgctttagcatccaactgtc

SEQ ID NO: 9006371 - DNA, 22 bp, Homo sapiens
agtgctttatgttgttgtgcaa

SEQ ID NO: 9006372 - DNA, 22 bp, Homo sapiens
agtgctttcagtgtgctctttt

SEQ ID NO: 9006373 - DNA, 22 bp, Homo sapiens
agtgctttggtatagaactatt

SEQ ID NO: 9006374 - DNA, 22 bp, Homo sapiens
agtgctttggtatagaactatt

SEQ ID NO: 9006375 - DNA, 22 bp, Homo sapiens
agtgctttggtatagaactatt

SEQ ID NO: 9006376 - DNA, 22 bp, Homo sapiens
agtggcagaagtcactgggtag

SEQ ID NO: 9006377 - DNA, 22 bp, Homo sapiens
agtggcagacacaatgtgggca

SEQ ID NO: 9006378 - DNA, 22 bp, Homo sapiens
agtgctttgaacgaaaggctga

SEQ ID NO: 9006379 - DNA, 22 bp, Homo sapiens
agtgctttcttgctccatcagt

SEQ ID NO: 9006380 - DNA, 22 bp, Homo sapiens
agtgctttgaacgaaaggctga

SEQ ID NO: 9006381 - DNA, 22 bp, Homo sapiens
agtgctttgaatgttctgggca

SEQ ID NO: 9006382 - DNA, 22 bp, Homo sapiens
agtgctttgagcgtttgaaaag

SEQ ID NO: 9006383 - DNA, 22 bp, Homo sapiens
agtgctttgagcgtttgaaaag

SEQ ID NO: 9006384 - DNA, 22 bp, Homo sapiens
agtgctttggatgatgtgggat

SEQ ID NO: 9006385 - DNA, 22 bp, Homo sapiens
agtgctttggatgatgtgggat

SEQ ID NO: 9006386 - DNA, 22 bp, Homo sapiens
agtgctttgaatgttctgggca

SEQ ID NO: 9006387 - DNA, 22 bp, Homo sapiens
agtggcagagaccccagccagc

SEQ ID NO: 9006388 - DNA, 22 bp, Homo sapiens
agtggcagacagagacagtacc

SEQ ID NO: 9006389 - DNA, 22 bp, Homo sapiens
agtggcagacagagacagtacc

SEQ ID NO: 9006390 - DNA, 22 bp, Homo sapiens
agtggcagacagagacagtacc

SEQ ID NO: 9006391 - DNA, 22 bp, Homo sapiens
agtggcagacagagacagtacc

SEQ ID NO: 9006392 - DNA, 22 bp, Homo sapiens
agtggcagacacaatgtgggca

SEQ ID NO: 9006393 - DNA, 22 bp, Homo sapiens
agtggcagacacaatgtgggca

SEQ ID NO: 9006394 - DNA, 22 bp, Homo sapiens
agtggcagacacaatgtgggca

SEQ ID NO: 9006395 - DNA, 22 bp, Homo sapiens
agtggcagagaccccagccagc

SEQ ID NO: 9006396 - DNA, 22 bp, Homo sapiens
agtggcagagaccccagccagc

SEQ ID NO: 9006397 - DNA, 22 bp, Homo sapiens
agtggcagagcaggtgctggaa

SEQ ID NO: 9006398 - DNA, 22 bp, Homo sapiens
agtggcagagcaggtgctggaa

SEQ ID NO: 9006399 - DNA, 22 bp, Homo sapiens
agtgatttggcggcagagttag

SEQ ID NO: 9006400 - DNA, 22 bp, Homo sapiens
agtgatttgcagtatttactaa

SEQ ID NO: 9006401 - DNA, 22 bp, Homo sapiens
agtgatttggttcatacttcca

SEQ ID NO: 9006402 - DNA, 22 bp, Homo sapiens
agtgatttggttcatacttcca

SEQ ID NO: 9006403 - DNA, 20 bp, Homo sapiens
agtgatttgttagtacattg

SEQ ID NO: 9006404 - DNA, 20 bp, Homo sapiens
agtgatttgttagtacattg

SEQ ID NO: 9006405 - DNA, 22 bp, Homo sapiens
agtgattttaacttccagcaat

SEQ ID NO: 9006406 - DNA, 22 bp, Homo sapiens
agtgattttatcaatttactca

SEQ ID NO: 9006407 - DNA, 22 bp, Homo sapiens
agtgattttatcaatttactca

SEQ ID NO: 9006408 - DNA, 22 bp, Homo sapiens
agtgattttatcaatttactca

SEQ ID NO: 9006409 - DNA, 22 bp, Homo sapiens
agtgattttcaagtggagcaca

SEQ ID NO: 9006410 - DNA, 22 bp, Homo sapiens
agtgattttgctttgaagtgac

SEQ ID NO: 9006411 - DNA, 22 bp, Homo sapiens
agtgcaaaattcagaagcaatt

SEQ ID NO: 9006412 - DNA, 22 bp, Homo sapiens
agtgcaaaattcagaagcaatt

SEQ ID NO: 9006413 - DNA, 22 bp, Homo sapiens
agtgcaaaattcagaagcaatt

SEQ ID NO: 9006414 - DNA, 22 bp, Homo sapiens
agtgcaaactttattgtgacct

SEQ ID NO: 9006415 - DNA, 22 bp, Homo sapiens
agtgcaaactttattgtgacct

SEQ ID NO: 9006416 - DNA, 22 bp, Homo sapiens
agtgcaaagaaatcagctttgt

SEQ ID NO: 9006417 - DNA, 22 bp, Homo sapiens
agtgcaaaattcagaagcaatt

SEQ ID NO: 9006418 - DNA, 22 bp, Homo sapiens
agtgctgaagactggctaggga

SEQ ID NO: 9006419 - DNA, 23 bp, Homo sapiens
agtgctgaattgaaagctccagg

SEQ ID NO: 9006420 - DNA, 22 bp, Homo sapiens
agtgctgaagactggctaggga

SEQ ID NO: 9006421 - DNA, 22 bp, Homo sapiens
agtgcaatagcaaagaacaaca

SEQ ID NO: 9006422 - DNA, 22 bp, Homo sapiens
agtgctgtccagtttcacaggt

SEQ ID NO: 9006423 - DNA, 22 bp, Homo sapiens
agtgctgtccagtttcacaggt

SEQ ID NO: 9006424 - DNA, 22 bp, Homo sapiens
agtgctgtcccgacaactgagg

SEQ ID NO: 9006425 - DNA, 22 bp, Homo sapiens
agtgctgtcccgacaactgagg

SEQ ID NO: 9006426 - DNA, 22 bp, Homo sapiens
agtgctgtctccttcccccggg

SEQ ID NO: 9006427 - DNA, 20 bp, Homo sapiens
agtgctgtggctgaataaga

SEQ ID NO: 9006428 - DNA, 20 bp, Homo sapiens
agtgcaagaaagcacagctg

SEQ ID NO: 9006429 - DNA, 20 bp, Homo sapiens
agtgcaagaaagcacagctg

SEQ ID NO: 9006430 - DNA, 20 bp, Homo sapiens
agtgcaagaaagcacagctg

SEQ ID NO: 9006431 - DNA, 22 bp, Homo sapiens
agtgcaaagggatcagattggg

SEQ ID NO: 9006432 - DNA, 22 bp, Homo sapiens
agtgcaaagggctgttgagaag

SEQ ID NO: 9006433 - DNA, 22 bp, Homo sapiens
agtgcaaagggctgttgagaag

SEQ ID NO: 9006434 - DNA, 22 bp, Homo sapiens
agtgcaaagggctgttgagaag

SEQ ID NO: 9006435 - DNA, 22 bp, Homo sapiens
agtgcaaattatttacctgatt

SEQ ID NO: 9006436 - DNA, 22 bp, Homo sapiens
agtgcaaagctgctgctgtggt

SEQ ID NO: 9006437 - DNA, 22 bp, Homo sapiens
agtgcaaagggatcagattggg

SEQ ID NO: 9006438 - DNA, 22 bp, Homo sapiens
agtgcaaagcagcctgtacacc

SEQ ID NO: 9006439 - DNA, 22 bp, Homo sapiens
agtgcaaagcagcctgtacacc

SEQ ID NO: 9006440 - DNA, 22 bp, Homo sapiens
agtgcaaagaaatcagctttgt

SEQ ID NO: 9006441 - DNA, 22 bp, Homo sapiens
agtgcaaagaaatcagctttgt

SEQ ID NO: 9006442 - DNA, 22 bp, Homo sapiens
agtgaatgtccccgcgggtcag

SEQ ID NO: 9006443 - DNA, 22 bp, Homo sapiens
agtgaatgagaggtgagtattg

SEQ ID NO: 9006444 - DNA, 21 bp, Homo sapiens
agtccttgaaactctttcttg

SEQ ID NO: 9006445 - DNA, 22 bp, Homo sapiens
agtgagacagtatactgagcag

SEQ ID NO: 9006446 - DNA, 22 bp, Homo sapiens
agtgagacagtggactctgcat

SEQ ID NO: 9006447 - DNA, 22 bp, Homo sapiens
agtgagagtattaatgtgaact

SEQ ID NO: 9006448 - DNA, 17 bp, Homo sapiens
agtgagaatgtcatgta

SEQ ID NO: 9006449 - DNA, 22 bp, Homo sapiens
agtgagacagtatactgagcag

SEQ ID NO: 9006450 - DNA, 23 bp, Homo sapiens
agtgaattcagtttaaaacagag

SEQ ID NO: 9006451 - DNA, 22 bp, Homo sapiens
agtgagagtattaatgtgaact

SEQ ID NO: 9006452 - DNA, 22 bp, Homo sapiens
agtgagagtattaatgtgaact

SEQ ID NO: 9006453 - DNA, 22 bp, Homo sapiens
agtgagagtattaatgtgaact

SEQ ID NO: 9006454 - DNA, 22 bp, Homo sapiens
agtgaggcaaagtgagaggcag

SEQ ID NO: 9006455 - DNA, 20 bp, Homo sapiens
agtgaggcagttcagtgggc

SEQ ID NO: 9006456 - DNA, 20 bp, Homo sapiens
agtgaggcagttcagtgggc

SEQ ID NO: 9006457 - DNA, 22 bp, Homo sapiens
agtgaggaaatccattatcaag

SEQ ID NO: 9006458 - DNA, 19 bp, Homo sapiens
agtgagcatggcttgactg

SEQ ID NO: 9006459 - DNA, 17 bp, Homo sapiens
agtgaggagattggaag

SEQ ID NO: 9006460 - DNA, 22 bp, Homo sapiens
agtgaggataccaatgtgtaga

SEQ ID NO: 9006461 - DNA, 22 bp, Homo sapiens
agtgagcattcgtttggaaccc

SEQ ID NO: 9006462 - DNA, 22 bp, Homo sapiens
agtgagcatcttcaggagccaa

SEQ ID NO: 9006463 - DNA, 19 bp, Homo sapiens
agtgagcatccagagaggt

SEQ ID NO: 9006464 - DNA, 19 bp, Homo sapiens
agtgagcatccagagaggt

SEQ ID NO: 9006465 - DNA, 22 bp, Homo sapiens
agtgagatgagtttttgactta

SEQ ID NO: 9006466 - DNA, 22 bp, Homo sapiens
agtgagcaacagaagcgtgggt

SEQ ID NO: 9006467 - DNA, 22 bp, Homo sapiens
agtgagcaacagaagcgtgggt

SEQ ID NO: 9006468 - DNA, 20 bp, Homo sapiens
agtgagattgctgctctagc

SEQ ID NO: 9006469 - DNA, 23 bp, Homo sapiens
agtgagcagctgtagggcaagga

SEQ ID NO: 9006470 - DNA, 23 bp, Homo sapiens
agtgagcagctgtagggcaagga

SEQ ID NO: 9006471 - DNA, 22 bp, Homo sapiens
agtgagcaagacttcgttgtcc

SEQ ID NO: 9006472 - DNA, 22 bp, Homo sapiens
agtgtggggtcaccggcccagg

SEQ ID NO: 9006473 - DNA, 22 bp, Homo sapiens
agtgtgggtgagggaggccctc

SEQ ID NO: 9006474 - DNA, 22 bp, Homo sapiens
agtgtgggtgagggaggccctc

SEQ ID NO: 9006475 - DNA, 22 bp, Homo sapiens
agtgtgggttttatggagccct

SEQ ID NO: 9006476 - DNA, 22 bp, Homo sapiens
agtgtgggttttatggagccct

SEQ ID NO: 9006477 - DNA, 22 bp, Homo sapiens
agtgtgtaagggatcaaagagt

SEQ ID NO: 9006478 - DNA, 23 bp, Homo sapiens
agtgtgtaaggtactttgctgct

SEQ ID NO: 9006479 - DNA, 22 bp, Homo sapiens
agtgtgtacataattgtacgcc

SEQ ID NO: 9006480 - DNA, 22 bp, Homo sapiens
agtgtggtcgggagcgcggggc

SEQ ID NO: 9006481 - DNA, 20 bp, Homo sapiens
agtgtggttttcaggaatat

SEQ ID NO: 9006482 - DNA, 20 bp, Homo sapiens
agtgtggttttcaggaatat

SEQ ID NO: 9006483 - DNA, 17 bp, Homo sapiens
agtgtgtaacttgtgta

SEQ ID NO: 9006484 - DNA, 22 bp, Homo sapiens
agtgtcttacatgaattgattt

SEQ ID NO: 9006485 - DNA, 22 bp, Homo sapiens
agtgtctgttgttcagaactct

SEQ ID NO: 9006486 - DNA, 22 bp, Homo sapiens
agtgtcttacatgaattgattt

SEQ ID NO: 9006487 - DNA, 22 bp, Homo sapiens
agtgtcttacatgaattgattt

SEQ ID NO: 9006488 - DNA, 22 bp, Homo sapiens
agtgtcttacatgaattgattt

SEQ ID NO: 9006489 - DNA, 22 bp, Homo sapiens
agtgtctgttgttcagaactct

SEQ ID NO: 9006490 - DNA, 22 bp, Homo sapiens
agtgtctgttgttcagaactct

SEQ ID NO: 9006491 - DNA, 22 bp, Homo sapiens
agtgtctgttgcttttgcagtg

SEQ ID NO: 9006492 - DNA, 22 bp, Homo sapiens
agtgtctgttgagtttcaaaag

SEQ ID NO: 9006493 - DNA, 22 bp, Homo sapiens
agtgtctttagcaagtttagtc

SEQ ID NO: 9006494 - DNA, 22 bp, Homo sapiens
agtgtctttagcaagtttagtc

SEQ ID NO: 9006495 - DNA, 22 bp, Homo sapiens
agtgtctttatagactgacaat

SEQ ID NO: 9006496 - DNA, 22 bp, Homo sapiens
agtgtctttcatatcctccatc

SEQ ID NO: 9006497 - DNA, 22 bp, Homo sapiens
agtgtcttcatgatgtggcagc

SEQ ID NO: 9006498 - DNA, 22 bp, Homo sapiens
agtgtcttagtccatttgggct

SEQ ID NO: 9006499 - DNA, 22 bp, Homo sapiens
agtgtctttagcaagtttagtc

SEQ ID NO: 9006500 - DNA, 22 bp, Homo sapiens
agtgtcttagtccatttgggct

SEQ ID NO: 9006501 - DNA, 22 bp, Homo sapiens
agtgtcttactccctcaggcac

SEQ ID NO: 9006502 - DNA, 22 bp, Homo sapiens
agtgtctttagcaagtttagtc

SEQ ID NO: 9006503 - DNA, 23 bp, Homo sapiens
agtgtgtattgctgagggcagct

SEQ ID NO: 9006504 - DNA, 22 bp, Homo sapiens
agtgtgtccagaaatctgtatt

SEQ ID NO: 9006505 - DNA, 22 bp, Homo sapiens
agtgtgtcgagggagggtccag

SEQ ID NO: 9006506 - DNA, 22 bp, Homo sapiens
agtgtgtccaggaagcagatgg

SEQ ID NO: 9006507 - DNA, 22 bp, Homo sapiens
agtgtgtcgagggagggtccag

SEQ ID NO: 9006508 - DNA, 22 bp, Homo sapiens
agtgtgtctgatcacttgtgag

SEQ ID NO: 9006509 - DNA, 20 bp, Homo sapiens
agtgtgtctcggaggtaagt

SEQ ID NO: 9006510 - DNA, 22 bp, Homo sapiens
agtgtgtagcaatatgctggca

SEQ ID NO: 9006511 - DNA, 22 bp, Homo sapiens
agtgtgtagcacatggtaagca

SEQ ID NO: 9006512 - DNA, 22 bp, Homo sapiens
agtgtgtagcacatggtaagca

SEQ ID NO: 9006513 - DNA, 22 bp, Homo sapiens
agtgtgtagcatttggcaggca

SEQ ID NO: 9006514 - DNA, 22 bp, Homo sapiens
agtgtgtcagttgaaagagatt

SEQ ID NO: 9006515 - DNA, 19 bp, Homo sapiens
agtgtgtactgaaagcact

SEQ ID NO: 9006516 - DNA, 22 bp, Homo sapiens
agtgtgtacatttggtgcagtt

SEQ ID NO: 9006517 - DNA, 17 bp, Homo sapiens
agtgtgtgaaatggtgg

SEQ ID NO: 9006518 - DNA, 17 bp, Homo sapiens
agtgtgtgaaatggtgg

SEQ ID NO: 9006519 - DNA, 17 bp, Homo sapiens
agtgtgtgaaatggtgg

SEQ ID NO: 9006520 - DNA, 22 bp, Homo sapiens
agtgtgtcttatcctgggagaa

SEQ ID NO: 9006521 - DNA, 17 bp, Homo sapiens
agtgtgtgaaatggtgg

SEQ ID NO: 9006522 - DNA, 22 bp, Homo sapiens
agtgtgtgaccttttaatttaa

SEQ ID NO: 9006523 - DNA, 22 bp, Homo sapiens
agtgggggccaacgagggcagc

SEQ ID NO: 9006524 - DNA, 22 bp, Homo sapiens
agtgggggccaacgagggcagc

SEQ ID NO: 9006525 - DNA, 22 bp, Homo sapiens
agtgggggccaacgagggcagc

SEQ ID NO: 9006526 - DNA, 22 bp, Homo sapiens
agtgggggccaacgagggcagc

SEQ ID NO: 9006527 - DNA, 22 bp, Homo sapiens
agtgggggccaacgagggcagc

SEQ ID NO: 9006528 - DNA, 22 bp, Homo sapiens
agtgggggccaacgagggcagc

SEQ ID NO: 9006529 - DNA, 22 bp, Homo sapiens
agtgggggccaacgagggcagc

SEQ ID NO: 9006530 - DNA, 22 bp, Homo sapiens
agtgggggccaacgagggcagc

SEQ ID NO: 9006531 - DNA, 21 bp, Homo sapiens
agtggggtctctgtggaggcc

SEQ ID NO: 9006532 - DNA, 22 bp, Homo sapiens
agtgggggctggctctgtctgt

SEQ ID NO: 9006533 - DNA, 22 bp, Homo sapiens
agtgggggctggctctgtctgt

SEQ ID NO: 9006534 - DNA, 22 bp, Homo sapiens
agtgggggcagagcctctctcg

SEQ ID NO: 9006535 - DNA, 22 bp, Homo sapiens
agtggggcggacaggaccagga

SEQ ID NO: 9006536 - DNA, 22 bp, Homo sapiens
agtggggcggacaggaccagga

SEQ ID NO: 9006537 - DNA, 22 bp, Homo sapiens
agtgggggcagagcctctctcg

SEQ ID NO: 9006538 - DNA, 22 bp, Homo sapiens
agtggggccggtgaggccgagg

SEQ ID NO: 9006539 - DNA, 22 bp, Homo sapiens
agtggggcggacaggaccagga

SEQ ID NO: 9006540 - DNA, 22 bp, Homo sapiens
agtgtctggtgagggctctctc

SEQ ID NO: 9006541 - DNA, 22 bp, Homo sapiens
agtgtctgaacctgcagtggga

SEQ ID NO: 9006542 - DNA, 22 bp, Homo sapiens
agtgtctgaaccaccggggcat

SEQ ID NO: 9006543 - DNA, 22 bp, Homo sapiens
agtgtctgaaccaccggggcat

SEQ ID NO: 9006544 - DNA, 22 bp, Homo sapiens
agtgtctgaaccaccggggcat

SEQ ID NO: 9006545 - DNA, 22 bp, Homo sapiens
agtgtctggtgagggctctctc

SEQ ID NO: 9006546 - DNA, 22 bp, Homo sapiens
agtgtctggtgagggctctctc

SEQ ID NO: 9006547 - DNA, 20 bp, Homo sapiens
agtgtctggtgcagggcctc

SEQ ID NO: 9006548 - DNA, 20 bp, Homo sapiens
agtgtctggtgcagggcctc

SEQ ID NO: 9006549 - DNA, 20 bp, Homo sapiens
agtgtctggtgcagggcctc

SEQ ID NO: 9006550 - DNA, 22 bp, Homo sapiens
agtgtctggtgagggctctctc

SEQ ID NO: 9006551 - DNA, 22 bp, Homo sapiens
agtgtctgtgatgaggtcagga

SEQ ID NO: 9006552 - DNA, 22 bp, Homo sapiens
agtgtctgtgaggggaattcct

SEQ ID NO: 9006553 - DNA, 22 bp, Homo sapiens
agtgtctgtgttttctattgct

SEQ ID NO: 9006554 - DNA, 22 bp, Homo sapiens
agtgtctgtgctttgcagcaaa

SEQ ID NO: 9006555 - DNA, 20 bp, Homo sapiens
agtgtctggtgcagggcctc

SEQ ID NO: 9006556 - DNA, 22 bp, Homo sapiens
agtgtctgtgatgaggtcagga

SEQ ID NO: 9006557 - DNA, 22 bp, Homo sapiens
agtgtctgtgatgaggtcagga

SEQ ID NO: 9006558 - DNA, 22 bp, Homo sapiens
agtgtctgtgatgaggtcagga

SEQ ID NO: 9006559 - DNA, 22 bp, Homo sapiens
agtgtctgtgatgaggtcagga

SEQ ID NO: 9006560 - DNA, 22 bp, Homo sapiens
agtgtctgttacgcttgcagaa

SEQ ID NO: 9006561 - DNA, 22 bp, Homo sapiens
agtgtctgttacgcttgcagaa

SEQ ID NO: 9006562 - DNA, 22 bp, Homo sapiens
agtgtctgtgttttctattgct

SEQ ID NO: 9006563 - DNA, 22 bp, Homo sapiens
agtgtctgtgttttctattgct

SEQ ID NO: 9006564 - DNA, 22 bp, Homo sapiens
agtgtctgttgagtttcaaaag

SEQ ID NO: 9006565 - DNA, 22 bp, Homo sapiens
agtgtctgttacgcttgcagaa

SEQ ID NO: 9006566 - DNA, 22 bp, Homo sapiens
agttaataatggaaagacacat

SEQ ID NO: 9006567 - DNA, 22 bp, Homo sapiens
agttaataatggaaagacacat

SEQ ID NO: 9006568 - DNA, 22 bp, Homo sapiens
agttaatgagcattttggaatg

SEQ ID NO: 9006569 - DNA, 19 bp, Homo sapiens
agttaatgagcttttgatc

SEQ ID NO: 9006570 - DNA, 22 bp, Homo sapiens
agttaagggggttcatctgtaa

SEQ ID NO: 9006571 - DNA, 17 bp, Homo sapiens
agttaaggctctttgct

SEQ ID NO: 9006572 - DNA, 22 bp, Homo sapiens
agttacaaacactatcagttct

SEQ ID NO: 9006573 - DNA, 22 bp, Homo sapiens
agttacaaacactatcagttct

SEQ ID NO: 9006574 - DNA, 22 bp, Homo sapiens
agttacaaccatgacacaagca

SEQ ID NO: 9006575 - DNA, 22 bp, Homo sapiens
agttacaaccatgacacaagca

SEQ ID NO: 9006576 - DNA, 22 bp, Homo sapiens
agttacaaccatgacacaagca

SEQ ID NO: 9006577 - DNA, 22 bp, Homo sapiens
actggttgaagaaaagctagta

SEQ ID NO: 9006578 - DNA, 22 bp, Homo sapiens
actggtgtgcttttgttacata

SEQ ID NO: 9006579 - DNA, 22 bp, Homo sapiens
actggtggtttctccccagaga

SEQ ID NO: 9006580 - DNA, 22 bp, Homo sapiens
actggtgttgatttggaagggg

SEQ ID NO: 9006581 - DNA, 22 bp, Homo sapiens
actggtgttgatttggaagggg

SEQ ID NO: 9006582 - DNA, 22 bp, Homo sapiens
actggtctaagacattgggacc

SEQ ID NO: 9006583 - DNA, 22 bp, Homo sapiens
actggtcctctgccagcagctg

SEQ ID NO: 9006584 - DNA, 22 bp, Homo sapiens
actggtggctttcagacagaaa

SEQ ID NO: 9006585 - DNA, 22 bp, Homo sapiens
actggtggccctcagtgttctc

SEQ ID NO: 9006586 - DNA, 20 bp, Homo sapiens
actggtggactgttcattga

SEQ ID NO: 9006587 - DNA, 22 bp, Homo sapiens
actggtctagaagggagaagac

SEQ ID NO: 9006588 - DNA, 22 bp, Homo sapiens
actggtctagaagggagaagac

SEQ ID NO: 9006589 - DNA, 22 bp, Homo sapiens
actggggcagtgggcagtggtt

SEQ ID NO: 9006590 - DNA, 22 bp, Homo sapiens
actggggagttgaagcactttc

SEQ ID NO: 9006591 - DNA, 22 bp, Homo sapiens
actggggattagggactcagtg

SEQ ID NO: 9006592 - DNA, 22 bp, Homo sapiens
actggggattagggactcagtg

SEQ ID NO: 9006593 - DNA, 22 bp, Homo sapiens
actggggcaggaaagtatgctg

SEQ ID NO: 9006594 - DNA, 22 bp, Homo sapiens
actggggcctcctccatgctct

SEQ ID NO: 9006595 - DNA, 22 bp, Homo sapiens
actgggtgtaaaggacttaagc

SEQ ID NO: 9006596 - DNA, 22 bp, Homo sapiens
actgggtggctgcctccttctc

SEQ ID NO: 9006597 - DNA, 22 bp, Homo sapiens
actgggtggctgcctccttctc

SEQ ID NO: 9006598 - DNA, 22 bp, Homo sapiens
actggggtgaaattggagtgtc

SEQ ID NO: 9006599 - DNA, 22 bp, Homo sapiens
agttacatctgttatgtgtgtt

SEQ ID NO: 9006600 - DNA, 21 bp, Homo sapiens
agttacatgtatagataaagt

SEQ ID NO: 9006601 - DNA, 22 bp, Homo sapiens
agttacatgactgccggcggtg

SEQ ID NO: 9006602 - DNA, 22 bp, Homo sapiens
agttacatataagaagacagac

SEQ ID NO: 9006603 - DNA, 22 bp, Homo sapiens
agttacataatctgtgaatttt

SEQ ID NO: 9006604 - DNA, 22 bp, Homo sapiens
agttacatataagaagacagac

SEQ ID NO: 9006605 - DNA, 21 bp, Homo sapiens
agttacatgtatagataaagt

SEQ ID NO: 9006606 - DNA, 21 bp, Homo sapiens
agttacatgtatagataaagt

SEQ ID NO: 9006607 - DNA, 21 bp, Homo sapiens
agttacatgtatagataaagt

SEQ ID NO: 9006608 - DNA, 22 bp, Homo sapiens
agttacatgtgaatagaaagta

SEQ ID NO: 9006609 - DNA, 22 bp, Homo sapiens
agttacatgtgaatagaaagta

SEQ ID NO: 9006610 - DNA, 22 bp, Homo sapiens
agttacatgtgaatagaaagta

SEQ ID NO: 9006611 - DNA, 22 bp, Homo sapiens
agttacagtgaccatttattta

SEQ ID NO: 9006612 - DNA, 22 bp, Homo sapiens
agttacataatctgtgaatttt

SEQ ID NO: 9006613 - DNA, 22 bp, Homo sapiens
agttacagtgttctattactct

SEQ ID NO: 9006614 - DNA, 22 bp, Homo sapiens
agttacaggaaagggccaggaa

SEQ ID NO: 9006615 - DNA, 22 bp, Homo sapiens
agttacagcactcaaagttttc

SEQ ID NO: 9006616 - DNA, 22 bp, Homo sapiens
agttacacataaacattaaagg

SEQ ID NO: 9006617 - DNA, 22 bp, Homo sapiens
agttacaaccatgacacaagca

SEQ ID NO: 9006618 - DNA, 22 bp, Homo sapiens
agttacaaccatgacacaagca

SEQ ID NO: 9006619 - DNA, 22 bp, Homo sapiens
agttacaaacactatcagttct

SEQ ID NO: 9006620 - DNA, 22 bp, Homo sapiens
agttacaaccatgacacaagca

SEQ ID NO: 9006621 - DNA, 22 bp, Homo sapiens
agttacaagctattttacttaa

SEQ ID NO: 9006622 - DNA, 21 bp, Homo sapiens
agttacaagtttattcagagg

SEQ ID NO: 9006623 - DNA, 21 bp, Homo sapiens
agttacaagtttattcagagg

SEQ ID NO: 9006624 - DNA, 22 bp, Homo sapiens
agttacaagtacaggctttgga

SEQ ID NO: 9006625 - DNA, 22 bp, Homo sapiens
agttacaagctattttacttaa

SEQ ID NO: 9006626 - DNA, 22 bp, Homo sapiens
agttcaaagctgcagtaatgga

SEQ ID NO: 9006627 - DNA, 22 bp, Homo sapiens
agttcaaaaaggtaaagtttat

SEQ ID NO: 9006628 - DNA, 22 bp, Homo sapiens
agttcaaagctgcagtaatgga

SEQ ID NO: 9006629 - DNA, 22 bp, Homo sapiens
agttcaacaccagcctgaccaa

SEQ ID NO: 9006630 - DNA, 22 bp, Homo sapiens
agttcaagcaatgctggaagaa

SEQ ID NO: 9006631 - DNA, 22 bp, Homo sapiens
agttcaacctaatacagcagaa

SEQ ID NO: 9006632 - DNA, 22 bp, Homo sapiens
agttcaatagaaaaatatatta

SEQ ID NO: 9006633 - DNA, 22 bp, Homo sapiens
agttcaatagaaaaatatatta

SEQ ID NO: 9006634 - DNA, 22 bp, Homo sapiens
agttcaattgttttgtaaaagt

SEQ ID NO: 9006635 - DNA, 22 bp, Homo sapiens
agttcacaagcgtaggtgctga

SEQ ID NO: 9006636 - DNA, 22 bp, Homo sapiens
agttcacaagcgtaggtgctga

SEQ ID NO: 9006637 - DNA, 22 bp, Homo sapiens
agttcaattgttttgtaaaagt

SEQ ID NO: 9006638 - DNA, 19 bp, Homo sapiens
agttatttctaaatttacc

SEQ ID NO: 9006639 - DNA, 22 bp, Homo sapiens
agttattttggaaaatgagtca

SEQ ID NO: 9006640 - DNA, 22 bp, Homo sapiens
agttattttacatggaagtttg

SEQ ID NO: 9006641 - DNA, 22 bp, Homo sapiens
agttattttggaaaatgagtca

SEQ ID NO: 9006642 - DNA, 22 bp, Homo sapiens
agttattttggaaaatgagtca

SEQ ID NO: 9006643 - DNA, 19 bp, Homo sapiens
agttatttctaaatttacc

SEQ ID NO: 9006644 - DNA, 19 bp, Homo sapiens
agttatttctaaatttacc

SEQ ID NO: 9006645 - DNA, 20 bp, Homo sapiens
agttactaagtgctggaacc

SEQ ID NO: 9006646 - DNA, 20 bp, Homo sapiens
agttacgctattactctcct

SEQ ID NO: 9006647 - DNA, 22 bp, Homo sapiens
agttaccatatatcaaacatgg

SEQ ID NO: 9006648 - DNA, 22 bp, Homo sapiens
agttaccacccacaagcttgtt

SEQ ID NO: 9006649 - DNA, 22 bp, Homo sapiens
agttaccagccgtaagaagcat

SEQ ID NO: 9006650 - DNA, 22 bp, Homo sapiens
agttaccagccgtaagaagcat

SEQ ID NO: 9006651 - DNA, 22 bp, Homo sapiens
agttacatgtgaatagaaagta

SEQ ID NO: 9006652 - DNA, 22 bp, Homo sapiens
agttacattctgagctgagtag

SEQ ID NO: 9006653 - DNA, 22 bp, Homo sapiens
agaaatgtacacgacacccaga

SEQ ID NO: 9006654 - DNA, 22 bp, Homo sapiens
agaaatgtacgatgttatgcag

SEQ ID NO: 9006655 - DNA, 22 bp, Homo sapiens
agaaatgtacgatgttatgcag

SEQ ID NO: 9006656 - DNA, 22 bp, Homo sapiens
agaaatgtacgatgttatgcag

SEQ ID NO: 9006657 - DNA, 22 bp, Homo sapiens
agaaatgtaggcatataaggaa

SEQ ID NO: 9006658 - DNA, 22 bp, Homo sapiens
agaaatgtaggcatataaggaa

SEQ ID NO: 9006659 - DNA, 22 bp, Homo sapiens
agaaatgtatagtgaatttttc

SEQ ID NO: 9006660 - DNA, 22 bp, Homo sapiens
agaaatgtatagtgaatttttc

SEQ ID NO: 9006661 - DNA, 22 bp, Homo sapiens
agaaatgtatagtgaatttttc

SEQ ID NO: 9006662 - DNA, 22 bp, Homo sapiens
agaaatggaaatccaagcaact

SEQ ID NO: 9006663 - DNA, 22 bp, Homo sapiens
agaaatgtaattgcaactgtct

SEQ ID NO: 9006664 - DNA, 22 bp, Homo sapiens
agaaatggtgagtgagagcccc

SEQ ID NO: 9006665 - DNA, 22 bp, Homo sapiens
agaaatgtaattgcaactgtct

SEQ ID NO: 9006666 - DNA, 22 bp, Homo sapiens
agaaatgtaattgcaactgtct

SEQ ID NO: 9006667 - DNA, 22 bp, Homo sapiens
agaaatgtacacgacacccaga

SEQ ID NO: 9006668 - DNA, 22 bp, Homo sapiens
agaaatgtaattgcaactgtct

SEQ ID NO: 9006669 - DNA, 22 bp, Homo sapiens
agaaatgtcaggaaagaagtcc

SEQ ID NO: 9006670 - DNA, 22 bp, Homo sapiens
agaaatgtcaggaaagaagtcc

SEQ ID NO: 9006671 - DNA, 22 bp, Homo sapiens
agaaatgtcaggaaagaagtcc

SEQ ID NO: 9006672 - DNA, 22 bp, Homo sapiens
agaaatgtcaggaaagaagtcc

SEQ ID NO: 9006673 - DNA, 22 bp, Homo sapiens
agaaatgtcaagtgttcttgtt

SEQ ID NO: 9006674 - DNA, 22 bp, Homo sapiens
agaaatgtcaagtgttcttgtt

SEQ ID NO: 9006675 - DNA, 22 bp, Homo sapiens
agaaatgtcaagtgttcttgtt

SEQ ID NO: 9006676 - DNA, 22 bp, Homo sapiens
agaaatgtcaggaaagaagtcc

SEQ ID NO: 9006677 - DNA, 22 bp, Homo sapiens
agaaatgtattctgtatgtttt

SEQ ID NO: 9006678 - DNA, 22 bp, Homo sapiens
agaaatgtattctgtatgtttt

SEQ ID NO: 9006679 - DNA, 22 bp, Homo sapiens
agaaatgtattctgtatgtttt

SEQ ID NO: 9006680 - DNA, 22 bp, Homo sapiens
agaaatgtattctgtatgtttt

SEQ ID NO: 9006681 - DNA, 21 bp, Homo sapiens
agaaatgtatcattcttttcc

SEQ ID NO: 9006682 - DNA, 21 bp, Homo sapiens
agaaatgtatcattcttttcc

SEQ ID NO: 9006683 - DNA, 21 bp, Homo sapiens
agaaatgtatcattcttttcc

SEQ ID NO: 9006684 - DNA, 22 bp, Homo sapiens
agaaatgtattctgtatgtttt

SEQ ID NO: 9006685 - DNA, 22 bp, Homo sapiens
agaaatgtgagccccttatcaa

SEQ ID NO: 9006686 - DNA, 22 bp, Homo sapiens
agaaatgtgagccccttatcaa

SEQ ID NO: 9006687 - DNA, 22 bp, Homo sapiens
agaaatgtggaggaacagggct

SEQ ID NO: 9006688 - DNA, 22 bp, Homo sapiens
agaaatgtggaggaacagggct

SEQ ID NO: 9006689 - DNA, 22 bp, Homo sapiens
agaaatgtggaggaacagggct

SEQ ID NO: 9006690 - DNA, 22 bp, Homo sapiens
agaaatgtggaggaacagggct

SEQ ID NO: 9006691 - DNA, 22 bp, Homo sapiens
agaaatgtccagggctaggatc

SEQ ID NO: 9006692 - DNA, 20 bp, Homo sapiens
agaaatgtgaaaggctgagt

SEQ ID NO: 9006693 - DNA, 22 bp, Homo sapiens
agaaatgtccagggctaggatc

SEQ ID NO: 9006694 - DNA, 22 bp, Homo sapiens
agaaatgtccagggctaggatc

SEQ ID NO: 9006695 - DNA, 22 bp, Homo sapiens
agaaatgtgaatttcatttcct

SEQ ID NO: 9006696 - DNA, 22 bp, Homo sapiens
agaaatgtgaatttcatttcct

SEQ ID NO: 9006697 - DNA, 22 bp, Homo sapiens
agaaatgtgaatttcatttcct

SEQ ID NO: 9006698 - DNA, 20 bp, Homo sapiens
agaaatgtgaaaggctgagt

SEQ ID NO: 9006699 - DNA, 20 bp, Homo sapiens
agaaatgtgaaaggctgagt

SEQ ID NO: 9006700 - DNA, 22 bp, Homo sapiens
agaaatgttcttcatttgccat

SEQ ID NO: 9006701 - DNA, 22 bp, Homo sapiens
agaaatgttcttcatttgccat

SEQ ID NO: 9006702 - DNA, 22 bp, Homo sapiens
agaaatgttcttcatttgccat

SEQ ID NO: 9006703 - DNA, 22 bp, Homo sapiens
agaaatgttacagttgttattt

SEQ ID NO: 9006704 - DNA, 22 bp, Homo sapiens
agaaatgttgaatacacaaaat

SEQ ID NO: 9006705 - DNA, 22 bp, Homo sapiens
agaaatgttgaatacacaaaat

SEQ ID NO: 9006706 - DNA, 22 bp, Homo sapiens
agaaatgttgaatacacaaaat

SEQ ID NO: 9006707 - DNA, 22 bp, Homo sapiens
agaaatgttacagttgttattt

SEQ ID NO: 9006708 - DNA, 22 bp, Homo sapiens
agaaatgttacagttgttattt

SEQ ID NO: 9006709 - DNA, 22 bp, Homo sapiens
agaaatgttacagttgttattt

SEQ ID NO: 9006710 - DNA, 22 bp, Homo sapiens
agaaatgttacagttgttattt

SEQ ID NO: 9006711 - DNA, 22 bp, Homo sapiens
agaaatgtggatcgttttaaaa

SEQ ID NO: 9006712 - DNA, 22 bp, Homo sapiens
agaaatgtggatcgttttaaaa

SEQ ID NO: 9006713 - DNA, 22 bp, Homo sapiens
agaaatgtggatcgttttaaaa

SEQ ID NO: 9006714 - DNA, 22 bp, Homo sapiens
agaaatgtggatcgttttaaaa

SEQ ID NO: 9006715 - DNA, 22 bp, Homo sapiens
agaaatgtggatcgttttaaaa

SEQ ID NO: 9006716 - DNA, 22 bp, Homo sapiens
agaagcagggcagggaaaagca

SEQ ID NO: 9006717 - DNA, 22 bp, Homo sapiens
agaagcagggcagggaaaagca

SEQ ID NO: 9006718 - DNA, 22 bp, Homo sapiens
agaagcagggcagggaaaagca

SEQ ID NO: 9006719 - DNA, 22 bp, Homo sapiens
agaagcagggcagggaaaagca

SEQ ID NO: 9006720 - DNA, 22 bp, Homo sapiens
agaagcagggcagggaaaagca

SEQ ID NO: 9006721 - DNA, 22 bp, Homo sapiens
agaagcaggcctcacagatctg

SEQ ID NO: 9006722 - DNA, 22 bp, Homo sapiens
agaagcactagagggtatggaa

SEQ ID NO: 9006723 - DNA, 22 bp, Homo sapiens
agaagcagctttcaaggtgatt

SEQ ID NO: 9006724 - DNA, 22 bp, Homo sapiens
agaagcacggttttgtctagca

SEQ ID NO: 9006725 - DNA, 22 bp, Homo sapiens
agaaatgtttactcaccccctt

SEQ ID NO: 9006726 - DNA, 22 bp, Homo sapiens
agaaatgtttatggctgcctat

SEQ ID NO: 9006727 - DNA, 22 bp, Homo sapiens
agaaatgttgtgggttttgtta

SEQ ID NO: 9006728 - DNA, 22 bp, Homo sapiens
agaaattaggaaagtaacactt

SEQ ID NO: 9006729 - DNA, 22 bp, Homo sapiens
agaaatgtttatggctgcctat

SEQ ID NO: 9006730 - DNA, 22 bp, Homo sapiens
agaaatgtttatggctgcctat

SEQ ID NO: 9006731 - DNA, 22 bp, Homo sapiens
agaaatgttgaatacatcagga

SEQ ID NO: 9006732 - DNA, 22 bp, Homo sapiens
agaaatgttgaatacatcagga

SEQ ID NO: 9006733 - DNA, 22 bp, Homo sapiens
agaaatgtttactcaccccctt

SEQ ID NO: 9006734 - DNA, 22 bp, Homo sapiens
agaaatgttgtgggttttgtta

SEQ ID NO: 9006735 - DNA, 22 bp, Homo sapiens
agaaatgttgaatacacaaaat

SEQ ID NO: 9006736 - DNA, 22 bp, Homo sapiens
agaaatgttgaatacatcagga

SEQ ID NO: 9006737 - DNA, 22 bp, Homo sapiens
agaaatgttgaatacatcagga

SEQ ID NO: 9006738 - DNA, 22 bp, Homo sapiens
agaaatgttgaatacatcagga

SEQ ID NO: 9006739 - DNA, 22 bp, Homo sapiens
agaagccaaaggggccagatat

SEQ ID NO: 9006740 - DNA, 22 bp, Homo sapiens
agaagccaaatgccagtgacct

SEQ ID NO: 9006741 - DNA, 22 bp, Homo sapiens
agaagccaaatgccagtgacct

SEQ ID NO: 9006742 - DNA, 22 bp, Homo sapiens
agaagccaacagggcaggagag

SEQ ID NO: 9006743 - DNA, 22 bp, Homo sapiens
atcctgaaaattgaatggaagg

SEQ ID NO: 9006744 - DNA, 20 bp, Homo sapiens
agaagcattcaaagaaaact

SEQ ID NO: 9006745 - DNA, 20 bp, Homo sapiens
agaagcattcaaagaaaact

SEQ ID NO: 9006746 - DNA, 20 bp, Homo sapiens
agaagcattcaaagaaaact

SEQ ID NO: 9006747 - DNA, 20 bp, Homo sapiens
agaagcattcaaagaaaact

SEQ ID NO: 9006748 - DNA, 20 bp, Homo sapiens
agaagcattcaaagaaaact

SEQ ID NO: 9006749 - DNA, 22 bp, Homo sapiens
agaagcattggaccaggggccc

SEQ ID NO: 9006750 - DNA, 20 bp, Homo sapiens
agaagcatcattctgatgtc

SEQ ID NO: 9006751 - DNA, 22 bp, Homo sapiens
agaagcattatttaattttact

SEQ ID NO: 9006752 - DNA, 22 bp, Homo sapiens
agaagcattatttaattttact

SEQ ID NO: 9006753 - DNA, 22 bp, Homo sapiens
agaagcattataacatgcaagg

SEQ ID NO: 9006754 - DNA, 22 bp, Homo sapiens
agaagcattataacatgcaagg

SEQ ID NO: 9006755 - DNA, 22 bp, Homo sapiens
agaagcagttattttttgcaca

SEQ ID NO: 9006756 - DNA, 18 bp, Homo sapiens
agaagcaggtaaaattct

SEQ ID NO: 9006757 - DNA, 22 bp, Homo sapiens
atctgcttttgagaatttactt

SEQ ID NO: 9006758 - DNA, 22 bp, Homo sapiens
atctgcttttgagaatttactt

SEQ ID NO: 9006759 - DNA, 20 bp, Homo sapiens
atctgcttgcctgtcctcgg

SEQ ID NO: 9006760 - DNA, 20 bp, Homo sapiens
agaagctgatactgatggaa

SEQ ID NO: 9006761 - DNA, 22 bp, Homo sapiens
agaagctgcctacatgaccagc

SEQ ID NO: 9006762 - DNA, 22 bp, Homo sapiens
agaagctgcgtttatttaaatc

SEQ ID NO: 9006763 - DNA, 22 bp, Homo sapiens
agaagctgcgtttatttaaatc

SEQ ID NO: 9006764 - DNA, 22 bp, Homo sapiens
agaagctgcgtttatttaaatc

SEQ ID NO: 9006765 - DNA, 22 bp, Homo sapiens
agaagctgcctacatgaccagc

SEQ ID NO: 9006766 - DNA, 22 bp, Homo sapiens
agaagctgacagatgcagcagg

SEQ ID NO: 9006767 - DNA, 20 bp, Homo sapiens
agaagctgagactgggtttt

SEQ ID NO: 9006768 - DNA, 22 bp, Homo sapiens
agaagctgagaatgaattaaga

SEQ ID NO: 9006769 - DNA, 20 bp, Homo sapiens
agaagctgatactgatggaa

SEQ ID NO: 9006770 - DNA, 20 bp, Homo sapiens
agaagctgagactgggtttt

SEQ ID NO: 9006771 - DNA, 22 bp, Homo sapiens
agaagctgacagatgcagcagg

SEQ ID NO: 9006772 - DNA, 22 bp, Homo sapiens
agaagctgacagatgcagcagg

SEQ ID NO: 9006773 - DNA, 22 bp, Homo sapiens
agaagctgacagatgcagcagg

SEQ ID NO: 9006774 - DNA, 22 bp, Homo sapiens
agaagctatttagctgcacttt

SEQ ID NO: 9006775 - DNA, 22 bp, Homo sapiens
agaagctaattcatgtcttatg

SEQ ID NO: 9006776 - DNA, 22 bp, Homo sapiens
agaagccatgtttagtaggatg

SEQ ID NO: 9006777 - DNA, 22 bp, Homo sapiens
agaagccatgtttagtaggatg

SEQ ID NO: 9006778 - DNA, 22 bp, Homo sapiens
agaagccatgtttagtaggatg

SEQ ID NO: 9006779 - DNA, 22 bp, Homo sapiens
agaagccattccctgtaggctc

SEQ ID NO: 9006780 - DNA, 22 bp, Homo sapiens
agaagccatgtttagtaggatg

SEQ ID NO: 9006781 - DNA, 22 bp, Homo sapiens
agaagccatgtttagtaggatg

SEQ ID NO: 9006782 - DNA, 22 bp, Homo sapiens
agaagccattctcagttcctga

SEQ ID NO: 9006783 - DNA, 22 bp, Homo sapiens
agaagccattctcagttcctga

SEQ ID NO: 9006784 - DNA, 22 bp, Homo sapiens
agaagccattctcagttcctga

SEQ ID NO: 9006785 - DNA, 22 bp, Homo sapiens
agaagccattccctgtaggctc

SEQ ID NO: 9006786 - DNA, 22 bp, Homo sapiens
agaagccattccctgtaggctc

SEQ ID NO: 9006787 - DNA, 22 bp, Homo sapiens
agaagcctcatcctctctagtg

SEQ ID NO: 9006788 - DNA, 19 bp, Homo sapiens
agaagcccagatcccagcc

SEQ ID NO: 9006789 - DNA, 21 bp, Homo sapiens
agaagccatttgttaggactt

SEQ ID NO: 9006790 - DNA, 21 bp, Homo sapiens
agaagccatttgttaggactt

SEQ ID NO: 9006791 - DNA, 21 bp, Homo sapiens
agaagccatttgttaggactt

SEQ ID NO: 9006792 - DNA, 21 bp, Homo sapiens
agaagcctgatgaggtctgct

SEQ ID NO: 9006793 - DNA, 18 bp, Homo sapiens
agaagcctgcctcaatgc

SEQ ID NO: 9006794 - DNA, 22 bp, Homo sapiens
agaagcctcatcctctctagtg

SEQ ID NO: 9006795 - DNA, 22 bp, Homo sapiens
agaagcctgttgagagggccgt

SEQ ID NO: 9006796 - DNA, 21 bp, Homo sapiens
agaagcctgggtggaggtggg

SEQ ID NO: 9006797 - DNA, 21 bp, Homo sapiens
agaagcctggggaatgtggct

SEQ ID NO: 9006798 - DNA, 21 bp, Homo sapiens
agaagcctgggtggaggtggg

SEQ ID NO: 9006799 - DNA, 22 bp, Homo sapiens
atcctgaggtactgcagggccg

SEQ ID NO: 9006800 - DNA, 22 bp, Homo sapiens
atcctgagttcctgcctctaaa

SEQ ID NO: 9006801 - DNA, 22 bp, Homo sapiens
atcctgagttcctgcctctaaa

SEQ ID NO: 9006802 - DNA, 22 bp, Homo sapiens
atcctgagttctcagagtctcc

SEQ ID NO: 9006803 - DNA, 22 bp, Homo sapiens
atcctgagttctcagagtctcc

SEQ ID NO: 9006804 - DNA, 22 bp, Homo sapiens
atcctgagttctcagagtctcc

SEQ ID NO: 9006805 - DNA, 22 bp, Homo sapiens
atcctgagttctcagagtctcc

SEQ ID NO: 9006806 - DNA, 22 bp, Homo sapiens
atcctgcagggggttttattca

SEQ ID NO: 9006807 - DNA, 23 bp, Homo sapiens
atcctgctgatggccctccagga

SEQ ID NO: 9006808 - DNA, 22 bp, Homo sapiens
atcctgctgctgtggacttctc

SEQ ID NO: 9006809 - DNA, 22 bp, Homo sapiens
atcctgagttcctgcctctaaa

SEQ ID NO: 9006810 - DNA, 22 bp, Homo sapiens
atcctgaggaaggtgcagagat

SEQ ID NO: 9006811 - DNA, 22 bp, Homo sapiens
atcctgaggaaggtgcagagat

SEQ ID NO: 9006812 - DNA, 22 bp, Homo sapiens
atcctgagctacacctgctcct

SEQ ID NO: 9006813 - DNA, 22 bp, Homo sapiens
atcctgagctacacctgctcct

SEQ ID NO: 9006814 - DNA, 22 bp, Homo sapiens
atcctgaggaaggtgcagagat

SEQ ID NO: 9006815 - DNA, 22 bp, Homo sapiens
atcctggcgccacacggctcta

SEQ ID NO: 9006816 - DNA, 22 bp, Homo sapiens
atcctgggaagctgacattgaa

SEQ ID NO: 9006817 - DNA, 20 bp, Homo sapiens
atcctggaatccaaatggag

SEQ ID NO: 9006818 - DNA, 22 bp, Homo sapiens
atcctgcttgttacttatagag

SEQ ID NO: 9006819 - DNA, 20 bp, Homo sapiens
atcctggaatccaaatggag

SEQ ID NO: 9006820 - DNA, 22 bp, Homo sapiens
atcctggacagtttcccctatt

SEQ ID NO: 9006821 - DNA, 20 bp, Homo sapiens
atcctggaatccaaatggag

SEQ ID NO: 9006822 - DNA, 22 bp, Homo sapiens
atcctggaggctggaggcttgc

SEQ ID NO: 9006823 - DNA, 21 bp, Homo sapiens
agaagccatgtggtggagaac

SEQ ID NO: 9006824 - DNA, 21 bp, Homo sapiens
agaagccatgtggtggagaac

SEQ ID NO: 9006825 - DNA, 21 bp, Homo sapiens
agaagccatgtggtggagaac

SEQ ID NO: 9006826 - DNA, 22 bp, Homo sapiens
agaagccatggggtcaccagag

SEQ ID NO: 9006827 - DNA, 22 bp, Homo sapiens
agaagccatggtatgcaactac

SEQ ID NO: 9006828 - DNA, 22 bp, Homo sapiens
agaagccatagtctgggaggca

SEQ ID NO: 9006829 - DNA, 22 bp, Homo sapiens
agaagccatagtctgggaggca

SEQ ID NO: 9006830 - DNA, 22 bp, Homo sapiens
agaagccatatttagggaggag

SEQ ID NO: 9006831 - DNA, 21 bp, Homo sapiens
agaagccatgccagtaaaatt

SEQ ID NO: 9006832 - DNA, 21 bp, Homo sapiens
agaagccatgccagtaaaatt

SEQ ID NO: 9006833 - DNA, 22 bp, Homo sapiens
agaagccatagtatctcagggt

SEQ ID NO: 9006834 - DNA, 22 bp, Homo sapiens
agaagccatagtctgggaggca

SEQ ID NO: 9006835 - DNA, 22 bp, Homo sapiens
agaagccatagtatctcagggt

SEQ ID NO: 9006836 - DNA, 22 bp, Homo sapiens
agaagccatagtatctcagggt

SEQ ID NO: 9006837 - DNA, 22 bp, Homo sapiens
agaagccaccagctgaggaaga

SEQ ID NO: 9006838 - DNA, 22 bp, Homo sapiens
atcctgggaatgggagggtcat

SEQ ID NO: 9006839 - DNA, 22 bp, Homo sapiens
atcctgggaatgggagggtcat

SEQ ID NO: 9006840 - DNA, 22 bp, Homo sapiens
agaagccaccagctgaggaaga

SEQ ID NO: 9006841 - DNA, 22 bp, Homo sapiens
atcctgggaagtggcctcctcc

SEQ ID NO: 9006842 - DNA, 22 bp, Homo sapiens
atcctgggaagtggcctcctcc

SEQ ID NO: 9006843 - DNA, 22 bp, Homo sapiens
atcctgggaagctgacattgaa

SEQ ID NO: 9006844 - DNA, 22 bp, Homo sapiens
atcctgggaagtggcctcctcc

SEQ ID NO: 9006845 - DNA, 22 bp, Homo sapiens
agaaagacgtgatgaagaagta

SEQ ID NO: 9006846 - DNA, 22 bp, Homo sapiens
agaaagacgtgatgaagaagta

SEQ ID NO: 9006847 - DNA, 22 bp, Homo sapiens
agaaagacgtgatgaagaagta

SEQ ID NO: 9006848 - DNA, 22 bp, Homo sapiens
agaaagacaaaatgcagtggct

SEQ ID NO: 9006849 - DNA, 22 bp, Homo sapiens
agaaagacaaaatgcagtggct

SEQ ID NO: 9006850 - DNA, 22 bp, Homo sapiens
agaaagaacgttggttatctta

SEQ ID NO: 9006851 - DNA, 22 bp, Homo sapiens
agaaagaacgttggttatctta

SEQ ID NO: 9006852 - DNA, 22 bp, Homo sapiens
agaaagaacgttggttatctta

SEQ ID NO: 9006853 - DNA, 22 bp, Homo sapiens
agaaagaacgcacttgtgctgc

SEQ ID NO: 9006854 - DNA, 22 bp, Homo sapiens
agaaagaacgcacttgtgctgc

SEQ ID NO: 9006855 - DNA, 22 bp, Homo sapiens
agaaagaacgttggttatctta

SEQ ID NO: 9006856 - DNA, 22 bp, Homo sapiens
agaaagaacgttggttatctta

SEQ ID NO: 9006857 - DNA, 17 bp, Homo sapiens
agaaagaggatccacag

SEQ ID NO: 9006858 - DNA, 17 bp, Homo sapiens
agaaagaggatccacag

SEQ ID NO: 9006859 - DNA, 17 bp, Homo sapiens
agaaagaggatccacag

SEQ ID NO: 9006860 - DNA, 22 bp, Homo sapiens
agaaagacgtgatgaagaagta

SEQ ID NO: 9006861 - DNA, 22 bp, Homo sapiens
agaaagacgtgatgaagaagta

SEQ ID NO: 9006862 - DNA, 22 bp, Homo sapiens
agaaagagctcgggattaacag

SEQ ID NO: 9006863 - DNA, 22 bp, Homo sapiens
agaaagagctcgggattaacag

SEQ ID NO: 9006864 - DNA, 22 bp, Homo sapiens
agaaagagctcgggattaacag

SEQ ID NO: 9006865 - DNA, 22 bp, Homo sapiens
atattaatgagcaagtaagtga

SEQ ID NO: 9006866 - DNA, 22 bp, Homo sapiens
atattaatgagcaagtaagtga

SEQ ID NO: 9006867 - DNA, 22 bp, Homo sapiens
atattaatgagcaagtaagtga

SEQ ID NO: 9006868 - DNA, 22 bp, Homo sapiens
atattaatgggatttagtcagg

SEQ ID NO: 9006869 - DNA, 22 bp, Homo sapiens
atattaatgggatttagtcagg

SEQ ID NO: 9006870 - DNA, 22 bp, Homo sapiens
atattaatgggatttagtcagg

SEQ ID NO: 9006871 - DNA, 22 bp, Homo sapiens
atattaatgggatttagtcagg

SEQ ID NO: 9006872 - DNA, 22 bp, Homo sapiens
atattaatgggatttagtcagg

SEQ ID NO: 9006873 - DNA, 22 bp, Homo sapiens
atattaatgggatttagtcagg

SEQ ID NO: 9006874 - DNA, 22 bp, Homo sapiens
atattaatgggatttagtcagg

SEQ ID NO: 9006875 - DNA, 22 bp, Homo sapiens
atattaattatttacacatgag

SEQ ID NO: 9006876 - DNA, 22 bp, Homo sapiens
atattaattatttacacatgag

SEQ ID NO: 9006877 - DNA, 22 bp, Homo sapiens
atattaaaactatggttttcag

SEQ ID NO: 9006878 - DNA, 22 bp, Homo sapiens
atattaaaactatggttttcag

SEQ ID NO: 9006879 - DNA, 22 bp, Homo sapiens
atattaaatggattttgggagc

SEQ ID NO: 9006880 - DNA, 22 bp, Homo sapiens
atattaaatggattttgggagc

SEQ ID NO: 9006881 - DNA, 22 bp, Homo sapiens
atattaaaactatggttttcag

SEQ ID NO: 9006882 - DNA, 22 bp, Homo sapiens
atattaaatggattttgggagc

SEQ ID NO: 9006883 - DNA, 22 bp, Homo sapiens
atattaaatggattttgggagc

SEQ ID NO: 9006884 - DNA, 22 bp, Homo sapiens
atattaagatgctattggtttt

SEQ ID NO: 9006885 - DNA, 22 bp, Homo sapiens
atattaatgagcaagtaagtga

SEQ ID NO: 9006886 - DNA, 22 bp, Homo sapiens
atattaatgagcaagtaagtga

SEQ ID NO: 9006887 - DNA, 22 bp, Homo sapiens
atattaatgagcaagtaagtga

SEQ ID NO: 9006888 - DNA, 22 bp, Homo sapiens
atattaaatggattttgggagc

SEQ ID NO: 9006889 - DNA, 22 bp, Homo sapiens
atattaagatgctattggtttt

SEQ ID NO: 9006890 - DNA, 22 bp, Homo sapiens
atatagtcaaacatatatgtgt

SEQ ID NO: 9006891 - DNA, 22 bp, Homo sapiens
atatagtgaaagtgatgtgtgg

SEQ ID NO: 9006892 - DNA, 22 bp, Homo sapiens
atatagtgagagattacagaag

SEQ ID NO: 9006893 - DNA, 22 bp, Homo sapiens
atatagtgagagattacagaag

SEQ ID NO: 9006894 - DNA, 22 bp, Homo sapiens
atatagtcaaacatatatgtgt

SEQ ID NO: 9006895 - DNA, 22 bp, Homo sapiens
atatagtcaaacatatatgtgt

SEQ ID NO: 9006896 - DNA, 22 bp, Homo sapiens
atatagtcaaacatatatgtgt

SEQ ID NO: 9006897 - DNA, 22 bp, Homo sapiens
atatagtttaagaaagtacagt

SEQ ID NO: 9006898 - DNA, 22 bp, Homo sapiens
atatagtttaagaaagtacagt

SEQ ID NO: 9006899 - DNA, 22 bp, Homo sapiens
atatagtttaagaaagtacagt

SEQ ID NO: 9006900 - DNA, 22 bp, Homo sapiens
atatagtttaggttcgaatggg

SEQ ID NO: 9006901 - DNA, 20 bp, Homo sapiens
agaaacatttcttgagaact

SEQ ID NO: 9006902 - DNA, 20 bp, Homo sapiens
agaaacatttcttgagaact

SEQ ID NO: 9006903 - DNA, 20 bp, Homo sapiens
agaaacatttcttgagaact

SEQ ID NO: 9006904 - DNA, 20 bp, Homo sapiens
agaaacatttcttgagaact

SEQ ID NO: 9006905 - DNA, 20 bp, Homo sapiens
agaaacatttcttgagaact

SEQ ID NO: 9006906 - DNA, 22 bp, Homo sapiens
agaaactgcagctcagagaagt

SEQ ID NO: 9006907 - DNA, 22 bp, Homo sapiens
agaaactgcagctcagagaagt

SEQ ID NO: 9006908 - DNA, 22 bp, Homo sapiens
agaaactgcagctcagagaagt

SEQ ID NO: 9006909 - DNA, 21 bp, Homo sapiens
agaaactgactcctagaggca

SEQ ID NO: 9006910 - DNA, 22 bp, Homo sapiens
agaaacttcagctattcttttg

SEQ ID NO: 9006911 - DNA, 22 bp, Homo sapiens
agaaacttcagctattcttttg

SEQ ID NO: 9006912 - DNA, 22 bp, Homo sapiens
agaaacttcagctattcttttg

SEQ ID NO: 9006913 - DNA, 22 bp, Homo sapiens
atatagaaggtgctatttacat

SEQ ID NO: 9006914 - DNA, 22 bp, Homo sapiens
atatagaaggtgctatttacat

SEQ ID NO: 9006915 - DNA, 22 bp, Homo sapiens
agaaaagggcaggagggataca

SEQ ID NO: 9006916 - DNA, 22 bp, Homo sapiens
agaaaagggcaggagggataca

SEQ ID NO: 9006917 - DNA, 22 bp, Homo sapiens
agaaaagggcaggagggataca

SEQ ID NO: 9006918 - DNA, 22 bp, Homo sapiens
agaaaagggcaggagggataca

SEQ ID NO: 9006919 - DNA, 22 bp, Homo sapiens
atatagaaggtgctatttacat

SEQ ID NO: 9006920 - DNA, 22 bp, Homo sapiens
atatagaaggtgctatttacat

SEQ ID NO: 9006921 - DNA, 22 bp, Homo sapiens
atatagaaggtgctatttacat

SEQ ID NO: 9006922 - DNA, 22 bp, Homo sapiens
atatagaatacacagggaaagt

SEQ ID NO: 9006923 - DNA, 22 bp, Homo sapiens
atatagaatacacagggaaagt

SEQ ID NO: 9006924 - DNA, 22 bp, Homo sapiens
atatagacagatgacagggata

SEQ ID NO: 9006925 - DNA, 22 bp, Homo sapiens
atatagagtaattatttggtgt

SEQ ID NO: 9006926 - DNA, 22 bp, Homo sapiens
atatagagtaattatttggtgt

SEQ ID NO: 9006927 - DNA, 20 bp, Homo sapiens
atataggcatagtaaaatga

SEQ ID NO: 9006928 - DNA, 22 bp, Homo sapiens
atataggctaacaactattgag

SEQ ID NO: 9006929 - DNA, 22 bp, Homo sapiens
atataggttatcatatttgccc

SEQ ID NO: 9006930 - DNA, 19 bp, Homo sapiens
atataggctgaaccatgct

SEQ ID NO: 9006931 - DNA, 22 bp, Homo sapiens
atatagtatgtcctccagaatt

SEQ ID NO: 9006932 - DNA, 22 bp, Homo sapiens
atatagtatgtcctccagaatt

SEQ ID NO: 9006933 - DNA, 22 bp, Homo sapiens
atatagtaagcagtctgtaaat

SEQ ID NO: 9006934 - DNA, 22 bp, Homo sapiens
atatagtaagcagtctgtaaat

SEQ ID NO: 9006935 - DNA, 22 bp, Homo sapiens
atataggcttcatgacagaggg

SEQ ID NO: 9006936 - DNA, 22 bp, Homo sapiens
atatagtaagcagtctgtaaat

SEQ ID NO: 9006937 - DNA, 22 bp, Homo sapiens
atatagctgaggggtattataa

SEQ ID NO: 9006938 - DNA, 22 bp, Homo sapiens
atataggcagaaaggaaggcaa

SEQ ID NO: 9006939 - DNA, 22 bp, Homo sapiens
atatagctgaggggtattataa

SEQ ID NO: 9006940 - DNA, 19 bp, Homo sapiens
atatagcattattcaattt

SEQ ID NO: 9006941 - DNA, 22 bp, Homo sapiens
agaaatcacaggaggcagaagg

SEQ ID NO: 9006942 - DNA, 22 bp, Homo sapiens
agaaatcacaggaggcagaagg

SEQ ID NO: 9006943 - DNA, 22 bp, Homo sapiens
agaaatcacttaatgaacgtag

SEQ ID NO: 9006944 - DNA, 22 bp, Homo sapiens
agaaatcacttaatgaacgtag

SEQ ID NO: 9006945 - DNA, 22 bp, Homo sapiens
agaaatcacttaatgaacgtag

SEQ ID NO: 9006946 - DNA, 22 bp, Homo sapiens
agaaatcacttagaggaagtga

SEQ ID NO: 9006947 - DNA, 22 bp, Homo sapiens
agaaatcacttagaggaagtga

SEQ ID NO: 9006948 - DNA, 22 bp, Homo sapiens
agaaatcagaaccctgaagttc

SEQ ID NO: 9006949 - DNA, 22 bp, Homo sapiens
agaaatcagaaccctgaagttc

SEQ ID NO: 9006950 - DNA, 22 bp, Homo sapiens
agaaatcacttagaggaagtga

SEQ ID NO: 9006951 - DNA, 20 bp, Homo sapiens
agaaatcagcatgtcctctg

SEQ ID NO: 9006952 - DNA, 20 bp, Homo sapiens
agaaatcagaccacacacta

SEQ ID NO: 9006953 - DNA, 22 bp, Homo sapiens
agaaatcaatatctatatgttg

SEQ ID NO: 9006954 - DNA, 22 bp, Homo sapiens
agaaatcaatatctatatgttg

SEQ ID NO: 9006955 - DNA, 22 bp, Homo sapiens
agaaatcaatatctatatgttg

SEQ ID NO: 9006956 - DNA, 22 bp, Homo sapiens
agaaatcaatgaagtctgctaa

SEQ ID NO: 9006957 - DNA, 22 bp, Homo sapiens
agaaatcaatgaagtctgctaa

SEQ ID NO: 9006958 - DNA, 22 bp, Homo sapiens
agaaatcaatatctatatgttg

SEQ ID NO: 9006959 - DNA, 22 bp, Homo sapiens
agaaatatgctgattagatgaa

SEQ ID NO: 9006960 - DNA, 20 bp, Homo sapiens
agaaatattgagttcagagg

SEQ ID NO: 9006961 - DNA, 20 bp, Homo sapiens
agaaatattgagttcagagg

SEQ ID NO: 9006962 - DNA, 20 bp, Homo sapiens
agaaatattgagttcagagg

SEQ ID NO: 9006963 - DNA, 20 bp, Homo sapiens
agaaatattgagttcagagg

SEQ ID NO: 9006964 - DNA, 22 bp, Homo sapiens
atattaattatttacacatgag

SEQ ID NO: 9006965 - DNA, 22 bp, Homo sapiens
atattaattatttacacatgag

SEQ ID NO: 9006966 - DNA, 22 bp, Homo sapiens
atattaattatttacacatgag

SEQ ID NO: 9006967 - DNA, 22 bp, Homo sapiens
atattacacacggtatcacggg

SEQ ID NO: 9006968 - DNA, 22 bp, Homo sapiens
agaaagttttgtgctatatatg

SEQ ID NO: 9006969 - DNA, 22 bp, Homo sapiens
agaaagttttgtgctatatatg

SEQ ID NO: 9006970 - DNA, 22 bp, Homo sapiens
agaaagttttgtgctatatatg

SEQ ID NO: 9006971 - DNA, 22 bp, Homo sapiens
agaaagtttgtttttatccata

SEQ ID NO: 9006972 - DNA, 22 bp, Homo sapiens
agaaatatgctgattagatgaa

SEQ ID NO: 9006973 - DNA, 22 bp, Homo sapiens
agaaatatgctgattagatgaa

SEQ ID NO: 9006974 - DNA, 19 bp, Homo sapiens
agaaatagccttccttgtc

SEQ ID NO: 9006975 - DNA, 22 bp, Homo sapiens
agaaatatgctgattagatgaa

SEQ ID NO: 9006976 - DNA, 22 bp, Homo sapiens
agaaatatgctgattagatgaa

SEQ ID NO: 9006977 - DNA, 22 bp, Homo sapiens
agaaatatgctgattagatgaa

SEQ ID NO: 9006978 - DNA, 22 bp, Homo sapiens
agaaatatgctgattagatgaa

SEQ ID NO: 9006979 - DNA, 22 bp, Homo sapiens
agaaatatgctgattagatgaa

SEQ ID NO: 9006980 - DNA, 22 bp, Homo sapiens
agaaatatgctgattagatgaa

SEQ ID NO: 9006981 - DNA, 22 bp, Homo sapiens
atcaatgcttgccaaatggaag

SEQ ID NO: 9006982 - DNA, 22 bp, Homo sapiens
atcaatgttttgatagcccaga

SEQ ID NO: 9006983 - DNA, 22 bp, Homo sapiens
atcaatgttgggccaaagcaaa

SEQ ID NO: 9006984 - DNA, 22 bp, Homo sapiens
atcaattttgaggatacaagaa

SEQ ID NO: 9006985 - DNA, 22 bp, Homo sapiens
atcaattttgaggatacaagaa

SEQ ID NO: 9006986 - DNA, 22 bp, Homo sapiens
agaaatctttcctgaagtgttt

SEQ ID NO: 9006987 - DNA, 22 bp, Homo sapiens
agaaatctttgaagtgtaatgt

SEQ ID NO: 9006988 - DNA, 22 bp, Homo sapiens
atcaattttgaggatacaagaa

SEQ ID NO: 9006989 - DNA, 22 bp, Homo sapiens
agaaatcttatcaagaaatgcc

SEQ ID NO: 9006990 - DNA, 22 bp, Homo sapiens
agaaatcttggagtctgtggta

SEQ ID NO: 9006991 - DNA, 22 bp, Homo sapiens
agaaatgcagtttcaagacaaa

SEQ ID NO: 9006992 - DNA, 22 bp, Homo sapiens
agaaatgcagtttcaagacaaa

SEQ ID NO: 9006993 - DNA, 22 bp, Homo sapiens
agaaatgcagtcattgtatagt

SEQ ID NO: 9006994 - DNA, 22 bp, Homo sapiens
agaaatgcagtttcaagacaaa

SEQ ID NO: 9006995 - DNA, 22 bp, Homo sapiens
agaaatgcaaattttcatagag

SEQ ID NO: 9006996 - DNA, 22 bp, Homo sapiens
agaaatgcaaattttcatagag

SEQ ID NO: 9006997 - DNA, 22 bp, Homo sapiens
agaaatgcaaattttcatagag

SEQ ID NO: 9006998 - DNA, 22 bp, Homo sapiens
agaaatgcagtcattgtatagt

SEQ ID NO: 9006999 - DNA, 22 bp, Homo sapiens
agaaatgcagtctcgtcaaaag

SEQ ID NO: 9007000 - DNA, 22 bp, Homo sapiens
agaaatgcagtcattgtatagt

SEQ ID NO: 9007001 - DNA, 22 bp, Homo sapiens
agaaatgctcaggtcaacttaa

SEQ ID NO: 9007002 - DNA, 22 bp, Homo sapiens
agaaatgctcttcctgaccaga

SEQ ID NO: 9007003 - DNA, 22 bp, Homo sapiens
agaaatgcattagcacatatag

SEQ ID NO: 9007004 - DNA, 22 bp, Homo sapiens
agaaatgcctacgagataggga

SEQ ID NO: 9007005 - DNA, 22 bp, Homo sapiens
atcaagagtattgacaagacca

SEQ ID NO: 9007006 - DNA, 22 bp, Homo sapiens
atcaagagttatatttcatagt

SEQ ID NO: 9007007 - DNA, 22 bp, Homo sapiens
atcaagagaaggggaagatgaa

SEQ ID NO: 9007008 - DNA, 22 bp, Homo sapiens
atcaagcagtgaaaaatgctag

SEQ ID NO: 9007009 - DNA, 22 bp, Homo sapiens
atcaagcagtgaaaaatgctag

SEQ ID NO: 9007010 - DNA, 22 bp, Homo sapiens
atcaagctacaccctttggaaa

SEQ ID NO: 9007011 - DNA, 22 bp, Homo sapiens
atcaagcatatataaaactgca

SEQ ID NO: 9007012 - DNA, 22 bp, Homo sapiens
atcaagctggcatatgtagttc

SEQ ID NO: 9007013 - DNA, 22 bp, Homo sapiens
atcaagctacaccctttggaaa

SEQ ID NO: 9007014 - DNA, 22 bp, Homo sapiens
atcaagttttcttagttgactg

SEQ ID NO: 9007015 - DNA, 22 bp, Homo sapiens
atcaagttctgtcacatttgtc

SEQ ID NO: 9007016 - DNA, 22 bp, Homo sapiens
atcaagtgaagggctcttgaag

SEQ ID NO: 9007017 - DNA, 18 bp, Homo sapiens
atcaaggaggggaaggtc

SEQ ID NO: 9007018 - DNA, 21 bp, Homo sapiens
atcaatgacctggcatgaggg

SEQ ID NO: 9007019 - DNA, 21 bp, Homo sapiens
atcaatgacctggcatgaggg

SEQ ID NO: 9007020 - DNA, 22 bp, Homo sapiens
atcaatgctctgtacccagaat

SEQ ID NO: 9007021 - DNA, 23 bp, Homo sapiens
atcaagtcatcagcaaaatacat

SEQ ID NO: 9007022 - DNA, 22 bp, Homo sapiens
atcaatatcagatcagacagga

SEQ ID NO: 9007023 - DNA, 22 bp, Homo sapiens
atcaatatcagatcagacagga

SEQ ID NO: 9007024 - DNA, 22 bp, Homo sapiens
atcaatatcagatcagacagga

SEQ ID NO: 9007025 - DNA, 22 bp, Homo sapiens
atcaatgacagttgaattctac

SEQ ID NO: 9007026 - DNA, 22 bp, Homo sapiens
atcaatatcagatcagacagga

SEQ ID NO: 9007027 - DNA, 22 bp, Homo sapiens
atagctgtattaattgttatga

SEQ ID NO: 9007028 - DNA, 22 bp, Homo sapiens
atagctgtggaagatgtgggaa

SEQ ID NO: 9007029 - DNA, 22 bp, Homo sapiens
atagctgtagaatgtatacaca

SEQ ID NO: 9007030 - DNA, 22 bp, Homo sapiens
atagctgtagaatgtatacaca

SEQ ID NO: 9007031 - DNA, 22 bp, Homo sapiens
atagctgactccagacatagct

SEQ ID NO: 9007032 - DNA, 22 bp, Homo sapiens
atagccaggagatgatggggga

SEQ ID NO: 9007033 - DNA, 22 bp, Homo sapiens
atagccagcatatagcagggag

SEQ ID NO: 9007034 - DNA, 22 bp, Homo sapiens
atagccagcatatagcagggag

SEQ ID NO: 9007035 - DNA, 22 bp, Homo sapiens
atagctgttagattggggtcga

SEQ ID NO: 9007036 - DNA, 22 bp, Homo sapiens
atagctgttgccaatttccatg

SEQ ID NO: 9007037 - DNA, 22 bp, Homo sapiens
atagcttacaggtgatatcagc

SEQ ID NO: 9007038 - DNA, 22 bp, Homo sapiens
atagctgtgggctatttgtggg

SEQ ID NO: 9007039 - DNA, 22 bp, Homo sapiens
atagctgtttttaggccaaata

SEQ ID NO: 9007040 - DNA, 22 bp, Homo sapiens
atagcttacaggtgatatcagc

SEQ ID NO: 9007041 - DNA, 22 bp, Homo sapiens
ataggaaagaaaattatgtagg

SEQ ID NO: 9007042 - DNA, 22 bp, Homo sapiens
ataggaaagaatggagggtggg

SEQ ID NO: 9007043 - DNA, 22 bp, Homo sapiens
ataggaaagaaaattatgtagg

SEQ ID NO: 9007044 - DNA, 22 bp, Homo sapiens
atagctttttgtcatagagtct

SEQ ID NO: 9007045 - DNA, 22 bp, Homo sapiens
atagctttttgtcatagagtct

SEQ ID NO: 9007046 - DNA, 22 bp, Homo sapiens
atagctttcttaaatatataaa

SEQ ID NO: 9007047 - DNA, 22 bp, Homo sapiens
atagctttcttaaatatataaa

SEQ ID NO: 9007048 - DNA, 22 bp, Homo sapiens
atagctttcttaaatatataaa

SEQ ID NO: 9007049 - DNA, 22 bp, Homo sapiens
atagtgtgtggtataggtagag

SEQ ID NO: 9007050 - DNA, 22 bp, Homo sapiens
atagtgttagagccagtatgtt

SEQ ID NO: 9007051 - DNA, 22 bp, Homo sapiens
atagtgttgatagcagtggagt

SEQ ID NO: 9007052 - DNA, 22 bp, Homo sapiens
atagtgttacccttcttaaagt

SEQ ID NO: 9007053 - DNA, 22 bp, Homo sapiens
atagtgttacccttcttaaagt

SEQ ID NO: 9007054 - DNA, 22 bp, Homo sapiens
atagtgttacccttcttaaagt

SEQ ID NO: 9007055 - DNA, 22 bp, Homo sapiens
atagtgtgttagtgacataggc

SEQ ID NO: 9007056 - DNA, 22 bp, Homo sapiens
atagtgtgtggtataggtagag

SEQ ID NO: 9007057 - DNA, 22 bp, Homo sapiens
atagtgtgttagtgacataggc

SEQ ID NO: 9007058 - DNA, 22 bp, Homo sapiens
atagtgttacccttcttaaagt

SEQ ID NO: 9007059 - DNA, 22 bp, Homo sapiens
atagtgttgatagcagtggagt

SEQ ID NO: 9007060 - DNA, 22 bp, Homo sapiens
atagttacaaagactttttaaa

SEQ ID NO: 9007061 - DNA, 22 bp, Homo sapiens
atagtgttttacttagacttct

SEQ ID NO: 9007062 - DNA, 23 bp, Homo sapiens
atagttagcacacttacaactgc

SEQ ID NO: 9007063 - DNA, 23 bp, Homo sapiens
atagttagcacacttacaactgc

SEQ ID NO: 9007064 - DNA, 22 bp, Homo sapiens
atagttacatacagaaatattt

SEQ ID NO: 9007065 - DNA, 22 bp, Homo sapiens
atagttacatacagaaatattt

SEQ ID NO: 9007066 - DNA, 22 bp, Homo sapiens
ataggcaaattaataagtcata

SEQ ID NO: 9007067 - DNA, 22 bp, Homo sapiens
atagtgtctttcttcacaggca

SEQ ID NO: 9007068 - DNA, 22 bp, Homo sapiens
atagtgtgtaaagtgcagtgat

SEQ ID NO: 9007069 - DNA, 22 bp, Homo sapiens
atagtgtgtgattgcttcctca

SEQ ID NO: 9007070 - DNA, 22 bp, Homo sapiens
atagtgtgtaaagtgcagtgat

SEQ ID NO: 9007071 - DNA, 22 bp, Homo sapiens
atagtgtgtaaagtgcagtgat

SEQ ID NO: 9007072 - DNA, 22 bp, Homo sapiens
atagtgtgactgaggagttgaa

SEQ ID NO: 9007073 - DNA, 22 bp, Homo sapiens
atagtgtgactgaggagttgaa

SEQ ID NO: 9007074 - DNA, 22 bp, Homo sapiens
ataggaacctgaaaagctgtgc

SEQ ID NO: 9007075 - DNA, 22 bp, Homo sapiens
ataggaaatcgctattaaccta

SEQ ID NO: 9007076 - DNA, 17 bp, Homo sapiens
agaaaagagaccagcag

SEQ ID NO: 9007077 - DNA, 17 bp, Homo sapiens
agaaaagagaccagcag

SEQ ID NO: 9007078 - DNA, 22 bp, Homo sapiens
agaaaagaggctttctaagcat

SEQ ID NO: 9007079 - DNA, 17 bp, Homo sapiens
agaaaagagaccagcag

SEQ ID NO: 9007080 - DNA, 17 bp, Homo sapiens
agaaaagagaccagcag

SEQ ID NO: 9007081 - DNA, 22 bp, Homo sapiens
agaaaagaggctttctaagcat

SEQ ID NO: 9007082 - DNA, 22 bp, Homo sapiens
agaaaagaggctttctaagcat

SEQ ID NO: 9007083 - DNA, 22 bp, Homo sapiens
agaaaagaggctttctaagcat

SEQ ID NO: 9007084 - DNA, 22 bp, Homo sapiens
agaaaagcggtcaggaccctca

SEQ ID NO: 9007085 - DNA, 22 bp, Homo sapiens
agaaaagcggtcaggaccctca

SEQ ID NO: 9007086 - DNA, 22 bp, Homo sapiens
agaaaagcggtcaggaccctca

SEQ ID NO: 9007087 - DNA, 23 bp, Homo sapiens
agaaaagcttggacacatggcct

SEQ ID NO: 9007088 - DNA, 23 bp, Homo sapiens
agaaaagcttggacacatggcct

SEQ ID NO: 9007089 - DNA, 23 bp, Homo sapiens
agaaaagcttggacacatggcct

SEQ ID NO: 9007090 - DNA, 22 bp, Homo sapiens
agaaaagaggctttctaagcat

SEQ ID NO: 9007091 - DNA, 22 bp, Homo sapiens
agaaaaggattgatggatcaga

SEQ ID NO: 9007092 - DNA, 22 bp, Homo sapiens
agaaaaggattgatggatcaga

SEQ ID NO: 9007093 - DNA, 22 bp, Homo sapiens
agaaaaggattgatggatcaga

SEQ ID NO: 9007094 - DNA, 22 bp, Homo sapiens
agaaaagggcaggagggataca

SEQ ID NO: 9007095 - DNA, 22 bp, Homo sapiens
agaaaaggcttgaagaggtttt

SEQ ID NO: 9007096 - DNA, 22 bp, Homo sapiens
agaaaaggcttgaagaggtttt

SEQ ID NO: 9007097 - DNA, 22 bp, Homo sapiens
agaaaaggattgatggatcaga

SEQ ID NO: 9007098 - DNA, 20 bp, Homo sapiens
agaaaaagtgtggaaatttc

SEQ ID NO: 9007099 - DNA, 20 bp, Homo sapiens
agaaaaagtgtggaaatttc

SEQ ID NO: 9007100 - DNA, 20 bp, Homo sapiens
agaaaaagtgtggaaatttc

SEQ ID NO: 9007101 - DNA, 20 bp, Homo sapiens
agaaaaagtgtggaaatttc

SEQ ID NO: 9007102 - DNA, 22 bp, Homo sapiens
agaaaactgggaggagagcttc

SEQ ID NO: 9007103 - DNA, 20 bp, Homo sapiens
agaaaaagtgtggaaatttc

SEQ ID NO: 9007104 - DNA, 20 bp, Homo sapiens
agaaaaagtgtggaaatttc

SEQ ID NO: 9007105 - DNA, 22 bp, Homo sapiens
agaaaacttgtcacagctctca

SEQ ID NO: 9007106 - DNA, 22 bp, Homo sapiens
agaaaacttgctcgagcctgtt

SEQ ID NO: 9007107 - DNA, 22 bp, Homo sapiens
agaaaacttgtcacagctctca

SEQ ID NO: 9007108 - DNA, 22 bp, Homo sapiens
agaaaacttgtcacagctctca

SEQ ID NO: 9007109 - DNA, 22 bp, Homo sapiens
atagttcactaatagcaaaagc

SEQ ID NO: 9007110 - DNA, 22 bp, Homo sapiens
atagttctggatgtacttatag

SEQ ID NO: 9007111 - DNA, 22 bp, Homo sapiens
atagttctcactcagaatttga

SEQ ID NO: 9007112 - DNA, 23 bp, Homo sapiens
atagttctgcttagaaatcagtg

SEQ ID NO: 9007113 - DNA, 22 bp, Homo sapiens
atagttgagatcagattcaact

SEQ ID NO: 9007114 - DNA, 22 bp, Homo sapiens
agaaaaagtcaaggaattggac

SEQ ID NO: 9007115 - DNA, 22 bp, Homo sapiens
atagaagcaagaacagaatgga

SEQ ID NO: 9007116 - DNA, 22 bp, Homo sapiens
atagaagctgataaactacttc

SEQ ID NO: 9007117 - DNA, 22 bp, Homo sapiens
atagaagctgataaactacttc

SEQ ID NO: 9007118 - DNA, 22 bp, Homo sapiens
atagaagtatcaagatcttgaa

SEQ ID NO: 9007119 - DNA, 20 bp, Homo sapiens
atagaagtattatgtaatgt

SEQ ID NO: 9007120 - DNA, 20 bp, Homo sapiens
atagaagtattatgtaatgt

SEQ ID NO: 9007121 - DNA, 20 bp, Homo sapiens
atagaagtattatgtaatgt

SEQ ID NO: 9007122 - DNA, 20 bp, Homo sapiens
atagaagtattatgtaatgt

SEQ ID NO: 9007123 - DNA, 22 bp, Homo sapiens
atagaagatagcttttgtttct

SEQ ID NO: 9007124 - DNA, 22 bp, Homo sapiens
atagaagaggaaactgaggttg

SEQ ID NO: 9007125 - DNA, 23 bp, Homo sapiens
atagaagattattgcaacagtcc

SEQ ID NO: 9007126 - DNA, 23 bp, Homo sapiens
atagaagattattgcaacagtcc

SEQ ID NO: 9007127 - DNA, 23 bp, Homo sapiens
atagaagattattgcaacagtcc

SEQ ID NO: 9007128 - DNA, 22 bp, Homo sapiens
atagaacctgttgtgaaattca

SEQ ID NO: 9007129 - DNA, 19 bp, Homo sapiens
atagaacctgcagtttcaa

SEQ ID NO: 9007130 - DNA, 22 bp, Homo sapiens
atagaaccacccagagcctttt

SEQ ID NO: 9007131 - DNA, 22 bp, Homo sapiens
atagaacataattctcagccct

SEQ ID NO: 9007132 - DNA, 22 bp, Homo sapiens
atagaacagggcactgtcatga

SEQ ID NO: 9007133 - DNA, 22 bp, Homo sapiens
atagaacataattctcagccct

SEQ ID NO: 9007134 - DNA, 22 bp, Homo sapiens
atagaacaggggcaggagcatt

SEQ ID NO: 9007135 - DNA, 22 bp, Homo sapiens
atagaacaggggcaggagcatt

SEQ ID NO: 9007136 - DNA, 22 bp, Homo sapiens
atagaacagggcactgtcatga

SEQ ID NO: 9007137 - DNA, 22 bp, Homo sapiens
atagaacagaaacagatgcaca

SEQ ID NO: 9007138 - DNA, 22 bp, Homo sapiens
atagaacagaaacagatgcaca

SEQ ID NO: 9007139 - DNA, 22 bp, Homo sapiens
atagaacaaggtagacagcttt

SEQ ID NO: 9007140 - DNA, 22 bp, Homo sapiens
atagaacaaggtagacagcttt

SEQ ID NO: 9007141 - DNA, 22 bp, Homo sapiens
atagaacaaggtagacagcttt

SEQ ID NO: 9007142 - DNA, 22 bp, Homo sapiens
atagaacacagatgggcgtggc

SEQ ID NO: 9007143 - DNA, 21 bp, Homo sapiens
atagaacaccaggcatatata

SEQ ID NO: 9007144 - DNA, 22 bp, Homo sapiens
atagaacagaaacagatgcaca

SEQ ID NO: 9007145 - DNA, 22 bp, Homo sapiens
atagaacagaaacagatgcaca

SEQ ID NO: 9007146 - DNA, 22 bp, Homo sapiens
atagaacagaaacagatgcaca

SEQ ID NO: 9007147 - DNA, 22 bp, Homo sapiens
atactgttggcagcagaccaga

SEQ ID NO: 9007148 - DNA, 20 bp, Homo sapiens
atacacttgcccagcttgtg

SEQ ID NO: 9007149 - DNA, 22 bp, Homo sapiens
atacacttgacctggagtgaag

SEQ ID NO: 9007150 - DNA, 20 bp, Homo sapiens
atacacttgcccagcttgtg

SEQ ID NO: 9007151 - DNA, 20 bp, Homo sapiens
atacacttgcccagcttgtg

SEQ ID NO: 9007152 - DNA, 22 bp, Homo sapiens
atactgtgtgtgctcaaggaat

SEQ ID NO: 9007153 - DNA, 22 bp, Homo sapiens
atactgtgtgtgctcaaggaat

SEQ ID NO: 9007154 - DNA, 22 bp, Homo sapiens
atacacttgacctggagtgaag

SEQ ID NO: 9007155 - DNA, 22 bp, Homo sapiens
atacacttgacctggagtgaag

SEQ ID NO: 9007156 - DNA, 22 bp, Homo sapiens
atacttaactgtggagtcattg

SEQ ID NO: 9007157 - DNA, 22 bp, Homo sapiens
atagaaatgtattttggactag

SEQ ID NO: 9007158 - DNA, 22 bp, Homo sapiens
atagaaatgtattttggactag

SEQ ID NO: 9007159 - DNA, 22 bp, Homo sapiens
atacacttcatgttttcatctg

SEQ ID NO: 9007160 - DNA, 22 bp, Homo sapiens
atacacttcatgttttcatctg

SEQ ID NO: 9007161 - DNA, 22 bp, Homo sapiens
atacacttcatgttttcatctg

SEQ ID NO: 9007162 - DNA, 22 bp, Homo sapiens
atacactgttcactagatcttc

SEQ ID NO: 9007163 - DNA, 22 bp, Homo sapiens
atacactgttcactagatcttc

SEQ ID NO: 9007164 - DNA, 22 bp, Homo sapiens
atacacttcatgttttcatctg

SEQ ID NO: 9007165 - DNA, 22 bp, Homo sapiens
atacacttccaaatattgatta

SEQ ID NO: 9007166 - DNA, 22 bp, Homo sapiens
atacacttccaaatattgatta

SEQ ID NO: 9007167 - DNA, 22 bp, Homo sapiens
atacacttccaaatattgatta

SEQ ID NO: 9007168 - DNA, 22 bp, Homo sapiens
atacactggtttatgatattgt

SEQ ID NO: 9007169 - DNA, 22 bp, Homo sapiens
atacactggtttatgatattgt

SEQ ID NO: 9007170 - DNA, 22 bp, Homo sapiens
atacactggtttatgatattgt

SEQ ID NO: 9007171 - DNA, 22 bp, Homo sapiens
atacactggtttatgatattgt

SEQ ID NO: 9007172 - DNA, 22 bp, Homo sapiens
atacactgatctttttatgggg

SEQ ID NO: 9007173 - DNA, 22 bp, Homo sapiens
atacactgctgccacacagctg

SEQ ID NO: 9007174 - DNA, 22 bp, Homo sapiens
atacactggacatcattgcatt

SEQ ID NO: 9007175 - DNA, 22 bp, Homo sapiens
atacactggcctttgcagagcc

SEQ ID NO: 9007176 - DNA, 22 bp, Homo sapiens
atacactggacatcattgcatt

SEQ ID NO: 9007177 - DNA, 22 bp, Homo sapiens
actttagaccatcttccacagt

SEQ ID NO: 9007178 - DNA, 22 bp, Homo sapiens
actttagagaaatgtagaagta

SEQ ID NO: 9007179 - DNA, 22 bp, Homo sapiens
actttagagaaatgtagaagta

SEQ ID NO: 9007180 - DNA, 22 bp, Homo sapiens
actttagaagtaaggatgagtt

SEQ ID NO: 9007181 - DNA, 22 bp, Homo sapiens
actttagaaaaggaacagagga

SEQ ID NO: 9007182 - DNA, 22 bp, Homo sapiens
actttagaaaagcatccataga

SEQ ID NO: 9007183 - DNA, 22 bp, Homo sapiens
actttagaaaagcatccataga

SEQ ID NO: 9007184 - DNA, 22 bp, Homo sapiens
actttactccccaacataaatg

SEQ ID NO: 9007185 - DNA, 22 bp, Homo sapiens
actttactccccaacataaatg

SEQ ID NO: 9007186 - DNA, 22 bp, Homo sapiens
atagcatggcctgtgacacttt

SEQ ID NO: 9007187 - DNA, 22 bp, Homo sapiens
atagcatataagttataaaact

SEQ ID NO: 9007188 - DNA, 22 bp, Homo sapiens
atagcatataagttataaaact

SEQ ID NO: 9007189 - DNA, 22 bp, Homo sapiens
atagatcttttcactacatatg

SEQ ID NO: 9007190 - DNA, 22 bp, Homo sapiens
atagatgtcattgtcatccatc

SEQ ID NO: 9007191 - DNA, 22 bp, Homo sapiens
actttagatattcctctgtaca

SEQ ID NO: 9007192 - DNA, 23 bp, Homo sapiens
actttagataaattatgtgcaca

SEQ ID NO: 9007193 - DNA, 22 bp, Homo sapiens
atagatccagaaaatttattat

SEQ ID NO: 9007194 - DNA, 22 bp, Homo sapiens
atagatgtacgtatgtaaatca

SEQ ID NO: 9007195 - DNA, 22 bp, Homo sapiens
atagatgtacgtatgtaaatca

SEQ ID NO: 9007196 - DNA, 22 bp, Homo sapiens
actttacaggcacttcaagtat

SEQ ID NO: 9007197 - DNA, 22 bp, Homo sapiens
actttacaggcacttcaagtat

SEQ ID NO: 9007198 - DNA, 22 bp, Homo sapiens
actttacaggcacttcaagtat

SEQ ID NO: 9007199 - DNA, 22 bp, Homo sapiens
actttacagatggtttcctgac

SEQ ID NO: 9007200 - DNA, 22 bp, Homo sapiens
actttactacatccacagatgg

SEQ ID NO: 9007201 - DNA, 22 bp, Homo sapiens
actttactcaacaaatatttat

SEQ ID NO: 9007202 - DNA, 22 bp, Homo sapiens
actttactacatccacagatgg

SEQ ID NO: 9007203 - DNA, 22 bp, Homo sapiens
atagaatacatttcatggagat

SEQ ID NO: 9007204 - DNA, 22 bp, Homo sapiens
atagaatacatttcatggagat

SEQ ID NO: 9007205 - DNA, 22 bp, Homo sapiens
atagaataatggttgtcaggag

SEQ ID NO: 9007206 - DNA, 22 bp, Homo sapiens
atagaataaggcacagattctt

SEQ ID NO: 9007207 - DNA, 22 bp, Homo sapiens
atagaataaggcacagattctt

SEQ ID NO: 9007208 - DNA, 22 bp, Homo sapiens
atagaataaggcacagattctt

SEQ ID NO: 9007209 - DNA, 22 bp, Homo sapiens
atagaataaggcacagattctt

SEQ ID NO: 9007210 - DNA, 22 bp, Homo sapiens
atagaatagcatagaaaattga

SEQ ID NO: 9007211 - DNA, 22 bp, Homo sapiens
atagaatagcatagaaaattga

SEQ ID NO: 9007212 - DNA, 22 bp, Homo sapiens
atagaatagcatagaaaattga

SEQ ID NO: 9007213 - DNA, 22 bp, Homo sapiens
ataacagacttagagttacaag

SEQ ID NO: 9007214 - DNA, 22 bp, Homo sapiens
ataacagagagctactgaactg

SEQ ID NO: 9007215 - DNA, 22 bp, Homo sapiens
ataacagactgatttttaaatg

SEQ ID NO: 9007216 - DNA, 22 bp, Homo sapiens
ataacagacttagagttacaag

SEQ ID NO: 9007217 - DNA, 22 bp, Homo sapiens
ataacagactgatttttaaatg

SEQ ID NO: 9007218 - DNA, 22 bp, Homo sapiens
ataacagacttagagttacaag

SEQ ID NO: 9007219 - DNA, 22 bp, Homo sapiens
ataacactaaatgtatgtaaca

SEQ ID NO: 9007220 - DNA, 22 bp, Homo sapiens
ataacactaaatgtatgtaaca

SEQ ID NO: 9007221 - DNA, 22 bp, Homo sapiens
ataacactaaatgtatgtaaca

SEQ ID NO: 9007222 - DNA, 22 bp, Homo sapiens
ataacaatagtggtagtgctgg

SEQ ID NO: 9007223 - DNA, 22 bp, Homo sapiens
ataacagaataagtcattaccg

SEQ ID NO: 9007224 - DNA, 22 bp, Homo sapiens
ataacagaataagtcattaccg

SEQ ID NO: 9007225 - DNA, 22 bp, Homo sapiens
ataacagactgatttttaaatg

SEQ ID NO: 9007226 - DNA, 22 bp, Homo sapiens
ataaatttataattgtttcctg

SEQ ID NO: 9007227 - DNA, 22 bp, Homo sapiens
ataaatttataattgtttcctg

SEQ ID NO: 9007228 - DNA, 22 bp, Homo sapiens
ataaatttataattgtttcctg

SEQ ID NO: 9007229 - DNA, 22 bp, Homo sapiens
ataaatttataattgtttcctg

SEQ ID NO: 9007230 - DNA, 22 bp, Homo sapiens
ataaatttataattgtttcctg

SEQ ID NO: 9007231 - DNA, 22 bp, Homo sapiens
ataacaatagtggtagtgctgg

SEQ ID NO: 9007232 - DNA, 22 bp, Homo sapiens
ataacaatagtggtagtgctgg

SEQ ID NO: 9007233 - DNA, 22 bp, Homo sapiens
ataacaatagtggtagtgctgg

SEQ ID NO: 9007234 - DNA, 22 bp, Homo sapiens
ataacaatagtggtagtgctgg

SEQ ID NO: 9007235 - DNA, 22 bp, Homo sapiens
ataaattttcttgctgtactta

SEQ ID NO: 9007236 - DNA, 22 bp, Homo sapiens
ataaattttcttgctgtactta

SEQ ID NO: 9007237 - DNA, 22 bp, Homo sapiens
ataacaagtatttattgagcat

SEQ ID NO: 9007238 - DNA, 22 bp, Homo sapiens
ataaattcaaagcatttaggac

SEQ ID NO: 9007239 - DNA, 22 bp, Homo sapiens
ataaattctctgatgtatagta

SEQ ID NO: 9007240 - DNA, 22 bp, Homo sapiens
ataaattctctgatgtatagta

SEQ ID NO: 9007241 - DNA, 22 bp, Homo sapiens
ataaattatgaatggccctttt

SEQ ID NO: 9007242 - DNA, 22 bp, Homo sapiens
ataaattatgaatggccctttt

SEQ ID NO: 9007243 - DNA, 19 bp, Homo sapiens
ataaataaaaagtgggaga

SEQ ID NO: 9007244 - DNA, 22 bp, Homo sapiens
ataaattgtgcttttgacatct

SEQ ID NO: 9007245 - DNA, 22 bp, Homo sapiens
ataaattgtgcttttgacatct

SEQ ID NO: 9007246 - DNA, 21 bp, Homo sapiens
ataaattctgagaggctctgc

SEQ ID NO: 9007247 - DNA, 22 bp, Homo sapiens
ataaattctctgatgtatagta

SEQ ID NO: 9007248 - DNA, 22 bp, Homo sapiens
ataaattctctgatgtatagta

SEQ ID NO: 9007249 - DNA, 19 bp, Homo sapiens
ataaataaaaagtgggaga

SEQ ID NO: 9007250 - DNA, 19 bp, Homo sapiens
ataaataaaaagtgggaga

SEQ ID NO: 9007251 - DNA, 19 bp, Homo sapiens
ataaataaaaagtgggaga

SEQ ID NO: 9007252 - DNA, 22 bp, Homo sapiens
agttgcagacgcagagatgttg

SEQ ID NO: 9007253 - DNA, 22 bp, Homo sapiens
agttgcagacgcagagatgttg

SEQ ID NO: 9007254 - DNA, 22 bp, Homo sapiens
agttgcagacgcagagatgttg

SEQ ID NO: 9007255 - DNA, 22 bp, Homo sapiens
agttgcagacgcagagatgttg

SEQ ID NO: 9007256 - DNA, 22 bp, Homo sapiens
agttgatttttctggctcagcc

SEQ ID NO: 9007257 - DNA, 22 bp, Homo sapiens
agttgcagacgcagagatgttg

SEQ ID NO: 9007258 - DNA, 22 bp, Homo sapiens
agttcacagaatggccagaact

SEQ ID NO: 9007259 - DNA, 22 bp, Homo sapiens
agttcacagcaaagtggggacc

SEQ ID NO: 9007260 - DNA, 22 bp, Homo sapiens
agttcacagaatggccagaact

SEQ ID NO: 9007261 - DNA, 22 bp, Homo sapiens
agttcacagaatagtgccccac

SEQ ID NO: 9007262 - DNA, 22 bp, Homo sapiens
agttcacaccaaagttaggtag

SEQ ID NO: 9007263 - DNA, 22 bp, Homo sapiens
agttcacagaatagtgccccac

SEQ ID NO: 9007264 - DNA, 22 bp, Homo sapiens
agttcacaatagaagaggtggc

SEQ ID NO: 9007265 - DNA, 22 bp, Homo sapiens
agttcacaatagaagaggtggc

SEQ ID NO: 9007266 - DNA, 22 bp, Homo sapiens
agttcacaagtgcatttcagga

SEQ ID NO: 9007267 - DNA, 20 bp, Homo sapiens
agttcacaggccaaatttct

SEQ ID NO: 9007268 - DNA, 22 bp, Homo sapiens
agttcacatatctgttttattt

SEQ ID NO: 9007269 - DNA, 22 bp, Homo sapiens
agttcacatatctgttttattt

SEQ ID NO: 9007270 - DNA, 22 bp, Homo sapiens
agttcacattccgaggtactgg

SEQ ID NO: 9007271 - DNA, 22 bp, Homo sapiens
agttcacagggaaggttattgt

SEQ ID NO: 9007272 - DNA, 21 bp, Homo sapiens
agttcacaggaacaagcaggg

SEQ ID NO: 9007273 - DNA, 22 bp, Homo sapiens
agttcagaaatgtctttgcaaa

SEQ ID NO: 9007274 - DNA, 22 bp, Homo sapiens
agttcagagtaaatgttgaagg

SEQ ID NO: 9007275 - DNA, 22 bp, Homo sapiens
agttcactttctgtagtggaag

SEQ ID NO: 9007276 - DNA, 22 bp, Homo sapiens
agttcactttctgtagtggaag

SEQ ID NO: 9007277 - DNA, 22 bp, Homo sapiens
agttcactgcttaagcctttga

SEQ ID NO: 9007278 - DNA, 22 bp, Homo sapiens
agttcactctttatgagaaagt

SEQ ID NO: 9007279 - DNA, 22 bp, Homo sapiens
agttcactatagaagacagtgt

SEQ ID NO: 9007280 - DNA, 22 bp, Homo sapiens
agttcacagccatgttcatgtg

SEQ ID NO: 9007281 - DNA, 22 bp, Homo sapiens
agttcactatagaagacagtgt

SEQ ID NO: 9007282 - DNA, 22 bp, Homo sapiens
agttcactctttatgagaaagt

SEQ ID NO: 9007283 - DNA, 22 bp, Homo sapiens
agttcagagtaaatgttgaagg

SEQ ID NO: 9007284 - DNA, 22 bp, Homo sapiens
agttcagaggttaatttatttg

SEQ ID NO: 9007285 - DNA, 22 bp, Homo sapiens
agttcagccatttgttaactat

SEQ ID NO: 9007286 - DNA, 23 bp, Homo sapiens
agttcagctcagttcagtgagca

SEQ ID NO: 9007287 - DNA, 22 bp, Homo sapiens
agttcaggcataaggcatgaac

SEQ ID NO: 9007288 - DNA, 22 bp, Homo sapiens
agttcagtagtccttcattgta

SEQ ID NO: 9007289 - DNA, 22 bp, Homo sapiens
agttcagcttcccaggtcactg

SEQ ID NO: 9007290 - DNA, 22 bp, Homo sapiens
agttcagcttcaagctatgagg

SEQ ID NO: 9007291 - DNA, 22 bp, Homo sapiens
agttcagcaaataaaacatagt

SEQ ID NO: 9007292 - DNA, 22 bp, Homo sapiens
agttcttttgtgaacatatgct

SEQ ID NO: 9007293 - DNA, 22 bp, Homo sapiens
agttcttttgtgaacatatgct

SEQ ID NO: 9007294 - DNA, 22 bp, Homo sapiens
agttgaaaattaagtgaatttc

SEQ ID NO: 9007295 - DNA, 22 bp, Homo sapiens
agttcttttgtgaacatatgct

SEQ ID NO: 9007296 - DNA, 22 bp, Homo sapiens
agttctttgtgagtaatacaga

SEQ ID NO: 9007297 - DNA, 22 bp, Homo sapiens
agttctttgtgagtaatacaga

SEQ ID NO: 9007298 - DNA, 22 bp, Homo sapiens
agttcttttaccaaggcaaatg

SEQ ID NO: 9007299 - DNA, 22 bp, Homo sapiens
agttcttttctagattctggat

SEQ ID NO: 9007300 - DNA, 22 bp, Homo sapiens
agttctttgtcatctctggagt

SEQ ID NO: 9007301 - DNA, 22 bp, Homo sapiens
agttctttgtgagtaatacaga

SEQ ID NO: 9007302 - DNA, 22 bp, Homo sapiens
agttctttggcagctgggctgg

SEQ ID NO: 9007303 - DNA, 22 bp, Homo sapiens
agttctttgtaaaaggtctcta

SEQ ID NO: 9007304 - DNA, 22 bp, Homo sapiens
agttgaaggttggctgatccat

SEQ ID NO: 9007305 - DNA, 22 bp, Homo sapiens
agttgaagtcttcaataagctt

SEQ ID NO: 9007306 - DNA, 22 bp, Homo sapiens
agttgaaagccttatttctctg

SEQ ID NO: 9007307 - DNA, 22 bp, Homo sapiens
agttgaaattaagagagagttt

SEQ ID NO: 9007308 - DNA, 22 bp, Homo sapiens
agttgaaattaagagagagttt

SEQ ID NO: 9007309 - DNA, 22 bp, Homo sapiens
agttgacatccataacaggaag

SEQ ID NO: 9007310 - DNA, 22 bp, Homo sapiens
agttgacatccagagacattct

SEQ ID NO: 9007311 - DNA, 22 bp, Homo sapiens
agttgacaataaatttaattgg

SEQ ID NO: 9007312 - DNA, 22 bp, Homo sapiens
ataaggaaaattggagaaattg

SEQ ID NO: 9007313 - DNA, 22 bp, Homo sapiens
ataaggaaatgaaactctaata

SEQ ID NO: 9007314 - DNA, 22 bp, Homo sapiens
ataaggaaatgaaactctaata

SEQ ID NO: 9007315 - DNA, 22 bp, Homo sapiens
ataaggaacctgggcttaagag

SEQ ID NO: 9007316 - DNA, 22 bp, Homo sapiens
ataacagagagctactgaactg

SEQ ID NO: 9007317 - DNA, 22 bp, Homo sapiens
ataagctttgctggagagacct

SEQ ID NO: 9007318 - DNA, 22 bp, Homo sapiens
ataagcttcctgttagaaaccg

SEQ ID NO: 9007319 - DNA, 22 bp, Homo sapiens
ataagctttgctggagagacct

SEQ ID NO: 9007320 - DNA, 22 bp, Homo sapiens
ataagcttgatgtaactaacca

SEQ ID NO: 9007321 - DNA, 19 bp, Homo sapiens
ataaggcaattggatttgg

SEQ ID NO: 9007322 - DNA, 22 bp, Homo sapiens
ataaggcacacatagatagggt

SEQ ID NO: 9007323 - DNA, 22 bp, Homo sapiens
ataaggaagttgcagaagtgga

SEQ ID NO: 9007324 - DNA, 22 bp, Homo sapiens
ataaggaatgatgtatcagttt

SEQ ID NO: 9007325 - DNA, 22 bp, Homo sapiens
ataaggaatgatgtatcagttt

SEQ ID NO: 9007326 - DNA, 22 bp, Homo sapiens
ataaggaatttagaatagggaa

SEQ ID NO: 9007327 - DNA, 22 bp, Homo sapiens
ataaggacacccttctctttac

SEQ ID NO: 9007328 - DNA, 22 bp, Homo sapiens
atacaaagacaaatctcaatct

SEQ ID NO: 9007329 - DNA, 22 bp, Homo sapiens
atacaaagacaaatctcaatct

SEQ ID NO: 9007330 - DNA, 22 bp, Homo sapiens
ataaggtatgaaaagtaaatgg

SEQ ID NO: 9007331 - DNA, 22 bp, Homo sapiens
atacaagttgtgataatgtaaa

SEQ ID NO: 9007332 - DNA, 22 bp, Homo sapiens
atacaagttgtgataatgtaaa

SEQ ID NO: 9007333 - DNA, 22 bp, Homo sapiens
atacaagttgcccaaatgatta

SEQ ID NO: 9007334 - DNA, 22 bp, Homo sapiens
atacaagttgtgataatgtaaa

SEQ ID NO: 9007335 - DNA, 22 bp, Homo sapiens
ataaggcatatagtcacttttt

SEQ ID NO: 9007336 - DNA, 22 bp, Homo sapiens
ataaggcagtcactggaatgtt

SEQ ID NO: 9007337 - DNA, 22 bp, Homo sapiens
ataaggcttaaaccttgttgcc

SEQ ID NO: 9007338 - DNA, 22 bp, Homo sapiens
ataaggcttctggctgctttct

SEQ ID NO: 9007339 - DNA, 20 bp, Homo sapiens
ataaggctgtgatagtctga

SEQ ID NO: 9007340 - DNA, 22 bp, Homo sapiens
ataaggtataaggcctattttt

SEQ ID NO: 9007341 - DNA, 22 bp, Homo sapiens
ataaggtataaggcctattttt

SEQ ID NO: 9007342 - DNA, 22 bp, Homo sapiens
atacaagttgtgataatgtaaa

SEQ ID NO: 9007343 - DNA, 22 bp, Homo sapiens
atacaatcatcattatattccc

SEQ ID NO: 9007344 - DNA, 22 bp, Homo sapiens
atacaatccagccattgccaca

SEQ ID NO: 9007345 - DNA, 22 bp, Homo sapiens
atacaatctagtctgtcagcaa

SEQ ID NO: 9007346 - DNA, 20 bp, Homo sapiens
atacaatcatgaggaaaaag

SEQ ID NO: 9007347 - DNA, 22 bp, Homo sapiens
atacaatccagccattgccaca

SEQ ID NO: 9007348 - DNA, 20 bp, Homo sapiens
atacaatcatgaggaaaaag

SEQ ID NO: 9007349 - DNA, 22 bp, Homo sapiens
atacaatagtgtttgttttgag

SEQ ID NO: 9007350 - DNA, 22 bp, Homo sapiens
atacaagttgtgataatgtaaa

SEQ ID NO: 9007351 - DNA, 22 bp, Homo sapiens
atacaatagtgtttgttttgag

SEQ ID NO: 9007352 - DNA, 22 bp, Homo sapiens
atacaatagtgtttgttttgag

SEQ ID NO: 9007353 - DNA, 22 bp, Homo sapiens
atacaatgaagtatagatgaaa

SEQ ID NO: 9007354 - DNA, 22 bp, Homo sapiens
atacaatgaagtatagatgaaa

SEQ ID NO: 9007355 - DNA, 22 bp, Homo sapiens
atacaatgaagtatagatgaaa

SEQ ID NO: 9007356 - DNA, 22 bp, Homo sapiens
atacaatgaagtatagatgaaa

SEQ ID NO: 9007357 - DNA, 22 bp, Homo sapiens
atacaatgaagtatagatgaaa

SEQ ID NO: 9007358 - DNA, 22 bp, Homo sapiens
atacaatctagtctgtcagcaa

SEQ ID NO: 9007359 - DNA, 22 bp, Homo sapiens
atacaatgataatagtacttta

SEQ ID NO: 9007360 - DNA, 22 bp, Homo sapiens
atacaatgagtgagtgaatggg

SEQ ID NO: 9007361 - DNA, 22 bp, Homo sapiens
atacaatgacccgggtccaagg

SEQ ID NO: 9007362 - DNA, 22 bp, Homo sapiens
atacaattattctgcagatatt

SEQ ID NO: 9007363 - DNA, 22 bp, Homo sapiens
atacacacaatcaggttttgta

SEQ ID NO: 9007364 - DNA, 22 bp, Homo sapiens
atacacaattgtgtttttatga

SEQ ID NO: 9007365 - DNA, 22 bp, Homo sapiens
atacacaattgtgtttttatga

SEQ ID NO: 9007366 - DNA, 22 bp, Homo sapiens
atacacacatatgtgagttttg

SEQ ID NO: 9007367 - DNA, 22 bp, Homo sapiens
atacacacaatcaggttttgta

SEQ ID NO: 9007368 - DNA, 22 bp, Homo sapiens
atacacacatatgtgagttttg

SEQ ID NO: 9007369 - DNA, 22 bp, Homo sapiens
atacacacgtgcacgtgggaaa

SEQ ID NO: 9007370 - DNA, 22 bp, Homo sapiens
atacacacgtgcacgtgggaaa

SEQ ID NO: 9007371 - DNA, 22 bp, Homo sapiens
atacaattattctgcagatatt

SEQ ID NO: 9007372 - DNA, 22 bp, Homo sapiens
atacaattattctgcagatatt

SEQ ID NO: 9007373 - DNA, 22 bp, Homo sapiens
atacaattattctgcagatatt

SEQ ID NO: 9007374 - DNA, 22 bp, Homo sapiens
atacaattattctgcagatatt

SEQ ID NO: 9007375 - DNA, 22 bp, Homo sapiens
atacaatgggtgcaaagatgtg

SEQ ID NO: 9007376 - DNA, 22 bp, Homo sapiens
atacaatgataatagtacttta

SEQ ID NO: 9007377 - DNA, 22 bp, Homo sapiens
atacaatgattggttctcaccc

SEQ ID NO: 9007378 - DNA, 22 bp, Homo sapiens
atacaatgggtgcaaagatgtg

SEQ ID NO: 9007379 - DNA, 22 bp, Homo sapiens
atacacatttgctagagatggg

SEQ ID NO: 9007380 - DNA, 22 bp, Homo sapiens
atacacatttgctagagatggg

SEQ ID NO: 9007381 - DNA, 22 bp, Homo sapiens
atacacagcgatgagaggaggc

SEQ ID NO: 9007382 - DNA, 22 bp, Homo sapiens
atacacagcgatgagaggaggc

SEQ ID NO: 9007383 - DNA, 22 bp, Homo sapiens
atacacagctacattgaacaat

SEQ ID NO: 9007384 - DNA, 22 bp, Homo sapiens
atacacagcgatgagaggaggc

SEQ ID NO: 9007385 - DNA, 22 bp, Homo sapiens
atacacagccattatgaattag

SEQ ID NO: 9007386 - DNA, 22 bp, Homo sapiens
atacacactgctatcctttttt

SEQ ID NO: 9007387 - DNA, 22 bp, Homo sapiens
atacacactgctatcctttttt

SEQ ID NO: 9007388 - DNA, 22 bp, Homo sapiens
atacacactgctatcctttttt

SEQ ID NO: 9007389 - DNA, 22 bp, Homo sapiens
atacactaatcatgtgctcagt

SEQ ID NO: 9007390 - DNA, 22 bp, Homo sapiens
atacactactaagcacagattg

SEQ ID NO: 9007391 - DNA, 22 bp, Homo sapiens
atacactaacagtgggtgagtc

SEQ ID NO: 9007392 - DNA, 19 bp, Homo sapiens
atacactaatataaaccac

SEQ ID NO: 9007393 - DNA, 22 bp, Homo sapiens
atacactactaagcacagattg

SEQ ID NO: 9007394 - DNA, 22 bp, Homo sapiens
atacactactaagcacagattg

SEQ ID NO: 9007395 - DNA, 22 bp, Homo sapiens
atacactactaagcacagattg

SEQ ID NO: 9007396 - DNA, 22 bp, Homo sapiens
atacactgagtccttttctcat

SEQ ID NO: 9007397 - DNA, 22 bp, Homo sapiens
atacacatttgctagagatggg

SEQ ID NO: 9007398 - DNA, 22 bp, Homo sapiens
atacacgtgccatgttggtgtg

SEQ ID NO: 9007399 - DNA, 22 bp, Homo sapiens
atacacctgtggagtgtctctc

SEQ ID NO: 9007400 - DNA, 22 bp, Homo sapiens
atacacgtgtgtgtacatgcac

SEQ ID NO: 9007401 - DNA, 19 bp, Homo sapiens
atacactaatataaaccac

SEQ ID NO: 9007402 - DNA, 22 bp, Homo sapiens
atttccatgtcggtattttata

SEQ ID NO: 9007403 - DNA, 22 bp, Homo sapiens
atttccatgtcggtattttata

SEQ ID NO: 9007404 - DNA, 22 bp, Homo sapiens
atttccatgtcggtattttata

SEQ ID NO: 9007405 - DNA, 22 bp, Homo sapiens
atttccatgtcggtattttata

SEQ ID NO: 9007406 - DNA, 22 bp, Homo sapiens
atttccatgtccaaaaattagt

SEQ ID NO: 9007407 - DNA, 22 bp, Homo sapiens
atttccatgtccaaaaattagt

SEQ ID NO: 9007408 - DNA, 22 bp, Homo sapiens
atttccatgtccaaaaattagt

SEQ ID NO: 9007409 - DNA, 22 bp, Homo sapiens
atttccattatcatgacaaatt

SEQ ID NO: 9007410 - DNA, 22 bp, Homo sapiens
atttccattatcatgacaaatt

SEQ ID NO: 9007411 - DNA, 22 bp, Homo sapiens
atttccattatcatgacaaatt

SEQ ID NO: 9007412 - DNA, 22 bp, Homo sapiens
atttccatgaagtttagttata

SEQ ID NO: 9007413 - DNA, 22 bp, Homo sapiens
atttccatgccttagcttaagg

SEQ ID NO: 9007414 - DNA, 22 bp, Homo sapiens
atttccatgccttagcttaagg

SEQ ID NO: 9007415 - DNA, 22 bp, Homo sapiens
atttccatagagcgtctcacag

SEQ ID NO: 9007416 - DNA, 22 bp, Homo sapiens
atttccatacacccatttctga

SEQ ID NO: 9007417 - DNA, 22 bp, Homo sapiens
gcccacatttttggcttagagg

SEQ ID NO: 9007418 - DNA, 22 bp, Homo sapiens
gcccacagttagtttgcatggc

SEQ ID NO: 9007419 - DNA, 23 bp, Homo sapiens
gcccaccctcagcgtcctcacgg

SEQ ID NO: 9007420 - DNA, 23 bp, Homo sapiens
gcccaccctcagcgtcctcacgg

SEQ ID NO: 9007421 - DNA, 23 bp, Homo sapiens
gcccaccctcagcgtcctcacgg

SEQ ID NO: 9007422 - DNA, 23 bp, Homo sapiens
gcccaccctcagcgtcctcacgg

SEQ ID NO: 9007423 - DNA, 23 bp, Homo sapiens
gcccaccctcagcgtcctcacgg

SEQ ID NO: 9007424 - DNA, 23 bp, Homo sapiens
gcccaccctcagcgtcctcacgg

SEQ ID NO: 9007425 - DNA, 17 bp, Homo sapiens
gcccacccttaggagct

SEQ ID NO: 9007426 - DNA, 17 bp, Homo sapiens
gcccacccttaggagct

SEQ ID NO: 9007427 - DNA, 17 bp, Homo sapiens
gcccacccttaggagct

SEQ ID NO: 9007428 - DNA, 21 bp, Homo sapiens
gcccacagtgaggaggatccc

SEQ ID NO: 9007429 - DNA, 22 bp, Homo sapiens
gcccacagtctatcagtttgcg

SEQ ID NO: 9007430 - DNA, 22 bp, Homo sapiens
gcccacagtctatcagtttgcg

SEQ ID NO: 9007431 - DNA, 21 bp, Homo sapiens
gcccacagtgaggaggatccc

SEQ ID NO: 9007432 - DNA, 21 bp, Homo sapiens
gcccacagtgaggaggatccc

SEQ ID NO: 9007433 - DNA, 22 bp, Homo sapiens
gcccacagtgtagcaggtactc

SEQ ID NO: 9007434 - DNA, 22 bp, Homo sapiens
gcccacagtgtagcaggtactc

SEQ ID NO: 9007435 - DNA, 21 bp, Homo sapiens
gcccacagtgaggaggatccc

SEQ ID NO: 9007436 - DNA, 22 bp, Homo sapiens
gcccacagtgtagcaggtactc

SEQ ID NO: 9007437 - DNA, 22 bp, Homo sapiens
gcccacagttaatgggggctct

SEQ ID NO: 9007438 - DNA, 22 bp, Homo sapiens
gcccacagttaatgggggctct

SEQ ID NO: 9007439 - DNA, 22 bp, Homo sapiens
atttctgttgcttataaattac

SEQ ID NO: 9007440 - DNA, 22 bp, Homo sapiens
atttctgttgcttataaattac

SEQ ID NO: 9007441 - DNA, 22 bp, Homo sapiens
atttctgttgcttataaattac

SEQ ID NO: 9007442 - DNA, 22 bp, Homo sapiens
gccccaggttgcctgtcccagg

SEQ ID NO: 9007443 - DNA, 22 bp, Homo sapiens
gccccaggttgcctgtcccagg

SEQ ID NO: 9007444 - DNA, 22 bp, Homo sapiens
gcccccacaggcgggctcgggt

SEQ ID NO: 9007445 - DNA, 22 bp, Homo sapiens
gcccccacaggcgggctcgggt

SEQ ID NO: 9007446 - DNA, 22 bp, Homo sapiens
gcccccacaggcgggctcgggt

SEQ ID NO: 9007447 - DNA, 22 bp, Homo sapiens
gccccaggttgcctgtcccagg

SEQ ID NO: 9007448 - DNA, 22 bp, Homo sapiens
gccccaggttgcctgtcccagg

SEQ ID NO: 9007449 - DNA, 22 bp, Homo sapiens
atttctgttatacctttctcag

SEQ ID NO: 9007450 - DNA, 22 bp, Homo sapiens
atttctgttatacctttctcag

SEQ ID NO: 9007451 - DNA, 22 bp, Homo sapiens
atttctgttatacctttctcag

SEQ ID NO: 9007452 - DNA, 22 bp, Homo sapiens
atttctgttatacctttctcag

SEQ ID NO: 9007453 - DNA, 22 bp, Homo sapiens
atttctgtggcttcattctcct

SEQ ID NO: 9007454 - DNA, 22 bp, Homo sapiens
atttctgtggcttcattctcct

SEQ ID NO: 9007455 - DNA, 22 bp, Homo sapiens
atttctgtggcttcattctcct

SEQ ID NO: 9007456 - DNA, 22 bp, Homo sapiens
atttctgtggcttcattctcct

SEQ ID NO: 9007457 - DNA, 22 bp, Homo sapiens
atttctgtatcctgctgtcaga

SEQ ID NO: 9007458 - DNA, 22 bp, Homo sapiens
atttctgtatcctgctgtcaga

SEQ ID NO: 9007459 - DNA, 22 bp, Homo sapiens
atttctgtgcagtaaatggtga

SEQ ID NO: 9007460 - DNA, 22 bp, Homo sapiens
atttctgtgcagtaaatggtga

SEQ ID NO: 9007461 - DNA, 22 bp, Homo sapiens
atttctgtaacttatgaaagtt

SEQ ID NO: 9007462 - DNA, 22 bp, Homo sapiens
atttctgtaacttatgaaagtt

SEQ ID NO: 9007463 - DNA, 22 bp, Homo sapiens
atttctgtaacttatgaaagtt

SEQ ID NO: 9007464 - DNA, 22 bp, Homo sapiens
atttctgtagtccacattcttt

SEQ ID NO: 9007465 - DNA, 22 bp, Homo sapiens
atttctgtagtccacattcttt

SEQ ID NO: 9007466 - DNA, 22 bp, Homo sapiens
atttctgcatctctggagatct

SEQ ID NO: 9007467 - DNA, 22 bp, Homo sapiens
atttctgctactgcaccctagt

SEQ ID NO: 9007468 - DNA, 22 bp, Homo sapiens
atttctgccatagccaggggat

SEQ ID NO: 9007469 - DNA, 22 bp, Homo sapiens
atttctgccaaagtggggacct

SEQ ID NO: 9007470 - DNA, 22 bp, Homo sapiens
atttctgctctgacctgaaagt

SEQ ID NO: 9007471 - DNA, 22 bp, Homo sapiens
atttctggattttggatgctgc

SEQ ID NO: 9007472 - DNA, 22 bp, Homo sapiens
atttctggctgttggaaagttc

SEQ ID NO: 9007473 - DNA, 22 bp, Homo sapiens
atttctgataaacgtaagctgc

SEQ ID NO: 9007474 - DNA, 22 bp, Homo sapiens
atttctgataaacgtaagctgc

SEQ ID NO: 9007475 - DNA, 22 bp, Homo sapiens
atttctgatacccggtcaccct

SEQ ID NO: 9007476 - DNA, 22 bp, Homo sapiens
atttctcagttcctactgttta

SEQ ID NO: 9007477 - DNA, 22 bp, Homo sapiens
atttctcagtgtgatcaggcct

SEQ ID NO: 9007478 - DNA, 22 bp, Homo sapiens
atttctcagtgtacattatgtt

SEQ ID NO: 9007479 - DNA, 22 bp, Homo sapiens
atttctcagtgtacattatgtt

SEQ ID NO: 9007480 - DNA, 22 bp, Homo sapiens
gcccacctaacctgctcacctt

SEQ ID NO: 9007481 - DNA, 17 bp, Homo sapiens
gcccacccttaggagct

SEQ ID NO: 9007482 - DNA, 17 bp, Homo sapiens
gcccacccttaggagct

SEQ ID NO: 9007483 - DNA, 22 bp, Homo sapiens
gcccacctaacctgctcacctt

SEQ ID NO: 9007484 - DNA, 22 bp, Homo sapiens
gcccacctaacctgctcacctt

SEQ ID NO: 9007485 - DNA, 17 bp, Homo sapiens
gcccacccttaggagct

SEQ ID NO: 9007486 - DNA, 22 bp, Homo sapiens
gccaggtggaggttgcagtgag

SEQ ID NO: 9007487 - DNA, 22 bp, Homo sapiens
gccaggtggaggttgcagtgag

SEQ ID NO: 9007488 - DNA, 22 bp, Homo sapiens
gccaggtggaggttgcagtgag

SEQ ID NO: 9007489 - DNA, 22 bp, Homo sapiens
gccaggtggctgagcagctgca

SEQ ID NO: 9007490 - DNA, 22 bp, Homo sapiens
atttcatgttaactgaacagaa

SEQ ID NO: 9007491 - DNA, 22 bp, Homo sapiens
atttcatgtgaagaagagataa

SEQ ID NO: 9007492 - DNA, 22 bp, Homo sapiens
gccaggtggctgagcagctgca

SEQ ID NO: 9007493 - DNA, 22 bp, Homo sapiens
atttcatgttgatctttcgagg

SEQ ID NO: 9007494 - DNA, 22 bp, Homo sapiens
atttcatgttgatctttcgagg

SEQ ID NO: 9007495 - DNA, 22 bp, Homo sapiens
atttcatgtttcatctacctaa

SEQ ID NO: 9007496 - DNA, 22 bp, Homo sapiens
atttcatgtttcatctacctaa

SEQ ID NO: 9007497 - DNA, 22 bp, Homo sapiens
atttccaggctgttttgtgaat

SEQ ID NO: 9007498 - DNA, 22 bp, Homo sapiens
atttccaggtaacctgttgagt

SEQ ID NO: 9007499 - DNA, 22 bp, Homo sapiens
atttccagtgcactgaatagaa

SEQ ID NO: 9007500 - DNA, 22 bp, Homo sapiens
atttccagtgactctcacaggt

SEQ ID NO: 9007501 - DNA, 22 bp, Homo sapiens
gccaggtgcatattagaagcat

SEQ ID NO: 9007502 - DNA, 22 bp, Homo sapiens
gccaggtgcatggctgagtctc

SEQ ID NO: 9007503 - DNA, 22 bp, Homo sapiens
gccaggtgcatggctgagtctc

SEQ ID NO: 9007504 - DNA, 22 bp, Homo sapiens
gccaggtgcatattagaagcat

SEQ ID NO: 9007505 - DNA, 22 bp, Homo sapiens
gccaggtgcatggctgagtctc

SEQ ID NO: 9007506 - DNA, 22 bp, Homo sapiens
gccaggtgctatccctgcgctg

SEQ ID NO: 9007507 - DNA, 22 bp, Homo sapiens
gccaggtgcatggctgagtctc

SEQ ID NO: 9007508 - DNA, 22 bp, Homo sapiens
gccaggtgctatccctgcgctg

SEQ ID NO: 9007509 - DNA, 22 bp, Homo sapiens
gccaggtggaggttgcagtgag

SEQ ID NO: 9007510 - DNA, 22 bp, Homo sapiens
gccaggtggaggttgcagtgag

SEQ ID NO: 9007511 - DNA, 22 bp, Homo sapiens
gccaggtggaggttgcagtgag

SEQ ID NO: 9007512 - DNA, 22 bp, Homo sapiens
gccaggtgatttcaaagtcctt

SEQ ID NO: 9007513 - DNA, 22 bp, Homo sapiens
gccaggtgagtgcgcgccgtcc

SEQ ID NO: 9007514 - DNA, 22 bp, Homo sapiens
gccaggtgcacctgccctggcc

SEQ ID NO: 9007515 - DNA, 22 bp, Homo sapiens
gccaggtgcacctgccctggcc

SEQ ID NO: 9007516 - DNA, 22 bp, Homo sapiens
gccaggtgcacctgccctggcc

SEQ ID NO: 9007517 - DNA, 22 bp, Homo sapiens
gccaggtgagaggactgaggct

SEQ ID NO: 9007518 - DNA, 22 bp, Homo sapiens
gccaggtgagaggactgaggct

SEQ ID NO: 9007519 - DNA, 22 bp, Homo sapiens
gccaggtgagaggactgaggct

SEQ ID NO: 9007520 - DNA, 22 bp, Homo sapiens
gccaggtctgggtagcagagga

SEQ ID NO: 9007521 - DNA, 22 bp, Homo sapiens
gccaggctggtgcaaggatatt

SEQ ID NO: 9007522 - DNA, 22 bp, Homo sapiens
gccaggctggtgcaaggatatt

SEQ ID NO: 9007523 - DNA, 22 bp, Homo sapiens
gccacaggtactatgggagaga

SEQ ID NO: 9007524 - DNA, 22 bp, Homo sapiens
gccacaggtactatgggagaga

SEQ ID NO: 9007525 - DNA, 22 bp, Homo sapiens
gccacaggtactatgggagaga

SEQ ID NO: 9007526 - DNA, 22 bp, Homo sapiens
gccacaggtactatgggagaga

SEQ ID NO: 9007527 - DNA, 22 bp, Homo sapiens
gccacaggtactatgggagaga

SEQ ID NO: 9007528 - DNA, 22 bp, Homo sapiens
gccacagggcgagcggaggcca

SEQ ID NO: 9007529 - DNA, 22 bp, Homo sapiens
gccacaggtactatgggagaga

SEQ ID NO: 9007530 - DNA, 22 bp, Homo sapiens
gccacaggtcggctagagggtc

SEQ ID NO: 9007531 - DNA, 22 bp, Homo sapiens
gccacaggtcggctagagggtc

SEQ ID NO: 9007532 - DNA, 22 bp, Homo sapiens
gccacaggtcggctagagggtc

SEQ ID NO: 9007533 - DNA, 22 bp, Homo sapiens
gccacaggtactatgggagaga

SEQ ID NO: 9007534 - DNA, 22 bp, Homo sapiens
gccacaggtaggaacctacctc

SEQ ID NO: 9007535 - DNA, 22 bp, Homo sapiens
gccacaggtaggaacctacctc

SEQ ID NO: 9007536 - DNA, 22 bp, Homo sapiens
gccacagtcactgctgcagggg

SEQ ID NO: 9007537 - DNA, 22 bp, Homo sapiens
gccacaggtgggctctgggaaa

SEQ ID NO: 9007538 - DNA, 22 bp, Homo sapiens
gccacaggtgggctctgggaaa

SEQ ID NO: 9007539 - DNA, 22 bp, Homo sapiens
gccacaggtgggctctgggaaa

SEQ ID NO: 9007540 - DNA, 22 bp, Homo sapiens
gccacaggtggaattaagaaat

SEQ ID NO: 9007541 - DNA, 22 bp, Homo sapiens
gccacaggtggaattaagaaat

SEQ ID NO: 9007542 - DNA, 19 bp, Homo sapiens
gccaggcctggacctgcag

SEQ ID NO: 9007543 - DNA, 19 bp, Homo sapiens
gccaggcctggacctgcag

SEQ ID NO: 9007544 - DNA, 19 bp, Homo sapiens
gccaggcctggacctgcag

SEQ ID NO: 9007545 - DNA, 19 bp, Homo sapiens
gccaggcctggacctgcag

SEQ ID NO: 9007546 - DNA, 19 bp, Homo sapiens
gccaggcctggacctgcag

SEQ ID NO: 9007547 - DNA, 22 bp, Homo sapiens
gccaggctgctggctgctgtcc

SEQ ID NO: 9007548 - DNA, 22 bp, Homo sapiens
gccaggctgctggctgctgtcc

SEQ ID NO: 9007549 - DNA, 22 bp, Homo sapiens
gccaggcgggtctcaaactcct

SEQ ID NO: 9007550 - DNA, 22 bp, Homo sapiens
gccaggctgctggctgctgtcc

SEQ ID NO: 9007551 - DNA, 22 bp, Homo sapiens
gccaggctggaaagaacagaca

SEQ ID NO: 9007552 - DNA, 22 bp, Homo sapiens
gccaggctggaaagaacagaca

SEQ ID NO: 9007553 - DNA, 22 bp, Homo sapiens
gccaggctggaaagaacagaca

SEQ ID NO: 9007554 - DNA, 22 bp, Homo sapiens
gccaggctggaaagaacagaca

SEQ ID NO: 9007555 - DNA, 22 bp, Homo sapiens
gccaggctggcaaaaggaaacc

SEQ ID NO: 9007556 - DNA, 22 bp, Homo sapiens
gccaggctggaaagaacagaca

SEQ ID NO: 9007557 - DNA, 22 bp, Homo sapiens
gccaggctggccagcaccttct

SEQ ID NO: 9007558 - DNA, 22 bp, Homo sapiens
gccaggctggcaaaaggaaacc

SEQ ID NO: 9007559 - DNA, 22 bp, Homo sapiens
gccaggctggccagcaccttct

SEQ ID NO: 9007560 - DNA, 22 bp, Homo sapiens
gccaggctggcaaaaggaaacc

SEQ ID NO: 9007561 - DNA, 22 bp, Homo sapiens
gccaggctggggggagatgtct

SEQ ID NO: 9007562 - DNA, 22 bp, Homo sapiens
gccaggctggggggagatgtct

SEQ ID NO: 9007563 - DNA, 22 bp, Homo sapiens
gccaggctggggggagatgtct

SEQ ID NO: 9007564 - DNA, 22 bp, Homo sapiens
gccaggctggccagcaccttct

SEQ ID NO: 9007565 - DNA, 22 bp, Homo sapiens
gccaggctggggggagatgtct

SEQ ID NO: 9007566 - DNA, 22 bp, Homo sapiens
gccaggctggtcttgaactcct

SEQ ID NO: 9007567 - DNA, 22 bp, Homo sapiens
gccaggctggtcttgaactcct

SEQ ID NO: 9007568 - DNA, 22 bp, Homo sapiens
gccaggctggtgcaaggatatt

SEQ ID NO: 9007569 - DNA, 20 bp, Homo sapiens
gcctagggtcacttcagtga

SEQ ID NO: 9007570 - DNA, 22 bp, Homo sapiens
gcctagggtgctcagggacgag

SEQ ID NO: 9007571 - DNA, 20 bp, Homo sapiens
gcctagggtcacttcagtga

SEQ ID NO: 9007572 - DNA, 22 bp, Homo sapiens
gcctagggtgctcagggacgag

SEQ ID NO: 9007573 - DNA, 22 bp, Homo sapiens
gcctagggtgctcagggacgag

SEQ ID NO: 9007574 - DNA, 22 bp, Homo sapiens
gcctagggtgctcagggacgag

SEQ ID NO: 9007575 - DNA, 22 bp, Homo sapiens
gcctagtgcactggcagggctc

SEQ ID NO: 9007576 - DNA, 22 bp, Homo sapiens
gcctaggtaccagcagagagcc

SEQ ID NO: 9007577 - DNA, 22 bp, Homo sapiens
gcctaggtaccagcagagagcc

SEQ ID NO: 9007578 - DNA, 22 bp, Homo sapiens
gcctaggtaccagcagagagcc

SEQ ID NO: 9007579 - DNA, 22 bp, Homo sapiens
gcctagggttggcctgagaatc

SEQ ID NO: 9007580 - DNA, 22 bp, Homo sapiens
gcctagggttggcctgagaatc

SEQ ID NO: 9007581 - DNA, 22 bp, Homo sapiens
gcctattatcagagctagtgat

SEQ ID NO: 9007582 - DNA, 22 bp, Homo sapiens
gcctcaaatgtggagcactatt

SEQ ID NO: 9007583 - DNA, 22 bp, Homo sapiens
gcctattaaagagcttggagca

SEQ ID NO: 9007584 - DNA, 22 bp, Homo sapiens
gcctattttattatgcatgtaa

SEQ ID NO: 9007585 - DNA, 19 bp, Homo sapiens
gcctatgtcttcaaatcat

SEQ ID NO: 9007586 - DNA, 22 bp, Homo sapiens
gcctatggattggagaaggagc

SEQ ID NO: 9007587 - DNA, 22 bp, Homo sapiens
gcctatatgttaataggaggga

SEQ ID NO: 9007588 - DNA, 22 bp, Homo sapiens
gcctgaagaacagctgtgagga

SEQ ID NO: 9007589 - DNA, 22 bp, Homo sapiens
gcctcttgtttccttacatgga

SEQ ID NO: 9007590 - DNA, 22 bp, Homo sapiens
gcctctgagtttggagaagagc

SEQ ID NO: 9007591 - DNA, 22 bp, Homo sapiens
gcctctgagtttggagaagagc

SEQ ID NO: 9007592 - DNA, 22 bp, Homo sapiens
gcctctgatggaggccagcgct

SEQ ID NO: 9007593 - DNA, 22 bp, Homo sapiens
gcctctgatggaggccagcgct

SEQ ID NO: 9007594 - DNA, 19 bp, Homo sapiens
gcctcacaggtctcaggcc

SEQ ID NO: 9007595 - DNA, 19 bp, Homo sapiens
gcctctgagggcaggacac

SEQ ID NO: 9007596 - DNA, 22 bp, Homo sapiens
gcctcacatattcatggttact

SEQ ID NO: 9007597 - DNA, 22 bp, Homo sapiens
atttggaacaaatattagtaaa

SEQ ID NO: 9007598 - DNA, 22 bp, Homo sapiens
atttggaacaaatattagtaaa

SEQ ID NO: 9007599 - DNA, 22 bp, Homo sapiens
atttggaaatgtaagaatgcaa

SEQ ID NO: 9007600 - DNA, 22 bp, Homo sapiens
atttggaaatgtaagaatgcaa

SEQ ID NO: 9007601 - DNA, 22 bp, Homo sapiens
atttggaacttataataagttt

SEQ ID NO: 9007602 - DNA, 22 bp, Homo sapiens
atttggaacttataataagttt

SEQ ID NO: 9007603 - DNA, 22 bp, Homo sapiens
atttggaacttataataagttt

SEQ ID NO: 9007604 - DNA, 22 bp, Homo sapiens
atttggaacttataataagttt

SEQ ID NO: 9007605 - DNA, 22 bp, Homo sapiens
gcctaggagtggggatggcggt

SEQ ID NO: 9007606 - DNA, 22 bp, Homo sapiens
atttggaagaaatctgtcacag

SEQ ID NO: 9007607 - DNA, 22 bp, Homo sapiens
atttggaacttataataagttt

SEQ ID NO: 9007608 - DNA, 22 bp, Homo sapiens
gcctaggattgtaaaagagctt

SEQ ID NO: 9007609 - DNA, 22 bp, Homo sapiens
gcctagggatgacaaatattct

SEQ ID NO: 9007610 - DNA, 21 bp, Homo sapiens
gcctagggagatgggactgcc

SEQ ID NO: 9007611 - DNA, 21 bp, Homo sapiens
gcctagggagatgggactgcc

SEQ ID NO: 9007612 - DNA, 21 bp, Homo sapiens
gcctagggagatgggactgcc

SEQ ID NO: 9007613 - DNA, 22 bp, Homo sapiens
gcctaggatcaaccacatgaaa

SEQ ID NO: 9007614 - DNA, 20 bp, Homo sapiens
gcctaggggttgggaaagca

SEQ ID NO: 9007615 - DNA, 20 bp, Homo sapiens
gcctaggggttgggaaagca

SEQ ID NO: 9007616 - DNA, 22 bp, Homo sapiens
gcctaggggtaagagtactggc

SEQ ID NO: 9007617 - DNA, 22 bp, Homo sapiens
gcctaggggtaagagtactggc

SEQ ID NO: 9007618 - DNA, 22 bp, Homo sapiens
gcccccaggtgacttatccaca

SEQ ID NO: 9007619 - DNA, 22 bp, Homo sapiens
gcccccaggctctggagaacct

SEQ ID NO: 9007620 - DNA, 22 bp, Homo sapiens
gcccccaggctctggagaacct

SEQ ID NO: 9007621 - DNA, 22 bp, Homo sapiens
gcccccaggtgacttatccaca

SEQ ID NO: 9007622 - DNA, 22 bp, Homo sapiens
gcccccgtagtagatgaggcgc

SEQ ID NO: 9007623 - DNA, 22 bp, Homo sapiens
gcccccaggtgacttatccaca

SEQ ID NO: 9007624 - DNA, 22 bp, Homo sapiens
gccccctcaaagaggaagctct

SEQ ID NO: 9007625 - DNA, 22 bp, Homo sapiens
gcccccagctctcaagctcaaa

SEQ ID NO: 9007626 - DNA, 22 bp, Homo sapiens
gcccccagctctcaagctcaaa

SEQ ID NO: 9007627 - DNA, 22 bp, Homo sapiens
gcccccaggctctggagaacct

SEQ ID NO: 9007628 - DNA, 22 bp, Homo sapiens
gcccccaggcactacatgtgaa

SEQ ID NO: 9007629 - DNA, 22 bp, Homo sapiens
gcccccaggcactacatgtgaa

SEQ ID NO: 9007630 - DNA, 22 bp, Homo sapiens
gcccccagacctcagtgggctg

SEQ ID NO: 9007631 - DNA, 22 bp, Homo sapiens
gcccccagacctcagtgggctg

SEQ ID NO: 9007632 - DNA, 18 bp, Homo sapiens
gcccccagatgctactga

SEQ ID NO: 9007633 - DNA, 18 bp, Homo sapiens
gcccccagatgctactga

SEQ ID NO: 9007634 - DNA, 18 bp, Homo sapiens
gcccccagatgctactga

SEQ ID NO: 9007635 - DNA, 22 bp, Homo sapiens
gcccccagagaatgaggtacga

SEQ ID NO: 9007636 - DNA, 22 bp, Homo sapiens
gcccccagagaatgaggtacga

SEQ ID NO: 9007637 - DNA, 22 bp, Homo sapiens
gcccccagagaatgaggtacga

SEQ ID NO: 9007638 - DNA, 22 bp, Homo sapiens
gcccccagaagggccacagatt

SEQ ID NO: 9007639 - DNA, 22 bp, Homo sapiens
gcccccagaagggccacagatt

SEQ ID NO: 9007640 - DNA, 22 bp, Homo sapiens
gcccccagaagggccacagatt

SEQ ID NO: 9007641 - DNA, 22 bp, Homo sapiens
gcccccagaagggccacagatt

SEQ ID NO: 9007642 - DNA, 22 bp, Homo sapiens
gcccccagaagggccacagatt

SEQ ID NO: 9007643 - DNA, 22 bp, Homo sapiens
atttgccttttaaactcacaat

SEQ ID NO: 9007644 - DNA, 22 bp, Homo sapiens
atttgccttttaaactcacaat

SEQ ID NO: 9007645 - DNA, 22 bp, Homo sapiens
gccccctatgaagaagggcaca

SEQ ID NO: 9007646 - DNA, 22 bp, Homo sapiens
gccccctctttggagccagcca

SEQ ID NO: 9007647 - DNA, 22 bp, Homo sapiens
atttgctgagctcaaagaaaag

SEQ ID NO: 9007648 - DNA, 22 bp, Homo sapiens
atttggaaaatctggttataga

SEQ ID NO: 9007649 - DNA, 22 bp, Homo sapiens
atttggaaacaattatattctt

SEQ ID NO: 9007650 - DNA, 22 bp, Homo sapiens
atttggaaatgcatctcttgag

SEQ ID NO: 9007651 - DNA, 19 bp, Homo sapiens
atttggaaataaggtcttc

SEQ ID NO: 9007652 - DNA, 22 bp, Homo sapiens
gcctggcaaggccctgttgact

SEQ ID NO: 9007653 - DNA, 23 bp, Homo sapiens
gcctggcaaagcactaccgagag

SEQ ID NO: 9007654 - DNA, 22 bp, Homo sapiens
gcctggcaatggcctcaggaag

SEQ ID NO: 9007655 - DNA, 22 bp, Homo sapiens
gcctggcaaggccctgttgact

SEQ ID NO: 9007656 - DNA, 22 bp, Homo sapiens
gcctggcaatggcctcaggaag

SEQ ID NO: 9007657 - DNA, 22 bp, Homo sapiens
gcctggcacaggaattaggagg

SEQ ID NO: 9007658 - DNA, 22 bp, Homo sapiens
gcctggcacagtagggacccaa

SEQ ID NO: 9007659 - DNA, 22 bp, Homo sapiens
gcctggcaccacagcctttcag

SEQ ID NO: 9007660 - DNA, 22 bp, Homo sapiens
gcctggcacattgcagtggatt

SEQ ID NO: 9007661 - DNA, 22 bp, Homo sapiens
gcctggcacattgcagtggatt

SEQ ID NO: 9007662 - DNA, 22 bp, Homo sapiens
gcctggcacattgcagtggatt

SEQ ID NO: 9007663 - DNA, 22 bp, Homo sapiens
attttactactccaattaatga

SEQ ID NO: 9007664 - DNA, 22 bp, Homo sapiens
attttactactccaattaatga

SEQ ID NO: 9007665 - DNA, 22 bp, Homo sapiens
attttactactccaattaatga

SEQ ID NO: 9007666 - DNA, 22 bp, Homo sapiens
attttactactccaattaatga

SEQ ID NO: 9007667 - DNA, 22 bp, Homo sapiens
gcctggagttgtggtgaagcca

SEQ ID NO: 9007668 - DNA, 22 bp, Homo sapiens
gcctggagttgtggtgaagcca

SEQ ID NO: 9007669 - DNA, 22 bp, Homo sapiens
gcctggagttgtggtgaagcca

SEQ ID NO: 9007670 - DNA, 22 bp, Homo sapiens
gcctggatcccagggagtcagg

SEQ ID NO: 9007671 - DNA, 22 bp, Homo sapiens
gcctggatcccagggagtcagg

SEQ ID NO: 9007672 - DNA, 22 bp, Homo sapiens
gcctggagttgtggtgaagcca

SEQ ID NO: 9007673 - DNA, 22 bp, Homo sapiens
gcctggagttgaaactattatt

SEQ ID NO: 9007674 - DNA, 22 bp, Homo sapiens
gcctggagttgtggtgaagcca

SEQ ID NO: 9007675 - DNA, 23 bp, Homo sapiens
gcctggattaaggcagtgacttc

SEQ ID NO: 9007676 - DNA, 22 bp, Homo sapiens
gcctggattacaaacagccaac

SEQ ID NO: 9007677 - DNA, 22 bp, Homo sapiens
gcctggattccttgtttctcag

SEQ ID NO: 9007678 - DNA, 22 bp, Homo sapiens
gcctggattccttgtttctcag

SEQ ID NO: 9007679 - DNA, 21 bp, Homo sapiens
gcctggcaaaaaccggccctg

SEQ ID NO: 9007680 - DNA, 22 bp, Homo sapiens
gcctggaggaatgtagctgagg

SEQ ID NO: 9007681 - DNA, 22 bp, Homo sapiens
gcctggagttcagccaagtccc

SEQ ID NO: 9007682 - DNA, 22 bp, Homo sapiens
gcctggagttgaaactattatt

SEQ ID NO: 9007683 - DNA, 22 bp, Homo sapiens
gcctggaggaatgtagctgagg

SEQ ID NO: 9007684 - DNA, 20 bp, Homo sapiens
gcctggaggcaatgggaaga

SEQ ID NO: 9007685 - DNA, 22 bp, Homo sapiens
gcctggaggaatgtagctgagg

SEQ ID NO: 9007686 - DNA, 22 bp, Homo sapiens
gcctgaagtttcatgcctctat

SEQ ID NO: 9007687 - DNA, 22 bp, Homo sapiens
gcctgaagctggaataattgta

SEQ ID NO: 9007688 - DNA, 22 bp, Homo sapiens
gcctgaaggagtcagagagggc

SEQ ID NO: 9007689 - DNA, 22 bp, Homo sapiens
gcctgaaggagtcagagagggc

SEQ ID NO: 9007690 - DNA, 22 bp, Homo sapiens
gcctgaaggagtcagagagggc

SEQ ID NO: 9007691 - DNA, 22 bp, Homo sapiens
gcctgacctcttctgccctggg

SEQ ID NO: 9007692 - DNA, 21 bp, Homo sapiens
gcctgaccttactactggggt

SEQ ID NO: 9007693 - DNA, 22 bp, Homo sapiens
gcctgagaaggataggaagcga

SEQ ID NO: 9007694 - DNA, 22 bp, Homo sapiens
gcctgagaaggacacagcaggt

SEQ ID NO: 9007695 - DNA, 22 bp, Homo sapiens
gcctgagaaggataggaagcga

SEQ ID NO: 9007696 - DNA, 22 bp, Homo sapiens
gcctgagaaggacacagcaggt

SEQ ID NO: 9007697 - DNA, 22 bp, Homo sapiens
gcctgagaaggacacagcaggt

SEQ ID NO: 9007698 - DNA, 22 bp, Homo sapiens
gcctgagaaggacacagcaggt

SEQ ID NO: 9007699 - DNA, 22 bp, Homo sapiens
gcctgagagaactgaccaagag

SEQ ID NO: 9007700 - DNA, 22 bp, Homo sapiens
gcctgagagacccatggggcaa

SEQ ID NO: 9007701 - DNA, 22 bp, Homo sapiens
gcctgagagacccatggggcaa

SEQ ID NO: 9007702 - DNA, 22 bp, Homo sapiens
gcctgagagacccatggggcaa

SEQ ID NO: 9007703 - DNA, 22 bp, Homo sapiens
gcctgagagtctccagaccttg

SEQ ID NO: 9007704 - DNA, 22 bp, Homo sapiens
gcctgagagaactgaccaagag

SEQ ID NO: 9007705 - DNA, 22 bp, Homo sapiens
gcctgagagaactgaccaagag

SEQ ID NO: 9007706 - DNA, 22 bp, Homo sapiens
gcctgagacagtgtggtccaat

SEQ ID NO: 9007707 - DNA, 22 bp, Homo sapiens
gcctgagacagtgtggtccaat

SEQ ID NO: 9007708 - DNA, 22 bp, Homo sapiens
gcctgagatcaggagaaagcca

SEQ ID NO: 9007709 - DNA, 22 bp, Homo sapiens
gcctgagatcaggagaaagcca

SEQ ID NO: 9007710 - DNA, 22 bp, Homo sapiens
gcctgagagttgaagttcagtg

SEQ ID NO: 9007711 - DNA, 22 bp, Homo sapiens
gcctgagagttgaagttcagtg

SEQ ID NO: 9007712 - DNA, 22 bp, Homo sapiens
gcctgagagttgaagttcagtg

SEQ ID NO: 9007713 - DNA, 22 bp, Homo sapiens
gcctgagagtctgcatttctaa

SEQ ID NO: 9007714 - DNA, 22 bp, Homo sapiens
atttggaaggagctgcacagca

SEQ ID NO: 9007715 - DNA, 22 bp, Homo sapiens
atttggaaggagctgcacagca

SEQ ID NO: 9007716 - DNA, 22 bp, Homo sapiens
atttggaaggagctgcacagca

SEQ ID NO: 9007717 - DNA, 22 bp, Homo sapiens
atttggaagcttgaagattatt

SEQ ID NO: 9007718 - DNA, 22 bp, Homo sapiens
atttggaagcttgaagattatt

SEQ ID NO: 9007719 - DNA, 22 bp, Homo sapiens
gcctgagattctgcatttctaa

SEQ ID NO: 9007720 - DNA, 22 bp, Homo sapiens
gcctgagattcccggagccgtg

SEQ ID NO: 9007721 - DNA, 22 bp, Homo sapiens
gcctgagattcccggagccgtg

SEQ ID NO: 9007722 - DNA, 22 bp, Homo sapiens
atttggaagaaatctgtcacag

SEQ ID NO: 9007723 - DNA, 22 bp, Homo sapiens
atttggaatagctgtagaaata

SEQ ID NO: 9007724 - DNA, 22 bp, Homo sapiens
atttggaaggtttacaaagaga

SEQ ID NO: 9007725 - DNA, 22 bp, Homo sapiens
atttggaaggtttacaaagaga

SEQ ID NO: 9007726 - DNA, 22 bp, Homo sapiens
atttggaaggtttacaaagaga

SEQ ID NO: 9007727 - DNA, 22 bp, Homo sapiens
atttggaaggtttacaaagaga

SEQ ID NO: 9007728 - DNA, 22 bp, Homo sapiens
atttggaaggtttacaaagaga

SEQ ID NO: 9007729 - DNA, 22 bp, Homo sapiens
atttggaaggcgtttctctgta

SEQ ID NO: 9007730 - DNA, 22 bp, Homo sapiens
atttggaaggcgtttctctgta

SEQ ID NO: 9007731 - DNA, 22 bp, Homo sapiens
caaatagaactcacagacaaga

SEQ ID NO: 9007732 - DNA, 22 bp, Homo sapiens
caaatagaactcacagacaaga

SEQ ID NO: 9007733 - DNA, 22 bp, Homo sapiens
caaatagaactcacagacaaga

SEQ ID NO: 9007734 - DNA, 22 bp, Homo sapiens
caaatagaactcacagacaaga

SEQ ID NO: 9007735 - DNA, 22 bp, Homo sapiens
caaatagaactcacagacaaga

SEQ ID NO: 9007736 - DNA, 22 bp, Homo sapiens
caaatagaactcacagacaaga

SEQ ID NO: 9007737 - DNA, 22 bp, Homo sapiens
caaatacttttagcctattgag

SEQ ID NO: 9007738 - DNA, 22 bp, Homo sapiens
caaatagaaggtactcagagaa

SEQ ID NO: 9007739 - DNA, 22 bp, Homo sapiens
caaatagaaggtactcagagaa

SEQ ID NO: 9007740 - DNA, 22 bp, Homo sapiens
caaatagaaggtactcagagaa

SEQ ID NO: 9007741 - DNA, 22 bp, Homo sapiens
caaatagaaggtactcagagaa

SEQ ID NO: 9007742 - DNA, 21 bp, Homo sapiens
caaatagacatggctagagga

SEQ ID NO: 9007743 - DNA, 21 bp, Homo sapiens
caaatagacatggctagagga

SEQ ID NO: 9007744 - DNA, 22 bp, Homo sapiens
caaatagacaagatggcaggaa

SEQ ID NO: 9007745 - DNA, 21 bp, Homo sapiens
caaatagacatggctagagga

SEQ ID NO: 9007746 - DNA, 22 bp, Homo sapiens
caaatagacaagatggcaggaa

SEQ ID NO: 9007747 - DNA, 21 bp, Homo sapiens
caaatacttagaaacttaaga

SEQ ID NO: 9007748 - DNA, 21 bp, Homo sapiens
caaatacttagaaacttaaga

SEQ ID NO: 9007749 - DNA, 21 bp, Homo sapiens
caaatacttagaaacttaaga

SEQ ID NO: 9007750 - DNA, 21 bp, Homo sapiens
caaatacttagaaacttaaga

SEQ ID NO: 9007751 - DNA, 21 bp, Homo sapiens
caaatacttagaaacttaaga

SEQ ID NO: 9007752 - DNA, 21 bp, Homo sapiens
caaatacttagaaacttaaga

SEQ ID NO: 9007753 - DNA, 22 bp, Homo sapiens
caaatactttatatacttcaaa

SEQ ID NO: 9007754 - DNA, 22 bp, Homo sapiens
caaatactttatatacttcaaa

SEQ ID NO: 9007755 - DNA, 22 bp, Homo sapiens
caaatactttatatacttcaaa

SEQ ID NO: 9007756 - DNA, 22 bp, Homo sapiens
caaatactttatatacttcaaa

SEQ ID NO: 9007757 - DNA, 22 bp, Homo sapiens
caaatactttatatacttcaaa

SEQ ID NO: 9007758 - DNA, 22 bp, Homo sapiens
caaatactttatatacttcaaa

SEQ ID NO: 9007759 - DNA, 22 bp, Homo sapiens
caaatacttttagcctattgag

SEQ ID NO: 9007760 - DNA, 22 bp, Homo sapiens
caaatactctggatgtgtttgt

SEQ ID NO: 9007761 - DNA, 22 bp, Homo sapiens
caaatactgagcacgcaatcaa

SEQ ID NO: 9007762 - DNA, 22 bp, Homo sapiens
caaatactgagcacgcaatcaa

SEQ ID NO: 9007763 - DNA, 22 bp, Homo sapiens
caaatactctggatgtgtttgt

SEQ ID NO: 9007764 - DNA, 22 bp, Homo sapiens
caaatactctggatgtgtttgt

SEQ ID NO: 9007765 - DNA, 22 bp, Homo sapiens
caaatactgagtttattttcaa

SEQ ID NO: 9007766 - DNA, 22 bp, Homo sapiens
caaatactgggtaagttaattt

SEQ ID NO: 9007767 - DNA, 22 bp, Homo sapiens
caaatactgagtttattttcaa

SEQ ID NO: 9007768 - DNA, 22 bp, Homo sapiens
caaatactgagtttattttcaa

SEQ ID NO: 9007769 - DNA, 22 bp, Homo sapiens
caaatactgagtttattttcaa

SEQ ID NO: 9007770 - DNA, 18 bp, Homo sapiens
caaatactgttgtcttat

SEQ ID NO: 9007771 - DNA, 18 bp, Homo sapiens
caaatactgttgtcttat

SEQ ID NO: 9007772 - DNA, 18 bp, Homo sapiens
caaatactgttgtcttat

SEQ ID NO: 9007773 - DNA, 22 bp, Homo sapiens
caaatacttactgaacctgtgc

SEQ ID NO: 9007774 - DNA, 22 bp, Homo sapiens
caaatacttactgaacctgtgc

SEQ ID NO: 9007775 - DNA, 22 bp, Homo sapiens
caaatacttactgaacctgtgc

SEQ ID NO: 9007776 - DNA, 22 bp, Homo sapiens
caaatacttactgaacctgtgc

SEQ ID NO: 9007777 - DNA, 22 bp, Homo sapiens
caaatactgtactgaacactgt

SEQ ID NO: 9007778 - DNA, 22 bp, Homo sapiens
caaatactgtactgaacactgt

SEQ ID NO: 9007779 - DNA, 22 bp, Homo sapiens
caaatactgtactgaacactgt

SEQ ID NO: 9007780 - DNA, 22 bp, Homo sapiens
caaatactgtactgaacactgt

SEQ ID NO: 9007781 - DNA, 22 bp, Homo sapiens
caaatactgggtaagttaattt

SEQ ID NO: 9007782 - DNA, 22 bp, Homo sapiens
caaatactgggtaagttaattt

SEQ ID NO: 9007783 - DNA, 22 bp, Homo sapiens
caaatactgggtaagttaattt

SEQ ID NO: 9007784 - DNA, 22 bp, Homo sapiens
caaatactgggtaagttaattt

SEQ ID NO: 9007785 - DNA, 22 bp, Homo sapiens
caaaggaggtaatgggtgtgag

SEQ ID NO: 9007786 - DNA, 22 bp, Homo sapiens
caaaggaagctccttgatggcg

SEQ ID NO: 9007787 - DNA, 22 bp, Homo sapiens
caaaggaagctccttgatggcg

SEQ ID NO: 9007788 - DNA, 22 bp, Homo sapiens
caaaggacccataattaaaacc

SEQ ID NO: 9007789 - DNA, 21 bp, Homo sapiens
caaaggactgtagctcactga

SEQ ID NO: 9007790 - DNA, 22 bp, Homo sapiens
caaataattactatcctcactt

SEQ ID NO: 9007791 - DNA, 22 bp, Homo sapiens
caaagtgctgggattacaggct

SEQ ID NO: 9007792 - DNA, 22 bp, Homo sapiens
caaataattactatcctcactt

SEQ ID NO: 9007793 - DNA, 22 bp, Homo sapiens
caaagtgctggaattacaggtg

SEQ ID NO: 9007794 - DNA, 22 bp, Homo sapiens
caaagtgctggaattacaggtg

SEQ ID NO: 9007795 - DNA, 22 bp, Homo sapiens
caaagtgctggaattacaggtg

SEQ ID NO: 9007796 - DNA, 22 bp, Homo sapiens
caaagtgctggaattacaggtg

SEQ ID NO: 9007797 - DNA, 22 bp, Homo sapiens
caaaggaggtgataggccctct

SEQ ID NO: 9007798 - DNA, 22 bp, Homo sapiens
caaatactaaacataagatttt

SEQ ID NO: 9007799 - DNA, 22 bp, Homo sapiens
caaatactacgattcttgcagt

SEQ ID NO: 9007800 - DNA, 22 bp, Homo sapiens
caaatactacgattcttgcagt

SEQ ID NO: 9007801 - DNA, 22 bp, Homo sapiens
caaatactacgattcttgcagt

SEQ ID NO: 9007802 - DNA, 22 bp, Homo sapiens
caaatactaaacataagatttt

SEQ ID NO: 9007803 - DNA, 22 bp, Homo sapiens
caaatactaaacataagatttt

SEQ ID NO: 9007804 - DNA, 22 bp, Homo sapiens
caaatactaaacataagatttt

SEQ ID NO: 9007805 - DNA, 22 bp, Homo sapiens
caaatactaaacataagatttt

SEQ ID NO: 9007806 - DNA, 22 bp, Homo sapiens
caaatacaaatacgggcagctt

SEQ ID NO: 9007807 - DNA, 22 bp, Homo sapiens
caaatacaaatacgggcagctt

SEQ ID NO: 9007808 - DNA, 22 bp, Homo sapiens
caaataattactatcctcactt

SEQ ID NO: 9007809 - DNA, 22 bp, Homo sapiens
caaatacaaatacgggcagctt

SEQ ID NO: 9007810 - DNA, 22 bp, Homo sapiens
caaaggaaatactaatctggaa

SEQ ID NO: 9007811 - DNA, 22 bp, Homo sapiens
caaaggaaatactaatctggaa

SEQ ID NO: 9007812 - DNA, 22 bp, Homo sapiens
caaaggaaatactaatctggaa

SEQ ID NO: 9007813 - DNA, 22 bp, Homo sapiens
caaaggaaatactaatctggaa

SEQ ID NO: 9007814 - DNA, 22 bp, Homo sapiens
caaagctgtgaattcctacaaa

SEQ ID NO: 9007815 - DNA, 22 bp, Homo sapiens
caaagcttggagaagcagctgg

SEQ ID NO: 9007816 - DNA, 22 bp, Homo sapiens
caaagcttcatctgttgttttg

SEQ ID NO: 9007817 - DNA, 22 bp, Homo sapiens
caaaggaaatactaatctggaa

SEQ ID NO: 9007818 - DNA, 22 bp, Homo sapiens
caaagctgtaccccaacctatg

SEQ ID NO: 9007819 - DNA, 22 bp, Homo sapiens
caaagctgtgaattcctacaaa

SEQ ID NO: 9007820 - DNA, 22 bp, Homo sapiens
caaagctggactgctcagttca

SEQ ID NO: 9007821 - DNA, 22 bp, Homo sapiens
caaagctggaaaaggaggctgg

SEQ ID NO: 9007822 - DNA, 22 bp, Homo sapiens
caaagctgacgaggtcagcatc

SEQ ID NO: 9007823 - DNA, 22 bp, Homo sapiens
caaagctgacgaggtcagcatc

SEQ ID NO: 9007824 - DNA, 22 bp, Homo sapiens
caaagccctggaaagatgaaga

SEQ ID NO: 9007825 - DNA, 22 bp, Homo sapiens
caaagcctctgatttcacttgt

SEQ ID NO: 9007826 - DNA, 22 bp, Homo sapiens
caaagcgcagaggagcctccgg

SEQ ID NO: 9007827 - DNA, 18 bp, Homo sapiens
caaagctcacgttccatc

SEQ ID NO: 9007828 - DNA, 22 bp, Homo sapiens
gctgaaaaatagtgtcgtgttt

SEQ ID NO: 9007829 - DNA, 22 bp, Homo sapiens
gctgaaaggggtgacattcttt

SEQ ID NO: 9007830 - DNA, 22 bp, Homo sapiens
gctgaaaaatagtgtcgtgttt

SEQ ID NO: 9007831 - DNA, 22 bp, Homo sapiens
gctgaaatcccagcattcccca

SEQ ID NO: 9007832 - DNA, 22 bp, Homo sapiens
gctgaaatgaaaacacaggtcg

SEQ ID NO: 9007833 - DNA, 22 bp, Homo sapiens
gctgaaatgaaaacacaggtcg

SEQ ID NO: 9007834 - DNA, 22 bp, Homo sapiens
gctgacagagtgcctggcctca

SEQ ID NO: 9007835 - DNA, 22 bp, Homo sapiens
gctgaccattaggaggacgata

SEQ ID NO: 9007836 - DNA, 22 bp, Homo sapiens
gctgacccctacaggttgtgtt

SEQ ID NO: 9007837 - DNA, 20 bp, Homo sapiens
gctgaccataaatcacactg

SEQ ID NO: 9007838 - DNA, 20 bp, Homo sapiens
gctgaccataaatcacactg

SEQ ID NO: 9007839 - DNA, 22 bp, Homo sapiens
gctgaccatgaattaagcatct

SEQ ID NO: 9007840 - DNA, 22 bp, Homo sapiens
gctgaccattaggaggacgata

SEQ ID NO: 9007841 - DNA, 22 bp, Homo sapiens
gctgacagcgtttccagtgatg

SEQ ID NO: 9007842 - DNA, 22 bp, Homo sapiens
gctgacagcgtttccagtgatg

SEQ ID NO: 9007843 - DNA, 22 bp, Homo sapiens
gctgacagttgtacctgcccct

SEQ ID NO: 9007844 - DNA, 22 bp, Homo sapiens
gctgacagttactgctgtaaca

SEQ ID NO: 9007845 - DNA, 22 bp, Homo sapiens
gctcttgtcaaaaattagttga

SEQ ID NO: 9007846 - DNA, 22 bp, Homo sapiens
gctctttaattcattcatggat

SEQ ID NO: 9007847 - DNA, 22 bp, Homo sapiens
gctcttgtcagagaggccagct

SEQ ID NO: 9007848 - DNA, 22 bp, Homo sapiens
gctcttgtcaaaaattagttga

SEQ ID NO: 9007849 - DNA, 22 bp, Homo sapiens
gctcttgtcaaaaattagttga

SEQ ID NO: 9007850 - DNA, 22 bp, Homo sapiens
gctctttactgtgagggtggtc

SEQ ID NO: 9007851 - DNA, 18 bp, Homo sapiens
gctctttctgtctccagc

SEQ ID NO: 9007852 - DNA, 22 bp, Homo sapiens
gctctttctgtccgcagggcct

SEQ ID NO: 9007853 - DNA, 22 bp, Homo sapiens
gctctttagcgggggccaggcc

SEQ ID NO: 9007854 - DNA, 22 bp, Homo sapiens
gctcttgtcaaaaattagttga

SEQ ID NO: 9007855 - DNA, 22 bp, Homo sapiens
gctcttgtcaaaaattagttga

SEQ ID NO: 9007856 - DNA, 18 bp, Homo sapiens
gctctggttccttcaacc

SEQ ID NO: 9007857 - DNA, 22 bp, Homo sapiens
gctcttggccaagtggaagggt

SEQ ID NO: 9007858 - DNA, 22 bp, Homo sapiens
gctcttgggggacagatggagt

SEQ ID NO: 9007859 - DNA, 22 bp, Homo sapiens
gctcttgggggacagatggagt

SEQ ID NO: 9007860 - DNA, 22 bp, Homo sapiens
caaatagactctagaatttatt

SEQ ID NO: 9007861 - DNA, 22 bp, Homo sapiens
caaatagactctagaatttatt

SEQ ID NO: 9007862 - DNA, 22 bp, Homo sapiens
caaatagactctagaatttatt

SEQ ID NO: 9007863 - DNA, 22 bp, Homo sapiens
caaatagactctagaatttatt

SEQ ID NO: 9007864 - DNA, 22 bp, Homo sapiens
caaatagactctagaatttatt

SEQ ID NO: 9007865 - DNA, 22 bp, Homo sapiens
gctctggttccagttccgcacc

SEQ ID NO: 9007866 - DNA, 22 bp, Homo sapiens
gctcttggaagacaggatgtgt

SEQ ID NO: 9007867 - DNA, 18 bp, Homo sapiens
gctctggttccttcaacc

SEQ ID NO: 9007868 - DNA, 22 bp, Homo sapiens
caaatgcatagtttataagaag

SEQ ID NO: 9007869 - DNA, 22 bp, Homo sapiens
caaatgcatagtttataagaag

SEQ ID NO: 9007870 - DNA, 22 bp, Homo sapiens
caaatgcatagtttataagaag

SEQ ID NO: 9007871 - DNA, 22 bp, Homo sapiens
caaatgcatagtttataagaag

SEQ ID NO: 9007872 - DNA, 22 bp, Homo sapiens
caaatgcatagtttataagaag

SEQ ID NO: 9007873 - DNA, 20 bp, Homo sapiens
gctgactgtttgggtggcgg

SEQ ID NO: 9007874 - DNA, 22 bp, Homo sapiens
caaatgaatttccctgcaaatg

SEQ ID NO: 9007875 - DNA, 22 bp, Homo sapiens
gctgactgtccgctgctcccgg

SEQ ID NO: 9007876 - DNA, 22 bp, Homo sapiens
caaatgatacctattactaggc

SEQ ID NO: 9007877 - DNA, 22 bp, Homo sapiens
caaatgatacctattactaggc

SEQ ID NO: 9007878 - DNA, 22 bp, Homo sapiens
gctgactgatggacacagcacc

SEQ ID NO: 9007879 - DNA, 22 bp, Homo sapiens
gctgactgatggacacagcacc

SEQ ID NO: 9007880 - DNA, 22 bp, Homo sapiens
gctgactgctcagggccagctg

SEQ ID NO: 9007881 - DNA, 22 bp, Homo sapiens
gctgactgatggacacagcacc

SEQ ID NO: 9007882 - DNA, 22 bp, Homo sapiens
gctgactggttgcacagagggt

SEQ ID NO: 9007883 - DNA, 22 bp, Homo sapiens
gctgactggttcaggtcccgct

SEQ ID NO: 9007884 - DNA, 22 bp, Homo sapiens
gctgactggttgcacagagggt

SEQ ID NO: 9007885 - DNA, 22 bp, Homo sapiens
gctgactggttcaggtcccgct

SEQ ID NO: 9007886 - DNA, 22 bp, Homo sapiens
gctgactgctcagggccagctg

SEQ ID NO: 9007887 - DNA, 22 bp, Homo sapiens
gctgactcagatgcagctggat

SEQ ID NO: 9007888 - DNA, 22 bp, Homo sapiens
gctgacctttgccaggaaggca

SEQ ID NO: 9007889 - DNA, 22 bp, Homo sapiens
gctgacctgtggcagaagctca

SEQ ID NO: 9007890 - DNA, 20 bp, Homo sapiens
gctgacccctgctgtcatgc

SEQ ID NO: 9007891 - DNA, 22 bp, Homo sapiens
gctgacctgaatcattcggggt

SEQ ID NO: 9007892 - DNA, 22 bp, Homo sapiens
gctgacctgctctcagcagaga

SEQ ID NO: 9007893 - DNA, 22 bp, Homo sapiens
caaatgctatgattttgagttt

SEQ ID NO: 9007894 - DNA, 22 bp, Homo sapiens
caaatgctggccctgctactta

SEQ ID NO: 9007895 - DNA, 22 bp, Homo sapiens
caaatgctatgattttgagttt

SEQ ID NO: 9007896 - DNA, 22 bp, Homo sapiens
caaatgctatgattttgagttt

SEQ ID NO: 9007897 - DNA, 21 bp, Homo sapiens
caaatgctggctggatgagga

SEQ ID NO: 9007898 - DNA, 22 bp, Homo sapiens
caaatgctggccctgctactta

SEQ ID NO: 9007899 - DNA, 22 bp, Homo sapiens
caaatggaaagagcagaagctt

SEQ ID NO: 9007900 - DNA, 22 bp, Homo sapiens
caaatggagaattagcagtttg

SEQ ID NO: 9007901 - DNA, 22 bp, Homo sapiens
caaatggatacaggcaaacatt

SEQ ID NO: 9007902 - DNA, 22 bp, Homo sapiens
caaatggatacaggcaaacatt

SEQ ID NO: 9007903 - DNA, 22 bp, Homo sapiens
caaatggcaacaagaacactgg

SEQ ID NO: 9007904 - DNA, 22 bp, Homo sapiens
caaatggctggcatccttctac

SEQ ID NO: 9007905 - DNA, 22 bp, Homo sapiens
caaatgctaacttctttccaaa

SEQ ID NO: 9007906 - DNA, 22 bp, Homo sapiens
caaatgcatgagaaataagagg

SEQ ID NO: 9007907 - DNA, 22 bp, Homo sapiens
caaatgctaacttctttccaaa

SEQ ID NO: 9007908 - DNA, 22 bp, Homo sapiens
caaatgctactaataggcaagt

SEQ ID NO: 9007909 - DNA, 22 bp, Homo sapiens
caaatgctactaataggcaagt

SEQ ID NO: 9007910 - DNA, 22 bp, Homo sapiens
caaatgctactaataggcaagt

SEQ ID NO: 9007911 - DNA, 22 bp, Homo sapiens
caaatgcatgagaaataagagg

SEQ ID NO: 9007912 - DNA, 22 bp, Homo sapiens
caaatgcatgagaaataagagg

SEQ ID NO: 9007913 - DNA, 22 bp, Homo sapiens
caaatgcatgagaaataagagg

SEQ ID NO: 9007914 - DNA, 22 bp, Homo sapiens
caaatgcatgagaaataagagg

SEQ ID NO: 9007915 - DNA, 22 bp, Homo sapiens
caaatgcatgagaaataagagg

SEQ ID NO: 9007916 - DNA, 22 bp, Homo sapiens
caaatgcatgagaaataagagg

SEQ ID NO: 9007917 - DNA, 22 bp, Homo sapiens
atttttatgacaaaccatcctc

SEQ ID NO: 9007918 - DNA, 22 bp, Homo sapiens
atttttatgacaaaccatcctc

SEQ ID NO: 9007919 - DNA, 22 bp, Homo sapiens
atttttatgacaaaccatcctc

SEQ ID NO: 9007920 - DNA, 22 bp, Homo sapiens
atttttcaactttggaaatggc

SEQ ID NO: 9007921 - DNA, 22 bp, Homo sapiens
atttttatgacaaaccatcctc

SEQ ID NO: 9007922 - DNA, 23 bp, Homo sapiens
atttttagcctctctgagctgag

SEQ ID NO: 9007923 - DNA, 22 bp, Homo sapiens
attttgtttcctttggagtaga

SEQ ID NO: 9007924 - DNA, 22 bp, Homo sapiens
attttgctttatgtaaatatgt

SEQ ID NO: 9007925 - DNA, 22 bp, Homo sapiens
attttgctttatgtaaatatgt

SEQ ID NO: 9007926 - DNA, 22 bp, Homo sapiens
atttttcaactttggaaatggc

SEQ ID NO: 9007927 - DNA, 22 bp, Homo sapiens
atttttcaactttggaaatggc

SEQ ID NO: 9007928 - DNA, 22 bp, Homo sapiens
atttttcagcttcattgaggca

SEQ ID NO: 9007929 - DNA, 22 bp, Homo sapiens
atttttccaattaggataaaga

SEQ ID NO: 9007930 - DNA, 22 bp, Homo sapiens
atttttccaattaggataaaga

SEQ ID NO: 9007931 - DNA, 22 bp, Homo sapiens
atttttccaattaggataaaga

SEQ ID NO: 9007932 - DNA, 22 bp, Homo sapiens
atttttccatgatacttatctg

SEQ ID NO: 9007933 - DNA, 22 bp, Homo sapiens
atttttccaattaggataaaga

SEQ ID NO: 9007934 - DNA, 22 bp, Homo sapiens
atttttccatgatacttatctg

SEQ ID NO: 9007935 - DNA, 22 bp, Homo sapiens
attttagagaaacaaacgtagg

SEQ ID NO: 9007936 - DNA, 22 bp, Homo sapiens
attttactttgtgaatattgac

SEQ ID NO: 9007937 - DNA, 22 bp, Homo sapiens
attttacttcatttgaaatgcc

SEQ ID NO: 9007938 - DNA, 22 bp, Homo sapiens
attttacttcatttgaaatgcc

SEQ ID NO: 9007939 - DNA, 22 bp, Homo sapiens
attttacttagtgtaatgtcca

SEQ ID NO: 9007940 - DNA, 22 bp, Homo sapiens
attttacttagtgtaatgtcca

SEQ ID NO: 9007941 - DNA, 22 bp, Homo sapiens
attttagagctccaagtacagc

SEQ ID NO: 9007942 - DNA, 22 bp, Homo sapiens
attttagagctccaagtacagc

SEQ ID NO: 9007943 - DNA, 22 bp, Homo sapiens
attttagagctccaagtacagc

SEQ ID NO: 9007944 - DNA, 22 bp, Homo sapiens
attttagagctccaagtacagc

SEQ ID NO: 9007945 - DNA, 22 bp, Homo sapiens
attttagagctccaagtacagc

SEQ ID NO: 9007946 - DNA, 22 bp, Homo sapiens
attttgctgtggtacattagga

SEQ ID NO: 9007947 - DNA, 22 bp, Homo sapiens
attttgctttatgtaaatatgt

SEQ ID NO: 9007948 - DNA, 22 bp, Homo sapiens
attttagagaaacaaacgtagg

SEQ ID NO: 9007949 - DNA, 22 bp, Homo sapiens
attttagagaaacaaacgtagg

SEQ ID NO: 9007950 - DNA, 22 bp, Homo sapiens
attttagagaaacaaacgtagg

SEQ ID NO: 9007951 - DNA, 22 bp, Homo sapiens
attttagagaaacaaacgtagg

SEQ ID NO: 9007952 - DNA, 22 bp, Homo sapiens
attttagagctccaagtacagc

SEQ ID NO: 9007953 - DNA, 19 bp, Homo sapiens
atttttcttcctctgtgca

SEQ ID NO: 9007954 - DNA, 19 bp, Homo sapiens
atttttcttcctctgtgca

SEQ ID NO: 9007955 - DNA, 19 bp, Homo sapiens
atttttcttcctctgtgca

SEQ ID NO: 9007956 - DNA, 22 bp, Homo sapiens
atttttgagctgtgaacatagc

SEQ ID NO: 9007957 - DNA, 22 bp, Homo sapiens
atttttctctttccactgagat

SEQ ID NO: 9007958 - DNA, 22 bp, Homo sapiens
atttttctctttccactgagat

SEQ ID NO: 9007959 - DNA, 22 bp, Homo sapiens
atttttgtatccccagctcctg

SEQ ID NO: 9007960 - DNA, 22 bp, Homo sapiens
caaaagcagttctatctgagtt

SEQ ID NO: 9007961 - DNA, 22 bp, Homo sapiens
atttttgagctgtgaacatagc

SEQ ID NO: 9007962 - DNA, 22 bp, Homo sapiens
atttttgccctgcagtacataa

SEQ ID NO: 9007963 - DNA, 22 bp, Homo sapiens
caaaagcagttctatctgagtt

SEQ ID NO: 9007964 - DNA, 22 bp, Homo sapiens
caaaagcagttctatctgagtt

SEQ ID NO: 9007965 - DNA, 22 bp, Homo sapiens
caaaagcagttctatctgagtt

SEQ ID NO: 9007966 - DNA, 22 bp, Homo sapiens
caaaagcagttctatctgagtt

SEQ ID NO: 9007967 - DNA, 22 bp, Homo sapiens
caaaataccacgacttgtttta

SEQ ID NO: 9007968 - DNA, 22 bp, Homo sapiens
caaaataccacgacttgtttta

SEQ ID NO: 9007969 - DNA, 22 bp, Homo sapiens
atttttctctcacacttaccag

SEQ ID NO: 9007970 - DNA, 22 bp, Homo sapiens
atttttctctcacacttaccag

SEQ ID NO: 9007971 - DNA, 22 bp, Homo sapiens
atttttctctcacacttaccag

SEQ ID NO: 9007972 - DNA, 22 bp, Homo sapiens
atttttctctcacacttaccag

SEQ ID NO: 9007973 - DNA, 22 bp, Homo sapiens
atttttctctcacacttaccag

SEQ ID NO: 9007974 - DNA, 22 bp, Homo sapiens
atttttctctcacacttaccag

SEQ ID NO: 9007975 - DNA, 22 bp, Homo sapiens
atttttctctccactccattaa

SEQ ID NO: 9007976 - DNA, 22 bp, Homo sapiens
atttttctctccactccattaa

SEQ ID NO: 9007977 - DNA, 22 bp, Homo sapiens
atttttctctccactccattaa

SEQ ID NO: 9007978 - DNA, 22 bp, Homo sapiens
atttttctctccactccattaa

SEQ ID NO: 9007979 - DNA, 22 bp, Homo sapiens
atttttctctccactccattaa

SEQ ID NO: 9007980 - DNA, 22 bp, Homo sapiens
atttttctctccactccattaa

SEQ ID NO: 9007981 - DNA, 22 bp, Homo sapiens
atttttctctccactccattaa

SEQ ID NO: 9007982 - DNA, 22 bp, Homo sapiens
atttttctctccactccattaa

SEQ ID NO: 9007983 - DNA, 22 bp, Homo sapiens
atttttctctttccactgagat

SEQ ID NO: 9007984 - DNA, 23 bp, Homo sapiens
atttttcctggaacagtcaccca

SEQ ID NO: 9007985 - DNA, 23 bp, Homo sapiens
atttttcctggaacagtcaccca

SEQ ID NO: 9007986 - DNA, 22 bp, Homo sapiens
atttttcctgctggatctgctc

SEQ ID NO: 9007987 - DNA, 23 bp, Homo sapiens
atttttcctggaacagtcaccca

SEQ ID NO: 9007988 - DNA, 22 bp, Homo sapiens
atttttcctgctggatctgctc

SEQ ID NO: 9007989 - DNA, 22 bp, Homo sapiens
atttttcctgggtgctttagtt

SEQ ID NO: 9007990 - DNA, 22 bp, Homo sapiens
atttttcctgggtgctttagtt

SEQ ID NO: 9007991 - DNA, 22 bp, Homo sapiens
atttttcctgggtgctttagtt

SEQ ID NO: 9007992 - DNA, 22 bp, Homo sapiens
atttttccatgatacttatctg

SEQ ID NO: 9007993 - DNA, 22 bp, Homo sapiens
atttttccatgatacttatctg

SEQ ID NO: 9007994 - DNA, 22 bp, Homo sapiens
atttttccattctctgttagta

SEQ ID NO: 9007995 - DNA, 22 bp, Homo sapiens
atttttccattctctgttagta

SEQ ID NO: 9007996 - DNA, 22 bp, Homo sapiens
atttttccattctctgttagta

SEQ ID NO: 9007997 - DNA, 18 bp, Homo sapiens
atttttcccagatggata

SEQ ID NO: 9007998 - DNA, 22 bp, Homo sapiens
atttttcctgctggatctgctc

SEQ ID NO: 9007999 - DNA, 18 bp, Homo sapiens
atttttcccagatggata

SEQ ID NO: 9008000 - DNA, 18 bp, Homo sapiens
atttttcccagatggata

SEQ ID NO: 9008001 - DNA, 22 bp, Homo sapiens
caaacatagtgaagcaatgaca

SEQ ID NO: 9008002 - DNA, 22 bp, Homo sapiens
caaacatagtgaagcaatgaca

SEQ ID NO: 9008003 - DNA, 22 bp, Homo sapiens
caaacatagtgaagcaatgaca

SEQ ID NO: 9008004 - DNA, 22 bp, Homo sapiens
caaacatagtgaagcaatgaca

SEQ ID NO: 9008005 - DNA, 22 bp, Homo sapiens
caaacaatttgcatttccttag

SEQ ID NO: 9008006 - DNA, 22 bp, Homo sapiens
caaacaatttgcatttccttag

SEQ ID NO: 9008007 - DNA, 22 bp, Homo sapiens
caaaattagggagtgagctgga

SEQ ID NO: 9008008 - DNA, 22 bp, Homo sapiens
caaaattctgcatttctaataa

SEQ ID NO: 9008009 - DNA, 22 bp, Homo sapiens
caaaattctgcatttctaataa

SEQ ID NO: 9008010 - DNA, 22 bp, Homo sapiens
caaaattctgcatttctaataa

SEQ ID NO: 9008011 - DNA, 22 bp, Homo sapiens
caaaattctgcatttctaataa

SEQ ID NO: 9008012 - DNA, 22 bp, Homo sapiens
caaaattagaaatgcagctgtt

SEQ ID NO: 9008013 - DNA, 22 bp, Homo sapiens
caaaattagaaatgcagctgtt

SEQ ID NO: 9008014 - DNA, 22 bp, Homo sapiens
caaaattagggagtgagctgga

SEQ ID NO: 9008015 - DNA, 22 bp, Homo sapiens
caaaattagggagtgagctgga

SEQ ID NO: 9008016 - DNA, 22 bp, Homo sapiens
caaaattagggagtgagctgga

SEQ ID NO: 9008017 - DNA, 22 bp, Homo sapiens
caaaatgttctggcacctttaa

SEQ ID NO: 9008018 - DNA, 22 bp, Homo sapiens
caaaatgtgagtcccacctcaa

SEQ ID NO: 9008019 - DNA, 22 bp, Homo sapiens
caaaatgtgagtcccacctcaa

SEQ ID NO: 9008020 - DNA, 22 bp, Homo sapiens
caaaatgttctggcacctttaa

SEQ ID NO: 9008021 - DNA, 22 bp, Homo sapiens
caaaattagaaatgcagctgtt

SEQ ID NO: 9008022 - DNA, 22 bp, Homo sapiens
caaaattagaaatgcagctgtt

SEQ ID NO: 9008023 - DNA, 22 bp, Homo sapiens
caaaatgttctggcacctttaa

SEQ ID NO: 9008024 - DNA, 22 bp, Homo sapiens
caaaataccacgacttgtttta

SEQ ID NO: 9008025 - DNA, 22 bp, Homo sapiens
caaaataccacgacttgtttta

SEQ ID NO: 9008026 - DNA, 22 bp, Homo sapiens
caaaatagatgttaacctggaa

SEQ ID NO: 9008027 - DNA, 22 bp, Homo sapiens
caaaatagatgttaacctggaa

SEQ ID NO: 9008028 - DNA, 22 bp, Homo sapiens
caaaataccacgacttgtttta

SEQ ID NO: 9008029 - DNA, 22 bp, Homo sapiens
caaaatagatgttaacctggaa

SEQ ID NO: 9008030 - DNA, 22 bp, Homo sapiens
caaaatagatgttaacctggaa

SEQ ID NO: 9008031 - DNA, 22 bp, Homo sapiens
caaaatagatgttaacctggaa

SEQ ID NO: 9008032 - DNA, 22 bp, Homo sapiens
caaaatgatgtgattttattgt

SEQ ID NO: 9008033 - DNA, 22 bp, Homo sapiens
caaaatgatgtgattttattgt

SEQ ID NO: 9008034 - DNA, 23 bp, Homo sapiens
caaaatggtttaaaagtggcata

SEQ ID NO: 9008035 - DNA, 23 bp, Homo sapiens
caaaatggtttaaaagtggcata

SEQ ID NO: 9008036 - DNA, 22 bp, Homo sapiens
caaaatgatgtgattttattgt

SEQ ID NO: 9008037 - DNA, 22 bp, Homo sapiens
caaaatgatgtgattttattgt

SEQ ID NO: 9008038 - DNA, 22 bp, Homo sapiens
caaaatgatgtgattttattgt

SEQ ID NO: 9008039 - DNA, 22 bp, Homo sapiens
caaaatgatgtgattttattgt

SEQ ID NO: 9008040 - DNA, 22 bp, Homo sapiens
caaaatgatgtgattttattgt

SEQ ID NO: 9008041 - DNA, 22 bp, Homo sapiens
caaaatgatgtgattttattgt

SEQ ID NO: 9008042 - DNA, 18 bp, Homo sapiens
caaagcaggtgacagtgt

SEQ ID NO: 9008043 - DNA, 18 bp, Homo sapiens
caaagcaggtgacagtgt

SEQ ID NO: 9008044 - DNA, 18 bp, Homo sapiens
caaagcaggtgacagtgt

SEQ ID NO: 9008045 - DNA, 22 bp, Homo sapiens
caaagcaggaagctcctgacag

SEQ ID NO: 9008046 - DNA, 22 bp, Homo sapiens
caaagcaggaagctcctgacag

SEQ ID NO: 9008047 - DNA, 20 bp, Homo sapiens
caaagcagtaggataaaaat

SEQ ID NO: 9008048 - DNA, 22 bp, Homo sapiens
caaagcagtattggattcttta

SEQ ID NO: 9008049 - DNA, 20 bp, Homo sapiens
caaagcagtaggataaaaat

SEQ ID NO: 9008050 - DNA, 22 bp, Homo sapiens
caaagccaggctttctaatgta

SEQ ID NO: 9008051 - DNA, 22 bp, Homo sapiens
caaagccaggctttctaatgta

SEQ ID NO: 9008052 - DNA, 22 bp, Homo sapiens
caaagccaggctttctaatgta

SEQ ID NO: 9008053 - DNA, 22 bp, Homo sapiens
caaagccatagagtagataaga

SEQ ID NO: 9008054 - DNA, 22 bp, Homo sapiens
caaagccatagagtagataaga

SEQ ID NO: 9008055 - DNA, 22 bp, Homo sapiens
caaagccaggctttctaatgta

SEQ ID NO: 9008056 - DNA, 21 bp, Homo sapiens
caaagccaggcaactctctcc

SEQ ID NO: 9008057 - DNA, 22 bp, Homo sapiens
caaagcagttttaatcaagtag

SEQ ID NO: 9008058 - DNA, 22 bp, Homo sapiens
caaagcagttttaatcaagtag

SEQ ID NO: 9008059 - DNA, 21 bp, Homo sapiens
caaagccaggcaactctctcc

SEQ ID NO: 9008060 - DNA, 22 bp, Homo sapiens
caaacattcagatgcaatggta

SEQ ID NO: 9008061 - DNA, 22 bp, Homo sapiens
caaacattcaagtacaagtctt

SEQ ID NO: 9008062 - DNA, 22 bp, Homo sapiens
caaacattcaagtacaagtctt

SEQ ID NO: 9008063 - DNA, 22 bp, Homo sapiens
caaacattcaagtacaagtctt

SEQ ID NO: 9008064 - DNA, 22 bp, Homo sapiens
caaacattcaagtacaagtctt

SEQ ID NO: 9008065 - DNA, 22 bp, Homo sapiens
caaacattcaagtacaagtctt

SEQ ID NO: 9008066 - DNA, 22 bp, Homo sapiens
caaacattcaagtacaagtctt

SEQ ID NO: 9008067 - DNA, 22 bp, Homo sapiens
caaacattcaagtacaagtctt

SEQ ID NO: 9008068 - DNA, 22 bp, Homo sapiens
caaacattcaagtacaagtctt

SEQ ID NO: 9008069 - DNA, 22 bp, Homo sapiens
caaagaggttttgagggcagct

SEQ ID NO: 9008070 - DNA, 22 bp, Homo sapiens
caaagaggttttgagggcagct

SEQ ID NO: 9008071 - DNA, 22 bp, Homo sapiens
caaacattcagatgcaatggta

SEQ ID NO: 9008072 - DNA, 22 bp, Homo sapiens
caaacattccgcttctcccagg

SEQ ID NO: 9008073 - DNA, 22 bp, Homo sapiens
caaagagttttttcatataatg

SEQ ID NO: 9008074 - DNA, 22 bp, Homo sapiens
caaagcagacgcagtaagggta

SEQ ID NO: 9008075 - DNA, 22 bp, Homo sapiens
caaagcagagaactgtctcatt

SEQ ID NO: 9008076 - DNA, 22 bp, Homo sapiens
caaagcagagaactgtctcatt

SEQ ID NO: 9008077 - DNA, 22 bp, Homo sapiens
caaagcagagaactgtctcatt

SEQ ID NO: 9008078 - DNA, 22 bp, Homo sapiens
caaagcagagccagagcttgtc

SEQ ID NO: 9008079 - DNA, 22 bp, Homo sapiens
caaagcagcggattgggatagt

SEQ ID NO: 9008080 - DNA, 22 bp, Homo sapiens
caaagcagcctgcagtgtggac

SEQ ID NO: 9008081 - DNA, 22 bp, Homo sapiens
caaagcagcctgcagtgtggac

SEQ ID NO: 9008082 - DNA, 22 bp, Homo sapiens
caaagcaggaagctcctgacag

SEQ ID NO: 9008083 - DNA, 23 bp, Homo sapiens
attgaccagctgtctcattttca

SEQ ID NO: 9008084 - DNA, 22 bp, Homo sapiens
gcaggcggaggttgcagtgagc

SEQ ID NO: 9008085 - DNA, 22 bp, Homo sapiens
gcaggcggaggttgcagtgagc

SEQ ID NO: 9008086 - DNA, 22 bp, Homo sapiens
gcaggcctttatccctgcctca

SEQ ID NO: 9008087 - DNA, 22 bp, Homo sapiens
attgataaattgcaatggggct

SEQ ID NO: 9008088 - DNA, 22 bp, Homo sapiens
attgatatattatttctaactg

SEQ ID NO: 9008089 - DNA, 22 bp, Homo sapiens
attgagaaaataagtatggata

SEQ ID NO: 9008090 - DNA, 22 bp, Homo sapiens
attgactttcccttctcctcat

SEQ ID NO: 9008091 - DNA, 22 bp, Homo sapiens
attgatgtagtttcagatttca

SEQ ID NO: 9008092 - DNA, 22 bp, Homo sapiens
attgatggtgatagtgctgtgg

SEQ ID NO: 9008093 - DNA, 22 bp, Homo sapiens
attgatgggtgccaatggagtg

SEQ ID NO: 9008094 - DNA, 22 bp, Homo sapiens
attgatcatgcagatgcttcac

SEQ ID NO: 9008095 - DNA, 22 bp, Homo sapiens
attgatatcagtttgctgattg

SEQ ID NO: 9008096 - DNA, 22 bp, Homo sapiens
attgatatattatttctaactg

SEQ ID NO: 9008097 - DNA, 22 bp, Homo sapiens
attgatggaaaacaaatgatga

SEQ ID NO: 9008098 - DNA, 23 bp, Homo sapiens
attgatgacttgattacactttt

SEQ ID NO: 9008099 - DNA, 22 bp, Homo sapiens
gcaggcctggtttacatggtag

SEQ ID NO: 9008100 - DNA, 22 bp, Homo sapiens
gcaggcctgcccagcaggatgg

SEQ ID NO: 9008101 - DNA, 22 bp, Homo sapiens
gcaggcctgactgtagggggca

SEQ ID NO: 9008102 - DNA, 22 bp, Homo sapiens
gcaggcctgactgtagggggca

SEQ ID NO: 9008103 - DNA, 22 bp, Homo sapiens
gcaggcctgcaggtatggccgg

SEQ ID NO: 9008104 - DNA, 22 bp, Homo sapiens
gcaggcctgcccagcaggatgg

SEQ ID NO: 9008105 - DNA, 22 bp, Homo sapiens
gcaggccttggcaatgagcctg

SEQ ID NO: 9008106 - DNA, 22 bp, Homo sapiens
gcaggcctttatccctgcctca

SEQ ID NO: 9008107 - DNA, 22 bp, Homo sapiens
gcaggcctgtcttgctcgccct

SEQ ID NO: 9008108 - DNA, 22 bp, Homo sapiens
gcaggccttggcaatgagcctg

SEQ ID NO: 9008109 - DNA, 22 bp, Homo sapiens
gcaggcctgtaatgaagggaca

SEQ ID NO: 9008110 - DNA, 22 bp, Homo sapiens
gcaggcctgtaatgaagggaca

SEQ ID NO: 9008111 - DNA, 22 bp, Homo sapiens
gcaggcctggtttacatggtag

SEQ ID NO: 9008112 - DNA, 22 bp, Homo sapiens
gcaggcctgtcttgctcgccct

SEQ ID NO: 9008113 - DNA, 22 bp, Homo sapiens
gcagggctgagtcatgtgtgcc

SEQ ID NO: 9008114 - DNA, 22 bp, Homo sapiens
gcagggctgatggcttccctca

SEQ ID NO: 9008115 - DNA, 22 bp, Homo sapiens
gcagggctgagtcatgtgtgcc

SEQ ID NO: 9008116 - DNA, 22 bp, Homo sapiens
gcagggctgatggcttccctca

SEQ ID NO: 9008117 - DNA, 22 bp, Homo sapiens
gcagggctgatggcttccctca

SEQ ID NO: 9008118 - DNA, 22 bp, Homo sapiens
gcagggctgatgttattgacga

SEQ ID NO: 9008119 - DNA, 18 bp, Homo sapiens
gcagggctgcacacgcat

SEQ ID NO: 9008120 - DNA, 18 bp, Homo sapiens
gcagggctgcacacgcat

SEQ ID NO: 9008121 - DNA, 22 bp, Homo sapiens
gcagggctgcagagggcactgt

SEQ ID NO: 9008122 - DNA, 22 bp, Homo sapiens
gcagggctgcagagggcactgt

SEQ ID NO: 9008123 - DNA, 22 bp, Homo sapiens
gcagggctgcagagggcactgt

SEQ ID NO: 9008124 - DNA, 22 bp, Homo sapiens
gcagggctgatgttattgacga

SEQ ID NO: 9008125 - DNA, 22 bp, Homo sapiens
gcagggctgcagagggcactgt

SEQ ID NO: 9008126 - DNA, 18 bp, Homo sapiens
gcagggctggacaagtca

SEQ ID NO: 9008127 - DNA, 22 bp, Homo sapiens
gcagggctgggacttactggta

SEQ ID NO: 9008128 - DNA, 22 bp, Homo sapiens
gcagggctgctgaaacttgttt

SEQ ID NO: 9008129 - DNA, 22 bp, Homo sapiens
gcagggctgcagagggcactgt

SEQ ID NO: 9008130 - DNA, 22 bp, Homo sapiens
gcagggctgctgaaacttgttt

SEQ ID NO: 9008131 - DNA, 22 bp, Homo sapiens
attgatttgaacaaagatatta

SEQ ID NO: 9008132 - DNA, 22 bp, Homo sapiens
attgatttgaacaaagatatta

SEQ ID NO: 9008133 - DNA, 22 bp, Homo sapiens
attgatttaggcttgttatgac

SEQ ID NO: 9008134 - DNA, 22 bp, Homo sapiens
attgatttaggcttgttatgac

SEQ ID NO: 9008135 - DNA, 22 bp, Homo sapiens
attgatttagctcaagacacat

SEQ ID NO: 9008136 - DNA, 18 bp, Homo sapiens
attgattgggagaggatt

SEQ ID NO: 9008137 - DNA, 22 bp, Homo sapiens
attgatttgtagtgcctgcact

SEQ ID NO: 9008138 - DNA, 22 bp, Homo sapiens
attgcaaagaaatacatgctta

SEQ ID NO: 9008139 - DNA, 22 bp, Homo sapiens
attgcaaagaaatacatgctta

SEQ ID NO: 9008140 - DNA, 22 bp, Homo sapiens
attgcaaagaaatacatgctta

SEQ ID NO: 9008141 - DNA, 22 bp, Homo sapiens
gcagggctgactcagccaccct

SEQ ID NO: 9008142 - DNA, 22 bp, Homo sapiens
gcagggctgactcagccaccct

SEQ ID NO: 9008143 - DNA, 22 bp, Homo sapiens
gcagggctgactcagccaccct

SEQ ID NO: 9008144 - DNA, 22 bp, Homo sapiens
gcagctgcctattcagggcttg

SEQ ID NO: 9008145 - DNA, 22 bp, Homo sapiens
gcagcgagtgcggctgccacag

SEQ ID NO: 9008146 - DNA, 22 bp, Homo sapiens
gcagcgaggtgatgaaatagct

SEQ ID NO: 9008147 - DNA, 22 bp, Homo sapiens
gcagcgaggtgatgaaatagct

SEQ ID NO: 9008148 - DNA, 22 bp, Homo sapiens
gcagctgccttcagctggatgg

SEQ ID NO: 9008149 - DNA, 22 bp, Homo sapiens
gcagctgccttcagctggatgg

SEQ ID NO: 9008150 - DNA, 22 bp, Homo sapiens
gcagctgccttcagctggatgg

SEQ ID NO: 9008151 - DNA, 22 bp, Homo sapiens
gcagctgcctattcagggcttg

SEQ ID NO: 9008152 - DNA, 22 bp, Homo sapiens
gcagctgccttcagctggatgg

SEQ ID NO: 9008153 - DNA, 22 bp, Homo sapiens
gcagctgctcacattctcacaa

SEQ ID NO: 9008154 - DNA, 22 bp, Homo sapiens
gcagctgcgctggtgtggggca

SEQ ID NO: 9008155 - DNA, 22 bp, Homo sapiens
gcagctgctcacattctcacaa

SEQ ID NO: 9008156 - DNA, 22 bp, Homo sapiens
gcagctgctcacattctcacaa

SEQ ID NO: 9008157 - DNA, 22 bp, Homo sapiens
gcagctgctcccttttacagtg

SEQ ID NO: 9008158 - DNA, 22 bp, Homo sapiens
gcagctgcgaagaagtctatct

SEQ ID NO: 9008159 - DNA, 22 bp, Homo sapiens
gcagctgcgctggtgtggggca

SEQ ID NO: 9008160 - DNA, 22 bp, Homo sapiens
gcagctgcgctggtgtggggca

SEQ ID NO: 9008161 - DNA, 22 bp, Homo sapiens
gcagctgcgctggtgtggggca

SEQ ID NO: 9008162 - DNA, 22 bp, Homo sapiens
gcagctgctggaagttcctgcc

SEQ ID NO: 9008163 - DNA, 22 bp, Homo sapiens
gcagctgctggaagttcctgcc

SEQ ID NO: 9008164 - DNA, 22 bp, Homo sapiens
gcagctgctggaagttcctgcc

SEQ ID NO: 9008165 - DNA, 22 bp, Homo sapiens
gcagctgctggaagttcctgcc

SEQ ID NO: 9008166 - DNA, 22 bp, Homo sapiens
gcagctgctggagggaggcagg

SEQ ID NO: 9008167 - DNA, 22 bp, Homo sapiens
gcagctggaagtgacactctgt

SEQ ID NO: 9008168 - DNA, 22 bp, Homo sapiens
gcagctggaagtgacactctgt

SEQ ID NO: 9008169 - DNA, 19 bp, Homo sapiens
gcagctgcttgaaaagaaa

SEQ ID NO: 9008170 - DNA, 22 bp, Homo sapiens
gcagctgctggagggaggcagg

SEQ ID NO: 9008171 - DNA, 22 bp, Homo sapiens
gcagctgctggagggaggcagg

SEQ ID NO: 9008172 - DNA, 22 bp, Homo sapiens
gcagctgctgtggcatcaagct

SEQ ID NO: 9008173 - DNA, 22 bp, Homo sapiens
gcagctgctgtggcatcaagct

SEQ ID NO: 9008174 - DNA, 22 bp, Homo sapiens
gcagctgctgggatcatttagg

SEQ ID NO: 9008175 - DNA, 22 bp, Homo sapiens
gcagctgctgggatcatttagg

SEQ ID NO: 9008176 - DNA, 22 bp, Homo sapiens
attccttgctctcatcaacctt

SEQ ID NO: 9008177 - DNA, 22 bp, Homo sapiens
attccttgctctcatcaacctt

SEQ ID NO: 9008178 - DNA, 22 bp, Homo sapiens
attccttggaacagatgcgaag

SEQ ID NO: 9008179 - DNA, 22 bp, Homo sapiens
attccttgcacatcagatagtt

SEQ ID NO: 9008180 - DNA, 22 bp, Homo sapiens
attccttgcacatcagatagtt

SEQ ID NO: 9008181 - DNA, 22 bp, Homo sapiens
attccttgcacatcagatagtt

SEQ ID NO: 9008182 - DNA, 22 bp, Homo sapiens
gcagctggacccacacggctta

SEQ ID NO: 9008183 - DNA, 22 bp, Homo sapiens
gcagctggacccacacggctta

SEQ ID NO: 9008184 - DNA, 22 bp, Homo sapiens
gcagctggacccacacggctta

SEQ ID NO: 9008185 - DNA, 22 bp, Homo sapiens
attctttaattcaattgaagga

SEQ ID NO: 9008186 - DNA, 22 bp, Homo sapiens
attcttgtaaattttgtgtgaa

SEQ ID NO: 9008187 - DNA, 19 bp, Homo sapiens
attcttgttaagtgtcatc

SEQ ID NO: 9008188 - DNA, 22 bp, Homo sapiens
attcttgtttaatttgcatccc

SEQ ID NO: 9008189 - DNA, 19 bp, Homo sapiens
attcttgttaagtgtcatc

SEQ ID NO: 9008190 - DNA, 22 bp, Homo sapiens
attctttaattcaattgaagga

SEQ ID NO: 9008191 - DNA, 22 bp, Homo sapiens
attctttaattcaattgaagga

SEQ ID NO: 9008192 - DNA, 22 bp, Homo sapiens
attctttattgctgatggttat

SEQ ID NO: 9008193 - DNA, 22 bp, Homo sapiens
attctttcaaggaatagttatt

SEQ ID NO: 9008194 - DNA, 22 bp, Homo sapiens
attctttcatataaaggctcag

SEQ ID NO: 9008195 - DNA, 22 bp, Homo sapiens
attctttcaaggaatagttatt

SEQ ID NO: 9008196 - DNA, 22 bp, Homo sapiens
attctttcatataaaggctcag

SEQ ID NO: 9008197 - DNA, 22 bp, Homo sapiens
attctttagttggcttcttgcc

SEQ ID NO: 9008198 - DNA, 19 bp, Homo sapiens
attcttcagcagtgagacc

SEQ ID NO: 9008199 - DNA, 22 bp, Homo sapiens
attccttgtatatctacatgca

SEQ ID NO: 9008200 - DNA, 22 bp, Homo sapiens
attccttgtatatctacatgca

SEQ ID NO: 9008201 - DNA, 22 bp, Homo sapiens
attccttgggctgccttattat

SEQ ID NO: 9008202 - DNA, 22 bp, Homo sapiens
attccttgggctgccttattat

SEQ ID NO: 9008203 - DNA, 22 bp, Homo sapiens
attccttgtatatctacatgca

SEQ ID NO: 9008204 - DNA, 22 bp, Homo sapiens
attccttggcattctggacttg

SEQ ID NO: 9008205 - DNA, 22 bp, Homo sapiens
attccttggcattctggacttg

SEQ ID NO: 9008206 - DNA, 22 bp, Homo sapiens
attccttggaacagatgcgaag

SEQ ID NO: 9008207 - DNA, 22 bp, Homo sapiens
attccttggaacagatgcgaag

SEQ ID NO: 9008208 - DNA, 22 bp, Homo sapiens
attccttgctctcatcaacctt

SEQ ID NO: 9008209 - DNA, 22 bp, Homo sapiens
attccttgggaattattgaatg

SEQ ID NO: 9008210 - DNA, 22 bp, Homo sapiens
attccttgggaattattgaatg

SEQ ID NO: 9008211 - DNA, 22 bp, Homo sapiens
attcttgcttcacactcctctg

SEQ ID NO: 9008212 - DNA, 22 bp, Homo sapiens
attcttgcagtatacaactact

SEQ ID NO: 9008213 - DNA, 19 bp, Homo sapiens
attcttggtgcaccttgta

SEQ ID NO: 9008214 - DNA, 22 bp, Homo sapiens
attcttcttgagtcttggactc

SEQ ID NO: 9008215 - DNA, 22 bp, Homo sapiens
attcttcagtatgtgtggattg

SEQ ID NO: 9008216 - DNA, 19 bp, Homo sapiens
attcttcagcagtgagacc

SEQ ID NO: 9008217 - DNA, 20 bp, Homo sapiens
attgtgaatactgcatatgt

SEQ ID NO: 9008218 - DNA, 20 bp, Homo sapiens
attgtgaatactgcatatgt

SEQ ID NO: 9008219 - DNA, 22 bp, Homo sapiens
attgtgaataatgctgcaataa

SEQ ID NO: 9008220 - DNA, 22 bp, Homo sapiens
attgtctttgtttaagggatac

SEQ ID NO: 9008221 - DNA, 22 bp, Homo sapiens
attgtctttggtgcttccagga

SEQ ID NO: 9008222 - DNA, 22 bp, Homo sapiens
attgtctttaaaaatatacaac

SEQ ID NO: 9008223 - DNA, 22 bp, Homo sapiens
attgtctttaaaaatatacaac

SEQ ID NO: 9008224 - DNA, 22 bp, Homo sapiens
attgtctttaaaaatatacaac

SEQ ID NO: 9008225 - DNA, 22 bp, Homo sapiens
attgtctttaacctctgagggg

SEQ ID NO: 9008226 - DNA, 22 bp, Homo sapiens
attgtctttccactgagaagtt

SEQ ID NO: 9008227 - DNA, 22 bp, Homo sapiens
attgtctttccactgagaagtt

SEQ ID NO: 9008228 - DNA, 22 bp, Homo sapiens
attgtctttccactgagaagtt

SEQ ID NO: 9008229 - DNA, 22 bp, Homo sapiens
attgtcttaaacaaatgtgttt

SEQ ID NO: 9008230 - DNA, 22 bp, Homo sapiens
attgtcttctggtcttatcttt

SEQ ID NO: 9008231 - DNA, 22 bp, Homo sapiens
attgtctgtactttaaaaatgt

SEQ ID NO: 9008232 - DNA, 22 bp, Homo sapiens
attgtcttctgtcttatagttc

SEQ ID NO: 9008233 - DNA, 22 bp, Homo sapiens
attgtcttggaaccaaggtctt

SEQ ID NO: 9008234 - DNA, 22 bp, Homo sapiens
attgtcttggcattcaaattag

SEQ ID NO: 9008235 - DNA, 22 bp, Homo sapiens
attgtcttggcattcaaattag

SEQ ID NO: 9008236 - DNA, 22 bp, Homo sapiens
gcattctgtgctacagccattc

SEQ ID NO: 9008237 - DNA, 22 bp, Homo sapiens
gcattctctctctaaatgttgt

SEQ ID NO: 9008238 - DNA, 22 bp, Homo sapiens
gcattctatagtctacattaca

SEQ ID NO: 9008239 - DNA, 22 bp, Homo sapiens
gccaaagcagtcttgcctctgc

SEQ ID NO: 9008240 - DNA, 22 bp, Homo sapiens
gccaaagagctgagtacatgta

SEQ ID NO: 9008241 - DNA, 22 bp, Homo sapiens
gccaaactacaagttaaatttt

SEQ ID NO: 9008242 - DNA, 22 bp, Homo sapiens
gcattctgtgctacagccattc

SEQ ID NO: 9008243 - DNA, 22 bp, Homo sapiens
attgtgcaatgttttacaattt

SEQ ID NO: 9008244 - DNA, 22 bp, Homo sapiens
gcattcctttataggaaaatgg

SEQ ID NO: 9008245 - DNA, 22 bp, Homo sapiens
gcattcctttataggaaaatgg

SEQ ID NO: 9008246 - DNA, 22 bp, Homo sapiens
attgtgactcctgatatagaaa

SEQ ID NO: 9008247 - DNA, 22 bp, Homo sapiens
attgtgacaaatgtgccatact

SEQ ID NO: 9008248 - DNA, 22 bp, Homo sapiens
attgtgaattgagagtacttct

SEQ ID NO: 9008249 - DNA, 22 bp, Homo sapiens
attgtgactttgagctgaaagc

SEQ ID NO: 9008250 - DNA, 22 bp, Homo sapiens
attgtgaatagtgccgcagtaa

SEQ ID NO: 9008251 - DNA, 22 bp, Homo sapiens
attgtgaatagtgccgcagtaa

SEQ ID NO: 9008252 - DNA, 22 bp, Homo sapiens
attgtgaatagtgccgcagtaa

SEQ ID NO: 9008253 - DNA, 22 bp, Homo sapiens
attgtgaatagtgccgcagtaa

SEQ ID NO: 9008254 - DNA, 22 bp, Homo sapiens
attgtgaatagtgccgcagtaa

SEQ ID NO: 9008255 - DNA, 22 bp, Homo sapiens
attgtgaattgagagtacttct

SEQ ID NO: 9008256 - DNA, 22 bp, Homo sapiens
attgtgaatagtgctgcaataa

SEQ ID NO: 9008257 - DNA, 22 bp, Homo sapiens
attgtgaattgagagtacttct

SEQ ID NO: 9008258 - DNA, 21 bp, Homo sapiens
gccaagaacaagacagacatg

SEQ ID NO: 9008259 - DNA, 21 bp, Homo sapiens
gccaagaacaagacagacatg

SEQ ID NO: 9008260 - DNA, 21 bp, Homo sapiens
gccaagaacaagacagacatg

SEQ ID NO: 9008261 - DNA, 22 bp, Homo sapiens
gccaagaaggtggggacatgca

SEQ ID NO: 9008262 - DNA, 22 bp, Homo sapiens
gccaagagtttccagctgcaag

SEQ ID NO: 9008263 - DNA, 22 bp, Homo sapiens
gccaagagtttccagctgcaag

SEQ ID NO: 9008264 - DNA, 22 bp, Homo sapiens
gccaagcctgggaagagcccat

SEQ ID NO: 9008265 - DNA, 22 bp, Homo sapiens
gccaagcctgggaagagcccat

SEQ ID NO: 9008266 - DNA, 22 bp, Homo sapiens
gccaagcactgaggacattgtt

SEQ ID NO: 9008267 - DNA, 22 bp, Homo sapiens
gccaagcactgaggacattgtt

SEQ ID NO: 9008268 - DNA, 22 bp, Homo sapiens
gccaagagtttccagctgcaag

SEQ ID NO: 9008269 - DNA, 22 bp, Homo sapiens
gccaagagtttccagctgcaag

SEQ ID NO: 9008270 - DNA, 22 bp, Homo sapiens
gccacagggcgagcggaggcca

SEQ ID NO: 9008271 - DNA, 22 bp, Homo sapiens
gccacagggcgagcggaggcca

SEQ ID NO: 9008272 - DNA, 22 bp, Homo sapiens
gccacagggcgagcggaggcca

SEQ ID NO: 9008273 - DNA, 22 bp, Homo sapiens
gccacagggcagatgcgcagag

SEQ ID NO: 9008274 - DNA, 22 bp, Homo sapiens
gccacagggcgagcggaggcca

SEQ ID NO: 9008275 - DNA, 22 bp, Homo sapiens
gccacagggcagatgcgcagag

SEQ ID NO: 9008276 - DNA, 22 bp, Homo sapiens
gccacagggcagatgcgcagag

SEQ ID NO: 9008277 - DNA, 22 bp, Homo sapiens
gccacagggcagatgcgcagag

SEQ ID NO: 9008278 - DNA, 22 bp, Homo sapiens
gccacagggcagatgcgcagag

SEQ ID NO: 9008279 - DNA, 22 bp, Homo sapiens
gccacagggcagatgcgcagag

SEQ ID NO: 9008280 - DNA, 22 bp, Homo sapiens
gccacagggattgttttgtgag

SEQ ID NO: 9008281 - DNA, 22 bp, Homo sapiens
gccacagggaggcgttttcagg

SEQ ID NO: 9008282 - DNA, 22 bp, Homo sapiens
gccacagggaggcgttttcagg

SEQ ID NO: 9008283 - DNA, 22 bp, Homo sapiens
gccacagggcagatgcgcagag

SEQ ID NO: 9008284 - DNA, 22 bp, Homo sapiens
gccaagcctgggaagagcccat

SEQ ID NO: 9008285 - DNA, 22 bp, Homo sapiens
gccacagggattgttttgtgag

SEQ ID NO: 9008286 - DNA, 20 bp, Homo sapiens
gccaacgcgctggggctgcc

SEQ ID NO: 9008287 - DNA, 22 bp, Homo sapiens
gccaactggctgatctcaaagc

SEQ ID NO: 9008288 - DNA, 22 bp, Homo sapiens
gccaacaggccttgctctgctc

SEQ ID NO: 9008289 - DNA, 22 bp, Homo sapiens
gccaacagctgggtgcatgtcc

SEQ ID NO: 9008290 - DNA, 22 bp, Homo sapiens
gccaaatactggaatcatagaa

SEQ ID NO: 9008291 - DNA, 22 bp, Homo sapiens
gccaaataccattaaccagaaa

SEQ ID NO: 9008292 - DNA, 22 bp, Homo sapiens
gccaaatactggaatcatagaa

SEQ ID NO: 9008293 - DNA, 22 bp, Homo sapiens
gccaaatataattctccacctt

SEQ ID NO: 9008294 - DNA, 22 bp, Homo sapiens
gccaaatatggtggacagtttg

SEQ ID NO: 9008295 - DNA, 22 bp, Homo sapiens
gccaaatatggtggacagtttg

SEQ ID NO: 9008296 - DNA, 22 bp, Homo sapiens
gccaaatcacagggccaaaagc

SEQ ID NO: 9008297 - DNA, 22 bp, Homo sapiens
gccaaatctggatttagcaaga

SEQ ID NO: 9008298 - DNA, 22 bp, Homo sapiens
gccaaataccattaaccagaaa

SEQ ID NO: 9008299 - DNA, 22 bp, Homo sapiens
gccaaatacagtagtcattgcc

SEQ ID NO: 9008300 - DNA, 22 bp, Homo sapiens
gccaaatacagtagtcattgcc

SEQ ID NO: 9008301 - DNA, 22 bp, Homo sapiens
gccaaataagtggaatcacaca

SEQ ID NO: 9008302 - DNA, 22 bp, Homo sapiens
gccaaataagtgtccggccctc

SEQ ID NO: 9008303 - DNA, 22 bp, Homo sapiens
gccaaataagtggaatcacaca

SEQ ID NO: 9008304 - DNA, 22 bp, Homo sapiens
gccaaagtcctccagccatgca

SEQ ID NO: 9008305 - DNA, 22 bp, Homo sapiens
gccaaagtgctgctctttacca

SEQ ID NO: 9008306 - DNA, 22 bp, Homo sapiens
gccaaagtccacttgctttctg

SEQ ID NO: 9008307 - DNA, 22 bp, Homo sapiens
gccaaaggttggcctgtgagtt

SEQ ID NO: 9008308 - DNA, 22 bp, Homo sapiens
gccaaagtacctagccctctgc

SEQ ID NO: 9008309 - DNA, 22 bp, Homo sapiens
gccaaagtacctagccctctgc

SEQ ID NO: 9008310 - DNA, 17 bp, Homo sapiens
gccaaagggttccaatc

SEQ ID NO: 9008311 - DNA, 22 bp, Homo sapiens
gccaaaggattctatggagata

SEQ ID NO: 9008312 - DNA, 22 bp, Homo sapiens
gccaaaggattctatggagata

SEQ ID NO: 9008313 - DNA, 22 bp, Homo sapiens
gccaaaggattctatggagata

SEQ ID NO: 9008314 - DNA, 22 bp, Homo sapiens
gccaaaggacctgtgggtgaca

SEQ ID NO: 9008315 - DNA, 22 bp, Homo sapiens
gcatacagagaggatgtggcat

SEQ ID NO: 9008316 - DNA, 22 bp, Homo sapiens
gcatacaaaggtttacaactga

SEQ ID NO: 9008317 - DNA, 22 bp, Homo sapiens
gcatacaaaggtttacaactga

SEQ ID NO: 9008318 - DNA, 22 bp, Homo sapiens
gcatacaaaggtttacaactga

SEQ ID NO: 9008319 - DNA, 22 bp, Homo sapiens
gcagtgttacttggagtactaa

SEQ ID NO: 9008320 - DNA, 18 bp, Homo sapiens
gcatacagaggggaagta

SEQ ID NO: 9008321 - DNA, 22 bp, Homo sapiens
gcatacagtccttgtattcttc

SEQ ID NO: 9008322 - DNA, 22 bp, Homo sapiens
gcatacatgaaaaggtactgac

SEQ ID NO: 9008323 - DNA, 22 bp, Homo sapiens
gcatacatacaatagctgccac

SEQ ID NO: 9008324 - DNA, 22 bp, Homo sapiens
gcatacatgggtgcagggacat

SEQ ID NO: 9008325 - DNA, 22 bp, Homo sapiens
gcatacattgcaccctggtagt

SEQ ID NO: 9008326 - DNA, 22 bp, Homo sapiens
gcagtgttaaacaactgctgct

SEQ ID NO: 9008327 - DNA, 22 bp, Homo sapiens
gcagtgttacctcttcagtggg

SEQ ID NO: 9008328 - DNA, 22 bp, Homo sapiens
gcagtgttaatgcgagtgttca

SEQ ID NO: 9008329 - DNA, 22 bp, Homo sapiens
gcagtgttaccttgggctggtt

SEQ ID NO: 9008330 - DNA, 22 bp, Homo sapiens
gcagtgtgtggtgagggctgcc

SEQ ID NO: 9008331 - DNA, 22 bp, Homo sapiens
gcagtgtgtggtgagggctgcc

SEQ ID NO: 9008332 - DNA, 21 bp, Homo sapiens
gcagtgcttcgagactgtggt

SEQ ID NO: 9008333 - DNA, 22 bp, Homo sapiens
gcagtgcttgaagaggtggcca

SEQ ID NO: 9008334 - DNA, 22 bp, Homo sapiens
gcagtgcttgaagaggtggcca

SEQ ID NO: 9008335 - DNA, 22 bp, Homo sapiens
gcagtgtgaccgagcttgcttc

SEQ ID NO: 9008336 - DNA, 23 bp, Homo sapiens
gcagtgtgaatccagtgtttcag

SEQ ID NO: 9008337 - DNA, 22 bp, Homo sapiens
gcagtgtgacgctgttctccgt

SEQ ID NO: 9008338 - DNA, 22 bp, Homo sapiens
gcagtgtgtctcttggcttcct

SEQ ID NO: 9008339 - DNA, 22 bp, Homo sapiens
gcagtgtgtggtgagggctgcc

SEQ ID NO: 9008340 - DNA, 22 bp, Homo sapiens
gcagtgtgtggtgagggctgcc

SEQ ID NO: 9008341 - DNA, 22 bp, Homo sapiens
gcagtgtgtggtgagggctgcc

SEQ ID NO: 9008342 - DNA, 22 bp, Homo sapiens
gcagtgtgcatggcttttggcc

SEQ ID NO: 9008343 - DNA, 22 bp, Homo sapiens
gcagtgtggcgtggggacctaa

SEQ ID NO: 9008344 - DNA, 22 bp, Homo sapiens
attgtcgtcaatggacacatag

SEQ ID NO: 9008345 - DNA, 17 bp, Homo sapiens
attgtctcttcacttat

SEQ ID NO: 9008346 - DNA, 17 bp, Homo sapiens
attgtctcttcacttat

SEQ ID NO: 9008347 - DNA, 22 bp, Homo sapiens
attgtccatctccacattaatg

SEQ ID NO: 9008348 - DNA, 22 bp, Homo sapiens
attgtccatctccacattaatg

SEQ ID NO: 9008349 - DNA, 22 bp, Homo sapiens
attgtcctgtgtaattcaatgg

SEQ ID NO: 9008350 - DNA, 22 bp, Homo sapiens
attgtcgtcaatggacacatag

SEQ ID NO: 9008351 - DNA, 22 bp, Homo sapiens
attgtcgtcaatggacacatag

SEQ ID NO: 9008352 - DNA, 22 bp, Homo sapiens
attgtcattggcttctatgtct

SEQ ID NO: 9008353 - DNA, 22 bp, Homo sapiens
attgtcctatctcagtgccatg

SEQ ID NO: 9008354 - DNA, 22 bp, Homo sapiens
attgtcattggcttctatgtct

SEQ ID NO: 9008355 - DNA, 22 bp, Homo sapiens
attgtcattccagtcattgtta

SEQ ID NO: 9008356 - DNA, 22 bp, Homo sapiens
attgtcattccagtcattgtta

SEQ ID NO: 9008357 - DNA, 22 bp, Homo sapiens
attgtcattccagtcattgtta

SEQ ID NO: 9008358 - DNA, 22 bp, Homo sapiens
attgtatttgtacaagacatgt

SEQ ID NO: 9008359 - DNA, 22 bp, Homo sapiens
attgtatttgtacaagacatgt

SEQ ID NO: 9008360 - DNA, 22 bp, Homo sapiens
attgtcacttaaaagtgcatgt

SEQ ID NO: 9008361 - DNA, 18 bp, Homo sapiens
attgtcagaagtcatgtg

SEQ ID NO: 9008362 - DNA, 22 bp, Homo sapiens
attgtcacttaaaagtgcatgt

SEQ ID NO: 9008363 - DNA, 22 bp, Homo sapiens
attgtcagtgggatttgtcaac

SEQ ID NO: 9008364 - DNA, 22 bp, Homo sapiens
attgtcatcgatgttagccagt

SEQ ID NO: 9008365 - DNA, 22 bp, Homo sapiens
attgtcagctcgaaatgcatca

SEQ ID NO: 9008366 - DNA, 22 bp, Homo sapiens
attgtcagctcgaaatgcatca

SEQ ID NO: 9008367 - DNA, 22 bp, Homo sapiens
attgtcagagtttgagaaagta

SEQ ID NO: 9008368 - DNA, 22 bp, Homo sapiens
gcatcaagacgatgtgaaatcg

SEQ ID NO: 9008369 - DNA, 22 bp, Homo sapiens
gcatcaagacgatgtgaaatcg

SEQ ID NO: 9008370 - DNA, 17 bp, Homo sapiens
gcatcacagataacacg

SEQ ID NO: 9008371 - DNA, 17 bp, Homo sapiens
gcatcacagataacacg

SEQ ID NO: 9008372 - DNA, 20 bp, Homo sapiens
gcatcaaggtacgctctcca

SEQ ID NO: 9008373 - DNA, 22 bp, Homo sapiens
gcatattttcacaagctcttgg

SEQ ID NO: 9008374 - DNA, 22 bp, Homo sapiens
gcatcaagacgatgtgaaatcg

SEQ ID NO: 9008375 - DNA, 22 bp, Homo sapiens
gcatattttcacaagctcttgg

SEQ ID NO: 9008376 - DNA, 22 bp, Homo sapiens
attgtagcccatgcataaaccg

SEQ ID NO: 9008377 - DNA, 22 bp, Homo sapiens
attgtataacagcatgtatttt

SEQ ID NO: 9008378 - DNA, 22 bp, Homo sapiens
attgtagcaatttctcttaatt

SEQ ID NO: 9008379 - DNA, 22 bp, Homo sapiens
attgtacttttattacatgtag

SEQ ID NO: 9008380 - DNA, 22 bp, Homo sapiens
attgtacttttattacatgtag

SEQ ID NO: 9008381 - DNA, 22 bp, Homo sapiens
attgtacttttattacatgtag

SEQ ID NO: 9008382 - DNA, 22 bp, Homo sapiens
gcatagaatttagagacaaaag

SEQ ID NO: 9008383 - DNA, 22 bp, Homo sapiens
gcatagaatttagagacaaaag

SEQ ID NO: 9008384 - DNA, 22 bp, Homo sapiens
gcatagctttgatgctgcctta

SEQ ID NO: 9008385 - DNA, 22 bp, Homo sapiens
gcatatgatcacgtgtgtcggt

SEQ ID NO: 9008386 - DNA, 22 bp, Homo sapiens
gcatattttcacaagctcttgg

SEQ ID NO: 9008387 - DNA, 22 bp, Homo sapiens
gcatatgatcacgtgtgtcggt

SEQ ID NO: 9008388 - DNA, 22 bp, Homo sapiens
gcatatgatcacgtgtgtcggt

SEQ ID NO: 9008389 - DNA, 20 bp, Homo sapiens
attcagaataggcatgtaaa

SEQ ID NO: 9008390 - DNA, 22 bp, Homo sapiens
attcagaagcaatcacagtgag

SEQ ID NO: 9008391 - DNA, 22 bp, Homo sapiens
attcagaagcaatcacagtgag

SEQ ID NO: 9008392 - DNA, 22 bp, Homo sapiens
attcagaatggcaaacttctag

SEQ ID NO: 9008393 - DNA, 22 bp, Homo sapiens
attcagaatggcaaacttctag

SEQ ID NO: 9008394 - DNA, 20 bp, Homo sapiens
attcagaataggcatgtaaa

SEQ ID NO: 9008395 - DNA, 23 bp, Homo sapiens
attcagaattgtgtgtttgtata

SEQ ID NO: 9008396 - DNA, 22 bp, Homo sapiens
attcagaattgtgggcagtaca

SEQ ID NO: 9008397 - DNA, 23 bp, Homo sapiens
attcagaattgtgtgtttgtata

SEQ ID NO: 9008398 - DNA, 22 bp, Homo sapiens
attcagaattttggggagctaa

SEQ ID NO: 9008399 - DNA, 22 bp, Homo sapiens
attcagaattttggggagctaa

SEQ ID NO: 9008400 - DNA, 22 bp, Homo sapiens
attcagactatgaacacgtcag

SEQ ID NO: 9008401 - DNA, 22 bp, Homo sapiens
gcagatggaaagtgcttgaggg

SEQ ID NO: 9008402 - DNA, 22 bp, Homo sapiens
attcagactcttgagcagtccc

SEQ ID NO: 9008403 - DNA, 21 bp, Homo sapiens
gcagcagaggcttgacagaca

SEQ ID NO: 9008404 - DNA, 21 bp, Homo sapiens
gcagcagaggcttgacagaca

SEQ ID NO: 9008405 - DNA, 21 bp, Homo sapiens
gcagcagaggcttgacagaca

SEQ ID NO: 9008406 - DNA, 22 bp, Homo sapiens
gcagcagagtagacagagccct

SEQ ID NO: 9008407 - DNA, 22 bp, Homo sapiens
gcagcagagctttgtcctggct

SEQ ID NO: 9008408 - DNA, 22 bp, Homo sapiens
gcagcagaggccctactctttg

SEQ ID NO: 9008409 - DNA, 22 bp, Homo sapiens
gcagcagaggccctactctttg

SEQ ID NO: 9008410 - DNA, 20 bp, Homo sapiens
gcagcagacagacaggggac

SEQ ID NO: 9008411 - DNA, 20 bp, Homo sapiens
gcagcagacagacaggggac

SEQ ID NO: 9008412 - DNA, 22 bp, Homo sapiens
gcagcagagaacacaatgatgg

SEQ ID NO: 9008413 - DNA, 22 bp, Homo sapiens
gcagcagagaccccaggaagga

SEQ ID NO: 9008414 - DNA, 22 bp, Homo sapiens
gcagcagagaccccaggaagga

SEQ ID NO: 9008415 - DNA, 22 bp, Homo sapiens
gcagcagagaccccaggaagga

SEQ ID NO: 9008416 - DNA, 22 bp, Homo sapiens
attcagttgtctactactgcct

SEQ ID NO: 9008417 - DNA, 22 bp, Homo sapiens
attcagttgtaatctttgttag

SEQ ID NO: 9008418 - DNA, 22 bp, Homo sapiens
attcagttgtaatctttgttag

SEQ ID NO: 9008419 - DNA, 22 bp, Homo sapiens
attcagttgtctactactgcct

SEQ ID NO: 9008420 - DNA, 23 bp, Homo sapiens
attcagttgtgagagaagacaca

SEQ ID NO: 9008421 - DNA, 22 bp, Homo sapiens
attcagtttcaatcattgtagt

SEQ ID NO: 9008422 - DNA, 22 bp, Homo sapiens
attcagtttcaatcattgtagt

SEQ ID NO: 9008423 - DNA, 22 bp, Homo sapiens
gcagcagatgctttcatggaca

SEQ ID NO: 9008424 - DNA, 22 bp, Homo sapiens
attcagttccttgtgattgtag

SEQ ID NO: 9008425 - DNA, 22 bp, Homo sapiens
attcagttctaaggtcagtgcc

SEQ ID NO: 9008426 - DNA, 22 bp, Homo sapiens
attcagttctggctgccttcct

SEQ ID NO: 9008427 - DNA, 22 bp, Homo sapiens
attcagttctggctgccttcct

SEQ ID NO: 9008428 - DNA, 22 bp, Homo sapiens
attcagttctgctggttctgct

SEQ ID NO: 9008429 - DNA, 22 bp, Homo sapiens
gcagcagagtagacagagccct

SEQ ID NO: 9008430 - DNA, 22 bp, Homo sapiens
gcagcagagtagacagagccct

SEQ ID NO: 9008431 - DNA, 22 bp, Homo sapiens
gcagcagagtttgggagatggt

SEQ ID NO: 9008432 - DNA, 22 bp, Homo sapiens
gcagcagagtagacagagccct

SEQ ID NO: 9008433 - DNA, 22 bp, Homo sapiens
gcagcagatgctttcatggaca

SEQ ID NO: 9008434 - DNA, 22 bp, Homo sapiens
gcagcagagtttgggagatggt

SEQ ID NO: 9008435 - DNA, 22 bp, Homo sapiens
gcagcagagtttgggagatggt

SEQ ID NO: 9008436 - DNA, 22 bp, Homo sapiens
attcagtttttattggaccagc

SEQ ID NO: 9008437 - DNA, 21 bp, Homo sapiens
attcagtttgacatctagcag

SEQ ID NO: 9008438 - DNA, 21 bp, Homo sapiens
attcagtttgacatctagcag

SEQ ID NO: 9008439 - DNA, 21 bp, Homo sapiens
attcagtttgacatctagcag

SEQ ID NO: 9008440 - DNA, 22 bp, Homo sapiens
attcagtttcatggcacagcta

SEQ ID NO: 9008441 - DNA, 22 bp, Homo sapiens
attcagtttcatggcacagcta

SEQ ID NO: 9008442 - DNA, 22 bp, Homo sapiens
attcagtttcaatcattgtagt

SEQ ID NO: 9008443 - DNA, 22 bp, Homo sapiens
attcataacggcaaatgtcacc

SEQ ID NO: 9008444 - DNA, 22 bp, Homo sapiens
attcataacggcaaatgtcacc

SEQ ID NO: 9008445 - DNA, 22 bp, Homo sapiens
attcagtttttgaagggaaatt

SEQ ID NO: 9008446 - DNA, 22 bp, Homo sapiens
attcataacggcaaatgtcacc

SEQ ID NO: 9008447 - DNA, 22 bp, Homo sapiens
attcagtttttattggaccagc

SEQ ID NO: 9008448 - DNA, 22 bp, Homo sapiens
attcatctatgactctaatgtg

SEQ ID NO: 9008449 - DNA, 22 bp, Homo sapiens
attcatccttaccagtccccgg

SEQ ID NO: 9008450 - DNA, 22 bp, Homo sapiens
attcatcagctaatggacattt

SEQ ID NO: 9008451 - DNA, 22 bp, Homo sapiens
attcatcagctaatggacattt

SEQ ID NO: 9008452 - DNA, 22 bp, Homo sapiens
attcatctgtacttcaatatct

SEQ ID NO: 9008453 - DNA, 22 bp, Homo sapiens
attcatctctgcatatagagtc

SEQ ID NO: 9008454 - DNA, 22 bp, Homo sapiens
attcatctgtacttcaatatct

SEQ ID NO: 9008455 - DNA, 22 bp, Homo sapiens
attcatctctgcatatagagtc

SEQ ID NO: 9008456 - DNA, 22 bp, Homo sapiens
attcatatcatagagttattga

SEQ ID NO: 9008457 - DNA, 22 bp, Homo sapiens
attcatatcatagagttattga

SEQ ID NO: 9008458 - DNA, 22 bp, Homo sapiens
attcatatcatagagttattga

SEQ ID NO: 9008459 - DNA, 22 bp, Homo sapiens
attcatagctcagtacagactc

SEQ ID NO: 9008460 - DNA, 22 bp, Homo sapiens
attcataagtaaatgattacct

SEQ ID NO: 9008461 - DNA, 22 bp, Homo sapiens
attcataagtaaatgattacct

SEQ ID NO: 9008462 - DNA, 22 bp, Homo sapiens
attcataacggcaaatgtcacc

SEQ ID NO: 9008463 - DNA, 22 bp, Homo sapiens
gcactagaagtacgccttgtaa

SEQ ID NO: 9008464 - DNA, 22 bp, Homo sapiens
gcactaaaccaacatgtaataa

SEQ ID NO: 9008465 - DNA, 22 bp, Homo sapiens
gcacgtgcacacatgtgtacaa

SEQ ID NO: 9008466 - DNA, 22 bp, Homo sapiens
gcactagaatcccttcaagaag

SEQ ID NO: 9008467 - DNA, 22 bp, Homo sapiens
gcactagagcagctctcagaga

SEQ ID NO: 9008468 - DNA, 22 bp, Homo sapiens
gcactaggtaagtgggtggcaa

SEQ ID NO: 9008469 - DNA, 22 bp, Homo sapiens
gcactagatactgttcaggaaa

SEQ ID NO: 9008470 - DNA, 22 bp, Homo sapiens
gcactagagcagctctcagaga

SEQ ID NO: 9008471 - DNA, 22 bp, Homo sapiens
gcacgtggaatgctcatgagcc

SEQ ID NO: 9008472 - DNA, 22 bp, Homo sapiens
gcactaaaccaacatgtaataa

SEQ ID NO: 9008473 - DNA, 22 bp, Homo sapiens
gcacgtgcacacatgtgtacaa

SEQ ID NO: 9008474 - DNA, 22 bp, Homo sapiens
gcacggctaatttttgtatttt

SEQ ID NO: 9008475 - DNA, 22 bp, Homo sapiens
gcacctttctatattcagtggc

SEQ ID NO: 9008476 - DNA, 22 bp, Homo sapiens
gcacggctaatttttgtatttt

SEQ ID NO: 9008477 - DNA, 22 bp, Homo sapiens
gcacggctaatttttgtatttt

SEQ ID NO: 9008478 - DNA, 22 bp, Homo sapiens
attcacaatagcagcttgcatg

SEQ ID NO: 9008479 - DNA, 22 bp, Homo sapiens
attcacaatagcagcttgcatg

SEQ ID NO: 9008480 - DNA, 22 bp, Homo sapiens
attcacaatgatacataagcga

SEQ ID NO: 9008481 - DNA, 22 bp, Homo sapiens
attcacaatgatacataagcga

SEQ ID NO: 9008482 - DNA, 22 bp, Homo sapiens
attcacagtttcctcatattct

SEQ ID NO: 9008483 - DNA, 22 bp, Homo sapiens
attcacaatgatacataagcga

SEQ ID NO: 9008484 - DNA, 22 bp, Homo sapiens
attcacagtttcctcatattct

SEQ ID NO: 9008485 - DNA, 19 bp, Homo sapiens
attcacatccctgggaagg

SEQ ID NO: 9008486 - DNA, 19 bp, Homo sapiens
attcacatccctgggaagg

SEQ ID NO: 9008487 - DNA, 20 bp, Homo sapiens
attcacatataccagggagg

SEQ ID NO: 9008488 - DNA, 20 bp, Homo sapiens
attcacatataccagggagg

SEQ ID NO: 9008489 - DNA, 22 bp, Homo sapiens
attcacatgatgtatgtagggc

SEQ ID NO: 9008490 - DNA, 22 bp, Homo sapiens
attcacatgatgtatgtagggc

SEQ ID NO: 9008491 - DNA, 22 bp, Homo sapiens
attcacatgatgtatgtagggc

SEQ ID NO: 9008492 - DNA, 22 bp, Homo sapiens
attcaagattaattctatgtca

SEQ ID NO: 9008493 - DNA, 22 bp, Homo sapiens
attcaaggtatttaaaacataa

SEQ ID NO: 9008494 - DNA, 22 bp, Homo sapiens
attcaaggtatttaaaacataa

SEQ ID NO: 9008495 - DNA, 22 bp, Homo sapiens
attcaagtacagttttcttctt

SEQ ID NO: 9008496 - DNA, 22 bp, Homo sapiens
attcaagtaaacactgaaggaa

SEQ ID NO: 9008497 - DNA, 22 bp, Homo sapiens
gcacctggggtacacagctaca

SEQ ID NO: 9008498 - DNA, 22 bp, Homo sapiens
gcacctggggtacacagctaca

SEQ ID NO: 9008499 - DNA, 22 bp, Homo sapiens
attcaaggttggctcaggaatt

SEQ ID NO: 9008500 - DNA, 22 bp, Homo sapiens
attcaaggtttattcagtttag

SEQ ID NO: 9008501 - DNA, 22 bp, Homo sapiens
gcacctttctatattcagtggc

SEQ ID NO: 9008502 - DNA, 22 bp, Homo sapiens
gcacgaggcaccgctgttttgt

SEQ ID NO: 9008503 - DNA, 22 bp, Homo sapiens
gcacggctaatttttgtatttt

SEQ ID NO: 9008504 - DNA, 19 bp, Homo sapiens
gcacgctggcttgataggg

SEQ ID NO: 9008505 - DNA, 22 bp, Homo sapiens
gcacggcaagacggggcctcct

SEQ ID NO: 9008506 - DNA, 18 bp, Homo sapiens
gcaccttaccaattctac

SEQ ID NO: 9008507 - DNA, 22 bp, Homo sapiens
gcacctttctatattcagtggc

SEQ ID NO: 9008508 - DNA, 22 bp, Homo sapiens
gcacctggtttatataatcata

SEQ ID NO: 9008509 - DNA, 22 bp, Homo sapiens
gcacctggggtacacagctaca

SEQ ID NO: 9008510 - DNA, 22 bp, Homo sapiens
gcacctggtttatataatcata

SEQ ID NO: 9008511 - DNA, 22 bp, Homo sapiens
attcacatttagacatcaggta

SEQ ID NO: 9008512 - DNA, 22 bp, Homo sapiens
attcacatttagacatcaggta

SEQ ID NO: 9008513 - DNA, 22 bp, Homo sapiens
attcacatttagacatcaggta

SEQ ID NO: 9008514 - DNA, 22 bp, Homo sapiens
attcacatttacaaagcactca

SEQ ID NO: 9008515 - DNA, 22 bp, Homo sapiens
attcacatttacaaagcactca

SEQ ID NO: 9008516 - DNA, 22 bp, Homo sapiens
attcacatttacaaagcactca

SEQ ID NO: 9008517 - DNA, 15 bp, Homo sapiens
attcacattgcttca

SEQ ID NO: 9008518 - DNA, 15 bp, Homo sapiens
attcacattgcttca

SEQ ID NO: 9008519 - DNA, 15 bp, Homo sapiens
attcacattgcttca

SEQ ID NO: 9008520 - DNA, 22 bp, Homo sapiens
attcacattttatttcactgga

SEQ ID NO: 9008521 - DNA, 22 bp, Homo sapiens
attcacattttatttcactgga

SEQ ID NO: 9008522 - DNA, 22 bp, Homo sapiens
attcacattttatttcactgga

SEQ ID NO: 9008523 - DNA, 22 bp, Homo sapiens
attcacattttatttcactgga

SEQ ID NO: 9008524 - DNA, 22 bp, Homo sapiens
attcaccaagaatgatttcagt

SEQ ID NO: 9008525 - DNA, 22 bp, Homo sapiens
attcaccaagaatgatttcagt

SEQ ID NO: 9008526 - DNA, 22 bp, Homo sapiens
attcacccacgtcttagtctgt

SEQ ID NO: 9008527 - DNA, 22 bp, Homo sapiens
attcacatttagcctctgacat

SEQ ID NO: 9008528 - DNA, 22 bp, Homo sapiens
attcacatttagcctctgacat

SEQ ID NO: 9008529 - DNA, 22 bp, Homo sapiens
attcacatttagcctctgacat

SEQ ID NO: 9008530 - DNA, 22 bp, Homo sapiens
attcacatttagcctctgacat

SEQ ID NO: 9008531 - DNA, 22 bp, Homo sapiens
attcacattctagggccctact

SEQ ID NO: 9008532 - DNA, 22 bp, Homo sapiens
attcacatgttgaagccctaac

SEQ ID NO: 9008533 - DNA, 22 bp, Homo sapiens
attcacatgttgaagccctaac

SEQ ID NO: 9008534 - DNA, 22 bp, Homo sapiens
attcacatgttgaagccctaac

SEQ ID NO: 9008535 - DNA, 22 bp, Homo sapiens
attcacatgttgaagccctaac

SEQ ID NO: 9008536 - DNA, 22 bp, Homo sapiens
attcacattgagcttcactgtg

SEQ ID NO: 9008537 - DNA, 22 bp, Homo sapiens
attcacattgagcttcactgtg

SEQ ID NO: 9008538 - DNA, 22 bp, Homo sapiens
attcacattgagcttcactgtg

SEQ ID NO: 9008539 - DNA, 22 bp, Homo sapiens
attcacattgagcttcactgtg

SEQ ID NO: 9008540 - DNA, 22 bp, Homo sapiens
attcacattctagggccctact

SEQ ID NO: 9008541 - DNA, 22 bp, Homo sapiens
attcacattctagggccctact

SEQ ID NO: 9008542 - DNA, 22 bp, Homo sapiens
attcacatgcccaagcagcacc

SEQ ID NO: 9008543 - DNA, 22 bp, Homo sapiens
attcacatgcccaagcagcacc

SEQ ID NO: 9008544 - DNA, 22 bp, Homo sapiens
attcacatgcccaagcagcacc

SEQ ID NO: 9008545 - DNA, 22 bp, Homo sapiens
attcacatgcccaagcagcacc

SEQ ID NO: 9008546 - DNA, 22 bp, Homo sapiens
attcacatgtgcttcttatcac

SEQ ID NO: 9008547 - DNA, 22 bp, Homo sapiens
attcacatgtgcttcttatcac

SEQ ID NO: 9008548 - DNA, 22 bp, Homo sapiens
attcacatgtgcttcttatcac

SEQ ID NO: 9008549 - DNA, 22 bp, Homo sapiens
attcactgtcagcttgcatggg

SEQ ID NO: 9008550 - DNA, 22 bp, Homo sapiens
attcacttattctcaaagtcct

SEQ ID NO: 9008551 - DNA, 22 bp, Homo sapiens
attcagaaactctgggcagaac

SEQ ID NO: 9008552 - DNA, 22 bp, Homo sapiens
attcagaaagatatgcctggtt

SEQ ID NO: 9008553 - DNA, 22 bp, Homo sapiens
attcactggtgtcagggatcag

SEQ ID NO: 9008554 - DNA, 22 bp, Homo sapiens
attcactgtcagcttgcatggg

SEQ ID NO: 9008555 - DNA, 22 bp, Homo sapiens
attcacctgttagtaaaaatct

SEQ ID NO: 9008556 - DNA, 22 bp, Homo sapiens
attcacccagcacagtggcagc

SEQ ID NO: 9008557 - DNA, 22 bp, Homo sapiens
attcaccccctatttgcaatgc

SEQ ID NO: 9008558 - DNA, 22 bp, Homo sapiens
attcagaaagttgtcatatttg

SEQ ID NO: 9008559 - DNA, 22 bp, Homo sapiens
attcagaagcaatcacagtgag

SEQ ID NO: 9008560 - DNA, 22 bp, Homo sapiens
attcagaaagggttgcctggtt

SEQ ID NO: 9008561 - DNA, 22 bp, Homo sapiens
attcagaaagttgtcatatttg

SEQ ID NO: 9008562 - DNA, 21 bp, Homo sapiens
attcagaaagggaataaactc

SEQ ID NO: 9008563 - DNA, 22 bp, Homo sapiens
attcagaaagcaagtgctgggt

SEQ ID NO: 9008564 - DNA, 22 bp, Homo sapiens
attagaggtacaaaccttcact

SEQ ID NO: 9008565 - DNA, 22 bp, Homo sapiens
attagagtaatgccagggccgg

SEQ ID NO: 9008566 - DNA, 22 bp, Homo sapiens
attagagtccctttggagtttt

SEQ ID NO: 9008567 - DNA, 22 bp, Homo sapiens
gatttctcaatcctagtactat

SEQ ID NO: 9008568 - DNA, 22 bp, Homo sapiens
gatttctcactgtggatttcct

SEQ ID NO: 9008569 - DNA, 22 bp, Homo sapiens
gatttctcatttgtggattgaa

SEQ ID NO: 9008570 - DNA, 22 bp, Homo sapiens
gatttctcaatcctagtactat

SEQ ID NO: 9008571 - DNA, 22 bp, Homo sapiens
gatttctcaatcctagtactat

SEQ ID NO: 9008572 - DNA, 22 bp, Homo sapiens
gatttctcaatcctagtactat

SEQ ID NO: 9008573 - DNA, 22 bp, Homo sapiens
gatttctacttgaacttgctaa

SEQ ID NO: 9008574 - DNA, 22 bp, Homo sapiens
gatttctaaggaggctgaactt

SEQ ID NO: 9008575 - DNA, 22 bp, Homo sapiens
gatttctagtaagtcatgaagg

SEQ ID NO: 9008576 - DNA, 22 bp, Homo sapiens
gatttctagttcattatctatt

SEQ ID NO: 9008577 - DNA, 22 bp, Homo sapiens
gatttctagttcattatctatt

SEQ ID NO: 9008578 - DNA, 22 bp, Homo sapiens
gatttctagtaagtcatgaagg

SEQ ID NO: 9008579 - DNA, 22 bp, Homo sapiens
gatttccatgattgggccagaa

SEQ ID NO: 9008580 - DNA, 22 bp, Homo sapiens
gatttcctaatgtggatctctg

SEQ ID NO: 9008581 - DNA, 17 bp, Homo sapiens
gatttcctgaagttctt

SEQ ID NO: 9008582 - DNA, 22 bp, Homo sapiens
gatttccttgcatattggtaat

SEQ ID NO: 9008583 - DNA, 22 bp, Homo sapiens
gatttcctcactaacatccatc

SEQ ID NO: 9008584 - DNA, 17 bp, Homo sapiens
gatttcctgaagttctt

SEQ ID NO: 9008585 - DNA, 22 bp, Homo sapiens
gatttcctagacatggggcaga

SEQ ID NO: 9008586 - DNA, 22 bp, Homo sapiens
gatttcctaatgtggatctctg

SEQ ID NO: 9008587 - DNA, 22 bp, Homo sapiens
gatttcctagacatggggcaga

SEQ ID NO: 9008588 - DNA, 22 bp, Homo sapiens
gatttcagtggctgtctcaaat

SEQ ID NO: 9008589 - DNA, 22 bp, Homo sapiens
gatttccaggacgggaggtggg

SEQ ID NO: 9008590 - DNA, 22 bp, Homo sapiens
gatttccaggacgggaggtggg

SEQ ID NO: 9008591 - DNA, 22 bp, Homo sapiens
gatttcaggctatctatgcaga

SEQ ID NO: 9008592 - DNA, 22 bp, Homo sapiens
gatttcagggtgcagatgatga

SEQ ID NO: 9008593 - DNA, 22 bp, Homo sapiens
gatttcagggtgtcttccagct

SEQ ID NO: 9008594 - DNA, 22 bp, Homo sapiens
gatttcagaagcaagaggaggt

SEQ ID NO: 9008595 - DNA, 22 bp, Homo sapiens
gatttcagagtttattaggtta

SEQ ID NO: 9008596 - DNA, 23 bp, Homo sapiens
attagaaaggctttctggtgaaa

SEQ ID NO: 9008597 - DNA, 23 bp, Homo sapiens
attagaaaggctttctggtgaaa

SEQ ID NO: 9008598 - DNA, 22 bp, Homo sapiens
attagaaaatctggaggtgggg

SEQ ID NO: 9008599 - DNA, 22 bp, Homo sapiens
attagaaaaactcaagggctct

SEQ ID NO: 9008600 - DNA, 22 bp, Homo sapiens
attactgaggcaaagtagtttt

SEQ ID NO: 9008601 - DNA, 22 bp, Homo sapiens
attactagattgtcaagattta

SEQ ID NO: 9008602 - DNA, 22 bp, Homo sapiens
attacctatttcattttctgtc

SEQ ID NO: 9008603 - DNA, 22 bp, Homo sapiens
attacctatttcattttctgtc

SEQ ID NO: 9008604 - DNA, 22 bp, Homo sapiens
attacgagaatgaagtatcagg

SEQ ID NO: 9008605 - DNA, 22 bp, Homo sapiens
attactccttttctagcaggtg

SEQ ID NO: 9008606 - DNA, 22 bp, Homo sapiens
attactctgtctgcctctgacc

SEQ ID NO: 9008607 - DNA, 22 bp, Homo sapiens
attacatgagagaatgtaaata

SEQ ID NO: 9008608 - DNA, 22 bp, Homo sapiens
attaccacttaatcaacatatg

SEQ ID NO: 9008609 - DNA, 23 bp, Homo sapiens
attacatgagcaaatatagctat

SEQ ID NO: 9008610 - DNA, 22 bp, Homo sapiens
attacctatgctctagtaatca

SEQ ID NO: 9008611 - DNA, 23 bp, Homo sapiens
attaccagcctgacaccaacaaa

SEQ ID NO: 9008612 - DNA, 22 bp, Homo sapiens
attacccagtctgtggtattct

SEQ ID NO: 9008613 - DNA, 22 bp, Homo sapiens
attacccagggtaggaattcct

SEQ ID NO: 9008614 - DNA, 22 bp, Homo sapiens
attacatatgttggcaacattt

SEQ ID NO: 9008615 - DNA, 22 bp, Homo sapiens
attacatcagttgacatgtgag

SEQ ID NO: 9008616 - DNA, 21 bp, Homo sapiens
attacatccctggtgatacat

SEQ ID NO: 9008617 - DNA, 22 bp, Homo sapiens
attacagtgggtaaacagaatt

SEQ ID NO: 9008618 - DNA, 22 bp, Homo sapiens
attacagttctgcaggtagttt

SEQ ID NO: 9008619 - DNA, 22 bp, Homo sapiens
attacagttctgcaggtagttt

SEQ ID NO: 9008620 - DNA, 22 bp, Homo sapiens
gatattcctgaaggacagggtt

SEQ ID NO: 9008621 - DNA, 22 bp, Homo sapiens
gatattctacctgctgaccaag

SEQ ID NO: 9008622 - DNA, 22 bp, Homo sapiens
gatatgtttaatgcctcagtat

SEQ ID NO: 9008623 - DNA, 22 bp, Homo sapiens
gatatgtttaatgcctcagtat

SEQ ID NO: 9008624 - DNA, 22 bp, Homo sapiens
gatattcaaagattactgatat

SEQ ID NO: 9008625 - DNA, 22 bp, Homo sapiens
gatattcaactaaagtgaatta

SEQ ID NO: 9008626 - DNA, 22 bp, Homo sapiens
gatatgtgcttgtaatatttat

SEQ ID NO: 9008627 - DNA, 22 bp, Homo sapiens
gatatgtattgaatgatcattt

SEQ ID NO: 9008628 - DNA, 22 bp, Homo sapiens
attacaatcgagagaaacaaat

SEQ ID NO: 9008629 - DNA, 22 bp, Homo sapiens
attacaatcgagagaaacaaat

SEQ ID NO: 9008630 - DNA, 22 bp, Homo sapiens
attacaatcgagagaaacaaat

SEQ ID NO: 9008631 - DNA, 22 bp, Homo sapiens
attacaatcgagagaaacaaat

SEQ ID NO: 9008632 - DNA, 22 bp, Homo sapiens
attacagtggacagctatgcac

SEQ ID NO: 9008633 - DNA, 22 bp, Homo sapiens
attacaatcgagagaaacaaat

SEQ ID NO: 9008634 - DNA, 22 bp, Homo sapiens
attacaatcgagagaaacaaat

SEQ ID NO: 9008635 - DNA, 22 bp, Homo sapiens
attacaatcgagagaaacaaat

SEQ ID NO: 9008636 - DNA, 22 bp, Homo sapiens
attaggtaatctttagatacac

SEQ ID NO: 9008637 - DNA, 22 bp, Homo sapiens
attaggcatatatgcttttaat

SEQ ID NO: 9008638 - DNA, 22 bp, Homo sapiens
attaggtaatctttagatacac

SEQ ID NO: 9008639 - DNA, 22 bp, Homo sapiens
attaggtggggttgttactgtt

SEQ ID NO: 9008640 - DNA, 22 bp, Homo sapiens
attagtaaaacattgtatatgt

SEQ ID NO: 9008641 - DNA, 22 bp, Homo sapiens
attagtaaaacattgtatatgt

SEQ ID NO: 9008642 - DNA, 22 bp, Homo sapiens
attagtaaaacattgtatatgt

SEQ ID NO: 9008643 - DNA, 22 bp, Homo sapiens
attagtctactgtctaataaat

SEQ ID NO: 9008644 - DNA, 22 bp, Homo sapiens
attagtctactgtctaataaat

SEQ ID NO: 9008645 - DNA, 22 bp, Homo sapiens
attagtattcagtttataacac

SEQ ID NO: 9008646 - DNA, 22 bp, Homo sapiens
attagtattcagtttataacac

SEQ ID NO: 9008647 - DNA, 22 bp, Homo sapiens
attagtattcagtttataacac

SEQ ID NO: 9008648 - DNA, 22 bp, Homo sapiens
attagtagctgtaataactggg

SEQ ID NO: 9008649 - DNA, 22 bp, Homo sapiens
attagctgttgtgaaaggggtg

SEQ ID NO: 9008650 - DNA, 22 bp, Homo sapiens
attagatacacagatttccact

SEQ ID NO: 9008651 - DNA, 22 bp, Homo sapiens
attagcttaggcatgaagagaa

SEQ ID NO: 9008652 - DNA, 22 bp, Homo sapiens
attagctttatttgaaatagga

SEQ ID NO: 9008653 - DNA, 22 bp, Homo sapiens
attagctttaaaccacagcagt

SEQ ID NO: 9008654 - DNA, 22 bp, Homo sapiens
attaggaaatgtgttgcaagca

SEQ ID NO: 9008655 - DNA, 22 bp, Homo sapiens
attaggaaatgtgttgcaagca

SEQ ID NO: 9008656 - DNA, 22 bp, Homo sapiens
attaggaaactgaatgtcagaa

SEQ ID NO: 9008657 - DNA, 22 bp, Homo sapiens
attaggaagaggatgtcagcat

SEQ ID NO: 9008658 - DNA, 22 bp, Homo sapiens
attaggaaattatatgtcctcc

SEQ ID NO: 9008659 - DNA, 22 bp, Homo sapiens
attaggaagtaagtatcacaag

SEQ ID NO: 9008660 - DNA, 22 bp, Homo sapiens
attaggaagtaagtatcacaag

SEQ ID NO: 9008661 - DNA, 22 bp, Homo sapiens
attcaacatattctgagtaaaa

SEQ ID NO: 9008662 - DNA, 22 bp, Homo sapiens
attcaacatattctgagtaaaa

SEQ ID NO: 9008663 - DNA, 22 bp, Homo sapiens
attcaacatattctgagtaaaa

SEQ ID NO: 9008664 - DNA, 22 bp, Homo sapiens
attcaactgtaaacttgttcac

SEQ ID NO: 9008665 - DNA, 22 bp, Homo sapiens
attcaaattaagttaattcagc

SEQ ID NO: 9008666 - DNA, 22 bp, Homo sapiens
attcaaattaagttaattcagc

SEQ ID NO: 9008667 - DNA, 22 bp, Homo sapiens
attcaaattaagttaattcagc

SEQ ID NO: 9008668 - DNA, 22 bp, Homo sapiens
attcaaattaagttaattcagc

SEQ ID NO: 9008669 - DNA, 22 bp, Homo sapiens
attcaaattaagttaattcagc

SEQ ID NO: 9008670 - DNA, 22 bp, Homo sapiens
attcaaattaagttaattcagc

SEQ ID NO: 9008671 - DNA, 22 bp, Homo sapiens
attcaaattaagttaattcagc

SEQ ID NO: 9008672 - DNA, 22 bp, Homo sapiens
attcaaatgtcaaatccaccag

SEQ ID NO: 9008673 - DNA, 22 bp, Homo sapiens
attcaaatgtcaaatccaccag

SEQ ID NO: 9008674 - DNA, 22 bp, Homo sapiens
attcaaattaagttaattcagc

SEQ ID NO: 9008675 - DNA, 22 bp, Homo sapiens
attcaaagtctagatgtagtgt

SEQ ID NO: 9008676 - DNA, 22 bp, Homo sapiens
attcaaatgtcaaatccaccag

SEQ ID NO: 9008677 - DNA, 22 bp, Homo sapiens
attcaaagtactagctattttt

SEQ ID NO: 9008678 - DNA, 22 bp, Homo sapiens
attcaaagtctagatgtagtgt

SEQ ID NO: 9008679 - DNA, 20 bp, Homo sapiens
attagtgcatctggacatgc

SEQ ID NO: 9008680 - DNA, 22 bp, Homo sapiens
attagtgtacatctcacacgca

SEQ ID NO: 9008681 - DNA, 22 bp, Homo sapiens
attagtgtcatgttgaggactt

SEQ ID NO: 9008682 - DNA, 22 bp, Homo sapiens
attagtgtacatctcacacgca

SEQ ID NO: 9008683 - DNA, 22 bp, Homo sapiens
attagtgactctcacatatgcc

SEQ ID NO: 9008684 - DNA, 22 bp, Homo sapiens
attagtgtgtaggctggaaaaa

SEQ ID NO: 9008685 - DNA, 22 bp, Homo sapiens
attagtgtggaccctaatttaa

SEQ ID NO: 9008686 - DNA, 22 bp, Homo sapiens
attagtgttcttatcttctagg

SEQ ID NO: 9008687 - DNA, 22 bp, Homo sapiens
attagtgtgtaggctggaaaaa

SEQ ID NO: 9008688 - DNA, 22 bp, Homo sapiens
attagtgtctgtgaataattct

SEQ ID NO: 9008689 - DNA, 22 bp, Homo sapiens
attagtgtctgtgaataattct

SEQ ID NO: 9008690 - DNA, 22 bp, Homo sapiens
attagtgtggaccctaatttaa

SEQ ID NO: 9008691 - DNA, 22 bp, Homo sapiens
attagtgtcatgttgaggactt

SEQ ID NO: 9008692 - DNA, 22 bp, Homo sapiens
attagtgttgtggcttcatggc

SEQ ID NO: 9008693 - DNA, 22 bp, Homo sapiens
attagtgttgtggcttcatggc

SEQ ID NO: 9008694 - DNA, 22 bp, Homo sapiens
attagtgttgtggcttcatggc

SEQ ID NO: 9008695 - DNA, 22 bp, Homo sapiens
attagtgttcttatcttctagg

SEQ ID NO: 9008696 - DNA, 22 bp, Homo sapiens
attagtgttgtaagaagctgcc

SEQ ID NO: 9008697 - DNA, 22 bp, Homo sapiens
attagtgttgtaagaagctgcc

SEQ ID NO: 9008698 - DNA, 22 bp, Homo sapiens
attagtgttgtaagaagctgcc

SEQ ID NO: 9008699 - DNA, 22 bp, Homo sapiens
attagtgttgtggcttcatggc

SEQ ID NO: 9008700 - DNA, 22 bp, Homo sapiens
attatttcagtcagacactggc

SEQ ID NO: 9008701 - DNA, 22 bp, Homo sapiens
attatttcagtcagacactggc

SEQ ID NO: 9008702 - DNA, 22 bp, Homo sapiens
attatttccttgctttgaggaa

SEQ ID NO: 9008703 - DNA, 22 bp, Homo sapiens
attatttccttgctttgaggaa

SEQ ID NO: 9008704 - DNA, 22 bp, Homo sapiens
attatttccttgctttgaggaa

SEQ ID NO: 9008705 - DNA, 22 bp, Homo sapiens
attcaaagtactagctattttt

SEQ ID NO: 9008706 - DNA, 22 bp, Homo sapiens
attcaaagtactagctattttt

SEQ ID NO: 9008707 - DNA, 22 bp, Homo sapiens
gaggagaatgcgcaccacatat

SEQ ID NO: 9008708 - DNA, 22 bp, Homo sapiens
gaggagaatgcgcaccacatat

SEQ ID NO: 9008709 - DNA, 22 bp, Homo sapiens
gaggagaagggcacggagaaaa

SEQ ID NO: 9008710 - DNA, 22 bp, Homo sapiens
gaggagaagggcacggagaaaa

SEQ ID NO: 9008711 - DNA, 22 bp, Homo sapiens
gaggagaagggcacggagaaaa

SEQ ID NO: 9008712 - DNA, 22 bp, Homo sapiens
gaggagaagggcacggagaaaa

SEQ ID NO: 9008713 - DNA, 22 bp, Homo sapiens
atggtctttttgttatgagaga

SEQ ID NO: 9008714 - DNA, 22 bp, Homo sapiens
atggtgactcctaaatgtgaaa

SEQ ID NO: 9008715 - DNA, 22 bp, Homo sapiens
atggtgaagcttcatgggtgtt

SEQ ID NO: 9008716 - DNA, 22 bp, Homo sapiens
atggtggaagagcatcagaaag

SEQ ID NO: 9008717 - DNA, 22 bp, Homo sapiens
atggtggaatcggcgtgaatgg

SEQ ID NO: 9008718 - DNA, 22 bp, Homo sapiens
atggtgccaaagatttctaagc

SEQ ID NO: 9008719 - DNA, 22 bp, Homo sapiens
atggtcttgggcttaggcagag

SEQ ID NO: 9008720 - DNA, 22 bp, Homo sapiens
atggtcttgtgagagtaacagt

SEQ ID NO: 9008721 - DNA, 18 bp, Homo sapiens
atggtctcatactgggag

SEQ ID NO: 9008722 - DNA, 18 bp, Homo sapiens
atggtctcatactgggag

SEQ ID NO: 9008723 - DNA, 22 bp, Homo sapiens
gaggagaaatttggggacctga

SEQ ID NO: 9008724 - DNA, 22 bp, Homo sapiens
gaggagaaatttggggacctga

SEQ ID NO: 9008725 - DNA, 22 bp, Homo sapiens
gaggagaagctaagaaacacag

SEQ ID NO: 9008726 - DNA, 22 bp, Homo sapiens
gaggagaaatttggggacctga

SEQ ID NO: 9008727 - DNA, 22 bp, Homo sapiens
gaggagaaatttggggacctga

SEQ ID NO: 9008728 - DNA, 22 bp, Homo sapiens
gaggagaaattatccttggtgt

SEQ ID NO: 9008729 - DNA, 22 bp, Homo sapiens
gaggagaaatttggggacctga

SEQ ID NO: 9008730 - DNA, 22 bp, Homo sapiens
gaggaaggctaaggggcttaga

SEQ ID NO: 9008731 - DNA, 22 bp, Homo sapiens
gaggaaggctaaggggcttaga

SEQ ID NO: 9008732 - DNA, 22 bp, Homo sapiens
gaggagaagctaagaaacacag

SEQ ID NO: 9008733 - DNA, 22 bp, Homo sapiens
gaggagaagctaagaaacacag

SEQ ID NO: 9008734 - DNA, 22 bp, Homo sapiens
gaggagaagctaagaaacacag

SEQ ID NO: 9008735 - DNA, 22 bp, Homo sapiens
gaggagaagctaagaaacacag

SEQ ID NO: 9008736 - DNA, 22 bp, Homo sapiens
gaggagaagctaagaaacacag

SEQ ID NO: 9008737 - DNA, 22 bp, Homo sapiens
gaggagaagctaagaaacacag

SEQ ID NO: 9008738 - DNA, 22 bp, Homo sapiens
gaggagaagctattggaaggac

SEQ ID NO: 9008739 - DNA, 22 bp, Homo sapiens
gaggagaagctaagaaacacag

SEQ ID NO: 9008740 - DNA, 22 bp, Homo sapiens
gaggagaagctattggaaggac

SEQ ID NO: 9008741 - DNA, 22 bp, Homo sapiens
gaggagaagctattggaaggac

SEQ ID NO: 9008742 - DNA, 22 bp, Homo sapiens
gaggcagcctcagtggacctcg

SEQ ID NO: 9008743 - DNA, 22 bp, Homo sapiens
gaggcagcctcagtggacctcg

SEQ ID NO: 9008744 - DNA, 22 bp, Homo sapiens
gaggcagcctcagtggacctcg

SEQ ID NO: 9008745 - DNA, 22 bp, Homo sapiens
gaggcagcctcagtggacctcg

SEQ ID NO: 9008746 - DNA, 22 bp, Homo sapiens
gaggcagcctcagtggacctcg

SEQ ID NO: 9008747 - DNA, 22 bp, Homo sapiens
gaggcagccagaggttctcatt

SEQ ID NO: 9008748 - DNA, 22 bp, Homo sapiens
gaggcagccagaggttctcatt

SEQ ID NO: 9008749 - DNA, 22 bp, Homo sapiens
gaggcagcatggtaccttggag

SEQ ID NO: 9008750 - DNA, 22 bp, Homo sapiens
gaggcagcatctatggtgggaa

SEQ ID NO: 9008751 - DNA, 22 bp, Homo sapiens
gaggcagcatggtaccttggag

SEQ ID NO: 9008752 - DNA, 22 bp, Homo sapiens
gaggcagcatggtaccttggag

SEQ ID NO: 9008753 - DNA, 22 bp, Homo sapiens
gaggcagcatggtaccttggag

SEQ ID NO: 9008754 - DNA, 22 bp, Homo sapiens
gaggcagcatggtaccttggag

SEQ ID NO: 9008755 - DNA, 22 bp, Homo sapiens
gaggcagcattcgcatagacag

SEQ ID NO: 9008756 - DNA, 22 bp, Homo sapiens
gaggcagcattcgcatagacag

SEQ ID NO: 9008757 - DNA, 22 bp, Homo sapiens
atggtgtccccagcctttgaag

SEQ ID NO: 9008758 - DNA, 22 bp, Homo sapiens
atggtggtagaagcactatgtg

SEQ ID NO: 9008759 - DNA, 22 bp, Homo sapiens
atggtggtgaagagcacagtga

SEQ ID NO: 9008760 - DNA, 22 bp, Homo sapiens
atggtggtgaagagcacagtga

SEQ ID NO: 9008761 - DNA, 22 bp, Homo sapiens
atggtggactcttgattcaggc

SEQ ID NO: 9008762 - DNA, 22 bp, Homo sapiens
atggtggatttgtgattcagct

SEQ ID NO: 9008763 - DNA, 22 bp, Homo sapiens
gaggcagcagggctggttcctt

SEQ ID NO: 9008764 - DNA, 22 bp, Homo sapiens
gaggcagcatctatggtgggaa

SEQ ID NO: 9008765 - DNA, 22 bp, Homo sapiens
gaggcagcagggctggttcctt

SEQ ID NO: 9008766 - DNA, 22 bp, Homo sapiens
gaggcagcagggctggttcctt

SEQ ID NO: 9008767 - DNA, 22 bp, Homo sapiens
gaggcagcagggctggttcctt

SEQ ID NO: 9008768 - DNA, 22 bp, Homo sapiens
gaggcacatatatacagagccc

SEQ ID NO: 9008769 - DNA, 22 bp, Homo sapiens
gaggcacatatatacagagccc

SEQ ID NO: 9008770 - DNA, 22 bp, Homo sapiens
gaggcacatatatacagagccc

SEQ ID NO: 9008771 - DNA, 22 bp, Homo sapiens
atggtgtttataggcaaagatc

SEQ ID NO: 9008772 - DNA, 22 bp, Homo sapiens
atggttattactgctgttccag

SEQ ID NO: 9008773 - DNA, 22 bp, Homo sapiens
atgggacacacaaggaagtaaa

SEQ ID NO: 9008774 - DNA, 22 bp, Homo sapiens
atgggacaatttgaacacagtg

SEQ ID NO: 9008775 - DNA, 22 bp, Homo sapiens
atgggagaaacatcatgaggca

SEQ ID NO: 9008776 - DNA, 22 bp, Homo sapiens
atgggaaagaagccactgccca

SEQ ID NO: 9008777 - DNA, 19 bp, Homo sapiens
atgggaagcggccagcgga

SEQ ID NO: 9008778 - DNA, 22 bp, Homo sapiens
atgggaagctgacctgcatgga

SEQ ID NO: 9008779 - DNA, 22 bp, Homo sapiens
atgggaagctgacctgcatgga

SEQ ID NO: 9008780 - DNA, 22 bp, Homo sapiens
atgggaaggttttgagagcggg

SEQ ID NO: 9008781 - DNA, 22 bp, Homo sapiens
atgggaagtgaagtcagggagg

SEQ ID NO: 9008782 - DNA, 22 bp, Homo sapiens
atgggaaggttttgagagcggg

SEQ ID NO: 9008783 - DNA, 22 bp, Homo sapiens
atgggctgaggaagctcctgag

SEQ ID NO: 9008784 - DNA, 22 bp, Homo sapiens
atgggctgaggaagctcctgag

SEQ ID NO: 9008785 - DNA, 22 bp, Homo sapiens
atgggctgaggaagctcctgag

SEQ ID NO: 9008786 - DNA, 22 bp, Homo sapiens
atgggctgaggaagctcctgag

SEQ ID NO: 9008787 - DNA, 22 bp, Homo sapiens
atgggctgaggaagctcctgag

SEQ ID NO: 9008788 - DNA, 22 bp, Homo sapiens
atgggctgaggtgggatagaag

SEQ ID NO: 9008789 - DNA, 22 bp, Homo sapiens
atgggctgacccagtcgtggca

SEQ ID NO: 9008790 - DNA, 22 bp, Homo sapiens
atgggctgacccagtcgtggca

SEQ ID NO: 9008791 - DNA, 22 bp, Homo sapiens
atgggctgacaagacatgcata

SEQ ID NO: 9008792 - DNA, 22 bp, Homo sapiens
atgggctgagaatcaagaatat

SEQ ID NO: 9008793 - DNA, 22 bp, Homo sapiens
atgggctgacccagtcgtggca

SEQ ID NO: 9008794 - DNA, 22 bp, Homo sapiens
atgggctgacccagtcgtggca

SEQ ID NO: 9008795 - DNA, 22 bp, Homo sapiens
atgggctgaaagagtaagctgt

SEQ ID NO: 9008796 - DNA, 18 bp, Homo sapiens
atgggcaggtaagatcca

SEQ ID NO: 9008797 - DNA, 22 bp, Homo sapiens
atgggcaggcctctcatttctg

SEQ ID NO: 9008798 - DNA, 22 bp, Homo sapiens
atgggcagggcagtgtataaga

SEQ ID NO: 9008799 - DNA, 22 bp, Homo sapiens
atgggcagggcagtgtataaga

SEQ ID NO: 9008800 - DNA, 22 bp, Homo sapiens
atgggcagggcagtgtataaga

SEQ ID NO: 9008801 - DNA, 22 bp, Homo sapiens
atgggagaaacatcatgaggca

SEQ ID NO: 9008802 - DNA, 22 bp, Homo sapiens
atgggagaaacatcatgaggca

SEQ ID NO: 9008803 - DNA, 22 bp, Homo sapiens
atgggagaaacatcatgaggca

SEQ ID NO: 9008804 - DNA, 22 bp, Homo sapiens
atggggagagaagggctgagct

SEQ ID NO: 9008805 - DNA, 22 bp, Homo sapiens
atggggagagaagggctgagct

SEQ ID NO: 9008806 - DNA, 22 bp, Homo sapiens
atggggagagcctctgtcccca

SEQ ID NO: 9008807 - DNA, 22 bp, Homo sapiens
atggggagagcctctgtcccca

SEQ ID NO: 9008808 - DNA, 23 bp, Homo sapiens
atggggctcaacacttagtagct

SEQ ID NO: 9008809 - DNA, 22 bp, Homo sapiens
atggggctagacaaccagtgcc

SEQ ID NO: 9008810 - DNA, 22 bp, Homo sapiens
atggggagctcaccacctgttt

SEQ ID NO: 9008811 - DNA, 22 bp, Homo sapiens
atggggagagaagggctgagct

SEQ ID NO: 9008812 - DNA, 22 bp, Homo sapiens
atggggagagaagggctgagct

SEQ ID NO: 9008813 - DNA, 22 bp, Homo sapiens
atggggagagaagggctgagct

SEQ ID NO: 9008814 - DNA, 22 bp, Homo sapiens
atgggctgtgggaccctggacc

SEQ ID NO: 9008815 - DNA, 22 bp, Homo sapiens
atgggcttgaccctacagaaag

SEQ ID NO: 9008816 - DNA, 22 bp, Homo sapiens
atgggcttgaccctacagaaag

SEQ ID NO: 9008817 - DNA, 22 bp, Homo sapiens
atggggaagagccagtgagctg

SEQ ID NO: 9008818 - DNA, 22 bp, Homo sapiens
atggggaagagccagtgagctg

SEQ ID NO: 9008819 - DNA, 22 bp, Homo sapiens
atggggaagagccagtgagctg

SEQ ID NO: 9008820 - DNA, 22 bp, Homo sapiens
atgggctgcttctccagcacct

SEQ ID NO: 9008821 - DNA, 22 bp, Homo sapiens
atgggctgcttggcttccaccc

SEQ ID NO: 9008822 - DNA, 22 bp, Homo sapiens
atgggctgcttggcttccaccc

SEQ ID NO: 9008823 - DNA, 22 bp, Homo sapiens
atgggctggcagcctgaacagc

SEQ ID NO: 9008824 - DNA, 22 bp, Homo sapiens
atgggctggcctttcccgctct

SEQ ID NO: 9008825 - DNA, 22 bp, Homo sapiens
atgggctggcctttcccgctct

SEQ ID NO: 9008826 - DNA, 22 bp, Homo sapiens
atgggctgggaatacacagggg

SEQ ID NO: 9008827 - DNA, 22 bp, Homo sapiens
atgggctgggatctgagtgtca

SEQ ID NO: 9008828 - DNA, 22 bp, Homo sapiens
atgggctgggatctgagtgtca

SEQ ID NO: 9008829 - DNA, 22 bp, Homo sapiens
atgggctgggatctgagtgtca

SEQ ID NO: 9008830 - DNA, 22 bp, Homo sapiens
atgggctggggaagctcactcc

SEQ ID NO: 9008831 - DNA, 22 bp, Homo sapiens
atgggctgtccattgctggctg

SEQ ID NO: 9008832 - DNA, 22 bp, Homo sapiens
atgggctgtccattgctggctg

SEQ ID NO: 9008833 - DNA, 22 bp, Homo sapiens
atgggctgtccattgctggctg

SEQ ID NO: 9008834 - DNA, 22 bp, Homo sapiens
atgggctgtcctagtccagccc

SEQ ID NO: 9008835 - DNA, 22 bp, Homo sapiens
atgggctgtcctagtccagccc

SEQ ID NO: 9008836 - DNA, 22 bp, Homo sapiens
atgggctgtgaggtccggcagg

SEQ ID NO: 9008837 - DNA, 22 bp, Homo sapiens
atgggctgtcctagtccagccc

SEQ ID NO: 9008838 - DNA, 22 bp, Homo sapiens
atgggctgtcctagtccagccc

SEQ ID NO: 9008839 - DNA, 22 bp, Homo sapiens
atgggctggggaagctcactcc

SEQ ID NO: 9008840 - DNA, 22 bp, Homo sapiens
atgggctggggaagctcactcc

SEQ ID NO: 9008841 - DNA, 20 bp, Homo sapiens
atgggctggttaggaagtgt

SEQ ID NO: 9008842 - DNA, 22 bp, Homo sapiens
atggcttggcaccatctccttg

SEQ ID NO: 9008843 - DNA, 22 bp, Homo sapiens
atggcttgcttttagagagatc

SEQ ID NO: 9008844 - DNA, 22 bp, Homo sapiens
atggcttctgtcttggaaattt

SEQ ID NO: 9008845 - DNA, 22 bp, Homo sapiens
atggcttctgtcttggaaactt

SEQ ID NO: 9008846 - DNA, 22 bp, Homo sapiens
atggctttccggactttggcca

SEQ ID NO: 9008847 - DNA, 22 bp, Homo sapiens
atggctttttagactttggtac

SEQ ID NO: 9008848 - DNA, 21 bp, Homo sapiens
atggcttttttaaagcttgtg

SEQ ID NO: 9008849 - DNA, 21 bp, Homo sapiens
atggcttttttaaagcttgtg

SEQ ID NO: 9008850 - DNA, 22 bp, Homo sapiens
atggctttgttccaataaaact

SEQ ID NO: 9008851 - DNA, 22 bp, Homo sapiens
atggcttttgatcaaaagaaat

SEQ ID NO: 9008852 - DNA, 22 bp, Homo sapiens
atggctttgctcaagtttagcc

SEQ ID NO: 9008853 - DNA, 22 bp, Homo sapiens
atggctttgctcaagtttagcc

SEQ ID NO: 9008854 - DNA, 22 bp, Homo sapiens
atggctttgaagtaatgtaatt

SEQ ID NO: 9008855 - DNA, 22 bp, Homo sapiens
atggctgttttgtgacttctca

SEQ ID NO: 9008856 - DNA, 22 bp, Homo sapiens
atggctgtttagcttctctgct

SEQ ID NO: 9008857 - DNA, 22 bp, Homo sapiens
atggctggcatccaggtgggct

SEQ ID NO: 9008858 - DNA, 22 bp, Homo sapiens
atggccagagaggccagcctgg

SEQ ID NO: 9008859 - DNA, 22 bp, Homo sapiens
atggccagagaggccagcctgg

SEQ ID NO: 9008860 - DNA, 22 bp, Homo sapiens
atggctggcatccaggtgggct

SEQ ID NO: 9008861 - DNA, 21 bp, Homo sapiens
atggcttctcaggtgcactga

SEQ ID NO: 9008862 - DNA, 22 bp, Homo sapiens
atggcttctcgctggcacctgt

SEQ ID NO: 9008863 - DNA, 22 bp, Homo sapiens
atggcttctagcattgtcacaa

SEQ ID NO: 9008864 - DNA, 21 bp, Homo sapiens
atggcttctcaggtgcactga

SEQ ID NO: 9008865 - DNA, 22 bp, Homo sapiens
atggcttccaaggccctccgtg

SEQ ID NO: 9008866 - DNA, 17 bp, Homo sapiens
atggcttccattgacca

SEQ ID NO: 9008867 - DNA, 22 bp, Homo sapiens
atggcttcctctggattggatt

SEQ ID NO: 9008868 - DNA, 22 bp, Homo sapiens
atggcttcgagtatatacatag

SEQ ID NO: 9008869 - DNA, 22 bp, Homo sapiens
atggcttccaaggccctccgtg

SEQ ID NO: 9008870 - DNA, 22 bp, Homo sapiens
gagatggggtcagctgggacat

SEQ ID NO: 9008871 - DNA, 22 bp, Homo sapiens
gagatggggtcttgctatgttg

SEQ ID NO: 9008872 - DNA, 22 bp, Homo sapiens
gagatggggtcttgctatgttg

SEQ ID NO: 9008873 - DNA, 22 bp, Homo sapiens
gagatggggtcttgctatgttg

SEQ ID NO: 9008874 - DNA, 22 bp, Homo sapiens
gagatggggaataggagcaagc

SEQ ID NO: 9008875 - DNA, 22 bp, Homo sapiens
gagatggggtcagctgggacat

SEQ ID NO: 9008876 - DNA, 22 bp, Homo sapiens
gagatggggtcagctgggacat

SEQ ID NO: 9008877 - DNA, 22 bp, Homo sapiens
gagatggggtcagctgggacat

SEQ ID NO: 9008878 - DNA, 22 bp, Homo sapiens
gagatgggcgagaaggtggact

SEQ ID NO: 9008879 - DNA, 22 bp, Homo sapiens
gagatggggaataggagcaagc

SEQ ID NO: 9008880 - DNA, 22 bp, Homo sapiens
gagatggggaataggagcaagc

SEQ ID NO: 9008881 - DNA, 22 bp, Homo sapiens
gagatggggaataggagcaagc

SEQ ID NO: 9008882 - DNA, 22 bp, Homo sapiens
gagatggggaataggagcaagc

SEQ ID NO: 9008883 - DNA, 17 bp, Homo sapiens
gagatgggtggatcacc

SEQ ID NO: 9008884 - DNA, 17 bp, Homo sapiens
gagatgggtggatcacc

SEQ ID NO: 9008885 - DNA, 17 bp, Homo sapiens
gagatgggtggatcacc

SEQ ID NO: 9008886 - DNA, 17 bp, Homo sapiens
gagatgggtggatcacc

SEQ ID NO: 9008887 - DNA, 22 bp, Homo sapiens
atggcattcacatttccagaga

SEQ ID NO: 9008888 - DNA, 22 bp, Homo sapiens
atggccaaagccacagcagagg

SEQ ID NO: 9008889 - DNA, 22 bp, Homo sapiens
atggccaaatctaaactgttgg

SEQ ID NO: 9008890 - DNA, 22 bp, Homo sapiens
atggccaaataacagcttgcat

SEQ ID NO: 9008891 - DNA, 22 bp, Homo sapiens
atggccaagatcacagacttca

SEQ ID NO: 9008892 - DNA, 22 bp, Homo sapiens
atggccaagcatatacagattg

SEQ ID NO: 9008893 - DNA, 22 bp, Homo sapiens
atggccaagagtcgatttgggg

SEQ ID NO: 9008894 - DNA, 22 bp, Homo sapiens
atggccaagaatatttctcaac

SEQ ID NO: 9008895 - DNA, 20 bp, Homo sapiens
atggccaacctgcttatgac

SEQ ID NO: 9008896 - DNA, 22 bp, Homo sapiens
atggccaagaagtattcctgac

SEQ ID NO: 9008897 - DNA, 22 bp, Homo sapiens
atggccaactgaaatgaaagat

SEQ ID NO: 9008898 - DNA, 22 bp, Homo sapiens
atggccaagaaattgccgactg

SEQ ID NO: 9008899 - DNA, 22 bp, Homo sapiens
atggccagagaaggcagggtca

SEQ ID NO: 9008900 - DNA, 22 bp, Homo sapiens
atggccagagaaggcagggtca

SEQ ID NO: 9008901 - DNA, 22 bp, Homo sapiens
atggccagagagagcacacctg

SEQ ID NO: 9008902 - DNA, 22 bp, Homo sapiens
atggccagagagagcacacctg

SEQ ID NO: 9008903 - DNA, 21 bp, Homo sapiens
atggccactatggtgcagcag

SEQ ID NO: 9008904 - DNA, 22 bp, Homo sapiens
atggccagagaaggcagggtca

SEQ ID NO: 9008905 - DNA, 22 bp, Homo sapiens
atggccaccatctctaaaacac

SEQ ID NO: 9008906 - DNA, 22 bp, Homo sapiens
atggccaccatttaatgaagct

SEQ ID NO: 9008907 - DNA, 22 bp, Homo sapiens
atggccacatttagtaactggt

SEQ ID NO: 9008908 - DNA, 22 bp, Homo sapiens
atggccaaggggcctaggcagg

SEQ ID NO: 9008909 - DNA, 22 bp, Homo sapiens
atggccaagcatatacagattg

SEQ ID NO: 9008910 - DNA, 22 bp, Homo sapiens
atggccaagcatgcctgtggcc

SEQ ID NO: 9008911 - DNA, 22 bp, Homo sapiens
atggccaagcttactctgttgt

SEQ ID NO: 9008912 - DNA, 22 bp, Homo sapiens
atggaggatgtgcagcatgggc

SEQ ID NO: 9008913 - DNA, 18 bp, Homo sapiens
atggaggcagagagctga

SEQ ID NO: 9008914 - DNA, 18 bp, Homo sapiens
atggaggcagagagctga

SEQ ID NO: 9008915 - DNA, 22 bp, Homo sapiens
atggagggaaaagtggagagcc

SEQ ID NO: 9008916 - DNA, 22 bp, Homo sapiens
atggagggaaaagtggagagcc

SEQ ID NO: 9008917 - DNA, 22 bp, Homo sapiens
atggagggaaaagtggagagcc

SEQ ID NO: 9008918 - DNA, 22 bp, Homo sapiens
atggagggaaaagtggagagcc

SEQ ID NO: 9008919 - DNA, 21 bp, Homo sapiens
atggagggaccagggaagcag

SEQ ID NO: 9008920 - DNA, 21 bp, Homo sapiens
atggagggaccagggaagcag

SEQ ID NO: 9008921 - DNA, 21 bp, Homo sapiens
atggagggaccagggaagcag

SEQ ID NO: 9008922 - DNA, 22 bp, Homo sapiens
gagatgggcgagaaggtggact

SEQ ID NO: 9008923 - DNA, 22 bp, Homo sapiens
gagatgggcgagaaggtggact

SEQ ID NO: 9008924 - DNA, 22 bp, Homo sapiens
gagatgggcgagaaggtggact

SEQ ID NO: 9008925 - DNA, 22 bp, Homo sapiens
gagatgggcgagaaggtggact

SEQ ID NO: 9008926 - DNA, 22 bp, Homo sapiens
gagatggcttgctctcacgtgg

SEQ ID NO: 9008927 - DNA, 22 bp, Homo sapiens
gagatggcttgctctcacgtgg

SEQ ID NO: 9008928 - DNA, 22 bp, Homo sapiens
gagatgggcgagaaggtggact

SEQ ID NO: 9008929 - DNA, 22 bp, Homo sapiens
gagatgggcgagaaggtggact

SEQ ID NO: 9008930 - DNA, 22 bp, Homo sapiens
gagatgggcgagaaggtggact

SEQ ID NO: 9008931 - DNA, 22 bp, Homo sapiens
gagatggccagtgccaggacaa

SEQ ID NO: 9008932 - DNA, 21 bp, Homo sapiens
gagatggcccagtagcgggcc

SEQ ID NO: 9008933 - DNA, 23 bp, Homo sapiens
gagatggctggttgtcctctgaa

SEQ ID NO: 9008934 - DNA, 22 bp, Homo sapiens
gagaggttgaacaacatactct

SEQ ID NO: 9008935 - DNA, 22 bp, Homo sapiens
gagatggagtctttttctgtca

SEQ ID NO: 9008936 - DNA, 22 bp, Homo sapiens
gagatggagtctttttctgtca

SEQ ID NO: 9008937 - DNA, 22 bp, Homo sapiens
gagagtcactgtctgcatttcc

SEQ ID NO: 9008938 - DNA, 22 bp, Homo sapiens
gagagagctctgtgcctgggat

SEQ ID NO: 9008939 - DNA, 22 bp, Homo sapiens
gagagagctctgtgcctgggat

SEQ ID NO: 9008940 - DNA, 22 bp, Homo sapiens
gagagagctctgtgcctgggat

SEQ ID NO: 9008941 - DNA, 22 bp, Homo sapiens
gagagaggcctccatgtactga

SEQ ID NO: 9008942 - DNA, 22 bp, Homo sapiens
gagagaggcctccatgtactga

SEQ ID NO: 9008943 - DNA, 22 bp, Homo sapiens
gagagaggcctccatgtactga

SEQ ID NO: 9008944 - DNA, 22 bp, Homo sapiens
gagagaggcctccatgtactga

SEQ ID NO: 9008945 - DNA, 22 bp, Homo sapiens
gagagaggcctccatgtactga

SEQ ID NO: 9008946 - DNA, 22 bp, Homo sapiens
gagagaggcctccatgtactga

SEQ ID NO: 9008947 - DNA, 22 bp, Homo sapiens
gagagcagactctcaaagctgg

SEQ ID NO: 9008948 - DNA, 22 bp, Homo sapiens
gagagcagactctcaaagctgg

SEQ ID NO: 9008949 - DNA, 22 bp, Homo sapiens
gagagcagactctcaaagctgg

SEQ ID NO: 9008950 - DNA, 22 bp, Homo sapiens
gagagcaatggggacgggcagg

SEQ ID NO: 9008951 - DNA, 22 bp, Homo sapiens
gagagcaatggggacgggcagg

SEQ ID NO: 9008952 - DNA, 23 bp, Homo sapiens
gagagcaatgagatgtaaacact

SEQ ID NO: 9008953 - DNA, 23 bp, Homo sapiens
gagagcaatgagatgtaaacact

SEQ ID NO: 9008954 - DNA, 22 bp, Homo sapiens
gagacagtggttgcagaagctc

SEQ ID NO: 9008955 - DNA, 22 bp, Homo sapiens
gactggggctctagccaggcct

SEQ ID NO: 9008956 - DNA, 22 bp, Homo sapiens
gactggggctctagccaggcct

SEQ ID NO: 9008957 - DNA, 22 bp, Homo sapiens
gactgggccaaggtcagcagct

SEQ ID NO: 9008958 - DNA, 22 bp, Homo sapiens
gactgggccaaggtcagcagct

SEQ ID NO: 9008959 - DNA, 22 bp, Homo sapiens
gactgggctccaagagggagag

SEQ ID NO: 9008960 - DNA, 21 bp, Homo sapiens
gactgggctgacttgtgctgg

SEQ ID NO: 9008961 - DNA, 22 bp, Homo sapiens
gactggggctctagccaggcct

SEQ ID NO: 9008962 - DNA, 22 bp, Homo sapiens
gagacatggcaaaagcactggt

SEQ ID NO: 9008963 - DNA, 22 bp, Homo sapiens
gagagagaaggcctgtgggtgt

SEQ ID NO: 9008964 - DNA, 22 bp, Homo sapiens
gagagagacatgtaaacgcggt

SEQ ID NO: 9008965 - DNA, 22 bp, Homo sapiens
gagagagaagtgggtgtcacct

SEQ ID NO: 9008966 - DNA, 22 bp, Homo sapiens
gagagagagctaatattaagct

SEQ ID NO: 9008967 - DNA, 22 bp, Homo sapiens
gagagagaggtgctgccaggca

SEQ ID NO: 9008968 - DNA, 22 bp, Homo sapiens
gagagagaggtgctgccaggca

SEQ ID NO: 9008969 - DNA, 22 bp, Homo sapiens
atgttctttgaaatattttaga

SEQ ID NO: 9008970 - DNA, 22 bp, Homo sapiens
atgttctttcagccagtgcatc

SEQ ID NO: 9008971 - DNA, 22 bp, Homo sapiens
atgttctttcagccagtgcatc

SEQ ID NO: 9008972 - DNA, 22 bp, Homo sapiens
atgttctttcagccagtgcatc

SEQ ID NO: 9008973 - DNA, 22 bp, Homo sapiens
atgttcttgttcaaatgtcagt

SEQ ID NO: 9008974 - DNA, 22 bp, Homo sapiens
atgttctttgaaatattttaga

SEQ ID NO: 9008975 - DNA, 22 bp, Homo sapiens
atgttgaactaggatctcttga

SEQ ID NO: 9008976 - DNA, 22 bp, Homo sapiens
atgttgcacaaagtccatccat

SEQ ID NO: 9008977 - DNA, 22 bp, Homo sapiens
atgttgcacaaagtccatccat

SEQ ID NO: 9008978 - DNA, 22 bp, Homo sapiens
atgttcttagcaaagtacttgc

SEQ ID NO: 9008979 - DNA, 20 bp, Homo sapiens
atgttcttcatttaatgttc

SEQ ID NO: 9008980 - DNA, 22 bp, Homo sapiens
atgttcttccaaatctgtaaca

SEQ ID NO: 9008981 - DNA, 22 bp, Homo sapiens
atgttcttgactttcctgcctg

SEQ ID NO: 9008982 - DNA, 20 bp, Homo sapiens
atgtgtctgtaaacaactct

SEQ ID NO: 9008983 - DNA, 22 bp, Homo sapiens
atgtgtctggttattgacatgc

SEQ ID NO: 9008984 - DNA, 22 bp, Homo sapiens
atgtgtctggcatggctctatt

SEQ ID NO: 9008985 - DNA, 22 bp, Homo sapiens
atgtgtctggcatggctctatt

SEQ ID NO: 9008986 - DNA, 20 bp, Homo sapiens
atgtgtcttagagcatcagg

SEQ ID NO: 9008987 - DNA, 22 bp, Homo sapiens
atgtgtctgtgggcacacacac

SEQ ID NO: 9008988 - DNA, 22 bp, Homo sapiens
atgtgtcttctaagccaagcct

SEQ ID NO: 9008989 - DNA, 22 bp, Homo sapiens
atgtgtcttatttgattccaca

SEQ ID NO: 9008990 - DNA, 20 bp, Homo sapiens
atgtgtcttagagcatcagg

SEQ ID NO: 9008991 - DNA, 22 bp, Homo sapiens
atgttctgtttcttaatcttga

SEQ ID NO: 9008992 - DNA, 22 bp, Homo sapiens
atgttctgtttcttaatcttga

SEQ ID NO: 9008993 - DNA, 22 bp, Homo sapiens
atgttctgaatcaagcaactct

SEQ ID NO: 9008994 - DNA, 22 bp, Homo sapiens
atgttctgcctccattttgagt

SEQ ID NO: 9008995 - DNA, 22 bp, Homo sapiens
atgttctgcctccattttgagt

SEQ ID NO: 9008996 - DNA, 19 bp, Homo sapiens
atgttctatcctccaagtt

SEQ ID NO: 9008997 - DNA, 22 bp, Homo sapiens
atgttatttctgaaagatcatt

SEQ ID NO: 9008998 - DNA, 22 bp, Homo sapiens
atgttatttctgaaagatcatt

SEQ ID NO: 9008999 - DNA, 22 bp, Homo sapiens
atgtgtctgatggccctgaatt

SEQ ID NO: 9009000 - DNA, 20 bp, Homo sapiens
atgtgtctgcctctgtgttc

SEQ ID NO: 9009001 - DNA, 17 bp, Homo sapiens
atgtgtctgagtgtcct

SEQ ID NO: 9009002 - DNA, 22 bp, Homo sapiens
atgtgtctggcatggaaagtgt

SEQ ID NO: 9009003 - DNA, 22 bp, Homo sapiens
atgtgtctggcatggaaagtgt

SEQ ID NO: 9009004 - DNA, 22 bp, Homo sapiens
atgtgtctgaccactgtattgg

SEQ ID NO: 9009005 - DNA, 17 bp, Homo sapiens
atgtgtctgagtgtcct

SEQ ID NO: 9009006 - DNA, 22 bp, Homo sapiens
atgtgtctctaccaatgcaatt

SEQ ID NO: 9009007 - DNA, 22 bp, Homo sapiens
atgtgtctctaccaatgcaatt

SEQ ID NO: 9009008 - DNA, 22 bp, Homo sapiens
gaggtggcctcaagcagtcttc

SEQ ID NO: 9009009 - DNA, 22 bp, Homo sapiens
gaggtggcgcgccatccctgcc

SEQ ID NO: 9009010 - DNA, 22 bp, Homo sapiens
gaggtggcgcgccatccctgcc

SEQ ID NO: 9009011 - DNA, 22 bp, Homo sapiens
gaggtggcgcgccatccctgcc

SEQ ID NO: 9009012 - DNA, 22 bp, Homo sapiens
atgtgtctctaaaatttagtaa

SEQ ID NO: 9009013 - DNA, 17 bp, Homo sapiens
atgtgtctagtgcaacc

SEQ ID NO: 9009014 - DNA, 22 bp, Homo sapiens
atgtgtctagattgctgtaccg

SEQ ID NO: 9009015 - DNA, 22 bp, Homo sapiens
atgtgtctaattccaggagcac

SEQ ID NO: 9009016 - DNA, 22 bp, Homo sapiens
atgtgtccttgttcccattcca

SEQ ID NO: 9009017 - DNA, 22 bp, Homo sapiens
atgtgtccttataagaagaaga

SEQ ID NO: 9009018 - DNA, 22 bp, Homo sapiens
atgtgtctaattccaggagcac

SEQ ID NO: 9009019 - DNA, 22 bp, Homo sapiens
gaggtggcactgtgaggagcac

SEQ ID NO: 9009020 - DNA, 22 bp, Homo sapiens
gaggtggcactgtgaggagcac

SEQ ID NO: 9009021 - DNA, 22 bp, Homo sapiens
gaggtggcactgtgaggagcac

SEQ ID NO: 9009022 - DNA, 23 bp, Homo sapiens
gaggtggcaatgagggcagttgg

SEQ ID NO: 9009023 - DNA, 22 bp, Homo sapiens
gaggtggcaatttaatgcagtc

SEQ ID NO: 9009024 - DNA, 22 bp, Homo sapiens
gaggtggcactgtgaggagcac

SEQ ID NO: 9009025 - DNA, 22 bp, Homo sapiens
gaggtggcactgtgaggagcac

SEQ ID NO: 9009026 - DNA, 22 bp, Homo sapiens
gaggtggcactgtgaggagcac

SEQ ID NO: 9009027 - DNA, 22 bp, Homo sapiens
gaggtggcactgtgaggagcac

SEQ ID NO: 9009028 - DNA, 22 bp, Homo sapiens
gaggtggcagaggcctggacct

SEQ ID NO: 9009029 - DNA, 22 bp, Homo sapiens
gaggtggcagaggcctggacct

SEQ ID NO: 9009030 - DNA, 22 bp, Homo sapiens
gaggtggccagagtcaagagcc

SEQ ID NO: 9009031 - DNA, 22 bp, Homo sapiens
gaggtggccagagtcaagagcc

SEQ ID NO: 9009032 - DNA, 22 bp, Homo sapiens
gaggtggccaagcgaggaaggg

SEQ ID NO: 9009033 - DNA, 22 bp, Homo sapiens
gaggtggccaagcgaggaaggg

SEQ ID NO: 9009034 - DNA, 22 bp, Homo sapiens
gaggtggccaagcgaggaaggg

SEQ ID NO: 9009035 - DNA, 22 bp, Homo sapiens
gaggtggcccttgctcagcctt

SEQ ID NO: 9009036 - DNA, 22 bp, Homo sapiens
gaggtggcccttgctcagcctt

SEQ ID NO: 9009037 - DNA, 22 bp, Homo sapiens
gaggtggcccttgctcagcctt

SEQ ID NO: 9009038 - DNA, 22 bp, Homo sapiens
gaggtggcccttgctcagcctt

SEQ ID NO: 9009039 - DNA, 22 bp, Homo sapiens
gaggtggcccttgctcagcctt

SEQ ID NO: 9009040 - DNA, 22 bp, Homo sapiens
gaggtggcctcaagcagtcttc

SEQ ID NO: 9009041 - DNA, 22 bp, Homo sapiens
gaggtggcctcaagcagtcttc

SEQ ID NO: 9009042 - DNA, 22 bp, Homo sapiens
gaggtggcctcaagcagtcttc

SEQ ID NO: 9009043 - DNA, 22 bp, Homo sapiens
gaggtggcctcaagcagtcttc

SEQ ID NO: 9009044 - DNA, 22 bp, Homo sapiens
gatacaaaatataaatggagag

SEQ ID NO: 9009045 - DNA, 22 bp, Homo sapiens
gatacaaaatataaatggagag

SEQ ID NO: 9009046 - DNA, 22 bp, Homo sapiens
gatacaaaatataaatggagag

SEQ ID NO: 9009047 - DNA, 22 bp, Homo sapiens
gatacaaaatataaatggagag

SEQ ID NO: 9009048 - DNA, 22 bp, Homo sapiens
gatacaaaatataaatggagag

SEQ ID NO: 9009049 - DNA, 22 bp, Homo sapiens
gatacaaattcatgtctgaatt

SEQ ID NO: 9009050 - DNA, 22 bp, Homo sapiens
gatacaaaatataaatggagag

SEQ ID NO: 9009051 - DNA, 22 bp, Homo sapiens
gatacaaaatataaatggagag

SEQ ID NO: 9009052 - DNA, 22 bp, Homo sapiens
gatacaaaatataaatggagag

SEQ ID NO: 9009053 - DNA, 22 bp, Homo sapiens
gataattttagtctgaaaattg

SEQ ID NO: 9009054 - DNA, 22 bp, Homo sapiens
gataattttagtctgaaaattg

SEQ ID NO: 9009055 - DNA, 22 bp, Homo sapiens
gataattttggttccaggttgg

SEQ ID NO: 9009056 - DNA, 22 bp, Homo sapiens
gataattttagtctgaaaattg

SEQ ID NO: 9009057 - DNA, 22 bp, Homo sapiens
gataattttagtctgaaaattg

SEQ ID NO: 9009058 - DNA, 22 bp, Homo sapiens
gataatttgatacctcaatcag

SEQ ID NO: 9009059 - DNA, 22 bp, Homo sapiens
gataatttctccatctcaaggt

SEQ ID NO: 9009060 - DNA, 22 bp, Homo sapiens
gataatttctccatctcaaggt

SEQ ID NO: 9009061 - DNA, 22 bp, Homo sapiens
gataatttctccatctcaaggt

SEQ ID NO: 9009062 - DNA, 22 bp, Homo sapiens
gataatttgatacctcaatcag

SEQ ID NO: 9009063 - DNA, 22 bp, Homo sapiens
gataattataggctaagccact

SEQ ID NO: 9009064 - DNA, 22 bp, Homo sapiens
gataattataggctaagccact

SEQ ID NO: 9009065 - DNA, 22 bp, Homo sapiens
gataatttaagtcttgggggct

SEQ ID NO: 9009066 - DNA, 22 bp, Homo sapiens
gataatgatgacaatgacaacc

SEQ ID NO: 9009067 - DNA, 22 bp, Homo sapiens
gataatgtgccgataatttcta

SEQ ID NO: 9009068 - DNA, 22 bp, Homo sapiens
gataatgtggatttattgtgat

SEQ ID NO: 9009069 - DNA, 22 bp, Homo sapiens
gataatgtggatttattgtgat

SEQ ID NO: 9009070 - DNA, 22 bp, Homo sapiens
gataatgtggatttattgtgat

SEQ ID NO: 9009071 - DNA, 22 bp, Homo sapiens
gataatgtgccgataatttcta

SEQ ID NO: 9009072 - DNA, 22 bp, Homo sapiens
gatacaaattcatgtctgaatt

SEQ ID NO: 9009073 - DNA, 22 bp, Homo sapiens
gatacaaattcatgtctgaatt

SEQ ID NO: 9009074 - DNA, 22 bp, Homo sapiens
gatacaaattcatgtctgaatt

SEQ ID NO: 9009075 - DNA, 22 bp, Homo sapiens
gatacaaattcatgtctgaatt

SEQ ID NO: 9009076 - DNA, 22 bp, Homo sapiens
gatacaaattcatgtctgaatt

SEQ ID NO: 9009077 - DNA, 22 bp, Homo sapiens
gatacaaattcatgtctgaatt

SEQ ID NO: 9009078 - DNA, 22 bp, Homo sapiens
gatacacaaaagtctagtgagg

SEQ ID NO: 9009079 - DNA, 22 bp, Homo sapiens
gatacacaaaagtctagtgagg

SEQ ID NO: 9009080 - DNA, 22 bp, Homo sapiens
gatacacaagtggaaggagacg

SEQ ID NO: 9009081 - DNA, 22 bp, Homo sapiens
gatacaagactaataggaaaca

SEQ ID NO: 9009082 - DNA, 22 bp, Homo sapiens
gatacaagactaataggaaaca

SEQ ID NO: 9009083 - DNA, 22 bp, Homo sapiens
gatacaaattcatgtctgaatt

SEQ ID NO: 9009084 - DNA, 22 bp, Homo sapiens
gatacacaagtggaaggagacg

SEQ ID NO: 9009085 - DNA, 22 bp, Homo sapiens
gatacacaagtggaaggagacg

SEQ ID NO: 9009086 - DNA, 22 bp, Homo sapiens
gatacacaagtggaaggagacg

SEQ ID NO: 9009087 - DNA, 22 bp, Homo sapiens
gatacacaagtggaaggagacg

SEQ ID NO: 9009088 - DNA, 19 bp, Homo sapiens
gatatgaacgttactggcc

SEQ ID NO: 9009089 - DNA, 22 bp, Homo sapiens
gatatgaagtggcattgtgaag

SEQ ID NO: 9009090 - DNA, 22 bp, Homo sapiens
gatatgaagtggcattgtgaag

SEQ ID NO: 9009091 - DNA, 22 bp, Homo sapiens
gatatgcacattcaaaaattgc

SEQ ID NO: 9009092 - DNA, 19 bp, Homo sapiens
gatatgaacgttactggcc

SEQ ID NO: 9009093 - DNA, 22 bp, Homo sapiens
gatatcatgggaaggtgtactt

SEQ ID NO: 9009094 - DNA, 22 bp, Homo sapiens
gatatcattgagcccaggagtt

SEQ ID NO: 9009095 - DNA, 22 bp, Homo sapiens
gatatgtaccacctcttaaaag

SEQ ID NO: 9009096 - DNA, 22 bp, Homo sapiens
gatatgtatgaggagtatgtat

SEQ ID NO: 9009097 - DNA, 18 bp, Homo sapiens
gatatggaaggccatgcc

SEQ ID NO: 9009098 - DNA, 22 bp, Homo sapiens
atgttgtgtttgactgttaccc

SEQ ID NO: 9009099 - DNA, 22 bp, Homo sapiens
atgttgtgtttgactgttaccc

SEQ ID NO: 9009100 - DNA, 22 bp, Homo sapiens
atgttgtgtttgactgttaccc

SEQ ID NO: 9009101 - DNA, 22 bp, Homo sapiens
atgttgtattatgttattgtct

SEQ ID NO: 9009102 - DNA, 22 bp, Homo sapiens
atgttgttttttcataaagtat

SEQ ID NO: 9009103 - DNA, 22 bp, Homo sapiens
atgtttaaaggagtcagagact

SEQ ID NO: 9009104 - DNA, 22 bp, Homo sapiens
atgtttaaaggagtcagagact

SEQ ID NO: 9009105 - DNA, 22 bp, Homo sapiens
atgttgggaaggccgcaggcac

SEQ ID NO: 9009106 - DNA, 22 bp, Homo sapiens
atgttggagtcgtaaggcatgg

SEQ ID NO: 9009107 - DNA, 22 bp, Homo sapiens
atgttggagtcgtaaggcatgg

SEQ ID NO: 9009108 - DNA, 22 bp, Homo sapiens
atgttggagtcgtaaggcatgg

SEQ ID NO: 9009109 - DNA, 22 bp, Homo sapiens
atgttggagtcgtaaggcatgg

SEQ ID NO: 9009110 - DNA, 22 bp, Homo sapiens
atgttgcccattccaggagata

SEQ ID NO: 9009111 - DNA, 22 bp, Homo sapiens
atgtttaatcggctgcctttcc

SEQ ID NO: 9009112 - DNA, 22 bp, Homo sapiens
atgtttaatcggctgcctttcc

SEQ ID NO: 9009113 - DNA, 22 bp, Homo sapiens
gagttcatattcagagatcgct

SEQ ID NO: 9009114 - DNA, 22 bp, Homo sapiens
gataatatctggtttattcacc

SEQ ID NO: 9009115 - DNA, 22 bp, Homo sapiens
gataatatctggtttattcacc

SEQ ID NO: 9009116 - DNA, 22 bp, Homo sapiens
gagttctaaaggcagaacataa

SEQ ID NO: 9009117 - DNA, 22 bp, Homo sapiens
atgtttaagaaagtcttccata

SEQ ID NO: 9009118 - DNA, 22 bp, Homo sapiens
atgtttaagaaagtcttccata

SEQ ID NO: 9009119 - DNA, 22 bp, Homo sapiens
atgtttaagaaagtcttccata

SEQ ID NO: 9009120 - DNA, 22 bp, Homo sapiens
atgtttaaggaactggtttgct

SEQ ID NO: 9009121 - DNA, 22 bp, Homo sapiens
atgtttaaggaactggtttgct

SEQ ID NO: 9009122 - DNA, 22 bp, Homo sapiens
atgtttaagaaagtcttccata

SEQ ID NO: 9009123 - DNA, 22 bp, Homo sapiens
atgtttaagaaagtcttccata

SEQ ID NO: 9009124 - DNA, 22 bp, Homo sapiens
atgtttaaatttatagacagtg

SEQ ID NO: 9009125 - DNA, 22 bp, Homo sapiens
atgtttaaatttatagacagtg

SEQ ID NO: 9009126 - DNA, 22 bp, Homo sapiens
atgtttaaatttatagacagtg

SEQ ID NO: 9009127 - DNA, 22 bp, Homo sapiens
atgtttaaagggttgagaaata

SEQ ID NO: 9009128 - DNA, 22 bp, Homo sapiens
atgtttaaagggttgagaaata

SEQ ID NO: 9009129 - DNA, 22 bp, Homo sapiens
atgtttaaagggttgagaaata

SEQ ID NO: 9009130 - DNA, 22 bp, Homo sapiens
atgtttaaaggagtcagagact

SEQ ID NO: 9009131 - DNA, 22 bp, Homo sapiens
atgtttaaagggttgagaaata

SEQ ID NO: 9009132 - DNA, 22 bp, Homo sapiens
atgtgaaagaggtgttcagtgg

SEQ ID NO: 9009133 - DNA, 22 bp, Homo sapiens
atgtgaaagaggtgttcagtgg

SEQ ID NO: 9009134 - DNA, 20 bp, Homo sapiens
atgtgaaagatcagttgtct

SEQ ID NO: 9009135 - DNA, 20 bp, Homo sapiens
atgtgaaagatcagttgtct

SEQ ID NO: 9009136 - DNA, 20 bp, Homo sapiens
atgtgaaagatcagttgtct

SEQ ID NO: 9009137 - DNA, 20 bp, Homo sapiens
atgtgaaagatcagttgtct

SEQ ID NO: 9009138 - DNA, 20 bp, Homo sapiens
atgtgaaagatcagttgtct

SEQ ID NO: 9009139 - DNA, 22 bp, Homo sapiens
atgtgaaatagctggatatgaa

SEQ ID NO: 9009140 - DNA, 22 bp, Homo sapiens
atgtgaaactgaagcatccata

SEQ ID NO: 9009141 - DNA, 22 bp, Homo sapiens
atgtgaaactgaagcatccata

SEQ ID NO: 9009142 - DNA, 22 bp, Homo sapiens
atgtgaaacgcaatgggatcat

SEQ ID NO: 9009143 - DNA, 22 bp, Homo sapiens
atgtgaaacgcaatgggatcat

SEQ ID NO: 9009144 - DNA, 22 bp, Homo sapiens
atgtgaaacgcaatgggatcat

SEQ ID NO: 9009145 - DNA, 22 bp, Homo sapiens
gagggctgaagattgtggcccc

SEQ ID NO: 9009146 - DNA, 22 bp, Homo sapiens
gagggctgaagattgtggcccc

SEQ ID NO: 9009147 - DNA, 22 bp, Homo sapiens
atgtgaagcttgtgctaacata

SEQ ID NO: 9009148 - DNA, 21 bp, Homo sapiens
atgtgaaatatcatcagagca

SEQ ID NO: 9009149 - DNA, 21 bp, Homo sapiens
atgtgaaatatcatcagagca

SEQ ID NO: 9009150 - DNA, 21 bp, Homo sapiens
atgtgaaatatcatcagagca

SEQ ID NO: 9009151 - DNA, 22 bp, Homo sapiens
atgtgaaatagctggatatgaa

SEQ ID NO: 9009152 - DNA, 20 bp, Homo sapiens
atgtgaagtaggaagggtgt

SEQ ID NO: 9009153 - DNA, 22 bp, Homo sapiens
atgtgaatgcagttatctataa

SEQ ID NO: 9009154 - DNA, 22 bp, Homo sapiens
atgtgacagtgtttgacagatg

SEQ ID NO: 9009155 - DNA, 22 bp, Homo sapiens
atgtgaggcagcacggagatta

SEQ ID NO: 9009156 - DNA, 22 bp, Homo sapiens
atgtgaggaagaaagaggtaag

SEQ ID NO: 9009157 - DNA, 22 bp, Homo sapiens
atgtgaggaagaaagaggtaag

SEQ ID NO: 9009158 - DNA, 22 bp, Homo sapiens
atgtgacagtgtttgacagatg

SEQ ID NO: 9009159 - DNA, 22 bp, Homo sapiens
atgtgagatgcacataattata

SEQ ID NO: 9009160 - DNA, 22 bp, Homo sapiens
atgtgactccaggcagttttgt

SEQ ID NO: 9009161 - DNA, 22 bp, Homo sapiens
gaggtggatgttgcagtgagct

SEQ ID NO: 9009162 - DNA, 22 bp, Homo sapiens
gaggtggatgttgcagtgagct

SEQ ID NO: 9009163 - DNA, 22 bp, Homo sapiens
gaggtggatgttgcagtgagct

SEQ ID NO: 9009164 - DNA, 22 bp, Homo sapiens
gaggtggatgttgcagtgagct

SEQ ID NO: 9009165 - DNA, 22 bp, Homo sapiens
atgtgagggctcaggctgactg

SEQ ID NO: 9009166 - DNA, 22 bp, Homo sapiens
atgtgagggctcaggctgactg

SEQ ID NO: 9009167 - DNA, 22 bp, Homo sapiens
atgtgagggaaatcagtcagaa

SEQ ID NO: 9009168 - DNA, 22 bp, Homo sapiens
gaggtagggcagaggctgaatg

SEQ ID NO: 9009169 - DNA, 22 bp, Homo sapiens
gaggtagggcagaggctgaatg

SEQ ID NO: 9009170 - DNA, 22 bp, Homo sapiens
gagggctgaagattgtggcccc

SEQ ID NO: 9009171 - DNA, 22 bp, Homo sapiens
gagggctgaagattgtggcccc

SEQ ID NO: 9009172 - DNA, 22 bp, Homo sapiens
gagggctgaagattgtggcccc

SEQ ID NO: 9009173 - DNA, 22 bp, Homo sapiens
gagggctgaagattgtggcccc

SEQ ID NO: 9009174 - DNA, 22 bp, Homo sapiens
gagggctgaagattgtggcccc

SEQ ID NO: 9009175 - DNA, 22 bp, Homo sapiens
gagggctgaagattgtggcccc

SEQ ID NO: 9009176 - DNA, 22 bp, Homo sapiens
gagggctctgtctggaagggaa

SEQ ID NO: 9009177 - DNA, 22 bp, Homo sapiens
gagggctctgtctggaagggaa

SEQ ID NO: 9009178 - DNA, 22 bp, Homo sapiens
gagggctctgtctggaagggaa

SEQ ID NO: 9009179 - DNA, 22 bp, Homo sapiens
gagggctctgaaaggaggtcac

SEQ ID NO: 9009180 - DNA, 23 bp, Homo sapiens
gagggctctgagtgcttgggcca

SEQ ID NO: 9009181 - DNA, 23 bp, Homo sapiens
gagggctctgagtgcttgggcca

SEQ ID NO: 9009182 - DNA, 20 bp, Homo sapiens
gagggctcgtggatggataa

SEQ ID NO: 9009183 - DNA, 22 bp, Homo sapiens
gagggctctaccaagtaactct

SEQ ID NO: 9009184 - DNA, 22 bp, Homo sapiens
gagggctctaccaagtaactct

SEQ ID NO: 9009185 - DNA, 22 bp, Homo sapiens
gagggctcctcacattctctat

SEQ ID NO: 9009186 - DNA, 22 bp, Homo sapiens
gagggctcctcacattctctat

SEQ ID NO: 9009187 - DNA, 19 bp, Homo sapiens
gagggctcatttgaacaat

SEQ ID NO: 9009188 - DNA, 19 bp, Homo sapiens
gagggctcatttgaacaat

SEQ ID NO: 9009189 - DNA, 22 bp, Homo sapiens
gagggctccattccccgtgccc

SEQ ID NO: 9009190 - DNA, 22 bp, Homo sapiens
gagggctcactgagaaagcagt

SEQ ID NO: 9009191 - DNA, 23 bp, Homo sapiens
atgtctctgggcagtagggcttg

SEQ ID NO: 9009192 - DNA, 19 bp, Homo sapiens
atgtctctgtagcacatac

SEQ ID NO: 9009193 - DNA, 19 bp, Homo sapiens
atgtctctgtagcacatac

SEQ ID NO: 9009194 - DNA, 19 bp, Homo sapiens
atgtctctgtagcacatac

SEQ ID NO: 9009195 - DNA, 19 bp, Homo sapiens
atgtctctgtagcacatac

SEQ ID NO: 9009196 - DNA, 19 bp, Homo sapiens
atgtctctgtagcacatac

SEQ ID NO: 9009197 - DNA, 22 bp, Homo sapiens
atgtctctttagagcaacagta

SEQ ID NO: 9009198 - DNA, 22 bp, Homo sapiens
atgtctctttactcttagaacc

SEQ ID NO: 9009199 - DNA, 22 bp, Homo sapiens
atgtctctttactcttagaacc

SEQ ID NO: 9009200 - DNA, 20 bp, Homo sapiens
atgtctgaagtaatccattt

SEQ ID NO: 9009201 - DNA, 20 bp, Homo sapiens
atgtctgaagtaatccattt

SEQ ID NO: 9009202 - DNA, 22 bp, Homo sapiens
atgtctgagtctgctccagttg

SEQ ID NO: 9009203 - DNA, 22 bp, Homo sapiens
atgtctgcgttatatcaatatc

SEQ ID NO: 9009204 - DNA, 22 bp, Homo sapiens
atgtctgataaataatgcataa

SEQ ID NO: 9009205 - DNA, 22 bp, Homo sapiens
gagggcgatggtttcagtttct

SEQ ID NO: 9009206 - DNA, 22 bp, Homo sapiens
gagggcagaaaattatgcggtg

SEQ ID NO: 9009207 - DNA, 22 bp, Homo sapiens
gagggcctggcacagggaggct

SEQ ID NO: 9009208 - DNA, 22 bp, Homo sapiens
gagggcagagacagtgattcac

SEQ ID NO: 9009209 - DNA, 22 bp, Homo sapiens
atgtctgctattcatagggaaa

SEQ ID NO: 9009210 - DNA, 22 bp, Homo sapiens
gagggcagaaaattatgcggtg

SEQ ID NO: 9009211 - DNA, 22 bp, Homo sapiens
atgtctgctattcatagggaaa

SEQ ID NO: 9009212 - DNA, 22 bp, Homo sapiens
gagggcgatggtttcagtttct

SEQ ID NO: 9009213 - DNA, 22 bp, Homo sapiens
gagggcgttcagtcagtgtctc

SEQ ID NO: 9009214 - DNA, 22 bp, Homo sapiens
gagggcgttcagtcagtgtctc

SEQ ID NO: 9009215 - DNA, 22 bp, Homo sapiens
gagggctcaactactactaggc

SEQ ID NO: 9009216 - DNA, 22 bp, Homo sapiens
gagggctcaactactactaggc

SEQ ID NO: 9009217 - DNA, 22 bp, Homo sapiens
atgtcatttaaatgtttgtata

SEQ ID NO: 9009218 - DNA, 22 bp, Homo sapiens
atgtcccagctgagagacaact

SEQ ID NO: 9009219 - DNA, 22 bp, Homo sapiens
atgtcattaaaattgtgctgca

SEQ ID NO: 9009220 - DNA, 22 bp, Homo sapiens
atgtcatgggccaaaaatagtt

SEQ ID NO: 9009221 - DNA, 22 bp, Homo sapiens
atgtcatgggccaaaaatagtt

SEQ ID NO: 9009222 - DNA, 22 bp, Homo sapiens
atgtagcatctatcctgataaa

SEQ ID NO: 9009223 - DNA, 22 bp, Homo sapiens
atgtagcatctatcctgataaa

SEQ ID NO: 9009224 - DNA, 22 bp, Homo sapiens
atgtagctgcagatgataatgc

SEQ ID NO: 9009225 - DNA, 22 bp, Homo sapiens
atgtcatgaaatgctactaact

SEQ ID NO: 9009226 - DNA, 22 bp, Homo sapiens
atgtcatgaaatgctactaact

SEQ ID NO: 9009227 - DNA, 22 bp, Homo sapiens
atgtagatttgcttctcctgcc

SEQ ID NO: 9009228 - DNA, 22 bp, Homo sapiens
atgtagatgttggtttaaattt

SEQ ID NO: 9009229 - DNA, 20 bp, Homo sapiens
atgtagatgaaagcaaaggc

SEQ ID NO: 9009230 - DNA, 22 bp, Homo sapiens
atgtagaagtgggcattataga

SEQ ID NO: 9009231 - DNA, 22 bp, Homo sapiens
atgtagaagtgggcattataga

SEQ ID NO: 9009232 - DNA, 22 bp, Homo sapiens
atgtagaatggtgattggcagg

SEQ ID NO: 9009233 - DNA, 22 bp, Homo sapiens
atgtagaagtgggcattataga

SEQ ID NO: 9009234 - DNA, 22 bp, Homo sapiens
atgtagaagctgacagtgctgt

SEQ ID NO: 9009235 - DNA, 22 bp, Homo sapiens
atgtagaacaggttaatgacag

SEQ ID NO: 9009236 - DNA, 22 bp, Homo sapiens
atgtagaattccttctactttg

SEQ ID NO: 9009237 - DNA, 22 bp, Homo sapiens
atgtagaattccttctactttg

SEQ ID NO: 9009238 - DNA, 22 bp, Homo sapiens
atgtagagcagtgttgtccaat

SEQ ID NO: 9009239 - DNA, 22 bp, Homo sapiens
atgtagaggagtttctggtctg

SEQ ID NO: 9009240 - DNA, 22 bp, Homo sapiens
atgtagagctccttgatcctcc

SEQ ID NO: 9009241 - DNA, 22 bp, Homo sapiens
atgtagagtagaatagtacaac

SEQ ID NO: 9009242 - DNA, 22 bp, Homo sapiens
atgtagagggtttggccaggag

SEQ ID NO: 9009243 - DNA, 22 bp, Homo sapiens
gaggcagcggctcacagagaaa

SEQ ID NO: 9009244 - DNA, 22 bp, Homo sapiens
gaggcagcgggtcaggaccgtg

SEQ ID NO: 9009245 - DNA, 22 bp, Homo sapiens
gaggcagcgggtcaggaccgtg

SEQ ID NO: 9009246 - DNA, 22 bp, Homo sapiens
gaggcagcgggtcaggaccgtg

SEQ ID NO: 9009247 - DNA, 22 bp, Homo sapiens
atgtagaaattaggatgatagt

SEQ ID NO: 9009248 - DNA, 22 bp, Homo sapiens
atgtagaacaggttaatgacag

SEQ ID NO: 9009249 - DNA, 22 bp, Homo sapiens
atgtagaacaggttaatgacag

SEQ ID NO: 9009250 - DNA, 22 bp, Homo sapiens
atgtagaacaggttaatgacag

SEQ ID NO: 9009251 - DNA, 22 bp, Homo sapiens
atgtagaaattaggatgatagt

SEQ ID NO: 9009252 - DNA, 22 bp, Homo sapiens
atgtagaaagttcatagatgcg

SEQ ID NO: 9009253 - DNA, 22 bp, Homo sapiens
atgtagaaataatttcagttcc

SEQ ID NO: 9009254 - DNA, 22 bp, Homo sapiens
atgtcctggtcctccaccatgg

SEQ ID NO: 9009255 - DNA, 20 bp, Homo sapiens
atgtcctgttgctgccccag

SEQ ID NO: 9009256 - DNA, 23 bp, Homo sapiens
atgtcctgtgatgcttaatgacc

SEQ ID NO: 9009257 - DNA, 22 bp, Homo sapiens
atgtcctggtctagcttccggg

SEQ ID NO: 9009258 - DNA, 22 bp, Homo sapiens
atgtcctggtcctccaccatgg

SEQ ID NO: 9009259 - DNA, 21 bp, Homo sapiens
atgtcctggctaccagcgcag

SEQ ID NO: 9009260 - DNA, 21 bp, Homo sapiens
atgtcctggctaccagcgcag

SEQ ID NO: 9009261 - DNA, 20 bp, Homo sapiens
atgtcctgcttctcctcacc

SEQ ID NO: 9009262 - DNA, 20 bp, Homo sapiens
atgtcctgcttctcctcacc

SEQ ID NO: 9009263 - DNA, 22 bp, Homo sapiens
atgtcctgctgattcacattat

SEQ ID NO: 9009264 - DNA, 23 bp, Homo sapiens
atgtcctgcatagttgcttctgt

SEQ ID NO: 9009265 - DNA, 23 bp, Homo sapiens
atgtcctgcatagttgcttctgt

SEQ ID NO: 9009266 - DNA, 22 bp, Homo sapiens
atgtccttaatctgaatgttag

SEQ ID NO: 9009267 - DNA, 22 bp, Homo sapiens
atgtcctgttttggcttgctct

SEQ ID NO: 9009268 - DNA, 22 bp, Homo sapiens
atgtccttccattttgatctgt

SEQ ID NO: 9009269 - DNA, 22 bp, Homo sapiens
atgtctctgctgtggttagctt

SEQ ID NO: 9009270 - DNA, 19 bp, Homo sapiens
atgtctctgtagcacatac

SEQ ID NO: 9009271 - DNA, 22 bp, Homo sapiens
atgtctctgctgtggttagctt

SEQ ID NO: 9009272 - DNA, 22 bp, Homo sapiens
atgtctctgccccagagagctt

SEQ ID NO: 9009273 - DNA, 22 bp, Homo sapiens
atgtctctgctgtggttagctt

SEQ ID NO: 9009274 - DNA, 22 bp, Homo sapiens
atgtctctctctgagtgccaga

SEQ ID NO: 9009275 - DNA, 22 bp, Homo sapiens
atgtctctctctgagtgccaga

SEQ ID NO: 9009276 - DNA, 22 bp, Homo sapiens
atgtctctgccccagagagctt

SEQ ID NO: 9009277 - DNA, 22 bp, Homo sapiens
atgtctctgccccagagagctt

SEQ ID NO: 9009278 - DNA, 22 bp, Homo sapiens
atgtctctcaggtttaacttta

SEQ ID NO: 9009279 - DNA, 22 bp, Homo sapiens
atgtctctcaggtttaacttta

SEQ ID NO: 9009280 - DNA, 22 bp, Homo sapiens
atgtctctgccccagagagctt

SEQ ID NO: 9009281 - DNA, 22 bp, Homo sapiens
atgtctctctctgagtgccaga

SEQ ID NO: 9009282 - DNA, 22 bp, Homo sapiens
atgtctctcatgaccaaagaag

SEQ ID NO: 9009283 - DNA, 22 bp, Homo sapiens
atgtctctcatgaccaaagaag

SEQ ID NO: 9009284 - DNA, 22 bp, Homo sapiens
atgtctctcaggtttaacttta

SEQ ID NO: 9009285 - DNA, 22 bp, Homo sapiens
atgtccttttaaaatgtgagaa

SEQ ID NO: 9009286 - DNA, 22 bp, Homo sapiens
atgtccttttatttaaagcagg

SEQ ID NO: 9009287 - DNA, 22 bp, Homo sapiens
atgtctatgttctttactgtgt

SEQ ID NO: 9009288 - DNA, 22 bp, Homo sapiens
atgtctatggaatttccacaca

SEQ ID NO: 9009289 - DNA, 22 bp, Homo sapiens
atgtctatatagtcaataatca

SEQ ID NO: 9009290 - DNA, 22 bp, Homo sapiens
atgtctatatagtcaataatca

SEQ ID NO: 9009291 - DNA, 22 bp, Homo sapiens
atgtctatatagtcaataatca

SEQ ID NO: 9009292 - DNA, 22 bp, Homo sapiens
atgtctagagcaagagatgctg

SEQ ID NO: 9009293 - DNA, 22 bp, Homo sapiens
atgtctatatagtcaataatca

SEQ ID NO: 9009294 - DNA, 22 bp, Homo sapiens
atgtctagagcaagagatgctg

SEQ ID NO: 9009295 - DNA, 22 bp, Homo sapiens
ctttccaggaatcctcacagcc

SEQ ID NO: 9009296 - DNA, 22 bp, Homo sapiens
ctttccaggacttgcatttctg

SEQ ID NO: 9009297 - DNA, 19 bp, Homo sapiens
ctttccaggagatgctgag

SEQ ID NO: 9009298 - DNA, 22 bp, Homo sapiens
ctttccagtttctaagtacagt

SEQ ID NO: 9009299 - DNA, 22 bp, Homo sapiens
ctttccagtaccaggaagcgga

SEQ ID NO: 9009300 - DNA, 22 bp, Homo sapiens
ctttccagtaccaggaagcgga

SEQ ID NO: 9009301 - DNA, 22 bp, Homo sapiens
ctttccaggctgagtttgcttg

SEQ ID NO: 9009302 - DNA, 22 bp, Homo sapiens
ctttccaggtctaaaggcaggg

SEQ ID NO: 9009303 - DNA, 22 bp, Homo sapiens
atctggctattgacatgttata

SEQ ID NO: 9009304 - DNA, 22 bp, Homo sapiens
atctggctattgacatgttata

SEQ ID NO: 9009305 - DNA, 22 bp, Homo sapiens
ctttcaaaacgctctgtatgca

SEQ ID NO: 9009306 - DNA, 22 bp, Homo sapiens
atctggctcacttagtctagga

SEQ ID NO: 9009307 - DNA, 22 bp, Homo sapiens
ctttccagcatttccttgtgaa

SEQ ID NO: 9009308 - DNA, 22 bp, Homo sapiens
ctttccagcatttccttgtgaa

SEQ ID NO: 9009309 - DNA, 22 bp, Homo sapiens
ctttcaaagaccttggcatggg

SEQ ID NO: 9009310 - DNA, 22 bp, Homo sapiens
ctttcaaagaccttggcatggg

SEQ ID NO: 9009311 - DNA, 22 bp, Homo sapiens
ctttcaaagagtaggaggtttt

SEQ ID NO: 9009312 - DNA, 22 bp, Homo sapiens
atgaaaagttcgatctagaagg

SEQ ID NO: 9009313 - DNA, 22 bp, Homo sapiens
atgaaaagttcgatctagaagg

SEQ ID NO: 9009314 - DNA, 22 bp, Homo sapiens
atgaaaagttcgatctagaagg

SEQ ID NO: 9009315 - DNA, 22 bp, Homo sapiens
ctttcctagtagttacagaatg

SEQ ID NO: 9009316 - DNA, 22 bp, Homo sapiens
ctttcctagatggccatctttc

SEQ ID NO: 9009317 - DNA, 22 bp, Homo sapiens
ctttcccttagccccattctat

SEQ ID NO: 9009318 - DNA, 22 bp, Homo sapiens
ctttcctagaaatatatactta

SEQ ID NO: 9009319 - DNA, 22 bp, Homo sapiens
ctttcccttttgccttgcgtgg

SEQ ID NO: 9009320 - DNA, 22 bp, Homo sapiens
ctttccctgcttagaaggattt

SEQ ID NO: 9009321 - DNA, 22 bp, Homo sapiens
ctttccctgcttagaaggattt

SEQ ID NO: 9009322 - DNA, 22 bp, Homo sapiens
ctttcccttagccccattctat

SEQ ID NO: 9009323 - DNA, 22 bp, Homo sapiens
ctttcccttagccccattctat

SEQ ID NO: 9009324 - DNA, 22 bp, Homo sapiens
ctttcccagagtagttgatgct

SEQ ID NO: 9009325 - DNA, 22 bp, Homo sapiens
ctttccccagtatatcattgcc

SEQ ID NO: 9009326 - DNA, 22 bp, Homo sapiens
atctggataggttgttttgcat

SEQ ID NO: 9009327 - DNA, 22 bp, Homo sapiens
atctggattctagatctagatc

SEQ ID NO: 9009328 - DNA, 22 bp, Homo sapiens
atctggagtttcagttttctgg

SEQ ID NO: 9009329 - DNA, 22 bp, Homo sapiens
atctggagtgggacacagaaat

SEQ ID NO: 9009330 - DNA, 22 bp, Homo sapiens
atctggaggattctgggacttg

SEQ ID NO: 9009331 - DNA, 22 bp, Homo sapiens
atctggaggcaaaggggcgtga

SEQ ID NO: 9009332 - DNA, 18 bp, Homo sapiens
cttcttgtttgatttggg

SEQ ID NO: 9009333 - DNA, 22 bp, Homo sapiens
cttcttgttgttagggtcctgt

SEQ ID NO: 9009334 - DNA, 22 bp, Homo sapiens
cttcttgtgcactctctatgta

SEQ ID NO: 9009335 - DNA, 22 bp, Homo sapiens
cttcttgtgctgggccagcttc

SEQ ID NO: 9009336 - DNA, 22 bp, Homo sapiens
cttcttgtcagtgatttcttcc

SEQ ID NO: 9009337 - DNA, 22 bp, Homo sapiens
cttctttaatgtatacaaaaga

SEQ ID NO: 9009338 - DNA, 22 bp, Homo sapiens
cttcttgttttagccctcatac

SEQ ID NO: 9009339 - DNA, 22 bp, Homo sapiens
cttctttaatgtatacaaaaga

SEQ ID NO: 9009340 - DNA, 22 bp, Homo sapiens
cttctttactttctagaaataa

SEQ ID NO: 9009341 - DNA, 22 bp, Homo sapiens
cttctttaatgtatacaaaaga

SEQ ID NO: 9009342 - DNA, 22 bp, Homo sapiens
atgaactaagagtcattagtgt

SEQ ID NO: 9009343 - DNA, 22 bp, Homo sapiens
atgaaccttgatttgttcatct

SEQ ID NO: 9009344 - DNA, 22 bp, Homo sapiens
atgaactatcatcagttccacc

SEQ ID NO: 9009345 - DNA, 22 bp, Homo sapiens
atgaactacatgatcctgaaat

SEQ ID NO: 9009346 - DNA, 23 bp, Homo sapiens
atgaacattagtttcagatattg

SEQ ID NO: 9009347 - DNA, 22 bp, Homo sapiens
atgaacatttggtttggcagca

SEQ ID NO: 9009348 - DNA, 22 bp, Homo sapiens
atgaacatttggtttggcagca

SEQ ID NO: 9009349 - DNA, 22 bp, Homo sapiens
atgaaccataggcaagacaata

SEQ ID NO: 9009350 - DNA, 22 bp, Homo sapiens
atgaacatctctgatccaagca

SEQ ID NO: 9009351 - DNA, 22 bp, Homo sapiens
atgaacatcggaaatgagactg

SEQ ID NO: 9009352 - DNA, 22 bp, Homo sapiens
atgaacatgtgactcagacctg

SEQ ID NO: 9009353 - DNA, 22 bp, Homo sapiens
atgaacatctctgatccaagca

SEQ ID NO: 9009354 - DNA, 22 bp, Homo sapiens
atgaacatgtgactcagacctg

SEQ ID NO: 9009355 - DNA, 22 bp, Homo sapiens
atgaacatgtgactcagacctg

SEQ ID NO: 9009356 - DNA, 22 bp, Homo sapiens
atgaacattaaaatggtagaat

SEQ ID NO: 9009357 - DNA, 22 bp, Homo sapiens
atgaacattaaaatggtagaat

SEQ ID NO: 9009358 - DNA, 22 bp, Homo sapiens
atgaactttctttacagttttg

SEQ ID NO: 9009359 - DNA, 22 bp, Homo sapiens
atgaactgcagtataaacttgg

SEQ ID NO: 9009360 - DNA, 22 bp, Homo sapiens
atgaactcttctggttattttt

SEQ ID NO: 9009361 - DNA, 22 bp, Homo sapiens
atgaactcatttattttcctct

SEQ ID NO: 9009362 - DNA, 22 bp, Homo sapiens
atgaactcttgctttatttcag

SEQ ID NO: 9009363 - DNA, 22 bp, Homo sapiens
atgaagaaaaatccagctgtcc

SEQ ID NO: 9009364 - DNA, 22 bp, Homo sapiens
atgaagaaaaatccagctgtcc

SEQ ID NO: 9009365 - DNA, 22 bp, Homo sapiens
atgaagacaaactgggtagaaa

SEQ ID NO: 9009366 - DNA, 22 bp, Homo sapiens
atgaagacaaacgacgttgcaa

SEQ ID NO: 9009367 - DNA, 22 bp, Homo sapiens
atgaagacaaacgacgttgcaa

SEQ ID NO: 9009368 - DNA, 22 bp, Homo sapiens
atgaagacaaacgacgttgcaa

SEQ ID NO: 9009369 - DNA, 22 bp, Homo sapiens
atgaagacaaactgggtagaaa

SEQ ID NO: 9009370 - DNA, 22 bp, Homo sapiens
ctttcttaatttttaaggacac

SEQ ID NO: 9009371 - DNA, 22 bp, Homo sapiens
ctttcttaatttttaaggacac

SEQ ID NO: 9009372 - DNA, 22 bp, Homo sapiens
ctttctggctgaagtgatgaat

SEQ ID NO: 9009373 - DNA, 22 bp, Homo sapiens
ctttctgattttaagctctaat

SEQ ID NO: 9009374 - DNA, 22 bp, Homo sapiens
ctttctgattttaagctctaat

SEQ ID NO: 9009375 - DNA, 22 bp, Homo sapiens
ctttctgattttaagctctaat

SEQ ID NO: 9009376 - DNA, 22 bp, Homo sapiens
ctttctggagtggaaaggtatt

SEQ ID NO: 9009377 - DNA, 22 bp, Homo sapiens
atgaagacaggtctcatcacca

SEQ ID NO: 9009378 - DNA, 22 bp, Homo sapiens
ctttctcttcgaaaacctgccc

SEQ ID NO: 9009379 - DNA, 22 bp, Homo sapiens
ctttctcttcgaaaacctgccc

SEQ ID NO: 9009380 - DNA, 22 bp, Homo sapiens
ctttctcttgagcaagagctgt

SEQ ID NO: 9009381 - DNA, 22 bp, Homo sapiens
ctttctcttgagcaagagctgt

SEQ ID NO: 9009382 - DNA, 22 bp, Homo sapiens
ctttctcttcgaaaacctgccc

SEQ ID NO: 9009383 - DNA, 22 bp, Homo sapiens
ctttctcttgagcaagagctgt

SEQ ID NO: 9009384 - DNA, 22 bp, Homo sapiens
ctttctcttgagcaagagctgt

SEQ ID NO: 9009385 - DNA, 22 bp, Homo sapiens
ctttctgaagtttaagttctaa

SEQ ID NO: 9009386 - DNA, 22 bp, Homo sapiens
ctttctgaagtttaagttctaa

SEQ ID NO: 9009387 - DNA, 22 bp, Homo sapiens
ctttctgaagtttaagttctaa

SEQ ID NO: 9009388 - DNA, 22 bp, Homo sapiens
ctttctgagtccaacccctgat

SEQ ID NO: 9009389 - DNA, 22 bp, Homo sapiens
ctttctgagtccaacccctgat

SEQ ID NO: 9009390 - DNA, 22 bp, Homo sapiens
atgaaacagagtacttaatata

SEQ ID NO: 9009391 - DNA, 22 bp, Homo sapiens
atgaaacagagtacttaatata

SEQ ID NO: 9009392 - DNA, 22 bp, Homo sapiens
atgaaacaagggtattttctct

SEQ ID NO: 9009393 - DNA, 22 bp, Homo sapiens
atgaaacaaacctctatggagt

SEQ ID NO: 9009394 - DNA, 22 bp, Homo sapiens
atgaaaattgacagcggaagta

SEQ ID NO: 9009395 - DNA, 22 bp, Homo sapiens
atgaaaatgtacatgtgtataa

SEQ ID NO: 9009396 - DNA, 22 bp, Homo sapiens
atgaaaatgtacatgtgtataa

SEQ ID NO: 9009397 - DNA, 22 bp, Homo sapiens
atgaaaatgtacatgtgtataa

SEQ ID NO: 9009398 - DNA, 22 bp, Homo sapiens
atgaaaatactgtggttgatag

SEQ ID NO: 9009399 - DNA, 22 bp, Homo sapiens
atgaaaatactgtggttgatag

SEQ ID NO: 9009400 - DNA, 22 bp, Homo sapiens
atgaaaagttcgatctagaagg

SEQ ID NO: 9009401 - DNA, 22 bp, Homo sapiens
atgaaaatactgtggttgatag

SEQ ID NO: 9009402 - DNA, 22 bp, Homo sapiens
atgaaaatactgtggttgatag

SEQ ID NO: 9009403 - DNA, 22 bp, Homo sapiens
atgaacagtatgcaacatgatt

SEQ ID NO: 9009404 - DNA, 22 bp, Homo sapiens
atgaacatcggaaatgagactg

SEQ ID NO: 9009405 - DNA, 22 bp, Homo sapiens
atgaacatcggaaatgagactg

SEQ ID NO: 9009406 - DNA, 22 bp, Homo sapiens
atgaacatcggaaatgagactg

SEQ ID NO: 9009407 - DNA, 22 bp, Homo sapiens
atgaacagtatgcaacatgatt

SEQ ID NO: 9009408 - DNA, 22 bp, Homo sapiens
atgaacagtacaaagcacagac

SEQ ID NO: 9009409 - DNA, 22 bp, Homo sapiens
atgaacagcattgaaatccagc

SEQ ID NO: 9009410 - DNA, 22 bp, Homo sapiens
atgaacagaggcactaggaggg

SEQ ID NO: 9009411 - DNA, 22 bp, Homo sapiens
atgaacagcattgaaatccagc

SEQ ID NO: 9009412 - DNA, 22 bp, Homo sapiens
atgaaattcatctgagaatgct

SEQ ID NO: 9009413 - DNA, 22 bp, Homo sapiens
atgaaacagtgtgtatagcaaa

SEQ ID NO: 9009414 - DNA, 22 bp, Homo sapiens
atgaaacagtgtgtatagcaaa

SEQ ID NO: 9009415 - DNA, 22 bp, Homo sapiens
atgaaacagtgtgtatagcaaa

SEQ ID NO: 9009416 - DNA, 22 bp, Homo sapiens
atgaaattaatcaacacataca

SEQ ID NO: 9009417 - DNA, 22 bp, Homo sapiens
atgaaattaatcaacacataca

SEQ ID NO: 9009418 - DNA, 22 bp, Homo sapiens
atgaaacagtgtgtatagcaaa

SEQ ID NO: 9009419 - DNA, 22 bp, Homo sapiens
atgaaacagtgtgtatagcaaa

SEQ ID NO: 9009420 - DNA, 22 bp, Homo sapiens
atgaaacagtgtgtatagcaaa

SEQ ID NO: 9009421 - DNA, 22 bp, Homo sapiens
atgaaacagtgtgtatagcaaa

SEQ ID NO: 9009422 - DNA, 22 bp, Homo sapiens
atgaaacagtgaattagtcaag

SEQ ID NO: 9009423 - DNA, 22 bp, Homo sapiens
atgaaacagtgaattagtcaag

SEQ ID NO: 9009424 - DNA, 22 bp, Homo sapiens
atgaaacagtgaattagtcaag

SEQ ID NO: 9009425 - DNA, 22 bp, Homo sapiens
atgaaacagagtacttaatata

SEQ ID NO: 9009426 - DNA, 22 bp, Homo sapiens
gaaacatttgttgagtacttgc

SEQ ID NO: 9009427 - DNA, 22 bp, Homo sapiens
gaaaccacagtacccaggaaaa

SEQ ID NO: 9009428 - DNA, 22 bp, Homo sapiens
gaaaccacagtacccaggaaaa

SEQ ID NO: 9009429 - DNA, 22 bp, Homo sapiens
gaaacatttgttgagtacttgc

SEQ ID NO: 9009430 - DNA, 22 bp, Homo sapiens
gaaacatttgttgagtacttgc

SEQ ID NO: 9009431 - DNA, 21 bp, Homo sapiens
atgacagatgctgcagatcgt

SEQ ID NO: 9009432 - DNA, 20 bp, Homo sapiens
gaaaccagaacgcagccctg

SEQ ID NO: 9009433 - DNA, 20 bp, Homo sapiens
gaaaccagaacgcagccctg

SEQ ID NO: 9009434 - DNA, 21 bp, Homo sapiens
atgacagatgctgcagatcgt

SEQ ID NO: 9009435 - DNA, 21 bp, Homo sapiens
atgacagatgctgcagatcgt

SEQ ID NO: 9009436 - DNA, 21 bp, Homo sapiens
atgacagatgctgcagatcgt

SEQ ID NO: 9009437 - DNA, 22 bp, Homo sapiens
atgacagatgctgtggggaggt

SEQ ID NO: 9009438 - DNA, 22 bp, Homo sapiens
atgacaggaataactatgatgg

SEQ ID NO: 9009439 - DNA, 22 bp, Homo sapiens
atgacagtactggtgacaatac

SEQ ID NO: 9009440 - DNA, 22 bp, Homo sapiens
atgacaggaggcagctgggcag

SEQ ID NO: 9009441 - DNA, 22 bp, Homo sapiens
atgacagatgctgtggggaggt

SEQ ID NO: 9009442 - DNA, 22 bp, Homo sapiens
atgacagatgctgtggggaggt

SEQ ID NO: 9009443 - DNA, 22 bp, Homo sapiens
atgacagcattcaagacataga

SEQ ID NO: 9009444 - DNA, 22 bp, Homo sapiens
gaaagcataactaatatttatt

SEQ ID NO: 9009445 - DNA, 22 bp, Homo sapiens
gaaagcataactaatatttatt

SEQ ID NO: 9009446 - DNA, 22 bp, Homo sapiens
gaaagcagtatttagttctgtt

SEQ ID NO: 9009447 - DNA, 22 bp, Homo sapiens
gaaaggtttaagtaggatttgt

SEQ ID NO: 9009448 - DNA, 22 bp, Homo sapiens
gaaaggtttcatctacttttca

SEQ ID NO: 9009449 - DNA, 22 bp, Homo sapiens
gaaaggttgtaacaagactctt

SEQ ID NO: 9009450 - DNA, 22 bp, Homo sapiens
gaaaggttgggtgaatggtgga

SEQ ID NO: 9009451 - DNA, 22 bp, Homo sapiens
gaaagcagtatttagttctgtt

SEQ ID NO: 9009452 - DNA, 22 bp, Homo sapiens
gaaagcagtaaatgggtcccat

SEQ ID NO: 9009453 - DNA, 22 bp, Homo sapiens
atgacatgaggcatctttggag

SEQ ID NO: 9009454 - DNA, 22 bp, Homo sapiens
atgacatgacctggtagagaca

SEQ ID NO: 9009455 - DNA, 22 bp, Homo sapiens
atgacagttctacacttaatct

SEQ ID NO: 9009456 - DNA, 22 bp, Homo sapiens
atgacagtgggtcttgcaaaga

SEQ ID NO: 9009457 - DNA, 22 bp, Homo sapiens
atgacagttctttagagatgta

SEQ ID NO: 9009458 - DNA, 22 bp, Homo sapiens
atgacataagtgaaaaacatca

SEQ ID NO: 9009459 - DNA, 22 bp, Homo sapiens
atgacataagtgaaaaacatca

SEQ ID NO: 9009460 - DNA, 22 bp, Homo sapiens
atgacagtactggtgacaatac

SEQ ID NO: 9009461 - DNA, 22 bp, Homo sapiens
atgacagtaggtaaatgatagc

SEQ ID NO: 9009462 - DNA, 22 bp, Homo sapiens
atgacagtactggtgacaatac

SEQ ID NO: 9009463 - DNA, 22 bp, Homo sapiens
atgacagtactggtgacaatac

SEQ ID NO: 9009464 - DNA, 22 bp, Homo sapiens
atgacagtaggtaaatgatagc

SEQ ID NO: 9009465 - DNA, 22 bp, Homo sapiens
atgacagtgggtcttgcaaaga

SEQ ID NO: 9009466 - DNA, 22 bp, Homo sapiens
atgacagtaggtaaatgatagc

SEQ ID NO: 9009467 - DNA, 22 bp, Homo sapiens
gaaacatgtctgacaatttacc

SEQ ID NO: 9009468 - DNA, 22 bp, Homo sapiens
gaaacatgtctgacaatttacc

SEQ ID NO: 9009469 - DNA, 22 bp, Homo sapiens
gaaacatacgatttaggagaaa

SEQ ID NO: 9009470 - DNA, 22 bp, Homo sapiens
gaaacattcatatgagaaacct

SEQ ID NO: 9009471 - DNA, 22 bp, Homo sapiens
gaaacattcatatgagaaacct

SEQ ID NO: 9009472 - DNA, 22 bp, Homo sapiens
gaaacattcatatgagaaacct

SEQ ID NO: 9009473 - DNA, 22 bp, Homo sapiens
gaaacattcagtcaacagtgtt

SEQ ID NO: 9009474 - DNA, 22 bp, Homo sapiens
gaaacattcagtcaacagtgtt

SEQ ID NO: 9009475 - DNA, 22 bp, Homo sapiens
gaaacattcagtcaacagtgtt

SEQ ID NO: 9009476 - DNA, 22 bp, Homo sapiens
gaaacattcagtcaacagtgtt

SEQ ID NO: 9009477 - DNA, 22 bp, Homo sapiens
gaaacattgagcagaaggagaa

SEQ ID NO: 9009478 - DNA, 22 bp, Homo sapiens
gaaacattcatatgagaaacct

SEQ ID NO: 9009479 - DNA, 22 bp, Homo sapiens
gaaacattgagcagaaggagaa

SEQ ID NO: 9009480 - DNA, 20 bp, Homo sapiens
gaaacattggcagcaactga

SEQ ID NO: 9009481 - DNA, 22 bp, Homo sapiens
gaaacattgtgttctacagatt

SEQ ID NO: 9009482 - DNA, 22 bp, Homo sapiens
gaaacattggtctgccccttat

SEQ ID NO: 9009483 - DNA, 22 bp, Homo sapiens
gaaacattgtgttctacagatt

SEQ ID NO: 9009484 - DNA, 22 bp, Homo sapiens
ctttcttcatcaagtgccacgt

SEQ ID NO: 9009485 - DNA, 22 bp, Homo sapiens
ctttcttcaagctggtctcaat

SEQ ID NO: 9009486 - DNA, 22 bp, Homo sapiens
ctttcttcaacctcattctgca

SEQ ID NO: 9009487 - DNA, 22 bp, Homo sapiens
ctttcttcatctgtaatatgga

SEQ ID NO: 9009488 - DNA, 22 bp, Homo sapiens
ctttcttctccctcaatattac

SEQ ID NO: 9009489 - DNA, 22 bp, Homo sapiens
ctttcttcatctgtaatatgga

SEQ ID NO: 9009490 - DNA, 22 bp, Homo sapiens
ctttctttcgaagacgtgatta

SEQ ID NO: 9009491 - DNA, 22 bp, Homo sapiens
ctttctttcgaagacgtgatta

SEQ ID NO: 9009492 - DNA, 22 bp, Homo sapiens
ctttcttggtcctgaagatggc

SEQ ID NO: 9009493 - DNA, 22 bp, Homo sapiens
ctttctttcgaagacgtgatta

SEQ ID NO: 9009494 - DNA, 22 bp, Homo sapiens
gaaacaggtggcaggctagatt

SEQ ID NO: 9009495 - DNA, 22 bp, Homo sapiens
gaaacaggtggcaggctagatt

SEQ ID NO: 9009496 - DNA, 22 bp, Homo sapiens
gaaacagggagtagtaatttac

SEQ ID NO: 9009497 - DNA, 22 bp, Homo sapiens
gaaacagtcaactttctttccc

SEQ ID NO: 9009498 - DNA, 22 bp, Homo sapiens
gaaaatgttagcttcatagtca

SEQ ID NO: 9009499 - DNA, 22 bp, Homo sapiens
gaaacagctttaagtgatactg

SEQ ID NO: 9009500 - DNA, 22 bp, Homo sapiens
gaaaatgtgtcatccctactgt

SEQ ID NO: 9009501 - DNA, 22 bp, Homo sapiens
atgatgcataatttatacatgc

SEQ ID NO: 9009502 - DNA, 19 bp, Homo sapiens
atgatgcagagctgactca

SEQ ID NO: 9009503 - DNA, 22 bp, Homo sapiens
gaaatttattatctacatcatt

SEQ ID NO: 9009504 - DNA, 22 bp, Homo sapiens
gaaatttattatctacatcatt

SEQ ID NO: 9009505 - DNA, 22 bp, Homo sapiens
gaaatttattatctacatcatt

SEQ ID NO: 9009506 - DNA, 22 bp, Homo sapiens
atgatggaaaaagatcagtcaa

SEQ ID NO: 9009507 - DNA, 22 bp, Homo sapiens
atgatggaatattattcaggca

SEQ ID NO: 9009508 - DNA, 22 bp, Homo sapiens
atgatggaccatcccaatgtga

SEQ ID NO: 9009509 - DNA, 22 bp, Homo sapiens
atgatccaaagccacaggggca

SEQ ID NO: 9009510 - DNA, 22 bp, Homo sapiens
atgatccaaagccacaggggca

SEQ ID NO: 9009511 - DNA, 22 bp, Homo sapiens
atgatcatggaagtgcacccat

SEQ ID NO: 9009512 - DNA, 22 bp, Homo sapiens
atgatcagggcagaagcagaag

SEQ ID NO: 9009513 - DNA, 22 bp, Homo sapiens
atgatcaagaattttgtattcc

SEQ ID NO: 9009514 - DNA, 22 bp, Homo sapiens
atgatcagggcagaagcagaag

SEQ ID NO: 9009515 - DNA, 22 bp, Homo sapiens
atgatcatacagagccctggta

SEQ ID NO: 9009516 - DNA, 19 bp, Homo sapiens
atgatctgcccttgtaata

SEQ ID NO: 9009517 - DNA, 22 bp, Homo sapiens
atgatctgataatcatccacta

SEQ ID NO: 9009518 - DNA, 22 bp, Homo sapiens
atgatctcattctttcaaaggg

SEQ ID NO: 9009519 - DNA, 22 bp, Homo sapiens
atgatgaaactaggaactagag

SEQ ID NO: 9009520 - DNA, 22 bp, Homo sapiens
atgatgaaaactgaaggttagg

SEQ ID NO: 9009521 - DNA, 22 bp, Homo sapiens
atgatgaaactaggaactagag

SEQ ID NO: 9009522 - DNA, 22 bp, Homo sapiens
gaaatagatctctgggatgcaa

SEQ ID NO: 9009523 - DNA, 22 bp, Homo sapiens
gaaatagatctctgggatgcaa

SEQ ID NO: 9009524 - DNA, 22 bp, Homo sapiens
gaaatagaggacagctggatca

SEQ ID NO: 9009525 - DNA, 22 bp, Homo sapiens
gaaatagaggacagctggatca

SEQ ID NO: 9009526 - DNA, 22 bp, Homo sapiens
gaaatagaggacagctggatca

SEQ ID NO: 9009527 - DNA, 22 bp, Homo sapiens
gaaatagatctctgggatgcaa

SEQ ID NO: 9009528 - DNA, 19 bp, Homo sapiens
atgatacaggtgaaaattg

SEQ ID NO: 9009529 - DNA, 19 bp, Homo sapiens
atgatacaggtgaaaattg

SEQ ID NO: 9009530 - DNA, 19 bp, Homo sapiens
atgatacaggtgaaaattg

SEQ ID NO: 9009531 - DNA, 19 bp, Homo sapiens
atgatacaggtgaaaattg

SEQ ID NO: 9009532 - DNA, 22 bp, Homo sapiens
gaaatatacatgaagtcggctg

SEQ ID NO: 9009533 - DNA, 22 bp, Homo sapiens
gaaatatacatgaagtcggctg

SEQ ID NO: 9009534 - DNA, 22 bp, Homo sapiens
gaaatagtacagcatagttctt

SEQ ID NO: 9009535 - DNA, 22 bp, Homo sapiens
atgatatttgcaatgtgcttgc

SEQ ID NO: 9009536 - DNA, 22 bp, Homo sapiens
atgatatttgcaatgtgcttgc

SEQ ID NO: 9009537 - DNA, 22 bp, Homo sapiens
atgatatatgtgttgagcttgc

SEQ ID NO: 9009538 - DNA, 22 bp, Homo sapiens
atgatcagcagttttcagtgtt

SEQ ID NO: 9009539 - DNA, 21 bp, Homo sapiens
gaaatactgccttaggagctg

SEQ ID NO: 9009540 - DNA, 22 bp, Homo sapiens
gaaatactgcacaccctgtaag

SEQ ID NO: 9009541 - DNA, 21 bp, Homo sapiens
gaaatactgccttaggagctg

SEQ ID NO: 9009542 - DNA, 22 bp, Homo sapiens
gaaatacagttgggaggaggta

SEQ ID NO: 9009543 - DNA, 22 bp, Homo sapiens
gaaatacagttgggaggaggta

SEQ ID NO: 9009544 - DNA, 22 bp, Homo sapiens
gaaatactgcacaccctgtaag

SEQ ID NO: 9009545 - DNA, 22 bp, Homo sapiens
gaaatacagttgggaggaggta

SEQ ID NO: 9009546 - DNA, 22 bp, Homo sapiens
gaaatacagttgggaggaggta

SEQ ID NO: 9009547 - DNA, 22 bp, Homo sapiens
gaaagtgcagtcagacaaggca

SEQ ID NO: 9009548 - DNA, 22 bp, Homo sapiens
gaaagtgcagtcagacaaggca

SEQ ID NO: 9009549 - DNA, 22 bp, Homo sapiens
gaaagtgcagtcagacaaggca

SEQ ID NO: 9009550 - DNA, 22 bp, Homo sapiens
gaaagtcatggatgaacactac

SEQ ID NO: 9009551 - DNA, 22 bp, Homo sapiens
gaaagtcatggatgaacactac

SEQ ID NO: 9009552 - DNA, 22 bp, Homo sapiens
gaaagtgcagtcagacaaggca

SEQ ID NO: 9009553 - DNA, 22 bp, Homo sapiens
gaaatagacactttctatgaat

SEQ ID NO: 9009554 - DNA, 22 bp, Homo sapiens
gaaatagacactttctatgaat

SEQ ID NO: 9009555 - DNA, 22 bp, Homo sapiens
gaaatagacactttctatgaat

SEQ ID NO: 9009556 - DNA, 22 bp, Homo sapiens
gaaatagacactttctatgaat

SEQ ID NO: 9009557 - DNA, 22 bp, Homo sapiens
gaaatagacactttctatgaat

SEQ ID NO: 9009558 - DNA, 22 bp, Homo sapiens
gaaatagacactttctatgaat

SEQ ID NO: 9009559 - DNA, 22 bp, Homo sapiens
gaaatagaagctgccaatttct

SEQ ID NO: 9009560 - DNA, 22 bp, Homo sapiens
gaaatagacactttctatgaat

SEQ ID NO: 9009561 - DNA, 22 bp, Homo sapiens
gaaatagaagctgccaatttct

SEQ ID NO: 9009562 - DNA, 22 bp, Homo sapiens
gaaatagaagctgccaatttct

SEQ ID NO: 9009563 - DNA, 22 bp, Homo sapiens
gaaatagaagctgccaatttct

SEQ ID NO: 9009564 - DNA, 22 bp, Homo sapiens
gaaatactgtaaagttattatt

SEQ ID NO: 9009565 - DNA, 22 bp, Homo sapiens
gaaatactgtaaagttattatt

SEQ ID NO: 9009566 - DNA, 20 bp, Homo sapiens
gaaatacttacccaactgtt

SEQ ID NO: 9009567 - DNA, 22 bp, Homo sapiens
gaaaggtttggcttttcagtag

SEQ ID NO: 9009568 - DNA, 22 bp, Homo sapiens
gaaagtaacatttcttgaatta

SEQ ID NO: 9009569 - DNA, 22 bp, Homo sapiens
gaaagtatgccatctacctctt

SEQ ID NO: 9009570 - DNA, 22 bp, Homo sapiens
gaaagtatgccatctacctctt

SEQ ID NO: 9009571 - DNA, 22 bp, Homo sapiens
gaaagtacagattcctggccag

SEQ ID NO: 9009572 - DNA, 22 bp, Homo sapiens
gaaagtaacatttcttgaatta

SEQ ID NO: 9009573 - DNA, 22 bp, Homo sapiens
gaaagtattcacaaagttcttg

SEQ ID NO: 9009574 - DNA, 22 bp, Homo sapiens
gaaagtattcacaaagttcttg

SEQ ID NO: 9009575 - DNA, 22 bp, Homo sapiens
gaaagtattctccctgaatttt

SEQ ID NO: 9009576 - DNA, 22 bp, Homo sapiens
gaaagtattcacaaagttcttg

SEQ ID NO: 9009577 - DNA, 22 bp, Homo sapiens
gaaagtattagcctagaagtca

SEQ ID NO: 9009578 - DNA, 22 bp, Homo sapiens
gaaagtattagcctagaagtca

SEQ ID NO: 9009579 - DNA, 22 bp, Homo sapiens
gaaagtattagcctagaagtca

SEQ ID NO: 9009580 - DNA, 22 bp, Homo sapiens
gaaagtattagcctagaagtca

SEQ ID NO: 9009581 - DNA, 22 bp, Homo sapiens
gaaagtatttaagtccatattt

SEQ ID NO: 9009582 - DNA, 22 bp, Homo sapiens
gaaagtatttaagtccatattt

SEQ ID NO: 9009583 - DNA, 22 bp, Homo sapiens
gaaagtatttaagtccatattt

SEQ ID NO: 9009584 - DNA, 22 bp, Homo sapiens
gaaagtattctccctgaatttt

SEQ ID NO: 9009585 - DNA, 22 bp, Homo sapiens
gaaagtatttaagtccatattt

SEQ ID NO: 9009586 - DNA, 22 bp, Homo sapiens
gaaagtattctccctgaatttt

SEQ ID NO: 9009587 - DNA, 22 bp, Homo sapiens
gaaagtatttacattaacatct

SEQ ID NO: 9009588 - DNA, 22 bp, Homo sapiens
gaaagtatttaagtccatattt

SEQ ID NO: 9009589 - DNA, 22 bp, Homo sapiens
gaaagtatttacattaacatct

SEQ ID NO: 9009590 - DNA, 23 bp, Homo sapiens
gaaagtcaatatggtagctttga

SEQ ID NO: 9009591 - DNA, 22 bp, Homo sapiens
gaaagtatttacattaacatct

SEQ ID NO: 9009592 - DNA, 22 bp, Homo sapiens
gaaagtatttacattaacatct

SEQ ID NO: 9009593 - DNA, 22 bp, Homo sapiens
gaaagtatttacattaacatct

SEQ ID NO: 9009594 - DNA, 22 bp, Homo sapiens
gaaagtatttacattaacatct

SEQ ID NO: 9009595 - DNA, 22 bp, Homo sapiens
gactggagcccccaaggacacc

SEQ ID NO: 9009596 - DNA, 22 bp, Homo sapiens
gactggagataaaaccatgagt

SEQ ID NO: 9009597 - DNA, 21 bp, Homo sapiens
gactggagagaggaagtctgg

SEQ ID NO: 9009598 - DNA, 22 bp, Homo sapiens
gactggaaagcctgtcctcaga

SEQ ID NO: 9009599 - DNA, 22 bp, Homo sapiens
gactggagtcaatgagcagcac

SEQ ID NO: 9009600 - DNA, 22 bp, Homo sapiens
gactggagcccccaaggacacc

SEQ ID NO: 9009601 - DNA, 22 bp, Homo sapiens
gactggagtcaatgagcagcac

SEQ ID NO: 9009602 - DNA, 22 bp, Homo sapiens
gactggagtgcctccaggaaag

SEQ ID NO: 9009603 - DNA, 22 bp, Homo sapiens
gactggcctggggctgggcaca

SEQ ID NO: 9009604 - DNA, 22 bp, Homo sapiens
gactggctcactccactcctat

SEQ ID NO: 9009605 - DNA, 22 bp, Homo sapiens
gactgggcagccggtagggaag

SEQ ID NO: 9009606 - DNA, 22 bp, Homo sapiens
gactgggagggttcagctgggt

SEQ ID NO: 9009607 - DNA, 22 bp, Homo sapiens
gactgggagggttcagctgggt

SEQ ID NO: 9009608 - DNA, 22 bp, Homo sapiens
gactgggacaggacagacatct

SEQ ID NO: 9009609 - DNA, 22 bp, Homo sapiens
gactgggagggttcagctgggt

SEQ ID NO: 9009610 - DNA, 22 bp, Homo sapiens
gacctttagtgtccaatattca

SEQ ID NO: 9009611 - DNA, 22 bp, Homo sapiens
gacctttagtgtcatgttatat

SEQ ID NO: 9009612 - DNA, 22 bp, Homo sapiens
gacctttagtgtcatgttatat

SEQ ID NO: 9009613 - DNA, 22 bp, Homo sapiens
gacctttagtgtcatgttatat

SEQ ID NO: 9009614 - DNA, 22 bp, Homo sapiens
gacctttcaaatgtttacatga

SEQ ID NO: 9009615 - DNA, 22 bp, Homo sapiens
gacctttttactgtgtacgctg

SEQ ID NO: 9009616 - DNA, 22 bp, Homo sapiens
gacgcactgaaggctggttacc

SEQ ID NO: 9009617 - DNA, 22 bp, Homo sapiens
gacgctttcaagggcctttctt

SEQ ID NO: 9009618 - DNA, 22 bp, Homo sapiens
gacgctttcaagggcctttctt

SEQ ID NO: 9009619 - DNA, 22 bp, Homo sapiens
gacgccgtgtcccggcactctt

SEQ ID NO: 9009620 - DNA, 22 bp, Homo sapiens
gacggagctggttgctgcggct

SEQ ID NO: 9009621 - DNA, 22 bp, Homo sapiens
gacggagctggttgctgcggct

SEQ ID NO: 9009622 - DNA, 22 bp, Homo sapiens
gacggagctggttgctgcggct

SEQ ID NO: 9009623 - DNA, 22 bp, Homo sapiens
gacggagctggttgctgcggct

SEQ ID NO: 9009624 - DNA, 22 bp, Homo sapiens
gactacaacaataagaacagct

SEQ ID NO: 9009625 - DNA, 22 bp, Homo sapiens
gactacagatagccaattaagt

SEQ ID NO: 9009626 - DNA, 22 bp, Homo sapiens
gactacaggccggcatcagaga

SEQ ID NO: 9009627 - DNA, 22 bp, Homo sapiens
gactggaaagcctgtcctcaga

SEQ ID NO: 9009628 - DNA, 19 bp, Homo sapiens
gactaaataataatagcag

SEQ ID NO: 9009629 - DNA, 22 bp, Homo sapiens
gactaaataaaagccaaacttc

SEQ ID NO: 9009630 - DNA, 22 bp, Homo sapiens
gacgggtgtatgctcccagcca

SEQ ID NO: 9009631 - DNA, 22 bp, Homo sapiens
gacgggtgtccctatgtccatt

SEQ ID NO: 9009632 - DNA, 22 bp, Homo sapiens
atgctccttggcttcaaagcca

SEQ ID NO: 9009633 - DNA, 22 bp, Homo sapiens
atgctccttggcttcaaagcca

SEQ ID NO: 9009634 - DNA, 22 bp, Homo sapiens
atgctccttggcttcaaagcca

SEQ ID NO: 9009635 - DNA, 18 bp, Homo sapiens
atgctctagtctttcctg

SEQ ID NO: 9009636 - DNA, 22 bp, Homo sapiens
atgctcagtagctggctgaccc

SEQ ID NO: 9009637 - DNA, 18 bp, Homo sapiens
atgctcctatctctgagc

SEQ ID NO: 9009638 - DNA, 22 bp, Homo sapiens
atgctcctcgagtgtctcacag

SEQ ID NO: 9009639 - DNA, 22 bp, Homo sapiens
atgctcacttcagagaagatga

SEQ ID NO: 9009640 - DNA, 22 bp, Homo sapiens
atgctcagggcacactctggac

SEQ ID NO: 9009641 - DNA, 22 bp, Homo sapiens
atgctcagggcacactctggac

SEQ ID NO: 9009642 - DNA, 22 bp, Homo sapiens
atgctcaggttttgcccaagac

SEQ ID NO: 9009643 - DNA, 22 bp, Homo sapiens
atgctatttaccacacatcatt

SEQ ID NO: 9009644 - DNA, 22 bp, Homo sapiens
atgctattgaaaagaaataaga

SEQ ID NO: 9009645 - DNA, 22 bp, Homo sapiens
atgctattttacataggaatgg

SEQ ID NO: 9009646 - DNA, 22 bp, Homo sapiens
atgctattttacataggaatgg

SEQ ID NO: 9009647 - DNA, 22 bp, Homo sapiens
atgctattccagaatgtaaatt

SEQ ID NO: 9009648 - DNA, 22 bp, Homo sapiens
atgctattccagaatgtaaatt

SEQ ID NO: 9009649 - DNA, 22 bp, Homo sapiens
gaccctggcagataccgtcaca

SEQ ID NO: 9009650 - DNA, 22 bp, Homo sapiens
gaccctggagttagtcctgtgt

SEQ ID NO: 9009651 - DNA, 22 bp, Homo sapiens
gaccctggcagataccgtcaca

SEQ ID NO: 9009652 - DNA, 22 bp, Homo sapiens
gaccttgtgatccacctgcctt

SEQ ID NO: 9009653 - DNA, 22 bp, Homo sapiens
gaccttgtgatccacccgcttt

SEQ ID NO: 9009654 - DNA, 17 bp, Homo sapiens
atgctctatagtcagtg

SEQ ID NO: 9009655 - DNA, 22 bp, Homo sapiens
atgctctataaatatgacatgt

SEQ ID NO: 9009656 - DNA, 22 bp, Homo sapiens
atgctctataaatatgacatgt

SEQ ID NO: 9009657 - DNA, 23 bp, Homo sapiens
atgctctatttgggatatgacag

SEQ ID NO: 9009658 - DNA, 22 bp, Homo sapiens
atgctctggagtacgtgaaatt

SEQ ID NO: 9009659 - DNA, 22 bp, Homo sapiens
atgctctgggcaggagccctgg

SEQ ID NO: 9009660 - DNA, 22 bp, Homo sapiens
gaccttgtgatctgcccacctt

SEQ ID NO: 9009661 - DNA, 22 bp, Homo sapiens
gaccttgtgatccgcccgcctt

SEQ ID NO: 9009662 - DNA, 22 bp, Homo sapiens
gaccttgtgatccagccacctt

SEQ ID NO: 9009663 - DNA, 22 bp, Homo sapiens
gaccttgtgatccccctgcctt

SEQ ID NO: 9009664 - DNA, 22 bp, Homo sapiens
gaccttgtgatctgcctgcctt

SEQ ID NO: 9009665 - DNA, 22 bp, Homo sapiens
gaccttgtgatctgcccacctt

SEQ ID NO: 9009666 - DNA, 21 bp, Homo sapiens
gacctttacatttttcactgt

SEQ ID NO: 9009667 - DNA, 22 bp, Homo sapiens
gacctttaatgtttctaccact

SEQ ID NO: 9009668 - DNA, 18 bp, Homo sapiens
gacaccagcctctgcccc

SEQ ID NO: 9009669 - DNA, 23 bp, Homo sapiens
gacaccaggcgtggccctcgaca

SEQ ID NO: 9009670 - DNA, 22 bp, Homo sapiens
gacacccctttcaacttggtgg

SEQ ID NO: 9009671 - DNA, 22 bp, Homo sapiens
gacaccattacctttctatatt

SEQ ID NO: 9009672 - DNA, 18 bp, Homo sapiens
gacaccagcctctgcccc

SEQ ID NO: 9009673 - DNA, 18 bp, Homo sapiens
gacaccagcctctgcccc

SEQ ID NO: 9009674 - DNA, 22 bp, Homo sapiens
gacacatatgcgtatagtttag

SEQ ID NO: 9009675 - DNA, 19 bp, Homo sapiens
gacacagttggttcctttg

SEQ ID NO: 9009676 - DNA, 22 bp, Homo sapiens
gacacagtttttctcacggtgg

SEQ ID NO: 9009677 - DNA, 22 bp, Homo sapiens
gacacatagatctatctcactc

SEQ ID NO: 9009678 - DNA, 22 bp, Homo sapiens
gacacatagatctatctcactc

SEQ ID NO: 9009679 - DNA, 22 bp, Homo sapiens
gacacatgaccataaatgctaa

SEQ ID NO: 9009680 - DNA, 22 bp, Homo sapiens
gacacattgatgtgagtacata

SEQ ID NO: 9009681 - DNA, 16 bp, Homo sapiens
gacacatgggggaaaa

SEQ ID NO: 9009682 - DNA, 22 bp, Homo sapiens
gacacaaagtttgtcagaaatt

SEQ ID NO: 9009683 - DNA, 22 bp, Homo sapiens
gacacaaagtttgtcagaaatt

SEQ ID NO: 9009684 - DNA, 22 bp, Homo sapiens
gacacaaagtttgtcagaaatt

SEQ ID NO: 9009685 - DNA, 22 bp, Homo sapiens
gacacaaagtttgtcagaaatt

SEQ ID NO: 9009686 - DNA, 21 bp, Homo sapiens
gacacaaagggtagtaatggt

SEQ ID NO: 9009687 - DNA, 21 bp, Homo sapiens
gacacaaagggtagtaatggt

SEQ ID NO: 9009688 - DNA, 21 bp, Homo sapiens
gacacaaagggtagtaatggt

SEQ ID NO: 9009689 - DNA, 21 bp, Homo sapiens
gacacaaagggtagtaatggt

SEQ ID NO: 9009690 - DNA, 21 bp, Homo sapiens
gacacaaagggtagtaatggt

SEQ ID NO: 9009691 - DNA, 22 bp, Homo sapiens
gacaatgtgcaattgcagctag

SEQ ID NO: 9009692 - DNA, 22 bp, Homo sapiens
gacaatgtgcaattgcagctag

SEQ ID NO: 9009693 - DNA, 19 bp, Homo sapiens
gacaattagagatcactca

SEQ ID NO: 9009694 - DNA, 22 bp, Homo sapiens
gacaattagatcattcctttga

SEQ ID NO: 9009695 - DNA, 22 bp, Homo sapiens
gacaattaggttaagagcaaga

SEQ ID NO: 9009696 - DNA, 22 bp, Homo sapiens
gacaattgcttttgccgaataa

SEQ ID NO: 9009697 - DNA, 22 bp, Homo sapiens
gacaattgcttttgccgaataa

SEQ ID NO: 9009698 - DNA, 22 bp, Homo sapiens
gacaattgcttttgccgaataa

SEQ ID NO: 9009699 - DNA, 22 bp, Homo sapiens
gacaattgcttttgccgaataa

SEQ ID NO: 9009700 - DNA, 21 bp, Homo sapiens
gacacaaagggtagtaatggt

SEQ ID NO: 9009701 - DNA, 22 bp, Homo sapiens
gaccacagaggtgtgggagaga

SEQ ID NO: 9009702 - DNA, 22 bp, Homo sapiens
gaccacagaggtgtgggagaga

SEQ ID NO: 9009703 - DNA, 22 bp, Homo sapiens
gaccacagaggtgtgggagaga

SEQ ID NO: 9009704 - DNA, 22 bp, Homo sapiens
gaccacagagcacggcctgctt

SEQ ID NO: 9009705 - DNA, 22 bp, Homo sapiens
gaccacagagcacggcctgctt

SEQ ID NO: 9009706 - DNA, 22 bp, Homo sapiens
gaccacagactggaaagagggc

SEQ ID NO: 9009707 - DNA, 22 bp, Homo sapiens
gaccacagattcctaagtggca

SEQ ID NO: 9009708 - DNA, 22 bp, Homo sapiens
atgctattccagaatgtaaatt

SEQ ID NO: 9009709 - DNA, 22 bp, Homo sapiens
atgctattaatatccagtctga

SEQ ID NO: 9009710 - DNA, 22 bp, Homo sapiens
atgctatgtttggtgttggaga

SEQ ID NO: 9009711 - DNA, 22 bp, Homo sapiens
atgctatgtaactggcagatag

SEQ ID NO: 9009712 - DNA, 22 bp, Homo sapiens
gaccaacagaatttcctgtttt

SEQ ID NO: 9009713 - DNA, 17 bp, Homo sapiens
gaccaaatcgcttggca

SEQ ID NO: 9009714 - DNA, 22 bp, Homo sapiens
gaccaaatgaaaggatggatgg

SEQ ID NO: 9009715 - DNA, 22 bp, Homo sapiens
gaccaaatgaatggtaatgagt

SEQ ID NO: 9009716 - DNA, 22 bp, Homo sapiens
gaccaagatacagcatcataga

SEQ ID NO: 9009717 - DNA, 22 bp, Homo sapiens
gaccaagatacagcatcataga

SEQ ID NO: 9009718 - DNA, 21 bp, Homo sapiens
gaccaaagggctggcactgcc

SEQ ID NO: 9009719 - DNA, 22 bp, Homo sapiens
gaccaaagaagccacccgtcct

SEQ ID NO: 9009720 - DNA, 22 bp, Homo sapiens
gaccacactttggaaatcacga

SEQ ID NO: 9009721 - DNA, 22 bp, Homo sapiens
gaccacacgtcccagagagccc

SEQ ID NO: 9009722 - DNA, 22 bp, Homo sapiens
gaccaagatacagcatcataga

SEQ ID NO: 9009723 - DNA, 22 bp, Homo sapiens
gaccaaggaagaggggagccag

SEQ ID NO: 9009724 - DNA, 22 bp, Homo sapiens
gaccaaggccaggccagggcgt

SEQ ID NO: 9009725 - DNA, 22 bp, Homo sapiens
gaccaaggccaggccagggcgt

SEQ ID NO: 9009726 - DNA, 22 bp, Homo sapiens
gacatttattagaaaactatca

SEQ ID NO: 9009727 - DNA, 22 bp, Homo sapiens
gacatttattagaaaactatca

SEQ ID NO: 9009728 - DNA, 22 bp, Homo sapiens
gacatttattagaaaactatca

SEQ ID NO: 9009729 - DNA, 22 bp, Homo sapiens
gacatttattagaaaactatca

SEQ ID NO: 9009730 - DNA, 22 bp, Homo sapiens
gacatttattagaaaactatca

SEQ ID NO: 9009731 - DNA, 22 bp, Homo sapiens
gacatttattagaaaactatca

SEQ ID NO: 9009732 - DNA, 22 bp, Homo sapiens
gacatttattggattttacgag

SEQ ID NO: 9009733 - DNA, 22 bp, Homo sapiens
gacatttattggattttacgag

SEQ ID NO: 9009734 - DNA, 22 bp, Homo sapiens
gacataaatgaagtttgactat

SEQ ID NO: 9009735 - DNA, 22 bp, Homo sapiens
gacataataatctgacctagat

SEQ ID NO: 9009736 - DNA, 22 bp, Homo sapiens
gacataatcctcctcacctact

SEQ ID NO: 9009737 - DNA, 22 bp, Homo sapiens
gacatacaagctggtacctcct

SEQ ID NO: 9009738 - DNA, 22 bp, Homo sapiens
gacatttattagaaaactatca

SEQ ID NO: 9009739 - DNA, 22 bp, Homo sapiens
gacatttatgaaggagatatgc

SEQ ID NO: 9009740 - DNA, 22 bp, Homo sapiens
gacataaatgaagtttgactat

SEQ ID NO: 9009741 - DNA, 22 bp, Homo sapiens
gacacccttcctcctgaggcta

SEQ ID NO: 9009742 - DNA, 22 bp, Homo sapiens
gacacgtttctgaattctgaag

SEQ ID NO: 9009743 - DNA, 22 bp, Homo sapiens
gaaatttattatctacatcatt

SEQ ID NO: 9009744 - DNA, 22 bp, Homo sapiens
gaacaaacacatcccagcagtg

SEQ ID NO: 9009745 - DNA, 22 bp, Homo sapiens
gaacaaacagaagaggcggaac

SEQ ID NO: 9009746 - DNA, 22 bp, Homo sapiens
gaacaaagacatggaggaggat

SEQ ID NO: 9009747 - DNA, 19 bp, Homo sapiens
gaacaaacttaaacttttc

SEQ ID NO: 9009748 - DNA, 22 bp, Homo sapiens
gaacaaactgggtcccaatgat

SEQ ID NO: 9009749 - DNA, 22 bp, Homo sapiens
gaacaactcttcttgagagatg

SEQ ID NO: 9009750 - DNA, 22 bp, Homo sapiens
gaacaactcttcttgagagatg

SEQ ID NO: 9009751 - DNA, 22 bp, Homo sapiens
gaacaactttgaaacatgaaga

SEQ ID NO: 9009752 - DNA, 22 bp, Homo sapiens
gaacaactccaagggacatcat

SEQ ID NO: 9009753 - DNA, 22 bp, Homo sapiens
gaacaaattggagaaatcagga

SEQ ID NO: 9009754 - DNA, 22 bp, Homo sapiens
gaacaaattggagaaatcagga

SEQ ID NO: 9009755 - DNA, 22 bp, Homo sapiens
gaacaaattggagaaatcagga

SEQ ID NO: 9009756 - DNA, 22 bp, Homo sapiens
gaacaaattggagaaatcagga

SEQ ID NO: 9009757 - DNA, 22 bp, Homo sapiens
gaacaaattctcatcaacttgt

SEQ ID NO: 9009758 - DNA, 22 bp, Homo sapiens
gaacaaattggagaaatcagga

SEQ ID NO: 9009759 - DNA, 22 bp, Homo sapiens
gaacaaattggagaaatcagga

SEQ ID NO: 9009760 - DNA, 22 bp, Homo sapiens
gaacaaattctcatcaacttgt

SEQ ID NO: 9009761 - DNA, 22 bp, Homo sapiens
gaacaaattctcatcaacttgt

SEQ ID NO: 9009762 - DNA, 22 bp, Homo sapiens
gaacaaattctcatcaacttgt

SEQ ID NO: 9009763 - DNA, 22 bp, Homo sapiens
gaacaaattggagaaatcagga

SEQ ID NO: 9009764 - DNA, 22 bp, Homo sapiens
gaacaaattggagaaatcagga

SEQ ID NO: 9009765 - DNA, 22 bp, Homo sapiens
gaacaaattggagaaatcagga

SEQ ID NO: 9009766 - DNA, 22 bp, Homo sapiens
gaacaaattctcatcaacttgt

SEQ ID NO: 9009767 - DNA, 22 bp, Homo sapiens
gaacaaattctcatcaacttgt

SEQ ID NO: 9009768 - DNA, 22 bp, Homo sapiens
gaaggctgctgggaagtgtggt

SEQ ID NO: 9009769 - DNA, 22 bp, Homo sapiens
gaaggcaagcagcataaatgtc

SEQ ID NO: 9009770 - DNA, 22 bp, Homo sapiens
gaacaatagtggtaacaaagcc

SEQ ID NO: 9009771 - DNA, 22 bp, Homo sapiens
gaacaatacaggctttattcct

SEQ ID NO: 9009772 - DNA, 22 bp, Homo sapiens
gaacaatagtggtaacaaagcc

SEQ ID NO: 9009773 - DNA, 22 bp, Homo sapiens
gaacaatagtggtaacaaagcc

SEQ ID NO: 9009774 - DNA, 22 bp, Homo sapiens
gaacaatacaggctttattcct

SEQ ID NO: 9009775 - DNA, 22 bp, Homo sapiens
gaacaatacaggctttattcct

SEQ ID NO: 9009776 - DNA, 22 bp, Homo sapiens
gaacaaggattcccaaagaaga

SEQ ID NO: 9009777 - DNA, 22 bp, Homo sapiens
gaacaaggattcccaaagaaga

SEQ ID NO: 9009778 - DNA, 22 bp, Homo sapiens
gaacaaggattcccaaagaaga

SEQ ID NO: 9009779 - DNA, 22 bp, Homo sapiens
gaacaactttgaaacatgaaga

SEQ ID NO: 9009780 - DNA, 22 bp, Homo sapiens
gaaggctggctttctgagagca

SEQ ID NO: 9009781 - DNA, 22 bp, Homo sapiens
gaaggctggaaggcaagtagga

SEQ ID NO: 9009782 - DNA, 22 bp, Homo sapiens
gaaggctggctttctgagagca

SEQ ID NO: 9009783 - DNA, 22 bp, Homo sapiens
gaaggctggctttctgagagca

SEQ ID NO: 9009784 - DNA, 22 bp, Homo sapiens
gaaggctggaaggcaagtagga

SEQ ID NO: 9009785 - DNA, 22 bp, Homo sapiens
gaaggctggaaggcaagtagga

SEQ ID NO: 9009786 - DNA, 22 bp, Homo sapiens
gaaggctggaaggcaagtagga

SEQ ID NO: 9009787 - DNA, 22 bp, Homo sapiens
gaaggctggaaggcaagtagga

SEQ ID NO: 9009788 - DNA, 22 bp, Homo sapiens
gaaggctgctgggaagtgtggt

SEQ ID NO: 9009789 - DNA, 22 bp, Homo sapiens
gaaggctgctgggaagtgtggt

SEQ ID NO: 9009790 - DNA, 22 bp, Homo sapiens
gaaggctgtttctggtagtgat

SEQ ID NO: 9009791 - DNA, 22 bp, Homo sapiens
gaaggcttagaaacaagggagc

SEQ ID NO: 9009792 - DNA, 16 bp, Homo sapiens
gaaggcttactgcagg

SEQ ID NO: 9009793 - DNA, 22 bp, Homo sapiens
atgcacaagttatatgtatgga

SEQ ID NO: 9009794 - DNA, 22 bp, Homo sapiens
atgcacaaggtagattattatt

SEQ ID NO: 9009795 - DNA, 22 bp, Homo sapiens
atgcacaaggtagattattatt

SEQ ID NO: 9009796 - DNA, 22 bp, Homo sapiens
gaaggcttatgtgtgactttcg

SEQ ID NO: 9009797 - DNA, 22 bp, Homo sapiens
atgcacaatgttttgatttgag

SEQ ID NO: 9009798 - DNA, 22 bp, Homo sapiens
atgcacaatgttttgatttgag

SEQ ID NO: 9009799 - DNA, 22 bp, Homo sapiens
atgcacaagttatatgtatgga

SEQ ID NO: 9009800 - DNA, 22 bp, Homo sapiens
atgcacaattaggatatagctt

SEQ ID NO: 9009801 - DNA, 22 bp, Homo sapiens
gaaggctggggccttctcatct

SEQ ID NO: 9009802 - DNA, 22 bp, Homo sapiens
gaaggctggggcatcagtgaaa

SEQ ID NO: 9009803 - DNA, 22 bp, Homo sapiens
gaaggctggggcatcagtgaaa

SEQ ID NO: 9009804 - DNA, 22 bp, Homo sapiens
gaaggctgtcagagaggagggc

SEQ ID NO: 9009805 - DNA, 22 bp, Homo sapiens
gaaggctgtcagagaggagggc

SEQ ID NO: 9009806 - DNA, 22 bp, Homo sapiens
gaaggctgtaggcaaagtagga

SEQ ID NO: 9009807 - DNA, 22 bp, Homo sapiens
gaaggctgtcagagaggagggc

SEQ ID NO: 9009808 - DNA, 22 bp, Homo sapiens
gaaggctgtcagagaggagggc

SEQ ID NO: 9009809 - DNA, 22 bp, Homo sapiens
gaaggctgtggctggtctcagt

SEQ ID NO: 9009810 - DNA, 22 bp, Homo sapiens
gaaggctgtggctggtctcagt

SEQ ID NO: 9009811 - DNA, 19 bp, Homo sapiens
atgcacacattgaagagga

SEQ ID NO: 9009812 - DNA, 19 bp, Homo sapiens
atgcacacattgaagagga

SEQ ID NO: 9009813 - DNA, 22 bp, Homo sapiens
atgcacacgtaccctacaaggc

SEQ ID NO: 9009814 - DNA, 22 bp, Homo sapiens
atgcacacacattatgtctgtg

SEQ ID NO: 9009815 - DNA, 22 bp, Homo sapiens
atgcacacacattatgtctgtg

SEQ ID NO: 9009816 - DNA, 22 bp, Homo sapiens
atgcacacacattatgtctgtg

SEQ ID NO: 9009817 - DNA, 22 bp, Homo sapiens
atgcacacaagcttatgtatta

SEQ ID NO: 9009818 - DNA, 22 bp, Homo sapiens
atgcacaattaggatatagctt

SEQ ID NO: 9009819 - DNA, 22 bp, Homo sapiens
atgcacacaagcttatgtatta

SEQ ID NO: 9009820 - DNA, 22 bp, Homo sapiens
atgcacacacattatgtctgtg

SEQ ID NO: 9009821 - DNA, 22 bp, Homo sapiens
atgcacactgggattcaactgg

SEQ ID NO: 9009822 - DNA, 22 bp, Homo sapiens
atgcacactgaatgcttacttt

SEQ ID NO: 9009823 - DNA, 22 bp, Homo sapiens
atgcacacgtaccctacaaggc

SEQ ID NO: 9009824 - DNA, 22 bp, Homo sapiens
atgcacacgtaccctacaaggc

SEQ ID NO: 9009825 - DNA, 22 bp, Homo sapiens
atgcacagaaaaattgcttact

SEQ ID NO: 9009826 - DNA, 22 bp, Homo sapiens
atgcacactgggattcaactgg

SEQ ID NO: 9009827 - DNA, 22 bp, Homo sapiens
atgcacagaaaaattgcttact

SEQ ID NO: 9009828 - DNA, 22 bp, Homo sapiens
atgcacagctgaacactctaaa

SEQ ID NO: 9009829 - DNA, 22 bp, Homo sapiens
atgcacagacccaaaggccatc

SEQ ID NO: 9009830 - DNA, 23 bp, Homo sapiens
gaatacaaagcagatggtccagc

SEQ ID NO: 9009831 - DNA, 23 bp, Homo sapiens
gaatacaaagcagatggtccagc

SEQ ID NO: 9009832 - DNA, 22 bp, Homo sapiens
gaatacaaagcagaactcatac

SEQ ID NO: 9009833 - DNA, 22 bp, Homo sapiens
gaatacaaagcagaactcatac

SEQ ID NO: 9009834 - DNA, 22 bp, Homo sapiens
gaatacaaataataccaaggtg

SEQ ID NO: 9009835 - DNA, 22 bp, Homo sapiens
gaatacaaataataccaaggtg

SEQ ID NO: 9009836 - DNA, 22 bp, Homo sapiens
gaatacaaataataccaaggtg

SEQ ID NO: 9009837 - DNA, 22 bp, Homo sapiens
gaatacaaataataccaaggtg

SEQ ID NO: 9009838 - DNA, 22 bp, Homo sapiens
gaatacaaagcagaactcatac

SEQ ID NO: 9009839 - DNA, 22 bp, Homo sapiens
gaatacaaagcagaactcatac

SEQ ID NO: 9009840 - DNA, 22 bp, Homo sapiens
gaatacaaagcagaactcatac

SEQ ID NO: 9009841 - DNA, 22 bp, Homo sapiens
gaatacaaagcagaactcatac

SEQ ID NO: 9009842 - DNA, 22 bp, Homo sapiens
gaatacaaacttaaggctttac

SEQ ID NO: 9009843 - DNA, 22 bp, Homo sapiens
gaatacaaacttaaggctttac

SEQ ID NO: 9009844 - DNA, 22 bp, Homo sapiens
gaatacaaacttaaggctttac

SEQ ID NO: 9009845 - DNA, 22 bp, Homo sapiens
gaatacaaacttaaggctttac

SEQ ID NO: 9009846 - DNA, 22 bp, Homo sapiens
gaatacaaacttaaggctttac

SEQ ID NO: 9009847 - DNA, 22 bp, Homo sapiens
gaataattttgatcagaaggga

SEQ ID NO: 9009848 - DNA, 22 bp, Homo sapiens
gaataattttgatcagaaggga

SEQ ID NO: 9009849 - DNA, 22 bp, Homo sapiens
gaataattgtgatgcttgaagt

SEQ ID NO: 9009850 - DNA, 22 bp, Homo sapiens
gaataattgtgatgcttgaagt

SEQ ID NO: 9009851 - DNA, 22 bp, Homo sapiens
gaataatcatatcgtctcacat

SEQ ID NO: 9009852 - DNA, 22 bp, Homo sapiens
gaataatcatgaaattcagtga

SEQ ID NO: 9009853 - DNA, 22 bp, Homo sapiens
gaataatattgactttgcaggc

SEQ ID NO: 9009854 - DNA, 22 bp, Homo sapiens
gaataatattgactttgcaggc

SEQ ID NO: 9009855 - DNA, 22 bp, Homo sapiens
gaataatattgactttgcaggc

SEQ ID NO: 9009856 - DNA, 22 bp, Homo sapiens
gaataatagcagaaattagcag

SEQ ID NO: 9009857 - DNA, 22 bp, Homo sapiens
gaataatagcagaaattagcag

SEQ ID NO: 9009858 - DNA, 22 bp, Homo sapiens
gaataactaaatggcagttctt

SEQ ID NO: 9009859 - DNA, 22 bp, Homo sapiens
gaataactaaatggcagttctt

SEQ ID NO: 9009860 - DNA, 22 bp, Homo sapiens
gaataacattttttcctttaca

SEQ ID NO: 9009861 - DNA, 22 bp, Homo sapiens
gaataacattttttcctttaca

SEQ ID NO: 9009862 - DNA, 22 bp, Homo sapiens
gaataatagcagaaattagcag

SEQ ID NO: 9009863 - DNA, 22 bp, Homo sapiens
gaataactgctatctttctggc

SEQ ID NO: 9009864 - DNA, 22 bp, Homo sapiens
gaataactccatgatatgcttt

SEQ ID NO: 9009865 - DNA, 22 bp, Homo sapiens
gaagtcttttcttccacccaaa

SEQ ID NO: 9009866 - DNA, 22 bp, Homo sapiens
gaataactccatgatatgcttt

SEQ ID NO: 9009867 - DNA, 22 bp, Homo sapiens
gaagtcttcatctgatgctctg

SEQ ID NO: 9009868 - DNA, 22 bp, Homo sapiens
atgcacaggaccacacataatg

SEQ ID NO: 9009869 - DNA, 22 bp, Homo sapiens
gaatattttcagtacagatggt

SEQ ID NO: 9009870 - DNA, 22 bp, Homo sapiens
gaatattttcagtacagatggt

SEQ ID NO: 9009871 - DNA, 22 bp, Homo sapiens
gaatattttcagtacagatggt

SEQ ID NO: 9009872 - DNA, 22 bp, Homo sapiens
gaatattttcagtacagatggt

SEQ ID NO: 9009873 - DNA, 22 bp, Homo sapiens
gaatcaaatcaagttcttttga

SEQ ID NO: 9009874 - DNA, 22 bp, Homo sapiens
gaatcaaatcaagttcttttga

SEQ ID NO: 9009875 - DNA, 22 bp, Homo sapiens
gaatatttttaaagggactaat

SEQ ID NO: 9009876 - DNA, 22 bp, Homo sapiens
gaatattttcagtacagatggt

SEQ ID NO: 9009877 - DNA, 22 bp, Homo sapiens
gaatattttcagtacagatggt

SEQ ID NO: 9009878 - DNA, 22 bp, Homo sapiens
gaatatttttaaagggactaat

SEQ ID NO: 9009879 - DNA, 22 bp, Homo sapiens
gaatcaatggtagattaagtaa

SEQ ID NO: 9009880 - DNA, 22 bp, Homo sapiens
gaatcaaatcaagttcttttga

SEQ ID NO: 9009881 - DNA, 22 bp, Homo sapiens
gaatcaattgtgaagactatga

SEQ ID NO: 9009882 - DNA, 22 bp, Homo sapiens
gaatcaattatccaggctgttg

SEQ ID NO: 9009883 - DNA, 22 bp, Homo sapiens
gaatcacactcgtaagtgagtt

SEQ ID NO: 9009884 - DNA, 22 bp, Homo sapiens
gaatcacactcgtaagtgagtt

SEQ ID NO: 9009885 - DNA, 22 bp, Homo sapiens
gaatcacactcgtaagtgagtt

SEQ ID NO: 9009886 - DNA, 22 bp, Homo sapiens
gaatcagaaccactggagggtt

SEQ ID NO: 9009887 - DNA, 22 bp, Homo sapiens
gaatcacagaggcaaattctga

SEQ ID NO: 9009888 - DNA, 22 bp, Homo sapiens
gaatcagaatctctaaggtggg

SEQ ID NO: 9009889 - DNA, 22 bp, Homo sapiens
gaattttatcttattacttgca

SEQ ID NO: 9009890 - DNA, 22 bp, Homo sapiens
gaattttatcttattacttgca

SEQ ID NO: 9009891 - DNA, 22 bp, Homo sapiens
gaattttatcttattacttgca

SEQ ID NO: 9009892 - DNA, 22 bp, Homo sapiens
gacaataaagtgatacatggga

SEQ ID NO: 9009893 - DNA, 22 bp, Homo sapiens
gaatcagcctgagtttgcagct

SEQ ID NO: 9009894 - DNA, 19 bp, Homo sapiens
gaattttaggacttcagca

SEQ ID NO: 9009895 - DNA, 19 bp, Homo sapiens
gaattttaggacttcagca

SEQ ID NO: 9009896 - DNA, 22 bp, Homo sapiens
gacaatgtaaatcaggatagca

SEQ ID NO: 9009897 - DNA, 22 bp, Homo sapiens
gacaatgcattgtgattgtgac

SEQ ID NO: 9009898 - DNA, 22 bp, Homo sapiens
gacaatgcattgtgattgtgac

SEQ ID NO: 9009899 - DNA, 21 bp, Homo sapiens
gacaatgcagtcttttttgga

SEQ ID NO: 9009900 - DNA, 21 bp, Homo sapiens
gacaatgcagtcttttttgga

SEQ ID NO: 9009901 - DNA, 22 bp, Homo sapiens
gacaatgagtgaggcacctggg

SEQ ID NO: 9009902 - DNA, 22 bp, Homo sapiens
gacaatgcagaagtacttgttc

SEQ ID NO: 9009903 - DNA, 22 bp, Homo sapiens
gacaatgcagaagtacttgttc

SEQ ID NO: 9009904 - DNA, 22 bp, Homo sapiens
gacaataagaaaagaggaggca

SEQ ID NO: 9009905 - DNA, 22 bp, Homo sapiens
gacaataaagtgatacatggga

SEQ ID NO: 9009906 - DNA, 22 bp, Homo sapiens
gacaataagaacagatactgtg

SEQ ID NO: 9009907 - DNA, 22 bp, Homo sapiens
gacaataagaacagatactgtg

SEQ ID NO: 9009908 - DNA, 22 bp, Homo sapiens
gacaataagaacagatactgtg

SEQ ID NO: 9009909 - DNA, 22 bp, Homo sapiens
gacaataaagtgatacatggga

SEQ ID NO: 9009910 - DNA, 22 bp, Homo sapiens
gtctggaagaacctgtgccagt

SEQ ID NO: 9009911 - DNA, 22 bp, Homo sapiens
gtctggaaattaagaggaggtt

SEQ ID NO: 9009912 - DNA, 22 bp, Homo sapiens
gtctggaaggaggagatggagc

SEQ ID NO: 9009913 - DNA, 22 bp, Homo sapiens
gtctggactgcaaaataaggat

SEQ ID NO: 9009914 - DNA, 22 bp, Homo sapiens
gtctggacaggactatttctaa

SEQ ID NO: 9009915 - DNA, 22 bp, Homo sapiens
gtctggacagcagcacctcggc

SEQ ID NO: 9009916 - DNA, 22 bp, Homo sapiens
cagccaggcccccgagtcgttg

SEQ ID NO: 9009917 - DNA, 22 bp, Homo sapiens
cagccaggcccccgagtcgttg

SEQ ID NO: 9009918 - DNA, 22 bp, Homo sapiens
cagccaggcctggtgaccaaag

SEQ ID NO: 9009919 - DNA, 22 bp, Homo sapiens
cagccaggcctggtgaccaaag

SEQ ID NO: 9009920 - DNA, 22 bp, Homo sapiens
cagccaggcctggtgaccaaag

SEQ ID NO: 9009921 - DNA, 22 bp, Homo sapiens
cagccaggcctggtgaccaaag

SEQ ID NO: 9009922 - DNA, 22 bp, Homo sapiens
cagccagggagcaaagagttga

SEQ ID NO: 9009923 - DNA, 22 bp, Homo sapiens
cagccagggagggcaaatgaga

SEQ ID NO: 9009924 - DNA, 22 bp, Homo sapiens
cagccagggagggcaaatgaga

SEQ ID NO: 9009925 - DNA, 22 bp, Homo sapiens
cagccagggagcaaagagttga

SEQ ID NO: 9009926 - DNA, 22 bp, Homo sapiens
cagccagggagcaaagagttga

SEQ ID NO: 9009927 - DNA, 22 bp, Homo sapiens
cagccagggagcaaagagttga

SEQ ID NO: 9009928 - DNA, 22 bp, Homo sapiens
gtctggagccactgctgctgct

SEQ ID NO: 9009929 - DNA, 22 bp, Homo sapiens
gtctggagagctgagcagagtt

SEQ ID NO: 9009930 - DNA, 22 bp, Homo sapiens
gtctggagccaccctaagcatt

SEQ ID NO: 9009931 - DNA, 22 bp, Homo sapiens
gtctggagagctgagcagagtt

SEQ ID NO: 9009932 - DNA, 22 bp, Homo sapiens
gtcccaggcttatgtggagctt

SEQ ID NO: 9009933 - DNA, 22 bp, Homo sapiens
gtcccaggcttatgtggagctt

SEQ ID NO: 9009934 - DNA, 22 bp, Homo sapiens
gtcccagggaagaaggcagcac

SEQ ID NO: 9009935 - DNA, 22 bp, Homo sapiens
gtcccagggaagaaggcagcac

SEQ ID NO: 9009936 - DNA, 22 bp, Homo sapiens
gtccctggcgctttcgagcctt

SEQ ID NO: 9009937 - DNA, 22 bp, Homo sapiens
gtccctggatctgggacagctg

SEQ ID NO: 9009938 - DNA, 22 bp, Homo sapiens
gtccctggatctgggacagctg

SEQ ID NO: 9009939 - DNA, 22 bp, Homo sapiens
gtcccaggctccatggcagcca

SEQ ID NO: 9009940 - DNA, 22 bp, Homo sapiens
gtcccaggctccatggcagcca

SEQ ID NO: 9009941 - DNA, 22 bp, Homo sapiens
gtcccaggctccatggcagcca

SEQ ID NO: 9009942 - DNA, 22 bp, Homo sapiens
gtcccaggctccatggcagcca

SEQ ID NO: 9009943 - DNA, 22 bp, Homo sapiens
gtcccaggcttatgtggagctt

SEQ ID NO: 9009944 - DNA, 22 bp, Homo sapiens
gtcccaggcttatgtggagctt

SEQ ID NO: 9009945 - DNA, 22 bp, Homo sapiens
gtccctgggaaaggagagggca

SEQ ID NO: 9009946 - DNA, 19 bp, Homo sapiens
gtccctgggcagaggcacc

SEQ ID NO: 9009947 - DNA, 19 bp, Homo sapiens
gtccctgggcagaggcacc

SEQ ID NO: 9009948 - DNA, 22 bp, Homo sapiens
gtccctgggcgcctccgtgctc

SEQ ID NO: 9009949 - DNA, 22 bp, Homo sapiens
gtccctgggcgcctccgtgctc

SEQ ID NO: 9009950 - DNA, 22 bp, Homo sapiens
gtccctgggcgcctccgtgctc

SEQ ID NO: 9009951 - DNA, 22 bp, Homo sapiens
gtccctggggaatcagctggag

SEQ ID NO: 9009952 - DNA, 22 bp, Homo sapiens
gtccctgggtctaaggcagtaa

SEQ ID NO: 9009953 - DNA, 22 bp, Homo sapiens
gtccctgggtctaaggcagtaa

SEQ ID NO: 9009954 - DNA, 22 bp, Homo sapiens
gtccctgggtagctcagtggct

SEQ ID NO: 9009955 - DNA, 22 bp, Homo sapiens
gtccctggtttgcccaggacca

SEQ ID NO: 9009956 - DNA, 22 bp, Homo sapiens
gtccctggtttgcccaggacca

SEQ ID NO: 9009957 - DNA, 22 bp, Homo sapiens
gtccctggtctaccgtggcttc

SEQ ID NO: 9009958 - DNA, 22 bp, Homo sapiens
gtccctgggtctaaggcagtaa

SEQ ID NO: 9009959 - DNA, 22 bp, Homo sapiens
gtccctgggtctaaggcagtaa

SEQ ID NO: 9009960 - DNA, 22 bp, Homo sapiens
gtcccttcctcattccacttta

SEQ ID NO: 9009961 - DNA, 22 bp, Homo sapiens
gtcccttcctcattccacttta

SEQ ID NO: 9009962 - DNA, 19 bp, Homo sapiens
gtcccttcactcctgctgg

SEQ ID NO: 9009963 - DNA, 19 bp, Homo sapiens
gtcccttcactcctgctgg

SEQ ID NO: 9009964 - DNA, 19 bp, Homo sapiens
gtcccttcactcctgctgg

SEQ ID NO: 9009965 - DNA, 22 bp, Homo sapiens
gtctcttttatggtgagttgat

SEQ ID NO: 9009966 - DNA, 22 bp, Homo sapiens
cagcccaggctcagatgttggg

SEQ ID NO: 9009967 - DNA, 22 bp, Homo sapiens
cagcccaggctcagatgttggg

SEQ ID NO: 9009968 - DNA, 22 bp, Homo sapiens
cagcccaggctcagatgttggg

SEQ ID NO: 9009969 - DNA, 22 bp, Homo sapiens
cagcccaggctcagatgttggg

SEQ ID NO: 9009970 - DNA, 22 bp, Homo sapiens
cagccaggttcaagtccttata

SEQ ID NO: 9009971 - DNA, 22 bp, Homo sapiens
cagccaggttcaagtccttata

SEQ ID NO: 9009972 - DNA, 22 bp, Homo sapiens
cagccaggtatgggcgtgcggg

SEQ ID NO: 9009973 - DNA, 22 bp, Homo sapiens
cagccaggtatgggcgtgcggg

SEQ ID NO: 9009974 - DNA, 22 bp, Homo sapiens
cagccaggttagtgctaattgt

SEQ ID NO: 9009975 - DNA, 22 bp, Homo sapiens
cagccaggtatgggcgtgcggg

SEQ ID NO: 9009976 - DNA, 22 bp, Homo sapiens
cagccaggttagtgctaattgt

SEQ ID NO: 9009977 - DNA, 22 bp, Homo sapiens
cagccaggggctggcgtgttga

SEQ ID NO: 9009978 - DNA, 22 bp, Homo sapiens
cagccaggggctggcgtgttga

SEQ ID NO: 9009979 - DNA, 22 bp, Homo sapiens
cagccagggtcaggcagcttct

SEQ ID NO: 9009980 - DNA, 22 bp, Homo sapiens
cagccaggggctggcgtgttga

SEQ ID NO: 9009981 - DNA, 22 bp, Homo sapiens
cagccagggagggcaaatgaga

SEQ ID NO: 9009982 - DNA, 22 bp, Homo sapiens
cagccagggtcaggcagcttct

SEQ ID NO: 9009983 - DNA, 22 bp, Homo sapiens
cagccagggtcaggcagcttct

SEQ ID NO: 9009984 - DNA, 22 bp, Homo sapiens
cagccagggtcaggcagcttct

SEQ ID NO: 9009985 - DNA, 22 bp, Homo sapiens
cagccagggtcaggcagcttct

SEQ ID NO: 9009986 - DNA, 22 bp, Homo sapiens
cagccaggtatgggcgtgcggg

SEQ ID NO: 9009987 - DNA, 22 bp, Homo sapiens
cagccagggtcaggcagcttct

SEQ ID NO: 9009988 - DNA, 22 bp, Homo sapiens
cagccagggtcaggcagcttct

SEQ ID NO: 9009989 - DNA, 22 bp, Homo sapiens
cagccccatggtgtgctccagc

SEQ ID NO: 9009990 - DNA, 22 bp, Homo sapiens
cagccccatggtgtgctccagc

SEQ ID NO: 9009991 - DNA, 22 bp, Homo sapiens
cagccccatggtgtgctccagc

SEQ ID NO: 9009992 - DNA, 22 bp, Homo sapiens
cagcccccatggggaggtcaag

SEQ ID NO: 9009993 - DNA, 22 bp, Homo sapiens
cagcccctcacagagctgtcct

SEQ ID NO: 9009994 - DNA, 22 bp, Homo sapiens
cagcccctcacagagctgtcct

SEQ ID NO: 9009995 - DNA, 22 bp, Homo sapiens
cagcccctcacagagctgtcct

SEQ ID NO: 9009996 - DNA, 22 bp, Homo sapiens
cagcccctcacagagctgtcct

SEQ ID NO: 9009997 - DNA, 22 bp, Homo sapiens
cagcccctcacagagctgtcct

SEQ ID NO: 9009998 - DNA, 22 bp, Homo sapiens
cagcccctcacagagctgtcct

SEQ ID NO: 9009999 - DNA, 22 bp, Homo sapiens
cagcccctcacagagctgtcct

SEQ ID NO: 9010000 - DNA, 22 bp, Homo sapiens
cagcccctccctcaggcaggtg

SEQ ID NO: 9010001 - DNA, 22 bp, Homo sapiens
cagcccctccctcaggcaggtg

SEQ ID NO: 9010002 - DNA, 22 bp, Homo sapiens
cagcccctggcgcacgccgagc

SEQ ID NO: 9010003 - DNA, 22 bp, Homo sapiens
cagccctcaaaccacttccagg

SEQ ID NO: 9010004 - DNA, 22 bp, Homo sapiens
cagccctcaaaccacttccagg

SEQ ID NO: 9010005 - DNA, 22 bp, Homo sapiens
cagcccgccctgaactttcggg

SEQ ID NO: 9010006 - DNA, 22 bp, Homo sapiens
cagccccttgtccggtagccac

SEQ ID NO: 9010007 - DNA, 22 bp, Homo sapiens
cagccccttcctggcatctgga

SEQ ID NO: 9010008 - DNA, 22 bp, Homo sapiens
cagccccttcctggcatctgga

SEQ ID NO: 9010009 - DNA, 22 bp, Homo sapiens
cagccccttcctggcatctgga

SEQ ID NO: 9010010 - DNA, 22 bp, Homo sapiens
cagccccttcctggcatctgga

SEQ ID NO: 9010011 - DNA, 22 bp, Homo sapiens
cagccccttcctggcatctgga

SEQ ID NO: 9010012 - DNA, 22 bp, Homo sapiens
cagccctcaaaccacttccagg

SEQ ID NO: 9010013 - DNA, 22 bp, Homo sapiens
cagccctcaggtcctcagcagc

SEQ ID NO: 9010014 - DNA, 22 bp, Homo sapiens
cagccctcaggtcctcagcagc

SEQ ID NO: 9010015 - DNA, 22 bp, Homo sapiens
cagccctcaggtcctcagcagc

SEQ ID NO: 9010016 - DNA, 22 bp, Homo sapiens
cagccctcaggtcctcagcagc

SEQ ID NO: 9010017 - DNA, 22 bp, Homo sapiens
cagccctcaggtcctcagcagc

SEQ ID NO: 9010018 - DNA, 22 bp, Homo sapiens
cagccctcaggtcctcagcagc

SEQ ID NO: 9010019 - DNA, 22 bp, Homo sapiens
gtctgtaattattaaagaaagg

SEQ ID NO: 9010020 - DNA, 22 bp, Homo sapiens
gtctgtaattattaaagaaagg

SEQ ID NO: 9010021 - DNA, 22 bp, Homo sapiens
gtctgtaattattaaagaaagg

SEQ ID NO: 9010022 - DNA, 22 bp, Homo sapiens
gtctgtacccacgtcctgctag

SEQ ID NO: 9010023 - DNA, 22 bp, Homo sapiens
gtctgtacccacgtcctgctag

SEQ ID NO: 9010024 - DNA, 22 bp, Homo sapiens
gtctgtagatattcactccttc

SEQ ID NO: 9010025 - DNA, 22 bp, Homo sapiens
cagccctcatcccgcctgcgtt

SEQ ID NO: 9010026 - DNA, 22 bp, Homo sapiens
cagccctcatcccgcctgcgtt

SEQ ID NO: 9010027 - DNA, 22 bp, Homo sapiens
gtctgtccttttcatctcccaa

SEQ ID NO: 9010028 - DNA, 22 bp, Homo sapiens
gtctgtccttccgactgtagct

SEQ ID NO: 9010029 - DNA, 22 bp, Homo sapiens
gtctgtcctgtacccagcatct

SEQ ID NO: 9010030 - DNA, 22 bp, Homo sapiens
gtctgtcctgtacccagcatct

SEQ ID NO: 9010031 - DNA, 22 bp, Homo sapiens
gtctgtccatcagcaaaggctt

SEQ ID NO: 9010032 - DNA, 22 bp, Homo sapiens
gtctgtccatcagcaaaggctt

SEQ ID NO: 9010033 - DNA, 22 bp, Homo sapiens
gtctgtcccaatagccaacagg

SEQ ID NO: 9010034 - DNA, 22 bp, Homo sapiens
gtctgtccatgagtagttccat

SEQ ID NO: 9010035 - DNA, 19 bp, Homo sapiens
gtctgtccccacgagtggc

SEQ ID NO: 9010036 - DNA, 22 bp, Homo sapiens
gtctgtccaggtgaatgcttca

SEQ ID NO: 9010037 - DNA, 22 bp, Homo sapiens
gtctgtccaggagattcagtct

SEQ ID NO: 9010038 - DNA, 22 bp, Homo sapiens
gtctgtccagcaacacaggagt

SEQ ID NO: 9010039 - DNA, 22 bp, Homo sapiens
gtctgtccagcaacacaggagt

SEQ ID NO: 9010040 - DNA, 22 bp, Homo sapiens
gtctgtcatctgagatggagtg

SEQ ID NO: 9010041 - DNA, 22 bp, Homo sapiens
gtctgtccacttggaagctccc

SEQ ID NO: 9010042 - DNA, 22 bp, Homo sapiens
gtctgtccacttggaagctccc

SEQ ID NO: 9010043 - DNA, 22 bp, Homo sapiens
gtctgtcatctgagatggagtg

SEQ ID NO: 9010044 - DNA, 22 bp, Homo sapiens
gtctgtatcagaggagtgaatg

SEQ ID NO: 9010045 - DNA, 22 bp, Homo sapiens
gtctgtggcaggggagaagttt

SEQ ID NO: 9010046 - DNA, 22 bp, Homo sapiens
gtctgtgcttattcagcagggg

SEQ ID NO: 9010047 - DNA, 22 bp, Homo sapiens
gtctgtgcagttactagctggt

SEQ ID NO: 9010048 - DNA, 22 bp, Homo sapiens
gtctgtctgttgttgagaagca

SEQ ID NO: 9010049 - DNA, 22 bp, Homo sapiens
gtctgtctcctgggtgcgcacc

SEQ ID NO: 9010050 - DNA, 22 bp, Homo sapiens
gtctgtctctctccagagtgca

SEQ ID NO: 9010051 - DNA, 22 bp, Homo sapiens
gtctgtgtgcacagcgagtgcc

SEQ ID NO: 9010052 - DNA, 22 bp, Homo sapiens
gtctgtgtgcacagcgagtgcc

SEQ ID NO: 9010053 - DNA, 22 bp, Homo sapiens
gtctgtggtccctgctggggac

SEQ ID NO: 9010054 - DNA, 22 bp, Homo sapiens
gtctgtgtgcacagcgagtgcc

SEQ ID NO: 9010055 - DNA, 22 bp, Homo sapiens
gtctgtgtgcacagcgagtgcc

SEQ ID NO: 9010056 - DNA, 18 bp, Homo sapiens
gtctgtgtggcttgggga

SEQ ID NO: 9010057 - DNA, 18 bp, Homo sapiens
gtctgtgtggcttgggga

SEQ ID NO: 9010058 - DNA, 22 bp, Homo sapiens
gtctgtgtgcacagagctttgg

SEQ ID NO: 9010059 - DNA, 19 bp, Homo sapiens
gtctgtgtatttgttgctg

SEQ ID NO: 9010060 - DNA, 22 bp, Homo sapiens
gtctgtggtagacaggaaggca

SEQ ID NO: 9010061 - DNA, 22 bp, Homo sapiens
gtctgtgggccaaatacagccc

SEQ ID NO: 9010062 - DNA, 22 bp, Homo sapiens
gtcccaggaacattctggctag

SEQ ID NO: 9010063 - DNA, 22 bp, Homo sapiens
gtcccaggaacattctggctag

SEQ ID NO: 9010064 - DNA, 22 bp, Homo sapiens
gtcccaggaacattctggctag

SEQ ID NO: 9010065 - DNA, 22 bp, Homo sapiens
gtcccagcttcccactagcagc

SEQ ID NO: 9010066 - DNA, 22 bp, Homo sapiens
gtcccaggaacattctggctag

SEQ ID NO: 9010067 - DNA, 22 bp, Homo sapiens
gtcccagcttcccactagcagc

SEQ ID NO: 9010068 - DNA, 22 bp, Homo sapiens
gtcccagcttcccactagcagc

SEQ ID NO: 9010069 - DNA, 22 bp, Homo sapiens
gtcccagagagcactagtccat

SEQ ID NO: 9010070 - DNA, 22 bp, Homo sapiens
gtcccagagagcactagtccat

SEQ ID NO: 9010071 - DNA, 22 bp, Homo sapiens
gtcccagaggacagggtcacat

SEQ ID NO: 9010072 - DNA, 22 bp, Homo sapiens
gtcccagatgtctggaactccc

SEQ ID NO: 9010073 - DNA, 22 bp, Homo sapiens
gtcccagaggctttggccacag

SEQ ID NO: 9010074 - DNA, 22 bp, Homo sapiens
gtcccaggcagagtcaggaggg

SEQ ID NO: 9010075 - DNA, 22 bp, Homo sapiens
gtcccaggcagagtcaggaggg

SEQ ID NO: 9010076 - DNA, 22 bp, Homo sapiens
gtcccaggagttgctgggcctt

SEQ ID NO: 9010077 - DNA, 22 bp, Homo sapiens
gtcccaggagttgctgggcctt

SEQ ID NO: 9010078 - DNA, 22 bp, Homo sapiens
gtcccaggctccatggcagcca

SEQ ID NO: 9010079 - DNA, 22 bp, Homo sapiens
gtcccaggcaggccactggcag

SEQ ID NO: 9010080 - DNA, 22 bp, Homo sapiens
gtcccaggcaggccactggcag

SEQ ID NO: 9010081 - DNA, 22 bp, Homo sapiens
gtcccaggcagagtcaggaggg

SEQ ID NO: 9010082 - DNA, 22 bp, Homo sapiens
gtcccaggcagagtcaggaggg

SEQ ID NO: 9010083 - DNA, 22 bp, Homo sapiens
cagcaggctctgagtggctgcc

SEQ ID NO: 9010084 - DNA, 22 bp, Homo sapiens
cagcaggctctgagtggctgcc

SEQ ID NO: 9010085 - DNA, 22 bp, Homo sapiens
cagcaggctgcgattgctcatt

SEQ ID NO: 9010086 - DNA, 22 bp, Homo sapiens
cagcaggctgcgattgctcatt

SEQ ID NO: 9010087 - DNA, 22 bp, Homo sapiens
cagcaggctgcgattgctcatt

SEQ ID NO: 9010088 - DNA, 22 bp, Homo sapiens
cagcaggctctgagtggctgcc

SEQ ID NO: 9010089 - DNA, 22 bp, Homo sapiens
cagcaggctctgagtggctgcc

SEQ ID NO: 9010090 - DNA, 22 bp, Homo sapiens
cagcaggctctgagtggctgcc

SEQ ID NO: 9010091 - DNA, 22 bp, Homo sapiens
cagcaggctctgagtggctgcc

SEQ ID NO: 9010092 - DNA, 22 bp, Homo sapiens
cagcaggctctgagtggctgcc

SEQ ID NO: 9010093 - DNA, 22 bp, Homo sapiens
gtccagccactcaccttccagc

SEQ ID NO: 9010094 - DNA, 22 bp, Homo sapiens
gtccagccactcaccttccagc

SEQ ID NO: 9010095 - DNA, 22 bp, Homo sapiens
gtccagccaccctggaggcacg

SEQ ID NO: 9010096 - DNA, 22 bp, Homo sapiens
gtccagccagctggtccttgcc

SEQ ID NO: 9010097 - DNA, 22 bp, Homo sapiens
gtccagccactcaccttccagc

SEQ ID NO: 9010098 - DNA, 22 bp, Homo sapiens
gtccagccagctggtccttgcc

SEQ ID NO: 9010099 - DNA, 22 bp, Homo sapiens
gtccagccagctggtccttgcc

SEQ ID NO: 9010100 - DNA, 22 bp, Homo sapiens
gtccagccagctggtccttgcc

SEQ ID NO: 9010101 - DNA, 22 bp, Homo sapiens
gtcccagaaacatattgctggt

SEQ ID NO: 9010102 - DNA, 22 bp, Homo sapiens
cagcaggctgcgattgctcatt

SEQ ID NO: 9010103 - DNA, 22 bp, Homo sapiens
cagcaggctgtggaaatcctgg

SEQ ID NO: 9010104 - DNA, 22 bp, Homo sapiens
cagcaggctgtggaaatcctgg

SEQ ID NO: 9010105 - DNA, 22 bp, Homo sapiens
cagcaggctgtggaaatcctgg

SEQ ID NO: 9010106 - DNA, 22 bp, Homo sapiens
gtcatcttgctgttttagatct

SEQ ID NO: 9010107 - DNA, 22 bp, Homo sapiens
gtcatgagaaatctttgaaggt

SEQ ID NO: 9010108 - DNA, 22 bp, Homo sapiens
gtcatgtgacccaacctgagcc

SEQ ID NO: 9010109 - DNA, 22 bp, Homo sapiens
gtcatgtgaataagtgtggggt

SEQ ID NO: 9010110 - DNA, 22 bp, Homo sapiens
gtcatgtgaaatttggcaggcc

SEQ ID NO: 9010111 - DNA, 22 bp, Homo sapiens
gtcatggaggattgtgagtggt

SEQ ID NO: 9010112 - DNA, 22 bp, Homo sapiens
gtcatggtgctagcgggaatgt

SEQ ID NO: 9010113 - DNA, 22 bp, Homo sapiens
gtcattaaaggttttaaatgct

SEQ ID NO: 9010114 - DNA, 22 bp, Homo sapiens
cagcaggcggcccgcgggcccg

SEQ ID NO: 9010115 - DNA, 22 bp, Homo sapiens
cagcaggcggcccgcgggcccg

SEQ ID NO: 9010116 - DNA, 22 bp, Homo sapiens
cagcaggcgttgggagaaagac

SEQ ID NO: 9010117 - DNA, 20 bp, Homo sapiens
cagcaggctatggggcaccc

SEQ ID NO: 9010118 - DNA, 20 bp, Homo sapiens
cagcaggctatggggcaccc

SEQ ID NO: 9010119 - DNA, 22 bp, Homo sapiens
gtcatattataaatgttctgtt

SEQ ID NO: 9010120 - DNA, 22 bp, Homo sapiens
gtcatatacactgcatgtaatc

SEQ ID NO: 9010121 - DNA, 22 bp, Homo sapiens
gtcataggttcaaaaggcagat

SEQ ID NO: 9010122 - DNA, 22 bp, Homo sapiens
gtcatagtagtggaacagcagc

SEQ ID NO: 9010123 - DNA, 22 bp, Homo sapiens
gtcatagaggcctatataattt

SEQ ID NO: 9010124 - DNA, 22 bp, Homo sapiens
gtcataatcacagttttatgca

SEQ ID NO: 9010125 - DNA, 22 bp, Homo sapiens
gtcataggcatggatgtgggtt

SEQ ID NO: 9010126 - DNA, 22 bp, Homo sapiens
gtcataggttcaaaaggcagat

SEQ ID NO: 9010127 - DNA, 22 bp, Homo sapiens
gtcataggtagggggaaggatg

SEQ ID NO: 9010128 - DNA, 22 bp, Homo sapiens
gtcatcttaaggactgctatag

SEQ ID NO: 9010129 - DNA, 22 bp, Homo sapiens
gtcatcttaaggactgctatag

SEQ ID NO: 9010130 - DNA, 22 bp, Homo sapiens
gtcatcttcctagtgttaacta

SEQ ID NO: 9010131 - DNA, 22 bp, Homo sapiens
gtcatcttcgcagagtgatttt

SEQ ID NO: 9010132 - DNA, 22 bp, Homo sapiens
gtcatcttctctcagcccaggc

SEQ ID NO: 9010133 - DNA, 21 bp, Homo sapiens
gtcatccacctctcgggctct

SEQ ID NO: 9010134 - DNA, 22 bp, Homo sapiens
gtcatcatttttagcatatggg

SEQ ID NO: 9010135 - DNA, 22 bp, Homo sapiens
gtcatattgaagaagactggca

SEQ ID NO: 9010136 - DNA, 22 bp, Homo sapiens
gtcatccagactttgcctctgc

SEQ ID NO: 9010137 - DNA, 22 bp, Homo sapiens
cagcacctaggacagtagtcag

SEQ ID NO: 9010138 - DNA, 22 bp, Homo sapiens
cagcacctaggacagtagtcag

SEQ ID NO: 9010139 - DNA, 22 bp, Homo sapiens
cagcaccctttccactgccttg

SEQ ID NO: 9010140 - DNA, 22 bp, Homo sapiens
cagcacctacccatcctgagtc

SEQ ID NO: 9010141 - DNA, 22 bp, Homo sapiens
cagcacccctcctggctatgaa

SEQ ID NO: 9010142 - DNA, 22 bp, Homo sapiens
cagcacccctcctggctatgaa

SEQ ID NO: 9010143 - DNA, 22 bp, Homo sapiens
cagcaccctcggaggctgccgt

SEQ ID NO: 9010144 - DNA, 22 bp, Homo sapiens
cagcaccctcggaggctgccgt

SEQ ID NO: 9010145 - DNA, 22 bp, Homo sapiens
cagcaccatttgcagcctcttt

SEQ ID NO: 9010146 - DNA, 22 bp, Homo sapiens
cagcaccattttcctggtcagc

SEQ ID NO: 9010147 - DNA, 22 bp, Homo sapiens
cagcacctggcacaggagggcc

SEQ ID NO: 9010148 - DNA, 22 bp, Homo sapiens
cagcacctgttagcattaaata

SEQ ID NO: 9010149 - DNA, 22 bp, Homo sapiens
cagcaccttccttaactccagg

SEQ ID NO: 9010150 - DNA, 22 bp, Homo sapiens
cagcaccttccttaactccagg

SEQ ID NO: 9010151 - DNA, 22 bp, Homo sapiens
cagcaccttccttaactccagg

SEQ ID NO: 9010152 - DNA, 22 bp, Homo sapiens
cagcaccttcctatccaggaga

SEQ ID NO: 9010153 - DNA, 22 bp, Homo sapiens
cagcagctacttggagcagcag

SEQ ID NO: 9010154 - DNA, 22 bp, Homo sapiens
cagcactaggatatacatttcc

SEQ ID NO: 9010155 - DNA, 22 bp, Homo sapiens
cagcagctacttggagcagcag

SEQ ID NO: 9010156 - DNA, 23 bp, Homo sapiens
cagcagctgcctggttttttggt

SEQ ID NO: 9010157 - DNA, 22 bp, Homo sapiens
cagcagctgcaaatggaaacag

SEQ ID NO: 9010158 - DNA, 22 bp, Homo sapiens
cagcagctgcctcagctgggga

SEQ ID NO: 9010159 - DNA, 22 bp, Homo sapiens
cagcagctgcctcagctgggga

SEQ ID NO: 9010160 - DNA, 22 bp, Homo sapiens
cagcagctgatggggaagtgat

SEQ ID NO: 9010161 - DNA, 22 bp, Homo sapiens
cagcagctgcaaatggaaacag

SEQ ID NO: 9010162 - DNA, 22 bp, Homo sapiens
cagcagctgcaaatggaaacag

SEQ ID NO: 9010163 - DNA, 22 bp, Homo sapiens
cagcagctgcaaatggaaacag

SEQ ID NO: 9010164 - DNA, 22 bp, Homo sapiens
cagcagctggtgagacacagcc

SEQ ID NO: 9010165 - DNA, 22 bp, Homo sapiens
cagcagctggtgagacacagcc

SEQ ID NO: 9010166 - DNA, 22 bp, Homo sapiens
cagcagctgggaaggaggctga

SEQ ID NO: 9010167 - DNA, 22 bp, Homo sapiens
cagcagctgggaaggaggctga

SEQ ID NO: 9010168 - DNA, 22 bp, Homo sapiens
cagcagctgcgtgcccaggccg

SEQ ID NO: 9010169 - DNA, 22 bp, Homo sapiens
cagcagctgcgtgcccaggccg

SEQ ID NO: 9010170 - DNA, 22 bp, Homo sapiens
cagcagctgcgtgcccaggccg

SEQ ID NO: 9010171 - DNA, 22 bp, Homo sapiens
cagcagcttttgcattctcatt

SEQ ID NO: 9010172 - DNA, 22 bp, Homo sapiens
cagcagctttgccaagtcagcc

SEQ ID NO: 9010173 - DNA, 20 bp, Homo sapiens
cagcaggaaaagtgcctcag

SEQ ID NO: 9010174 - DNA, 20 bp, Homo sapiens
cagcaggaaaagtgcctcag

SEQ ID NO: 9010175 - DNA, 22 bp, Homo sapiens
cagcagcttctgttgatcagaa

SEQ ID NO: 9010176 - DNA, 22 bp, Homo sapiens
cagcagctttgccaagtcagcc

SEQ ID NO: 9010177 - DNA, 22 bp, Homo sapiens
cagcagctttgccaagtcagcc

SEQ ID NO: 9010178 - DNA, 22 bp, Homo sapiens
cagcagctttgccaagtcagcc

SEQ ID NO: 9010179 - DNA, 22 bp, Homo sapiens
cagcagcttctgttgatcagaa

SEQ ID NO: 9010180 - DNA, 22 bp, Homo sapiens
cagcagcttctgttgatcagaa

SEQ ID NO: 9010181 - DNA, 22 bp, Homo sapiens
cagcagctggtgagacacagcc

SEQ ID NO: 9010182 - DNA, 22 bp, Homo sapiens
cagcagctggtgagacacagcc

SEQ ID NO: 9010183 - DNA, 22 bp, Homo sapiens
cagcagctggtgagacacagcc

SEQ ID NO: 9010184 - DNA, 22 bp, Homo sapiens
cagcagctggtgagacacagcc

SEQ ID NO: 9010185 - DNA, 22 bp, Homo sapiens
cagcagctggtgagacacagcc

SEQ ID NO: 9010186 - DNA, 22 bp, Homo sapiens
cagcagctggttatacctgtgg

SEQ ID NO: 9010187 - DNA, 22 bp, Homo sapiens
cagcagctggttatacctgtgg

SEQ ID NO: 9010188 - DNA, 22 bp, Homo sapiens
cagcagctggttgaatccttct

SEQ ID NO: 9010189 - DNA, 22 bp, Homo sapiens
cagcagctggttatacctgtgg

SEQ ID NO: 9010190 - DNA, 22 bp, Homo sapiens
cagcagctgtttacggaacacc

SEQ ID NO: 9010191 - DNA, 22 bp, Homo sapiens
cagcaggacatggaggagtaaa

SEQ ID NO: 9010192 - DNA, 22 bp, Homo sapiens
cagcaggacatggaggagtaaa

SEQ ID NO: 9010193 - DNA, 22 bp, Homo sapiens
gtcagcatagttcacacacagt

SEQ ID NO: 9010194 - DNA, 22 bp, Homo sapiens
cagcaggaaggtttcccctgca

SEQ ID NO: 9010195 - DNA, 22 bp, Homo sapiens
cagcaggacatggaggagtaaa

SEQ ID NO: 9010196 - DNA, 22 bp, Homo sapiens
gtcataaagacagaaacattcc

SEQ ID NO: 9010197 - DNA, 22 bp, Homo sapiens
gtcagcattgcagatatatggc

SEQ ID NO: 9010198 - DNA, 22 bp, Homo sapiens
gtcagcatccagctgtgaaagg

SEQ ID NO: 9010199 - DNA, 22 bp, Homo sapiens
gtcagcatgagcaagggctgac

SEQ ID NO: 9010200 - DNA, 22 bp, Homo sapiens
gtcagcattagcaatgactggt

SEQ ID NO: 9010201 - DNA, 22 bp, Homo sapiens
gtcagcattgcagatatatggc

SEQ ID NO: 9010202 - DNA, 22 bp, Homo sapiens
gtcagcctgcactcagggagcg

SEQ ID NO: 9010203 - DNA, 22 bp, Homo sapiens
cagcaggaaagacatctgagca

SEQ ID NO: 9010204 - DNA, 22 bp, Homo sapiens
cagcaggaaagacatctgagca

SEQ ID NO: 9010205 - DNA, 22 bp, Homo sapiens
cagcaggaaggtttcccctgca

SEQ ID NO: 9010206 - DNA, 22 bp, Homo sapiens
cagcaggaaggtttcccctgca

SEQ ID NO: 9010207 - DNA, 22 bp, Homo sapiens
cagcaggaaggtttcccctgca

SEQ ID NO: 9010208 - DNA, 20 bp, Homo sapiens
cagcaggaaaagtgcctcag

SEQ ID NO: 9010209 - DNA, 20 bp, Homo sapiens
cagcaggaaaagtgcctcag

SEQ ID NO: 9010210 - DNA, 20 bp, Homo sapiens
cagcaggaaaagtgcctcag

SEQ ID NO: 9010211 - DNA, 22 bp, Homo sapiens
cagcaggaaacttaaaggtaat

SEQ ID NO: 9010212 - DNA, 22 bp, Homo sapiens
cagcaggaaacttaaaggtaat

SEQ ID NO: 9010213 - DNA, 22 bp, Homo sapiens
gtgctgtgtgatccatgctggc

SEQ ID NO: 9010214 - DNA, 22 bp, Homo sapiens
gtgctgtgtgatccatgctggc

SEQ ID NO: 9010215 - DNA, 22 bp, Homo sapiens
gtgctgtgtctatcaggaataa

SEQ ID NO: 9010216 - DNA, 18 bp, Homo sapiens
gtgctgtgggcagtggcc

SEQ ID NO: 9010217 - DNA, 18 bp, Homo sapiens
gtgctgtgggcagtggcc

SEQ ID NO: 9010218 - DNA, 22 bp, Homo sapiens
gtgctgtgcgctttttctgtat

SEQ ID NO: 9010219 - DNA, 22 bp, Homo sapiens
gtgctgtgcgctttttctgtat

SEQ ID NO: 9010220 - DNA, 18 bp, Homo sapiens
gtgctgtgggcagtggcc

SEQ ID NO: 9010221 - DNA, 22 bp, Homo sapiens
gtgctgttgcctggctgcacgg

SEQ ID NO: 9010222 - DNA, 22 bp, Homo sapiens
gtgcccagttgaggccaggact

SEQ ID NO: 9010223 - DNA, 22 bp, Homo sapiens
gtgcccagtgcaggcccgcagg

SEQ ID NO: 9010224 - DNA, 22 bp, Homo sapiens
gtgcccagtgcaggcccgcagg

SEQ ID NO: 9010225 - DNA, 22 bp, Homo sapiens
gtgcccagttgaggccaggact

SEQ ID NO: 9010226 - DNA, 22 bp, Homo sapiens
gtgcccagttgaggccaggact

SEQ ID NO: 9010227 - DNA, 22 bp, Homo sapiens
gtgcccagttgaggccaggact

SEQ ID NO: 9010228 - DNA, 20 bp, Homo sapiens
gtgcccagttggtgacagac

SEQ ID NO: 9010229 - DNA, 20 bp, Homo sapiens
gtgcccagttggtgacagac

SEQ ID NO: 9010230 - DNA, 22 bp, Homo sapiens
gtgcccagttgaggccaggact

SEQ ID NO: 9010231 - DNA, 20 bp, Homo sapiens
gtgcccagttggtgacagac

SEQ ID NO: 9010232 - DNA, 20 bp, Homo sapiens
gtgcccagttggtgacagac

SEQ ID NO: 9010233 - DNA, 22 bp, Homo sapiens
gtgctgtgcgctttttctgtat

SEQ ID NO: 9010234 - DNA, 22 bp, Homo sapiens
gtgctgagtagaatgaatgcct

SEQ ID NO: 9010235 - DNA, 22 bp, Homo sapiens
gtgctgagtagaatgaatgcct

SEQ ID NO: 9010236 - DNA, 22 bp, Homo sapiens
gtgccctccgtgttcatagagc

SEQ ID NO: 9010237 - DNA, 22 bp, Homo sapiens
gtgccctccgtgttcatagagc

SEQ ID NO: 9010238 - DNA, 22 bp, Homo sapiens
gtgccctcctgaagccatcaca

SEQ ID NO: 9010239 - DNA, 21 bp, Homo sapiens
gtgcccgtcccaggagccgac

SEQ ID NO: 9010240 - DNA, 22 bp, Homo sapiens
gtgcccctggcaaatttccctg

SEQ ID NO: 9010241 - DNA, 22 bp, Homo sapiens
cagccctgcttccccgctagtt

SEQ ID NO: 9010242 - DNA, 22 bp, Homo sapiens
cagccctgcttccccgctagtt

SEQ ID NO: 9010243 - DNA, 22 bp, Homo sapiens
cagccctgcttccccgctagtt

SEQ ID NO: 9010244 - DNA, 22 bp, Homo sapiens
cagccctgcttccccgctagtt

SEQ ID NO: 9010245 - DNA, 22 bp, Homo sapiens
cagccctgcttccccgctagtt

SEQ ID NO: 9010246 - DNA, 22 bp, Homo sapiens
cagccctgcttccccgctagtt

SEQ ID NO: 9010247 - DNA, 22 bp, Homo sapiens
cagccctgctggttttgggcaa

SEQ ID NO: 9010248 - DNA, 22 bp, Homo sapiens
cagccctgctggttttgggcaa

SEQ ID NO: 9010249 - DNA, 22 bp, Homo sapiens
cagccctgcttccccgctagtt

SEQ ID NO: 9010250 - DNA, 22 bp, Homo sapiens
cagccctgctggcaatgatgag

SEQ ID NO: 9010251 - DNA, 22 bp, Homo sapiens
cagccctgctggttttgggcaa

SEQ ID NO: 9010252 - DNA, 22 bp, Homo sapiens
cagccctgctgccttagtgcct

SEQ ID NO: 9010253 - DNA, 22 bp, Homo sapiens
cagccctgctgacactgtctga

SEQ ID NO: 9010254 - DNA, 22 bp, Homo sapiens
cagccctgctgacactgtctga

SEQ ID NO: 9010255 - DNA, 22 bp, Homo sapiens
cagccctgctgacactgtctga

SEQ ID NO: 9010256 - DNA, 22 bp, Homo sapiens
cagccctgctcttagtgtctcc

SEQ ID NO: 9010257 - DNA, 22 bp, Homo sapiens
cagccctgctcttagtgtctcc

SEQ ID NO: 9010258 - DNA, 22 bp, Homo sapiens
cagccctgctcttagtgtctcc

SEQ ID NO: 9010259 - DNA, 22 bp, Homo sapiens
cagccctgccatggagcctcct

SEQ ID NO: 9010260 - DNA, 22 bp, Homo sapiens
cagccctgccatggagcctcct

SEQ ID NO: 9010261 - DNA, 22 bp, Homo sapiens
cagccctgccatggagcctcct

SEQ ID NO: 9010262 - DNA, 22 bp, Homo sapiens
cagccctgccatggagcctcct

SEQ ID NO: 9010263 - DNA, 22 bp, Homo sapiens
cagccctgccatggagcctcct

SEQ ID NO: 9010264 - DNA, 22 bp, Homo sapiens
cagccctgccatggagcctcct

SEQ ID NO: 9010265 - DNA, 22 bp, Homo sapiens
cagccctgccatggagcctcct

SEQ ID NO: 9010266 - DNA, 17 bp, Homo sapiens
cagccctgccgttccca

SEQ ID NO: 9010267 - DNA, 17 bp, Homo sapiens
cagccctgccgttccca

SEQ ID NO: 9010268 - DNA, 22 bp, Homo sapiens
cagccctgcggaggtgtatact

SEQ ID NO: 9010269 - DNA, 22 bp, Homo sapiens
cagccctgcggaggtgtatact

SEQ ID NO: 9010270 - DNA, 22 bp, Homo sapiens
cagccctgcggaggtgtatact

SEQ ID NO: 9010271 - DNA, 22 bp, Homo sapiens
cagccctgcagctggatctcac

SEQ ID NO: 9010272 - DNA, 22 bp, Homo sapiens
cagccctgcagctggatctcac

SEQ ID NO: 9010273 - DNA, 22 bp, Homo sapiens
cagccctgcagctggatctcac

SEQ ID NO: 9010274 - DNA, 22 bp, Homo sapiens
cagccctgcagccatggcctgt

SEQ ID NO: 9010275 - DNA, 22 bp, Homo sapiens
cagccctgcagccatggcctgt

SEQ ID NO: 9010276 - DNA, 22 bp, Homo sapiens
cagccctgcagccatggcctgt

SEQ ID NO: 9010277 - DNA, 22 bp, Homo sapiens
cagccctgaaacaacctcctct

SEQ ID NO: 9010278 - DNA, 23 bp, Homo sapiens
cagccctgaaatcgaggtgacac

SEQ ID NO: 9010279 - DNA, 23 bp, Homo sapiens
cagccctgaaatcgaggtgacac

SEQ ID NO: 9010280 - DNA, 22 bp, Homo sapiens
cagccctgcagccatggcctgt

SEQ ID NO: 9010281 - DNA, 22 bp, Homo sapiens
cagccctgcagccatggcctgt

SEQ ID NO: 9010282 - DNA, 22 bp, Homo sapiens
cagccctgcagccatggcctgt

SEQ ID NO: 9010283 - DNA, 22 bp, Homo sapiens
cagcctgactatggctgcaggt

SEQ ID NO: 9010284 - DNA, 22 bp, Homo sapiens
cagcctgacaccagctttgggc

SEQ ID NO: 9010285 - DNA, 22 bp, Homo sapiens
cagcctgacaccagctttgggc

SEQ ID NO: 9010286 - DNA, 22 bp, Homo sapiens
cagcctgactatggctgcaggt

SEQ ID NO: 9010287 - DNA, 22 bp, Homo sapiens
cagcctgactatggctgcaggt

SEQ ID NO: 9010288 - DNA, 22 bp, Homo sapiens
cagcctgacaccagctttgggc

SEQ ID NO: 9010289 - DNA, 22 bp, Homo sapiens
cagcctctttccacatcaggca

SEQ ID NO: 9010290 - DNA, 22 bp, Homo sapiens
cagcctgcagggctgcctgttg

SEQ ID NO: 9010291 - DNA, 22 bp, Homo sapiens
cagcctgcagggctgcctgttg

SEQ ID NO: 9010292 - DNA, 22 bp, Homo sapiens
cagcctgagccttctgtagcaa

SEQ ID NO: 9010293 - DNA, 22 bp, Homo sapiens
cagcctgagccttctgtagcaa

SEQ ID NO: 9010294 - DNA, 20 bp, Homo sapiens
cagcctgcatcatctgcagc

SEQ ID NO: 9010295 - DNA, 20 bp, Homo sapiens
cagcctgcatcatctgcagc

SEQ ID NO: 9010296 - DNA, 22 bp, Homo sapiens
cagcctgcagggctgcctgttg

SEQ ID NO: 9010297 - DNA, 22 bp, Homo sapiens
cagcctgcagggctgcctgttg

SEQ ID NO: 9010298 - DNA, 22 bp, Homo sapiens
cagcctgcagggctgcctgttg

SEQ ID NO: 9010299 - DNA, 16 bp, Homo sapiens
cagcctgcagtggtca

SEQ ID NO: 9010300 - DNA, 22 bp, Homo sapiens
cagcctgctagggcaatgcctt

SEQ ID NO: 9010301 - DNA, 22 bp, Homo sapiens
cagcctgccgtcagccaggtag

SEQ ID NO: 9010302 - DNA, 22 bp, Homo sapiens
cagcctgccgtcagccaggtag

SEQ ID NO: 9010303 - DNA, 22 bp, Homo sapiens
cagcctgccctggaagcccagc

SEQ ID NO: 9010304 - DNA, 22 bp, Homo sapiens
cagcctgcatttgtatctgtat

SEQ ID NO: 9010305 - DNA, 22 bp, Homo sapiens
cagcctctttccacatcaggca

SEQ ID NO: 9010306 - DNA, 20 bp, Homo sapiens
cagcctccactcactcagct

SEQ ID NO: 9010307 - DNA, 20 bp, Homo sapiens
cagcctccactcactcagct

SEQ ID NO: 9010308 - DNA, 20 bp, Homo sapiens
cagcctccactcactcagct

SEQ ID NO: 9010309 - DNA, 20 bp, Homo sapiens
cagcctccactcactcagct

SEQ ID NO: 9010310 - DNA, 20 bp, Homo sapiens
cagcctccactcactcagct

SEQ ID NO: 9010311 - DNA, 20 bp, Homo sapiens
cagcctccactcactcagct

SEQ ID NO: 9010312 - DNA, 23 bp, Homo sapiens
cagccctggagatgtgggaggca

SEQ ID NO: 9010313 - DNA, 22 bp, Homo sapiens
cagccctggcagctttcagggt

SEQ ID NO: 9010314 - DNA, 22 bp, Homo sapiens
cagccctggcagctttcagggt

SEQ ID NO: 9010315 - DNA, 20 bp, Homo sapiens
cagcctccactcactcagct

SEQ ID NO: 9010316 - DNA, 22 bp, Homo sapiens
cagccctggcccaggtgcctta

SEQ ID NO: 9010317 - DNA, 22 bp, Homo sapiens
cagccctggcccaggtgcctta

SEQ ID NO: 9010318 - DNA, 22 bp, Homo sapiens
cagccctggcccaggtgcctta

SEQ ID NO: 9010319 - DNA, 22 bp, Homo sapiens
cagccctggaacagctgactca

SEQ ID NO: 9010320 - DNA, 22 bp, Homo sapiens
cagccctggaacagctgactca

SEQ ID NO: 9010321 - DNA, 22 bp, Homo sapiens
cagccctggaacagctgactca

SEQ ID NO: 9010322 - DNA, 22 bp, Homo sapiens
cagccctgcttccccgctagtt

SEQ ID NO: 9010323 - DNA, 23 bp, Homo sapiens
cagccctggagatgtgggaggca

SEQ ID NO: 9010324 - DNA, 23 bp, Homo sapiens
cagccctggagatgtgggaggca

SEQ ID NO: 9010325 - DNA, 23 bp, Homo sapiens
cagccctggagatgtgggaggca

SEQ ID NO: 9010326 - DNA, 23 bp, Homo sapiens
cagccctggagatgtgggaggca

SEQ ID NO: 9010327 - DNA, 22 bp, Homo sapiens
cagcctggagccacagcccagg

SEQ ID NO: 9010328 - DNA, 22 bp, Homo sapiens
cagcctggagccacagcccagg

SEQ ID NO: 9010329 - DNA, 22 bp, Homo sapiens
cagcctggagccacagcccagg

SEQ ID NO: 9010330 - DNA, 22 bp, Homo sapiens
cagcctggagccacagcccagg

SEQ ID NO: 9010331 - DNA, 22 bp, Homo sapiens
cagcctggagccacagcccagg

SEQ ID NO: 9010332 - DNA, 22 bp, Homo sapiens
cagcctggagccacagcccagg

SEQ ID NO: 9010333 - DNA, 22 bp, Homo sapiens
cagcctggattgcagaatgcta

SEQ ID NO: 9010334 - DNA, 22 bp, Homo sapiens
cagcctggattgcagaatgcta

SEQ ID NO: 9010335 - DNA, 21 bp, Homo sapiens
cagcctgctgctccagggcca

SEQ ID NO: 9010336 - DNA, 21 bp, Homo sapiens
cagcctgctgctccagggcca

SEQ ID NO: 9010337 - DNA, 21 bp, Homo sapiens
cagcctgctgctccagggcca

SEQ ID NO: 9010338 - DNA, 21 bp, Homo sapiens
cagcctgctgctccagggcca

SEQ ID NO: 9010339 - DNA, 22 bp, Homo sapiens
cagcctgctagggcaatgcctt

SEQ ID NO: 9010340 - DNA, 21 bp, Homo sapiens
cagcctgctgctccagggcca

SEQ ID NO: 9010341 - DNA, 22 bp, Homo sapiens
cagcctgctctcagatgttgag

SEQ ID NO: 9010342 - DNA, 22 bp, Homo sapiens
cagcctgctagggcaatgcctt

SEQ ID NO: 9010343 - DNA, 22 bp, Homo sapiens
cagcctgctagggcaatgcctt

SEQ ID NO: 9010344 - DNA, 22 bp, Homo sapiens
cagcctggacagcgaccagagt

SEQ ID NO: 9010345 - DNA, 22 bp, Homo sapiens
cagcctggacagcgaccagagt

SEQ ID NO: 9010346 - DNA, 21 bp, Homo sapiens
cagcctgctgctccagggcca

SEQ ID NO: 9010347 - DNA, 21 bp, Homo sapiens
cagcctgctgctccagggcca

SEQ ID NO: 9010348 - DNA, 22 bp, Homo sapiens
cagcctggacagcgaccagagt

SEQ ID NO: 9010349 - DNA, 22 bp, Homo sapiens
cagcctgggctccagagtccct

SEQ ID NO: 9010350 - DNA, 22 bp, Homo sapiens
cagcctgggctccagagtccct

SEQ ID NO: 9010351 - DNA, 22 bp, Homo sapiens
cagcctggtccccggctcaccc

SEQ ID NO: 9010352 - DNA, 22 bp, Homo sapiens
cagcctggtccccggctcaccc

SEQ ID NO: 9010353 - DNA, 22 bp, Homo sapiens
cagcctggcctgggactgctga

SEQ ID NO: 9010354 - DNA, 22 bp, Homo sapiens
cagcctgggctccagagtccct

SEQ ID NO: 9010355 - DNA, 22 bp, Homo sapiens
cagcctggcctgggactgctga

SEQ ID NO: 9010356 - DNA, 22 bp, Homo sapiens
cagcctggcctgggactgctga

SEQ ID NO: 9010357 - DNA, 22 bp, Homo sapiens
cagcctgtggcagaggtctaat

SEQ ID NO: 9010358 - DNA, 22 bp, Homo sapiens
cagcctgtggcagaggtctaat

SEQ ID NO: 9010359 - DNA, 22 bp, Homo sapiens
cagccttcaaggcttagctcag

SEQ ID NO: 9010360 - DNA, 22 bp, Homo sapiens
cagcctggtccccggctcaccc

SEQ ID NO: 9010361 - DNA, 22 bp, Homo sapiens
cagcctggtccccggctcaccc

SEQ ID NO: 9010362 - DNA, 22 bp, Homo sapiens
cagcctggtccccggctcaccc

SEQ ID NO: 9010363 - DNA, 22 bp, Homo sapiens
cagctaggaaaccagagggcag

SEQ ID NO: 9010364 - DNA, 22 bp, Homo sapiens
cagctagcggtgctggcggctc

SEQ ID NO: 9010365 - DNA, 22 bp, Homo sapiens
cagctagctaagaaggccagag

SEQ ID NO: 9010366 - DNA, 22 bp, Homo sapiens
cagctacagttccactgagcat

SEQ ID NO: 9010367 - DNA, 22 bp, Homo sapiens
cagctacagttccactgagcat

SEQ ID NO: 9010368 - DNA, 22 bp, Homo sapiens
cagctacaggacgggcatctgc

SEQ ID NO: 9010369 - DNA, 22 bp, Homo sapiens
cagctacagttccactgagcat

SEQ ID NO: 9010370 - DNA, 22 bp, Homo sapiens
cagctactcctcccatgacttc

SEQ ID NO: 9010371 - DNA, 22 bp, Homo sapiens
cagctaccatggtttgttccag

SEQ ID NO: 9010372 - DNA, 22 bp, Homo sapiens
cagctactcctcccatgacttc

SEQ ID NO: 9010373 - DNA, 22 bp, Homo sapiens
cagctacacaccagaactatta

SEQ ID NO: 9010374 - DNA, 22 bp, Homo sapiens
cagctacacaccagaactatta

SEQ ID NO: 9010375 - DNA, 22 bp, Homo sapiens
cagctacaaatacttttgtatg

SEQ ID NO: 9010376 - DNA, 22 bp, Homo sapiens
cagctaatcctctctatccaag

SEQ ID NO: 9010377 - DNA, 22 bp, Homo sapiens
cagctaaggctccttctaggta

SEQ ID NO: 9010378 - DNA, 22 bp, Homo sapiens
cagctaaggctccttctaggta

SEQ ID NO: 9010379 - DNA, 22 bp, Homo sapiens
cagctaagttccaggggctttc

SEQ ID NO: 9010380 - DNA, 22 bp, Homo sapiens
cagctacacttctgggtgtgtc

SEQ ID NO: 9010381 - DNA, 22 bp, Homo sapiens
cagctacagaggccacatggct

SEQ ID NO: 9010382 - DNA, 22 bp, Homo sapiens
cagctacagaggccacatggct

SEQ ID NO: 9010383 - DNA, 22 bp, Homo sapiens
cagctacagaggccacatggct

SEQ ID NO: 9010384 - DNA, 22 bp, Homo sapiens
cagctacaggacctgatgcacc

SEQ ID NO: 9010385 - DNA, 22 bp, Homo sapiens
gtgcccagtcctgccttgacag

SEQ ID NO: 9010386 - DNA, 22 bp, Homo sapiens
gtgcccagtcctgccttgacag

SEQ ID NO: 9010387 - DNA, 22 bp, Homo sapiens
gtgcccagtaaatgaaagcttt

SEQ ID NO: 9010388 - DNA, 22 bp, Homo sapiens
gtgcccagtcctgccttgacag

SEQ ID NO: 9010389 - DNA, 22 bp, Homo sapiens
gtgcccagtcctgccttgacag

SEQ ID NO: 9010390 - DNA, 22 bp, Homo sapiens
cagctattattttctctaaatt

SEQ ID NO: 9010391 - DNA, 22 bp, Homo sapiens
cagctattccaggagtagaatc

SEQ ID NO: 9010392 - DNA, 22 bp, Homo sapiens
gtgcccaggtgtccctgagaag

SEQ ID NO: 9010393 - DNA, 22 bp, Homo sapiens
gtgcccagtaaatgaaagcttt

SEQ ID NO: 9010394 - DNA, 22 bp, Homo sapiens
gtgcccagtaaatgaaagcttt

SEQ ID NO: 9010395 - DNA, 22 bp, Homo sapiens
cagctagtaaatggcaagacta

SEQ ID NO: 9010396 - DNA, 22 bp, Homo sapiens
cagctaggaagtccttggcgaa

SEQ ID NO: 9010397 - DNA, 22 bp, Homo sapiens
cagctagggagtggcagagctt

SEQ ID NO: 9010398 - DNA, 22 bp, Homo sapiens
cagctagtacaatgggagagca

SEQ ID NO: 9010399 - DNA, 22 bp, Homo sapiens
cagctatagatggactgaagag

SEQ ID NO: 9010400 - DNA, 22 bp, Homo sapiens
cagcacagtttgcttggcagag

SEQ ID NO: 9010401 - DNA, 22 bp, Homo sapiens
cagcacagtttgcttggcagag

SEQ ID NO: 9010402 - DNA, 22 bp, Homo sapiens
cagcacagtttgcttggcagag

SEQ ID NO: 9010403 - DNA, 22 bp, Homo sapiens
cagcacataagccgaagactgt

SEQ ID NO: 9010404 - DNA, 22 bp, Homo sapiens
cagcacataagccgaagactgt

SEQ ID NO: 9010405 - DNA, 22 bp, Homo sapiens
cagcacataatcagtgattgtg

SEQ ID NO: 9010406 - DNA, 22 bp, Homo sapiens
cagcacataagccgaagactgt

SEQ ID NO: 9010407 - DNA, 22 bp, Homo sapiens
cagcacataagccgaagactgt

SEQ ID NO: 9010408 - DNA, 22 bp, Homo sapiens
cagcacataagccgaagactgt

SEQ ID NO: 9010409 - DNA, 22 bp, Homo sapiens
cagcacatagcatgcttgtcag

SEQ ID NO: 9010410 - DNA, 22 bp, Homo sapiens
cagcacatagcatgcttgtcag

SEQ ID NO: 9010411 - DNA, 22 bp, Homo sapiens
cagcacatctgattatatgact

SEQ ID NO: 9010412 - DNA, 22 bp, Homo sapiens
cagcaccaggcagacctggagc

SEQ ID NO: 9010413 - DNA, 22 bp, Homo sapiens
cagcaccattttcctggtcagc

SEQ ID NO: 9010414 - DNA, 19 bp, Homo sapiens
cagcacatgcttctctgag

SEQ ID NO: 9010415 - DNA, 22 bp, Homo sapiens
cagcacatggatggagttagga

SEQ ID NO: 9010416 - DNA, 22 bp, Homo sapiens
cagcacatggatggagttagga

SEQ ID NO: 9010417 - DNA, 22 bp, Homo sapiens
cagcacattgatcagagacgct

SEQ ID NO: 9010418 - DNA, 22 bp, Homo sapiens
cagcacatttactcagccctca

SEQ ID NO: 9010419 - DNA, 22 bp, Homo sapiens
cagcacatgctcatcagggaag

SEQ ID NO: 9010420 - DNA, 22 bp, Homo sapiens
cagcacatgctcatcagggaag

SEQ ID NO: 9010421 - DNA, 22 bp, Homo sapiens
cagcacatctgattatatgact

SEQ ID NO: 9010422 - DNA, 22 bp, Homo sapiens
cagcacagtgaccagacccact

SEQ ID NO: 9010423 - DNA, 22 bp, Homo sapiens
cagcacagtgcagatgctgact

SEQ ID NO: 9010424 - DNA, 22 bp, Homo sapiens
cagcacagtgcagatgctgact

SEQ ID NO: 9010425 - DNA, 22 bp, Homo sapiens
cagcacagtgaccagacccact

SEQ ID NO: 9010426 - DNA, 22 bp, Homo sapiens
cagcacagtgaccagacccact

SEQ ID NO: 9010427 - DNA, 22 bp, Homo sapiens
cagcacagtgaccagacccact

SEQ ID NO: 9010428 - DNA, 22 bp, Homo sapiens
cagcacagtgaccagacccact

SEQ ID NO: 9010429 - DNA, 22 bp, Homo sapiens
cagcacagtgaccagacccact

SEQ ID NO: 9010430 - DNA, 22 bp, Homo sapiens
cagcacagtagagtagttgtaa

SEQ ID NO: 9010431 - DNA, 22 bp, Homo sapiens
cagcacagtttctggcccgccg

SEQ ID NO: 9010432 - DNA, 22 bp, Homo sapiens
cagcacagtttctggcccgccg

SEQ ID NO: 9010433 - DNA, 22 bp, Homo sapiens
cagcacagtttcccccatgagc

SEQ ID NO: 9010434 - DNA, 22 bp, Homo sapiens
cagcacagtttcccccatgagc

SEQ ID NO: 9010435 - DNA, 22 bp, Homo sapiens
cagcacagtttcccccatgagc

SEQ ID NO: 9010436 - DNA, 22 bp, Homo sapiens
cagcacagtttcccccatgagc

SEQ ID NO: 9010437 - DNA, 22 bp, Homo sapiens
cagcacagtttcccccatgagc

SEQ ID NO: 9010438 - DNA, 22 bp, Homo sapiens
cagcacagtttcccccatgagc

SEQ ID NO: 9010439 - DNA, 22 bp, Homo sapiens
ggtgctgagtgagctagaggct

SEQ ID NO: 9010440 - DNA, 22 bp, Homo sapiens
ggtgctgaggccttggcaggga

SEQ ID NO: 9010441 - DNA, 20 bp, Homo sapiens
ggtgctgataagaaagaagt

SEQ ID NO: 9010442 - DNA, 22 bp, Homo sapiens
ggtgctgagtgagctagaggct

SEQ ID NO: 9010443 - DNA, 22 bp, Homo sapiens
ggtgctgatagtaacaataata

SEQ ID NO: 9010444 - DNA, 22 bp, Homo sapiens
ggtgctgatattgttttggtga

SEQ ID NO: 9010445 - DNA, 22 bp, Homo sapiens
ggtgctgatattgttttggtga

SEQ ID NO: 9010446 - DNA, 22 bp, Homo sapiens
ggtgctgatctaaatttaggac

SEQ ID NO: 9010447 - DNA, 22 bp, Homo sapiens
ggtgctgagagcctaggagggc

SEQ ID NO: 9010448 - DNA, 22 bp, Homo sapiens
ggtgctgacttcacagtcttac

SEQ ID NO: 9010449 - DNA, 22 bp, Homo sapiens
ggtgctgactgaggatggcttg

SEQ ID NO: 9010450 - DNA, 22 bp, Homo sapiens
ggtgctgactctgtcgtgagca

SEQ ID NO: 9010451 - DNA, 22 bp, Homo sapiens
ggtgctgactgaggatggcttg

SEQ ID NO: 9010452 - DNA, 22 bp, Homo sapiens
ggtgctgacattcagagtctgg

SEQ ID NO: 9010453 - DNA, 22 bp, Homo sapiens
ggtgctgacattcagagtctgg

SEQ ID NO: 9010454 - DNA, 22 bp, Homo sapiens
ggtgctgaattctggaggaggc

SEQ ID NO: 9010455 - DNA, 22 bp, Homo sapiens
ggtgctgaataaatactagtta

SEQ ID NO: 9010456 - DNA, 19 bp, Homo sapiens
ggtgctgacatcatgcttt

SEQ ID NO: 9010457 - DNA, 22 bp, Homo sapiens
cagcaaggactgggcatgtgaa

SEQ ID NO: 9010458 - DNA, 21 bp, Homo sapiens
cagcaaggaagtcgagtaggt

SEQ ID NO: 9010459 - DNA, 21 bp, Homo sapiens
cagcaaggaagtcgagtaggt

SEQ ID NO: 9010460 - DNA, 22 bp, Homo sapiens
cagcaaggactgggcatgtgaa

SEQ ID NO: 9010461 - DNA, 22 bp, Homo sapiens
cagcaaggactgggcatgtgaa

SEQ ID NO: 9010462 - DNA, 22 bp, Homo sapiens
ggtgctgaaggactataacggt

SEQ ID NO: 9010463 - DNA, 22 bp, Homo sapiens
cagcaaggactgggcatgtgaa

SEQ ID NO: 9010464 - DNA, 22 bp, Homo sapiens
cagcaaggactgggcatgtgaa

SEQ ID NO: 9010465 - DNA, 22 bp, Homo sapiens
cagcaaggactgggcatgtgaa

SEQ ID NO: 9010466 - DNA, 22 bp, Homo sapiens
ggtgctggacacgtggcactcc

SEQ ID NO: 9010467 - DNA, 22 bp, Homo sapiens
ggtgctggacacgtggcactcc

SEQ ID NO: 9010468 - DNA, 22 bp, Homo sapiens
ggtgctgggaacgaggaattca

SEQ ID NO: 9010469 - DNA, 22 bp, Homo sapiens
ggtgctgatttgttgctgagat

SEQ ID NO: 9010470 - DNA, 22 bp, Homo sapiens
ggtgctgctgctgaacccagct

SEQ ID NO: 9010471 - DNA, 22 bp, Homo sapiens
ggtgctggacacgtggcactcc

SEQ ID NO: 9010472 - DNA, 22 bp, Homo sapiens
ggtgctgatgaagatgtagcct

SEQ ID NO: 9010473 - DNA, 22 bp, Homo sapiens
ggtgctgatgaagatgtagcct

SEQ ID NO: 9010474 - DNA, 22 bp, Homo sapiens
ggtgctgatgagttaggagagg

SEQ ID NO: 9010475 - DNA, 22 bp, Homo sapiens
ggtgctgattcactgacttctg

SEQ ID NO: 9010476 - DNA, 22 bp, Homo sapiens
ggtgctgattcactgacttctg

SEQ ID NO: 9010477 - DNA, 22 bp, Homo sapiens
ggtgctgattaagaactgtata

SEQ ID NO: 9010478 - DNA, 22 bp, Homo sapiens
ggtgctgatgttattgatgctg

SEQ ID NO: 9010479 - DNA, 22 bp, Homo sapiens
cagcacaattttcaggagtcca

SEQ ID NO: 9010480 - DNA, 22 bp, Homo sapiens
ggtgctgggaacgaggaattca

SEQ ID NO: 9010481 - DNA, 22 bp, Homo sapiens
cagcacaattttcaggagtcca

SEQ ID NO: 9010482 - DNA, 22 bp, Homo sapiens
cagcacacagtgactcgcacct

SEQ ID NO: 9010483 - DNA, 22 bp, Homo sapiens
cagcacagtacaaggcacggat

SEQ ID NO: 9010484 - DNA, 22 bp, Homo sapiens
cagcacagtacaaggcacggat

SEQ ID NO: 9010485 - DNA, 22 bp, Homo sapiens
cagcacagtacaaggcacggat

SEQ ID NO: 9010486 - DNA, 23 bp, Homo sapiens
cagcacagtacatttcctgtctc

SEQ ID NO: 9010487 - DNA, 21 bp, Homo sapiens
cagcacagtactgggtcttgc

SEQ ID NO: 9010488 - DNA, 21 bp, Homo sapiens
cagcacagtactgggtcttgc

SEQ ID NO: 9010489 - DNA, 21 bp, Homo sapiens
cagcacagtactgggtcttgc

SEQ ID NO: 9010490 - DNA, 22 bp, Homo sapiens
ggtgacatagttacttcaggct

SEQ ID NO: 9010491 - DNA, 22 bp, Homo sapiens
ggtgacatcagtaaccgtggtt

SEQ ID NO: 9010492 - DNA, 22 bp, Homo sapiens
ggtgacatctagagacatccaa

SEQ ID NO: 9010493 - DNA, 19 bp, Homo sapiens
ggtgaccacctggtcagtg

SEQ ID NO: 9010494 - DNA, 22 bp, Homo sapiens
ggtgacattatcattattttaa

SEQ ID NO: 9010495 - DNA, 22 bp, Homo sapiens
ggtgacatgcacctatcccttg

SEQ ID NO: 9010496 - DNA, 22 bp, Homo sapiens
ggtgacctcacctggtcccacc

SEQ ID NO: 9010497 - DNA, 22 bp, Homo sapiens
ggtgacctcacctggtcccacc

SEQ ID NO: 9010498 - DNA, 22 bp, Homo sapiens
ggtgacctcacctggtcccacc

SEQ ID NO: 9010499 - DNA, 22 bp, Homo sapiens
ggtgacctcacctggtcccacc

SEQ ID NO: 9010500 - DNA, 22 bp, Homo sapiens
ggtgacctcacctggtcccacc

SEQ ID NO: 9010501 - DNA, 22 bp, Homo sapiens
ggtgacagtggttaaaatttgt

SEQ ID NO: 9010502 - DNA, 22 bp, Homo sapiens
ggtgacagttccggaggtacag

SEQ ID NO: 9010503 - DNA, 22 bp, Homo sapiens
ggtgacagtggttaaaatttgt

SEQ ID NO: 9010504 - DNA, 22 bp, Homo sapiens
ggtgacagtggttaaaatttgt

SEQ ID NO: 9010505 - DNA, 22 bp, Homo sapiens
ggtctggaataaggtccaggaa

SEQ ID NO: 9010506 - DNA, 22 bp, Homo sapiens
ggtctggaataaggtccaggaa

SEQ ID NO: 9010507 - DNA, 22 bp, Homo sapiens
ggtctgaggctccaaggaggtg

SEQ ID NO: 9010508 - DNA, 22 bp, Homo sapiens
ggtctgaggctccaaggaggtg

SEQ ID NO: 9010509 - DNA, 22 bp, Homo sapiens
ggtctgagtagagggctggcga

SEQ ID NO: 9010510 - DNA, 22 bp, Homo sapiens
ggtctgagtagagggctggcga

SEQ ID NO: 9010511 - DNA, 22 bp, Homo sapiens
ggtctgaggtgggacccaggaa

SEQ ID NO: 9010512 - DNA, 22 bp, Homo sapiens
ggtctgaggctccaaggaggtg

SEQ ID NO: 9010513 - DNA, 22 bp, Homo sapiens
ggtctgagcttgagcccatgct

SEQ ID NO: 9010514 - DNA, 22 bp, Homo sapiens
ggtctgagcttgagcccatgct

SEQ ID NO: 9010515 - DNA, 22 bp, Homo sapiens
ggtctgagatatttgttcagct

SEQ ID NO: 9010516 - DNA, 18 bp, Homo sapiens
ggtctgagatcgtttttc

SEQ ID NO: 9010517 - DNA, 22 bp, Homo sapiens
ggtctgcccactactctccatt

SEQ ID NO: 9010518 - DNA, 22 bp, Homo sapiens
ggtctgagtgggcaggggccgg

SEQ ID NO: 9010519 - DNA, 22 bp, Homo sapiens
ggtctgagtgccagggagagaa

SEQ ID NO: 9010520 - DNA, 22 bp, Homo sapiens
ggtctgagtgccagggagagaa

SEQ ID NO: 9010521 - DNA, 22 bp, Homo sapiens
cagcaagagaggcagggcaaat

SEQ ID NO: 9010522 - DNA, 22 bp, Homo sapiens
cagcaagagaggcagggcaaat

SEQ ID NO: 9010523 - DNA, 22 bp, Homo sapiens
cagcaagagaggcagggcaaat

SEQ ID NO: 9010524 - DNA, 22 bp, Homo sapiens
cagcaagagggtaaggttgaag

SEQ ID NO: 9010525 - DNA, 22 bp, Homo sapiens
cagcaagagggtaaggttgaag

SEQ ID NO: 9010526 - DNA, 22 bp, Homo sapiens
cagcaagagggtaaggttgaag

SEQ ID NO: 9010527 - DNA, 22 bp, Homo sapiens
cagcaagagttggggttgttgg

SEQ ID NO: 9010528 - DNA, 22 bp, Homo sapiens
cagcaagagttggggttgttgg

SEQ ID NO: 9010529 - DNA, 22 bp, Homo sapiens
cagcaagagggtaaggttgaag

SEQ ID NO: 9010530 - DNA, 22 bp, Homo sapiens
cagcaagatggtgaatgagacg

SEQ ID NO: 9010531 - DNA, 22 bp, Homo sapiens
cagcaagatggtgaatgagacg

SEQ ID NO: 9010532 - DNA, 22 bp, Homo sapiens
cagcaagagttggggttgttgg

SEQ ID NO: 9010533 - DNA, 22 bp, Homo sapiens
cagcaagagttggggttgttgg

SEQ ID NO: 9010534 - DNA, 22 bp, Homo sapiens
cagcaagacttcagggcttggt

SEQ ID NO: 9010535 - DNA, 22 bp, Homo sapiens
cagcaagacttcagggcttggt

SEQ ID NO: 9010536 - DNA, 22 bp, Homo sapiens
cagcaagacttcagggcttggt

SEQ ID NO: 9010537 - DNA, 22 bp, Homo sapiens
cagcaagagactgttctctaag

SEQ ID NO: 9010538 - DNA, 22 bp, Homo sapiens
cagcaagagactgttctctaag

SEQ ID NO: 9010539 - DNA, 22 bp, Homo sapiens
cagcaagagactgttctctaag

SEQ ID NO: 9010540 - DNA, 22 bp, Homo sapiens
cagcaagagaggcagggcaaat

SEQ ID NO: 9010541 - DNA, 22 bp, Homo sapiens
cagcaagattaagggcagaaaa

SEQ ID NO: 9010542 - DNA, 22 bp, Homo sapiens
cagcaagattaagggcagaaaa

SEQ ID NO: 9010543 - DNA, 22 bp, Homo sapiens
cagcaagatggtgaatgagacg

SEQ ID NO: 9010544 - DNA, 22 bp, Homo sapiens
cagcaagatggtgaatgagacg

SEQ ID NO: 9010545 - DNA, 22 bp, Homo sapiens
cagcaagattaagggcagaaaa

SEQ ID NO: 9010546 - DNA, 22 bp, Homo sapiens
cagcaagattaagggcagaaaa

SEQ ID NO: 9010547 - DNA, 22 bp, Homo sapiens
cagcaagatttttaaagcaagg

SEQ ID NO: 9010548 - DNA, 22 bp, Homo sapiens
cagcaagatttttaaagcaagg

SEQ ID NO: 9010549 - DNA, 22 bp, Homo sapiens
cagcaagatttttaaagcaagg

SEQ ID NO: 9010550 - DNA, 22 bp, Homo sapiens
cagcaagatttttaaagcaagg

SEQ ID NO: 9010551 - DNA, 22 bp, Homo sapiens
cagcaagatttttaaagcaagg

SEQ ID NO: 9010552 - DNA, 22 bp, Homo sapiens
cagcaagccaaatgtggcccga

SEQ ID NO: 9010553 - DNA, 22 bp, Homo sapiens
cagcaagccaaatgtggcccga

SEQ ID NO: 9010554 - DNA, 21 bp, Homo sapiens
cagcaaggaagtcgagtaggt

SEQ ID NO: 9010555 - DNA, 21 bp, Homo sapiens
cagcaaggaagtcgagtaggt

SEQ ID NO: 9010556 - DNA, 21 bp, Homo sapiens
cagcaaggaagtcgagtaggt

SEQ ID NO: 9010557 - DNA, 22 bp, Homo sapiens
cagcaagacaaggaacaaactg

SEQ ID NO: 9010558 - DNA, 22 bp, Homo sapiens
cagcaagacaaggaacaaactg

SEQ ID NO: 9010559 - DNA, 22 bp, Homo sapiens
cagcaaagtaagctgacatgta

SEQ ID NO: 9010560 - DNA, 22 bp, Homo sapiens
cagcaaagtaagctgacatgta

SEQ ID NO: 9010561 - DNA, 22 bp, Homo sapiens
cagcaaagtaagctgacatgta

SEQ ID NO: 9010562 - DNA, 22 bp, Homo sapiens
cagcaaagtaagctgacatgta

SEQ ID NO: 9010563 - DNA, 21 bp, Homo sapiens
cagcaagacatgtttatcaag

SEQ ID NO: 9010564 - DNA, 22 bp, Homo sapiens
cagcaagacagtttcctaagtg

SEQ ID NO: 9010565 - DNA, 22 bp, Homo sapiens
cagcaagacagtttcctaagtg

SEQ ID NO: 9010566 - DNA, 22 bp, Homo sapiens
cagcaagacagtttcctaagtg

SEQ ID NO: 9010567 - DNA, 21 bp, Homo sapiens
cagcaagacatgtttatcaag

SEQ ID NO: 9010568 - DNA, 21 bp, Homo sapiens
cagcaagacatgtttatcaag

SEQ ID NO: 9010569 - DNA, 22 bp, Homo sapiens
cagcaagacagtttcctaagtg

SEQ ID NO: 9010570 - DNA, 22 bp, Homo sapiens
cagcaagacagtttcctaagtg

SEQ ID NO: 9010571 - DNA, 22 bp, Homo sapiens
cagcaagacaggattcccgtgg

SEQ ID NO: 9010572 - DNA, 22 bp, Homo sapiens
cagcaagacaggattcccgtgg

SEQ ID NO: 9010573 - DNA, 22 bp, Homo sapiens
cagcaagacaggattcccgtgg

SEQ ID NO: 9010574 - DNA, 22 bp, Homo sapiens
cagcaagacaggattcccgtgg

SEQ ID NO: 9010575 - DNA, 17 bp, Homo sapiens
ggtgagacctcccactc

SEQ ID NO: 9010576 - DNA, 22 bp, Homo sapiens
ggtgagactttagaagagccag

SEQ ID NO: 9010577 - DNA, 22 bp, Homo sapiens
ggtgagagaaaagaaacactgt

SEQ ID NO: 9010578 - DNA, 22 bp, Homo sapiens
cagcaaagtaagctgacatgta

SEQ ID NO: 9010579 - DNA, 22 bp, Homo sapiens
ggtgagactttagaagagccag

SEQ ID NO: 9010580 - DNA, 22 bp, Homo sapiens
ggtgagagaaaagaaacactgt

SEQ ID NO: 9010581 - DNA, 22 bp, Homo sapiens
ggtgactcccagctgctctctt

SEQ ID NO: 9010582 - DNA, 22 bp, Homo sapiens
ggtgactcatgtgtgttttcag

SEQ ID NO: 9010583 - DNA, 22 bp, Homo sapiens
ggtgacggggcccaggtttcct

SEQ ID NO: 9010584 - DNA, 22 bp, Homo sapiens
ggtgacggggcccaggtttcct

SEQ ID NO: 9010585 - DNA, 22 bp, Homo sapiens
ggtgacgaatccatagcatcga

SEQ ID NO: 9010586 - DNA, 22 bp, Homo sapiens
ggtgacgaatccatagcatcga

SEQ ID NO: 9010587 - DNA, 22 bp, Homo sapiens
cagagggctgccctgagttcgt

SEQ ID NO: 9010588 - DNA, 22 bp, Homo sapiens
cagagggctgccctgagttcgt

SEQ ID NO: 9010589 - DNA, 22 bp, Homo sapiens
cagagggctcttggctgcctgc

SEQ ID NO: 9010590 - DNA, 22 bp, Homo sapiens
cagagggctcttggctgcctgc

SEQ ID NO: 9010591 - DNA, 22 bp, Homo sapiens
cagagggctcggcggccgctcc

SEQ ID NO: 9010592 - DNA, 22 bp, Homo sapiens
cagagggctcttggctgcctgc

SEQ ID NO: 9010593 - DNA, 22 bp, Homo sapiens
cagagggctcttggctgcctgc

SEQ ID NO: 9010594 - DNA, 22 bp, Homo sapiens
cagagggctgtgtaaggatgtt

SEQ ID NO: 9010595 - DNA, 22 bp, Homo sapiens
cagagggcttcaggttcaggat

SEQ ID NO: 9010596 - DNA, 22 bp, Homo sapiens
cagagggcttcaggttcaggat

SEQ ID NO: 9010597 - DNA, 22 bp, Homo sapiens
cagagggcttcaggttcaggat

SEQ ID NO: 9010598 - DNA, 22 bp, Homo sapiens
cagagggctgtgtaaggatgtt

SEQ ID NO: 9010599 - DNA, 22 bp, Homo sapiens
cagagggctgtgtaaggatgtt

SEQ ID NO: 9010600 - DNA, 22 bp, Homo sapiens
cagagggctcttggctgcctgc

SEQ ID NO: 9010601 - DNA, 22 bp, Homo sapiens
cagagggctcggcggccgctcc

SEQ ID NO: 9010602 - DNA, 22 bp, Homo sapiens
cagagggctcggcggccgctcc

SEQ ID NO: 9010603 - DNA, 22 bp, Homo sapiens
cagagggctcggcggccgctcc

SEQ ID NO: 9010604 - DNA, 22 bp, Homo sapiens
cagagggctcagtcctgctgga

SEQ ID NO: 9010605 - DNA, 21 bp, Homo sapiens
cagagggccggcatgtggtct

SEQ ID NO: 9010606 - DNA, 22 bp, Homo sapiens
cagagggcgtccgggttaactt

SEQ ID NO: 9010607 - DNA, 22 bp, Homo sapiens
cagaggctttgccctggaaacc

SEQ ID NO: 9010608 - DNA, 22 bp, Homo sapiens
cagaggctttgccctggaaacc

SEQ ID NO: 9010609 - DNA, 22 bp, Homo sapiens
cagagggaaaaggggagtaata

SEQ ID NO: 9010610 - DNA, 22 bp, Homo sapiens
cagagggaaaaggggagtaata

SEQ ID NO: 9010611 - DNA, 23 bp, Homo sapiens
cagagggttccatggagcatggt

SEQ ID NO: 9010612 - DNA, 23 bp, Homo sapiens
cagagggttccatggagcatggt

SEQ ID NO: 9010613 - DNA, 23 bp, Homo sapiens
cagagggttccatggagcatggt

SEQ ID NO: 9010614 - DNA, 23 bp, Homo sapiens
cagagggttccatggagcatggt

SEQ ID NO: 9010615 - DNA, 23 bp, Homo sapiens
cagagggttccatggagcatggt

SEQ ID NO: 9010616 - DNA, 22 bp, Homo sapiens
cagagggtgtgaaggggatgaa

SEQ ID NO: 9010617 - DNA, 22 bp, Homo sapiens
cagagggtgtgaaggggatgaa

SEQ ID NO: 9010618 - DNA, 22 bp, Homo sapiens
cagagggtgtgaaggggatgaa

SEQ ID NO: 9010619 - DNA, 22 bp, Homo sapiens
cagagggtgtgaaggggatgaa

SEQ ID NO: 9010620 - DNA, 22 bp, Homo sapiens
cagagggtcaccaggaagtgca

SEQ ID NO: 9010621 - DNA, 22 bp, Homo sapiens
cagagggtcaccaggaagtgca

SEQ ID NO: 9010622 - DNA, 22 bp, Homo sapiens
cagagggcttcaggttcaggat

SEQ ID NO: 9010623 - DNA, 22 bp, Homo sapiens
cagagggcttcaggttcaggat

SEQ ID NO: 9010624 - DNA, 21 bp, Homo sapiens
cagagggcttttctctgttct

SEQ ID NO: 9010625 - DNA, 21 bp, Homo sapiens
cagagggcttttctctgttct

SEQ ID NO: 9010626 - DNA, 22 bp, Homo sapiens
cagaggggataacaggtgtaga

SEQ ID NO: 9010627 - DNA, 22 bp, Homo sapiens
cagaggggataacaggtgtaga

SEQ ID NO: 9010628 - DNA, 22 bp, Homo sapiens
cagaggggctgacacccttggc

SEQ ID NO: 9010629 - DNA, 21 bp, Homo sapiens
cagaggggctagcctggctgc

SEQ ID NO: 9010630 - DNA, 21 bp, Homo sapiens
cagaggggctagcctggctgc

SEQ ID NO: 9010631 - DNA, 21 bp, Homo sapiens
cagaggggctagcctggctgc

SEQ ID NO: 9010632 - DNA, 22 bp, Homo sapiens
ggggagcaatagttgaggtgtg

SEQ ID NO: 9010633 - DNA, 22 bp, Homo sapiens
ggggagcaatagttgaggtgtg

SEQ ID NO: 9010634 - DNA, 22 bp, Homo sapiens
ggggagcaatagttgaggtgtg

SEQ ID NO: 9010635 - DNA, 22 bp, Homo sapiens
ggggagcaatagttgaggtgtg

SEQ ID NO: 9010636 - DNA, 22 bp, Homo sapiens
ggggagcaatagttgaggtgtg

SEQ ID NO: 9010637 - DNA, 22 bp, Homo sapiens
ggggagcaatagttgaggtgtg

SEQ ID NO: 9010638 - DNA, 22 bp, Homo sapiens
ggggagcaatagttgaggtgtg

SEQ ID NO: 9010639 - DNA, 22 bp, Homo sapiens
ggggagcaggctgggctgtctg

SEQ ID NO: 9010640 - DNA, 18 bp, Homo sapiens
ggggagcagactgaactc

SEQ ID NO: 9010641 - DNA, 22 bp, Homo sapiens
ggggagcagaagcagcaacaac

SEQ ID NO: 9010642 - DNA, 22 bp, Homo sapiens
ggggagcaattgcccccttaga

SEQ ID NO: 9010643 - DNA, 22 bp, Homo sapiens
ggggagcaattgcccccttaga

SEQ ID NO: 9010644 - DNA, 22 bp, Homo sapiens
cagaggctttgccctggaaacc

SEQ ID NO: 9010645 - DNA, 22 bp, Homo sapiens
ggggagcttagggtctctgaat

SEQ ID NO: 9010646 - DNA, 22 bp, Homo sapiens
ggggagcaggctgggctgtctg

SEQ ID NO: 9010647 - DNA, 22 bp, Homo sapiens
ggggagcaggctgggctgtctg

SEQ ID NO: 9010648 - DNA, 22 bp, Homo sapiens
ggggagcaggctgggctgtctg

SEQ ID NO: 9010649 - DNA, 22 bp, Homo sapiens
ggggagctgagacactgccctc

SEQ ID NO: 9010650 - DNA, 22 bp, Homo sapiens
cagaggcacagtgcgggccact

SEQ ID NO: 9010651 - DNA, 22 bp, Homo sapiens
cagaggcacagtgcgggccact

SEQ ID NO: 9010652 - DNA, 22 bp, Homo sapiens
cagaggcacagtgcgggccact

SEQ ID NO: 9010653 - DNA, 22 bp, Homo sapiens
cagaggcacagtgcgggccact

SEQ ID NO: 9010654 - DNA, 22 bp, Homo sapiens
cagaggcacagtgcgggccact

SEQ ID NO: 9010655 - DNA, 19 bp, Homo sapiens
cagaggcaccaggtataga

SEQ ID NO: 9010656 - DNA, 22 bp, Homo sapiens
cagaggcacaagaaagcaaggc

SEQ ID NO: 9010657 - DNA, 22 bp, Homo sapiens
cagaggcacaagaaagcaaggc

SEQ ID NO: 9010658 - DNA, 22 bp, Homo sapiens
cagaggcacaagaaagcaaggc

SEQ ID NO: 9010659 - DNA, 22 bp, Homo sapiens
cagaggcacagcttcttttaat

SEQ ID NO: 9010660 - DNA, 22 bp, Homo sapiens
cagaggcacaagaaagcaaggc

SEQ ID NO: 9010661 - DNA, 22 bp, Homo sapiens
cagaggcacagtgcgggccact

SEQ ID NO: 9010662 - DNA, 22 bp, Homo sapiens
cagaggcacagcttcttttaat

SEQ ID NO: 9010663 - DNA, 22 bp, Homo sapiens
ggggagaccatctgaaggtgat

SEQ ID NO: 9010664 - DNA, 22 bp, Homo sapiens
ggggagagtcctttccagttcc

SEQ ID NO: 9010665 - DNA, 22 bp, Homo sapiens
ggggagagtcctttccagttcc

SEQ ID NO: 9010666 - DNA, 16 bp, Homo sapiens
cagaggcacctggctc

SEQ ID NO: 9010667 - DNA, 19 bp, Homo sapiens
cagaggcaccaggtataga

SEQ ID NO: 9010668 - DNA, 19 bp, Homo sapiens
cagaggcaccaggtataga

SEQ ID NO: 9010669 - DNA, 19 bp, Homo sapiens
cagaggcaccaggtataga

SEQ ID NO: 9010670 - DNA, 22 bp, Homo sapiens
ggtcagtctctcccgagtgttg

SEQ ID NO: 9010671 - DNA, 22 bp, Homo sapiens
ggtcacagggaagggctctcaa

SEQ ID NO: 9010672 - DNA, 22 bp, Homo sapiens
cagaggtagcatgctgtggctt

SEQ ID NO: 9010673 - DNA, 22 bp, Homo sapiens
cagaggtagaaggcatgcagtg

SEQ ID NO: 9010674 - DNA, 22 bp, Homo sapiens
cagaggtagaactggccctcac

SEQ ID NO: 9010675 - DNA, 22 bp, Homo sapiens
cagaggtagaaggcatgcagtg

SEQ ID NO: 9010676 - DNA, 22 bp, Homo sapiens
ggtcacaggggagaagagtgat

SEQ ID NO: 9010677 - DNA, 22 bp, Homo sapiens
ggtcagggttccaggtatcttc

SEQ ID NO: 9010678 - DNA, 22 bp, Homo sapiens
ggtcacagggaagggctctcaa

SEQ ID NO: 9010679 - DNA, 22 bp, Homo sapiens
ggtcaggtagctctgacaggcc

SEQ ID NO: 9010680 - DNA, 22 bp, Homo sapiens
ggtcagggttccaggtatcttc

SEQ ID NO: 9010681 - DNA, 22 bp, Homo sapiens
cagaggtacaagctaagttggg

SEQ ID NO: 9010682 - DNA, 22 bp, Homo sapiens
cagaggtacaagctaagttggg

SEQ ID NO: 9010683 - DNA, 21 bp, Homo sapiens
cagagggtttctcaggtgttt

SEQ ID NO: 9010684 - DNA, 21 bp, Homo sapiens
cagagggtttctcaggtgttt

SEQ ID NO: 9010685 - DNA, 22 bp, Homo sapiens
cagaggtaccagcagcctctgg

SEQ ID NO: 9010686 - DNA, 22 bp, Homo sapiens
cagaggtaccagcagcctctgg

SEQ ID NO: 9010687 - DNA, 22 bp, Homo sapiens
cagaggtacagccattgaagat

SEQ ID NO: 9010688 - DNA, 22 bp, Homo sapiens
cagaggtacagccattgaagat

SEQ ID NO: 9010689 - DNA, 22 bp, Homo sapiens
cagaggtacagccattgaagat

SEQ ID NO: 9010690 - DNA, 22 bp, Homo sapiens
cagagggttgatgtgaggctta

SEQ ID NO: 9010691 - DNA, 23 bp, Homo sapiens
cagagggttccatggagcatggt

SEQ ID NO: 9010692 - DNA, 21 bp, Homo sapiens
cagagggtttctcaggtgttt

SEQ ID NO: 9010693 - DNA, 22 bp, Homo sapiens
cagagggttgatgtgaggctta

SEQ ID NO: 9010694 - DNA, 22 bp, Homo sapiens
cagagtcctggacacagagaca

SEQ ID NO: 9010695 - DNA, 22 bp, Homo sapiens
cagagtcctgcaccagctccag

SEQ ID NO: 9010696 - DNA, 22 bp, Homo sapiens
cagagtcctggacacagagaca

SEQ ID NO: 9010697 - DNA, 22 bp, Homo sapiens
cagagtcctggacacagagaca

SEQ ID NO: 9010698 - DNA, 22 bp, Homo sapiens
cagagtctggactgcaggctcc

SEQ ID NO: 9010699 - DNA, 22 bp, Homo sapiens
cagagtctctgggaggctgggt

SEQ ID NO: 9010700 - DNA, 22 bp, Homo sapiens
cagagtctctgggaggctgggt

SEQ ID NO: 9010701 - DNA, 17 bp, Homo sapiens
cagagtctgtctgcatc

SEQ ID NO: 9010702 - DNA, 17 bp, Homo sapiens
cagagtctgtctgcatc

SEQ ID NO: 9010703 - DNA, 17 bp, Homo sapiens
cagagtctgtctgcatc

SEQ ID NO: 9010704 - DNA, 22 bp, Homo sapiens
cagagtctggactgcaggctcc

SEQ ID NO: 9010705 - DNA, 22 bp, Homo sapiens
cagagtctggactgcaggctcc

SEQ ID NO: 9010706 - DNA, 17 bp, Homo sapiens
cagagtctgtctgcatc

SEQ ID NO: 9010707 - DNA, 17 bp, Homo sapiens
cagagtctgtctgcatc

SEQ ID NO: 9010708 - DNA, 22 bp, Homo sapiens
ggtcctgggaagatgctcatga

SEQ ID NO: 9010709 - DNA, 18 bp, Homo sapiens
ggtcctgggcctggctca

SEQ ID NO: 9010710 - DNA, 22 bp, Homo sapiens
ggtctgagatatttgttcagct

SEQ ID NO: 9010711 - DNA, 22 bp, Homo sapiens
ggtccaaggctcggtggcgggg

SEQ ID NO: 9010712 - DNA, 23 bp, Homo sapiens
ggtccacccgagcctgcagcttc

SEQ ID NO: 9010713 - DNA, 22 bp, Homo sapiens
ggtcatgtgtccaggaggtagc

SEQ ID NO: 9010714 - DNA, 22 bp, Homo sapiens
ggtcatgagggagcagtgcagg

SEQ ID NO: 9010715 - DNA, 22 bp, Homo sapiens
cagagtcatgggccgtcaggca

SEQ ID NO: 9010716 - DNA, 22 bp, Homo sapiens
cagagtcatgggccgtcaggca

SEQ ID NO: 9010717 - DNA, 22 bp, Homo sapiens
cagagtcagtattgaattgaaa

SEQ ID NO: 9010718 - DNA, 22 bp, Homo sapiens
cagagtcatgggccgtcaggca

SEQ ID NO: 9010719 - DNA, 22 bp, Homo sapiens
cagagtcatgggccgtcaggca

SEQ ID NO: 9010720 - DNA, 22 bp, Homo sapiens
cagagtcatatcagagaatatg

SEQ ID NO: 9010721 - DNA, 22 bp, Homo sapiens
cagagtcagctagtcttgggat

SEQ ID NO: 9010722 - DNA, 22 bp, Homo sapiens
cagagtcagctagtcttgggat

SEQ ID NO: 9010723 - DNA, 22 bp, Homo sapiens
cagagtcccagatgcccctcct

SEQ ID NO: 9010724 - DNA, 22 bp, Homo sapiens
cagagtccaattgctcagagcg

SEQ ID NO: 9010725 - DNA, 22 bp, Homo sapiens
cagagtccccagcggcgcgggc

SEQ ID NO: 9010726 - DNA, 22 bp, Homo sapiens
cagagtcatgggccgtcaggca

SEQ ID NO: 9010727 - DNA, 22 bp, Homo sapiens
cagagtcattgacttccaggag

SEQ ID NO: 9010728 - DNA, 22 bp, Homo sapiens
cagagtcattgacttccaggag

SEQ ID NO: 9010729 - DNA, 22 bp, Homo sapiens
cagagtcattgacttccaggag

SEQ ID NO: 9010730 - DNA, 22 bp, Homo sapiens
cagaccctgggccacagaggag

SEQ ID NO: 9010731 - DNA, 22 bp, Homo sapiens
cagaccctcttctattggtggg

SEQ ID NO: 9010732 - DNA, 21 bp, Homo sapiens
cagaccctctagaggccacct

SEQ ID NO: 9010733 - DNA, 22 bp, Homo sapiens
cagaccctgggccacagaggag

SEQ ID NO: 9010734 - DNA, 22 bp, Homo sapiens
cagaccctcttctattggtggg

SEQ ID NO: 9010735 - DNA, 22 bp, Homo sapiens
cagaccctgggccacagaggag

SEQ ID NO: 9010736 - DNA, 22 bp, Homo sapiens
cagaccctgggccacagaggag

SEQ ID NO: 9010737 - DNA, 22 bp, Homo sapiens
cagaccctgggccacagaggag

SEQ ID NO: 9010738 - DNA, 21 bp, Homo sapiens
cagaccctctagaggccacct

SEQ ID NO: 9010739 - DNA, 21 bp, Homo sapiens
cagaccctctagaggccacct

SEQ ID NO: 9010740 - DNA, 23 bp, Homo sapiens
cagaccctcaatccacttgtttt

SEQ ID NO: 9010741 - DNA, 21 bp, Homo sapiens
cagaccctctagaggccacct

SEQ ID NO: 9010742 - DNA, 22 bp, Homo sapiens
cagaccctcgggtgagttggcc

SEQ ID NO: 9010743 - DNA, 22 bp, Homo sapiens
cagacctcaaagctgcagtgct

SEQ ID NO: 9010744 - DNA, 22 bp, Homo sapiens
cagacctcaaagctgcagtgct

SEQ ID NO: 9010745 - DNA, 22 bp, Homo sapiens
cagacccttttctgagaggacc

SEQ ID NO: 9010746 - DNA, 22 bp, Homo sapiens
cagacccttttctgagaggacc

SEQ ID NO: 9010747 - DNA, 22 bp, Homo sapiens
cagacccttttctgagaggacc

SEQ ID NO: 9010748 - DNA, 22 bp, Homo sapiens
cagaccctcgggtgagttggcc

SEQ ID NO: 9010749 - DNA, 23 bp, Homo sapiens
cagaccctcaatccacttgtttt

SEQ ID NO: 9010750 - DNA, 22 bp, Homo sapiens
cagaccatgatggacagctctg

SEQ ID NO: 9010751 - DNA, 22 bp, Homo sapiens
cagacccaggatccaaatgttg

SEQ ID NO: 9010752 - DNA, 22 bp, Homo sapiens
cagacatggcgccaagtgctag

SEQ ID NO: 9010753 - DNA, 22 bp, Homo sapiens
cagaccagaaggaagccgacaa

SEQ ID NO: 9010754 - DNA, 22 bp, Homo sapiens
cagaccagaaggaagccgacaa

SEQ ID NO: 9010755 - DNA, 22 bp, Homo sapiens
cagaccagaaggaagccgacaa

SEQ ID NO: 9010756 - DNA, 22 bp, Homo sapiens
cagaccagaaggaagccgacaa

SEQ ID NO: 9010757 - DNA, 22 bp, Homo sapiens
cagaccagtagggctcatccca

SEQ ID NO: 9010758 - DNA, 22 bp, Homo sapiens
cagaccagctctatgaacccaa

SEQ ID NO: 9010759 - DNA, 22 bp, Homo sapiens
cagacagggtcctgtccgtcac

SEQ ID NO: 9010760 - DNA, 22 bp, Homo sapiens
ggcttcagctggttatttcctt

SEQ ID NO: 9010761 - DNA, 22 bp, Homo sapiens
ggcttcagatttctcagttgtt

SEQ ID NO: 9010762 - DNA, 22 bp, Homo sapiens
ggcttcagaggggaggtagtgc

SEQ ID NO: 9010763 - DNA, 22 bp, Homo sapiens
ggcttcagaggggaggtagtgc

SEQ ID NO: 9010764 - DNA, 22 bp, Homo sapiens
ggcttcagaagactggacaggt

SEQ ID NO: 9010765 - DNA, 22 bp, Homo sapiens
ggcttcagaagactggacaggt

SEQ ID NO: 9010766 - DNA, 22 bp, Homo sapiens
ggcttcagaagactggacaggt

SEQ ID NO: 9010767 - DNA, 22 bp, Homo sapiens
ggcttcagaggagaagagggtg

SEQ ID NO: 9010768 - DNA, 22 bp, Homo sapiens
ggcttagattgacactgatctc

SEQ ID NO: 9010769 - DNA, 22 bp, Homo sapiens
ggcttagcaactcctgaggctc

SEQ ID NO: 9010770 - DNA, 22 bp, Homo sapiens
ggcttagcaactcctgaggctc

SEQ ID NO: 9010771 - DNA, 22 bp, Homo sapiens
ggcttagcaactcctgaggctc

SEQ ID NO: 9010772 - DNA, 22 bp, Homo sapiens
ggcttagattgacactgatctc

SEQ ID NO: 9010773 - DNA, 22 bp, Homo sapiens
ggcttaataaataacatgtcat

SEQ ID NO: 9010774 - DNA, 17 bp, Homo sapiens
ggcttacaggtgccagc

SEQ ID NO: 9010775 - DNA, 22 bp, Homo sapiens
ggcttagaaggcaaatgacttg

SEQ ID NO: 9010776 - DNA, 22 bp, Homo sapiens
ggcttagaaggcaaatgacttg

SEQ ID NO: 9010777 - DNA, 20 bp, Homo sapiens
ggcttagactgagttctcac

SEQ ID NO: 9010778 - DNA, 22 bp, Homo sapiens
ggcttcaatgtattcacattca

SEQ ID NO: 9010779 - DNA, 22 bp, Homo sapiens
cagacctgaggttgagtaccag

SEQ ID NO: 9010780 - DNA, 22 bp, Homo sapiens
cagacctgaggagcactgagcc

SEQ ID NO: 9010781 - DNA, 22 bp, Homo sapiens
cagacctgaggagcactgagcc

SEQ ID NO: 9010782 - DNA, 22 bp, Homo sapiens
cagacctgaggagcactgagcc

SEQ ID NO: 9010783 - DNA, 22 bp, Homo sapiens
cagacctggaaaacaggcttgc

SEQ ID NO: 9010784 - DNA, 23 bp, Homo sapiens
cagacctggcagtcatcctcaac

SEQ ID NO: 9010785 - DNA, 20 bp, Homo sapiens
cagacctgcacccacttcga

SEQ ID NO: 9010786 - DNA, 22 bp, Homo sapiens
cagacctggaaaacaggcttgc

SEQ ID NO: 9010787 - DNA, 20 bp, Homo sapiens
cagacctgcacccacttcga

SEQ ID NO: 9010788 - DNA, 19 bp, Homo sapiens
cagacctgtccagcctgtg

SEQ ID NO: 9010789 - DNA, 22 bp, Homo sapiens
cagacctgggtccctggcctgt

SEQ ID NO: 9010790 - DNA, 22 bp, Homo sapiens
cagacctgggtccctggcctgt

SEQ ID NO: 9010791 - DNA, 22 bp, Homo sapiens
cagacctggggcctgggagccc

SEQ ID NO: 9010792 - DNA, 23 bp, Homo sapiens
cagacctggcagtcatcctcaac

SEQ ID NO: 9010793 - DNA, 22 bp, Homo sapiens
cagactctcttccatgcatcac

SEQ ID NO: 9010794 - DNA, 19 bp, Homo sapiens
cagacctgtccagcctgtg

SEQ ID NO: 9010795 - DNA, 19 bp, Homo sapiens
cagacctgtccagcctgtg

SEQ ID NO: 9010796 - DNA, 19 bp, Homo sapiens
cagacctgtccagcctgtg

SEQ ID NO: 9010797 - DNA, 22 bp, Homo sapiens
cagactgggagtcaggaagaag

SEQ ID NO: 9010798 - DNA, 22 bp, Homo sapiens
cagactgggagtcaggaagaag

SEQ ID NO: 9010799 - DNA, 22 bp, Homo sapiens
cagactgggagtcaggaagaag

SEQ ID NO: 9010800 - DNA, 22 bp, Homo sapiens
cagactgggctggtggaaagct

SEQ ID NO: 9010801 - DNA, 22 bp, Homo sapiens
gggcagagactcagaaacagaa

SEQ ID NO: 9010802 - DNA, 22 bp, Homo sapiens
gggcagcagagccctgccgagt

SEQ ID NO: 9010803 - DNA, 22 bp, Homo sapiens
gggcagagactcagaaacagaa

SEQ ID NO: 9010804 - DNA, 22 bp, Homo sapiens
gggcagagaaatggacagttgg

SEQ ID NO: 9010805 - DNA, 22 bp, Homo sapiens
cagactggccacatctgcactg

SEQ ID NO: 9010806 - DNA, 22 bp, Homo sapiens
cagactggctgaaggccgagtg

SEQ ID NO: 9010807 - DNA, 22 bp, Homo sapiens
cagactggctgaaggccgagtg

SEQ ID NO: 9010808 - DNA, 22 bp, Homo sapiens
cagactgagtggattaaacaat

SEQ ID NO: 9010809 - DNA, 22 bp, Homo sapiens
cagactgagggcatcacatacg

SEQ ID NO: 9010810 - DNA, 22 bp, Homo sapiens
cagactggccacatctgcactg

SEQ ID NO: 9010811 - DNA, 22 bp, Homo sapiens
cagactggccacatctgcactg

SEQ ID NO: 9010812 - DNA, 22 bp, Homo sapiens
cagactctgatgcagccttgtg

SEQ ID NO: 9010813 - DNA, 22 bp, Homo sapiens
cagactctcttccatgcatcac

SEQ ID NO: 9010814 - DNA, 22 bp, Homo sapiens
cagactgactttctgtggctat

SEQ ID NO: 9010815 - DNA, 22 bp, Homo sapiens
cagactcttgagctgattgtat

SEQ ID NO: 9010816 - DNA, 22 bp, Homo sapiens
gggcagtggttacacagctgag

SEQ ID NO: 9010817 - DNA, 22 bp, Homo sapiens
gggcagtgtcgaggtctggtcc

SEQ ID NO: 9010818 - DNA, 22 bp, Homo sapiens
gggcagtgtcgaggtctggtcc

SEQ ID NO: 9010819 - DNA, 22 bp, Homo sapiens
gggcagtggttacacagctgag

SEQ ID NO: 9010820 - DNA, 22 bp, Homo sapiens
gggcagtgggtggctgcagcct

SEQ ID NO: 9010821 - DNA, 22 bp, Homo sapiens
gggcagtggtccaggctacagc

SEQ ID NO: 9010822 - DNA, 22 bp, Homo sapiens
gggcagtggtccaggctacagc

SEQ ID NO: 9010823 - DNA, 22 bp, Homo sapiens
gggcagtggtccaggctacagc

SEQ ID NO: 9010824 - DNA, 22 bp, Homo sapiens
gggcagtgggaccaggcaccag

SEQ ID NO: 9010825 - DNA, 22 bp, Homo sapiens
gggcagtgggtggctgcagcct

SEQ ID NO: 9010826 - DNA, 22 bp, Homo sapiens
gggcagtgggtggctgcagcct

SEQ ID NO: 9010827 - DNA, 22 bp, Homo sapiens
gggcagtgggtggctgcagcct

SEQ ID NO: 9010828 - DNA, 22 bp, Homo sapiens
cagagacagggcagggagtgtg

SEQ ID NO: 9010829 - DNA, 22 bp, Homo sapiens
cagagacagggcagggagtgtg

SEQ ID NO: 9010830 - DNA, 22 bp, Homo sapiens
cagagacaggcttgccctccac

SEQ ID NO: 9010831 - DNA, 22 bp, Homo sapiens
cagagacaggcttgccctccac

SEQ ID NO: 9010832 - DNA, 22 bp, Homo sapiens
cagagacaggatctcgaagact

SEQ ID NO: 9010833 - DNA, 22 bp, Homo sapiens
cagagacaggcttgccctccac

SEQ ID NO: 9010834 - DNA, 22 bp, Homo sapiens
cagagacaggcttgccctccac

SEQ ID NO: 9010835 - DNA, 22 bp, Homo sapiens
cagagacaggcttgccctccac

SEQ ID NO: 9010836 - DNA, 22 bp, Homo sapiens
cagagacagggcagggagtgtg

SEQ ID NO: 9010837 - DNA, 22 bp, Homo sapiens
cagagacagggcagggagtgtg

SEQ ID NO: 9010838 - DNA, 22 bp, Homo sapiens
gggcaggtatttatcttctatt

SEQ ID NO: 9010839 - DNA, 22 bp, Homo sapiens
cagagacaggaatcagctgcag

SEQ ID NO: 9010840 - DNA, 22 bp, Homo sapiens
cagagacaggaatcagctgcag

SEQ ID NO: 9010841 - DNA, 22 bp, Homo sapiens
cagagacaggaatcagctgcag

SEQ ID NO: 9010842 - DNA, 22 bp, Homo sapiens
cagagacaggagtgctcccagt

SEQ ID NO: 9010843 - DNA, 22 bp, Homo sapiens
cagagacaggagtgctcccagt

SEQ ID NO: 9010844 - DNA, 22 bp, Homo sapiens
cagagacaggagtgctcccagt

SEQ ID NO: 9010845 - DNA, 22 bp, Homo sapiens
cagagacaggagtgctcccagt

SEQ ID NO: 9010846 - DNA, 22 bp, Homo sapiens
cagagacaggagtgctcccagt

SEQ ID NO: 9010847 - DNA, 22 bp, Homo sapiens
cagagacaggagtgctcccagt

SEQ ID NO: 9010848 - DNA, 22 bp, Homo sapiens
cagagacaggatctcgaagact

SEQ ID NO: 9010849 - DNA, 22 bp, Homo sapiens
cagagacaggatctcgaagact

SEQ ID NO: 9010850 - DNA, 22 bp, Homo sapiens
cagagacaggatctcgaagact

SEQ ID NO: 9010851 - DNA, 22 bp, Homo sapiens
cagagacaggatctcgaagact

SEQ ID NO: 9010852 - DNA, 21 bp, Homo sapiens
gggcagcagcagcaacaaggg

SEQ ID NO: 9010853 - DNA, 21 bp, Homo sapiens
gggcagcagcagcaacaaggg

SEQ ID NO: 9010854 - DNA, 22 bp, Homo sapiens
gggcagcagagccctgccgagt

SEQ ID NO: 9010855 - DNA, 22 bp, Homo sapiens
gggcagcagaggatcccttaat

SEQ ID NO: 9010856 - DNA, 22 bp, Homo sapiens
gggcagcagcaggaggtctctg

SEQ ID NO: 9010857 - DNA, 22 bp, Homo sapiens
gggcagcagcaggaggtctctg

SEQ ID NO: 9010858 - DNA, 22 bp, Homo sapiens
gggcagcagcaggaggtctctg

SEQ ID NO: 9010859 - DNA, 22 bp, Homo sapiens
gggcagcatcaggaggggcttt

SEQ ID NO: 9010860 - DNA, 22 bp, Homo sapiens
gggcagcatgaggaccctcatc

SEQ ID NO: 9010861 - DNA, 22 bp, Homo sapiens
gggcagcatcaggaggggcttt

SEQ ID NO: 9010862 - DNA, 22 bp, Homo sapiens
gggcagcagttgccctaatcaa

SEQ ID NO: 9010863 - DNA, 22 bp, Homo sapiens
gggcagcaggctccacgttcct

SEQ ID NO: 9010864 - DNA, 22 bp, Homo sapiens
gggcagcattctgtgggcaggt

SEQ ID NO: 9010865 - DNA, 22 bp, Homo sapiens
gggcagcattctgtgggcaggt

SEQ ID NO: 9010866 - DNA, 22 bp, Homo sapiens
gggcagcatgtcactagcatgg

SEQ ID NO: 9010867 - DNA, 22 bp, Homo sapiens
gggcagcattctgtgggcaggt

SEQ ID NO: 9010868 - DNA, 22 bp, Homo sapiens
gggcagcattctgtgggcaggt

SEQ ID NO: 9010869 - DNA, 22 bp, Homo sapiens
gggcagcattctgtgggcaggt

SEQ ID NO: 9010870 - DNA, 22 bp, Homo sapiens
gggcagcattctgtgggcaggt

SEQ ID NO: 9010871 - DNA, 22 bp, Homo sapiens
gggcagcattctgtgggcaggt

SEQ ID NO: 9010872 - DNA, 22 bp, Homo sapiens
cagagacagcctgggagggaca

SEQ ID NO: 9010873 - DNA, 22 bp, Homo sapiens
cagagacagcaagttgatttcc

SEQ ID NO: 9010874 - DNA, 22 bp, Homo sapiens
gggcagcccagaactgctgcag

SEQ ID NO: 9010875 - DNA, 22 bp, Homo sapiens
gggcagcccagaactgctgcag

SEQ ID NO: 9010876 - DNA, 22 bp, Homo sapiens
cagagacaggaatcagctgcag

SEQ ID NO: 9010877 - DNA, 22 bp, Homo sapiens
cagagacaggaatcagctgcag

SEQ ID NO: 9010878 - DNA, 22 bp, Homo sapiens
cagagacaggaatcagctgcag

SEQ ID NO: 9010879 - DNA, 22 bp, Homo sapiens
cagagacagcctgggagggaca

SEQ ID NO: 9010880 - DNA, 22 bp, Homo sapiens
cagagacagcctgggagggaca

SEQ ID NO: 9010881 - DNA, 22 bp, Homo sapiens
cagagacaggaatcagctgcag

SEQ ID NO: 9010882 - DNA, 22 bp, Homo sapiens
cagagacaggaatcagctgcag

SEQ ID NO: 9010883 - DNA, 22 bp, Homo sapiens
cagagcctgctcacgtctctgt

SEQ ID NO: 9010884 - DNA, 19 bp, Homo sapiens
cagagctgctggcctcgtc

SEQ ID NO: 9010885 - DNA, 22 bp, Homo sapiens
cagagcctgctcacgtctctgt

SEQ ID NO: 9010886 - DNA, 22 bp, Homo sapiens
cagagcctgcctctggctgtgg

SEQ ID NO: 9010887 - DNA, 22 bp, Homo sapiens
cagagcctgcctctggctgtgg

SEQ ID NO: 9010888 - DNA, 22 bp, Homo sapiens
cagagctgcttcccagtttgtg

SEQ ID NO: 9010889 - DNA, 19 bp, Homo sapiens
cagagctgctggcctcgtc

SEQ ID NO: 9010890 - DNA, 22 bp, Homo sapiens
cagagctggctctgcatgtaca

SEQ ID NO: 9010891 - DNA, 22 bp, Homo sapiens
cagagctggctctgcatgtaca

SEQ ID NO: 9010892 - DNA, 23 bp, Homo sapiens
cagagctggctcagagctgcctg

SEQ ID NO: 9010893 - DNA, 22 bp, Homo sapiens
cagagcctctgccctgggcact

SEQ ID NO: 9010894 - DNA, 22 bp, Homo sapiens
cagagcctgccacctttctccc

SEQ ID NO: 9010895 - DNA, 22 bp, Homo sapiens
cagagcctctgccctgggcact

SEQ ID NO: 9010896 - DNA, 22 bp, Homo sapiens
cagagcctctgccctgggcact

SEQ ID NO: 9010897 - DNA, 22 bp, Homo sapiens
cagagcctctcagaggtcagac

SEQ ID NO: 9010898 - DNA, 22 bp, Homo sapiens
cagagcctctcagaggtcagac

SEQ ID NO: 9010899 - DNA, 22 bp, Homo sapiens
cagagcctctcagccccttggg

SEQ ID NO: 9010900 - DNA, 22 bp, Homo sapiens
cagagcctctcagccccttggg

SEQ ID NO: 9010901 - DNA, 22 bp, Homo sapiens
cagagcctctcagaggtcagac

SEQ ID NO: 9010902 - DNA, 22 bp, Homo sapiens
cagagcctccctcctctgccat

SEQ ID NO: 9010903 - DNA, 22 bp, Homo sapiens
cagagctggctctgcatgtaca

SEQ ID NO: 9010904 - DNA, 23 bp, Homo sapiens
cagagctggcttcatgggtgtgc

SEQ ID NO: 9010905 - DNA, 23 bp, Homo sapiens
cagagctggcttcatgggtgtgc

SEQ ID NO: 9010906 - DNA, 22 bp, Homo sapiens
cagagctgggatcccatgggcg

SEQ ID NO: 9010907 - DNA, 23 bp, Homo sapiens
cagagctggcttcatgggtgtgc

SEQ ID NO: 9010908 - DNA, 23 bp, Homo sapiens
cagagctggcttcatgggtgtgc

SEQ ID NO: 9010909 - DNA, 23 bp, Homo sapiens
cagagctggcttcatgggtgtgc

SEQ ID NO: 9010910 - DNA, 22 bp, Homo sapiens
cagagctgggatcccatgggcg

SEQ ID NO: 9010911 - DNA, 22 bp, Homo sapiens
cagagctgggatcccatgggcg

SEQ ID NO: 9010912 - DNA, 22 bp, Homo sapiens
cagagctgggatcccatgggcg

SEQ ID NO: 9010913 - DNA, 22 bp, Homo sapiens
cagagctgggatcccatgggcg

SEQ ID NO: 9010914 - DNA, 23 bp, Homo sapiens
cagagctggcttcatgggtgtgc

SEQ ID NO: 9010915 - DNA, 22 bp, Homo sapiens
cagagctgggatcccatgggcg

SEQ ID NO: 9010916 - DNA, 22 bp, Homo sapiens
cagagctgggatcccatgggcg

SEQ ID NO: 9010917 - DNA, 22 bp, Homo sapiens
cagagctgggcatggtgaaagg

SEQ ID NO: 9010918 - DNA, 22 bp, Homo sapiens
cagagctgggtttgggaaacct

SEQ ID NO: 9010919 - DNA, 22 bp, Homo sapiens
cagagctggggactgttggatg

SEQ ID NO: 9010920 - DNA, 22 bp, Homo sapiens
cagagctgggtttgggaaacct

SEQ ID NO: 9010921 - DNA, 22 bp, Homo sapiens
cagagctgggatcccatgggcg

SEQ ID NO: 9010922 - DNA, 20 bp, Homo sapiens
cagagctgggatttgaacac

SEQ ID NO: 9010923 - DNA, 20 bp, Homo sapiens
cagagctgggatttgaacac

SEQ ID NO: 9010924 - DNA, 22 bp, Homo sapiens
cagagctgggcatggtgaaagg

SEQ ID NO: 9010925 - DNA, 20 bp, Homo sapiens
cagagctgggatttgaacac

SEQ ID NO: 9010926 - DNA, 22 bp, Homo sapiens
cagagctgggcatggtgaaagg

SEQ ID NO: 9010927 - DNA, 22 bp, Homo sapiens
gggctgagtcatctggggcctc

SEQ ID NO: 9010928 - DNA, 22 bp, Homo sapiens
gggctgagtcatctggggcctc

SEQ ID NO: 9010929 - DNA, 22 bp, Homo sapiens
cagagctggggactgttggatg

SEQ ID NO: 9010930 - DNA, 22 bp, Homo sapiens
gggctgaggggtatctcatggg

SEQ ID NO: 9010931 - DNA, 22 bp, Homo sapiens
gggctgagtcatctggggcctc

SEQ ID NO: 9010932 - DNA, 22 bp, Homo sapiens
cagagctgggtttgggaaacct

SEQ ID NO: 9010933 - DNA, 22 bp, Homo sapiens
cagagctgggtttgggaaacct

SEQ ID NO: 9010934 - DNA, 22 bp, Homo sapiens
gggctgaggggtatctcatggg

SEQ ID NO: 9010935 - DNA, 22 bp, Homo sapiens
gggctgaggggtatctcatggg

SEQ ID NO: 9010936 - DNA, 22 bp, Homo sapiens
cagagctggggactgttggatg

SEQ ID NO: 9010937 - DNA, 22 bp, Homo sapiens
gggctgaggggtatctcatggg

SEQ ID NO: 9010938 - DNA, 22 bp, Homo sapiens
gggctgaggggtatctcatggg

SEQ ID NO: 9010939 - DNA, 22 bp, Homo sapiens
gggctgagtctgctgcctgtca

SEQ ID NO: 9010940 - DNA, 22 bp, Homo sapiens
gggctgagtgacctcaggccaa

SEQ ID NO: 9010941 - DNA, 22 bp, Homo sapiens
gggctgagtgacctcaggccaa

SEQ ID NO: 9010942 - DNA, 22 bp, Homo sapiens
gggctgagtgacctcaggccaa

SEQ ID NO: 9010943 - DNA, 22 bp, Homo sapiens
gggctgagtgacctcaggccaa

SEQ ID NO: 9010944 - DNA, 22 bp, Homo sapiens
gggctgagtctgctgcctgtca

SEQ ID NO: 9010945 - DNA, 22 bp, Homo sapiens
gggctgagtctgctgcctgtca

SEQ ID NO: 9010946 - DNA, 22 bp, Homo sapiens
gggctgagtctgctgcctgtca

SEQ ID NO: 9010947 - DNA, 22 bp, Homo sapiens
gggctgagtcatctggggcctc

SEQ ID NO: 9010948 - DNA, 22 bp, Homo sapiens
gggctgagtcatctggggcctc

SEQ ID NO: 9010949 - DNA, 22 bp, Homo sapiens
cagaggcaaaagaggtggaggt

SEQ ID NO: 9010950 - DNA, 22 bp, Homo sapiens
cagaggcaaaagaggtggaggt

SEQ ID NO: 9010951 - DNA, 22 bp, Homo sapiens
cagaggattatggagatggtct

SEQ ID NO: 9010952 - DNA, 22 bp, Homo sapiens
cagaggagaattgcgggatcat

SEQ ID NO: 9010953 - DNA, 22 bp, Homo sapiens
cagaggacttcccactcatctg

SEQ ID NO: 9010954 - DNA, 22 bp, Homo sapiens
gggctgagtgacctcaggccaa

SEQ ID NO: 9010955 - DNA, 22 bp, Homo sapiens
gggctgagtgggcctcttactt

SEQ ID NO: 9010956 - DNA, 20 bp, Homo sapiens
cagaggcaaggagacttgga

SEQ ID NO: 9010957 - DNA, 20 bp, Homo sapiens
cagaggcaaggagacttgga

SEQ ID NO: 9010958 - DNA, 20 bp, Homo sapiens
cagaggcaaggagacttgga

SEQ ID NO: 9010959 - DNA, 20 bp, Homo sapiens
cagaggcaaggagacttgga

SEQ ID NO: 9010960 - DNA, 22 bp, Homo sapiens
cagaggcaaaagaggtggaggt

SEQ ID NO: 9010961 - DNA, 22 bp, Homo sapiens
cagaggcaaaagaggtggaggt

SEQ ID NO: 9010962 - DNA, 22 bp, Homo sapiens
cagaggcaaaagaggtggaggt

SEQ ID NO: 9010963 - DNA, 20 bp, Homo sapiens
cagaggcaaggagacttgga

SEQ ID NO: 9010964 - DNA, 22 bp, Homo sapiens
gggctgacaccacccaggcgca

SEQ ID NO: 9010965 - DNA, 22 bp, Homo sapiens
gggctgaatttgttgcatgtaa

SEQ ID NO: 9010966 - DNA, 22 bp, Homo sapiens
gggctgacagtttcccctgaaa

SEQ ID NO: 9010967 - DNA, 22 bp, Homo sapiens
gggctgaccccacccctcactc

SEQ ID NO: 9010968 - DNA, 22 bp, Homo sapiens
gggctgaactcaagtcagctcc

SEQ ID NO: 9010969 - DNA, 22 bp, Homo sapiens
gggctgacaaccatctgacaag

SEQ ID NO: 9010970 - DNA, 22 bp, Homo sapiens
gggctgaaaggccgcctcagat

SEQ ID NO: 9010971 - DNA, 22 bp, Homo sapiens
gggctgaaaggccgcctcagat

SEQ ID NO: 9010972 - DNA, 22 bp, Homo sapiens
gggctctgtttagatcagagat

SEQ ID NO: 9010973 - DNA, 22 bp, Homo sapiens
gggctctgtttagaccagagat

SEQ ID NO: 9010974 - DNA, 22 bp, Homo sapiens
gggctctgtttagaccagagat

SEQ ID NO: 9010975 - DNA, 22 bp, Homo sapiens
gggctctgtttagaccagagat

SEQ ID NO: 9010976 - DNA, 22 bp, Homo sapiens
gggctctgtttagaccagagat

SEQ ID NO: 9010977 - DNA, 22 bp, Homo sapiens
gggctctgtttagaccagagat

SEQ ID NO: 9010978 - DNA, 22 bp, Homo sapiens
gggctgagaagttgatcccaag

SEQ ID NO: 9010979 - DNA, 22 bp, Homo sapiens
gggctgacgaaggccatgtgtg

SEQ ID NO: 9010980 - DNA, 22 bp, Homo sapiens
gggctgactcaaccttgcaaag

SEQ ID NO: 9010981 - DNA, 22 bp, Homo sapiens
cagagcctaaaacgactccact

SEQ ID NO: 9010982 - DNA, 22 bp, Homo sapiens
cagagcctaaaacgactccact

SEQ ID NO: 9010983 - DNA, 22 bp, Homo sapiens
cagagcctaaaacgactccact

SEQ ID NO: 9010984 - DNA, 22 bp, Homo sapiens
cagagcccttggctggagccca

SEQ ID NO: 9010985 - DNA, 22 bp, Homo sapiens
cagagcctaaaacgactccact

SEQ ID NO: 9010986 - DNA, 22 bp, Homo sapiens
cagagccgggagccagtcacag

SEQ ID NO: 9010987 - DNA, 19 bp, Homo sapiens
cagagcctcagagctagaa

SEQ ID NO: 9010988 - DNA, 19 bp, Homo sapiens
cagagcctcagagctagaa

SEQ ID NO: 9010989 - DNA, 19 bp, Homo sapiens
cagagcctcagagctagaa

SEQ ID NO: 9010990 - DNA, 19 bp, Homo sapiens
cagagcctcagagctagaa

SEQ ID NO: 9010991 - DNA, 22 bp, Homo sapiens
cagagcctcagaatcctgtgga

SEQ ID NO: 9010992 - DNA, 22 bp, Homo sapiens
cagagcctcagaatcctgtgga

SEQ ID NO: 9010993 - DNA, 22 bp, Homo sapiens
cagagcctcagaatcctgtgga

SEQ ID NO: 9010994 - DNA, 22 bp, Homo sapiens
cagagcctccctcctctgccat

SEQ ID NO: 9010995 - DNA, 22 bp, Homo sapiens
cagagcctcatcatccactcca

SEQ ID NO: 9010996 - DNA, 19 bp, Homo sapiens
cagagcctcagagctagaa

SEQ ID NO: 9010997 - DNA, 22 bp, Homo sapiens
cagagcctcatcatccactcca

SEQ ID NO: 9010998 - DNA, 22 bp, Homo sapiens
cagagcctcatcatccactcca

SEQ ID NO: 9010999 - DNA, 22 bp, Homo sapiens
gggcagtgtctgcaaatgaaca

SEQ ID NO: 9011000 - DNA, 22 bp, Homo sapiens
gggcagtgtctggcccccaggc

SEQ ID NO: 9011001 - DNA, 22 bp, Homo sapiens
gggcagtgtcgaggtctggtcc

SEQ ID NO: 9011002 - DNA, 22 bp, Homo sapiens
gggcagtgtcggggcccaggga

SEQ ID NO: 9011003 - DNA, 22 bp, Homo sapiens
gggccacctggattccatgtgt

SEQ ID NO: 9011004 - DNA, 22 bp, Homo sapiens
gggccacctggattccatgtgt

SEQ ID NO: 9011005 - DNA, 22 bp, Homo sapiens
gggccacattgaagggtgggta

SEQ ID NO: 9011006 - DNA, 22 bp, Homo sapiens
gggccaccccactgcccacgct

SEQ ID NO: 9011007 - DNA, 22 bp, Homo sapiens
gggccacggaaggaccagtggg

SEQ ID NO: 9011008 - DNA, 22 bp, Homo sapiens
gggccacggaaggaccagtggg

SEQ ID NO: 9011009 - DNA, 22 bp, Homo sapiens
gggccactcctggctgctgagt

SEQ ID NO: 9011010 - DNA, 22 bp, Homo sapiens
gggccagacccttggcgatctg

SEQ ID NO: 9011011 - DNA, 22 bp, Homo sapiens
gggccagacccttggcgatctg

SEQ ID NO: 9011012 - DNA, 22 bp, Homo sapiens
gggccacttctagtgcctcaga

SEQ ID NO: 9011013 - DNA, 22 bp, Homo sapiens
gggccactgggtcctgctggcc

SEQ ID NO: 9011014 - DNA, 22 bp, Homo sapiens
gggccagagcttggcagctggg

SEQ ID NO: 9011015 - DNA, 22 bp, Homo sapiens
gggccagagcttggcagctggg

SEQ ID NO: 9011016 - DNA, 22 bp, Homo sapiens
gggccagagcttggcagctggg

SEQ ID NO: 9011017 - DNA, 22 bp, Homo sapiens
gggccagagcttggcagctggg

SEQ ID NO: 9011018 - DNA, 22 bp, Homo sapiens
gggccagagcttggcagctggg

SEQ ID NO: 9011019 - DNA, 22 bp, Homo sapiens
gggccagacccttggcgatctg

SEQ ID NO: 9011020 - DNA, 22 bp, Homo sapiens
gggccagacctcttctcaggga

SEQ ID NO: 9011021 - DNA, 20 bp, Homo sapiens
gggctctgcttggcagaagt

SEQ ID NO: 9011022 - DNA, 22 bp, Homo sapiens
gggccagctctgtgatgtaggg

SEQ ID NO: 9011023 - DNA, 22 bp, Homo sapiens
gggccagcagtatcggaggcat

SEQ ID NO: 9011024 - DNA, 22 bp, Homo sapiens
gggccagcctactgctagaccc

SEQ ID NO: 9011025 - DNA, 22 bp, Homo sapiens
gggccagcctactgctagaccc

SEQ ID NO: 9011026 - DNA, 22 bp, Homo sapiens
gggccagcctactgctagaccc

SEQ ID NO: 9011027 - DNA, 22 bp, Homo sapiens
gggccagcagtatcggaggcat

SEQ ID NO: 9011028 - DNA, 22 bp, Homo sapiens
gggccagcagtatcggaggcat

SEQ ID NO: 9011029 - DNA, 22 bp, Homo sapiens
gggccagcagtatcggaggcat

SEQ ID NO: 9011030 - DNA, 22 bp, Homo sapiens
gggccagcagtatcggaggcat

SEQ ID NO: 9011031 - DNA, 22 bp, Homo sapiens
gctgttcacagactctgctctg

SEQ ID NO: 9011032 - DNA, 22 bp, Homo sapiens
gctgttataatattctgtttgt

SEQ ID NO: 9011033 - DNA, 22 bp, Homo sapiens
gctgttattttacaagacttat

SEQ ID NO: 9011034 - DNA, 19 bp, Homo sapiens
gctgttaaggaccctcgga

SEQ ID NO: 9011035 - DNA, 22 bp, Homo sapiens
gctgtgttttatgttaggttaa

SEQ ID NO: 9011036 - DNA, 22 bp, Homo sapiens
gctgttcagatgcgattcagga

SEQ ID NO: 9011037 - DNA, 22 bp, Homo sapiens
gctgttcagggcactcatgggc

SEQ ID NO: 9011038 - DNA, 22 bp, Homo sapiens
gctgttcccatgtggggctcag

SEQ ID NO: 9011039 - DNA, 22 bp, Homo sapiens
gctgttcctgcttagaggtcgg

SEQ ID NO: 9011040 - DNA, 22 bp, Homo sapiens
caagtattttaaggactagtgg

SEQ ID NO: 9011041 - DNA, 22 bp, Homo sapiens
caagtattttaaggactagtgg

SEQ ID NO: 9011042 - DNA, 22 bp, Homo sapiens
caagtatttgcggagttccacg

SEQ ID NO: 9011043 - DNA, 22 bp, Homo sapiens
caagtcaactcaaattgttatc

SEQ ID NO: 9011044 - DNA, 22 bp, Homo sapiens
gctgtggcctggcgcagagctg

SEQ ID NO: 9011045 - DNA, 22 bp, Homo sapiens
caagtcaatacctgtggacaaa

SEQ ID NO: 9011046 - DNA, 22 bp, Homo sapiens
gctgtggcctggcgcagagctg

SEQ ID NO: 9011047 - DNA, 22 bp, Homo sapiens
gctgtggcctggcgcagagctg

SEQ ID NO: 9011048 - DNA, 22 bp, Homo sapiens
gctgtggcggcagcagctggtg

SEQ ID NO: 9011049 - DNA, 22 bp, Homo sapiens
gctgttctaggagctgtgagca

SEQ ID NO: 9011050 - DNA, 22 bp, Homo sapiens
gctgttctccgatgaccccgtg

SEQ ID NO: 9011051 - DNA, 22 bp, Homo sapiens
gctgttctagcttcagtttcgc

SEQ ID NO: 9011052 - DNA, 22 bp, Homo sapiens
gctgttctctgtaacatgcatt

SEQ ID NO: 9011053 - DNA, 19 bp, Homo sapiens
gctgttctgaccatcaccc

SEQ ID NO: 9011054 - DNA, 20 bp, Homo sapiens
gctgttctgaagcagaaggc

SEQ ID NO: 9011055 - DNA, 22 bp, Homo sapiens
gctgttctgtccccatgggtaa

SEQ ID NO: 9011056 - DNA, 22 bp, Homo sapiens
gctgttctgcgtcccaggctgg

SEQ ID NO: 9011057 - DNA, 22 bp, Homo sapiens
gctgttctgcgtcccaggctgg

SEQ ID NO: 9011058 - DNA, 19 bp, Homo sapiens
gctgttctgaccatcaccc

SEQ ID NO: 9011059 - DNA, 22 bp, Homo sapiens
gctgttctgcaccagacttcag

SEQ ID NO: 9011060 - DNA, 22 bp, Homo sapiens
gctgttctgcgtcccaggctgg

SEQ ID NO: 9011061 - DNA, 22 bp, Homo sapiens
gctgttctgcaccagacttcag

SEQ ID NO: 9011062 - DNA, 22 bp, Homo sapiens
caagtttacaatgtgtatgtgt

SEQ ID NO: 9011063 - DNA, 22 bp, Homo sapiens
caagtttacaatgtgtatgtgt

SEQ ID NO: 9011064 - DNA, 22 bp, Homo sapiens
caagtttacaatgtgtatgtgt

SEQ ID NO: 9011065 - DNA, 22 bp, Homo sapiens
gctgttgcaatcaaggccatgg

SEQ ID NO: 9011066 - DNA, 22 bp, Homo sapiens
caagtttaaggcactgataagt

SEQ ID NO: 9011067 - DNA, 22 bp, Homo sapiens
caagtttaaggcactgataagt

SEQ ID NO: 9011068 - DNA, 21 bp, Homo sapiens
gctgttctttcagctggtctt

SEQ ID NO: 9011069 - DNA, 22 bp, Homo sapiens
gctgttctttcagcccagggct

SEQ ID NO: 9011070 - DNA, 22 bp, Homo sapiens
gctgttctttcagcccagggct

SEQ ID NO: 9011071 - DNA, 18 bp, Homo sapiens
gctgttcttcgcactggc

SEQ ID NO: 9011072 - DNA, 22 bp, Homo sapiens
gctgttctttgcatctctggtg

SEQ ID NO: 9011073 - DNA, 22 bp, Homo sapiens
gctgttctttgcatctctggtg

SEQ ID NO: 9011074 - DNA, 22 bp, Homo sapiens
gctgttctttggtcaaaggtat

SEQ ID NO: 9011075 - DNA, 22 bp, Homo sapiens
caagtactttgaaaagttgaat

SEQ ID NO: 9011076 - DNA, 22 bp, Homo sapiens
caagtactgtgatagctgaagt

SEQ ID NO: 9011077 - DNA, 22 bp, Homo sapiens
caagtacaatagctctggaact

SEQ ID NO: 9011078 - DNA, 22 bp, Homo sapiens
caagtactttgaaaagttgaat

SEQ ID NO: 9011079 - DNA, 22 bp, Homo sapiens
caagtactgtgatagctgaagt

SEQ ID NO: 9011080 - DNA, 22 bp, Homo sapiens
caagtacaatagctctggaact

SEQ ID NO: 9011081 - DNA, 22 bp, Homo sapiens
caagtacaatagctctggaact

SEQ ID NO: 9011082 - DNA, 22 bp, Homo sapiens
caagtacaatagctctggaact

SEQ ID NO: 9011083 - DNA, 22 bp, Homo sapiens
caagtacaagggtgtcagttta

SEQ ID NO: 9011084 - DNA, 18 bp, Homo sapiens
caagtatagaattaggtt

SEQ ID NO: 9011085 - DNA, 22 bp, Homo sapiens
caagtatatttgaacatgtaaa

SEQ ID NO: 9011086 - DNA, 22 bp, Homo sapiens
caagtatatttgaacatgtaaa

SEQ ID NO: 9011087 - DNA, 22 bp, Homo sapiens
caagtatatttgaacatgtaaa

SEQ ID NO: 9011088 - DNA, 22 bp, Homo sapiens
caagtatttcctgatggcctgt

SEQ ID NO: 9011089 - DNA, 22 bp, Homo sapiens
caagtatgagaaagctattacc

SEQ ID NO: 9011090 - DNA, 22 bp, Homo sapiens
caagtacaaaatgatatttagt

SEQ ID NO: 9011091 - DNA, 22 bp, Homo sapiens
caagtacaaaatgatatttagt

SEQ ID NO: 9011092 - DNA, 22 bp, Homo sapiens
caagtacaaaatgatatttagt

SEQ ID NO: 9011093 - DNA, 22 bp, Homo sapiens
caagtacaaaatgatatttagt

SEQ ID NO: 9011094 - DNA, 22 bp, Homo sapiens
caagtacaaaatgatatttagt

SEQ ID NO: 9011095 - DNA, 22 bp, Homo sapiens
caagtaacttgattaaggtaag

SEQ ID NO: 9011096 - DNA, 22 bp, Homo sapiens
caagtaaacaatatgtgattca

SEQ ID NO: 9011097 - DNA, 22 bp, Homo sapiens
caagtaaacaatatgtgattca

SEQ ID NO: 9011098 - DNA, 22 bp, Homo sapiens
caagtaaacaatatgtgattca

SEQ ID NO: 9011099 - DNA, 22 bp, Homo sapiens
caagtaaagaatcacatttctt

SEQ ID NO: 9011100 - DNA, 22 bp, Homo sapiens
caagtaaagaatcacatttctt

SEQ ID NO: 9011101 - DNA, 22 bp, Homo sapiens
caagtaaagaatcacatttctt

SEQ ID NO: 9011102 - DNA, 22 bp, Homo sapiens
caagtaaatgtgaactggaagg

SEQ ID NO: 9011103 - DNA, 22 bp, Homo sapiens
caagtaaagaatcacatttctt

SEQ ID NO: 9011104 - DNA, 22 bp, Homo sapiens
caagtaacttgattaaggtaag

SEQ ID NO: 9011105 - DNA, 22 bp, Homo sapiens
caagtaacttgattaaggtaag

SEQ ID NO: 9011106 - DNA, 22 bp, Homo sapiens
caaggtttacattgggctatca

SEQ ID NO: 9011107 - DNA, 22 bp, Homo sapiens
caaggtgccatgctgggcgggg

SEQ ID NO: 9011108 - DNA, 22 bp, Homo sapiens
caaggtgccatgctgggcgggg

SEQ ID NO: 9011109 - DNA, 22 bp, Homo sapiens
caaggtgccatgctgggcgggg

SEQ ID NO: 9011110 - DNA, 22 bp, Homo sapiens
caaggtgccatgctgggcgggg

SEQ ID NO: 9011111 - DNA, 22 bp, Homo sapiens
caaggtttgaaaacgccatggc

SEQ ID NO: 9011112 - DNA, 22 bp, Homo sapiens
caaggttttgcttgtaagggaa

SEQ ID NO: 9011113 - DNA, 22 bp, Homo sapiens
caaggttttggaagattttcgt

SEQ ID NO: 9011114 - DNA, 22 bp, Homo sapiens
caaggtttcgagttcccaacca

SEQ ID NO: 9011115 - DNA, 22 bp, Homo sapiens
caaggtttctatgctcaaagga

SEQ ID NO: 9011116 - DNA, 22 bp, Homo sapiens
caaggtttactttatgatccag

SEQ ID NO: 9011117 - DNA, 22 bp, Homo sapiens
caaggtgcagcgttgtcaagct

SEQ ID NO: 9011118 - DNA, 22 bp, Homo sapiens
caaggtgaacttgctgtacagc

SEQ ID NO: 9011119 - DNA, 22 bp, Homo sapiens
caaggtgcagctggctgtgtga

SEQ ID NO: 9011120 - DNA, 22 bp, Homo sapiens
caaggtgccatgctgggcgggg

SEQ ID NO: 9011121 - DNA, 22 bp, Homo sapiens
caaggtcacataacttgtcaaa

SEQ ID NO: 9011122 - DNA, 20 bp, Homo sapiens
caagggtttgcattggcttt

SEQ ID NO: 9011123 - DNA, 20 bp, Homo sapiens
caagggtttgcattggcttt

SEQ ID NO: 9011124 - DNA, 22 bp, Homo sapiens
caaggtcacataacttgtcaaa

SEQ ID NO: 9011125 - DNA, 22 bp, Homo sapiens
gctttctgtgcagtgaacacta

SEQ ID NO: 9011126 - DNA, 21 bp, Homo sapiens
gctttctgtggactctgcacc

SEQ ID NO: 9011127 - DNA, 22 bp, Homo sapiens
gctttctgtgcagtgaacacta

SEQ ID NO: 9011128 - DNA, 21 bp, Homo sapiens
gctttctgtggactctgcacc

SEQ ID NO: 9011129 - DNA, 21 bp, Homo sapiens
gctttctgtggactctgcacc

SEQ ID NO: 9011130 - DNA, 22 bp, Homo sapiens
gctttcttagtgtgttaattgg

SEQ ID NO: 9011131 - DNA, 22 bp, Homo sapiens
gctttctgtggtgatgtaaagg

SEQ ID NO: 9011132 - DNA, 22 bp, Homo sapiens
gctttctgtggtgatgtaaagg

SEQ ID NO: 9011133 - DNA, 18 bp, Homo sapiens
gctttctgtagaaaaggg

SEQ ID NO: 9011134 - DNA, 18 bp, Homo sapiens
gctttctgtagaaaaggg

SEQ ID NO: 9011135 - DNA, 18 bp, Homo sapiens
gctttctgtagaaaaggg

SEQ ID NO: 9011136 - DNA, 22 bp, Homo sapiens
gctttctggtttgtgctacagg

SEQ ID NO: 9011137 - DNA, 18 bp, Homo sapiens
gctttctgtagaaaaggg

SEQ ID NO: 9011138 - DNA, 18 bp, Homo sapiens
gctttctgtagaaaaggg

SEQ ID NO: 9011139 - DNA, 22 bp, Homo sapiens
gctttctgtaggtagttactgt

SEQ ID NO: 9011140 - DNA, 18 bp, Homo sapiens
gctttctgtgcagcggag

SEQ ID NO: 9011141 - DNA, 18 bp, Homo sapiens
gctttctgtgcagcggag

SEQ ID NO: 9011142 - DNA, 22 bp, Homo sapiens
gctttctgtaggtagttactgt

SEQ ID NO: 9011143 - DNA, 22 bp, Homo sapiens
gctttctgtaggtagttactgt

SEQ ID NO: 9011144 - DNA, 17 bp, Homo sapiens
gcttgggctgcctgttg

SEQ ID NO: 9011145 - DNA, 22 bp, Homo sapiens
caataactgctgaggagaagca

SEQ ID NO: 9011146 - DNA, 22 bp, Homo sapiens
gcttgggcttaactgtaggttc

SEQ ID NO: 9011147 - DNA, 22 bp, Homo sapiens
gcttggggagctcagtgtcctt

SEQ ID NO: 9011148 - DNA, 22 bp, Homo sapiens
gcttggggagctcagtgtcctt

SEQ ID NO: 9011149 - DNA, 22 bp, Homo sapiens
gcttggggagctcagtgtcctt

SEQ ID NO: 9011150 - DNA, 22 bp, Homo sapiens
gctttctgggctatagaacggg

SEQ ID NO: 9011151 - DNA, 22 bp, Homo sapiens
gctttctgggctatagaacggg

SEQ ID NO: 9011152 - DNA, 22 bp, Homo sapiens
gctttctggagcctgggggaac

SEQ ID NO: 9011153 - DNA, 22 bp, Homo sapiens
gctttctgctctgtaaaatggg

SEQ ID NO: 9011154 - DNA, 22 bp, Homo sapiens
gctttctgctctgtaaaatggg

SEQ ID NO: 9011155 - DNA, 22 bp, Homo sapiens
gctttctggttctcaaagcact

SEQ ID NO: 9011156 - DNA, 22 bp, Homo sapiens
gctttctggttctcaaagcact

SEQ ID NO: 9011157 - DNA, 22 bp, Homo sapiens
gctttctggttctcaaagcact

SEQ ID NO: 9011158 - DNA, 22 bp, Homo sapiens
gctttctgggctatagaacggg

SEQ ID NO: 9011159 - DNA, 22 bp, Homo sapiens
caataaagaagatttttgcaat

SEQ ID NO: 9011160 - DNA, 22 bp, Homo sapiens
caataaagaagatttttgcaat

SEQ ID NO: 9011161 - DNA, 22 bp, Homo sapiens
caataaagaagatttttgcaat

SEQ ID NO: 9011162 - DNA, 21 bp, Homo sapiens
caataaactgcacattgagac

SEQ ID NO: 9011163 - DNA, 22 bp, Homo sapiens
caataactagtaattattccgg

SEQ ID NO: 9011164 - DNA, 22 bp, Homo sapiens
caataaagtggaggcccgggct

SEQ ID NO: 9011165 - DNA, 22 bp, Homo sapiens
caagttttgcatagttctgtat

SEQ ID NO: 9011166 - DNA, 22 bp, Homo sapiens
caagttttgattttgcagtaaa

SEQ ID NO: 9011167 - DNA, 21 bp, Homo sapiens
caataaactgcacattgagac

SEQ ID NO: 9011168 - DNA, 21 bp, Homo sapiens
caataaactgcacattgagac

SEQ ID NO: 9011169 - DNA, 22 bp, Homo sapiens
caagttttgcatagttctgtat

SEQ ID NO: 9011170 - DNA, 22 bp, Homo sapiens
caagttttgcatagttctgtat

SEQ ID NO: 9011171 - DNA, 22 bp, Homo sapiens
caagtttggattatgaaaaagt

SEQ ID NO: 9011172 - DNA, 22 bp, Homo sapiens
caagtttgtgttctatcattct

SEQ ID NO: 9011173 - DNA, 22 bp, Homo sapiens
caagtttgctgatccttgtttt

SEQ ID NO: 9011174 - DNA, 22 bp, Homo sapiens
caagtttagtcatggtggtagt

SEQ ID NO: 9011175 - DNA, 22 bp, Homo sapiens
caagtttactactacctgtgtg

SEQ ID NO: 9011176 - DNA, 22 bp, Homo sapiens
caagtttgctgatccttgtttt

SEQ ID NO: 9011177 - DNA, 22 bp, Homo sapiens
caagttttctgggttcagagca

SEQ ID NO: 9011178 - DNA, 22 bp, Homo sapiens
caagttttctgggttcagagca

SEQ ID NO: 9011179 - DNA, 22 bp, Homo sapiens
caagttttgattttgcagtaaa

SEQ ID NO: 9011180 - DNA, 22 bp, Homo sapiens
caagttttagaaatatctggat

SEQ ID NO: 9011181 - DNA, 22 bp, Homo sapiens
gctttgattcttggcttatcag

SEQ ID NO: 9011182 - DNA, 21 bp, Homo sapiens
gctttgatgctgccttgctcc

SEQ ID NO: 9011183 - DNA, 22 bp, Homo sapiens
gctttgaagacttttccagggt

SEQ ID NO: 9011184 - DNA, 22 bp, Homo sapiens
gctttgaagtctgtgtcttttg

SEQ ID NO: 9011185 - DNA, 22 bp, Homo sapiens
gctttcttatttagaagatttg

SEQ ID NO: 9011186 - DNA, 18 bp, Homo sapiens
gctttgcagaaatacaga

SEQ ID NO: 9011187 - DNA, 18 bp, Homo sapiens
gctttgcagaaatacaga

SEQ ID NO: 9011188 - DNA, 18 bp, Homo sapiens
gctttgcactcatgttgt

SEQ ID NO: 9011189 - DNA, 22 bp, Homo sapiens
caatgtgtgtgtttttctcaac

SEQ ID NO: 9011190 - DNA, 22 bp, Homo sapiens
caatgtgtttgcatattaaaat

SEQ ID NO: 9011191 - DNA, 22 bp, Homo sapiens
caatgtcttctatagttactca

SEQ ID NO: 9011192 - DNA, 22 bp, Homo sapiens
caatgtggtggcagatgtcagt

SEQ ID NO: 9011193 - DNA, 21 bp, Homo sapiens
caatgtctgctctctgcctag

SEQ ID NO: 9011194 - DNA, 22 bp, Homo sapiens
caatgtttgagtaggagcataa

SEQ ID NO: 9011195 - DNA, 22 bp, Homo sapiens
caatgtttgagtaggagcataa

SEQ ID NO: 9011196 - DNA, 22 bp, Homo sapiens
caatgtttcttgtaaccagtga

SEQ ID NO: 9011197 - DNA, 22 bp, Homo sapiens
caatgtttgagtaggagcataa

SEQ ID NO: 9011198 - DNA, 22 bp, Homo sapiens
caatgtttactggggacccaga

SEQ ID NO: 9011199 - DNA, 22 bp, Homo sapiens
caatgttccctgtactgctttt

SEQ ID NO: 9011200 - DNA, 22 bp, Homo sapiens
caatgtcatgattttccattag

SEQ ID NO: 9011201 - DNA, 22 bp, Homo sapiens
caatgtcaaggagaccaaaacg

SEQ ID NO: 9011202 - DNA, 22 bp, Homo sapiens
caatgtcagtcaagcagcaaat

SEQ ID NO: 9011203 - DNA, 22 bp, Homo sapiens
caatgtcagagaagctcatatc

SEQ ID NO: 9011204 - DNA, 22 bp, Homo sapiens
caatgtctgaccgttttgccca

SEQ ID NO: 9011205 - DNA, 22 bp, Homo sapiens
caatgtcaaggagaccaaaacg

SEQ ID NO: 9011206 - DNA, 22 bp, Homo sapiens
caatgtatcaagaagcatcagt

SEQ ID NO: 9011207 - DNA, 22 bp, Homo sapiens
caatgtcaaggagaccaaaacg

SEQ ID NO: 9011208 - DNA, 22 bp, Homo sapiens
caatgtcaaggagaccaaaacg

SEQ ID NO: 9011209 - DNA, 22 bp, Homo sapiens
caatgtcagaattacagttgat

SEQ ID NO: 9011210 - DNA, 22 bp, Homo sapiens
caaggcctaatcatactgctaa

SEQ ID NO: 9011211 - DNA, 22 bp, Homo sapiens
caaggccatgagcagcgagtgt

SEQ ID NO: 9011212 - DNA, 22 bp, Homo sapiens
caaggccctgcaacctgacttg

SEQ ID NO: 9011213 - DNA, 22 bp, Homo sapiens
caaggccatgagcagcgagtgt

SEQ ID NO: 9011214 - DNA, 22 bp, Homo sapiens
caaggccatattgcctgtatgt

SEQ ID NO: 9011215 - DNA, 22 bp, Homo sapiens
caaggccatattgcctgtatgt

SEQ ID NO: 9011216 - DNA, 22 bp, Homo sapiens
caaggccataagagatacaaaa

SEQ ID NO: 9011217 - DNA, 22 bp, Homo sapiens
caaggcctgcctctggcagaaa

SEQ ID NO: 9011218 - DNA, 22 bp, Homo sapiens
caaggcctgcctctggcagaaa

SEQ ID NO: 9011219 - DNA, 22 bp, Homo sapiens
caaggcctcctgggcccagaga

SEQ ID NO: 9011220 - DNA, 22 bp, Homo sapiens
caaggcctaatcatactgctaa

SEQ ID NO: 9011221 - DNA, 22 bp, Homo sapiens
caaggcctatgcacacctagga

SEQ ID NO: 9011222 - DNA, 17 bp, Homo sapiens
caaggccagcatcttca

SEQ ID NO: 9011223 - DNA, 22 bp, Homo sapiens
caaggccagagccagcgataag

SEQ ID NO: 9011224 - DNA, 17 bp, Homo sapiens
caaggccagcatcttca

SEQ ID NO: 9011225 - DNA, 22 bp, Homo sapiens
caaggccactgctcaggtttcc

SEQ ID NO: 9011226 - DNA, 22 bp, Homo sapiens
caaggccagagccagcgataag

SEQ ID NO: 9011227 - DNA, 22 bp, Homo sapiens
caaggccactccagagactggt

SEQ ID NO: 9011228 - DNA, 22 bp, Homo sapiens
caaggccactgctcaggtttcc

SEQ ID NO: 9011229 - DNA, 22 bp, Homo sapiens
caaggccataagagatacaaaa

SEQ ID NO: 9011230 - DNA, 22 bp, Homo sapiens
caaggccataagagatacaaaa

SEQ ID NO: 9011231 - DNA, 22 bp, Homo sapiens
caaggccagtttctcctagtca

SEQ ID NO: 9011232 - DNA, 22 bp, Homo sapiens
caaggccagttcaccaagggca

SEQ ID NO: 9011233 - DNA, 22 bp, Homo sapiens
caaggccagttcaccaagggca

SEQ ID NO: 9011234 - DNA, 22 bp, Homo sapiens
caaggccagttcaccaagggca

SEQ ID NO: 9011235 - DNA, 22 bp, Homo sapiens
caaggccagttcaccaagggca

SEQ ID NO: 9011236 - DNA, 22 bp, Homo sapiens
caaggccagtccattttggaag

SEQ ID NO: 9011237 - DNA, 22 bp, Homo sapiens
caaggccagggaatttttctgg

SEQ ID NO: 9011238 - DNA, 22 bp, Homo sapiens
gctggaggcagttcagacacca

SEQ ID NO: 9011239 - DNA, 22 bp, Homo sapiens
gctggaggcagttcagacacca

SEQ ID NO: 9011240 - DNA, 22 bp, Homo sapiens
caaggcagcttaatagaatttg

SEQ ID NO: 9011241 - DNA, 22 bp, Homo sapiens
caaggcaggaagcctgtcttat

SEQ ID NO: 9011242 - DNA, 22 bp, Homo sapiens
gctggaggctggagtgcagtgg

SEQ ID NO: 9011243 - DNA, 22 bp, Homo sapiens
caaggccactccagagactggt

SEQ ID NO: 9011244 - DNA, 19 bp, Homo sapiens
caaggccaccatttctccg

SEQ ID NO: 9011245 - DNA, 22 bp, Homo sapiens
caaggccacgttctgcatgcgg

SEQ ID NO: 9011246 - DNA, 22 bp, Homo sapiens
caaggccactccagagactggt

SEQ ID NO: 9011247 - DNA, 22 bp, Homo sapiens
caaggccacgttctgcatgcgg

SEQ ID NO: 9011248 - DNA, 22 bp, Homo sapiens
caaggccaagtctctgtgaaga

SEQ ID NO: 9011249 - DNA, 22 bp, Homo sapiens
caaggccaaggttttgtgaact

SEQ ID NO: 9011250 - DNA, 22 bp, Homo sapiens
caaggccaagtctctgtgaaga

SEQ ID NO: 9011251 - DNA, 22 bp, Homo sapiens
caaggccaagtctctgtgaaga

SEQ ID NO: 9011252 - DNA, 22 bp, Homo sapiens
caaggccaaagggccactgtca

SEQ ID NO: 9011253 - DNA, 22 bp, Homo sapiens
caaggcaggaagcctgtcttat

SEQ ID NO: 9011254 - DNA, 22 bp, Homo sapiens
caagggaagaggacagggacct

SEQ ID NO: 9011255 - DNA, 22 bp, Homo sapiens
caagggtgaaggctcctccagg

SEQ ID NO: 9011256 - DNA, 22 bp, Homo sapiens
caagggtggtattgggagcata

SEQ ID NO: 9011257 - DNA, 22 bp, Homo sapiens
caagggttctgtgcctcctgct

SEQ ID NO: 9011258 - DNA, 19 bp, Homo sapiens
caagggttgggtctgtcat

SEQ ID NO: 9011259 - DNA, 22 bp, Homo sapiens
caagggaagaggacagggacct

SEQ ID NO: 9011260 - DNA, 22 bp, Homo sapiens
caaggcttggagagaatgccat

SEQ ID NO: 9011261 - DNA, 22 bp, Homo sapiens
caaggcttggagagaatgccat

SEQ ID NO: 9011262 - DNA, 22 bp, Homo sapiens
caaggcttatcagccaggagcc

SEQ ID NO: 9011263 - DNA, 21 bp, Homo sapiens
gctggctgtcccagggaagca

SEQ ID NO: 9011264 - DNA, 22 bp, Homo sapiens
caaggcttcagtgtgacaaaac

SEQ ID NO: 9011265 - DNA, 21 bp, Homo sapiens
gctggctgtcccagggaagca

SEQ ID NO: 9011266 - DNA, 22 bp, Homo sapiens
gctggctgtatcacctggccag

SEQ ID NO: 9011267 - DNA, 22 bp, Homo sapiens
gctggctgtatcacctggccag

SEQ ID NO: 9011268 - DNA, 22 bp, Homo sapiens
gctggctgtatcacctggccag

SEQ ID NO: 9011269 - DNA, 22 bp, Homo sapiens
gctggctgtatcacctggccag

SEQ ID NO: 9011270 - DNA, 21 bp, Homo sapiens
gctggctgtcccagggaagca

SEQ ID NO: 9011271 - DNA, 22 bp, Homo sapiens
gctggctggtccagcaggggct

SEQ ID NO: 9011272 - DNA, 22 bp, Homo sapiens
gctggctggtccagcaggggct

SEQ ID NO: 9011273 - DNA, 22 bp, Homo sapiens
gctggctgggtccctgagaggc

SEQ ID NO: 9011274 - DNA, 22 bp, Homo sapiens
gctggctgggtccctgagaggc

SEQ ID NO: 9011275 - DNA, 22 bp, Homo sapiens
gctggctgggtccctgagaggc

SEQ ID NO: 9011276 - DNA, 22 bp, Homo sapiens
gctggctgggtccctgagaggc

SEQ ID NO: 9011277 - DNA, 22 bp, Homo sapiens
gctggctgggtccctgagaggc

SEQ ID NO: 9011278 - DNA, 22 bp, Homo sapiens
gctggctgtatcacctggccag

SEQ ID NO: 9011279 - DNA, 22 bp, Homo sapiens
gctggctggtccagcaggggct

SEQ ID NO: 9011280 - DNA, 22 bp, Homo sapiens
gctggctgtatcacctggccag

SEQ ID NO: 9011281 - DNA, 22 bp, Homo sapiens
gctggctggtccagcaggggct

SEQ ID NO: 9011282 - DNA, 22 bp, Homo sapiens
gctggctgggacagattccatt

SEQ ID NO: 9011283 - DNA, 22 bp, Homo sapiens
gctggctggctgtgcaaaggca

SEQ ID NO: 9011284 - DNA, 22 bp, Homo sapiens
gctggctgggtccctgagaggc

SEQ ID NO: 9011285 - DNA, 22 bp, Homo sapiens
gctggctgggtccctgagaggc

SEQ ID NO: 9011286 - DNA, 22 bp, Homo sapiens
gctggctgggtccctgagaggc

SEQ ID NO: 9011287 - DNA, 22 bp, Homo sapiens
caaggccttcgtctcctagctt

SEQ ID NO: 9011288 - DNA, 22 bp, Homo sapiens
caaggccttcgtctcctagctt

SEQ ID NO: 9011289 - DNA, 22 bp, Homo sapiens
gctggctggctgtgcaaaggca

SEQ ID NO: 9011290 - DNA, 22 bp, Homo sapiens
gctggctggctgtgcaaaggca

SEQ ID NO: 9011291 - DNA, 22 bp, Homo sapiens
gctggctggctgtgcaaaggca

SEQ ID NO: 9011292 - DNA, 22 bp, Homo sapiens
gctggctggctgtgcaaaggca

SEQ ID NO: 9011293 - DNA, 22 bp, Homo sapiens
caagattatcttcttcttgtta

SEQ ID NO: 9011294 - DNA, 22 bp, Homo sapiens
caaatgtgtaaggaagtgttag

SEQ ID NO: 9011295 - DNA, 22 bp, Homo sapiens
caaatgtggtttctcagcattc

SEQ ID NO: 9011296 - DNA, 22 bp, Homo sapiens
caaatgtggtttctcagcattc

SEQ ID NO: 9011297 - DNA, 22 bp, Homo sapiens
caaatgtgtaaggaagtgttag

SEQ ID NO: 9011298 - DNA, 22 bp, Homo sapiens
caaatgtattctcacttcaggg

SEQ ID NO: 9011299 - DNA, 22 bp, Homo sapiens
caaatgtattctcacttcaggg

SEQ ID NO: 9011300 - DNA, 22 bp, Homo sapiens
caaatgtgacttttgggcttct

SEQ ID NO: 9011301 - DNA, 22 bp, Homo sapiens
caaatgtattctcacttcaggg

SEQ ID NO: 9011302 - DNA, 22 bp, Homo sapiens
caaatgtattctcacttcaggg

SEQ ID NO: 9011303 - DNA, 22 bp, Homo sapiens
caaatgtattctcacttcaggg

SEQ ID NO: 9011304 - DNA, 22 bp, Homo sapiens
caagcaggaggagaagtttctg

SEQ ID NO: 9011305 - DNA, 22 bp, Homo sapiens
caagcaggatgaagcccaggga

SEQ ID NO: 9011306 - DNA, 22 bp, Homo sapiens
caagcagggatactgcagggag

SEQ ID NO: 9011307 - DNA, 22 bp, Homo sapiens
caagattcagccctcctgacct

SEQ ID NO: 9011308 - DNA, 22 bp, Homo sapiens
caagattatcttcttcttgtta

SEQ ID NO: 9011309 - DNA, 22 bp, Homo sapiens
caagatttaagagtcagccttg

SEQ ID NO: 9011310 - DNA, 22 bp, Homo sapiens
caagatttaagagtcagccttg

SEQ ID NO: 9011311 - DNA, 22 bp, Homo sapiens
caagcagatattttagtcaaga

SEQ ID NO: 9011312 - DNA, 22 bp, Homo sapiens
caagcagccccaacatgaggat

SEQ ID NO: 9011313 - DNA, 22 bp, Homo sapiens
caagcagccccaacatgaggat

SEQ ID NO: 9011314 - DNA, 22 bp, Homo sapiens
caaatgtatgttttcctatgta

SEQ ID NO: 9011315 - DNA, 22 bp, Homo sapiens
caaatgtatgttttcctatgta

SEQ ID NO: 9011316 - DNA, 22 bp, Homo sapiens
caaatgtatcagcccagggatt

SEQ ID NO: 9011317 - DNA, 22 bp, Homo sapiens
caaatgtatcagcccagggatt

SEQ ID NO: 9011318 - DNA, 22 bp, Homo sapiens
caaatgtataaatgtactttct

SEQ ID NO: 9011319 - DNA, 22 bp, Homo sapiens
caaatgtataaatgtactttct

SEQ ID NO: 9011320 - DNA, 22 bp, Homo sapiens
caaatgtataaatgtactttct

SEQ ID NO: 9011321 - DNA, 22 bp, Homo sapiens
caaatgtataaatgtactttct

SEQ ID NO: 9011322 - DNA, 22 bp, Homo sapiens
caaatgtaattgcggtttttgc

SEQ ID NO: 9011323 - DNA, 22 bp, Homo sapiens
caaatgtaattgcggtttttgc

SEQ ID NO: 9011324 - DNA, 22 bp, Homo sapiens
caaatgtaattgcggtttttgc

SEQ ID NO: 9011325 - DNA, 22 bp, Homo sapiens
caaatgtaatggcaggttttgc

SEQ ID NO: 9011326 - DNA, 22 bp, Homo sapiens
caaatgtataaatgtactttct

SEQ ID NO: 9011327 - DNA, 22 bp, Homo sapiens
caaatgtataaatgtactttct

SEQ ID NO: 9011328 - DNA, 23 bp, Homo sapiens
caaatgtagtgtgtccacccctg

SEQ ID NO: 9011329 - DNA, 22 bp, Homo sapiens
caaatgtaataaggagtttccc

SEQ ID NO: 9011330 - DNA, 22 bp, Homo sapiens
caaatgtaaattcttttgaagc

SEQ ID NO: 9011331 - DNA, 22 bp, Homo sapiens
caaatgtaaattcttttgaagc

SEQ ID NO: 9011332 - DNA, 22 bp, Homo sapiens
caaatgtaatggcaggttttgc

SEQ ID NO: 9011333 - DNA, 22 bp, Homo sapiens
caaatgtaatggcaggttttgc

SEQ ID NO: 9011334 - DNA, 22 bp, Homo sapiens
caaatgtaaattcttttgaagc

SEQ ID NO: 9011335 - DNA, 22 bp, Homo sapiens
caaatggtcatttctcttttgt

SEQ ID NO: 9011336 - DNA, 19 bp, Homo sapiens
caaatgggacaggaaggca

SEQ ID NO: 9011337 - DNA, 20 bp, Homo sapiens
caaatggcttttatttcctt

SEQ ID NO: 9011338 - DNA, 19 bp, Homo sapiens
caaatgggacaggaaggca

SEQ ID NO: 9011339 - DNA, 22 bp, Homo sapiens
caaatggctggcatccttctac

SEQ ID NO: 9011340 - DNA, 22 bp, Homo sapiens
caaatggctggcatccttctac

SEQ ID NO: 9011341 - DNA, 20 bp, Homo sapiens
caaatggcttttatttcctt

SEQ ID NO: 9011342 - DNA, 22 bp, Homo sapiens
gctggaggatggactggaagaa

SEQ ID NO: 9011343 - DNA, 22 bp, Homo sapiens
gctggaggatggactggaagaa

SEQ ID NO: 9011344 - DNA, 22 bp, Homo sapiens
gctggaggatggactggaagaa

SEQ ID NO: 9011345 - DNA, 22 bp, Homo sapiens
gctggaggatcacttgagccca

SEQ ID NO: 9011346 - DNA, 22 bp, Homo sapiens
gctggaggatcacttgagccca

SEQ ID NO: 9011347 - DNA, 22 bp, Homo sapiens
gctggaggatggactggaagaa

SEQ ID NO: 9011348 - DNA, 22 bp, Homo sapiens
gctggaggatggactggaagaa

SEQ ID NO: 9011349 - DNA, 22 bp, Homo sapiens
gctggaggatggactggaagaa

SEQ ID NO: 9011350 - DNA, 22 bp, Homo sapiens
gctggaggatggactggaagaa

SEQ ID NO: 9011351 - DNA, 22 bp, Homo sapiens
gctggaggaggaagtgtgaggg

SEQ ID NO: 9011352 - DNA, 22 bp, Homo sapiens
gctggaggaggaagtgtgaggg

SEQ ID NO: 9011353 - DNA, 22 bp, Homo sapiens
gctggaggaggaagtgtgaggg

SEQ ID NO: 9011354 - DNA, 22 bp, Homo sapiens
gctggaggatcacttgagccca

SEQ ID NO: 9011355 - DNA, 22 bp, Homo sapiens
caagccagtgatgtttgctgcc

SEQ ID NO: 9011356 - DNA, 22 bp, Homo sapiens
caagccagtttgtagttctctc

SEQ ID NO: 9011357 - DNA, 22 bp, Homo sapiens
gctggagcttgagaggacaggg

SEQ ID NO: 9011358 - DNA, 22 bp, Homo sapiens
gctggaggaggaagtgtgaggg

SEQ ID NO: 9011359 - DNA, 22 bp, Homo sapiens
caagccagtgatgtttgctgcc

SEQ ID NO: 9011360 - DNA, 22 bp, Homo sapiens
caagccagtgacagccagggaa

SEQ ID NO: 9011361 - DNA, 22 bp, Homo sapiens
caagccagtgacagccagggaa

SEQ ID NO: 9011362 - DNA, 22 bp, Homo sapiens
caagccagtgacagccagggaa

SEQ ID NO: 9011363 - DNA, 22 bp, Homo sapiens
caagcagggatactgcagggag

SEQ ID NO: 9011364 - DNA, 22 bp, Homo sapiens
caagcagggagcatcaagggag

SEQ ID NO: 9011365 - DNA, 22 bp, Homo sapiens
caagcaggtttgctattttctt

SEQ ID NO: 9011366 - DNA, 21 bp, Homo sapiens
caagccagaccaatagcagcc

SEQ ID NO: 9011367 - DNA, 22 bp, Homo sapiens
caagcatactgtgagagtttta

SEQ ID NO: 9011368 - DNA, 22 bp, Homo sapiens
caagcatactgtgagagtttta

SEQ ID NO: 9011369 - DNA, 22 bp, Homo sapiens
caagcatactgtgagagtttta

SEQ ID NO: 9011370 - DNA, 22 bp, Homo sapiens
caagccaggtgaacataacaag

SEQ ID NO: 9011371 - DNA, 22 bp, Homo sapiens
caagccaggtgaacataacaag

SEQ ID NO: 9011372 - DNA, 22 bp, Homo sapiens
caagccaggtgaacataacaag

SEQ ID NO: 9011373 - DNA, 20 bp, Homo sapiens
caagccaggccctgctgctg

SEQ ID NO: 9011374 - DNA, 22 bp, Homo sapiens
caagccaggaaggatccagcac

SEQ ID NO: 9011375 - DNA, 22 bp, Homo sapiens
caagccagtcagctcagtagat

SEQ ID NO: 9011376 - DNA, 22 bp, Homo sapiens
caagccagtgacagccagggaa

SEQ ID NO: 9011377 - DNA, 22 bp, Homo sapiens
caagccagtcagctcagtagat

SEQ ID NO: 9011378 - DNA, 22 bp, Homo sapiens
caagccagcagtttaatgactc

SEQ ID NO: 9011379 - DNA, 22 bp, Homo sapiens
caagccagagagcaactgttct

SEQ ID NO: 9011380 - DNA, 22 bp, Homo sapiens
caagccagctcctgccacagag

SEQ ID NO: 9011381 - DNA, 22 bp, Homo sapiens
caagccagctcctgccacagag

SEQ ID NO: 9011382 - DNA, 22 bp, Homo sapiens
ggagctgctttgatctgaagaa

SEQ ID NO: 9011383 - DNA, 22 bp, Homo sapiens
ggagctgcttcttgctgtgggt

SEQ ID NO: 9011384 - DNA, 22 bp, Homo sapiens
ggagctgctttgatctgaagaa

SEQ ID NO: 9011385 - DNA, 23 bp, Homo sapiens
ggagctggacccttacacctttc

SEQ ID NO: 9011386 - DNA, 22 bp, Homo sapiens
ggagctggagagctagcctagg

SEQ ID NO: 9011387 - DNA, 22 bp, Homo sapiens
ggagctggcagcgcaacccaga

SEQ ID NO: 9011388 - DNA, 22 bp, Homo sapiens
ggagctggagagtacagagttt

SEQ ID NO: 9011389 - DNA, 22 bp, Homo sapiens
ggagctggagagtacagagttt

SEQ ID NO: 9011390 - DNA, 22 bp, Homo sapiens
ggagctggagagtacagagttt

SEQ ID NO: 9011391 - DNA, 22 bp, Homo sapiens
ggagctggcagcgcaacccaga

SEQ ID NO: 9011392 - DNA, 20 bp, Homo sapiens
ggagctggcatccagcctct

SEQ ID NO: 9011393 - DNA, 22 bp, Homo sapiens
ggagctggcagcgcaacccaga

SEQ ID NO: 9011394 - DNA, 22 bp, Homo sapiens
ggagctggcagcgcaacccaga

SEQ ID NO: 9011395 - DNA, 20 bp, Homo sapiens
ggagctggcatccagcctct

SEQ ID NO: 9011396 - DNA, 23 bp, Homo sapiens
ggagctgctgttgggggagctgc

SEQ ID NO: 9011397 - DNA, 23 bp, Homo sapiens
ggagctgctgttgggggagctgc

SEQ ID NO: 9011398 - DNA, 23 bp, Homo sapiens
ggagctgctgttgggggagctgc

SEQ ID NO: 9011399 - DNA, 22 bp, Homo sapiens
ggagctgctcagagccagtccc

SEQ ID NO: 9011400 - DNA, 22 bp, Homo sapiens
ggagctgctccttcagccaagt

SEQ ID NO: 9011401 - DNA, 22 bp, Homo sapiens
ggagctgctccttcagccaagt

SEQ ID NO: 9011402 - DNA, 22 bp, Homo sapiens
ggagcctgcgggagctcccatt

SEQ ID NO: 9011403 - DNA, 22 bp, Homo sapiens
ggagcctgcgggagctcccatt

SEQ ID NO: 9011404 - DNA, 19 bp, Homo sapiens
ggagcctggagcacgtgcc

SEQ ID NO: 9011405 - DNA, 19 bp, Homo sapiens
ggagcctggagcacgtgcc

SEQ ID NO: 9011406 - DNA, 22 bp, Homo sapiens
ggagcctgcgggagctcccatt

SEQ ID NO: 9011407 - DNA, 22 bp, Homo sapiens
ggagcctgcgggagctcccatt

SEQ ID NO: 9011408 - DNA, 22 bp, Homo sapiens
ggagcctgagcggcccagggcc

SEQ ID NO: 9011409 - DNA, 22 bp, Homo sapiens
ggagcctgacagtgcccagcat

SEQ ID NO: 9011410 - DNA, 22 bp, Homo sapiens
ggagcctgacagtgcccagcat

SEQ ID NO: 9011411 - DNA, 22 bp, Homo sapiens
ggagcctgacagtgcccagcat

SEQ ID NO: 9011412 - DNA, 22 bp, Homo sapiens
ggagcctgacagtgcccagcat

SEQ ID NO: 9011413 - DNA, 22 bp, Homo sapiens
ggagcctgaaaagtctgcattt

SEQ ID NO: 9011414 - DNA, 22 bp, Homo sapiens
cacagattatgagacgagatac

SEQ ID NO: 9011415 - DNA, 22 bp, Homo sapiens
cacagattatgagacgagatac

SEQ ID NO: 9011416 - DNA, 22 bp, Homo sapiens
cacagatttcctaagcatcaat

SEQ ID NO: 9011417 - DNA, 22 bp, Homo sapiens
cacagatttctggtcttcaccc

SEQ ID NO: 9011418 - DNA, 22 bp, Homo sapiens
cacagattatgagacgagatac

SEQ ID NO: 9011419 - DNA, 22 bp, Homo sapiens
cacagatttcctaagcatcaat

SEQ ID NO: 9011420 - DNA, 22 bp, Homo sapiens
cacagatttcctaagcatcaat

SEQ ID NO: 9011421 - DNA, 22 bp, Homo sapiens
cacagatttctggtcttcaccc

SEQ ID NO: 9011422 - DNA, 22 bp, Homo sapiens
cacagatttctggtcttcaccc

SEQ ID NO: 9011423 - DNA, 22 bp, Homo sapiens
ggagcaggcagggccgtgtctg

SEQ ID NO: 9011424 - DNA, 22 bp, Homo sapiens
ggagccctccatcccttgcggc

SEQ ID NO: 9011425 - DNA, 22 bp, Homo sapiens
ggagcaggcagggccgtgtctg

SEQ ID NO: 9011426 - DNA, 22 bp, Homo sapiens
ggagcaggcagggccgtgtctg

SEQ ID NO: 9011427 - DNA, 22 bp, Homo sapiens
ggagcaggcagggccgtgtctg

SEQ ID NO: 9011428 - DNA, 22 bp, Homo sapiens
ggagccctgccctaggcagctc

SEQ ID NO: 9011429 - DNA, 22 bp, Homo sapiens
ggagccctgccctaggcagctc

SEQ ID NO: 9011430 - DNA, 23 bp, Homo sapiens
ggagccctgagctgtccccatgc

SEQ ID NO: 9011431 - DNA, 22 bp, Homo sapiens
ggagccctgccctaggcagctc

SEQ ID NO: 9011432 - DNA, 22 bp, Homo sapiens
ggagccctgaagcaagaaagta

SEQ ID NO: 9011433 - DNA, 22 bp, Homo sapiens
ggagccctccatcccttgcggc

SEQ ID NO: 9011434 - DNA, 19 bp, Homo sapiens
ggagccgccgcccttcatt

SEQ ID NO: 9011435 - DNA, 19 bp, Homo sapiens
ggagccgccgcccttcatt

SEQ ID NO: 9011436 - DNA, 19 bp, Homo sapiens
ggagccgccgcccttcatt

SEQ ID NO: 9011437 - DNA, 19 bp, Homo sapiens
ggagccgccgcccttcatt

SEQ ID NO: 9011438 - DNA, 22 bp, Homo sapiens
ggagccggagggccactggcag

SEQ ID NO: 9011439 - DNA, 22 bp, Homo sapiens
ggagcccttggcacctagtagg

SEQ ID NO: 9011440 - DNA, 22 bp, Homo sapiens
ggagcccttggcacctagtagg

SEQ ID NO: 9011441 - DNA, 22 bp, Homo sapiens
ggagcccttgctgaccttccaa

SEQ ID NO: 9011442 - DNA, 22 bp, Homo sapiens
ggagcccttgctgaccttccaa

SEQ ID NO: 9011443 - DNA, 22 bp, Homo sapiens
ggagcccttctattccatggag

SEQ ID NO: 9011444 - DNA, 22 bp, Homo sapiens
ggagcccttctattccatggag

SEQ ID NO: 9011445 - DNA, 22 bp, Homo sapiens
ggagccctgccctaggcagctc

SEQ ID NO: 9011446 - DNA, 22 bp, Homo sapiens
ggagccctgctgacatgggtgt

SEQ ID NO: 9011447 - DNA, 20 bp, Homo sapiens
cacagatgggacaggaaagg

SEQ ID NO: 9011448 - DNA, 19 bp, Homo sapiens
cacagatgattgacacata

SEQ ID NO: 9011449 - DNA, 19 bp, Homo sapiens
cacagatgattgacacata

SEQ ID NO: 9011450 - DNA, 19 bp, Homo sapiens
cacagatgattgacacata

SEQ ID NO: 9011451 - DNA, 22 bp, Homo sapiens
cacagataaggatgttaatttt

SEQ ID NO: 9011452 - DNA, 22 bp, Homo sapiens
cacagataaggatgttaatttt

SEQ ID NO: 9011453 - DNA, 22 bp, Homo sapiens
cacagagttgaatattgacatt

SEQ ID NO: 9011454 - DNA, 22 bp, Homo sapiens
cacagaggtgatagtggtcaag

SEQ ID NO: 9011455 - DNA, 22 bp, Homo sapiens
cacagaggtgatagtggtcaag

SEQ ID NO: 9011456 - DNA, 22 bp, Homo sapiens
cacagaggtgatagtggtcaag

SEQ ID NO: 9011457 - DNA, 22 bp, Homo sapiens
cacagagtggaggcttggcctg

SEQ ID NO: 9011458 - DNA, 20 bp, Homo sapiens
cacagagtcttgcagcgttc

SEQ ID NO: 9011459 - DNA, 22 bp, Homo sapiens
cacagaggtgatagtggtcaag

SEQ ID NO: 9011460 - DNA, 22 bp, Homo sapiens
cacagaggctcaaagccaggtg

SEQ ID NO: 9011461 - DNA, 22 bp, Homo sapiens
cacagaggtctgggcccagcag

SEQ ID NO: 9011462 - DNA, 22 bp, Homo sapiens
cacagaggtgatagtggtcaag

SEQ ID NO: 9011463 - DNA, 22 bp, Homo sapiens
cacaggaataagtcaaacttca

SEQ ID NO: 9011464 - DNA, 22 bp, Homo sapiens
cacaggaataagtcaaacttca

SEQ ID NO: 9011465 - DNA, 22 bp, Homo sapiens
cacaggaataagtcaaacttca

SEQ ID NO: 9011466 - DNA, 22 bp, Homo sapiens
cacaggaagtggtcagtgccag

SEQ ID NO: 9011467 - DNA, 22 bp, Homo sapiens
cacaggaatataagtttgagtt

SEQ ID NO: 9011468 - DNA, 22 bp, Homo sapiens
cacaggaatataagtttgagtt

SEQ ID NO: 9011469 - DNA, 22 bp, Homo sapiens
cacaggaatataagtttgagtt

SEQ ID NO: 9011470 - DNA, 22 bp, Homo sapiens
cacaggaatcgtcacttagcgc

SEQ ID NO: 9011471 - DNA, 22 bp, Homo sapiens
cacaggaatcgtcacttagcgc

SEQ ID NO: 9011472 - DNA, 22 bp, Homo sapiens
cacaggaatcagcattaatggc

SEQ ID NO: 9011473 - DNA, 22 bp, Homo sapiens
cacaggaatcagcattaatggc

SEQ ID NO: 9011474 - DNA, 22 bp, Homo sapiens
cacaggaatcagcattaatggc

SEQ ID NO: 9011475 - DNA, 22 bp, Homo sapiens
cacaggaatcagcattaatggc

SEQ ID NO: 9011476 - DNA, 22 bp, Homo sapiens
cacaggaaggccttctcacaat

SEQ ID NO: 9011477 - DNA, 18 bp, Homo sapiens
cacaggaaggggaatatc

SEQ ID NO: 9011478 - DNA, 18 bp, Homo sapiens
cacaggaaggggaatatc

SEQ ID NO: 9011479 - DNA, 22 bp, Homo sapiens
cacaggaagtggtcagtgccag

SEQ ID NO: 9011480 - DNA, 22 bp, Homo sapiens
cacaggaagtggtcagtgccag

SEQ ID NO: 9011481 - DNA, 22 bp, Homo sapiens
cacaggaagtggtcagtgccag

SEQ ID NO: 9011482 - DNA, 20 bp, Homo sapiens
ggagctggcatccagcctct

SEQ ID NO: 9011483 - DNA, 20 bp, Homo sapiens
ggagctggcatccagcctct

SEQ ID NO: 9011484 - DNA, 22 bp, Homo sapiens
cacagcttgtttagtgactcac

SEQ ID NO: 9011485 - DNA, 22 bp, Homo sapiens
cacagcttgtttagtgactcac

SEQ ID NO: 9011486 - DNA, 22 bp, Homo sapiens
cacagcttgtttagtgactcac

SEQ ID NO: 9011487 - DNA, 22 bp, Homo sapiens
cacaggaaggccttctcacaat

SEQ ID NO: 9011488 - DNA, 22 bp, Homo sapiens
cacaggaaggccttctcacaat

SEQ ID NO: 9011489 - DNA, 22 bp, Homo sapiens
cacagctttgctttccttaata

SEQ ID NO: 9011490 - DNA, 22 bp, Homo sapiens
cacagctttgctttccttaata

SEQ ID NO: 9011491 - DNA, 22 bp, Homo sapiens
cacaggaccaattcacattcca

SEQ ID NO: 9011492 - DNA, 22 bp, Homo sapiens
cacaggactcgactgcagacag

SEQ ID NO: 9011493 - DNA, 22 bp, Homo sapiens
cacaggactcgactgcagacag

SEQ ID NO: 9011494 - DNA, 22 bp, Homo sapiens
cacaggaattagcagcctaaaa

SEQ ID NO: 9011495 - DNA, 22 bp, Homo sapiens
cacaggaattagcagcctaaaa

SEQ ID NO: 9011496 - DNA, 22 bp, Homo sapiens
cacaggaattagcagcctaaaa

SEQ ID NO: 9011497 - DNA, 22 bp, Homo sapiens
cacaggaccaattcacattcca

SEQ ID NO: 9011498 - DNA, 22 bp, Homo sapiens
cacaggaccaattcacattcca

SEQ ID NO: 9011499 - DNA, 22 bp, Homo sapiens
cacaggaatctgcattttgacc

SEQ ID NO: 9011500 - DNA, 22 bp, Homo sapiens
cacaggaatctgcattttgacc

SEQ ID NO: 9011501 - DNA, 22 bp, Homo sapiens
cacaggaatgaacagggaaaga

SEQ ID NO: 9011502 - DNA, 22 bp, Homo sapiens
cacaggaatgaacagggaaaga

SEQ ID NO: 9011503 - DNA, 22 bp, Homo sapiens
cacaggaatgaacagggaaaga

SEQ ID NO: 9011504 - DNA, 22 bp, Homo sapiens
cacaggaatgaacagggaaaga

SEQ ID NO: 9011505 - DNA, 22 bp, Homo sapiens
cacaggagaaaggggaagctcg

SEQ ID NO: 9011506 - DNA, 22 bp, Homo sapiens
ggaggcagaatagagtgtgggt

SEQ ID NO: 9011507 - DNA, 22 bp, Homo sapiens
ggaggcagaatagagtgtgggt

SEQ ID NO: 9011508 - DNA, 22 bp, Homo sapiens
ggaggcagaatagagtgtgggt

SEQ ID NO: 9011509 - DNA, 22 bp, Homo sapiens
ggaggcaggaaagacaggttca

SEQ ID NO: 9011510 - DNA, 22 bp, Homo sapiens
ggaggcagaatagagtgtgggt

SEQ ID NO: 9011511 - DNA, 22 bp, Homo sapiens
ggaggcagaatagagtgtgggt

SEQ ID NO: 9011512 - DNA, 22 bp, Homo sapiens
ggaggccaaggaggagcttgcc

SEQ ID NO: 9011513 - DNA, 22 bp, Homo sapiens
ggaggccaaggaggagcttgcc

SEQ ID NO: 9011514 - DNA, 22 bp, Homo sapiens
ggaggccaaggaggagcttgcc

SEQ ID NO: 9011515 - DNA, 22 bp, Homo sapiens
ggaggccaaggagggcggatca

SEQ ID NO: 9011516 - DNA, 22 bp, Homo sapiens
ggaggccaaggaggagcttgcc

SEQ ID NO: 9011517 - DNA, 20 bp, Homo sapiens
cacaggctatatgagagcca

SEQ ID NO: 9011518 - DNA, 20 bp, Homo sapiens
cacaggccttgtgagcagac

SEQ ID NO: 9011519 - DNA, 20 bp, Homo sapiens
cacaggccttgtgagcagac

SEQ ID NO: 9011520 - DNA, 22 bp, Homo sapiens
ggaggccaaggcaggcggatca

SEQ ID NO: 9011521 - DNA, 22 bp, Homo sapiens
ggaggcaggaaagacaggttca

SEQ ID NO: 9011522 - DNA, 22 bp, Homo sapiens
ggaggcaggaaagacaggttca

SEQ ID NO: 9011523 - DNA, 22 bp, Homo sapiens
ggaggcatctctgtggctgtct

SEQ ID NO: 9011524 - DNA, 22 bp, Homo sapiens
ggaggccaaagtgtgggcggct

SEQ ID NO: 9011525 - DNA, 22 bp, Homo sapiens
ggaggcattatggggaagactt

SEQ ID NO: 9011526 - DNA, 22 bp, Homo sapiens
ggaggccaaggaggagcttgcc

SEQ ID NO: 9011527 - DNA, 22 bp, Homo sapiens
ggaggccaaggaggagcttgcc

SEQ ID NO: 9011528 - DNA, 22 bp, Homo sapiens
ggaggccaaagtgtgggcggct

SEQ ID NO: 9011529 - DNA, 21 bp, Homo sapiens
cacaggcttctatacacaatg

SEQ ID NO: 9011530 - DNA, 21 bp, Homo sapiens
cacaggcttctatacacaatg

SEQ ID NO: 9011531 - DNA, 21 bp, Homo sapiens
cacaggcttctatacacaatg

SEQ ID NO: 9011532 - DNA, 22 bp, Homo sapiens
cacaggcttccagtccccagct

SEQ ID NO: 9011533 - DNA, 22 bp, Homo sapiens
cacaggcttccagtccccagct

SEQ ID NO: 9011534 - DNA, 20 bp, Homo sapiens
cacaggcttacagtttagat

SEQ ID NO: 9011535 - DNA, 20 bp, Homo sapiens
cacaggctatatgagagcca

SEQ ID NO: 9011536 - DNA, 22 bp, Homo sapiens
cacaggcttttctgacataggc

SEQ ID NO: 9011537 - DNA, 22 bp, Homo sapiens
cacaggcttttctgacataggc

SEQ ID NO: 9011538 - DNA, 22 bp, Homo sapiens
cacaggcttgtcagcatgaggc

SEQ ID NO: 9011539 - DNA, 21 bp, Homo sapiens
cacaggcttctatacacaatg

SEQ ID NO: 9011540 - DNA, 22 bp, Homo sapiens
cacaggcttgtcagcatgaggc

SEQ ID NO: 9011541 - DNA, 22 bp, Homo sapiens
cacaggcttgtcagcatgaggc

SEQ ID NO: 9011542 - DNA, 22 bp, Homo sapiens
cacaggcttgtcagcatgaggc

SEQ ID NO: 9011543 - DNA, 22 bp, Homo sapiens
cacaggcttgtcagcatgaggc

SEQ ID NO: 9011544 - DNA, 22 bp, Homo sapiens
cacaggcttgtcagcatgaggc

SEQ ID NO: 9011545 - DNA, 22 bp, Homo sapiens
cacaggcttgtcagcatgaggc

SEQ ID NO: 9011546 - DNA, 22 bp, Homo sapiens
caatgtttgttagagctctaga

SEQ ID NO: 9011547 - DNA, 22 bp, Homo sapiens
caatgtttgttagagctctaga

SEQ ID NO: 9011548 - DNA, 22 bp, Homo sapiens
caatgtttgtgatctactgact

SEQ ID NO: 9011549 - DNA, 22 bp, Homo sapiens
caatgtttgtgatctactgact

SEQ ID NO: 9011550 - DNA, 22 bp, Homo sapiens
caatgtttgtgatctactgact

SEQ ID NO: 9011551 - DNA, 18 bp, Homo sapiens
caatgttttagatctcta

SEQ ID NO: 9011552 - DNA, 22 bp, Homo sapiens
caatgttttcaactgacaagta

SEQ ID NO: 9011553 - DNA, 22 bp, Homo sapiens
caatgttttcaactgacaagta

SEQ ID NO: 9011554 - DNA, 22 bp, Homo sapiens
cacacagacagctctctgaaga

SEQ ID NO: 9011555 - DNA, 22 bp, Homo sapiens
cacacagacagctctctgaaga

SEQ ID NO: 9011556 - DNA, 22 bp, Homo sapiens
cacacagacagctctctgaaga

SEQ ID NO: 9011557 - DNA, 22 bp, Homo sapiens
cacaatttgttttatcagtatt

SEQ ID NO: 9011558 - DNA, 22 bp, Homo sapiens
cacacagacagctctctgaaga

SEQ ID NO: 9011559 - DNA, 22 bp, Homo sapiens
cacacagacagctctctgaaga

SEQ ID NO: 9011560 - DNA, 22 bp, Homo sapiens
cacacagatggtaagggaggga

SEQ ID NO: 9011561 - DNA, 22 bp, Homo sapiens
cacacagatggtaagggaggga

SEQ ID NO: 9011562 - DNA, 22 bp, Homo sapiens
cacacagatggtaagggaggga

SEQ ID NO: 9011563 - DNA, 22 bp, Homo sapiens
cacacagatggtaagggaggga

SEQ ID NO: 9011564 - DNA, 22 bp, Homo sapiens
cacacagatggtaagggaggga

SEQ ID NO: 9011565 - DNA, 22 bp, Homo sapiens
cacacagctcaggggcactgcc

SEQ ID NO: 9011566 - DNA, 22 bp, Homo sapiens
cacacagctcaggggcactgcc

SEQ ID NO: 9011567 - DNA, 22 bp, Homo sapiens
cacacagctagtgacaggagaa

SEQ ID NO: 9011568 - DNA, 22 bp, Homo sapiens
cacacagctcaggggcactgcc

SEQ ID NO: 9011569 - DNA, 22 bp, Homo sapiens
cacacagctcaggggcactgcc

SEQ ID NO: 9011570 - DNA, 22 bp, Homo sapiens
cacacagcaacaagaatagcca

SEQ ID NO: 9011571 - DNA, 22 bp, Homo sapiens
cacacagcaacaagaatagcca

SEQ ID NO: 9011572 - DNA, 22 bp, Homo sapiens
cacacagctagtgacaggagaa

SEQ ID NO: 9011573 - DNA, 22 bp, Homo sapiens
cacacagctagtgacaggagaa

SEQ ID NO: 9011574 - DNA, 22 bp, Homo sapiens
cacacagctagtgacaggagaa

SEQ ID NO: 9011575 - DNA, 22 bp, Homo sapiens
cacacagctagtgacaggagaa

SEQ ID NO: 9011576 - DNA, 22 bp, Homo sapiens
cacacaggagagtgctggaggt

SEQ ID NO: 9011577 - DNA, 22 bp, Homo sapiens
cacacaggagagtgctggaggt

SEQ ID NO: 9011578 - DNA, 22 bp, Homo sapiens
cacacaggagagtgctggaggt

SEQ ID NO: 9011579 - DNA, 22 bp, Homo sapiens
ggaagggcctcgggcgtgggac

SEQ ID NO: 9011580 - DNA, 22 bp, Homo sapiens
ggaagggcctcgggcgtgggac

SEQ ID NO: 9011581 - DNA, 22 bp, Homo sapiens
cacacaggagagtgctggaggt

SEQ ID NO: 9011582 - DNA, 22 bp, Homo sapiens
cacacaggaaaattggaattaa

SEQ ID NO: 9011583 - DNA, 21 bp, Homo sapiens
cacacagctgcccttaggtag

SEQ ID NO: 9011584 - DNA, 22 bp, Homo sapiens
cacacaggaaaattggaattaa

SEQ ID NO: 9011585 - DNA, 21 bp, Homo sapiens
cacacagctgcccttaggtag

SEQ ID NO: 9011586 - DNA, 21 bp, Homo sapiens
cacacagctgcccttaggtag

SEQ ID NO: 9011587 - DNA, 22 bp, Homo sapiens
cacagaactggttaatagcaga

SEQ ID NO: 9011588 - DNA, 22 bp, Homo sapiens
cacactgtctttcagaatggtt

SEQ ID NO: 9011589 - DNA, 22 bp, Homo sapiens
cacactgtctttatgagctgta

SEQ ID NO: 9011590 - DNA, 22 bp, Homo sapiens
cacactgtccccttctccccag

SEQ ID NO: 9011591 - DNA, 22 bp, Homo sapiens
ggaaggggccttgagcaaactg

SEQ ID NO: 9011592 - DNA, 22 bp, Homo sapiens
cacagaagaatcatgctgtgtt

SEQ ID NO: 9011593 - DNA, 22 bp, Homo sapiens
cacagaactggttaatagcaga

SEQ ID NO: 9011594 - DNA, 22 bp, Homo sapiens
cacagaataattcacatggctc

SEQ ID NO: 9011595 - DNA, 22 bp, Homo sapiens
cacagaataaattggtatcaga

SEQ ID NO: 9011596 - DNA, 22 bp, Homo sapiens
cacagaagtttcatagtctcga

SEQ ID NO: 9011597 - DNA, 22 bp, Homo sapiens
cacagaagtttcatagtctcga

SEQ ID NO: 9011598 - DNA, 22 bp, Homo sapiens
cacagaatcatattgtcagttt

SEQ ID NO: 9011599 - DNA, 21 bp, Homo sapiens
cacagaatatacattttagtt

SEQ ID NO: 9011600 - DNA, 21 bp, Homo sapiens
cacagaatatacattttagtt

SEQ ID NO: 9011601 - DNA, 21 bp, Homo sapiens
cacagaatatacattttagtt

SEQ ID NO: 9011602 - DNA, 22 bp, Homo sapiens
cacagaataattcacatggctc

SEQ ID NO: 9011603 - DNA, 22 bp, Homo sapiens
cacagaataattcacatggctc

SEQ ID NO: 9011604 - DNA, 22 bp, Homo sapiens
cacagaatctgtgactccaaga

SEQ ID NO: 9011605 - DNA, 22 bp, Homo sapiens
cacagaatcggccgatggtgct

SEQ ID NO: 9011606 - DNA, 22 bp, Homo sapiens
ggaagggcctcgggcgtgggac

SEQ ID NO: 9011607 - DNA, 21 bp, Homo sapiens
ggaagggctctgaggacggct

SEQ ID NO: 9011608 - DNA, 22 bp, Homo sapiens
ggaaggggagctggaaagggta

SEQ ID NO: 9011609 - DNA, 22 bp, Homo sapiens
ggaaggggagctggaaagggta

SEQ ID NO: 9011610 - DNA, 22 bp, Homo sapiens
ggaaggggagctggaaagggta

SEQ ID NO: 9011611 - DNA, 22 bp, Homo sapiens
ggaaggggagctggaaagggta

SEQ ID NO: 9011612 - DNA, 22 bp, Homo sapiens
ggaaggggagctggaaagggta

SEQ ID NO: 9011613 - DNA, 22 bp, Homo sapiens
ggaaggggagctggaaagggta

SEQ ID NO: 9011614 - DNA, 22 bp, Homo sapiens
ggaaggggagctggaaagggta

SEQ ID NO: 9011615 - DNA, 22 bp, Homo sapiens
ggaaggggagctggaaagggta

SEQ ID NO: 9011616 - DNA, 20 bp, Homo sapiens
ggaaggggcaaagtgtgtga

SEQ ID NO: 9011617 - DNA, 20 bp, Homo sapiens
ggaaggggcaaagtgtgtga

SEQ ID NO: 9011618 - DNA, 22 bp, Homo sapiens
cacagagctgaacctgggtcat

SEQ ID NO: 9011619 - DNA, 22 bp, Homo sapiens
cacagagctggaaaggctgggc

SEQ ID NO: 9011620 - DNA, 22 bp, Homo sapiens
cacagagagctacgtgcagcgt

SEQ ID NO: 9011621 - DNA, 22 bp, Homo sapiens
cacagagagctacgtgcagcgt

SEQ ID NO: 9011622 - DNA, 22 bp, Homo sapiens
cacagagctgaacctgggtcat

SEQ ID NO: 9011623 - DNA, 22 bp, Homo sapiens
cacagagagctacgtgcagcgt

SEQ ID NO: 9011624 - DNA, 22 bp, Homo sapiens
cacagagctgaacctgggtcat

SEQ ID NO: 9011625 - DNA, 22 bp, Homo sapiens
cacagaggactgtagcggggag

SEQ ID NO: 9011626 - DNA, 22 bp, Homo sapiens
cacagaggactgtagcggggag

SEQ ID NO: 9011627 - DNA, 22 bp, Homo sapiens
cacagaggactgtagcggggag

SEQ ID NO: 9011628 - DNA, 22 bp, Homo sapiens
cacagaggaaatgactttctta

SEQ ID NO: 9011629 - DNA, 22 bp, Homo sapiens
cacagaggaaatgactttctta

SEQ ID NO: 9011630 - DNA, 22 bp, Homo sapiens
cacagaggaatgcatcagcaga

SEQ ID NO: 9011631 - DNA, 22 bp, Homo sapiens
cacagaggaaaggcagttggta

SEQ ID NO: 9011632 - DNA, 22 bp, Homo sapiens
cacagaggaaatgactttctta

SEQ ID NO: 9011633 - DNA, 22 bp, Homo sapiens
cacagaggaaaggcagttggta

SEQ ID NO: 9011634 - DNA, 22 bp, Homo sapiens
cacagaggaaaggcagttggta

SEQ ID NO: 9011635 - DNA, 22 bp, Homo sapiens
cacagaggatttttagggcagt

SEQ ID NO: 9011636 - DNA, 22 bp, Homo sapiens
cacagaggatgcccaagcgatc

SEQ ID NO: 9011637 - DNA, 22 bp, Homo sapiens
cacagaggatttttagggcagt

SEQ ID NO: 9011638 - DNA, 22 bp, Homo sapiens
cacagaggatttttagggcagt

SEQ ID NO: 9011639 - DNA, 22 bp, Homo sapiens
cacagaggatgcccaagcgatc

SEQ ID NO: 9011640 - DNA, 22 bp, Homo sapiens
cacagaggatgcccaagcgatc

SEQ ID NO: 9011641 - DNA, 22 bp, Homo sapiens
cacagaggatgcccaagcgatc

SEQ ID NO: 9011642 - DNA, 22 bp, Homo sapiens
cacagaggatgcccaagcgatc

SEQ ID NO: 9011643 - DNA, 22 bp, Homo sapiens
cacagaggcatgaccctgccct

SEQ ID NO: 9011644 - DNA, 22 bp, Homo sapiens
cacagaggcatgaccctgccct

SEQ ID NO: 9011645 - DNA, 21 bp, Homo sapiens
cacagaggcgctgtatggctg

SEQ ID NO: 9011646 - DNA, 21 bp, Homo sapiens
cacagaggcgctgtatggctg

SEQ ID NO: 9011647 - DNA, 21 bp, Homo sapiens
cacagaggcgctgtatggctg

SEQ ID NO: 9011648 - DNA, 21 bp, Homo sapiens
cacagaggcgctgtatggctg

SEQ ID NO: 9011649 - DNA, 22 bp, Homo sapiens
cacagaggcggaaaattctgaa

SEQ ID NO: 9011650 - DNA, 22 bp, Homo sapiens
cacagaggctcaaagccaggtg

SEQ ID NO: 9011651 - DNA, 22 bp, Homo sapiens
cacagaggctcaaagccaggtg

SEQ ID NO: 9011652 - DNA, 22 bp, Homo sapiens
ggactgggcatgggtgctctgc

SEQ ID NO: 9011653 - DNA, 22 bp, Homo sapiens
ggactgggcatgggtgctctgc

SEQ ID NO: 9011654 - DNA, 22 bp, Homo sapiens
ggactgggcatgggtgctctgc

SEQ ID NO: 9011655 - DNA, 22 bp, Homo sapiens
ggactgggcatgggtgctctgc

SEQ ID NO: 9011656 - DNA, 22 bp, Homo sapiens
ggactgggattctggatctgct

SEQ ID NO: 9011657 - DNA, 22 bp, Homo sapiens
ggactgggattctggatctgct

SEQ ID NO: 9011658 - DNA, 22 bp, Homo sapiens
ggactgggattctggatctgct

SEQ ID NO: 9011659 - DNA, 22 bp, Homo sapiens
ggactgggattctggatctgct

SEQ ID NO: 9011660 - DNA, 22 bp, Homo sapiens
ggactgggattctggatctgct

SEQ ID NO: 9011661 - DNA, 22 bp, Homo sapiens
ggactgggccaggggttggact

SEQ ID NO: 9011662 - DNA, 22 bp, Homo sapiens
ggactgggccaggggttggact

SEQ ID NO: 9011663 - DNA, 22 bp, Homo sapiens
ggactgggccaggggttggact

SEQ ID NO: 9011664 - DNA, 22 bp, Homo sapiens
ggactgggccaggggttggact

SEQ ID NO: 9011665 - DNA, 22 bp, Homo sapiens
ggactgggccaggggttggact

SEQ ID NO: 9011666 - DNA, 17 bp, Homo sapiens
ggactgggcggggcagg

SEQ ID NO: 9011667 - DNA, 17 bp, Homo sapiens
ggactgggcggggcagg

SEQ ID NO: 9011668 - DNA, 17 bp, Homo sapiens
ggactgggcggggcagg

SEQ ID NO: 9011669 - DNA, 17 bp, Homo sapiens
ggactgggcggggcagg

SEQ ID NO: 9011670 - DNA, 17 bp, Homo sapiens
ggactgggcggggcagg

SEQ ID NO: 9011671 - DNA, 22 bp, Homo sapiens
cacagagaccccttctggggcc

SEQ ID NO: 9011672 - DNA, 22 bp, Homo sapiens
cacagagagctacgtgcagcgt

SEQ ID NO: 9011673 - DNA, 22 bp, Homo sapiens
cacagagaccccttctggggcc

SEQ ID NO: 9011674 - DNA, 22 bp, Homo sapiens
cacagagaccccttctggggcc

SEQ ID NO: 9011675 - DNA, 22 bp, Homo sapiens
ggactgggtaggagcccagggc

SEQ ID NO: 9011676 - DNA, 22 bp, Homo sapiens
ggactgggtaggagcccagggc

SEQ ID NO: 9011677 - DNA, 22 bp, Homo sapiens
ggactgggagaatggaggcaag

SEQ ID NO: 9011678 - DNA, 22 bp, Homo sapiens
ggactgggagaatggaggcaag

SEQ ID NO: 9011679 - DNA, 22 bp, Homo sapiens
ggactgggagaatggaggcaag

SEQ ID NO: 9011680 - DNA, 22 bp, Homo sapiens
ggactgggagaatggaggcaag

SEQ ID NO: 9011681 - DNA, 22 bp, Homo sapiens
ggactgggagaatggaggcaag

SEQ ID NO: 9011682 - DNA, 22 bp, Homo sapiens
ggactgggagaatggaggcaag

SEQ ID NO: 9011683 - DNA, 22 bp, Homo sapiens
cacagacttgagaagcacctta

SEQ ID NO: 9011684 - DNA, 20 bp, Homo sapiens
cacagactgtatgggcacca

SEQ ID NO: 9011685 - DNA, 22 bp, Homo sapiens
cacagacttgagaagcacctta

SEQ ID NO: 9011686 - DNA, 22 bp, Homo sapiens
cacagacttgagaagcacctta

SEQ ID NO: 9011687 - DNA, 22 bp, Homo sapiens
cacagagaaaatgttggtgctt

SEQ ID NO: 9011688 - DNA, 22 bp, Homo sapiens
cacagaattttctctttacaat

SEQ ID NO: 9011689 - DNA, 22 bp, Homo sapiens
cacagaattttctctttacaat

SEQ ID NO: 9011690 - DNA, 22 bp, Homo sapiens
cacagaattaagggagaaatat

SEQ ID NO: 9011691 - DNA, 22 bp, Homo sapiens
cacagaattaagggagaaatat

SEQ ID NO: 9011692 - DNA, 22 bp, Homo sapiens
cacagaattaagggagaaatat

SEQ ID NO: 9011693 - DNA, 22 bp, Homo sapiens
cacagaatggaccagttttaga

SEQ ID NO: 9011694 - DNA, 22 bp, Homo sapiens
cacagaatggaccagttttaga

SEQ ID NO: 9011695 - DNA, 22 bp, Homo sapiens
cacagactccccgccatagtgg

SEQ ID NO: 9011696 - DNA, 22 bp, Homo sapiens
cacagacccagaagggatgaag

SEQ ID NO: 9011697 - DNA, 22 bp, Homo sapiens
cacagaattttctctttacaat

SEQ ID NO: 9011698 - DNA, 20 bp, Homo sapiens
cacagactgtatgggcacca

SEQ ID NO: 9011699 - DNA, 20 bp, Homo sapiens
cacagactgtatgggcacca

SEQ ID NO: 9011700 - DNA, 20 bp, Homo sapiens
cacagactgtatgggcacca

SEQ ID NO: 9011701 - DNA, 22 bp, Homo sapiens
cacagacccagaagggatgaag

SEQ ID NO: 9011702 - DNA, 22 bp, Homo sapiens
ggctggtgttgagtgcctgtag

SEQ ID NO: 9011703 - DNA, 22 bp, Homo sapiens
ggctggtgttgagtgcctgtag

SEQ ID NO: 9011704 - DNA, 22 bp, Homo sapiens
ggctggtgttacagtcggcagc

SEQ ID NO: 9011705 - DNA, 22 bp, Homo sapiens
ggctggtgttacagtcggcagc

SEQ ID NO: 9011706 - DNA, 22 bp, Homo sapiens
ggctggtgttacagtcggcagc

SEQ ID NO: 9011707 - DNA, 22 bp, Homo sapiens
ggctggtgttacagtcggcagc

SEQ ID NO: 9011708 - DNA, 21 bp, Homo sapiens
ggctggtgtttagctgtgata

SEQ ID NO: 9011709 - DNA, 21 bp, Homo sapiens
ggctggtgtttagctgtgata

SEQ ID NO: 9011710 - DNA, 21 bp, Homo sapiens
ggctggtgtttagctgtgata

SEQ ID NO: 9011711 - DNA, 22 bp, Homo sapiens
ggctgtatatactgtatacagt

SEQ ID NO: 9011712 - DNA, 22 bp, Homo sapiens
ggctgtaggttggtgctggaca

SEQ ID NO: 9011713 - DNA, 22 bp, Homo sapiens
ggctgtagtcagtgacatggta

SEQ ID NO: 9011714 - DNA, 19 bp, Homo sapiens
ggctgtctacgaaccagtc

SEQ ID NO: 9011715 - DNA, 19 bp, Homo sapiens
ggctgtctcggcccagcca

SEQ ID NO: 9011716 - DNA, 22 bp, Homo sapiens
ggctgtccttggccaaggcact

SEQ ID NO: 9011717 - DNA, 20 bp, Homo sapiens
ggctgtcccgcggctgccgg

SEQ ID NO: 9011718 - DNA, 22 bp, Homo sapiens
ggctgtccacctaccatgccgg

SEQ ID NO: 9011719 - DNA, 22 bp, Homo sapiens
ggctgtgttccaagtgtcagga

SEQ ID NO: 9011720 - DNA, 22 bp, Homo sapiens
ggctgtgttccaagtgtcagga

SEQ ID NO: 9011721 - DNA, 22 bp, Homo sapiens
ggctgtgttccaagtgtcagga

SEQ ID NO: 9011722 - DNA, 22 bp, Homo sapiens
ggctgtgtttctgtttgacatt

SEQ ID NO: 9011723 - DNA, 22 bp, Homo sapiens
ggctgtgtttctgtttgacatt

SEQ ID NO: 9011724 - DNA, 22 bp, Homo sapiens
ggctgttgacagacataggttt

SEQ ID NO: 9011725 - DNA, 17 bp, Homo sapiens
ggctgtttttaggctgt

SEQ ID NO: 9011726 - DNA, 17 bp, Homo sapiens
ggctgtttttaggctgt

SEQ ID NO: 9011727 - DNA, 22 bp, Homo sapiens
ggcttaaagttttctagaataa

SEQ ID NO: 9011728 - DNA, 22 bp, Homo sapiens
ggcttaaagttttctagaataa

SEQ ID NO: 9011729 - DNA, 22 bp, Homo sapiens
ggcttaaagaattaacagagat

SEQ ID NO: 9011730 - DNA, 22 bp, Homo sapiens
ggcttaaaaggaaaatgagagt

SEQ ID NO: 9011731 - DNA, 22 bp, Homo sapiens
ggcttaaaactttgaaagtgtt

SEQ ID NO: 9011732 - DNA, 22 bp, Homo sapiens
ggctgtttttatagagtccata

SEQ ID NO: 9011733 - DNA, 22 bp, Homo sapiens
ggctgtttttatagagtccata

SEQ ID NO: 9011734 - DNA, 22 bp, Homo sapiens
ggctgtccttggccaaggcact

SEQ ID NO: 9011735 - DNA, 22 bp, Homo sapiens
ggctgtctctgtgactgccacc

SEQ ID NO: 9011736 - DNA, 22 bp, Homo sapiens
ggctgtctctgtgactgccacc

SEQ ID NO: 9011737 - DNA, 22 bp, Homo sapiens
ggctgtctctgtgactgccacc

SEQ ID NO: 9011738 - DNA, 22 bp, Homo sapiens
ggctgtgaaccctggcagtgtg

SEQ ID NO: 9011739 - DNA, 22 bp, Homo sapiens
ggctgtgaaccctggcagtgtg

SEQ ID NO: 9011740 - DNA, 22 bp, Homo sapiens
ggctgtgaaccctggcagtgtg

SEQ ID NO: 9011741 - DNA, 22 bp, Homo sapiens
ggctgtgaagtagcaggggcag

SEQ ID NO: 9011742 - DNA, 22 bp, Homo sapiens
ggctgtgttccaagtgtcagga

SEQ ID NO: 9011743 - DNA, 22 bp, Homo sapiens
cagaaagcttggtacaatatgc

SEQ ID NO: 9011744 - DNA, 22 bp, Homo sapiens
cagaaaggactttggttggctt

SEQ ID NO: 9011745 - DNA, 22 bp, Homo sapiens
cagaaaggactttggttggctt

SEQ ID NO: 9011746 - DNA, 22 bp, Homo sapiens
cagaaaggactttggttggctt

SEQ ID NO: 9011747 - DNA, 22 bp, Homo sapiens
cagaaaggactttggttggctt

SEQ ID NO: 9011748 - DNA, 22 bp, Homo sapiens
cagaaaggcacccactgggtct

SEQ ID NO: 9011749 - DNA, 22 bp, Homo sapiens
cagaaaggacagagtgagggtg

SEQ ID NO: 9011750 - DNA, 22 bp, Homo sapiens
cagaaaggacagagtgagggtg

SEQ ID NO: 9011751 - DNA, 22 bp, Homo sapiens
cagaaaggacagagtgagggtg

SEQ ID NO: 9011752 - DNA, 22 bp, Homo sapiens
cagaaaggacagagtgagggtg

SEQ ID NO: 9011753 - DNA, 22 bp, Homo sapiens
cagaaaggacagagtgagggtg

SEQ ID NO: 9011754 - DNA, 18 bp, Homo sapiens
cagaaagttatttactct

SEQ ID NO: 9011755 - DNA, 23 bp, Homo sapiens
cagaaagtttgagaagatacatc

SEQ ID NO: 9011756 - DNA, 23 bp, Homo sapiens
cagaaagtttgagaagatacatc

SEQ ID NO: 9011757 - DNA, 23 bp, Homo sapiens
cagaaagtttgagaagatacatc

SEQ ID NO: 9011758 - DNA, 23 bp, Homo sapiens
cagaaagtttgagaagatacatc

SEQ ID NO: 9011759 - DNA, 22 bp, Homo sapiens
cagaaagtgatttgctattcca

SEQ ID NO: 9011760 - DNA, 18 bp, Homo sapiens
cagaaagttatttactct

SEQ ID NO: 9011761 - DNA, 22 bp, Homo sapiens
cagaaaggcacccactgggtct

SEQ ID NO: 9011762 - DNA, 22 bp, Homo sapiens
cagaaaggtatgtgtgcctttg

SEQ ID NO: 9011763 - DNA, 22 bp, Homo sapiens
cagaaaggcacccactgggtct

SEQ ID NO: 9011764 - DNA, 22 bp, Homo sapiens
cagaaaggcacccactgggtct

SEQ ID NO: 9011765 - DNA, 22 bp, Homo sapiens
cagaaaggtatgtgtgcctttg

SEQ ID NO: 9011766 - DNA, 22 bp, Homo sapiens
cagaaaggtatgtgtgcctttg

SEQ ID NO: 9011767 - DNA, 22 bp, Homo sapiens
cagaaataaacttctcacatcg

SEQ ID NO: 9011768 - DNA, 22 bp, Homo sapiens
cagaaataaacttctcacatcg

SEQ ID NO: 9011769 - DNA, 22 bp, Homo sapiens
cagaaataaacttctcacatcg

SEQ ID NO: 9011770 - DNA, 22 bp, Homo sapiens
cagaaataaacttctcacatcg

SEQ ID NO: 9011771 - DNA, 22 bp, Homo sapiens
cagaaataaacttctcacatcg

SEQ ID NO: 9011772 - DNA, 22 bp, Homo sapiens
cagaaataaacttctcacatcg

SEQ ID NO: 9011773 - DNA, 22 bp, Homo sapiens
cagaaataaacttctcacatcg

SEQ ID NO: 9011774 - DNA, 23 bp, Homo sapiens
cagaaataaactggtttgtagat

SEQ ID NO: 9011775 - DNA, 23 bp, Homo sapiens
cagaaataaactggtttgtagat

SEQ ID NO: 9011776 - DNA, 23 bp, Homo sapiens
cagaaataaactggtttgtagat

SEQ ID NO: 9011777 - DNA, 23 bp, Homo sapiens
cagaaataaactggtttgtagat

SEQ ID NO: 9011778 - DNA, 23 bp, Homo sapiens
cagaaataaactggtttgtagat

SEQ ID NO: 9011779 - DNA, 22 bp, Homo sapiens
cagaaataaagtggacagagta

SEQ ID NO: 9011780 - DNA, 22 bp, Homo sapiens
cagaaataaagtggacagagta

SEQ ID NO: 9011781 - DNA, 22 bp, Homo sapiens
cagaaatacccagcatttggag

SEQ ID NO: 9011782 - DNA, 22 bp, Homo sapiens
cagaaatacccagcatttggag

SEQ ID NO: 9011783 - DNA, 22 bp, Homo sapiens
cagaaataaagtggacagagta

SEQ ID NO: 9011784 - DNA, 22 bp, Homo sapiens
cagaaataaagtggacagagta

SEQ ID NO: 9011785 - DNA, 22 bp, Homo sapiens
cagaaataaagtggacagagta

SEQ ID NO: 9011786 - DNA, 22 bp, Homo sapiens
cagaaatacccagcatttggag

SEQ ID NO: 9011787 - DNA, 22 bp, Homo sapiens
cagaaatacccagcatttggag

SEQ ID NO: 9011788 - DNA, 22 bp, Homo sapiens
cagaaatagacaatggcagtgg

SEQ ID NO: 9011789 - DNA, 22 bp, Homo sapiens
ggctgggaggatgacttgctac

SEQ ID NO: 9011790 - DNA, 22 bp, Homo sapiens
ggctgggaggatgacttgctac

SEQ ID NO: 9011791 - DNA, 22 bp, Homo sapiens
ggctgggaggatgacttgctac

SEQ ID NO: 9011792 - DNA, 22 bp, Homo sapiens
ggctgggaggatgacttgctac

SEQ ID NO: 9011793 - DNA, 22 bp, Homo sapiens
cagaaagcgggatgcagcatgt

SEQ ID NO: 9011794 - DNA, 22 bp, Homo sapiens
cagaaagctctttcaatcttgc

SEQ ID NO: 9011795 - DNA, 22 bp, Homo sapiens
cagaaagcgggatgcagcatgt

SEQ ID NO: 9011796 - DNA, 23 bp, Homo sapiens
cagaaagccctttccccacagta

SEQ ID NO: 9011797 - DNA, 22 bp, Homo sapiens
cagaaagccgacttacaatgga

SEQ ID NO: 9011798 - DNA, 22 bp, Homo sapiens
cagaaagccgacttacaatgga

SEQ ID NO: 9011799 - DNA, 22 bp, Homo sapiens
cagaaagcaagccattcactgt

SEQ ID NO: 9011800 - DNA, 22 bp, Homo sapiens
cagaaagcagttgtcaatgggc

SEQ ID NO: 9011801 - DNA, 22 bp, Homo sapiens
cagaaagcaaaatggatctctg

SEQ ID NO: 9011802 - DNA, 22 bp, Homo sapiens
cagaaagacctgggctcaagag

SEQ ID NO: 9011803 - DNA, 22 bp, Homo sapiens
cagaaacatgtataaagttgta

SEQ ID NO: 9011804 - DNA, 22 bp, Homo sapiens
cagaaacatgtataaagttgta

SEQ ID NO: 9011805 - DNA, 22 bp, Homo sapiens
ggctgcctagacttggaatttc

SEQ ID NO: 9011806 - DNA, 22 bp, Homo sapiens
ggctgcctactttcccagagtt

SEQ ID NO: 9011807 - DNA, 22 bp, Homo sapiens
ggctgcctactttcccagagtt

SEQ ID NO: 9011808 - DNA, 22 bp, Homo sapiens
ggctgcctcaaagctcaagctc

SEQ ID NO: 9011809 - DNA, 22 bp, Homo sapiens
ggctgcctagacttggaatttc

SEQ ID NO: 9011810 - DNA, 22 bp, Homo sapiens
ggctgcctcaaagctcaagctc

SEQ ID NO: 9011811 - DNA, 22 bp, Homo sapiens
ggctgcctatagaattattagt

SEQ ID NO: 9011812 - DNA, 22 bp, Homo sapiens
ggctgccctctgctgactgcaa

SEQ ID NO: 9011813 - DNA, 22 bp, Homo sapiens
ggctgccctctgctgactgcaa

SEQ ID NO: 9011814 - DNA, 22 bp, Homo sapiens
ggctgccctgggaggcaagggt

SEQ ID NO: 9011815 - DNA, 22 bp, Homo sapiens
ggctgcctaacccttaagtgtc

SEQ ID NO: 9011816 - DNA, 22 bp, Homo sapiens
ggctgcctaacccttaagtgtc

SEQ ID NO: 9011817 - DNA, 22 bp, Homo sapiens
ggctgcctaacccttaagtgtc

SEQ ID NO: 9011818 - DNA, 22 bp, Homo sapiens
ggctgccctgggaggcaagggt

SEQ ID NO: 9011819 - DNA, 22 bp, Homo sapiens
ggctgccctcggggtcgcaggc

SEQ ID NO: 9011820 - DNA, 22 bp, Homo sapiens
ggctgccctagagctggcaagg

SEQ ID NO: 9011821 - DNA, 22 bp, Homo sapiens
ggctgccctcggggtcgcaggc

SEQ ID NO: 9011822 - DNA, 22 bp, Homo sapiens
ggctgccctcggggtcgcaggc

SEQ ID NO: 9011823 - DNA, 22 bp, Homo sapiens
ggctgccctcgtctactgccca

SEQ ID NO: 9011824 - DNA, 22 bp, Homo sapiens
ggctgccctcgtctactgccca

SEQ ID NO: 9011825 - DNA, 22 bp, Homo sapiens
cagaaaacctgactctagaact

SEQ ID NO: 9011826 - DNA, 23 bp, Homo sapiens
cagaaaacccagagctcagtccc

SEQ ID NO: 9011827 - DNA, 22 bp, Homo sapiens
cagaaaacctgactctagaact

SEQ ID NO: 9011828 - DNA, 22 bp, Homo sapiens
cagaaaacctgactctagaact

SEQ ID NO: 9011829 - DNA, 22 bp, Homo sapiens
cacttttaacaggagaattccc

SEQ ID NO: 9011830 - DNA, 22 bp, Homo sapiens
cacttttaacaggagaattccc

SEQ ID NO: 9011831 - DNA, 22 bp, Homo sapiens
cagaaaacaaacctatcctgag

SEQ ID NO: 9011832 - DNA, 23 bp, Homo sapiens
cagaaaacccagagctcagtccc

SEQ ID NO: 9011833 - DNA, 23 bp, Homo sapiens
cagaaaacccagagctcagtccc

SEQ ID NO: 9011834 - DNA, 21 bp, Homo sapiens
cactttaatggatatttgttt

SEQ ID NO: 9011835 - DNA, 21 bp, Homo sapiens
cactttaatggatatttgttt

SEQ ID NO: 9011836 - DNA, 22 bp, Homo sapiens
cactttggggtatgacaagttt

SEQ ID NO: 9011837 - DNA, 22 bp, Homo sapiens
cactttgggtttatgtcaatca

SEQ ID NO: 9011838 - DNA, 20 bp, Homo sapiens
cactttggacctgatgtatc

SEQ ID NO: 9011839 - DNA, 22 bp, Homo sapiens
cactttggatgccactggtcta

SEQ ID NO: 9011840 - DNA, 22 bp, Homo sapiens
cactttggatgccactggtcta

SEQ ID NO: 9011841 - DNA, 22 bp, Homo sapiens
cacttttaacaggagaattccc

SEQ ID NO: 9011842 - DNA, 22 bp, Homo sapiens
cactttggttcacctgagtttc

SEQ ID NO: 9011843 - DNA, 22 bp, Homo sapiens
cactttggtagctgttttggga

SEQ ID NO: 9011844 - DNA, 22 bp, Homo sapiens
cagaaaataaacatttgtggaa

SEQ ID NO: 9011845 - DNA, 22 bp, Homo sapiens
cagaaaataaacatttgtggaa

SEQ ID NO: 9011846 - DNA, 22 bp, Homo sapiens
cagaaaagggtgtttgttcagg

SEQ ID NO: 9011847 - DNA, 22 bp, Homo sapiens
cagaaaataaagtttctacgca

SEQ ID NO: 9011848 - DNA, 22 bp, Homo sapiens
cagaaaataaacatttgtggaa

SEQ ID NO: 9011849 - DNA, 22 bp, Homo sapiens
cagaaaataaagtttctacgca

SEQ ID NO: 9011850 - DNA, 22 bp, Homo sapiens
cagaaaagggtgtttgttcagg

SEQ ID NO: 9011851 - DNA, 22 bp, Homo sapiens
cagaaaagggtgtttgttcagg

SEQ ID NO: 9011852 - DNA, 22 bp, Homo sapiens
cagaaaaggaagagctatgtaa

SEQ ID NO: 9011853 - DNA, 22 bp, Homo sapiens
cagaaaaggaagagctatgtaa

SEQ ID NO: 9011854 - DNA, 22 bp, Homo sapiens
cagaaaaggaagagctatgtaa

SEQ ID NO: 9011855 - DNA, 22 bp, Homo sapiens
ggctgccataacagagtaccac

SEQ ID NO: 9011856 - DNA, 22 bp, Homo sapiens
ggctgccataactgataccata

SEQ ID NO: 9011857 - DNA, 20 bp, Homo sapiens
ggctgcccactccagagtac

SEQ ID NO: 9011858 - DNA, 22 bp, Homo sapiens
ggctgccataactgataccata

SEQ ID NO: 9011859 - DNA, 22 bp, Homo sapiens
ggctgccataactgataccata

SEQ ID NO: 9011860 - DNA, 22 bp, Homo sapiens
ggctgccataacagagtaccac

SEQ ID NO: 9011861 - DNA, 22 bp, Homo sapiens
ggctgccataacagagtaccac

SEQ ID NO: 9011862 - DNA, 22 bp, Homo sapiens
ggctgccctagagctggcaagg

SEQ ID NO: 9011863 - DNA, 22 bp, Homo sapiens
ggctgccctagagctggcaagg

SEQ ID NO: 9011864 - DNA, 22 bp, Homo sapiens
ggctgccccatgggctgggctg

SEQ ID NO: 9011865 - DNA, 22 bp, Homo sapiens
ggctgccccatgggctgggctg

SEQ ID NO: 9011866 - DNA, 22 bp, Homo sapiens
ggctgccccatgggctgggctg

SEQ ID NO: 9011867 - DNA, 22 bp, Homo sapiens
ggctgccccagtgctcatggct

SEQ ID NO: 9011868 - DNA, 22 bp, Homo sapiens
ggctgccccagtgctcatggct

SEQ ID NO: 9011869 - DNA, 22 bp, Homo sapiens
ggctgccccatgggctgggctg

SEQ ID NO: 9011870 - DNA, 22 bp, Homo sapiens
ggctccagggtacccctggatg

SEQ ID NO: 9011871 - DNA, 22 bp, Homo sapiens
ggctccagggtacccctggatg

SEQ ID NO: 9011872 - DNA, 22 bp, Homo sapiens
ggctccagggtacccctggatg

SEQ ID NO: 9011873 - DNA, 22 bp, Homo sapiens
ggctccagggtacccctggatg

SEQ ID NO: 9011874 - DNA, 22 bp, Homo sapiens
ggctcaggtttaaagtgcttta

SEQ ID NO: 9011875 - DNA, 22 bp, Homo sapiens
ggctccagggagtggagagaag

SEQ ID NO: 9011876 - DNA, 22 bp, Homo sapiens
ggctcaggtttaaagtgcttta

SEQ ID NO: 9011877 - DNA, 22 bp, Homo sapiens
ggctcaggttaccagtccctcc

SEQ ID NO: 9011878 - DNA, 22 bp, Homo sapiens
ggctcaggttaccagtccctcc

SEQ ID NO: 9011879 - DNA, 22 bp, Homo sapiens
ggctcaggttaccagtccctcc

SEQ ID NO: 9011880 - DNA, 22 bp, Homo sapiens
ggctcaggggccaggcctgtcc

SEQ ID NO: 9011881 - DNA, 22 bp, Homo sapiens
ggctcaggttaccagtccctcc

SEQ ID NO: 9011882 - DNA, 22 bp, Homo sapiens
ggctcaggttgggtcacatgac

SEQ ID NO: 9011883 - DNA, 22 bp, Homo sapiens
ggctcaggttaccagtccctcc

SEQ ID NO: 9011884 - DNA, 22 bp, Homo sapiens
ggctcaggttgggtcacatgac

SEQ ID NO: 9011885 - DNA, 22 bp, Homo sapiens
ggctccagggtacccctggatg

SEQ ID NO: 9011886 - DNA, 22 bp, Homo sapiens
ggctccagggtacccctggatg

SEQ ID NO: 9011887 - DNA, 22 bp, Homo sapiens
ggctccagggtctctccttgtg

SEQ ID NO: 9011888 - DNA, 22 bp, Homo sapiens
ggctccagggtctctccttgtg

SEQ ID NO: 9011889 - DNA, 22 bp, Homo sapiens
ggctccagggtctctccttgtg

SEQ ID NO: 9011890 - DNA, 22 bp, Homo sapiens
ggctccagggtctctccttgtg

SEQ ID NO: 9011891 - DNA, 22 bp, Homo sapiens
ggctccaggtgcatgccaggct

SEQ ID NO: 9011892 - DNA, 22 bp, Homo sapiens
ggctccaggtgcatgccaggct

SEQ ID NO: 9011893 - DNA, 22 bp, Homo sapiens
ggctccagggtctctccttgtg

SEQ ID NO: 9011894 - DNA, 22 bp, Homo sapiens
ggctccaggtacgtatgggagg

SEQ ID NO: 9011895 - DNA, 22 bp, Homo sapiens
ggctccaggtacgtatgggagg

SEQ ID NO: 9011896 - DNA, 22 bp, Homo sapiens
ggctctggtcagtgaggggcct

SEQ ID NO: 9011897 - DNA, 22 bp, Homo sapiens
ggctctgggttctgcaatgcgt

SEQ ID NO: 9011898 - DNA, 22 bp, Homo sapiens
ggctctggaatgtgtagtcagg

SEQ ID NO: 9011899 - DNA, 22 bp, Homo sapiens
ggctctggtcagtgaggggcct

SEQ ID NO: 9011900 - DNA, 22 bp, Homo sapiens
ggctctgggttctgcaatgcgt

SEQ ID NO: 9011901 - DNA, 22 bp, Homo sapiens
ggctccaggtgcatgccaggct

SEQ ID NO: 9011902 - DNA, 22 bp, Homo sapiens
ggctccaggtgcatgccaggct

SEQ ID NO: 9011903 - DNA, 22 bp, Homo sapiens
ggctccaggtgcatgccaggct

SEQ ID NO: 9011904 - DNA, 22 bp, Homo sapiens
ggctccaggtttaagggtatgt

SEQ ID NO: 9011905 - DNA, 22 bp, Homo sapiens
ggctccaggtttaagggtatgt

SEQ ID NO: 9011906 - DNA, 22 bp, Homo sapiens
ggctccaggtttaagggtatgt

SEQ ID NO: 9011907 - DNA, 22 bp, Homo sapiens
ggctccagtttccccttggggc

SEQ ID NO: 9011908 - DNA, 22 bp, Homo sapiens
ggctccagtttccccttggggc

SEQ ID NO: 9011909 - DNA, 18 bp, Homo sapiens
ggctccagtcttcagtgg

SEQ ID NO: 9011910 - DNA, 22 bp, Homo sapiens
ggctccagtttccccttggggc

SEQ ID NO: 9011911 - DNA, 18 bp, Homo sapiens
ggctccagtcttcagtgg

SEQ ID NO: 9011912 - DNA, 22 bp, Homo sapiens
ggctccaggtttaagggtatgt

SEQ ID NO: 9011913 - DNA, 22 bp, Homo sapiens
ggctgagctcaggggcagcagg

SEQ ID NO: 9011914 - DNA, 22 bp, Homo sapiens
ggctgagctcaggggcagcagg

SEQ ID NO: 9011915 - DNA, 19 bp, Homo sapiens
ggctgagcgccttggctgc

SEQ ID NO: 9011916 - DNA, 22 bp, Homo sapiens
ggctgagcgtggctgccgtggg

SEQ ID NO: 9011917 - DNA, 22 bp, Homo sapiens
ggctgagcctggagcatctggt

SEQ ID NO: 9011918 - DNA, 22 bp, Homo sapiens
ggctgagcctggagcatctggt

SEQ ID NO: 9011919 - DNA, 19 bp, Homo sapiens
ggctgagcgccttggctgc

SEQ ID NO: 9011920 - DNA, 22 bp, Homo sapiens
ggctgagcctggagcatctggt

SEQ ID NO: 9011921 - DNA, 22 bp, Homo sapiens
ggctgagcctggagcatctggt

SEQ ID NO: 9011922 - DNA, 22 bp, Homo sapiens
ggctgagcctggagcatctggt

SEQ ID NO: 9011923 - DNA, 22 bp, Homo sapiens
ggctgaggcggcgatgcccttg

SEQ ID NO: 9011924 - DNA, 22 bp, Homo sapiens
ggctgaggcggcgatgcccttg

SEQ ID NO: 9011925 - DNA, 22 bp, Homo sapiens
cactttaactcacatttcagct

SEQ ID NO: 9011926 - DNA, 22 bp, Homo sapiens
ggctgagcttatatatgtgctg

SEQ ID NO: 9011927 - DNA, 22 bp, Homo sapiens
ggctgagcttatatatgtgctg

SEQ ID NO: 9011928 - DNA, 22 bp, Homo sapiens
ggctgagcttttcatgatggtt

SEQ ID NO: 9011929 - DNA, 22 bp, Homo sapiens
ggctctggtggcaattgactgg

SEQ ID NO: 9011930 - DNA, 22 bp, Homo sapiens
ggctctggtgggaaggttagat

SEQ ID NO: 9011931 - DNA, 22 bp, Homo sapiens
ggctctggtgggaaggttagat

SEQ ID NO: 9011932 - DNA, 22 bp, Homo sapiens
ggctctggtgccctggctccca

SEQ ID NO: 9011933 - DNA, 22 bp, Homo sapiens
ggctctggtgtgaagcagcctc

SEQ ID NO: 9011934 - DNA, 22 bp, Homo sapiens
ggctctggtgggaaggttagat

SEQ ID NO: 9011935 - DNA, 22 bp, Homo sapiens
ggctctggtgggaaggttagat

SEQ ID NO: 9011936 - DNA, 22 bp, Homo sapiens
ggctgagccccctctgcgtagg

SEQ ID NO: 9011937 - DNA, 22 bp, Homo sapiens
ggctctggtgccctggctccca

SEQ ID NO: 9011938 - DNA, 22 bp, Homo sapiens
ggctctggtgccctggctccca

SEQ ID NO: 9011939 - DNA, 22 bp, Homo sapiens
ggctctggtgccctggctccca

SEQ ID NO: 9011940 - DNA, 22 bp, Homo sapiens
ggctctggtgccctggctccca

SEQ ID NO: 9011941 - DNA, 22 bp, Homo sapiens
ggctctggtgccctggctccca

SEQ ID NO: 9011942 - DNA, 22 bp, Homo sapiens
ggctctggtgccctggctccca

SEQ ID NO: 9011943 - DNA, 22 bp, Homo sapiens
ggctctggtgagggtaggagat

SEQ ID NO: 9011944 - DNA, 22 bp, Homo sapiens
ggctctggtgccctggctccca

SEQ ID NO: 9011945 - DNA, 22 bp, Homo sapiens
ggctctggtcagtgaggggcct

SEQ ID NO: 9011946 - DNA, 22 bp, Homo sapiens
ggctctggtgagggtaggagat

SEQ ID NO: 9011947 - DNA, 22 bp, Homo sapiens
ggctctggtgagggtaggagat

SEQ ID NO: 9011948 - DNA, 22 bp, Homo sapiens
ggctctggtgagggtaggagat

SEQ ID NO: 9011949 - DNA, 22 bp, Homo sapiens
ggctctggtgagggtaggagat

SEQ ID NO: 9011950 - DNA, 22 bp, Homo sapiens
ggctctggtgagggtaggagat

SEQ ID NO: 9011951 - DNA, 21 bp, Homo sapiens
ggcctgagcacctgtccacct

SEQ ID NO: 9011952 - DNA, 22 bp, Homo sapiens
ggcctgagcagacagcatgatg

SEQ ID NO: 9011953 - DNA, 22 bp, Homo sapiens
ggcctgagcagacagcatgatg

SEQ ID NO: 9011954 - DNA, 22 bp, Homo sapiens
ggcctgagcagacagcatgatg

SEQ ID NO: 9011955 - DNA, 22 bp, Homo sapiens
ggcctgagcagacagcatgatg

SEQ ID NO: 9011956 - DNA, 20 bp, Homo sapiens
ggcctgagcatggctggcag

SEQ ID NO: 9011957 - DNA, 20 bp, Homo sapiens
ggcctgagcatggctggcag

SEQ ID NO: 9011958 - DNA, 22 bp, Homo sapiens
ggcctgagcagacagcatgatg

SEQ ID NO: 9011959 - DNA, 20 bp, Homo sapiens
ggcctgagcatggctggcag

SEQ ID NO: 9011960 - DNA, 20 bp, Homo sapiens
ggcctgagcatggctggcag

SEQ ID NO: 9011961 - DNA, 20 bp, Homo sapiens
ggcctgagcatggctggcag

SEQ ID NO: 9011962 - DNA, 20 bp, Homo sapiens
ggcctgagcatggctggcag

SEQ ID NO: 9011963 - DNA, 20 bp, Homo sapiens
ggcctgagcatggctggcag

SEQ ID NO: 9011964 - DNA, 22 bp, Homo sapiens
ggcctgagctctggggaggcaa

SEQ ID NO: 9011965 - DNA, 22 bp, Homo sapiens
ggcctgagctctggggaggcaa

SEQ ID NO: 9011966 - DNA, 22 bp, Homo sapiens
ggcctgagctctggggaggcaa

SEQ ID NO: 9011967 - DNA, 22 bp, Homo sapiens
ggcctgagcttgggcagcgtat

SEQ ID NO: 9011968 - DNA, 22 bp, Homo sapiens
ggcctgagcttgggcagcgtat

SEQ ID NO: 9011969 - DNA, 22 bp, Homo sapiens
ggcctgagctctggggaggcaa

SEQ ID NO: 9011970 - DNA, 22 bp, Homo sapiens
ggcctgagcttgggcagcgtat

SEQ ID NO: 9011971 - DNA, 18 bp, Homo sapiens
ggcctgaggatttcagca

SEQ ID NO: 9011972 - DNA, 22 bp, Homo sapiens
ggcctgaggcaatagtcagaca

SEQ ID NO: 9011973 - DNA, 22 bp, Homo sapiens
ggcctgagcttgggcagcgtat

SEQ ID NO: 9011974 - DNA, 19 bp, Homo sapiens
ggcctgaggccacagatcc

SEQ ID NO: 9011975 - DNA, 19 bp, Homo sapiens
ggcctgaggccacagatcc

SEQ ID NO: 9011976 - DNA, 22 bp, Homo sapiens
ggcctgaggcaatagtcagaca

SEQ ID NO: 9011977 - DNA, 22 bp, Homo sapiens
ggcctgaggcaatagtcagaca

SEQ ID NO: 9011978 - DNA, 22 bp, Homo sapiens
ggcctgtgagcccttgcatgta

SEQ ID NO: 9011979 - DNA, 22 bp, Homo sapiens
ggcctgtgagcccttgcatgta

SEQ ID NO: 9011980 - DNA, 22 bp, Homo sapiens
ggcctgtgagccttagtttata

SEQ ID NO: 9011981 - DNA, 22 bp, Homo sapiens
ggcctgtgcaagacagcacccc

SEQ ID NO: 9011982 - DNA, 22 bp, Homo sapiens
ggcctgtgcacatgtgcaggaa

SEQ ID NO: 9011983 - DNA, 22 bp, Homo sapiens
ggcctgtgcacatgtgcaggaa

SEQ ID NO: 9011984 - DNA, 22 bp, Homo sapiens
ggcctgtgcacatgtgcaggaa

SEQ ID NO: 9011985 - DNA, 22 bp, Homo sapiens
ggcctgtccagcctgcctggct

SEQ ID NO: 9011986 - DNA, 22 bp, Homo sapiens
ggcctgtccagcctgcctggct

SEQ ID NO: 9011987 - DNA, 22 bp, Homo sapiens
ggcctgtaatcccagctactca

SEQ ID NO: 9011988 - DNA, 22 bp, Homo sapiens
ggcctgtccagcctgcctggct

SEQ ID NO: 9011989 - DNA, 22 bp, Homo sapiens
ggcctgtctcacccccgggtgc

SEQ ID NO: 9011990 - DNA, 22 bp, Homo sapiens
ggcctgtccagcctgcctggct

SEQ ID NO: 9011991 - DNA, 22 bp, Homo sapiens
ggcctgtctcacccccgggtgc

SEQ ID NO: 9011992 - DNA, 22 bp, Homo sapiens
ggcctgtgagaatcaaggaaaa

SEQ ID NO: 9011993 - DNA, 22 bp, Homo sapiens
ggcctgaggccaccagcagccc

SEQ ID NO: 9011994 - DNA, 22 bp, Homo sapiens
ggcctgaggccaccagcagccc

SEQ ID NO: 9011995 - DNA, 22 bp, Homo sapiens
ggcctgaggccaccagcagccc

SEQ ID NO: 9011996 - DNA, 22 bp, Homo sapiens
ggcctgaggccaccagcagccc

SEQ ID NO: 9011997 - DNA, 22 bp, Homo sapiens
ggcctgaggccaccagcagccc

SEQ ID NO: 9011998 - DNA, 22 bp, Homo sapiens
ggcctgaggccaccagcagccc

SEQ ID NO: 9011999 - DNA, 22 bp, Homo sapiens
ggcctgaggcgtcccagctgtg

SEQ ID NO: 9012000 - DNA, 22 bp, Homo sapiens
ggcctgaggcgtcccagctgtg

SEQ ID NO: 9012001 - DNA, 22 bp, Homo sapiens
ggcctgaggcgtcccagctgtg

SEQ ID NO: 9012002 - DNA, 20 bp, Homo sapiens
ggcctggtgaatgagagaat

SEQ ID NO: 9012003 - DNA, 22 bp, Homo sapiens
ggcctgggctccgggagttact

SEQ ID NO: 9012004 - DNA, 22 bp, Homo sapiens
ggcctgtgggaggacagctggg

SEQ ID NO: 9012005 - DNA, 22 bp, Homo sapiens
ggcctgtgggaggacagctggg

SEQ ID NO: 9012006 - DNA, 22 bp, Homo sapiens
ggcctgtggtttctagtaggtt

SEQ ID NO: 9012007 - DNA, 22 bp, Homo sapiens
ggcctgtgggaggacagctggg

SEQ ID NO: 9012008 - DNA, 22 bp, Homo sapiens
ggcctgtggctttggcgtctaa

SEQ ID NO: 9012009 - DNA, 22 bp, Homo sapiens
ggcctgtggctttggcgtctaa

SEQ ID NO: 9012010 - DNA, 19 bp, Homo sapiens
ggcctgtgcagagcccgtc

SEQ ID NO: 9012011 - DNA, 22 bp, Homo sapiens
ggcctgtgcacatgtgcaggaa

SEQ ID NO: 9012012 - DNA, 22 bp, Homo sapiens
ggcctgtgctgagaacctggct

SEQ ID NO: 9012013 - DNA, 22 bp, Homo sapiens
ggcctgtgctgtcagccctagt

SEQ ID NO: 9012014 - DNA, 22 bp, Homo sapiens
ggcctgtgctgagaacctggct

SEQ ID NO: 9012015 - DNA, 22 bp, Homo sapiens
ggcctgtgctgagaacctggct

SEQ ID NO: 9012016 - DNA, 22 bp, Homo sapiens
ggcctgtgtcctccttgccctg

SEQ ID NO: 9012017 - DNA, 22 bp, Homo sapiens
ggcctgtgtcctccttgccctg

SEQ ID NO: 9012018 - DNA, 22 bp, Homo sapiens
ggcctgtgtcctccttgccctg

SEQ ID NO: 9012019 - DNA, 22 bp, Homo sapiens
ggcctgtggtttctagtaggtt

SEQ ID NO: 9012020 - DNA, 22 bp, Homo sapiens
ggcctgtgtcggccccgggttc

SEQ ID NO: 9012021 - DNA, 22 bp, Homo sapiens
ggcctgtgtcctccttgccctg

SEQ ID NO: 9012022 - DNA, 22 bp, Homo sapiens
ggcctgtgtctgtgcctgtcct

SEQ ID NO: 9012023 - DNA, 22 bp, Homo sapiens
ggctcaatgcaacttctgcctc

SEQ ID NO: 9012024 - DNA, 22 bp, Homo sapiens
ggcctgtgtctgtgcctgtcct

SEQ ID NO: 9012025 - DNA, 17 bp, Homo sapiens
ggcctgtgtggctgcag

SEQ ID NO: 9012026 - DNA, 22 bp, Homo sapiens
ggcctgtgtctgtgcctgtcct

SEQ ID NO: 9012027 - DNA, 22 bp, Homo sapiens
ggctcacaacagttttctgtaa

SEQ ID NO: 9012028 - DNA, 22 bp, Homo sapiens
ggctcacacatgactgggctct

SEQ ID NO: 9012029 - DNA, 22 bp, Homo sapiens
ggctcacacatgactgggctct

SEQ ID NO: 9012030 - DNA, 22 bp, Homo sapiens
ggcctgtgtctgtgcctgtcct

SEQ ID NO: 9012031 - DNA, 18 bp, Homo sapiens
ggctcaggctatcctaac

SEQ ID NO: 9012032 - DNA, 18 bp, Homo sapiens
ggctcaggctatcctaac

SEQ ID NO: 9012033 - DNA, 22 bp, Homo sapiens
ggctcaggctggagtgcagtgg

SEQ ID NO: 9012034 - DNA, 18 bp, Homo sapiens
ggctcaggctatcctaac

SEQ ID NO: 9012035 - DNA, 22 bp, Homo sapiens
ggctcaggctggagtgcagtgg

SEQ ID NO: 9012036 - DNA, 22 bp, Homo sapiens
ggctcaggctggagtgcagtgg

SEQ ID NO: 9012037 - DNA, 22 bp, Homo sapiens
ggctcaggctggagtgcagtgg

SEQ ID NO: 9012038 - DNA, 22 bp, Homo sapiens
ggctcagggaatgaggaagaat

SEQ ID NO: 9012039 - DNA, 22 bp, Homo sapiens
ggctcagggaatgaggaagaat

SEQ ID NO: 9012040 - DNA, 22 bp, Homo sapiens
ggctcagggaatgaggaagaat

SEQ ID NO: 9012041 - DNA, 19 bp, Homo sapiens
ggctcagggcgctgccgcc

SEQ ID NO: 9012042 - DNA, 19 bp, Homo sapiens
ggctcagggcgctgccgcc

SEQ ID NO: 9012043 - DNA, 22 bp, Homo sapiens
ggctcagggaatgaggaagaat

SEQ ID NO: 9012044 - DNA, 22 bp, Homo sapiens
ggctcaggggccaggcctgtcc

SEQ ID NO: 9012045 - DNA, 22 bp, Homo sapiens
ggctcaggggccaggcctgtcc

SEQ ID NO: 9012046 - DNA, 22 bp, Homo sapiens
ggctcaggggccaggcctgtcc

SEQ ID NO: 9012047 - DNA, 22 bp, Homo sapiens
cacattcttgagttacagtcta

SEQ ID NO: 9012048 - DNA, 22 bp, Homo sapiens
cacatatacctcttcttgagtt

SEQ ID NO: 9012049 - DNA, 22 bp, Homo sapiens
cacatatatgaaatgaggaatt

SEQ ID NO: 9012050 - DNA, 23 bp, Homo sapiens
cacatatagcagccactaaggtc

SEQ ID NO: 9012051 - DNA, 23 bp, Homo sapiens
cacatatagcagccactaaggtc

SEQ ID NO: 9012052 - DNA, 22 bp, Homo sapiens
cacatagataggcagaagaaca

SEQ ID NO: 9012053 - DNA, 22 bp, Homo sapiens
cacatacttgtgtgtacatatg

SEQ ID NO: 9012054 - DNA, 22 bp, Homo sapiens
cacattctttcacagttctgaa

SEQ ID NO: 9012055 - DNA, 22 bp, Homo sapiens
cacatttacatataaaactttc

SEQ ID NO: 9012056 - DNA, 22 bp, Homo sapiens
cacatttacatataaaactttc

SEQ ID NO: 9012057 - DNA, 18 bp, Homo sapiens
cacatttacctggctccc

SEQ ID NO: 9012058 - DNA, 22 bp, Homo sapiens
cacatttacatataaaactttc

SEQ ID NO: 9012059 - DNA, 22 bp, Homo sapiens
cacatttaggttcctatagcca

SEQ ID NO: 9012060 - DNA, 22 bp, Homo sapiens
cacatttaggttcctatagcca

SEQ ID NO: 9012061 - DNA, 22 bp, Homo sapiens
cacatttaggaggtggggaagc

SEQ ID NO: 9012062 - DNA, 22 bp, Homo sapiens
cacatttatctgttctttctag

SEQ ID NO: 9012063 - DNA, 22 bp, Homo sapiens
cacatttatctgttctttctag

SEQ ID NO: 9012064 - DNA, 22 bp, Homo sapiens
cacatttatctgttctttctag

SEQ ID NO: 9012065 - DNA, 22 bp, Homo sapiens
cacatttatctctctccggtga

SEQ ID NO: 9012066 - DNA, 22 bp, Homo sapiens
cacatttagaggttagcatggt

SEQ ID NO: 9012067 - DNA, 22 bp, Homo sapiens
cacatttagaggttagcatggt

SEQ ID NO: 9012068 - DNA, 22 bp, Homo sapiens
cacatttagaggttagcatggt

SEQ ID NO: 9012069 - DNA, 18 bp, Homo sapiens
cacatttacctggctccc

SEQ ID NO: 9012070 - DNA, 22 bp, Homo sapiens
cacatttagaggttagcatggt

SEQ ID NO: 9012071 - DNA, 22 bp, Homo sapiens
cacatttatttgaggctaattg

SEQ ID NO: 9012072 - DNA, 22 bp, Homo sapiens
cacatttcattggcttacgtaa

SEQ ID NO: 9012073 - DNA, 22 bp, Homo sapiens
ggcaggcaggagcgtgcttggg

SEQ ID NO: 9012074 - DNA, 22 bp, Homo sapiens
cacatttccttggcctttaatt

SEQ ID NO: 9012075 - DNA, 22 bp, Homo sapiens
ggcaggcaggagcgtgcttggg

SEQ ID NO: 9012076 - DNA, 22 bp, Homo sapiens
ggcaggcaggtcttcatggccc

SEQ ID NO: 9012077 - DNA, 22 bp, Homo sapiens
ggcaggcaggtcttcatggccc

SEQ ID NO: 9012078 - DNA, 22 bp, Homo sapiens
ggcaggcagtgtggtgtgaaac

SEQ ID NO: 9012079 - DNA, 22 bp, Homo sapiens
ggcaggcatggccactccctag

SEQ ID NO: 9012080 - DNA, 22 bp, Homo sapiens
ggcaggcatggccactccctag

SEQ ID NO: 9012081 - DNA, 22 bp, Homo sapiens
ggcaggcatggggtctgccatt

SEQ ID NO: 9012082 - DNA, 22 bp, Homo sapiens
ggcaggcatggggtctgccatt

SEQ ID NO: 9012083 - DNA, 22 bp, Homo sapiens
ggcaggcatggccactccctag

SEQ ID NO: 9012084 - DNA, 22 bp, Homo sapiens
ggcaggcatcatcagttgatca

SEQ ID NO: 9012085 - DNA, 22 bp, Homo sapiens
ggcagggagagcatgctgataa

SEQ ID NO: 9012086 - DNA, 22 bp, Homo sapiens
ggcagggagagcatgctgataa

SEQ ID NO: 9012087 - DNA, 22 bp, Homo sapiens
ggcagggagagcatgctgataa

SEQ ID NO: 9012088 - DNA, 22 bp, Homo sapiens
ggcagggaggaggtgaaagtga

SEQ ID NO: 9012089 - DNA, 22 bp, Homo sapiens
ggcagggaggaggtgaaagtga

SEQ ID NO: 9012090 - DNA, 20 bp, Homo sapiens
ggcagggagggatactgagg

SEQ ID NO: 9012091 - DNA, 20 bp, Homo sapiens
ggcagggagggatactgagg

SEQ ID NO: 9012092 - DNA, 22 bp, Homo sapiens
ggcagggaggaggtgaaagtga

SEQ ID NO: 9012093 - DNA, 19 bp, Homo sapiens
cacatacagaaaagagtaa

SEQ ID NO: 9012094 - DNA, 19 bp, Homo sapiens
cacatacagaaaagagtaa

SEQ ID NO: 9012095 - DNA, 22 bp, Homo sapiens
cacatacatacgtatgtataca

SEQ ID NO: 9012096 - DNA, 22 bp, Homo sapiens
cacatacatacgtatgtataca

SEQ ID NO: 9012097 - DNA, 22 bp, Homo sapiens
cacatacaatggtgttatttgg

SEQ ID NO: 9012098 - DNA, 22 bp, Homo sapiens
cacatacaatggtgttatttgg

SEQ ID NO: 9012099 - DNA, 19 bp, Homo sapiens
cacatacagaaaagagtaa

SEQ ID NO: 9012100 - DNA, 22 bp, Homo sapiens
cacatacatacgtatgtataca

SEQ ID NO: 9012101 - DNA, 22 bp, Homo sapiens
cacatacatacgtatgtataca

SEQ ID NO: 9012102 - DNA, 22 bp, Homo sapiens
cacatacatacgtatgtataca

SEQ ID NO: 9012103 - DNA, 22 bp, Homo sapiens
cacatacatacgtatgtataca

SEQ ID NO: 9012104 - DNA, 22 bp, Homo sapiens
cacatacatacgtatgtataca

SEQ ID NO: 9012105 - DNA, 22 bp, Homo sapiens
cacatacatgcacacctaaata

SEQ ID NO: 9012106 - DNA, 22 bp, Homo sapiens
cacatacatgcacacctaaata

SEQ ID NO: 9012107 - DNA, 22 bp, Homo sapiens
cacatacatgcacacctaaata

SEQ ID NO: 9012108 - DNA, 22 bp, Homo sapiens
cacatacatgcacacctaaata

SEQ ID NO: 9012109 - DNA, 22 bp, Homo sapiens
cacatacatgcacacctaaata

SEQ ID NO: 9012110 - DNA, 22 bp, Homo sapiens
cacatacatgcacacctaaata

SEQ ID NO: 9012111 - DNA, 22 bp, Homo sapiens
cacatacattcatgttactcta

SEQ ID NO: 9012112 - DNA, 22 bp, Homo sapiens
cacatacattcatgttactcta

SEQ ID NO: 9012113 - DNA, 22 bp, Homo sapiens
cacatacattcatgttactcta

SEQ ID NO: 9012114 - DNA, 22 bp, Homo sapiens
cacatacttgtgtgtacatatg

SEQ ID NO: 9012115 - DNA, 22 bp, Homo sapiens
cacagttttgcccagggcttct

SEQ ID NO: 9012116 - DNA, 22 bp, Homo sapiens
cacagttttgcccagggcttct

SEQ ID NO: 9012117 - DNA, 22 bp, Homo sapiens
cacagttttgtcttggtttcca

SEQ ID NO: 9012118 - DNA, 22 bp, Homo sapiens
cacagttttgtcttggtttcca

SEQ ID NO: 9012119 - DNA, 22 bp, Homo sapiens
cacataaatggtgccatgtttt

SEQ ID NO: 9012120 - DNA, 22 bp, Homo sapiens
cacataaatggtgccatgtttt

SEQ ID NO: 9012121 - DNA, 22 bp, Homo sapiens
cacataataaatgttcctgatg

SEQ ID NO: 9012122 - DNA, 22 bp, Homo sapiens
cacataagtcccctgtgccaag

SEQ ID NO: 9012123 - DNA, 22 bp, Homo sapiens
cacatacaaggcacactggagg

SEQ ID NO: 9012124 - DNA, 22 bp, Homo sapiens
cacatacaaggcacactggagg

SEQ ID NO: 9012125 - DNA, 22 bp, Homo sapiens
cacatacaaggcacactggagg

SEQ ID NO: 9012126 - DNA, 22 bp, Homo sapiens
cacatacaatggtgttatttgg

SEQ ID NO: 9012127 - DNA, 22 bp, Homo sapiens
cacatacaatggtgttatttgg

SEQ ID NO: 9012128 - DNA, 22 bp, Homo sapiens
cacataagtgggttccattgca

SEQ ID NO: 9012129 - DNA, 22 bp, Homo sapiens
cacataatacatgttccactta

SEQ ID NO: 9012130 - DNA, 22 bp, Homo sapiens
cacataatacatgttccactta

SEQ ID NO: 9012131 - DNA, 22 bp, Homo sapiens
cacataataaatgttcctgatg

SEQ ID NO: 9012132 - DNA, 22 bp, Homo sapiens
cacataataaatgttcctgatg

SEQ ID NO: 9012133 - DNA, 22 bp, Homo sapiens
cacataattgaacgtgatgagt

SEQ ID NO: 9012134 - DNA, 22 bp, Homo sapiens
cacataatcaccaagtcctttc

SEQ ID NO: 9012135 - DNA, 22 bp, Homo sapiens
cacatacaagccatggggggat

SEQ ID NO: 9012136 - DNA, 22 bp, Homo sapiens
cacataattgaacgtgatgagt

SEQ ID NO: 9012137 - DNA, 22 bp, Homo sapiens
ggaggtggagctggaagttcca

SEQ ID NO: 9012138 - DNA, 22 bp, Homo sapiens
ggaggtggagctggaagttcca

SEQ ID NO: 9012139 - DNA, 22 bp, Homo sapiens
ggaggtggagctggaagttcca

SEQ ID NO: 9012140 - DNA, 22 bp, Homo sapiens
ggaggtggagctggaagttcca

SEQ ID NO: 9012141 - DNA, 22 bp, Homo sapiens
ggaggtgctggcggccagctct

SEQ ID NO: 9012142 - DNA, 22 bp, Homo sapiens
ggaggtggaggttgcaatgagc

SEQ ID NO: 9012143 - DNA, 22 bp, Homo sapiens
ggaggtggaggttgcaatgagc

SEQ ID NO: 9012144 - DNA, 22 bp, Homo sapiens
ggaggtggaggttgcaatgagc

SEQ ID NO: 9012145 - DNA, 22 bp, Homo sapiens
ggaggtggaggttgcaatgagc

SEQ ID NO: 9012146 - DNA, 22 bp, Homo sapiens
ggaggtggaggttgcaatgagc

SEQ ID NO: 9012147 - DNA, 22 bp, Homo sapiens
ggaggtggagctggaagttcca

SEQ ID NO: 9012148 - DNA, 22 bp, Homo sapiens
ggaggtggaggttgcaatgagc

SEQ ID NO: 9012149 - DNA, 22 bp, Homo sapiens
ggaggtggaggttgcaatgagc

SEQ ID NO: 9012150 - DNA, 22 bp, Homo sapiens
ggaggtggaggttgcagtgagc

SEQ ID NO: 9012151 - DNA, 22 bp, Homo sapiens
ggaggtggaggttgcagtgagc

SEQ ID NO: 9012152 - DNA, 22 bp, Homo sapiens
cacagtttggttttgctgtaat

SEQ ID NO: 9012153 - DNA, 22 bp, Homo sapiens
cacagtttggttttgctgtaat

SEQ ID NO: 9012154 - DNA, 22 bp, Homo sapiens
cacagttttatcttatactgat

SEQ ID NO: 9012155 - DNA, 22 bp, Homo sapiens
cacagttttatcttatactgat

SEQ ID NO: 9012156 - DNA, 22 bp, Homo sapiens
cacagttttatcttatactgat

SEQ ID NO: 9012157 - DNA, 22 bp, Homo sapiens
ggaggtcccaggcctggcagca

SEQ ID NO: 9012158 - DNA, 22 bp, Homo sapiens
ggaggtcccaggcctggcagca

SEQ ID NO: 9012159 - DNA, 22 bp, Homo sapiens
cacagggaaccaaggctgggcc

SEQ ID NO: 9012160 - DNA, 22 bp, Homo sapiens
cacagggaaccaaggctgggcc

SEQ ID NO: 9012161 - DNA, 22 bp, Homo sapiens
cacagggaaccaaggctgggcc

SEQ ID NO: 9012162 - DNA, 22 bp, Homo sapiens
cacagggaaccaaggctgggcc

SEQ ID NO: 9012163 - DNA, 22 bp, Homo sapiens
cacagggaacaactagaacaaa

SEQ ID NO: 9012164 - DNA, 22 bp, Homo sapiens
cacagggaacaactagaacaaa

SEQ ID NO: 9012165 - DNA, 22 bp, Homo sapiens
cacagggaaccaaggctgggcc

SEQ ID NO: 9012166 - DNA, 22 bp, Homo sapiens
cacaggcttttctgacataggc

SEQ ID NO: 9012167 - DNA, 22 bp, Homo sapiens
cacaggcttttttggctgatgt

SEQ ID NO: 9012168 - DNA, 22 bp, Homo sapiens
cacaggcttttttggctgatgt

SEQ ID NO: 9012169 - DNA, 22 bp, Homo sapiens
cacaggcttttttggctgatgt

SEQ ID NO: 9012170 - DNA, 22 bp, Homo sapiens
cacaggcttttttggctgatgt

SEQ ID NO: 9012171 - DNA, 22 bp, Homo sapiens
ggaggtgacgaaaagaaattgt

SEQ ID NO: 9012172 - DNA, 22 bp, Homo sapiens
ggaggtgactggatcatgggca

SEQ ID NO: 9012173 - DNA, 22 bp, Homo sapiens
ggaggtgaggccgtagggtgtg

SEQ ID NO: 9012174 - DNA, 22 bp, Homo sapiens
ggaggtgaggccgtagggtgtg

SEQ ID NO: 9012175 - DNA, 22 bp, Homo sapiens
ggaggtgaggccgtagggtgtg

SEQ ID NO: 9012176 - DNA, 22 bp, Homo sapiens
ggaggtgcagagtagggttggt

SEQ ID NO: 9012177 - DNA, 22 bp, Homo sapiens
ggaggtgctgatcccagtcaac

SEQ ID NO: 9012178 - DNA, 22 bp, Homo sapiens
ggaggtgaggccgtagggtgtg

SEQ ID NO: 9012179 - DNA, 22 bp, Homo sapiens
ggaggtgatcagagttttgagg

SEQ ID NO: 9012180 - DNA, 22 bp, Homo sapiens
ggaggtgatcagagttttgagg

SEQ ID NO: 9012181 - DNA, 22 bp, Homo sapiens
ggaggtgcagagtagggttggt

SEQ ID NO: 9012182 - DNA, 22 bp, Homo sapiens
ggcattgatgggagatggtgga

SEQ ID NO: 9012183 - DNA, 22 bp, Homo sapiens
ggcattcaaagaatggtaatta

SEQ ID NO: 9012184 - DNA, 22 bp, Homo sapiens
ggcattgttctaggtggttgga

SEQ ID NO: 9012185 - DNA, 22 bp, Homo sapiens
ggcattaggtgaatgctcagca

SEQ ID NO: 9012186 - DNA, 22 bp, Homo sapiens
ggcatcaggatctgtcttgctt

SEQ ID NO: 9012187 - DNA, 22 bp, Homo sapiens
ggcatcaggagcttcttcaggt

SEQ ID NO: 9012188 - DNA, 22 bp, Homo sapiens
ggcatcaggatctgtcttgctt

SEQ ID NO: 9012189 - DNA, 22 bp, Homo sapiens
ggcatcaggatctgtcttgctt

SEQ ID NO: 9012190 - DNA, 22 bp, Homo sapiens
ggcatcaggacagggtttctag

SEQ ID NO: 9012191 - DNA, 22 bp, Homo sapiens
ggcatcaggagcttcttcaggt

SEQ ID NO: 9012192 - DNA, 22 bp, Homo sapiens
ggcatcaggagcttcttcaggt

SEQ ID NO: 9012193 - DNA, 22 bp, Homo sapiens
ggcatcaggagcttcttcaggt

SEQ ID NO: 9012194 - DNA, 20 bp, Homo sapiens
ggcatttatgaaccaagcct

SEQ ID NO: 9012195 - DNA, 22 bp, Homo sapiens
ggcatttatttgtctcattctt

SEQ ID NO: 9012196 - DNA, 22 bp, Homo sapiens
ggccactccgctgctactggaa

SEQ ID NO: 9012197 - DNA, 19 bp, Homo sapiens
ggccactcctggtgactgg

SEQ ID NO: 9012198 - DNA, 23 bp, Homo sapiens
ggccactgaattttctgcatctt

SEQ ID NO: 9012199 - DNA, 22 bp, Homo sapiens
ggccactcggccacccctgccg

SEQ ID NO: 9012200 - DNA, 23 bp, Homo sapiens
ggccactgaattttctgcatctt

SEQ ID NO: 9012201 - DNA, 23 bp, Homo sapiens
ggccactgaattttctgcatctt

SEQ ID NO: 9012202 - DNA, 22 bp, Homo sapiens
ggccaaggatggtggctctggt

SEQ ID NO: 9012203 - DNA, 22 bp, Homo sapiens
ggccaaggatggtggctctggt

SEQ ID NO: 9012204 - DNA, 22 bp, Homo sapiens
ggccaaggatggtggctctggt

SEQ ID NO: 9012205 - DNA, 22 bp, Homo sapiens
ggccaagctctcattccagcac

SEQ ID NO: 9012206 - DNA, 22 bp, Homo sapiens
ggccaagctctcattccagcac

SEQ ID NO: 9012207 - DNA, 22 bp, Homo sapiens
ggccaaggatggtggctctggt

SEQ ID NO: 9012208 - DNA, 22 bp, Homo sapiens
ggccaaggatggtggctctggt

SEQ ID NO: 9012209 - DNA, 22 bp, Homo sapiens
ggccaccttcctgtggtctctg

SEQ ID NO: 9012210 - DNA, 21 bp, Homo sapiens
ggccaacatggtctcatctct

SEQ ID NO: 9012211 - DNA, 22 bp, Homo sapiens
ggccaaatttggccatgagcat

SEQ ID NO: 9012212 - DNA, 22 bp, Homo sapiens
ggccaaatgaaatctgagcaat

SEQ ID NO: 9012213 - DNA, 22 bp, Homo sapiens
ggccaaatctgtaaggcaagat

SEQ ID NO: 9012214 - DNA, 22 bp, Homo sapiens
ggccaaatgaaggcaatgggac

SEQ ID NO: 9012215 - DNA, 22 bp, Homo sapiens
ggccaaatttatttgcagctgg

SEQ ID NO: 9012216 - DNA, 22 bp, Homo sapiens
ggccaagatcccattatacaaa

SEQ ID NO: 9012217 - DNA, 22 bp, Homo sapiens
ggcatttttgacaaagagcaat

SEQ ID NO: 9012218 - DNA, 17 bp, Homo sapiens
ggcatttgtcaggcaga

SEQ ID NO: 9012219 - DNA, 17 bp, Homo sapiens
ggcatttgtcaggcaga

SEQ ID NO: 9012220 - DNA, 22 bp, Homo sapiens
ggcatttgactcagtgactggg

SEQ ID NO: 9012221 - DNA, 21 bp, Homo sapiens
ggcatttgccaaagtgatcct

SEQ ID NO: 9012222 - DNA, 22 bp, Homo sapiens
ggcatttttgacaaagagcaat

SEQ ID NO: 9012223 - DNA, 22 bp, Homo sapiens
ggccaaaagcataatcctcaca

SEQ ID NO: 9012224 - DNA, 22 bp, Homo sapiens
ggccaaatcctccatggtggct

SEQ ID NO: 9012225 - DNA, 22 bp, Homo sapiens
ggccaaatcctccatggtggct

SEQ ID NO: 9012226 - DNA, 22 bp, Homo sapiens
ggcaggtgcccagagagcacga

SEQ ID NO: 9012227 - DNA, 22 bp, Homo sapiens
ggcagggcaggaaagtcaggaa

SEQ ID NO: 9012228 - DNA, 22 bp, Homo sapiens
ggcaggtgatctagagtcaata

SEQ ID NO: 9012229 - DNA, 22 bp, Homo sapiens
ggcaggtgatctagagtcaata

SEQ ID NO: 9012230 - DNA, 22 bp, Homo sapiens
ggcaggtgcacctgagccatct

SEQ ID NO: 9012231 - DNA, 22 bp, Homo sapiens
ggcaggtgcacctgagccatct

SEQ ID NO: 9012232 - DNA, 22 bp, Homo sapiens
ggcaggtgcacctgagccatct

SEQ ID NO: 9012233 - DNA, 22 bp, Homo sapiens
ggcagggcaggaaagtcaggaa

SEQ ID NO: 9012234 - DNA, 22 bp, Homo sapiens
ggcagggcaggaaagtcaggaa

SEQ ID NO: 9012235 - DNA, 22 bp, Homo sapiens
ggcagggcaggaaagtcaggaa

SEQ ID NO: 9012236 - DNA, 22 bp, Homo sapiens
ggcagggcaggaaagtcaggaa

SEQ ID NO: 9012237 - DNA, 22 bp, Homo sapiens
ggcagggcaggaaagtcaggaa

SEQ ID NO: 9012238 - DNA, 22 bp, Homo sapiens
ggcagggcaggaaagtcaggaa

SEQ ID NO: 9012239 - DNA, 22 bp, Homo sapiens
ggcagggcaggaaagtcaggaa

SEQ ID NO: 9012240 - DNA, 22 bp, Homo sapiens
ggcagggcaggaaagtcaggaa

SEQ ID NO: 9012241 - DNA, 22 bp, Homo sapiens
ggcagggcagcgctgattaggg

SEQ ID NO: 9012242 - DNA, 22 bp, Homo sapiens
ggcagggcagcgctgattaggg

SEQ ID NO: 9012243 - DNA, 22 bp, Homo sapiens
ggcagggcagcgctgattaggg

SEQ ID NO: 9012244 - DNA, 22 bp, Homo sapiens
ggcagggcagcgctgattaggg

SEQ ID NO: 9012245 - DNA, 22 bp, Homo sapiens
ggcagggcagcgctgattaggg

SEQ ID NO: 9012246 - DNA, 22 bp, Homo sapiens
ggcagggagtggagactcccta

SEQ ID NO: 9012247 - DNA, 22 bp, Homo sapiens
ggcagggagtggagactcccta

SEQ ID NO: 9012248 - DNA, 22 bp, Homo sapiens
ggcagggagtggagactcccta

SEQ ID NO: 9012249 - DNA, 22 bp, Homo sapiens
ggcagggagtggagactcccta

SEQ ID NO: 9012250 - DNA, 22 bp, Homo sapiens
ggcagggagtggagactcccta

SEQ ID NO: 9012251 - DNA, 20 bp, Homo sapiens
ggcagggagggatactgagg

SEQ ID NO: 9012252 - DNA, 22 bp, Homo sapiens
ggcagggagtggagactcccta

SEQ ID NO: 9012253 - DNA, 22 bp, Homo sapiens
ggcccttgcagcaggcgctggc

SEQ ID NO: 9012254 - DNA, 22 bp, Homo sapiens
ggcccttgcagcaggcgctggc

SEQ ID NO: 9012255 - DNA, 22 bp, Homo sapiens
ggcccttgcagcaggcgctggc

SEQ ID NO: 9012256 - DNA, 22 bp, Homo sapiens
ggccctgtctgtctgcccagct

SEQ ID NO: 9012257 - DNA, 22 bp, Homo sapiens
ggccctgtggttttgcaaagtc

SEQ ID NO: 9012258 - DNA, 22 bp, Homo sapiens
ggccctgtggttttgcaaagtc

SEQ ID NO: 9012259 - DNA, 22 bp, Homo sapiens
ggccctgtggttttgcaaagtc

SEQ ID NO: 9012260 - DNA, 22 bp, Homo sapiens
ggccctgtgatggatgtattag

SEQ ID NO: 9012261 - DNA, 22 bp, Homo sapiens
ggccctgtgatggatgtattag

SEQ ID NO: 9012262 - DNA, 22 bp, Homo sapiens
ggccctgttagagctcccacaa

SEQ ID NO: 9012263 - DNA, 22 bp, Homo sapiens
ggccctgttagagctcccacaa

SEQ ID NO: 9012264 - DNA, 21 bp, Homo sapiens
ggccctggttacgcctcctct

SEQ ID NO: 9012265 - DNA, 19 bp, Homo sapiens
ggccctgtaggatgtgagt

SEQ ID NO: 9012266 - DNA, 22 bp, Homo sapiens
ggccccagggattaggccaacc

SEQ ID NO: 9012267 - DNA, 22 bp, Homo sapiens
ggccccaggtagaagatataga

SEQ ID NO: 9012268 - DNA, 22 bp, Homo sapiens
ggccccaggtagaagatataga

SEQ ID NO: 9012269 - DNA, 22 bp, Homo sapiens
ggccctgtccctggccgtctgt

SEQ ID NO: 9012270 - DNA, 22 bp, Homo sapiens
ggccctgtccccttcagttttg

SEQ ID NO: 9012271 - DNA, 22 bp, Homo sapiens
ggccctgtccctggccgtctgt

SEQ ID NO: 9012272 - DNA, 22 bp, Homo sapiens
ggccctgtcctggctgtctccg

SEQ ID NO: 9012273 - DNA, 22 bp, Homo sapiens
ggccctgtcctggctgtctccg

SEQ ID NO: 9012274 - DNA, 22 bp, Homo sapiens
ggccctgtcctggctgtctccg

SEQ ID NO: 9012275 - DNA, 22 bp, Homo sapiens
ggccctgtcctggctgtctccg

SEQ ID NO: 9012276 - DNA, 22 bp, Homo sapiens
ggccctgtgatggatgtattag

SEQ ID NO: 9012277 - DNA, 22 bp, Homo sapiens
ggccctgtctgtctgcccagct

SEQ ID NO: 9012278 - DNA, 22 bp, Homo sapiens
ggccctgtctgtctgcccagct

SEQ ID NO: 9012279 - DNA, 22 bp, Homo sapiens
ggccactgacctacatctgggg

SEQ ID NO: 9012280 - DNA, 23 bp, Homo sapiens
ggccactgaattttctgcatctt

SEQ ID NO: 9012281 - DNA, 22 bp, Homo sapiens
ggccactgccctggctacaccg

SEQ ID NO: 9012282 - DNA, 22 bp, Homo sapiens
ggccactgacctacatctgggg

SEQ ID NO: 9012283 - DNA, 22 bp, Homo sapiens
ggccactgccctggctacaccg

SEQ ID NO: 9012284 - DNA, 22 bp, Homo sapiens
ggccactgccctggctacaccg

SEQ ID NO: 9012285 - DNA, 22 bp, Homo sapiens
ggccactgcctccgccatggct

SEQ ID NO: 9012286 - DNA, 22 bp, Homo sapiens
ggccactgcctccgccatggct

SEQ ID NO: 9012287 - DNA, 22 bp, Homo sapiens
ggccactgcctccgccatggct

SEQ ID NO: 9012288 - DNA, 22 bp, Homo sapiens
ggccactgcctccgccatggct

SEQ ID NO: 9012289 - DNA, 22 bp, Homo sapiens
ggccactgctgctctggtggag

SEQ ID NO: 9012290 - DNA, 22 bp, Homo sapiens
ggccactgctgctctggtggag

SEQ ID NO: 9012291 - DNA, 22 bp, Homo sapiens
ggccactgctctccagcctggg

SEQ ID NO: 9012292 - DNA, 22 bp, Homo sapiens
ggccactgctctccagcctggg

SEQ ID NO: 9012293 - DNA, 22 bp, Homo sapiens
ggccactgcctccgccatggct

SEQ ID NO: 9012294 - DNA, 22 bp, Homo sapiens
ggccactgctctccagcctggg

SEQ ID NO: 9012295 - DNA, 22 bp, Homo sapiens
ggccactgctctccagcctggg

SEQ ID NO: 9012296 - DNA, 21 bp, Homo sapiens
ggccgccgccttgtgctctgc

SEQ ID NO: 9012297 - DNA, 22 bp, Homo sapiens
ggccgctctccggtgtggatct

SEQ ID NO: 9012298 - DNA, 22 bp, Homo sapiens
ggccgctgcgcctccaaccgag

SEQ ID NO: 9012299 - DNA, 22 bp, Homo sapiens
ggccgctctccggtgtggatct

SEQ ID NO: 9012300 - DNA, 20 bp, Homo sapiens
ggccggggagctctccaggg

SEQ ID NO: 9012301 - DNA, 22 bp, Homo sapiens
ggccggaaaggtcagattctga

SEQ ID NO: 9012302 - DNA, 22 bp, Homo sapiens
ggccggggcctccccgcgtcgc

SEQ ID NO: 9012303 - DNA, 20 bp, Homo sapiens
ggccggggagctctccaggg

SEQ ID NO: 9012304 - DNA, 22 bp, Homo sapiens
ggccgggcaggtctcagccagc

SEQ ID NO: 9012305 - DNA, 22 bp, Homo sapiens
ggccgggcaggtctcagccagc

SEQ ID NO: 9012306 - DNA, 22 bp, Homo sapiens
ggccggggcctgctcgcctgtg

SEQ ID NO: 9012307 - DNA, 22 bp, Homo sapiens
ggccgtgctccaaagtcatcgt

SEQ ID NO: 9012308 - DNA, 22 bp, Homo sapiens
cacctgggtcattgctggtgtt

SEQ ID NO: 9012309 - DNA, 22 bp, Homo sapiens
cacctgggtcattgctggtgtt

SEQ ID NO: 9012310 - DNA, 22 bp, Homo sapiens
cacctgggtcattgctggtgtt

SEQ ID NO: 9012311 - DNA, 22 bp, Homo sapiens
cacctgtacagggccgggctgg

SEQ ID NO: 9012312 - DNA, 22 bp, Homo sapiens
cacctgtacagggccgggctgg

SEQ ID NO: 9012313 - DNA, 22 bp, Homo sapiens
cacctgttgtttattcatctct

SEQ ID NO: 9012314 - DNA, 22 bp, Homo sapiens
cacctgttagctctaattttct

SEQ ID NO: 9012315 - DNA, 22 bp, Homo sapiens
cacctgttagctctaattttct

SEQ ID NO: 9012316 - DNA, 22 bp, Homo sapiens
caccttccatctccttggctag

SEQ ID NO: 9012317 - DNA, 22 bp, Homo sapiens
caccttgcattcttttaattta

SEQ ID NO: 9012318 - DNA, 22 bp, Homo sapiens
caccttgagggggaaaataatc

SEQ ID NO: 9012319 - DNA, 22 bp, Homo sapiens
caccttccatctccttggctag

SEQ ID NO: 9012320 - DNA, 22 bp, Homo sapiens
cacctttgaccttgcagcgcac

SEQ ID NO: 9012321 - DNA, 22 bp, Homo sapiens
cacctttaatgagcaccagccg

SEQ ID NO: 9012322 - DNA, 22 bp, Homo sapiens
cacctttgcaaaccaaatctga

SEQ ID NO: 9012323 - DNA, 22 bp, Homo sapiens
caccttttgtgtctgcgtttgt

SEQ ID NO: 9012324 - DNA, 22 bp, Homo sapiens
cacgacttgtggaggagcgcgg

SEQ ID NO: 9012325 - DNA, 22 bp, Homo sapiens
cacgaggccatctccttctgga

SEQ ID NO: 9012326 - DNA, 22 bp, Homo sapiens
cacgaggccatctccttctgga

SEQ ID NO: 9012327 - DNA, 22 bp, Homo sapiens
cacgagtaacacattaacatgg

SEQ ID NO: 9012328 - DNA, 22 bp, Homo sapiens
cacgagggcacacgtgggaggg

SEQ ID NO: 9012329 - DNA, 22 bp, Homo sapiens
cacgagggcacacgtgggaggg

SEQ ID NO: 9012330 - DNA, 22 bp, Homo sapiens
cacgagggcacacgtgggaggg

SEQ ID NO: 9012331 - DNA, 22 bp, Homo sapiens
ggcctctctccagtcagtgcag

SEQ ID NO: 9012332 - DNA, 22 bp, Homo sapiens
ctgtgtgcatagttgtgctcaa

SEQ ID NO: 9012333 - DNA, 22 bp, Homo sapiens
ctgtgtgcctagagggtggccg

SEQ ID NO: 9012334 - DNA, 22 bp, Homo sapiens
ctgtgtgcagggcacaatggaa

SEQ ID NO: 9012335 - DNA, 22 bp, Homo sapiens
ctgtgtgcaggtgctgggtacc

SEQ ID NO: 9012336 - DNA, 22 bp, Homo sapiens
ctgtgtgcaggtgctgggtacc

SEQ ID NO: 9012337 - DNA, 22 bp, Homo sapiens
ctgtgtgcaggtgctgggtacc

SEQ ID NO: 9012338 - DNA, 22 bp, Homo sapiens
atccagttccaaagatcattta

SEQ ID NO: 9012339 - DNA, 22 bp, Homo sapiens
atccagttccaaagatcattta

SEQ ID NO: 9012340 - DNA, 22 bp, Homo sapiens
atccagttctcagtgcttacag

SEQ ID NO: 9012341 - DNA, 22 bp, Homo sapiens
atccatacagtggaatattatt

SEQ ID NO: 9012342 - DNA, 22 bp, Homo sapiens
atccataggttttgattattaa

SEQ ID NO: 9012343 - DNA, 22 bp, Homo sapiens
ctgtgtgcagggcacaatggaa

SEQ ID NO: 9012344 - DNA, 22 bp, Homo sapiens
atccatcagaagggcaaaattt

SEQ ID NO: 9012345 - DNA, 22 bp, Homo sapiens
ctgtgtgcaacttgcagttttg

SEQ ID NO: 9012346 - DNA, 22 bp, Homo sapiens
atccatataggcagatggcaca

SEQ ID NO: 9012347 - DNA, 22 bp, Homo sapiens
atccagtcaaaattagtaaggt

SEQ ID NO: 9012348 - DNA, 22 bp, Homo sapiens
atccagtgagtgcagctgttgt

SEQ ID NO: 9012349 - DNA, 22 bp, Homo sapiens
atccagggtgtggagagagctc

SEQ ID NO: 9012350 - DNA, 22 bp, Homo sapiens
atccagggtgtggagagagctc

SEQ ID NO: 9012351 - DNA, 22 bp, Homo sapiens
atccagtatgaggtagggcttg

SEQ ID NO: 9012352 - DNA, 22 bp, Homo sapiens
atccaccctgtggtggctttct

SEQ ID NO: 9012353 - DNA, 22 bp, Homo sapiens
atccaggcattctgacttcaag

SEQ ID NO: 9012354 - DNA, 22 bp, Homo sapiens
atccaggcattctgacttcaag

SEQ ID NO: 9012355 - DNA, 22 bp, Homo sapiens
atccaggcctgagtctggtcct

SEQ ID NO: 9012356 - DNA, 22 bp, Homo sapiens
atccaggcgaatgcagaaggcc

SEQ ID NO: 9012357 - DNA, 22 bp, Homo sapiens
atccaggcgaatgcagaaggcc

SEQ ID NO: 9012358 - DNA, 22 bp, Homo sapiens
atccaggccttgaagtaccagt

SEQ ID NO: 9012359 - DNA, 22 bp, Homo sapiens
atccagggataaaagtaaggtt

SEQ ID NO: 9012360 - DNA, 22 bp, Homo sapiens
atccaggcttcagctgcctact

SEQ ID NO: 9012361 - DNA, 22 bp, Homo sapiens
atccaggcttaatgggagccac

SEQ ID NO: 9012362 - DNA, 22 bp, Homo sapiens
atccaggcttaatgggagccac

SEQ ID NO: 9012363 - DNA, 22 bp, Homo sapiens
atccaggcttaatgggagccac

SEQ ID NO: 9012364 - DNA, 22 bp, Homo sapiens
atccaggcttaatgggagccac

SEQ ID NO: 9012365 - DNA, 22 bp, Homo sapiens
atccaggctgtctaatgggaga

SEQ ID NO: 9012366 - DNA, 22 bp, Homo sapiens
atccaggctgtctaatgggaga

SEQ ID NO: 9012367 - DNA, 22 bp, Homo sapiens
atccaggctgggtgtggctact

SEQ ID NO: 9012368 - DNA, 22 bp, Homo sapiens
atccaggctgctttctatgccc

SEQ ID NO: 9012369 - DNA, 22 bp, Homo sapiens
atccaggctggagtgcattggt

SEQ ID NO: 9012370 - DNA, 22 bp, Homo sapiens
atccaggctgctatgaggatga

SEQ ID NO: 9012371 - DNA, 22 bp, Homo sapiens
atccaggctgctatgaggatga

SEQ ID NO: 9012372 - DNA, 22 bp, Homo sapiens
atccaggctgctttctatgccc

SEQ ID NO: 9012373 - DNA, 22 bp, Homo sapiens
atccaggctgcgggtctcaagt

SEQ ID NO: 9012374 - DNA, 22 bp, Homo sapiens
atccaggctgcgggtctcaagt

SEQ ID NO: 9012375 - DNA, 22 bp, Homo sapiens
ctgtgtgtcatttgtcaatcct

SEQ ID NO: 9012376 - DNA, 22 bp, Homo sapiens
ctgtgtgtcatttgtcaatcct

SEQ ID NO: 9012377 - DNA, 22 bp, Homo sapiens
ctgtgtgtcatttgtcaatcct

SEQ ID NO: 9012378 - DNA, 22 bp, Homo sapiens
ctgtgtgtcatttgtcaatcct

SEQ ID NO: 9012379 - DNA, 22 bp, Homo sapiens
ctgtgtgtcctcggacgagttt

SEQ ID NO: 9012380 - DNA, 22 bp, Homo sapiens
ctgtgtgtcatttgtcaatcct

SEQ ID NO: 9012381 - DNA, 22 bp, Homo sapiens
ctgtgtgtcctcggacgagttt

SEQ ID NO: 9012382 - DNA, 22 bp, Homo sapiens
ctgtgtgtcctcggacgagttt

SEQ ID NO: 9012383 - DNA, 22 bp, Homo sapiens
ctgtgtgtcctcggacgagttt

SEQ ID NO: 9012384 - DNA, 22 bp, Homo sapiens
atcctgaaaacttacgaagtgg

SEQ ID NO: 9012385 - DNA, 22 bp, Homo sapiens
ctgtgtgctgttagggagctgc

SEQ ID NO: 9012386 - DNA, 22 bp, Homo sapiens
ctgtgtggactggttgaggccc

SEQ ID NO: 9012387 - DNA, 22 bp, Homo sapiens
ctgtgtggcctcaagccagcct

SEQ ID NO: 9012388 - DNA, 22 bp, Homo sapiens
ctgtgtggcctcaagccagcct

SEQ ID NO: 9012389 - DNA, 22 bp, Homo sapiens
ctgtgtgctgttagggagctgc

SEQ ID NO: 9012390 - DNA, 22 bp, Homo sapiens
ctgtgtggactggttgaggccc

SEQ ID NO: 9012391 - DNA, 22 bp, Homo sapiens
ctgtgtgctgttagggagctgc

SEQ ID NO: 9012392 - DNA, 22 bp, Homo sapiens
ctgtgtgctcggatggactcgt

SEQ ID NO: 9012393 - DNA, 22 bp, Homo sapiens
ctgtgtgcctcctgtgatcagg

SEQ ID NO: 9012394 - DNA, 22 bp, Homo sapiens
ctgtgtgcctagagggtggccg

SEQ ID NO: 9012395 - DNA, 22 bp, Homo sapiens
ctgtgtgctgaaatgcagtgag

SEQ ID NO: 9012396 - DNA, 22 bp, Homo sapiens
ctgtgtgctgaaatgcagtgag

SEQ ID NO: 9012397 - DNA, 19 bp, Homo sapiens
atcctgggtcctccagctg

SEQ ID NO: 9012398 - DNA, 22 bp, Homo sapiens
atcctgggtttgtgagtttatg

SEQ ID NO: 9012399 - DNA, 19 bp, Homo sapiens
atcctgggtcctccagctg

SEQ ID NO: 9012400 - DNA, 19 bp, Homo sapiens
atcctgggtcctccagctg

SEQ ID NO: 9012401 - DNA, 19 bp, Homo sapiens
atcctgggtcctccagctg

SEQ ID NO: 9012402 - DNA, 22 bp, Homo sapiens
atcctgtctctacccatcggct

SEQ ID NO: 9012403 - DNA, 22 bp, Homo sapiens
atcctgtgaggataagcccttg

SEQ ID NO: 9012404 - DNA, 22 bp, Homo sapiens
atcctgtctctacccatcggct

SEQ ID NO: 9012405 - DNA, 22 bp, Homo sapiens
atcctgtctttgttttaaatat

SEQ ID NO: 9012406 - DNA, 22 bp, Homo sapiens
atcctgtctatgagtagataat

SEQ ID NO: 9012407 - DNA, 22 bp, Homo sapiens
atcctgtcatcatagtacttga

SEQ ID NO: 9012408 - DNA, 22 bp, Homo sapiens
atcctgggctgcaccctcagcc

SEQ ID NO: 9012409 - DNA, 22 bp, Homo sapiens
atcctgggctgcaccctcagcc

SEQ ID NO: 9012410 - DNA, 22 bp, Homo sapiens
atcctgggctgcaccctcagcc

SEQ ID NO: 9012411 - DNA, 22 bp, Homo sapiens
atcctgggcctcagaggtgtgt

SEQ ID NO: 9012412 - DNA, 19 bp, Homo sapiens
atcctgggtcctccagctg

SEQ ID NO: 9012413 - DNA, 22 bp, Homo sapiens
atcctgggtaagttccttttaa

SEQ ID NO: 9012414 - DNA, 22 bp, Homo sapiens
atcctgggggcagctggaaaca

SEQ ID NO: 9012415 - DNA, 22 bp, Homo sapiens
atcctgaaaacttacgaagtgg

SEQ ID NO: 9012416 - DNA, 22 bp, Homo sapiens
atcctgggcaaagtatgctgtc

SEQ ID NO: 9012417 - DNA, 22 bp, Homo sapiens
atcctgggcaagtcaatgtccc

SEQ ID NO: 9012418 - DNA, 22 bp, Homo sapiens
atcctgggcaaagtatgctgtc

SEQ ID NO: 9012419 - DNA, 22 bp, Homo sapiens
atcctgggcaagtcaatgtccc

SEQ ID NO: 9012420 - DNA, 22 bp, Homo sapiens
atcctgggcagtgtgtcactct

SEQ ID NO: 9012421 - DNA, 22 bp, Homo sapiens
atcctgggcagtgtgtcactct

SEQ ID NO: 9012422 - DNA, 22 bp, Homo sapiens
atcctgggcagttttgagtgct

SEQ ID NO: 9012423 - DNA, 22 bp, Homo sapiens
atcctgggcagttttgagtgct

SEQ ID NO: 9012424 - DNA, 18 bp, Homo sapiens
atcctgggccagtctttc

SEQ ID NO: 9012425 - DNA, 18 bp, Homo sapiens
atcctgggccagtctttc

SEQ ID NO: 9012426 - DNA, 18 bp, Homo sapiens
atcctgggccagtctttc

SEQ ID NO: 9012427 - DNA, 22 bp, Homo sapiens
atcctgggcagtgtgtcactct

SEQ ID NO: 9012428 - DNA, 22 bp, Homo sapiens
atcctgggcagtgtgtcactct

SEQ ID NO: 9012429 - DNA, 22 bp, Homo sapiens
atcctgggcaagtcaatgtccc

SEQ ID NO: 9012430 - DNA, 22 bp, Homo sapiens
ctgtggccttggaccagcatct

SEQ ID NO: 9012431 - DNA, 22 bp, Homo sapiens
ctgtggccttggaccagcatct

SEQ ID NO: 9012432 - DNA, 21 bp, Homo sapiens
ctgtggcctggctagcaccgt

SEQ ID NO: 9012433 - DNA, 19 bp, Homo sapiens
ctgtggcctccaggaggga

SEQ ID NO: 9012434 - DNA, 21 bp, Homo sapiens
ctgtggcctggctagcaccgt

SEQ ID NO: 9012435 - DNA, 23 bp, Homo sapiens
ctgtggccctgcttcatgcagcc

SEQ ID NO: 9012436 - DNA, 22 bp, Homo sapiens
ctgtggccctgtgatctggcac

SEQ ID NO: 9012437 - DNA, 22 bp, Homo sapiens
ctgtggccctgtgatctggcac

SEQ ID NO: 9012438 - DNA, 22 bp, Homo sapiens
ctgtggccctgtgatctggcac

SEQ ID NO: 9012439 - DNA, 19 bp, Homo sapiens
ctgtggcctccaggaggga

SEQ ID NO: 9012440 - DNA, 19 bp, Homo sapiens
ctgtggcctccaggaggga

SEQ ID NO: 9012441 - DNA, 22 bp, Homo sapiens
ctgtggagttccatcaggggag

SEQ ID NO: 9012442 - DNA, 23 bp, Homo sapiens
ctgtggccctgcttcatgcagcc

SEQ ID NO: 9012443 - DNA, 22 bp, Homo sapiens
ctgtggagttccatcaggggag

SEQ ID NO: 9012444 - DNA, 22 bp, Homo sapiens
atcagaatggagcccacatggt

SEQ ID NO: 9012445 - DNA, 22 bp, Homo sapiens
atcagaatggagcccacatggt

SEQ ID NO: 9012446 - DNA, 22 bp, Homo sapiens
atcagaatggagcccacatggt

SEQ ID NO: 9012447 - DNA, 22 bp, Homo sapiens
atcagaatgcagccagcagtta

SEQ ID NO: 9012448 - DNA, 22 bp, Homo sapiens
atcagaatgcagccagcagtta

SEQ ID NO: 9012449 - DNA, 22 bp, Homo sapiens
atcagaatgattagtaaccaat

SEQ ID NO: 9012450 - DNA, 22 bp, Homo sapiens
atcagaatgattagtaaccaat

SEQ ID NO: 9012451 - DNA, 22 bp, Homo sapiens
atcagacctgtctcctcttgcc

SEQ ID NO: 9012452 - DNA, 22 bp, Homo sapiens
atcagaccatccagcgtggatg

SEQ ID NO: 9012453 - DNA, 22 bp, Homo sapiens
atcagacaattgttgagtactg

SEQ ID NO: 9012454 - DNA, 22 bp, Homo sapiens
atcagacagggaattatagcag

SEQ ID NO: 9012455 - DNA, 20 bp, Homo sapiens
atcagacttttaggaacata

SEQ ID NO: 9012456 - DNA, 22 bp, Homo sapiens
atcagagcaatggataaaatca

SEQ ID NO: 9012457 - DNA, 22 bp, Homo sapiens
atcagagattgtagtatgtgca

SEQ ID NO: 9012458 - DNA, 22 bp, Homo sapiens
ctgtggagtgtagatgctgggt

SEQ ID NO: 9012459 - DNA, 22 bp, Homo sapiens
ctgtggagtgtagatgctgggt

SEQ ID NO: 9012460 - DNA, 22 bp, Homo sapiens
ctgtggagtgtagatgctgggt

SEQ ID NO: 9012461 - DNA, 22 bp, Homo sapiens
ctgtggagtgtagatgctgggt

SEQ ID NO: 9012462 - DNA, 22 bp, Homo sapiens
ctgtggctttgcagggcttgtt

SEQ ID NO: 9012463 - DNA, 22 bp, Homo sapiens
ctgtggctttgcagggcttgtt

SEQ ID NO: 9012464 - DNA, 22 bp, Homo sapiens
ctgtggctttgtgtctattgta

SEQ ID NO: 9012465 - DNA, 22 bp, Homo sapiens
ctgtggctttggggcggaggac

SEQ ID NO: 9012466 - DNA, 22 bp, Homo sapiens
ctgtgggaaaggatgagattgc

SEQ ID NO: 9012467 - DNA, 22 bp, Homo sapiens
ctgtggctcaattgcctactga

SEQ ID NO: 9012468 - DNA, 22 bp, Homo sapiens
ctgtggctcaattgcctactga

SEQ ID NO: 9012469 - DNA, 22 bp, Homo sapiens
ctgtggctcaattgcctactga

SEQ ID NO: 9012470 - DNA, 22 bp, Homo sapiens
ctgtggctcaaaatcccatgat

SEQ ID NO: 9012471 - DNA, 22 bp, Homo sapiens
ctgtggctcaaaatcccatgat

SEQ ID NO: 9012472 - DNA, 22 bp, Homo sapiens
ctgtggctcaaaatcccatgat

SEQ ID NO: 9012473 - DNA, 22 bp, Homo sapiens
ctgtggctatggtgtacatact

SEQ ID NO: 9012474 - DNA, 22 bp, Homo sapiens
ctgtggctaggattattcctga

SEQ ID NO: 9012475 - DNA, 22 bp, Homo sapiens
ctgtggctaggaagctgtggga

SEQ ID NO: 9012476 - DNA, 22 bp, Homo sapiens
ctgtggctaggaagctgtggga

SEQ ID NO: 9012477 - DNA, 18 bp, Homo sapiens
ctgtgggaaggctttcta

SEQ ID NO: 9012478 - DNA, 22 bp, Homo sapiens
ctgtgggaatactgcgagtgta

SEQ ID NO: 9012479 - DNA, 23 bp, Homo sapiens
ctgtgggaagtcggggagcgcgc

SEQ ID NO: 9012480 - DNA, 18 bp, Homo sapiens
ctgtgggaagagtttggg

SEQ ID NO: 9012481 - DNA, 22 bp, Homo sapiens
ctgtgggaaaggatgagattgc

SEQ ID NO: 9012482 - DNA, 22 bp, Homo sapiens
ctgtgggaacactgaggacttc

SEQ ID NO: 9012483 - DNA, 22 bp, Homo sapiens
ctgtgggagaggtgcctggatt

SEQ ID NO: 9012484 - DNA, 22 bp, Homo sapiens
ctgtgggactctgaggaaaagc

SEQ ID NO: 9012485 - DNA, 22 bp, Homo sapiens
ctgtgggagaagctagcacagg

SEQ ID NO: 9012486 - DNA, 22 bp, Homo sapiens
ctgtgggagaagttgctggagt

SEQ ID NO: 9012487 - DNA, 21 bp, Homo sapiens
ctgtgggaccaagcactggga

SEQ ID NO: 9012488 - DNA, 21 bp, Homo sapiens
ctgtgggaccaagcactggga

SEQ ID NO: 9012489 - DNA, 22 bp, Homo sapiens
ctgtgggactctgaggaaaagc

SEQ ID NO: 9012490 - DNA, 22 bp, Homo sapiens
atcctgtggctccagggagccg

SEQ ID NO: 9012491 - DNA, 22 bp, Homo sapiens
atcctgtggggcggctgcaggg

SEQ ID NO: 9012492 - DNA, 22 bp, Homo sapiens
atcctgtggctccagggagccg

SEQ ID NO: 9012493 - DNA, 22 bp, Homo sapiens
atcctgtgcaatgactgcatct

SEQ ID NO: 9012494 - DNA, 22 bp, Homo sapiens
atcctgtgagggagcatagtta

SEQ ID NO: 9012495 - DNA, 23 bp, Homo sapiens
atcctgttgtaggcagtaattag

SEQ ID NO: 9012496 - DNA, 22 bp, Homo sapiens
atcctgtttggttgtctgcctt

SEQ ID NO: 9012497 - DNA, 22 bp, Homo sapiens
atcctgtttggttgtctgcctt

SEQ ID NO: 9012498 - DNA, 20 bp, Homo sapiens
atccttaaagagaatttcta

SEQ ID NO: 9012499 - DNA, 22 bp, Homo sapiens
atcctgttagcaccttcaaact

SEQ ID NO: 9012500 - DNA, 22 bp, Homo sapiens
atcctgtgttgctactggagga

SEQ ID NO: 9012501 - DNA, 22 bp, Homo sapiens
atcctgtgttgctactggagga

SEQ ID NO: 9012502 - DNA, 22 bp, Homo sapiens
atccttaaaggaattctgattt

SEQ ID NO: 9012503 - DNA, 22 bp, Homo sapiens
atcctgttttagataagcttat

SEQ ID NO: 9012504 - DNA, 22 bp, Homo sapiens
atccttaagaaagttttctata

SEQ ID NO: 9012505 - DNA, 22 bp, Homo sapiens
cttagaacattctgcctgggaa

SEQ ID NO: 9012506 - DNA, 18 bp, Homo sapiens
cttagaacatcattcctt

SEQ ID NO: 9012507 - DNA, 18 bp, Homo sapiens
cttagaacatcattcctt

SEQ ID NO: 9012508 - DNA, 22 bp, Homo sapiens
cttagaacattctgcctgggaa

SEQ ID NO: 9012509 - DNA, 22 bp, Homo sapiens
cttagaagaatgcctaggacag

SEQ ID NO: 9012510 - DNA, 20 bp, Homo sapiens
cttagaagggacatcctggg

SEQ ID NO: 9012511 - DNA, 22 bp, Homo sapiens
cttagaaggatgtttgctgttt

SEQ ID NO: 9012512 - DNA, 22 bp, Homo sapiens
cttagaaggaacagtttagtgc

SEQ ID NO: 9012513 - DNA, 22 bp, Homo sapiens
cttagaaattgttactcattca

SEQ ID NO: 9012514 - DNA, 22 bp, Homo sapiens
cttagaaattgttactcattca

SEQ ID NO: 9012515 - DNA, 22 bp, Homo sapiens
cttagaaattgttactcattca

SEQ ID NO: 9012516 - DNA, 22 bp, Homo sapiens
cttagaaattgttactcattca

SEQ ID NO: 9012517 - DNA, 22 bp, Homo sapiens
cttagaacatacttagtgtgat

SEQ ID NO: 9012518 - DNA, 22 bp, Homo sapiens
cttagaacagtgtctgccagag

SEQ ID NO: 9012519 - DNA, 22 bp, Homo sapiens
cttagaacatacttagtgtgat

SEQ ID NO: 9012520 - DNA, 22 bp, Homo sapiens
cttagaacagtgtctgccagag

SEQ ID NO: 9012521 - DNA, 20 bp, Homo sapiens
cttagaaatttttaccctgg

SEQ ID NO: 9012522 - DNA, 20 bp, Homo sapiens
cttagaaatttttaccctgg

SEQ ID NO: 9012523 - DNA, 22 bp, Homo sapiens
cttagacatggcagctccaagt

SEQ ID NO: 9012524 - DNA, 22 bp, Homo sapiens
cttagaattttgcctactacaa

SEQ ID NO: 9012525 - DNA, 22 bp, Homo sapiens
cttagaattttgcctactacaa

SEQ ID NO: 9012526 - DNA, 22 bp, Homo sapiens
cttagaattttaatccagaaag

SEQ ID NO: 9012527 - DNA, 22 bp, Homo sapiens
cttagagatgggttttacttag

SEQ ID NO: 9012528 - DNA, 22 bp, Homo sapiens
cttagagatgggttttacttag

SEQ ID NO: 9012529 - DNA, 22 bp, Homo sapiens
cttagaatgtctactcttacca

SEQ ID NO: 9012530 - DNA, 22 bp, Homo sapiens
cttagaattttaatccagaaag

SEQ ID NO: 9012531 - DNA, 22 bp, Homo sapiens
cttagaatgggacccaatgggt

SEQ ID NO: 9012532 - DNA, 22 bp, Homo sapiens
cttagaataaaagggggctata

SEQ ID NO: 9012533 - DNA, 22 bp, Homo sapiens
cttagaagtgggctataattag

SEQ ID NO: 9012534 - DNA, 22 bp, Homo sapiens
cttagagatgggttttacttag

SEQ ID NO: 9012535 - DNA, 22 bp, Homo sapiens
cttagagatgggttttacttag

SEQ ID NO: 9012536 - DNA, 22 bp, Homo sapiens
cttagagccttactcttcttgt

SEQ ID NO: 9012537 - DNA, 22 bp, Homo sapiens
cttagagatgggttttacttag

SEQ ID NO: 9012538 - DNA, 22 bp, Homo sapiens
cttagagatgggttttacttag

SEQ ID NO: 9012539 - DNA, 22 bp, Homo sapiens
cttagagcttaggctagccatt

SEQ ID NO: 9012540 - DNA, 22 bp, Homo sapiens
cttagagatgggttttacttag

SEQ ID NO: 9012541 - DNA, 22 bp, Homo sapiens
cttagagccttactcttcttgt

SEQ ID NO: 9012542 - DNA, 22 bp, Homo sapiens
cttagagttatggaaatgttga

SEQ ID NO: 9012543 - DNA, 22 bp, Homo sapiens
cttagagcttaggctagccatt

SEQ ID NO: 9012544 - DNA, 22 bp, Homo sapiens
cttccaggtgctggcctggcct

SEQ ID NO: 9012545 - DNA, 22 bp, Homo sapiens
cttccaggtgctggcctggcct

SEQ ID NO: 9012546 - DNA, 22 bp, Homo sapiens
cttccaggtccttcttgagaag

SEQ ID NO: 9012547 - DNA, 22 bp, Homo sapiens
cttcattaactattggaatgca

SEQ ID NO: 9012548 - DNA, 22 bp, Homo sapiens
cttcattaatgtctataagttt

SEQ ID NO: 9012549 - DNA, 23 bp, Homo sapiens
cttccagtactgcacactcaagg

SEQ ID NO: 9012550 - DNA, 22 bp, Homo sapiens
cttccaggtgctggcctggcct

SEQ ID NO: 9012551 - DNA, 22 bp, Homo sapiens
cttccagtggcaccaacatgca

SEQ ID NO: 9012552 - DNA, 22 bp, Homo sapiens
cttccagtctagagctatctgt

SEQ ID NO: 9012553 - DNA, 22 bp, Homo sapiens
cttccataatcttgtttattta

SEQ ID NO: 9012554 - DNA, 22 bp, Homo sapiens
cttcccaagactgtattgcaag

SEQ ID NO: 9012555 - DNA, 22 bp, Homo sapiens
cttcccaagactgtattgcaag

SEQ ID NO: 9012556 - DNA, 22 bp, Homo sapiens
cttcccaagctttagttatttt

SEQ ID NO: 9012557 - DNA, 22 bp, Homo sapiens
cttcccacagaattcaatcagt

SEQ ID NO: 9012558 - DNA, 22 bp, Homo sapiens
cttcccaagtaaatttgtattt

SEQ ID NO: 9012559 - DNA, 22 bp, Homo sapiens
cttcccaccaaagcccttgttg

SEQ ID NO: 9012560 - DNA, 22 bp, Homo sapiens
cttcccaccaaagcccttgttg

SEQ ID NO: 9012561 - DNA, 22 bp, Homo sapiens
cttcccactaaagcccttgttg

SEQ ID NO: 9012562 - DNA, 22 bp, Homo sapiens
cttcccactaaagcccttgttg

SEQ ID NO: 9012563 - DNA, 17 bp, Homo sapiens
cttcccaccatctcctg

SEQ ID NO: 9012564 - DNA, 17 bp, Homo sapiens
cttcccaccatctcctg

SEQ ID NO: 9012565 - DNA, 22 bp, Homo sapiens
cttcctcccccacacactcact

SEQ ID NO: 9012566 - DNA, 22 bp, Homo sapiens
cttcctcccggcccatgctctg

SEQ ID NO: 9012567 - DNA, 22 bp, Homo sapiens
cttcctcccggcccatgctctg

SEQ ID NO: 9012568 - DNA, 22 bp, Homo sapiens
cttcctcccggcccatgctctg

SEQ ID NO: 9012569 - DNA, 18 bp, Homo sapiens
cttcctcatcgctctccc

SEQ ID NO: 9012570 - DNA, 22 bp, Homo sapiens
cttcctagcttcagagtctgtt

SEQ ID NO: 9012571 - DNA, 22 bp, Homo sapiens
cttcctagcttcagagtctgtt

SEQ ID NO: 9012572 - DNA, 22 bp, Homo sapiens
cttcctcaggcattagctggac

SEQ ID NO: 9012573 - DNA, 22 bp, Homo sapiens
cttcctaaaagcttcaagagaa

SEQ ID NO: 9012574 - DNA, 22 bp, Homo sapiens
cttcccactagtatcacagagc

SEQ ID NO: 9012575 - DNA, 22 bp, Homo sapiens
cttcccactagtatcacagagc

SEQ ID NO: 9012576 - DNA, 22 bp, Homo sapiens
atctgaagggaagtggaaggca

SEQ ID NO: 9012577 - DNA, 19 bp, Homo sapiens
atctgaagtaggtgcagct

SEQ ID NO: 9012578 - DNA, 22 bp, Homo sapiens
atctgaagctatctgcacttca

SEQ ID NO: 9012579 - DNA, 22 bp, Homo sapiens
atctgaagggaagtggaaggca

SEQ ID NO: 9012580 - DNA, 22 bp, Homo sapiens
atctgaagaggtcatggctgac

SEQ ID NO: 9012581 - DNA, 22 bp, Homo sapiens
atctgaagctatctgcacttca

SEQ ID NO: 9012582 - DNA, 21 bp, Homo sapiens
atctgaagtttgagaggaaag

SEQ ID NO: 9012583 - DNA, 22 bp, Homo sapiens
atctgaagtggagaaaaatata

SEQ ID NO: 9012584 - DNA, 22 bp, Homo sapiens
atctgaagtccttataatctga

SEQ ID NO: 9012585 - DNA, 22 bp, Homo sapiens
atctgaagtggagaaaaatata

SEQ ID NO: 9012586 - DNA, 22 bp, Homo sapiens
atctgaagtccttataatctga

SEQ ID NO: 9012587 - DNA, 21 bp, Homo sapiens
atctgaagtttgagaggaaag

SEQ ID NO: 9012588 - DNA, 22 bp, Homo sapiens
atctgaataaatttcttttagt

SEQ ID NO: 9012589 - DNA, 22 bp, Homo sapiens
atctgaagaatgaatggaatta

SEQ ID NO: 9012590 - DNA, 21 bp, Homo sapiens
atctgaaatgtcaaagcagat

SEQ ID NO: 9012591 - DNA, 21 bp, Homo sapiens
atctgaaatgtcaaagcagat

SEQ ID NO: 9012592 - DNA, 22 bp, Homo sapiens
atctgaagaatgaatggaatta

SEQ ID NO: 9012593 - DNA, 22 bp, Homo sapiens
atctgaagaggtcatggctgac

SEQ ID NO: 9012594 - DNA, 21 bp, Homo sapiens
atctgaaaggttagtgttgag

SEQ ID NO: 9012595 - DNA, 22 bp, Homo sapiens
atctgaaatagtcttatctgag

SEQ ID NO: 9012596 - DNA, 22 bp, Homo sapiens
atctgaaatagtcttatctgag

SEQ ID NO: 9012597 - DNA, 21 bp, Homo sapiens
atctgaaatgtcaaagcagat

SEQ ID NO: 9012598 - DNA, 21 bp, Homo sapiens
atctgaaatgtcaaagcagat

SEQ ID NO: 9012599 - DNA, 21 bp, Homo sapiens
atctgaaaggttagtgttgag

SEQ ID NO: 9012600 - DNA, 22 bp, Homo sapiens
atctgaaagtttagaattcttg

SEQ ID NO: 9012601 - DNA, 22 bp, Homo sapiens
atctgaaatagtcttatctgag

SEQ ID NO: 9012602 - DNA, 22 bp, Homo sapiens
atctgaaagctaggagttctca

SEQ ID NO: 9012603 - DNA, 21 bp, Homo sapiens
atctgaaaggttagtgttgag

SEQ ID NO: 9012604 - DNA, 22 bp, Homo sapiens
atctgaaagctaggagttctca

SEQ ID NO: 9012605 - DNA, 22 bp, Homo sapiens
atctgaaagctaggagttctca

SEQ ID NO: 9012606 - DNA, 22 bp, Homo sapiens
atctgaaagctaggagttctca

SEQ ID NO: 9012607 - DNA, 22 bp, Homo sapiens
atctgaaaagctttaatgagct

SEQ ID NO: 9012608 - DNA, 22 bp, Homo sapiens
atctgaaaagctttaatgagct

SEQ ID NO: 9012609 - DNA, 23 bp, Homo sapiens
atctgaaaaggcattttcttccc

SEQ ID NO: 9012610 - DNA, 23 bp, Homo sapiens
atctgaaaaggcattttcttccc

SEQ ID NO: 9012611 - DNA, 22 bp, Homo sapiens
atctgaaactctgacattgtct

SEQ ID NO: 9012612 - DNA, 22 bp, Homo sapiens
atctgaaactctgacattgtct

SEQ ID NO: 9012613 - DNA, 22 bp, Homo sapiens
atctgaaactctgacattgtct

SEQ ID NO: 9012614 - DNA, 22 bp, Homo sapiens
atctgaaactctgacattgtct

SEQ ID NO: 9012615 - DNA, 22 bp, Homo sapiens
atctgaaactctgacattgtct

SEQ ID NO: 9012616 - DNA, 22 bp, Homo sapiens
atctgaaactctgacattgtct

SEQ ID NO: 9012617 - DNA, 22 bp, Homo sapiens
atctgaaaagcctcttactcct

SEQ ID NO: 9012618 - DNA, 23 bp, Homo sapiens
atctgaaaagcatttgcagtttg

SEQ ID NO: 9012619 - DNA, 23 bp, Homo sapiens
atctgaaaagcatttgcagtttg

SEQ ID NO: 9012620 - DNA, 23 bp, Homo sapiens
atctgaaaagcatttgcagtttg

SEQ ID NO: 9012621 - DNA, 22 bp, Homo sapiens
atctctttgatggctcctgtga

SEQ ID NO: 9012622 - DNA, 22 bp, Homo sapiens
atctctgcatccctcaaggttg

SEQ ID NO: 9012623 - DNA, 22 bp, Homo sapiens
atctctgcgtccccagcatcga

SEQ ID NO: 9012624 - DNA, 22 bp, Homo sapiens
atctgaaaaatctcctttgtca

SEQ ID NO: 9012625 - DNA, 22 bp, Homo sapiens
atctctgcgtccccagcatcga

SEQ ID NO: 9012626 - DNA, 22 bp, Homo sapiens
atctgaaaaatctcctttgtca

SEQ ID NO: 9012627 - DNA, 22 bp, Homo sapiens
cttcctcctccatctcgaaggc

SEQ ID NO: 9012628 - DNA, 22 bp, Homo sapiens
cttcctctagcctagtaatgcc

SEQ ID NO: 9012629 - DNA, 22 bp, Homo sapiens
atctctgatttacagcatctct

SEQ ID NO: 9012630 - DNA, 22 bp, Homo sapiens
atctctgatttacagcatctct

SEQ ID NO: 9012631 - DNA, 22 bp, Homo sapiens
atctctgatttacagcatctct

SEQ ID NO: 9012632 - DNA, 22 bp, Homo sapiens
cttcctccgaagaagttgctgg

SEQ ID NO: 9012633 - DNA, 22 bp, Homo sapiens
cttcctccgaagaagttgctgg

SEQ ID NO: 9012634 - DNA, 22 bp, Homo sapiens
cttcttgattgctttcaaacca

SEQ ID NO: 9012635 - DNA, 22 bp, Homo sapiens
cttcttgcaattttcatcttat

SEQ ID NO: 9012636 - DNA, 22 bp, Homo sapiens
cttcttgattgctttcaaacca

SEQ ID NO: 9012637 - DNA, 22 bp, Homo sapiens
cttcttgcaattttcatcttat

SEQ ID NO: 9012638 - DNA, 22 bp, Homo sapiens
cttcttggaagtcgtccttcca

SEQ ID NO: 9012639 - DNA, 22 bp, Homo sapiens
cttcttaatgcataaactgtgt

SEQ ID NO: 9012640 - DNA, 22 bp, Homo sapiens
atctgcatcagactttgcatga

SEQ ID NO: 9012641 - DNA, 22 bp, Homo sapiens
atctgcagtttgttttctcttg

SEQ ID NO: 9012642 - DNA, 22 bp, Homo sapiens
cttcttgctgggggcctcagtg

SEQ ID NO: 9012643 - DNA, 22 bp, Homo sapiens
cttcttggaagtcgtccttcca

SEQ ID NO: 9012644 - DNA, 20 bp, Homo sapiens
cttcttggagatggtgtttt

SEQ ID NO: 9012645 - DNA, 22 bp, Homo sapiens
cttcttggctgcaagtctctgt

SEQ ID NO: 9012646 - DNA, 22 bp, Homo sapiens
cttcttgggctgccagtttcag

SEQ ID NO: 9012647 - DNA, 22 bp, Homo sapiens
cttcttggttggtttcattcca

SEQ ID NO: 9012648 - DNA, 22 bp, Homo sapiens
cttcttgtaaacggttccccga

SEQ ID NO: 9012649 - DNA, 22 bp, Homo sapiens
cttcttgtaaacggttccccga

SEQ ID NO: 9012650 - DNA, 22 bp, Homo sapiens
cttcttgtatctgccgccgagc

SEQ ID NO: 9012651 - DNA, 22 bp, Homo sapiens
cttcttgtatctgccgccgagc

SEQ ID NO: 9012652 - DNA, 21 bp, Homo sapiens
atctgatgtataaatacctct

SEQ ID NO: 9012653 - DNA, 22 bp, Homo sapiens
atctgcacttaagcgaggcctg

SEQ ID NO: 9012654 - DNA, 22 bp, Homo sapiens
atctgcaggaatgtgtgcagag

SEQ ID NO: 9012655 - DNA, 22 bp, Homo sapiens
atctgagggtttgggcatcagc

SEQ ID NO: 9012656 - DNA, 20 bp, Homo sapiens
atctgaggctgtcgctggaa

SEQ ID NO: 9012657 - DNA, 22 bp, Homo sapiens
atctgacaaggccacatattct

SEQ ID NO: 9012658 - DNA, 22 bp, Homo sapiens
atctgacaaggccacatattct

SEQ ID NO: 9012659 - DNA, 22 bp, Homo sapiens
atctgacaagttgtgtgtatag

SEQ ID NO: 9012660 - DNA, 22 bp, Homo sapiens
atctgacatctactagaacaga

SEQ ID NO: 9012661 - DNA, 22 bp, Homo sapiens
atctgacatctactagaacaga

SEQ ID NO: 9012662 - DNA, 22 bp, Homo sapiens
atctgagactgagtttggattt

SEQ ID NO: 9012663 - DNA, 22 bp, Homo sapiens
atctgacatctccctctgacat

SEQ ID NO: 9012664 - DNA, 19 bp, Homo sapiens
atctgagattataaacaga

SEQ ID NO: 9012665 - DNA, 19 bp, Homo sapiens
atctgagattataaacaga

SEQ ID NO: 9012666 - DNA, 19 bp, Homo sapiens
atctgaggcctcatctggg

SEQ ID NO: 9012667 - DNA, 19 bp, Homo sapiens
atctgaggcctcatctggg

SEQ ID NO: 9012668 - DNA, 22 bp, Homo sapiens
ctggctgggagcgagctgctca

SEQ ID NO: 9012669 - DNA, 22 bp, Homo sapiens
ctggctgggagcgagctgctca

SEQ ID NO: 9012670 - DNA, 22 bp, Homo sapiens
ctggctgggagcgagctgctca

SEQ ID NO: 9012671 - DNA, 22 bp, Homo sapiens
ctggctgggagcgagctgctca

SEQ ID NO: 9012672 - DNA, 22 bp, Homo sapiens
ctggctgggagcgagctgctca

SEQ ID NO: 9012673 - DNA, 22 bp, Homo sapiens
ctggctgggaagtagagtaggt

SEQ ID NO: 9012674 - DNA, 22 bp, Homo sapiens
ctggctgtgtccacagagtaag

SEQ ID NO: 9012675 - DNA, 22 bp, Homo sapiens
ctggctgtgtccacagagtaag

SEQ ID NO: 9012676 - DNA, 22 bp, Homo sapiens
ctggctgtgtcttggaggagct

SEQ ID NO: 9012677 - DNA, 22 bp, Homo sapiens
ctggctgtggtcacaggtaact

SEQ ID NO: 9012678 - DNA, 22 bp, Homo sapiens
ctggctgtggattatcacaggc

SEQ ID NO: 9012679 - DNA, 22 bp, Homo sapiens
ctggctgggagcgagctgctca

SEQ ID NO: 9012680 - DNA, 22 bp, Homo sapiens
ctggctggctgtgcccctgccg

SEQ ID NO: 9012681 - DNA, 22 bp, Homo sapiens
ctggctggctgtgcccctgccg

SEQ ID NO: 9012682 - DNA, 22 bp, Homo sapiens
ctggctgggaagtagagtaggt

SEQ ID NO: 9012683 - DNA, 22 bp, Homo sapiens
ctggctggctcatttttcattg

SEQ ID NO: 9012684 - DNA, 22 bp, Homo sapiens
ctggctggcgttttccaaaagc

SEQ ID NO: 9012685 - DNA, 22 bp, Homo sapiens
ctggctggccggaggcatccct

SEQ ID NO: 9012686 - DNA, 22 bp, Homo sapiens
ctggctggccggaggcatccct

SEQ ID NO: 9012687 - DNA, 22 bp, Homo sapiens
ctggctggccggaggcatccct

SEQ ID NO: 9012688 - DNA, 22 bp, Homo sapiens
ctggctggccggaggcatccct

SEQ ID NO: 9012689 - DNA, 22 bp, Homo sapiens
ctggctggccggagcgaggcgg

SEQ ID NO: 9012690 - DNA, 22 bp, Homo sapiens
ctggctggccggagcgaggcgg

SEQ ID NO: 9012691 - DNA, 22 bp, Homo sapiens
ctggctggccggagcgaggcgg

SEQ ID NO: 9012692 - DNA, 22 bp, Homo sapiens
ctggctggccggagcgaggcgg

SEQ ID NO: 9012693 - DNA, 22 bp, Homo sapiens
ctggctggccggagcgaggcgg

SEQ ID NO: 9012694 - DNA, 19 bp, Homo sapiens
ctggcttcaagcagtcctc

SEQ ID NO: 9012695 - DNA, 19 bp, Homo sapiens
ctggcttcaagcagtcctc

SEQ ID NO: 9012696 - DNA, 22 bp, Homo sapiens
ctggctgttttcaatgttgatg

SEQ ID NO: 9012697 - DNA, 22 bp, Homo sapiens
ctggctgtttctcctttgtcta

SEQ ID NO: 9012698 - DNA, 22 bp, Homo sapiens
ctggctgtttcaggcagtgtcc

SEQ ID NO: 9012699 - DNA, 22 bp, Homo sapiens
ctggctgtttcaggcagtgtcc

SEQ ID NO: 9012700 - DNA, 22 bp, Homo sapiens
ctggctgtgtgtcttcattcag

SEQ ID NO: 9012701 - DNA, 22 bp, Homo sapiens
ctggctgtgtcttggaggagct

SEQ ID NO: 9012702 - DNA, 22 bp, Homo sapiens
ctggctgtgtcttggaggagct

SEQ ID NO: 9012703 - DNA, 22 bp, Homo sapiens
ctggctgtgtcttggaggagct

SEQ ID NO: 9012704 - DNA, 22 bp, Homo sapiens
ctggcttccctgtcttatggaa

SEQ ID NO: 9012705 - DNA, 22 bp, Homo sapiens
ctggcttccctgtcttatggaa

SEQ ID NO: 9012706 - DNA, 22 bp, Homo sapiens
ctggcttcctcaggagcagtgg

SEQ ID NO: 9012707 - DNA, 22 bp, Homo sapiens
ctggcttcctcaggagcagtgg

SEQ ID NO: 9012708 - DNA, 22 bp, Homo sapiens
ctggcttcctcaggagcagtgg

SEQ ID NO: 9012709 - DNA, 22 bp, Homo sapiens
ctggcttccaccatggcccctg

SEQ ID NO: 9012710 - DNA, 22 bp, Homo sapiens
ctggcttccatgctgtagtggc

SEQ ID NO: 9012711 - DNA, 22 bp, Homo sapiens
ctggcttccatgctgtagtggc

SEQ ID NO: 9012712 - DNA, 22 bp, Homo sapiens
ctggcttccatgctgtagtggc

SEQ ID NO: 9012713 - DNA, 22 bp, Homo sapiens
ctggcttccatgctgtagtggc

SEQ ID NO: 9012714 - DNA, 22 bp, Homo sapiens
atatgcagtctcttgcccttct

SEQ ID NO: 9012715 - DNA, 22 bp, Homo sapiens
atatgcagtctcttgcccttct

SEQ ID NO: 9012716 - DNA, 22 bp, Homo sapiens
atatgcagtctcttgcccttct

SEQ ID NO: 9012717 - DNA, 22 bp, Homo sapiens
atatgcagtctcttgcccttct

SEQ ID NO: 9012718 - DNA, 22 bp, Homo sapiens
atatgcatatgtcaaaacttat

SEQ ID NO: 9012719 - DNA, 22 bp, Homo sapiens
atatgcagtctcttgcccttct

SEQ ID NO: 9012720 - DNA, 22 bp, Homo sapiens
atatgcagagagcatgaatagg

SEQ ID NO: 9012721 - DNA, 22 bp, Homo sapiens
atatgcagagagcatgaatagg

SEQ ID NO: 9012722 - DNA, 22 bp, Homo sapiens
ctgggctcagcaggccaaggcc

SEQ ID NO: 9012723 - DNA, 22 bp, Homo sapiens
ctgggctcagcaggccaaggcc

SEQ ID NO: 9012724 - DNA, 22 bp, Homo sapiens
atatgcacatacatacataggt

SEQ ID NO: 9012725 - DNA, 22 bp, Homo sapiens
ctgggctcagaaccttgttaag

SEQ ID NO: 9012726 - DNA, 22 bp, Homo sapiens
ctgggctcagatgagaggaagg

SEQ ID NO: 9012727 - DNA, 22 bp, Homo sapiens
ctgggctcagaaccttgttaag

SEQ ID NO: 9012728 - DNA, 22 bp, Homo sapiens
ctgggctcagatgagaggaagg

SEQ ID NO: 9012729 - DNA, 22 bp, Homo sapiens
ctgggctcagatgagaggaagg

SEQ ID NO: 9012730 - DNA, 22 bp, Homo sapiens
ctgggctcagatgagaggaagg

SEQ ID NO: 9012731 - DNA, 22 bp, Homo sapiens
ctgggctcagatgagaggaagg

SEQ ID NO: 9012732 - DNA, 22 bp, Homo sapiens
ctgggctcacctgtggctggca

SEQ ID NO: 9012733 - DNA, 22 bp, Homo sapiens
ctgggctcacctgtggctggca

SEQ ID NO: 9012734 - DNA, 22 bp, Homo sapiens
ctgggctcacctgtggctggca

SEQ ID NO: 9012735 - DNA, 20 bp, Homo sapiens
ctgggctcaagtgatcctcc

SEQ ID NO: 9012736 - DNA, 22 bp, Homo sapiens
ctgggcctggggctgttgagag

SEQ ID NO: 9012737 - DNA, 22 bp, Homo sapiens
ctggcttctgggccagggcaga

SEQ ID NO: 9012738 - DNA, 20 bp, Homo sapiens
ctggcttcgggaactagttt

SEQ ID NO: 9012739 - DNA, 22 bp, Homo sapiens
ctgggcctggtagggcttgaaa

SEQ ID NO: 9012740 - DNA, 22 bp, Homo sapiens
ctgggcctggtagggcttgaaa

SEQ ID NO: 9012741 - DNA, 22 bp, Homo sapiens
ctgggcctggtagggcttgaaa

SEQ ID NO: 9012742 - DNA, 22 bp, Homo sapiens
ctgggcctggtagggcttgaaa

SEQ ID NO: 9012743 - DNA, 22 bp, Homo sapiens
ctgggcctggggctgttgagag

SEQ ID NO: 9012744 - DNA, 22 bp, Homo sapiens
ctgggcctggtagggcttgaaa

SEQ ID NO: 9012745 - DNA, 22 bp, Homo sapiens
ctgggctcaagaagtcttccct

SEQ ID NO: 9012746 - DNA, 22 bp, Homo sapiens
ctgggcctggtagggcttgaaa

SEQ ID NO: 9012747 - DNA, 22 bp, Homo sapiens
ctgggctcaagaagtcttccct

SEQ ID NO: 9012748 - DNA, 21 bp, Homo sapiens
ctgggctcaagcaatcctttc

SEQ ID NO: 9012749 - DNA, 21 bp, Homo sapiens
ctgggctcaagcaatcctttc

SEQ ID NO: 9012750 - DNA, 21 bp, Homo sapiens
ctgggctcaagcaatcctttc

SEQ ID NO: 9012751 - DNA, 20 bp, Homo sapiens
ctgggctcaagtgatcctcc

SEQ ID NO: 9012752 - DNA, 20 bp, Homo sapiens
ctgggctcaagtgatcctcc

SEQ ID NO: 9012753 - DNA, 20 bp, Homo sapiens
ctgggctcaagtgatcctcc

SEQ ID NO: 9012754 - DNA, 22 bp, Homo sapiens
ctgggctcaagtgatccaccca

SEQ ID NO: 9012755 - DNA, 20 bp, Homo sapiens
ctgggctcaagtgagcctcc

SEQ ID NO: 9012756 - DNA, 20 bp, Homo sapiens
ctgggctcaagtgagcctcc

SEQ ID NO: 9012757 - DNA, 20 bp, Homo sapiens
ctgggctcaagtgagcctcc

SEQ ID NO: 9012758 - DNA, 22 bp, Homo sapiens
ctgggctgagctgtggaaactc

SEQ ID NO: 9012759 - DNA, 19 bp, Homo sapiens
ctgggctgaggtctgcctt

SEQ ID NO: 9012760 - DNA, 22 bp, Homo sapiens
ctgggctgagctgtggaaactc

SEQ ID NO: 9012761 - DNA, 22 bp, Homo sapiens
ctgggctgagcctgggctgtgt

SEQ ID NO: 9012762 - DNA, 19 bp, Homo sapiens
ctgggctgaggtctgcctt

SEQ ID NO: 9012763 - DNA, 19 bp, Homo sapiens
ctgggctgaggtctgcctt

SEQ ID NO: 9012764 - DNA, 22 bp, Homo sapiens
ctgggctgagcctgggctgtgt

SEQ ID NO: 9012765 - DNA, 22 bp, Homo sapiens
ctgggctgagcctgggctgtgt

SEQ ID NO: 9012766 - DNA, 22 bp, Homo sapiens
ctgggctgagcctgggctgtgt

SEQ ID NO: 9012767 - DNA, 22 bp, Homo sapiens
ctgggctgaaggctccccacac

SEQ ID NO: 9012768 - DNA, 22 bp, Homo sapiens
ctgggctgaaggctccccacac

SEQ ID NO: 9012769 - DNA, 22 bp, Homo sapiens
ctgggctgagcctgggctgtgt

SEQ ID NO: 9012770 - DNA, 22 bp, Homo sapiens
ctgggctgagcctgggctgtgt

SEQ ID NO: 9012771 - DNA, 22 bp, Homo sapiens
ctgggctgagcctgggctgtgt

SEQ ID NO: 9012772 - DNA, 22 bp, Homo sapiens
ctgggctgagcctgggctgtgt

SEQ ID NO: 9012773 - DNA, 22 bp, Homo sapiens
ctgggctgagcctgggctgtgt

SEQ ID NO: 9012774 - DNA, 22 bp, Homo sapiens
atattcttcttgttcagactat

SEQ ID NO: 9012775 - DNA, 22 bp, Homo sapiens
atattcactgggtactaaaaag

SEQ ID NO: 9012776 - DNA, 22 bp, Homo sapiens
atattcttgaagggagattata

SEQ ID NO: 9012777 - DNA, 22 bp, Homo sapiens
atattcttcttgttcagactat

SEQ ID NO: 9012778 - DNA, 22 bp, Homo sapiens
atattcactgggtactaaaaag

SEQ ID NO: 9012779 - DNA, 22 bp, Homo sapiens
atattcactgagcataaagcca

SEQ ID NO: 9012780 - DNA, 19 bp, Homo sapiens
ctgggctgaggtctgcctt

SEQ ID NO: 9012781 - DNA, 22 bp, Homo sapiens
ctgggctgaaggctccccacac

SEQ ID NO: 9012782 - DNA, 22 bp, Homo sapiens
ctgggctgaaggctccccacac

SEQ ID NO: 9012783 - DNA, 22 bp, Homo sapiens
ctgggctgaaagtgttccttga

SEQ ID NO: 9012784 - DNA, 22 bp, Homo sapiens
ctgggctgaaagtgttccttga

SEQ ID NO: 9012785 - DNA, 22 bp, Homo sapiens
ctgggctcttctcaccctgttt

SEQ ID NO: 9012786 - DNA, 22 bp, Homo sapiens
ctgggctcttctcaccctgttt

SEQ ID NO: 9012787 - DNA, 22 bp, Homo sapiens
ctgggctctggggtcccggtgc

SEQ ID NO: 9012788 - DNA, 22 bp, Homo sapiens
ctgggctctggggtcccggtgc

SEQ ID NO: 9012789 - DNA, 22 bp, Homo sapiens
ctgggctctgtgtttcagtttc

SEQ ID NO: 9012790 - DNA, 22 bp, Homo sapiens
ctgggctctgtgtttcagtttc

SEQ ID NO: 9012791 - DNA, 22 bp, Homo sapiens
ctgggctctgcggtgtcgctct

SEQ ID NO: 9012792 - DNA, 22 bp, Homo sapiens
ctgggctctggggtcccggtgc

SEQ ID NO: 9012793 - DNA, 22 bp, Homo sapiens
atattatgctaagggaaataag

SEQ ID NO: 9012794 - DNA, 22 bp, Homo sapiens
ctgggctctgcggtgtcgctct

SEQ ID NO: 9012795 - DNA, 22 bp, Homo sapiens
ctgggctctgcggtgtcgctct

SEQ ID NO: 9012796 - DNA, 22 bp, Homo sapiens
atattatagacagagtcttctg

SEQ ID NO: 9012797 - DNA, 22 bp, Homo sapiens
atattatagacagagtcttctg

SEQ ID NO: 9012798 - DNA, 22 bp, Homo sapiens
atattatagacagagtcttctg

SEQ ID NO: 9012799 - DNA, 22 bp, Homo sapiens
atattataagttatttcaagtt

SEQ ID NO: 9012800 - DNA, 22 bp, Homo sapiens
atattataagttatttcaagtt

SEQ ID NO: 9012801 - DNA, 22 bp, Homo sapiens
atattataagttatttcaagtt

SEQ ID NO: 9012802 - DNA, 22 bp, Homo sapiens
atattataagttatttcaagtt

SEQ ID NO: 9012803 - DNA, 22 bp, Homo sapiens
atattaaaactatggttttcag

SEQ ID NO: 9012804 - DNA, 22 bp, Homo sapiens
atattaaaactatggttttcag

SEQ ID NO: 9012805 - DNA, 22 bp, Homo sapiens
atatgtttttggaaagaacaca

SEQ ID NO: 9012806 - DNA, 22 bp, Homo sapiens
atatgtttttggaaagaacaca

SEQ ID NO: 9012807 - DNA, 22 bp, Homo sapiens
atatgctattgctgtaatttaa

SEQ ID NO: 9012808 - DNA, 22 bp, Homo sapiens
atatgctagtgtgcttatactt

SEQ ID NO: 9012809 - DNA, 22 bp, Homo sapiens
atatgctatgtatgtaaatgag

SEQ ID NO: 9012810 - DNA, 22 bp, Homo sapiens
atatgcattcatacttagtgga

SEQ ID NO: 9012811 - DNA, 22 bp, Homo sapiens
atatgccatactgtacaatact

SEQ ID NO: 9012812 - DNA, 22 bp, Homo sapiens
atatgcatttacctggcatata

SEQ ID NO: 9012813 - DNA, 21 bp, Homo sapiens
atatgccaaatgccagtaacc

SEQ ID NO: 9012814 - DNA, 22 bp, Homo sapiens
atatgcatctgtgtgcgtgtct

SEQ ID NO: 9012815 - DNA, 22 bp, Homo sapiens
atatgcatgcatgcttgtgaga

SEQ ID NO: 9012816 - DNA, 22 bp, Homo sapiens
atattactctgatttagtaaat

SEQ ID NO: 9012817 - DNA, 22 bp, Homo sapiens
atattaggagttaaatgtatta

SEQ ID NO: 9012818 - DNA, 22 bp, Homo sapiens
atattacttcctggtataaaat

SEQ ID NO: 9012819 - DNA, 22 bp, Homo sapiens
atattacataaacatgagtgaa

SEQ ID NO: 9012820 - DNA, 22 bp, Homo sapiens
atattacataaacatgagtgaa

SEQ ID NO: 9012821 - DNA, 22 bp, Homo sapiens
atattagtgtaggtagctaata

SEQ ID NO: 9012822 - DNA, 22 bp, Homo sapiens
atattagtttggagactacaat

SEQ ID NO: 9012823 - DNA, 22 bp, Homo sapiens
atattaggtgctcaatacatgc

SEQ ID NO: 9012824 - DNA, 22 bp, Homo sapiens
atattaggcaaggagattattt

SEQ ID NO: 9012825 - DNA, 22 bp, Homo sapiens
atattagggtctctaaattcta

SEQ ID NO: 9012826 - DNA, 22 bp, Homo sapiens
atattataagttatttcaagtt

SEQ ID NO: 9012827 - DNA, 22 bp, Homo sapiens
atattataagttatttcaagtt

SEQ ID NO: 9012828 - DNA, 22 bp, Homo sapiens
atattataagttatttcaagtt

SEQ ID NO: 9012829 - DNA, 22 bp, Homo sapiens
atattataagttatttcaagtt

SEQ ID NO: 9012830 - DNA, 22 bp, Homo sapiens
atattataagttatttcaagtt

SEQ ID NO: 9012831 - DNA, 22 bp, Homo sapiens
atattataagttatttcaagtt

SEQ ID NO: 9012832 - DNA, 22 bp, Homo sapiens
atattagtgtaggtagctaata

SEQ ID NO: 9012833 - DNA, 22 bp, Homo sapiens
atattagtttggagactacaat

SEQ ID NO: 9012834 - DNA, 22 bp, Homo sapiens
atcagaagcttgtagtctctct

SEQ ID NO: 9012835 - DNA, 22 bp, Homo sapiens
atcagaagaaatggatgtgact

SEQ ID NO: 9012836 - DNA, 22 bp, Homo sapiens
atcagaagaaatggatgtgact

SEQ ID NO: 9012837 - DNA, 22 bp, Homo sapiens
atcagaagcaggaggaatgaag

SEQ ID NO: 9012838 - DNA, 22 bp, Homo sapiens
atcagaagcaggaggaatgaag

SEQ ID NO: 9012839 - DNA, 22 bp, Homo sapiens
atcagaaggggaggtaaagaag

SEQ ID NO: 9012840 - DNA, 22 bp, Homo sapiens
atcagaaggggaggtaaagaag

SEQ ID NO: 9012841 - DNA, 22 bp, Homo sapiens
atcagaaggggaggtaaagaag

SEQ ID NO: 9012842 - DNA, 22 bp, Homo sapiens
atcagaagcttgtagtctctct

SEQ ID NO: 9012843 - DNA, 22 bp, Homo sapiens
atcagaagcttgtagtctctct

SEQ ID NO: 9012844 - DNA, 22 bp, Homo sapiens
atcagaacaaaagaacagttta

SEQ ID NO: 9012845 - DNA, 22 bp, Homo sapiens
atcagaagaaatggatgtgact

SEQ ID NO: 9012846 - DNA, 22 bp, Homo sapiens
atcagaaattgcccagctgttt

SEQ ID NO: 9012847 - DNA, 22 bp, Homo sapiens
atcagaaattgctaccagtgga

SEQ ID NO: 9012848 - DNA, 22 bp, Homo sapiens
atcagaatagtgggggacagtc

SEQ ID NO: 9012849 - DNA, 21 bp, Homo sapiens
atcagaatctctagatttgga

SEQ ID NO: 9012850 - DNA, 22 bp, Homo sapiens
atcagaatcatttcatccctat

SEQ ID NO: 9012851 - DNA, 22 bp, Homo sapiens
atcagaatactatcaacagtga

SEQ ID NO: 9012852 - DNA, 22 bp, Homo sapiens
atcagaatactatcaacagtga

SEQ ID NO: 9012853 - DNA, 20 bp, Homo sapiens
atcagaagtgatattaacca

SEQ ID NO: 9012854 - DNA, 20 bp, Homo sapiens
atcagaagtgatattaacca

SEQ ID NO: 9012855 - DNA, 20 bp, Homo sapiens
atcagaagtgatattaacca

SEQ ID NO: 9012856 - DNA, 22 bp, Homo sapiens
atcagaagtgatgtgtgttatt

SEQ ID NO: 9012857 - DNA, 22 bp, Homo sapiens
atcagaagtgatgtgtgttatt

SEQ ID NO: 9012858 - DNA, 22 bp, Homo sapiens
atcagaagttgtgcatgcatgg

SEQ ID NO: 9012859 - DNA, 22 bp, Homo sapiens
atcagaagtgatgtgtgttatt

SEQ ID NO: 9012860 - DNA, 22 bp, Homo sapiens
atcagaagttgtgcatgcatgg

SEQ ID NO: 9012861 - DNA, 22 bp, Homo sapiens
atcagaaaaatgagaagagctg

SEQ ID NO: 9012862 - DNA, 22 bp, Homo sapiens
atcagaaaaatgagaagagctg

SEQ ID NO: 9012863 - DNA, 22 bp, Homo sapiens
atcagaaaaatgagaagagctg

SEQ ID NO: 9012864 - DNA, 22 bp, Homo sapiens
atcagaaaatacccagtgttta

SEQ ID NO: 9012865 - DNA, 22 bp, Homo sapiens
atcagaaaatacccagtgttta

SEQ ID NO: 9012866 - DNA, 21 bp, Homo sapiens
atcagaaaatgtaatggagca

SEQ ID NO: 9012867 - DNA, 21 bp, Homo sapiens
atcagaaaatgtaatggagca

SEQ ID NO: 9012868 - DNA, 22 bp, Homo sapiens
atcagaaactcttagagcaggg

SEQ ID NO: 9012869 - DNA, 22 bp, Homo sapiens
atcagaaactcttagagcaggg

SEQ ID NO: 9012870 - DNA, 22 bp, Homo sapiens
atcagaaactcttagagcaggg

SEQ ID NO: 9012871 - DNA, 22 bp, Homo sapiens
atcagaaatagtcatgttactt

SEQ ID NO: 9012872 - DNA, 22 bp, Homo sapiens
atcagaaatagtcatgttactt

SEQ ID NO: 9012873 - DNA, 22 bp, Homo sapiens
atcagaaatagtcatgttactt

SEQ ID NO: 9012874 - DNA, 22 bp, Homo sapiens
atcagaaatctaggattcagaa

SEQ ID NO: 9012875 - DNA, 22 bp, Homo sapiens
atcagaaatctaggattcagaa

SEQ ID NO: 9012876 - DNA, 22 bp, Homo sapiens
atcagaaagttcatcatgtttg

SEQ ID NO: 9012877 - DNA, 22 bp, Homo sapiens
atcagaaagttcatcatgtttg

SEQ ID NO: 9012878 - DNA, 22 bp, Homo sapiens
atcagaaaggtgggcaagcaga

SEQ ID NO: 9012879 - DNA, 22 bp, Homo sapiens
atcagaaaggtgggcaagcaga

SEQ ID NO: 9012880 - DNA, 22 bp, Homo sapiens
atcagaaaggtgggcaagcaga

SEQ ID NO: 9012881 - DNA, 22 bp, Homo sapiens
atcagaaactcttagagcaggg

SEQ ID NO: 9012882 - DNA, 22 bp, Homo sapiens
atcaacatactgctcaggcatt

SEQ ID NO: 9012883 - DNA, 22 bp, Homo sapiens
atcaacatgaatttctctgaag

SEQ ID NO: 9012884 - DNA, 22 bp, Homo sapiens
atcaacatgaatttctctgaag

SEQ ID NO: 9012885 - DNA, 22 bp, Homo sapiens
atcaacatgtcataaagtgaaa

SEQ ID NO: 9012886 - DNA, 22 bp, Homo sapiens
atcaacattccaatgtggtaga

SEQ ID NO: 9012887 - DNA, 22 bp, Homo sapiens
atcaacatgtcataaagtgaaa

SEQ ID NO: 9012888 - DNA, 22 bp, Homo sapiens
atcaactgccccaaatgtattt

SEQ ID NO: 9012889 - DNA, 22 bp, Homo sapiens
atcaacttaaagaaaagatact

SEQ ID NO: 9012890 - DNA, 18 bp, Homo sapiens
atcaactgctgtttcctt

SEQ ID NO: 9012891 - DNA, 22 bp, Homo sapiens
atcaacttaaagaaaagatact

SEQ ID NO: 9012892 - DNA, 22 bp, Homo sapiens
atcacattgccagtgattaccc

SEQ ID NO: 9012893 - DNA, 22 bp, Homo sapiens
atcacattctttcaaagcagtc

SEQ ID NO: 9012894 - DNA, 22 bp, Homo sapiens
atcacattgccagtgattaccc

SEQ ID NO: 9012895 - DNA, 22 bp, Homo sapiens
atcacattgccagtgattaccc

SEQ ID NO: 9012896 - DNA, 22 bp, Homo sapiens
atcaacttgtccttgatgttaa

SEQ ID NO: 9012897 - DNA, 22 bp, Homo sapiens
atcacattatgtagtgaaaagg

SEQ ID NO: 9012898 - DNA, 22 bp, Homo sapiens
atcagaaaaacataatgttatt

SEQ ID NO: 9012899 - DNA, 22 bp, Homo sapiens
atcagaaaaacataatgttatt

SEQ ID NO: 9012900 - DNA, 22 bp, Homo sapiens
atcactttggtaccaattcagc

SEQ ID NO: 9012901 - DNA, 22 bp, Homo sapiens
atcaacaggtatggatgagatt

SEQ ID NO: 9012902 - DNA, 22 bp, Homo sapiens
atcaacaggtatggatgagatt

SEQ ID NO: 9012903 - DNA, 22 bp, Homo sapiens
atcaacagagcaaagcctgaac

SEQ ID NO: 9012904 - DNA, 22 bp, Homo sapiens
atcaacagtgaagagatcaaga

SEQ ID NO: 9012905 - DNA, 22 bp, Homo sapiens
atcaacagtgaagagatcaaga

SEQ ID NO: 9012906 - DNA, 22 bp, Homo sapiens
atcaaattatgtgctacaagaa

SEQ ID NO: 9012907 - DNA, 22 bp, Homo sapiens
atcaaattatgtgctacaagaa

SEQ ID NO: 9012908 - DNA, 23 bp, Homo sapiens
atcaaatgattggccattcagtg

SEQ ID NO: 9012909 - DNA, 23 bp, Homo sapiens
atcaaatgattggccattcagtg

SEQ ID NO: 9012910 - DNA, 23 bp, Homo sapiens
atcaaatgattggccattcagtg

SEQ ID NO: 9012911 - DNA, 22 bp, Homo sapiens
atcaaatcattgcattaatgtt

SEQ ID NO: 9012912 - DNA, 22 bp, Homo sapiens
atcaaatcattgcattaatgtt

SEQ ID NO: 9012913 - DNA, 22 bp, Homo sapiens
atcaaatataataattttcgct

SEQ ID NO: 9012914 - DNA, 22 bp, Homo sapiens
atcaaatataataattttcgct

SEQ ID NO: 9012915 - DNA, 22 bp, Homo sapiens
atcaaatataataattttcgct

SEQ ID NO: 9012916 - DNA, 22 bp, Homo sapiens
atcaaatacaaagggcataagg

SEQ ID NO: 9012917 - DNA, 22 bp, Homo sapiens
atcaaatataataattttcgct

SEQ ID NO: 9012918 - DNA, 22 bp, Homo sapiens
atcaaatacaaagggcataagg

SEQ ID NO: 9012919 - DNA, 22 bp, Homo sapiens
atcaaatacaaagggcataagg

SEQ ID NO: 9012920 - DNA, 22 bp, Homo sapiens
atcaaatataataattttcgct

SEQ ID NO: 9012921 - DNA, 22 bp, Homo sapiens
atcaaatataataattttcgct

SEQ ID NO: 9012922 - DNA, 22 bp, Homo sapiens
atcaaatacaaagggcataagg

SEQ ID NO: 9012923 - DNA, 22 bp, Homo sapiens
atcaaatacaaagggcataagg

SEQ ID NO: 9012924 - DNA, 22 bp, Homo sapiens
atcaaagttcgtaactgataac

SEQ ID NO: 9012925 - DNA, 22 bp, Homo sapiens
atcaaagttcgtaactgataac

SEQ ID NO: 9012926 - DNA, 22 bp, Homo sapiens
atcaaagttcgtaactgataac

SEQ ID NO: 9012927 - DNA, 22 bp, Homo sapiens
atcaaagttcgtaactgataac

SEQ ID NO: 9012928 - DNA, 22 bp, Homo sapiens
atcaaagtttcccagaagttgt

SEQ ID NO: 9012929 - DNA, 22 bp, Homo sapiens
atcaaataaaggtacctagctt

SEQ ID NO: 9012930 - DNA, 22 bp, Homo sapiens
atcaaataaaggtacctagctt

SEQ ID NO: 9012931 - DNA, 22 bp, Homo sapiens
atattgatcttggaactgattt

SEQ ID NO: 9012932 - DNA, 22 bp, Homo sapiens
atattcttgtgattataaagta

SEQ ID NO: 9012933 - DNA, 22 bp, Homo sapiens
atattcttgtgattataaagta

SEQ ID NO: 9012934 - DNA, 22 bp, Homo sapiens
atattcttgtgattataaagta

SEQ ID NO: 9012935 - DNA, 22 bp, Homo sapiens
atattcttgtgattataaagta

SEQ ID NO: 9012936 - DNA, 22 bp, Homo sapiens
atattcttgtgattataaagta

SEQ ID NO: 9012937 - DNA, 22 bp, Homo sapiens
atattcttgtgattataaagta

SEQ ID NO: 9012938 - DNA, 22 bp, Homo sapiens
atattcttgtgattataaagta

SEQ ID NO: 9012939 - DNA, 22 bp, Homo sapiens
atattcttgaagggagattata

SEQ ID NO: 9012940 - DNA, 22 bp, Homo sapiens
atattgatggaggtgttagaca

SEQ ID NO: 9012941 - DNA, 22 bp, Homo sapiens
atattgccagcttagtggattc

SEQ ID NO: 9012942 - DNA, 22 bp, Homo sapiens
atattgccctggggtgtaaaat

SEQ ID NO: 9012943 - DNA, 22 bp, Homo sapiens
atattgcctaggtgaatagaat

SEQ ID NO: 9012944 - DNA, 23 bp, Homo sapiens
atattgggagatagggcctttaa

SEQ ID NO: 9012945 - DNA, 18 bp, Homo sapiens
atattgggagcaggggca

SEQ ID NO: 9012946 - DNA, 22 bp, Homo sapiens
atattgggagctgagatctatt

SEQ ID NO: 9012947 - DNA, 22 bp, Homo sapiens
atattgttgactataagagtaa

SEQ ID NO: 9012948 - DNA, 22 bp, Homo sapiens
atattgttgactataagagtaa

SEQ ID NO: 9012949 - DNA, 22 bp, Homo sapiens
atattgttagtaatatttcgaa

SEQ ID NO: 9012950 - DNA, 22 bp, Homo sapiens
atattgttgactataagagtaa

SEQ ID NO: 9012951 - DNA, 22 bp, Homo sapiens
atattgttagtaatatttcgaa

SEQ ID NO: 9012952 - DNA, 22 bp, Homo sapiens
atatttaaacagggtaccaata

SEQ ID NO: 9012953 - DNA, 22 bp, Homo sapiens
atatttaaacagggtaccaata

SEQ ID NO: 9012954 - DNA, 22 bp, Homo sapiens
atatttaaacagggtaccaata

SEQ ID NO: 9012955 - DNA, 22 bp, Homo sapiens
atatttaaacagggtaccaata

SEQ ID NO: 9012956 - DNA, 22 bp, Homo sapiens
atattgtactagggttacatgt

SEQ ID NO: 9012957 - DNA, 22 bp, Homo sapiens
atattgtactagggttacatgt

SEQ ID NO: 9012958 - DNA, 22 bp, Homo sapiens
atattggtaaagtggattaaca

SEQ ID NO: 9012959 - DNA, 21 bp, Homo sapiens
atattggtatctttttaaatc

SEQ ID NO: 9012960 - DNA, 22 bp, Homo sapiens
atattgggtgtgggcatcaggg

SEQ ID NO: 9012961 - DNA, 22 bp, Homo sapiens
atattggggataattgtgctgc

SEQ ID NO: 9012962 - DNA, 22 bp, Homo sapiens
atattgggatgtttggaaatgc

SEQ ID NO: 9012963 - DNA, 22 bp, Homo sapiens
atattgggcagggaagccagtg

SEQ ID NO: 9012964 - DNA, 22 bp, Homo sapiens
atattgggattttaggttaaag

SEQ ID NO: 9012965 - DNA, 22 bp, Homo sapiens
atcaaagtgaaaagtgctgatg

SEQ ID NO: 9012966 - DNA, 22 bp, Homo sapiens
atcaaagtgaaaagtgctgatg

SEQ ID NO: 9012967 - DNA, 22 bp, Homo sapiens
atcaaagtgatttgtaaacagg

SEQ ID NO: 9012968 - DNA, 22 bp, Homo sapiens
atcaaagtgatttgtaaacagg

SEQ ID NO: 9012969 - DNA, 22 bp, Homo sapiens
atcaaagtgatttgtaaacagg

SEQ ID NO: 9012970 - DNA, 22 bp, Homo sapiens
atcaaagtccatcagaaggtag

SEQ ID NO: 9012971 - DNA, 22 bp, Homo sapiens
atcaaagtccatcagaaggtag

SEQ ID NO: 9012972 - DNA, 22 bp, Homo sapiens
atcaaagtatctcaatatggta

SEQ ID NO: 9012973 - DNA, 22 bp, Homo sapiens
atcaaagtccatcagaaggtag

SEQ ID NO: 9012974 - DNA, 22 bp, Homo sapiens
atcaaagttcgtaactgataac

SEQ ID NO: 9012975 - DNA, 22 bp, Homo sapiens
atcaaagtggttttctgtgctt

SEQ ID NO: 9012976 - DNA, 23 bp, Homo sapiens
atcaaagtggaaatcaattatct

SEQ ID NO: 9012977 - DNA, 23 bp, Homo sapiens
atcaaagtggaaatcaattatct

SEQ ID NO: 9012978 - DNA, 22 bp, Homo sapiens
atcaaagtggaagtttactagg

SEQ ID NO: 9012979 - DNA, 22 bp, Homo sapiens
atcaaagtatctcaatatggta

SEQ ID NO: 9012980 - DNA, 22 bp, Homo sapiens
atcaaagtaggcatatgttttt

SEQ ID NO: 9012981 - DNA, 22 bp, Homo sapiens
atcaaagtaattaacactgaga

SEQ ID NO: 9012982 - DNA, 22 bp, Homo sapiens
atcaaagtaattaacactgaga

SEQ ID NO: 9012983 - DNA, 22 bp, Homo sapiens
atcaaagtaattaacactgaga

SEQ ID NO: 9012984 - DNA, 22 bp, Homo sapiens
atcaaaggtatctatgctgtct

SEQ ID NO: 9012985 - DNA, 22 bp, Homo sapiens
atcaaagtaattaacactgaga

SEQ ID NO: 9012986 - DNA, 22 bp, Homo sapiens
atcaaaggtatctatgctgtct

SEQ ID NO: 9012987 - DNA, 22 bp, Homo sapiens
atcaaagagcttgacaatccta

SEQ ID NO: 9012988 - DNA, 22 bp, Homo sapiens
atcaaagagtgagatttttact

SEQ ID NO: 9012989 - DNA, 22 bp, Homo sapiens
atcaaagagtgagatttttact

SEQ ID NO: 9012990 - DNA, 20 bp, Homo sapiens
atcaaaggctgattcagtcc

SEQ ID NO: 9012991 - DNA, 23 bp, Homo sapiens
atcaaaggatgtagagaagaagc

SEQ ID NO: 9012992 - DNA, 22 bp, Homo sapiens
atcaaaatgctccagtgatggt

SEQ ID NO: 9012993 - DNA, 22 bp, Homo sapiens
atcaaaatggaagaatttggct

SEQ ID NO: 9012994 - DNA, 22 bp, Homo sapiens
atcaaaatggaagaatttggct

SEQ ID NO: 9012995 - DNA, 22 bp, Homo sapiens
atattttggggtgatgtgcatc

SEQ ID NO: 9012996 - DNA, 22 bp, Homo sapiens
atattttggggtgatgtgcatc

SEQ ID NO: 9012997 - DNA, 22 bp, Homo sapiens
atcaaaatgctccagtgatggt

SEQ ID NO: 9012998 - DNA, 22 bp, Homo sapiens
atcaaaatgctccagtgatggt

SEQ ID NO: 9012999 - DNA, 22 bp, Homo sapiens
atcaaaatgctccagtgatggt

SEQ ID NO: 9013000 - DNA, 22 bp, Homo sapiens
atcaaaatggaagaatttggct

SEQ ID NO: 9013001 - DNA, 22 bp, Homo sapiens
atcaaagaatgtgactgaaata

SEQ ID NO: 9013002 - DNA, 22 bp, Homo sapiens
atcaaagaatgtgactgaaata

SEQ ID NO: 9013003 - DNA, 22 bp, Homo sapiens
atcaaagaatgtgactgaaata

SEQ ID NO: 9013004 - DNA, 22 bp, Homo sapiens
atattttggcaaatgtctagat

SEQ ID NO: 9013005 - DNA, 22 bp, Homo sapiens
atattttggcaaatgtctagat

SEQ ID NO: 9013006 - DNA, 22 bp, Homo sapiens
atattttggcaaatgtctagat

SEQ ID NO: 9013007 - DNA, 22 bp, Homo sapiens
atatttactgctgtggtgaagg

SEQ ID NO: 9013008 - DNA, 22 bp, Homo sapiens
atatttaactggtcccaatata

SEQ ID NO: 9013009 - DNA, 22 bp, Homo sapiens
atatttactgctgtggtgaagg

SEQ ID NO: 9013010 - DNA, 22 bp, Homo sapiens
atatttaactggtcccaatata

SEQ ID NO: 9013011 - DNA, 22 bp, Homo sapiens
atatttaaacagggtaccaata

SEQ ID NO: 9013012 - DNA, 22 bp, Homo sapiens
atatttaactggtcccaatata

SEQ ID NO: 9013013 - DNA, 22 bp, Homo sapiens
atatttaactggtcccaatata

SEQ ID NO: 9013014 - DNA, 17 bp, Homo sapiens
atacaaagccataaacc

SEQ ID NO: 9013015 - DNA, 17 bp, Homo sapiens
atacaaagccataaacc

SEQ ID NO: 9013016 - DNA, 22 bp, Homo sapiens
ataatttactaagctctacctt

SEQ ID NO: 9013017 - DNA, 22 bp, Homo sapiens
ataatttggcttcctagatgta

SEQ ID NO: 9013018 - DNA, 22 bp, Homo sapiens
atacaaagctaaatatggtttc

SEQ ID NO: 9013019 - DNA, 22 bp, Homo sapiens
atacaaagctaaatatggtttc

SEQ ID NO: 9013020 - DNA, 22 bp, Homo sapiens
atacaaagctaaatatggtttc

SEQ ID NO: 9013021 - DNA, 22 bp, Homo sapiens
ataatttactaagctctacctt

SEQ ID NO: 9013022 - DNA, 22 bp, Homo sapiens
ataatttggcttcctagatgta

SEQ ID NO: 9013023 - DNA, 21 bp, Homo sapiens
ataagcatgctgattacattt

SEQ ID NO: 9013024 - DNA, 21 bp, Homo sapiens
ataagcatgctgattacattt

SEQ ID NO: 9013025 - DNA, 21 bp, Homo sapiens
ataagcatgctgattacattt

SEQ ID NO: 9013026 - DNA, 22 bp, Homo sapiens
ataagcatgattaccgggagca

SEQ ID NO: 9013027 - DNA, 22 bp, Homo sapiens
ataagcagggtcaaatgcctac

SEQ ID NO: 9013028 - DNA, 22 bp, Homo sapiens
ataagattgtcatagtatggac

SEQ ID NO: 9013029 - DNA, 22 bp, Homo sapiens
ataagcagggtcaaatgcctac

SEQ ID NO: 9013030 - DNA, 22 bp, Homo sapiens
ataagatataaatccacagagt

SEQ ID NO: 9013031 - DNA, 22 bp, Homo sapiens
ataagatgagatcagctttctg

SEQ ID NO: 9013032 - DNA, 22 bp, Homo sapiens
ataagagtcttgttttcttatt

SEQ ID NO: 9013033 - DNA, 22 bp, Homo sapiens
ataagagtcttgttttcttatt

SEQ ID NO: 9013034 - DNA, 22 bp, Homo sapiens
ataagagtcttgttttcttatt

SEQ ID NO: 9013035 - DNA, 22 bp, Homo sapiens
ataagaggaattacagaagagg

SEQ ID NO: 9013036 - DNA, 22 bp, Homo sapiens
ataagaggaattacagaagagg

SEQ ID NO: 9013037 - DNA, 17 bp, Homo sapiens
ataagacagaagacaat

SEQ ID NO: 9013038 - DNA, 22 bp, Homo sapiens
ataagagctatggtgggagttg

SEQ ID NO: 9013039 - DNA, 22 bp, Homo sapiens
ataagagctatggtgggagttg

SEQ ID NO: 9013040 - DNA, 22 bp, Homo sapiens
ataacttaatgggtcatgctct

SEQ ID NO: 9013041 - DNA, 22 bp, Homo sapiens
ataacttagagtaggcaaaagt

SEQ ID NO: 9013042 - DNA, 22 bp, Homo sapiens
ataacttagagtaggcaaaagt

SEQ ID NO: 9013043 - DNA, 22 bp, Homo sapiens
ataacttattagattggagctg

SEQ ID NO: 9013044 - DNA, 23 bp, Homo sapiens
ataactgagccgaggcttaagaa

SEQ ID NO: 9013045 - DNA, 22 bp, Homo sapiens
ataacttaatgggtcatgctct

SEQ ID NO: 9013046 - DNA, 22 bp, Homo sapiens
ataactggaaggacacgtgtgt

SEQ ID NO: 9013047 - DNA, 22 bp, Homo sapiens
ataacttgatgttatttgtcca

SEQ ID NO: 9013048 - DNA, 22 bp, Homo sapiens
ataacttcagggctgtgacaga

SEQ ID NO: 9013049 - DNA, 22 bp, Homo sapiens
ataagaaacattattctttcca

SEQ ID NO: 9013050 - DNA, 22 bp, Homo sapiens
ataagaaacattattctttcca

SEQ ID NO: 9013051 - DNA, 22 bp, Homo sapiens
ataagaataattaagttagtcc

SEQ ID NO: 9013052 - DNA, 22 bp, Homo sapiens
ataagaaacattattctttcca

SEQ ID NO: 9013053 - DNA, 22 bp, Homo sapiens
ataagaataattaagttagtcc

SEQ ID NO: 9013054 - DNA, 22 bp, Homo sapiens
ataagaataattaagttagtcc

SEQ ID NO: 9013055 - DNA, 22 bp, Homo sapiens
ataagacacgcaaataggtacg

SEQ ID NO: 9013056 - DNA, 17 bp, Homo sapiens
ataagacagaagacaat

SEQ ID NO: 9013057 - DNA, 17 bp, Homo sapiens
ataagacagaagacaat

SEQ ID NO: 9013058 - DNA, 22 bp, Homo sapiens
ataagagctacagccagttctg

SEQ ID NO: 9013059 - DNA, 17 bp, Homo sapiens
ataagacagaagacaat

SEQ ID NO: 9013060 - DNA, 22 bp, Homo sapiens
ataagacacgcaaataggtacg

SEQ ID NO: 9013061 - DNA, 22 bp, Homo sapiens
ataagacacgcaaataggtacg

SEQ ID NO: 9013062 - DNA, 22 bp, Homo sapiens
ataagaataattaagttagtcc

SEQ ID NO: 9013063 - DNA, 22 bp, Homo sapiens
ataagacacgccccactcactc

SEQ ID NO: 9013064 - DNA, 22 bp, Homo sapiens
atacaaattataggccccatcc

SEQ ID NO: 9013065 - DNA, 22 bp, Homo sapiens
atacaaattataggccccatcc

SEQ ID NO: 9013066 - DNA, 22 bp, Homo sapiens
atacaaattataggccccatcc

SEQ ID NO: 9013067 - DNA, 22 bp, Homo sapiens
atacaaatcctctgggatggta

SEQ ID NO: 9013068 - DNA, 22 bp, Homo sapiens
atacaaatcctctgggatggta

SEQ ID NO: 9013069 - DNA, 22 bp, Homo sapiens
atacaaatcctctgggatggta

SEQ ID NO: 9013070 - DNA, 22 bp, Homo sapiens
atacaaagtattgatcctgagt

SEQ ID NO: 9013071 - DNA, 22 bp, Homo sapiens
atacaaagtattgatcctgagt

SEQ ID NO: 9013072 - DNA, 22 bp, Homo sapiens
atacaaagtattgatcctgagt

SEQ ID NO: 9013073 - DNA, 22 bp, Homo sapiens
atacaaagtattgatcctgagt

SEQ ID NO: 9013074 - DNA, 22 bp, Homo sapiens
atacaaagtattaatcctggat

SEQ ID NO: 9013075 - DNA, 22 bp, Homo sapiens
atacaaagtattgatcctgagt

SEQ ID NO: 9013076 - DNA, 22 bp, Homo sapiens
atacaaaggaacacaggcatgt

SEQ ID NO: 9013077 - DNA, 22 bp, Homo sapiens
atacaaaggaacacaggcatgt

SEQ ID NO: 9013078 - DNA, 22 bp, Homo sapiens
atacaaaggaacacaggcatgt

SEQ ID NO: 9013079 - DNA, 22 bp, Homo sapiens
atacaaaggaacacaggcatgt

SEQ ID NO: 9013080 - DNA, 22 bp, Homo sapiens
atacaaaggaacacaggcatgt

SEQ ID NO: 9013081 - DNA, 22 bp, Homo sapiens
atacaaagtattaatcctggat

SEQ ID NO: 9013082 - DNA, 22 bp, Homo sapiens
atacaacagaaaatgattattc

SEQ ID NO: 9013083 - DNA, 22 bp, Homo sapiens
atacaacagaaaatgattattc

SEQ ID NO: 9013084 - DNA, 22 bp, Homo sapiens
atacaaatttatagatgcattt

SEQ ID NO: 9013085 - DNA, 22 bp, Homo sapiens
atacaaatttatagatgcattt

SEQ ID NO: 9013086 - DNA, 22 bp, Homo sapiens
atacaacagaaaatgattattc

SEQ ID NO: 9013087 - DNA, 22 bp, Homo sapiens
atacaacagaaaatgattattc

SEQ ID NO: 9013088 - DNA, 22 bp, Homo sapiens
atacaacagaaaatgattattc

SEQ ID NO: 9013089 - DNA, 22 bp, Homo sapiens
atacaacagaaaatgattattc

SEQ ID NO: 9013090 - DNA, 22 bp, Homo sapiens
atacaaatttatagatgcattt

SEQ ID NO: 9013091 - DNA, 22 bp, Homo sapiens
atacaaatttatagatgcattt

SEQ ID NO: 9013092 - DNA, 22 bp, Homo sapiens
atacaaatttatagatgcattt

SEQ ID NO: 9013093 - DNA, 22 bp, Homo sapiens
atacaaatttatagatgcattt

SEQ ID NO: 9013094 - DNA, 22 bp, Homo sapiens
atacaaatttatagatgcattt

SEQ ID NO: 9013095 - DNA, 22 bp, Homo sapiens
atacaaatttatagatgcattt

SEQ ID NO: 9013096 - DNA, 22 bp, Homo sapiens
atacaaatttatagatgcattt

SEQ ID NO: 9013097 - DNA, 22 bp, Homo sapiens
ctgctgaggtatactatgtgac

SEQ ID NO: 9013098 - DNA, 22 bp, Homo sapiens
ctgctgaggtccttgctcagac

SEQ ID NO: 9013099 - DNA, 22 bp, Homo sapiens
ctgctgaggtccttgctcagac

SEQ ID NO: 9013100 - DNA, 22 bp, Homo sapiens
ctgctgaggtggagattgcagt

SEQ ID NO: 9013101 - DNA, 22 bp, Homo sapiens
ctgctgaggtccttgctcagac

SEQ ID NO: 9013102 - DNA, 22 bp, Homo sapiens
ctgctgaggtccttgctcagac

SEQ ID NO: 9013103 - DNA, 22 bp, Homo sapiens
ctgctgaggtccttgctcagac

SEQ ID NO: 9013104 - DNA, 22 bp, Homo sapiens
ctgctgattcttaaatgtggtt

SEQ ID NO: 9013105 - DNA, 22 bp, Homo sapiens
ctgctgattcttaaatgtggtt

SEQ ID NO: 9013106 - DNA, 22 bp, Homo sapiens
ctgctgcaactctttagagggt

SEQ ID NO: 9013107 - DNA, 22 bp, Homo sapiens
ctgctgattcttaaatgtggtt

SEQ ID NO: 9013108 - DNA, 22 bp, Homo sapiens
ctgctgatcgaatcagtcaccc

SEQ ID NO: 9013109 - DNA, 22 bp, Homo sapiens
ctgctgatgtaagccatgctct

SEQ ID NO: 9013110 - DNA, 22 bp, Homo sapiens
ctgctgatgacctcaaactctt

SEQ ID NO: 9013111 - DNA, 22 bp, Homo sapiens
ctgctgatcagggcaaagcaaa

SEQ ID NO: 9013112 - DNA, 22 bp, Homo sapiens
atacaactgctctcagataagt

SEQ ID NO: 9013113 - DNA, 22 bp, Homo sapiens
atacaactgctctcagataagt

SEQ ID NO: 9013114 - DNA, 22 bp, Homo sapiens
atacaactgctctcagataagt

SEQ ID NO: 9013115 - DNA, 22 bp, Homo sapiens
atacaactgccttagaaggaaa

SEQ ID NO: 9013116 - DNA, 22 bp, Homo sapiens
atacaactgccttagaaggaaa

SEQ ID NO: 9013117 - DNA, 22 bp, Homo sapiens
atacaactgctctcagataagt

SEQ ID NO: 9013118 - DNA, 22 bp, Homo sapiens
atacaactgccttagaaggaaa

SEQ ID NO: 9013119 - DNA, 22 bp, Homo sapiens
atacaactttatctgtaatgag

SEQ ID NO: 9013120 - DNA, 22 bp, Homo sapiens
atacaactttacatgcaattcc

SEQ ID NO: 9013121 - DNA, 22 bp, Homo sapiens
atacaactttacatgcaattcc

SEQ ID NO: 9013122 - DNA, 22 bp, Homo sapiens
atacaactttacatgcaattcc

SEQ ID NO: 9013123 - DNA, 22 bp, Homo sapiens
ctgctgaggtatactatgtgac

SEQ ID NO: 9013124 - DNA, 22 bp, Homo sapiens
ctgctgaggtatactatgtgac

SEQ ID NO: 9013125 - DNA, 22 bp, Homo sapiens
ctgctgaggccttccctgtcct

SEQ ID NO: 9013126 - DNA, 22 bp, Homo sapiens
ctgctgaggctccggaccaagt

SEQ ID NO: 9013127 - DNA, 20 bp, Homo sapiens
ctgccgaccacagccatgga

SEQ ID NO: 9013128 - DNA, 22 bp, Homo sapiens
ctgccctttgaaagaacgtctt

SEQ ID NO: 9013129 - DNA, 22 bp, Homo sapiens
ctgccctttgaaagaacgtctt

SEQ ID NO: 9013130 - DNA, 22 bp, Homo sapiens
ctgccctttgaaagaacgtctt

SEQ ID NO: 9013131 - DNA, 22 bp, Homo sapiens
ctgccctgtttggacagcccgg

SEQ ID NO: 9013132 - DNA, 22 bp, Homo sapiens
ctgcctctcagcctgaccgcca

SEQ ID NO: 9013133 - DNA, 22 bp, Homo sapiens
ctgcctctcagcctgaccgcca

SEQ ID NO: 9013134 - DNA, 20 bp, Homo sapiens
ctgccgaccacagccatgga

SEQ ID NO: 9013135 - DNA, 22 bp, Homo sapiens
ctgcctctcagcctgaccgcca

SEQ ID NO: 9013136 - DNA, 22 bp, Homo sapiens
ctgcctctcagcctgaccgcca

SEQ ID NO: 9013137 - DNA, 22 bp, Homo sapiens
ctgcctctcaggtccctgagat

SEQ ID NO: 9013138 - DNA, 22 bp, Homo sapiens
ctgcctctcaggtccctgagat

SEQ ID NO: 9013139 - DNA, 22 bp, Homo sapiens
ctgcctctcaggtccctgagat

SEQ ID NO: 9013140 - DNA, 22 bp, Homo sapiens
ctgcctctcaggtccctgagat

SEQ ID NO: 9013141 - DNA, 22 bp, Homo sapiens
ctgcctctcaggtccctgagat

SEQ ID NO: 9013142 - DNA, 22 bp, Homo sapiens
ctgcctctcaggtccctgagat

SEQ ID NO: 9013143 - DNA, 22 bp, Homo sapiens
ctgcctctccccagagtggccc

SEQ ID NO: 9013144 - DNA, 22 bp, Homo sapiens
ctgcctctccccagagtggccc

SEQ ID NO: 9013145 - DNA, 22 bp, Homo sapiens
ctgcctctccccagagtggccc

SEQ ID NO: 9013146 - DNA, 22 bp, Homo sapiens
ataaatgattcagcaggaaata

SEQ ID NO: 9013147 - DNA, 22 bp, Homo sapiens
ataaatgattcagcaggaaata

SEQ ID NO: 9013148 - DNA, 22 bp, Homo sapiens
ataaatgattcagcaggaaata

SEQ ID NO: 9013149 - DNA, 22 bp, Homo sapiens
ataaatgaacattcacagagct

SEQ ID NO: 9013150 - DNA, 22 bp, Homo sapiens
ataaatgcctcagaatcatccc

SEQ ID NO: 9013151 - DNA, 22 bp, Homo sapiens
ataaatgattcagcaggaaata

SEQ ID NO: 9013152 - DNA, 22 bp, Homo sapiens
ataaatgtgaaatgagcagtta

SEQ ID NO: 9013153 - DNA, 22 bp, Homo sapiens
ataaatgtgaaatgagcagtta

SEQ ID NO: 9013154 - DNA, 22 bp, Homo sapiens
ataaatgcctcagaatcatccc

SEQ ID NO: 9013155 - DNA, 22 bp, Homo sapiens
ataaatgcctcagaatcatccc

SEQ ID NO: 9013156 - DNA, 22 bp, Homo sapiens
ctgcctctgcgtcccacagagt

SEQ ID NO: 9013157 - DNA, 22 bp, Homo sapiens
ctgcctctccccagagtggccc

SEQ ID NO: 9013158 - DNA, 22 bp, Homo sapiens
ctgcctctgcgtcccacagagt

SEQ ID NO: 9013159 - DNA, 22 bp, Homo sapiens
ctgcctctgcgtcccacagagt

SEQ ID NO: 9013160 - DNA, 22 bp, Homo sapiens
ctgcctctgcgtcccacagagt

SEQ ID NO: 9013161 - DNA, 22 bp, Homo sapiens
ctgcctctgcgtcccacagagt

SEQ ID NO: 9013162 - DNA, 22 bp, Homo sapiens
ctgcctctgcgtcccacagagt

SEQ ID NO: 9013163 - DNA, 22 bp, Homo sapiens
ctgcctctgcgtcccacagagt

SEQ ID NO: 9013164 - DNA, 22 bp, Homo sapiens
ctgcctctgcgtcccacagagt

SEQ ID NO: 9013165 - DNA, 22 bp, Homo sapiens
ataaatctcttaagactcaaca

SEQ ID NO: 9013166 - DNA, 22 bp, Homo sapiens
ataaatgaacattcacagagct

SEQ ID NO: 9013167 - DNA, 22 bp, Homo sapiens
ataaatgaacattcacagagct

SEQ ID NO: 9013168 - DNA, 22 bp, Homo sapiens
ataaatgaacattcacagagct

SEQ ID NO: 9013169 - DNA, 22 bp, Homo sapiens
ataaatgaacattcacagagct

SEQ ID NO: 9013170 - DNA, 22 bp, Homo sapiens
ataacatgacctgtgcttcaca

SEQ ID NO: 9013171 - DNA, 22 bp, Homo sapiens
ataacatggagtttgtcattta

SEQ ID NO: 9013172 - DNA, 22 bp, Homo sapiens
ataacatgagccagattgaaag

SEQ ID NO: 9013173 - DNA, 22 bp, Homo sapiens
ataacatggagtttgtcattta

SEQ ID NO: 9013174 - DNA, 22 bp, Homo sapiens
ataacagtgacctctcagcacc

SEQ ID NO: 9013175 - DNA, 22 bp, Homo sapiens
ataacagtgacctctcagcacc

SEQ ID NO: 9013176 - DNA, 22 bp, Homo sapiens
ataacatgacctgtgcttcaca

SEQ ID NO: 9013177 - DNA, 22 bp, Homo sapiens
ataacatgacctgtgcttcaca

SEQ ID NO: 9013178 - DNA, 22 bp, Homo sapiens
ataacagatgtgaagtgctaat

SEQ ID NO: 9013179 - DNA, 22 bp, Homo sapiens
ataacagatgtgaagtgctaat

SEQ ID NO: 9013180 - DNA, 22 bp, Homo sapiens
ataacagatgcttcagcataaa

SEQ ID NO: 9013181 - DNA, 22 bp, Homo sapiens
ataacagatactctctgtgagg

SEQ ID NO: 9013182 - DNA, 22 bp, Homo sapiens
ataacagatgcttcagcataaa

SEQ ID NO: 9013183 - DNA, 22 bp, Homo sapiens
ataacctggatataaacagatg

SEQ ID NO: 9013184 - DNA, 22 bp, Homo sapiens
ataacatggagtttgtcattta

SEQ ID NO: 9013185 - DNA, 22 bp, Homo sapiens
ataacattttgacaactggtga

SEQ ID NO: 9013186 - DNA, 22 bp, Homo sapiens
ataacattttgacaactggtga

SEQ ID NO: 9013187 - DNA, 22 bp, Homo sapiens
ataactctgtttttttcatgca

SEQ ID NO: 9013188 - DNA, 22 bp, Homo sapiens
ataactgagagcaatctttctt

SEQ ID NO: 9013189 - DNA, 22 bp, Homo sapiens
ataactctgtttttttcatgca

SEQ ID NO: 9013190 - DNA, 19 bp, Homo sapiens
ataactacattggctcagt

SEQ ID NO: 9013191 - DNA, 22 bp, Homo sapiens
ataacctgtttcagacatttgt

SEQ ID NO: 9013192 - DNA, 22 bp, Homo sapiens
ataacgaaggctgatgcgggat

SEQ ID NO: 9013193 - DNA, 22 bp, Homo sapiens
ataacctggtagtattaaatgt

SEQ ID NO: 9013194 - DNA, 22 bp, Homo sapiens
ataacctggtagtattaaatgt

SEQ ID NO: 9013195 - DNA, 22 bp, Homo sapiens
ataaattaggatctggggttcc

SEQ ID NO: 9013196 - DNA, 22 bp, Homo sapiens
ataaattaggatctggggttcc

SEQ ID NO: 9013197 - DNA, 22 bp, Homo sapiens
ataaattaggatctggggttcc

SEQ ID NO: 9013198 - DNA, 22 bp, Homo sapiens
ataaattaggatctggggttcc

SEQ ID NO: 9013199 - DNA, 22 bp, Homo sapiens
ataaattaggatctggggttcc

SEQ ID NO: 9013200 - DNA, 22 bp, Homo sapiens
ataacagagttgggaagtgaaa

SEQ ID NO: 9013201 - DNA, 22 bp, Homo sapiens
ataacagagttgggaagtgaaa

SEQ ID NO: 9013202 - DNA, 22 bp, Homo sapiens
ataaattatgaatggccctttt

SEQ ID NO: 9013203 - DNA, 22 bp, Homo sapiens
ataacagatactctctgtgagg

SEQ ID NO: 9013204 - DNA, 22 bp, Homo sapiens
ataacagatactctctgtgagg

SEQ ID NO: 9013205 - DNA, 22 bp, Homo sapiens
ataacagatactctctgtgagg

SEQ ID NO: 9013206 - DNA, 22 bp, Homo sapiens
ataaatgtttgttgaatgaata

SEQ ID NO: 9013207 - DNA, 22 bp, Homo sapiens
ataaatgtttgttgaatgaata

SEQ ID NO: 9013208 - DNA, 22 bp, Homo sapiens
ataaatgtttgttgaatgaata

SEQ ID NO: 9013209 - DNA, 22 bp, Homo sapiens
ataaatgtttgttgaatgaata

SEQ ID NO: 9013210 - DNA, 22 bp, Homo sapiens
ataaatgtttgttgaatgaata

SEQ ID NO: 9013211 - DNA, 23 bp, Homo sapiens
ataaattactatctccctagagc

SEQ ID NO: 9013212 - DNA, 23 bp, Homo sapiens
ataaattactatctccctagagc

SEQ ID NO: 9013213 - DNA, 23 bp, Homo sapiens
ataaattactatctccctagagc

SEQ ID NO: 9013214 - DNA, 23 bp, Homo sapiens
ataaattactatctccctagagc

SEQ ID NO: 9013215 - DNA, 23 bp, Homo sapiens
ataaattactatctccctagagc

SEQ ID NO: 9013216 - DNA, 23 bp, Homo sapiens
ataaattactatctccctagagc

SEQ ID NO: 9013217 - DNA, 22 bp, Homo sapiens
ataaatgtgaattagagctttg

SEQ ID NO: 9013218 - DNA, 22 bp, Homo sapiens
ataaatgtgaattagagctttg

SEQ ID NO: 9013219 - DNA, 22 bp, Homo sapiens
ataaatgtgaattagagctttg

SEQ ID NO: 9013220 - DNA, 22 bp, Homo sapiens
ataaatgtgaattagagctttg

SEQ ID NO: 9013221 - DNA, 22 bp, Homo sapiens
ataaatgtgaattagagctttg

SEQ ID NO: 9013222 - DNA, 22 bp, Homo sapiens
ataaatgtgaattagagctttg

SEQ ID NO: 9013223 - DNA, 22 bp, Homo sapiens
ataaatgtgaaatgagcagtta

SEQ ID NO: 9013224 - DNA, 22 bp, Homo sapiens
ataaatgtgaaatgagcagtta

SEQ ID NO: 9013225 - DNA, 22 bp, Homo sapiens
ataaatgtgaaatgagcagtta

SEQ ID NO: 9013226 - DNA, 22 bp, Homo sapiens
ctgcattcatatcagatagaag

SEQ ID NO: 9013227 - DNA, 22 bp, Homo sapiens
ctgcattacagcctccttagga

SEQ ID NO: 9013228 - DNA, 22 bp, Homo sapiens
ctgcatgttttcttaattgtga

SEQ ID NO: 9013229 - DNA, 22 bp, Homo sapiens
ctgcatgtgttatatttggttc

SEQ ID NO: 9013230 - DNA, 22 bp, Homo sapiens
ctgcatgtcactctgctgtccc

SEQ ID NO: 9013231 - DNA, 22 bp, Homo sapiens
ctgcatgtttacatttttgaga

SEQ ID NO: 9013232 - DNA, 22 bp, Homo sapiens
ctgcatgtgtttctgctgggtt

SEQ ID NO: 9013233 - DNA, 20 bp, Homo sapiens
ctgcatctgtgacttgcaaa

SEQ ID NO: 9013234 - DNA, 22 bp, Homo sapiens
ctgcatctgcataatcaacttc

SEQ ID NO: 9013235 - DNA, 22 bp, Homo sapiens
ctgcatctgcataatcaacttc

SEQ ID NO: 9013236 - DNA, 21 bp, Homo sapiens
ctgcatctgagtcattatgcc

SEQ ID NO: 9013237 - DNA, 22 bp, Homo sapiens
ctgcatctctgtgccagagggc

SEQ ID NO: 9013238 - DNA, 21 bp, Homo sapiens
ctgcatctcatagaacatgtc

SEQ ID NO: 9013239 - DNA, 21 bp, Homo sapiens
ctgcatctcatagaacatgtc

SEQ ID NO: 9013240 - DNA, 22 bp, Homo sapiens
ctgcatcttagtcaaaatctgt

SEQ ID NO: 9013241 - DNA, 22 bp, Homo sapiens
ctgcatctgttagattatcacc

SEQ ID NO: 9013242 - DNA, 22 bp, Homo sapiens
ctgcatgagctgtcagtggagg

SEQ ID NO: 9013243 - DNA, 21 bp, Homo sapiens
ctgcatctcatagaacatgtc

SEQ ID NO: 9013244 - DNA, 22 bp, Homo sapiens
ctgcatcccagggagcaatggg

SEQ ID NO: 9013245 - DNA, 22 bp, Homo sapiens
ctgcatccatgttgctgcaaag

SEQ ID NO: 9013246 - DNA, 22 bp, Homo sapiens
ctgcatccatgttgctgcaaag

SEQ ID NO: 9013247 - DNA, 22 bp, Homo sapiens
ctgcagggtttcgccagttgtg

SEQ ID NO: 9013248 - DNA, 22 bp, Homo sapiens
ctgcagggtttcgccagttgtg

SEQ ID NO: 9013249 - DNA, 22 bp, Homo sapiens
ctgcagggttttaacaatggac

SEQ ID NO: 9013250 - DNA, 22 bp, Homo sapiens
ctgcagggtttttcaaggacaa

SEQ ID NO: 9013251 - DNA, 22 bp, Homo sapiens
ctgcagggttttaacaatggac

SEQ ID NO: 9013252 - DNA, 22 bp, Homo sapiens
ctgcagggttttaacaatggac

SEQ ID NO: 9013253 - DNA, 20 bp, Homo sapiens
ctgcagggttagaggctcca

SEQ ID NO: 9013254 - DNA, 20 bp, Homo sapiens
ctgcagggttagaggctcca

SEQ ID NO: 9013255 - DNA, 20 bp, Homo sapiens
ctgcagggttagaggctcca

SEQ ID NO: 9013256 - DNA, 22 bp, Homo sapiens
ctgcagggttcggagagttccc

SEQ ID NO: 9013257 - DNA, 22 bp, Homo sapiens
ctgcagggttcggagagttccc

SEQ ID NO: 9013258 - DNA, 22 bp, Homo sapiens
ctgcagggttcggagagttccc

SEQ ID NO: 9013259 - DNA, 22 bp, Homo sapiens
ctgcagggtttcgccagttgtg

SEQ ID NO: 9013260 - DNA, 22 bp, Homo sapiens
ctgcagggttcggagagttccc

SEQ ID NO: 9013261 - DNA, 22 bp, Homo sapiens
ctgcagggttcggagagttccc

SEQ ID NO: 9013262 - DNA, 22 bp, Homo sapiens
ctgcagggtttcgccagttgtg

SEQ ID NO: 9013263 - DNA, 22 bp, Homo sapiens
ctgcagggtttcgccagttgtg

SEQ ID NO: 9013264 - DNA, 22 bp, Homo sapiens
ctgcagggtttcgccagttgtg

SEQ ID NO: 9013265 - DNA, 22 bp, Homo sapiens
ctgcagggtttcgccagttgtg

SEQ ID NO: 9013266 - DNA, 20 bp, Homo sapiens
ctgcagggttagaggctcca

SEQ ID NO: 9013267 - DNA, 20 bp, Homo sapiens
ctgcagggtgagtgggcgat

SEQ ID NO: 9013268 - DNA, 20 bp, Homo sapiens
ctgcagggttagaggctcca

SEQ ID NO: 9013269 - DNA, 20 bp, Homo sapiens
ctgcagggttagaggctcca

SEQ ID NO: 9013270 - DNA, 20 bp, Homo sapiens
ctgcagggtgagtgggcgat

SEQ ID NO: 9013271 - DNA, 20 bp, Homo sapiens
ctgcagggtgagtgggcgat

SEQ ID NO: 9013272 - DNA, 20 bp, Homo sapiens
ctgcagggtgagtgggcgat

SEQ ID NO: 9013273 - DNA, 22 bp, Homo sapiens
ctgcaggggtgtcctgtattgg

SEQ ID NO: 9013274 - DNA, 22 bp, Homo sapiens
ctgcaggggtgtcctgtattgg

SEQ ID NO: 9013275 - DNA, 22 bp, Homo sapiens
ctgcagggtgacgttgcccacc

SEQ ID NO: 9013276 - DNA, 20 bp, Homo sapiens
ctgcagggtgagtgggcgat

SEQ ID NO: 9013277 - DNA, 22 bp, Homo sapiens
ctgcagggtgacgttgcccacc

SEQ ID NO: 9013278 - DNA, 22 bp, Homo sapiens
ctgcagggtgacgttgcccacc

SEQ ID NO: 9013279 - DNA, 20 bp, Homo sapiens
ctgcagggtgagtgggcgat

SEQ ID NO: 9013280 - DNA, 22 bp, Homo sapiens
ctgcagagatgaagaaggtggc

SEQ ID NO: 9013281 - DNA, 22 bp, Homo sapiens
ctgcagagatgaagaaggtggc

SEQ ID NO: 9013282 - DNA, 22 bp, Homo sapiens
ctgcagagcaagtaacatcctc

SEQ ID NO: 9013283 - DNA, 22 bp, Homo sapiens
ctgcagagatgaagaaggtggc

SEQ ID NO: 9013284 - DNA, 22 bp, Homo sapiens
ctgcagagcaagtaacatcctc

SEQ ID NO: 9013285 - DNA, 22 bp, Homo sapiens
ctgcagggagaggggacagcct

SEQ ID NO: 9013286 - DNA, 22 bp, Homo sapiens
ctgcagggagaggggacagcct

SEQ ID NO: 9013287 - DNA, 22 bp, Homo sapiens
ctgcagagcaagtaacatcctc

SEQ ID NO: 9013288 - DNA, 22 bp, Homo sapiens
ctgcagagcaagtaacatcctc

SEQ ID NO: 9013289 - DNA, 22 bp, Homo sapiens
ctgcaggggtgtcctgtattgg

SEQ ID NO: 9013290 - DNA, 22 bp, Homo sapiens
ctgcaggggctggagttggctt

SEQ ID NO: 9013291 - DNA, 22 bp, Homo sapiens
ctgcagagagtaactgaaatat

SEQ ID NO: 9013292 - DNA, 22 bp, Homo sapiens
ctgcagagagtaactgaaatat

SEQ ID NO: 9013293 - DNA, 22 bp, Homo sapiens
ctgcagagagtgccgggcagcc

SEQ ID NO: 9013294 - DNA, 22 bp, Homo sapiens
ctgcagagagtgccgggcagcc

SEQ ID NO: 9013295 - DNA, 22 bp, Homo sapiens
ctgcagagagtgccgggcagcc

SEQ ID NO: 9013296 - DNA, 22 bp, Homo sapiens
ctgcagagatgaagaaggtggc

SEQ ID NO: 9013297 - DNA, 22 bp, Homo sapiens
ctgcagagatgaagaaggtggc

SEQ ID NO: 9013298 - DNA, 22 bp, Homo sapiens
ctgcacacatatggcttctctc

SEQ ID NO: 9013299 - DNA, 22 bp, Homo sapiens
ctgcacaactagggcgtttgat

SEQ ID NO: 9013300 - DNA, 23 bp, Homo sapiens
ctgcagagaactgagggacagcc

SEQ ID NO: 9013301 - DNA, 23 bp, Homo sapiens
ctgcagagaactgagggacagcc

SEQ ID NO: 9013302 - DNA, 23 bp, Homo sapiens
ctgcagagaactgagggacagcc

SEQ ID NO: 9013303 - DNA, 22 bp, Homo sapiens
ctgcagagacctaggtcaggtt

SEQ ID NO: 9013304 - DNA, 22 bp, Homo sapiens
ctgcagagaattgtggggcttc

SEQ ID NO: 9013305 - DNA, 23 bp, Homo sapiens
ctgcagagaactgagggacagcc

SEQ ID NO: 9013306 - DNA, 22 bp, Homo sapiens
ctgcagagaattgtggggcttc

SEQ ID NO: 9013307 - DNA, 22 bp, Homo sapiens
ctgcagagaattgtggggcttc

SEQ ID NO: 9013308 - DNA, 22 bp, Homo sapiens
ctgcagagaattgtggggcttc

SEQ ID NO: 9013309 - DNA, 20 bp, Homo sapiens
ctgcaagcaggttattccag

SEQ ID NO: 9013310 - DNA, 20 bp, Homo sapiens
ctgcaagcaggttattccag

SEQ ID NO: 9013311 - DNA, 22 bp, Homo sapiens
ctgcaagattggaagatgcaat

SEQ ID NO: 9013312 - DNA, 22 bp, Homo sapiens
ctgcaactctagtccagggctg

SEQ ID NO: 9013313 - DNA, 22 bp, Homo sapiens
ctgcaactctctccagaggctg

SEQ ID NO: 9013314 - DNA, 22 bp, Homo sapiens
ctgcaagatgttgtcatatgct

SEQ ID NO: 9013315 - DNA, 22 bp, Homo sapiens
ctgcaaggagttgacattgtct

SEQ ID NO: 9013316 - DNA, 22 bp, Homo sapiens
ctgcaaggctggggtgagctgg

SEQ ID NO: 9013317 - DNA, 20 bp, Homo sapiens
ctgcaagcaggttattccag

SEQ ID NO: 9013318 - DNA, 22 bp, Homo sapiens
ctgcaagtatctaccattctct

SEQ ID NO: 9013319 - DNA, 22 bp, Homo sapiens
ctgcaaggtccacctgctacat

SEQ ID NO: 9013320 - DNA, 22 bp, Homo sapiens
ctgcaaggtccacctgctacat

SEQ ID NO: 9013321 - DNA, 22 bp, Homo sapiens
ctgcaatatgatgtctgagaaa

SEQ ID NO: 9013322 - DNA, 22 bp, Homo sapiens
ctgcaatatgatgtctgagaaa

SEQ ID NO: 9013323 - DNA, 22 bp, Homo sapiens
ctgcaatgcatgaattataaat

SEQ ID NO: 9013324 - DNA, 22 bp, Homo sapiens
ctgcaagggatcttcaggtagc

SEQ ID NO: 9013325 - DNA, 22 bp, Homo sapiens
ctgcaaggctggggtgagctgg

SEQ ID NO: 9013326 - DNA, 23 bp, Homo sapiens
ctgcaaggtacaagatgctggat

SEQ ID NO: 9013327 - DNA, 23 bp, Homo sapiens
ctgcaaggtacaagatgctggat

SEQ ID NO: 9013328 - DNA, 23 bp, Homo sapiens
ctgcaaggtacaagatgctggat

SEQ ID NO: 9013329 - DNA, 22 bp, Homo sapiens
ctgcaaggtcatgactctctgg

SEQ ID NO: 9013330 - DNA, 22 bp, Homo sapiens
ctgcaaggtcatgactctctgg

SEQ ID NO: 9013331 - DNA, 22 bp, Homo sapiens
ctgcaaatgggctttaggtggc

SEQ ID NO: 9013332 - DNA, 21 bp, Homo sapiens
ctgcaaatgtaatgagtttgg

SEQ ID NO: 9013333 - DNA, 23 bp, Homo sapiens
ctgcaactcagtctggagcagtt

SEQ ID NO: 9013334 - DNA, 22 bp, Homo sapiens
ctgcaaattggtggtgaggcaa

SEQ ID NO: 9013335 - DNA, 23 bp, Homo sapiens
ctgcaactcagtctggagcagtt

SEQ ID NO: 9013336 - DNA, 22 bp, Homo sapiens
ctgcaaatgccgtgagagcagg

SEQ ID NO: 9013337 - DNA, 22 bp, Homo sapiens
ctgcaaatgccgtgagagcagg

SEQ ID NO: 9013338 - DNA, 22 bp, Homo sapiens
ctgcaaatgggctttaggtggc

SEQ ID NO: 9013339 - DNA, 22 bp, Homo sapiens
ctgcaaatgcctcggtgtgcgg

SEQ ID NO: 9013340 - DNA, 22 bp, Homo sapiens
ctgcaaatcctcagaaagggtt

SEQ ID NO: 9013341 - DNA, 21 bp, Homo sapiens
ctgcaaatgcaaggtgaccag

SEQ ID NO: 9013342 - DNA, 22 bp, Homo sapiens
ctgcaaatccctactgggcaca

SEQ ID NO: 9013343 - DNA, 22 bp, Homo sapiens
ctgcaaatccctactgggcaca

SEQ ID NO: 9013344 - DNA, 22 bp, Homo sapiens
ctgcaaatcaagttcttataat

SEQ ID NO: 9013345 - DNA, 22 bp, Homo sapiens
ctgcaaatcaagttcttataat

SEQ ID NO: 9013346 - DNA, 22 bp, Homo sapiens
ctgcaaatcaagttcttataat

SEQ ID NO: 9013347 - DNA, 22 bp, Homo sapiens
ctgcaaatcaagttcttataat

SEQ ID NO: 9013348 - DNA, 22 bp, Homo sapiens
ctgcaaataggggtgtgaataa

SEQ ID NO: 9013349 - DNA, 21 bp, Homo sapiens
ctgatcccaaacctctgccct

SEQ ID NO: 9013350 - DNA, 22 bp, Homo sapiens
ctgatccagagccaaccaaggc

SEQ ID NO: 9013351 - DNA, 22 bp, Homo sapiens
ctgatcccattggcagtccagt

SEQ ID NO: 9013352 - DNA, 22 bp, Homo sapiens
ctgcaaataggggtgtgaataa

SEQ ID NO: 9013353 - DNA, 22 bp, Homo sapiens
agttatttactcctttgtctct

SEQ ID NO: 9013354 - DNA, 22 bp, Homo sapiens
agttatttactcctttgtctct

SEQ ID NO: 9013355 - DNA, 22 bp, Homo sapiens
ctgatcatgtgggaggatatgt

SEQ ID NO: 9013356 - DNA, 22 bp, Homo sapiens
ctgatcatgtgggaggatatgt

SEQ ID NO: 9013357 - DNA, 22 bp, Homo sapiens
agttatataactatctagatgc

SEQ ID NO: 9013358 - DNA, 22 bp, Homo sapiens
ctgaggagctgaaggccctcca

SEQ ID NO: 9013359 - DNA, 22 bp, Homo sapiens
ctgaggagctgaaggccctcca

SEQ ID NO: 9013360 - DNA, 22 bp, Homo sapiens
ctgaggagctgaaggccctcca

SEQ ID NO: 9013361 - DNA, 22 bp, Homo sapiens
agttatatgtgaaaacacgtat

SEQ ID NO: 9013362 - DNA, 22 bp, Homo sapiens
agttatatgtgaaaacacgtat

SEQ ID NO: 9013363 - DNA, 22 bp, Homo sapiens
agttatatgtgaaaacacgtat

SEQ ID NO: 9013364 - DNA, 22 bp, Homo sapiens
agttatattccatagattcaga

SEQ ID NO: 9013365 - DNA, 22 bp, Homo sapiens
agttatatgtgaaaacacgtat

SEQ ID NO: 9013366 - DNA, 22 bp, Homo sapiens
agttatattccatagattcaga

SEQ ID NO: 9013367 - DNA, 22 bp, Homo sapiens
ctgaggagccccctctcagcat

SEQ ID NO: 9013368 - DNA, 22 bp, Homo sapiens
ctgaggagccccctctcagcat

SEQ ID NO: 9013369 - DNA, 22 bp, Homo sapiens
ctgaggagccccctctcagcat

SEQ ID NO: 9013370 - DNA, 22 bp, Homo sapiens
ctgaggagccccctctcagcat

SEQ ID NO: 9013371 - DNA, 22 bp, Homo sapiens
ctgaggagcgttggtcacgtgt

SEQ ID NO: 9013372 - DNA, 22 bp, Homo sapiens
ctgaggagcgttggtcacgtgt

SEQ ID NO: 9013373 - DNA, 22 bp, Homo sapiens
ctgaggagatgggctttttagg

SEQ ID NO: 9013374 - DNA, 22 bp, Homo sapiens
ctgaggagatgataatgtcatt

SEQ ID NO: 9013375 - DNA, 22 bp, Homo sapiens
ctgaggagatgataatgtcatt

SEQ ID NO: 9013376 - DNA, 22 bp, Homo sapiens
ctgaggagatgataatgtcatt

SEQ ID NO: 9013377 - DNA, 22 bp, Homo sapiens
ctgaggagatccccccagaagt

SEQ ID NO: 9013378 - DNA, 22 bp, Homo sapiens
ctgaggagaggtggcctgtgtt

SEQ ID NO: 9013379 - DNA, 22 bp, Homo sapiens
ctgaggagatccccccagaagt

SEQ ID NO: 9013380 - DNA, 22 bp, Homo sapiens
ctgaggagatccccccagaagt

SEQ ID NO: 9013381 - DNA, 22 bp, Homo sapiens
ctgaggagcagctggcccgcta

SEQ ID NO: 9013382 - DNA, 22 bp, Homo sapiens
ctgaggagcagctggcccgcta

SEQ ID NO: 9013383 - DNA, 22 bp, Homo sapiens
ctgaggagcaaccccgtgccct

SEQ ID NO: 9013384 - DNA, 22 bp, Homo sapiens
ctgaggagcaaccccgtgccct

SEQ ID NO: 9013385 - DNA, 22 bp, Homo sapiens
agttattcatttattctgtaca

SEQ ID NO: 9013386 - DNA, 22 bp, Homo sapiens
agttattcatttattctgtaca

SEQ ID NO: 9013387 - DNA, 22 bp, Homo sapiens
agttattcatttattctgtaca

SEQ ID NO: 9013388 - DNA, 22 bp, Homo sapiens
agttattgagtatctataatgt

SEQ ID NO: 9013389 - DNA, 22 bp, Homo sapiens
agttattgggttaaaattgcat

SEQ ID NO: 9013390 - DNA, 22 bp, Homo sapiens
agttattgagtgcagagcaggg

SEQ ID NO: 9013391 - DNA, 22 bp, Homo sapiens
agttattgagtatctataatgt

SEQ ID NO: 9013392 - DNA, 19 bp, Homo sapiens
agttattgatctattcagg

SEQ ID NO: 9013393 - DNA, 22 bp, Homo sapiens
agttatttaaaatgattgtcct

SEQ ID NO: 9013394 - DNA, 22 bp, Homo sapiens
agttattgttcagtacaatgtc

SEQ ID NO: 9013395 - DNA, 22 bp, Homo sapiens
agttatgtcctcagcaaatcaa

SEQ ID NO: 9013396 - DNA, 22 bp, Homo sapiens
agttatctgttagtattccagg

SEQ ID NO: 9013397 - DNA, 22 bp, Homo sapiens
agttatcatcccttacactttg

SEQ ID NO: 9013398 - DNA, 22 bp, Homo sapiens
agttatccgaaggcactgagat

SEQ ID NO: 9013399 - DNA, 22 bp, Homo sapiens
agttattactctttaacatatt

SEQ ID NO: 9013400 - DNA, 22 bp, Homo sapiens
agttatattccatagattcaga

SEQ ID NO: 9013401 - DNA, 22 bp, Homo sapiens
agttatattccatagattcaga

SEQ ID NO: 9013402 - DNA, 22 bp, Homo sapiens
agttatattccatagattcaga

SEQ ID NO: 9013403 - DNA, 22 bp, Homo sapiens
agttatcatcccttacactttg

SEQ ID NO: 9013404 - DNA, 22 bp, Homo sapiens
agttatcatcccttacactttg

SEQ ID NO: 9013405 - DNA, 22 bp, Homo sapiens
agttatcaggtgttttcatgga

SEQ ID NO: 9013406 - DNA, 22 bp, Homo sapiens
atacatgtgtgtgcatacatgt

SEQ ID NO: 9013407 - DNA, 22 bp, Homo sapiens
atacatgttcgtgtacatgttc

SEQ ID NO: 9013408 - DNA, 22 bp, Homo sapiens
atacatgttcgtgtacatgttc

SEQ ID NO: 9013409 - DNA, 22 bp, Homo sapiens
atacatgttcgtgtacatgttc

SEQ ID NO: 9013410 - DNA, 22 bp, Homo sapiens
atacatagttctgtgaaaagta

SEQ ID NO: 9013411 - DNA, 22 bp, Homo sapiens
atacatagtaccacatttgaca

SEQ ID NO: 9013412 - DNA, 22 bp, Homo sapiens
atacataggatatgtacgtgca

SEQ ID NO: 9013413 - DNA, 22 bp, Homo sapiens
atacatagctgaaaacttgtag

SEQ ID NO: 9013414 - DNA, 22 bp, Homo sapiens
atacattcagcagtgctcatga

SEQ ID NO: 9013415 - DNA, 22 bp, Homo sapiens
atacattcagcagtgctcatga

SEQ ID NO: 9013416 - DNA, 22 bp, Homo sapiens
atacattcctactgactagcta

SEQ ID NO: 9013417 - DNA, 21 bp, Homo sapiens
atacattctattaagcattta

SEQ ID NO: 9013418 - DNA, 21 bp, Homo sapiens
atacattctattaagcattta

SEQ ID NO: 9013419 - DNA, 22 bp, Homo sapiens
ataccaaagcacatactgtttg

SEQ ID NO: 9013420 - DNA, 22 bp, Homo sapiens
ataccaattagagtttgttgca

SEQ ID NO: 9013421 - DNA, 22 bp, Homo sapiens
ataccaaagcacatactgtttg

SEQ ID NO: 9013422 - DNA, 22 bp, Homo sapiens
ataccaaagcacatactgtttg

SEQ ID NO: 9013423 - DNA, 17 bp, Homo sapiens
atacattgttaaagtat

SEQ ID NO: 9013424 - DNA, 22 bp, Homo sapiens
atacattgagttttgatgttct

SEQ ID NO: 9013425 - DNA, 22 bp, Homo sapiens
atacctctggcactcaagactt

SEQ ID NO: 9013426 - DNA, 22 bp, Homo sapiens
atacctgtgtatccacaagcgt

SEQ ID NO: 9013427 - DNA, 22 bp, Homo sapiens
atacctgtgtatccacaagcgt

SEQ ID NO: 9013428 - DNA, 22 bp, Homo sapiens
atacctgtgtatccacaagcgt

SEQ ID NO: 9013429 - DNA, 22 bp, Homo sapiens
atacctgtgtatccacaagcgt

SEQ ID NO: 9013430 - DNA, 22 bp, Homo sapiens
ataccttttactcattatccat

SEQ ID NO: 9013431 - DNA, 22 bp, Homo sapiens
atacgtaagttgaacatcagaa

SEQ ID NO: 9013432 - DNA, 22 bp, Homo sapiens
ataccctgttctggagtgaatg

SEQ ID NO: 9013433 - DNA, 22 bp, Homo sapiens
atacccagtccaatctcttagc

SEQ ID NO: 9013434 - DNA, 22 bp, Homo sapiens
atacccaggcttatgttggtca

SEQ ID NO: 9013435 - DNA, 22 bp, Homo sapiens
atacccagagtgggtagagtta

SEQ ID NO: 9013436 - DNA, 22 bp, Homo sapiens
atacccagagtgggtagagtta

SEQ ID NO: 9013437 - DNA, 22 bp, Homo sapiens
atacccagccccagctgcagga

SEQ ID NO: 9013438 - DNA, 22 bp, Homo sapiens
atacccagctctttcgttttgg

SEQ ID NO: 9013439 - DNA, 22 bp, Homo sapiens
ataccatttccatgttacatta

SEQ ID NO: 9013440 - DNA, 20 bp, Homo sapiens
ataccagagtacagtttatg

SEQ ID NO: 9013441 - DNA, 22 bp, Homo sapiens
ataccagaacaaatgagatcct

SEQ ID NO: 9013442 - DNA, 22 bp, Homo sapiens
ataccataggaaaggatcagcc

SEQ ID NO: 9013443 - DNA, 22 bp, Homo sapiens
ataccataggaaaggatcagcc

SEQ ID NO: 9013444 - DNA, 22 bp, Homo sapiens
ataccacaacatggctcagagg

SEQ ID NO: 9013445 - DNA, 22 bp, Homo sapiens
ataccaccatctatgaaaggta

SEQ ID NO: 9013446 - DNA, 22 bp, Homo sapiens
ataccacaacatggctcagagg

SEQ ID NO: 9013447 - DNA, 22 bp, Homo sapiens
ataccacaacatggctcagagg

SEQ ID NO: 9013448 - DNA, 22 bp, Homo sapiens
ataccacaacatggctcagagg

SEQ ID NO: 9013449 - DNA, 23 bp, Homo sapiens
atacatacagtcttactgacttt

SEQ ID NO: 9013450 - DNA, 23 bp, Homo sapiens
atacatacagtcttactgacttt

SEQ ID NO: 9013451 - DNA, 23 bp, Homo sapiens
atacatacagtcttactgacttt

SEQ ID NO: 9013452 - DNA, 23 bp, Homo sapiens
atacatacagtcttactgacttt

SEQ ID NO: 9013453 - DNA, 22 bp, Homo sapiens
atacatacatgtacacataaat

SEQ ID NO: 9013454 - DNA, 22 bp, Homo sapiens
atacatacatgtacacataaat

SEQ ID NO: 9013455 - DNA, 22 bp, Homo sapiens
atacatacatgtatgcacatac

SEQ ID NO: 9013456 - DNA, 22 bp, Homo sapiens
atacataattacttccgatgtt

SEQ ID NO: 9013457 - DNA, 17 bp, Homo sapiens
atacagtttattttaca

SEQ ID NO: 9013458 - DNA, 17 bp, Homo sapiens
atacagtttattttaca

SEQ ID NO: 9013459 - DNA, 17 bp, Homo sapiens
atacagtttattttaca

SEQ ID NO: 9013460 - DNA, 22 bp, Homo sapiens
atacatacatgtatgcacatac

SEQ ID NO: 9013461 - DNA, 22 bp, Homo sapiens
atacatacatgtatgcacatac

SEQ ID NO: 9013462 - DNA, 22 bp, Homo sapiens
atacatacgtacatacgtatgt

SEQ ID NO: 9013463 - DNA, 22 bp, Homo sapiens
atacatacgtacatacgtatgt

SEQ ID NO: 9013464 - DNA, 22 bp, Homo sapiens
atacatagcagggtagtagatc

SEQ ID NO: 9013465 - DNA, 22 bp, Homo sapiens
atacatagctgaaaacttgtag

SEQ ID NO: 9013466 - DNA, 22 bp, Homo sapiens
atacatagcagggtagtagatc

SEQ ID NO: 9013467 - DNA, 22 bp, Homo sapiens
atacatagcagggtagtagatc

SEQ ID NO: 9013468 - DNA, 22 bp, Homo sapiens
atacatagcagagtcaattaat

SEQ ID NO: 9013469 - DNA, 22 bp, Homo sapiens
atacatacgtacatacgtatgt

SEQ ID NO: 9013470 - DNA, 22 bp, Homo sapiens
atacatagatagataatctggc

SEQ ID NO: 9013471 - DNA, 22 bp, Homo sapiens
atacagtgagaataattcttag

SEQ ID NO: 9013472 - DNA, 22 bp, Homo sapiens
atacagtgaatacttacagtgt

SEQ ID NO: 9013473 - DNA, 22 bp, Homo sapiens
atacagtgaatacttacagtgt

SEQ ID NO: 9013474 - DNA, 22 bp, Homo sapiens
atacagtgccccttttcacatg

SEQ ID NO: 9013475 - DNA, 22 bp, Homo sapiens
atacagtcagactttagccatt

SEQ ID NO: 9013476 - DNA, 22 bp, Homo sapiens
atacagtcagactttagccatt

SEQ ID NO: 9013477 - DNA, 22 bp, Homo sapiens
atacagtcagactttagccatt

SEQ ID NO: 9013478 - DNA, 22 bp, Homo sapiens
atacagtcttcatattaagttt

SEQ ID NO: 9013479 - DNA, 22 bp, Homo sapiens
atacagtcttcatattaagttt

SEQ ID NO: 9013480 - DNA, 22 bp, Homo sapiens
atacagtgtactatttagcagt

SEQ ID NO: 9013481 - DNA, 22 bp, Homo sapiens
atacagttagaaaaaaagcctt

SEQ ID NO: 9013482 - DNA, 22 bp, Homo sapiens
atacagttagaaaaaaagcctt

SEQ ID NO: 9013483 - DNA, 22 bp, Homo sapiens
atacagtgtactatttagcagt

SEQ ID NO: 9013484 - DNA, 22 bp, Homo sapiens
atacagtgccccttttcacatg

SEQ ID NO: 9013485 - DNA, 22 bp, Homo sapiens
atacagtgccccttttcacatg

SEQ ID NO: 9013486 - DNA, 22 bp, Homo sapiens
atacagtattacctgttcagga

SEQ ID NO: 9013487 - DNA, 22 bp, Homo sapiens
atacagtattacctgttcagga

SEQ ID NO: 9013488 - DNA, 22 bp, Homo sapiens
atacagtattacctgttcagga

SEQ ID NO: 9013489 - DNA, 22 bp, Homo sapiens
atacagtatgtaggcttttcag

SEQ ID NO: 9013490 - DNA, 22 bp, Homo sapiens
atacagtattacctgttcagga

SEQ ID NO: 9013491 - DNA, 22 bp, Homo sapiens
atacagtataactaataaaccc

SEQ ID NO: 9013492 - DNA, 22 bp, Homo sapiens
atacagtatgtaggcttttcag

SEQ ID NO: 9013493 - DNA, 22 bp, Homo sapiens
atacagtataactaataaaccc

SEQ ID NO: 9013494 - DNA, 22 bp, Homo sapiens
atacagtataactaataaaccc

SEQ ID NO: 9013495 - DNA, 20 bp, Homo sapiens
atacagtaggtgctcaatat

SEQ ID NO: 9013496 - DNA, 22 bp, Homo sapiens
atacagtataactaataaaccc

SEQ ID NO: 9013497 - DNA, 20 bp, Homo sapiens
atacagtaggtgctcaatat

SEQ ID NO: 9013498 - DNA, 20 bp, Homo sapiens
atacagtaggtgctcaatat

SEQ ID NO: 9013499 - DNA, 22 bp, Homo sapiens
atacagtagggaccatgtctga

SEQ ID NO: 9013500 - DNA, 22 bp, Homo sapiens
atacagtagggaccatgtctga

SEQ ID NO: 9013501 - DNA, 22 bp, Homo sapiens
ctggaatgcggagagttggaga

SEQ ID NO: 9013502 - DNA, 22 bp, Homo sapiens
ctggaatgcggagagttggaga

SEQ ID NO: 9013503 - DNA, 22 bp, Homo sapiens
ctggaatgcctccctgtcagag

SEQ ID NO: 9013504 - DNA, 22 bp, Homo sapiens
ctggaatgggagtcagacagag

SEQ ID NO: 9013505 - DNA, 22 bp, Homo sapiens
ctggaatgggccatttgaggcc

SEQ ID NO: 9013506 - DNA, 22 bp, Homo sapiens
ctggaatgggtttcaggcactg

SEQ ID NO: 9013507 - DNA, 22 bp, Homo sapiens
ctggaatgggtttcaggcactg

SEQ ID NO: 9013508 - DNA, 22 bp, Homo sapiens
ctggaatgggtttcaggcactg

SEQ ID NO: 9013509 - DNA, 22 bp, Homo sapiens
ctggaatgggtttcaggcactg

SEQ ID NO: 9013510 - DNA, 22 bp, Homo sapiens
ctggaatgtatgggaacccaaa

SEQ ID NO: 9013511 - DNA, 22 bp, Homo sapiens
ctggaatgcctccctgtcagag

SEQ ID NO: 9013512 - DNA, 19 bp, Homo sapiens
ctggaatgatagagacctc

SEQ ID NO: 9013513 - DNA, 22 bp, Homo sapiens
ctggaatctttggagaatgtgg

SEQ ID NO: 9013514 - DNA, 22 bp, Homo sapiens
ctggaatctttggagaatgtgg

SEQ ID NO: 9013515 - DNA, 19 bp, Homo sapiens
ctggaatgagaacatgccc

SEQ ID NO: 9013516 - DNA, 22 bp, Homo sapiens
ctggaatgagcagggcttatgg

SEQ ID NO: 9013517 - DNA, 22 bp, Homo sapiens
ctgctgccaagggtgccacagg

SEQ ID NO: 9013518 - DNA, 22 bp, Homo sapiens
ctgctgccaagggtgccacagg

SEQ ID NO: 9013519 - DNA, 22 bp, Homo sapiens
ctgctgcaggatgggcactctg

SEQ ID NO: 9013520 - DNA, 18 bp, Homo sapiens
ctgctgcaggcactcagg

SEQ ID NO: 9013521 - DNA, 22 bp, Homo sapiens
ctggaagagcatttgcataggg

SEQ ID NO: 9013522 - DNA, 22 bp, Homo sapiens
ctggaagactcaatggcctgcc

SEQ ID NO: 9013523 - DNA, 22 bp, Homo sapiens
ctggaagagcatttgcataggg

SEQ ID NO: 9013524 - DNA, 22 bp, Homo sapiens
ctggaagagcatttgcataggg

SEQ ID NO: 9013525 - DNA, 22 bp, Homo sapiens
ctggaagtggcagtggaaaaga

SEQ ID NO: 9013526 - DNA, 22 bp, Homo sapiens
ctgctgccattagggcacagac

SEQ ID NO: 9013527 - DNA, 22 bp, Homo sapiens
ctggaagactcaatggcctgcc

SEQ ID NO: 9013528 - DNA, 22 bp, Homo sapiens
ctggaagtttccttcctggtca

SEQ ID NO: 9013529 - DNA, 22 bp, Homo sapiens
ctggaataaacgatcttcagca

SEQ ID NO: 9013530 - DNA, 22 bp, Homo sapiens
ctggaataaacgatcttcagca

SEQ ID NO: 9013531 - DNA, 18 bp, Homo sapiens
ctggaagttagtctttgg

SEQ ID NO: 9013532 - DNA, 22 bp, Homo sapiens
ctggaagttggaactgatatga

SEQ ID NO: 9013533 - DNA, 22 bp, Homo sapiens
ctggaagtggggttggcttgaa

SEQ ID NO: 9013534 - DNA, 22 bp, Homo sapiens
ctggagaagaggtagtatgtag

SEQ ID NO: 9013535 - DNA, 22 bp, Homo sapiens
ctggaatgtctgctcaatgttt

SEQ ID NO: 9013536 - DNA, 22 bp, Homo sapiens
ctggagaagtactgagacattt

SEQ ID NO: 9013537 - DNA, 22 bp, Homo sapiens
ctggagagaatgtggaatgatt

SEQ ID NO: 9013538 - DNA, 22 bp, Homo sapiens
ctggagagaatgtggaatgatt

SEQ ID NO: 9013539 - DNA, 22 bp, Homo sapiens
ctggagagaatgtggaatgatt

SEQ ID NO: 9013540 - DNA, 22 bp, Homo sapiens
ctggagagaatgtggaatgatt

SEQ ID NO: 9013541 - DNA, 22 bp, Homo sapiens
ctggagagaaatgacaaagcta

SEQ ID NO: 9013542 - DNA, 22 bp, Homo sapiens
ctggagagaatgtggaatgatt

SEQ ID NO: 9013543 - DNA, 22 bp, Homo sapiens
ctggagagaaatgacaaagcta

SEQ ID NO: 9013544 - DNA, 22 bp, Homo sapiens
ctggagacctctcctgagagtg

SEQ ID NO: 9013545 - DNA, 22 bp, Homo sapiens
ctggagacctctcctgagagtg

SEQ ID NO: 9013546 - DNA, 22 bp, Homo sapiens
ctggagagaaatgacaaagcta

SEQ ID NO: 9013547 - DNA, 22 bp, Homo sapiens
ctggagagaaatgacaaagcta

SEQ ID NO: 9013548 - DNA, 22 bp, Homo sapiens
atacagtaatttgtaactcatc

SEQ ID NO: 9013549 - DNA, 19 bp, Homo sapiens
atacagatgtatccatgat

SEQ ID NO: 9013550 - DNA, 22 bp, Homo sapiens
atacagtaatttgtaactcatc

SEQ ID NO: 9013551 - DNA, 22 bp, Homo sapiens
atacagtaattgccctgcaatg

SEQ ID NO: 9013552 - DNA, 22 bp, Homo sapiens
atacagtaatttgtaactcatc

SEQ ID NO: 9013553 - DNA, 22 bp, Homo sapiens
atacagtaattgcataggcttc

SEQ ID NO: 9013554 - DNA, 22 bp, Homo sapiens
atacagtaatttgtaactcatc

SEQ ID NO: 9013555 - DNA, 22 bp, Homo sapiens
atacagtaagtgtccctgaaac

SEQ ID NO: 9013556 - DNA, 22 bp, Homo sapiens
atacagtaagtgtccctgaaac

SEQ ID NO: 9013557 - DNA, 22 bp, Homo sapiens
atacagtagacaatctcatgaa

SEQ ID NO: 9013558 - DNA, 22 bp, Homo sapiens
atacagtagacaatctcatgaa

SEQ ID NO: 9013559 - DNA, 22 bp, Homo sapiens
atacagtagacaatctcatgaa

SEQ ID NO: 9013560 - DNA, 22 bp, Homo sapiens
atacagtaatttgtaactcatc

SEQ ID NO: 9013561 - DNA, 22 bp, Homo sapiens
atacagtagggaccatgtctga

SEQ ID NO: 9013562 - DNA, 22 bp, Homo sapiens
atacagtagggaccatgtctga

SEQ ID NO: 9013563 - DNA, 22 bp, Homo sapiens
atacagtagacaatctcatgaa

SEQ ID NO: 9013564 - DNA, 22 bp, Homo sapiens
atacagtaaccacattctatag

SEQ ID NO: 9013565 - DNA, 19 bp, Homo sapiens
atacagtaaggtgtttgcc

SEQ ID NO: 9013566 - DNA, 19 bp, Homo sapiens
atacagtaaggtgtttgcc

SEQ ID NO: 9013567 - DNA, 22 bp, Homo sapiens
atacagatgttaaagcaatttc

SEQ ID NO: 9013568 - DNA, 19 bp, Homo sapiens
atacagatgtatccatgat

SEQ ID NO: 9013569 - DNA, 22 bp, Homo sapiens
ctggagagaatgttcattgcag

SEQ ID NO: 9013570 - DNA, 20 bp, Homo sapiens
atacagatggttccagctgg

SEQ ID NO: 9013571 - DNA, 22 bp, Homo sapiens
ctggagagaatgttcattgcag

SEQ ID NO: 9013572 - DNA, 22 bp, Homo sapiens
ctggagagaatgtggaatgatt

SEQ ID NO: 9013573 - DNA, 22 bp, Homo sapiens
ctggagagaatgttcattgcag

SEQ ID NO: 9013574 - DNA, 22 bp, Homo sapiens
ctggctcccagctttcagggag

SEQ ID NO: 9013575 - DNA, 22 bp, Homo sapiens
ctggctcccatgagctctcacg

SEQ ID NO: 9013576 - DNA, 22 bp, Homo sapiens
ctggctcccgaagccctcagtg

SEQ ID NO: 9013577 - DNA, 22 bp, Homo sapiens
ctggctcccgaagccctcagtg

SEQ ID NO: 9013578 - DNA, 22 bp, Homo sapiens
ctggctcccgaagccctcagtg

SEQ ID NO: 9013579 - DNA, 22 bp, Homo sapiens
ctggctcccatgagctctcacg

SEQ ID NO: 9013580 - DNA, 22 bp, Homo sapiens
ctggctcccggggatcgagcac

SEQ ID NO: 9013581 - DNA, 22 bp, Homo sapiens
ctggctcccgaagccctcagtg

SEQ ID NO: 9013582 - DNA, 22 bp, Homo sapiens
ctggctcccgaagccctcagtg

SEQ ID NO: 9013583 - DNA, 22 bp, Homo sapiens
ctggctcccgtctggtggccat

SEQ ID NO: 9013584 - DNA, 22 bp, Homo sapiens
ctggctcccgtctggtggccat

SEQ ID NO: 9013585 - DNA, 22 bp, Homo sapiens
atagcaaagtgcaggggcagca

SEQ ID NO: 9013586 - DNA, 22 bp, Homo sapiens
atagcaaatattttaatgagca

SEQ ID NO: 9013587 - DNA, 22 bp, Homo sapiens
ctggctccctcgctgaggtgct

SEQ ID NO: 9013588 - DNA, 22 bp, Homo sapiens
ctggctcccgttgtccttgaag

SEQ ID NO: 9013589 - DNA, 22 bp, Homo sapiens
ctggctccctcgctgaggtgct

SEQ ID NO: 9013590 - DNA, 22 bp, Homo sapiens
ctggctcccgttgtccttgaag

SEQ ID NO: 9013591 - DNA, 22 bp, Homo sapiens
ctggctccatctttgcttcctg

SEQ ID NO: 9013592 - DNA, 22 bp, Homo sapiens
ctggctccatccttgagctctg

SEQ ID NO: 9013593 - DNA, 22 bp, Homo sapiens
ctggctccatccttgagctctg

SEQ ID NO: 9013594 - DNA, 22 bp, Homo sapiens
ctggctccatccttgagctctg

SEQ ID NO: 9013595 - DNA, 22 bp, Homo sapiens
ctggctccatctttgcttcctg

SEQ ID NO: 9013596 - DNA, 22 bp, Homo sapiens
ctggctccatctttgcttcctg

SEQ ID NO: 9013597 - DNA, 22 bp, Homo sapiens
ctggctccatctttgcttcctg

SEQ ID NO: 9013598 - DNA, 22 bp, Homo sapiens
ctggctccatcactgggtgatg

SEQ ID NO: 9013599 - DNA, 22 bp, Homo sapiens
ctggctccatcactgggtgatg

SEQ ID NO: 9013600 - DNA, 22 bp, Homo sapiens
ctggctccatcctaggcaaatg

SEQ ID NO: 9013601 - DNA, 22 bp, Homo sapiens
ctggctccagtgacaagtcgat

SEQ ID NO: 9013602 - DNA, 22 bp, Homo sapiens
ctggctccatcactgggtgatg

SEQ ID NO: 9013603 - DNA, 22 bp, Homo sapiens
ctggctcacaggtgagatgcat

SEQ ID NO: 9013604 - DNA, 22 bp, Homo sapiens
ctggctcacaggtgagatgcat

SEQ ID NO: 9013605 - DNA, 22 bp, Homo sapiens
ctggcccctgtggctaaaatca

SEQ ID NO: 9013606 - DNA, 22 bp, Homo sapiens
ctggcccggctgcctggtcatt

SEQ ID NO: 9013607 - DNA, 22 bp, Homo sapiens
ctggctcacaggtgagatgcat

SEQ ID NO: 9013608 - DNA, 22 bp, Homo sapiens
ctggccctaggcaaacacagat

SEQ ID NO: 9013609 - DNA, 22 bp, Homo sapiens
ctggctcacaggtgagatgcat

SEQ ID NO: 9013610 - DNA, 22 bp, Homo sapiens
ctggctcacaggtgagatgcat

SEQ ID NO: 9013611 - DNA, 22 bp, Homo sapiens
ctggctcacaggtgagatgcat

SEQ ID NO: 9013612 - DNA, 22 bp, Homo sapiens
atagcaaggtatgactggagcc

SEQ ID NO: 9013613 - DNA, 22 bp, Homo sapiens
atagcaagcgttcccaagccac

SEQ ID NO: 9013614 - DNA, 22 bp, Homo sapiens
atagcaaattctttaggtgctt

SEQ ID NO: 9013615 - DNA, 22 bp, Homo sapiens
atagcaaattctttaggtgctt

SEQ ID NO: 9013616 - DNA, 22 bp, Homo sapiens
atagcaaattctttaggtgctt

SEQ ID NO: 9013617 - DNA, 22 bp, Homo sapiens
atagcaaatattttaatgagca

SEQ ID NO: 9013618 - DNA, 22 bp, Homo sapiens
atagcaaatattttaatgagca

SEQ ID NO: 9013619 - DNA, 22 bp, Homo sapiens
atagcaaatattttaatgagca

SEQ ID NO: 9013620 - DNA, 22 bp, Homo sapiens
atagcaaatattttaatgagca

SEQ ID NO: 9013621 - DNA, 22 bp, Homo sapiens
atagcaaatattttaatgagca

SEQ ID NO: 9013622 - DNA, 22 bp, Homo sapiens
atagcaatcagtgtatttgaaa

SEQ ID NO: 9013623 - DNA, 22 bp, Homo sapiens
atagcaaggtatgactggagcc

SEQ ID NO: 9013624 - DNA, 22 bp, Homo sapiens
atagcaatggcaacaactaagc

SEQ ID NO: 9013625 - DNA, 22 bp, Homo sapiens
atagcaatggcaacaactaagc

SEQ ID NO: 9013626 - DNA, 22 bp, Homo sapiens
atagcagcatcagtttatctcc

SEQ ID NO: 9013627 - DNA, 22 bp, Homo sapiens
atagcactggtttttcttggtt

SEQ ID NO: 9013628 - DNA, 22 bp, Homo sapiens
atagcagcatttcttccaagga

SEQ ID NO: 9013629 - DNA, 22 bp, Homo sapiens
atagcagcatttcttccaagga

SEQ ID NO: 9013630 - DNA, 22 bp, Homo sapiens
atagcagcatcagtttatctcc

SEQ ID NO: 9013631 - DNA, 22 bp, Homo sapiens
atagcagcatcagtttatctcc

SEQ ID NO: 9013632 - DNA, 22 bp, Homo sapiens
atagcagcatttcttccaagga

SEQ ID NO: 9013633 - DNA, 22 bp, Homo sapiens
atagcacaatattacctttatg

SEQ ID NO: 9013634 - DNA, 22 bp, Homo sapiens
atagcacaatgacttgggtatc

SEQ ID NO: 9013635 - DNA, 22 bp, Homo sapiens
atagcaattaagctccagaatt

SEQ ID NO: 9013636 - DNA, 22 bp, Homo sapiens
atagcacatcactccagtgagt

SEQ ID NO: 9013637 - DNA, 22 bp, Homo sapiens
atagcaccatgactaaacaatt

SEQ ID NO: 9013638 - DNA, 22 bp, Homo sapiens
ctggctggccatgtagagatga

SEQ ID NO: 9013639 - DNA, 22 bp, Homo sapiens
ctggctggccggagcgaggcgg

SEQ ID NO: 9013640 - DNA, 22 bp, Homo sapiens
ctggctggccggagcgaggcgg

SEQ ID NO: 9013641 - DNA, 22 bp, Homo sapiens
ctggctggccggagcgaggcgg

SEQ ID NO: 9013642 - DNA, 22 bp, Homo sapiens
ctggctggccatgcagcgccag

SEQ ID NO: 9013643 - DNA, 22 bp, Homo sapiens
ctggctggccatgcagcgccag

SEQ ID NO: 9013644 - DNA, 22 bp, Homo sapiens
ctggctggccatgtagagatga

SEQ ID NO: 9013645 - DNA, 22 bp, Homo sapiens
ctggctggcagatgctcttgct

SEQ ID NO: 9013646 - DNA, 22 bp, Homo sapiens
ctggctggcaagtagaacacaa

SEQ ID NO: 9013647 - DNA, 22 bp, Homo sapiens
ctggctggcagatgctcttgct

SEQ ID NO: 9013648 - DNA, 22 bp, Homo sapiens
ctggctggccatgcagcgccag

SEQ ID NO: 9013649 - DNA, 22 bp, Homo sapiens
ctggctggcagatgctcttgct

SEQ ID NO: 9013650 - DNA, 22 bp, Homo sapiens
ctggctggccatgcagcgccag

SEQ ID NO: 9013651 - DNA, 22 bp, Homo sapiens
atagcagtaacactgacatttt

SEQ ID NO: 9013652 - DNA, 22 bp, Homo sapiens
atagcagtaacactgacatttt

SEQ ID NO: 9013653 - DNA, 22 bp, Homo sapiens
ctggctgcagctccgaggaaga

SEQ ID NO: 9013654 - DNA, 19 bp, Homo sapiens
atagcagctatacccagat

SEQ ID NO: 9013655 - DNA, 22 bp, Homo sapiens
atagcagggatgtcagcaagta

SEQ ID NO: 9013656 - DNA, 19 bp, Homo sapiens
atagcagctatacccagat

SEQ ID NO: 9013657 - DNA, 19 bp, Homo sapiens
atagcagctatacccagat

SEQ ID NO: 9013658 - DNA, 22 bp, Homo sapiens
ctggctggagtgcaggtgagtg

SEQ ID NO: 9013659 - DNA, 22 bp, Homo sapiens
ctggctggagtgcaggtgagtg

SEQ ID NO: 9013660 - DNA, 22 bp, Homo sapiens
ctggctgcagctccgaggaaga

SEQ ID NO: 9013661 - DNA, 22 bp, Homo sapiens
ctggctggcaagtagaacacaa

SEQ ID NO: 9013662 - DNA, 22 bp, Homo sapiens
ctggctggagtgcaggtgagtg

SEQ ID NO: 9013663 - DNA, 22 bp, Homo sapiens
ctggctggcaagtagaacacaa

SEQ ID NO: 9013664 - DNA, 22 bp, Homo sapiens
ctggcccatggtgagctctggg

SEQ ID NO: 9013665 - DNA, 22 bp, Homo sapiens
ctggcccatggtgagctctggg

SEQ ID NO: 9013666 - DNA, 22 bp, Homo sapiens
ctggcccatggtgagctctggg

SEQ ID NO: 9013667 - DNA, 20 bp, Homo sapiens
ctggcccatctaccgctctg

SEQ ID NO: 9013668 - DNA, 20 bp, Homo sapiens
ctggcccatctaccgctctg

SEQ ID NO: 9013669 - DNA, 20 bp, Homo sapiens
ctggcccatctaccgctctg

SEQ ID NO: 9013670 - DNA, 22 bp, Homo sapiens
ctggcccatggtgagctctggg

SEQ ID NO: 9013671 - DNA, 22 bp, Homo sapiens
ctggcccatggtgagctctggg

SEQ ID NO: 9013672 - DNA, 22 bp, Homo sapiens
ctggcccattgccttctctctc

SEQ ID NO: 9013673 - DNA, 22 bp, Homo sapiens
ctggcccatggtgagctctggg

SEQ ID NO: 9013674 - DNA, 22 bp, Homo sapiens
ctggccccaggcagcctgctgg

SEQ ID NO: 9013675 - DNA, 22 bp, Homo sapiens
ctggcccattgccttctctctc

SEQ ID NO: 9013676 - DNA, 22 bp, Homo sapiens
ctggcccccacacctgtcaggg

SEQ ID NO: 9013677 - DNA, 22 bp, Homo sapiens
ctggcccccacacctgtcaggg

SEQ ID NO: 9013678 - DNA, 22 bp, Homo sapiens
ctggccccggttcctaaaaacc

SEQ ID NO: 9013679 - DNA, 22 bp, Homo sapiens
ctggcccccacacctgtcaggg

SEQ ID NO: 9013680 - DNA, 22 bp, Homo sapiens
ctggccccaggcagcctgctgg

SEQ ID NO: 9013681 - DNA, 22 bp, Homo sapiens
ctggccccatctggagtctgag

SEQ ID NO: 9013682 - DNA, 22 bp, Homo sapiens
ctggccccatctggagtctgag

SEQ ID NO: 9013683 - DNA, 22 bp, Homo sapiens
ctggccccaggcagcctgctgg

SEQ ID NO: 9013684 - DNA, 22 bp, Homo sapiens
atagcaaaggacaatagtcagt

SEQ ID NO: 9013685 - DNA, 22 bp, Homo sapiens
atagcaaaggacaatagtcagt

SEQ ID NO: 9013686 - DNA, 22 bp, Homo sapiens
atagcaaaggacaatagtcagt

SEQ ID NO: 9013687 - DNA, 22 bp, Homo sapiens
ctggcccagttctgcgttttgc

SEQ ID NO: 9013688 - DNA, 22 bp, Homo sapiens
atagcaaaggacaatagtcagt

SEQ ID NO: 9013689 - DNA, 22 bp, Homo sapiens
atagcaaaggacaatagtcagt

SEQ ID NO: 9013690 - DNA, 22 bp, Homo sapiens
atagcaaagatgtcaattcccc

SEQ ID NO: 9013691 - DNA, 22 bp, Homo sapiens
atagcaaagatgtcaattcccc

SEQ ID NO: 9013692 - DNA, 22 bp, Homo sapiens
atagcaaagcctggcacaatga

SEQ ID NO: 9013693 - DNA, 22 bp, Homo sapiens
atagcaaagcctggcacaatga

SEQ ID NO: 9013694 - DNA, 22 bp, Homo sapiens
atagcaaagcctggcacaatga

SEQ ID NO: 9013695 - DNA, 22 bp, Homo sapiens
atagcaaagcctggcacaatga

SEQ ID NO: 9013696 - DNA, 22 bp, Homo sapiens
atagcaaaggacaatagtcagt

SEQ ID NO: 9013697 - DNA, 22 bp, Homo sapiens
atagcaaaagcatgtgcaatac

SEQ ID NO: 9013698 - DNA, 22 bp, Homo sapiens
atagcaaaagcatgtgcaatac

SEQ ID NO: 9013699 - DNA, 22 bp, Homo sapiens
atagcaaaagcatgtgcaatac

SEQ ID NO: 9013700 - DNA, 22 bp, Homo sapiens
atagcaaaagcatgtgcaatac

SEQ ID NO: 9013701 - DNA, 22 bp, Homo sapiens
atagcaaaaggcaccagagtga

SEQ ID NO: 9013702 - DNA, 22 bp, Homo sapiens
atagcaaaaatgaacaaagctt

SEQ ID NO: 9013703 - DNA, 22 bp, Homo sapiens
atagcaaaacccactgcattac

SEQ ID NO: 9013704 - DNA, 22 bp, Homo sapiens
atagcaaaacccactgcattac

SEQ ID NO: 9013705 - DNA, 22 bp, Homo sapiens
atagcaaactggagcttgcttt

SEQ ID NO: 9013706 - DNA, 22 bp, Homo sapiens
atagcaaactggagcttgcttt

SEQ ID NO: 9013707 - DNA, 22 bp, Homo sapiens
atagcaaactggagcttgcttt

SEQ ID NO: 9013708 - DNA, 22 bp, Homo sapiens
atagcaaaaggcaccagagtga

SEQ ID NO: 9013709 - DNA, 22 bp, Homo sapiens
atagcaaactggcagcttgtgg

SEQ ID NO: 9013710 - DNA, 22 bp, Homo sapiens
atagcaaactggcagcttgtgg

SEQ ID NO: 9013711 - DNA, 22 bp, Homo sapiens
atagcaaactggcagcttgtgg

SEQ ID NO: 9013712 - DNA, 22 bp, Homo sapiens
atagcaaactggcagcttgtgg

SEQ ID NO: 9013713 - DNA, 22 bp, Homo sapiens
atagcaaagatcacttccttga

SEQ ID NO: 9013714 - DNA, 22 bp, Homo sapiens
atagagctataagaattttgtg

SEQ ID NO: 9013715 - DNA, 22 bp, Homo sapiens
atagatgtgtgtaagtacataa

SEQ ID NO: 9013716 - DNA, 22 bp, Homo sapiens
atagatgttcaatcagatattt

SEQ ID NO: 9013717 - DNA, 22 bp, Homo sapiens
atagatgttcaatcagatattt

SEQ ID NO: 9013718 - DNA, 22 bp, Homo sapiens
atagagatgggtttagttataa

SEQ ID NO: 9013719 - DNA, 22 bp, Homo sapiens
atagagatgggtttagttataa

SEQ ID NO: 9013720 - DNA, 22 bp, Homo sapiens
atagagactatagagcacttac

SEQ ID NO: 9013721 - DNA, 22 bp, Homo sapiens
atactcaaggttaatgattgaa

SEQ ID NO: 9013722 - DNA, 22 bp, Homo sapiens
atactcaaggttaatgattgaa

SEQ ID NO: 9013723 - DNA, 22 bp, Homo sapiens
atactatattaccttctcaact

SEQ ID NO: 9013724 - DNA, 22 bp, Homo sapiens
atactatattaccttctcaact

SEQ ID NO: 9013725 - DNA, 22 bp, Homo sapiens
atagatttgaatttaagacttg

SEQ ID NO: 9013726 - DNA, 22 bp, Homo sapiens
atagatttgaatttaagacttg

SEQ ID NO: 9013727 - DNA, 22 bp, Homo sapiens
atagatttgaatttaagacttg

SEQ ID NO: 9013728 - DNA, 22 bp, Homo sapiens
atagatttgaatttaagacttg

SEQ ID NO: 9013729 - DNA, 22 bp, Homo sapiens
atagatgttttagtaatactgt

SEQ ID NO: 9013730 - DNA, 22 bp, Homo sapiens
atagatgttttagtaatactgt

SEQ ID NO: 9013731 - DNA, 22 bp, Homo sapiens
atagatgttttctcctaattgg

SEQ ID NO: 9013732 - DNA, 22 bp, Homo sapiens
atagattagccctatagtttta

SEQ ID NO: 9013733 - DNA, 22 bp, Homo sapiens
atagattatttgctcattactt

SEQ ID NO: 9013734 - DNA, 22 bp, Homo sapiens
atagattatttgctcattactt

SEQ ID NO: 9013735 - DNA, 22 bp, Homo sapiens
atactacatactatgtaaacat

SEQ ID NO: 9013736 - DNA, 22 bp, Homo sapiens
atactacatactatgtaaacat

SEQ ID NO: 9013737 - DNA, 22 bp, Homo sapiens
atactacactatgcatggatgt

SEQ ID NO: 9013738 - DNA, 22 bp, Homo sapiens
atactacacattgactatattt

SEQ ID NO: 9013739 - DNA, 22 bp, Homo sapiens
atactacacattgactatattt

SEQ ID NO: 9013740 - DNA, 22 bp, Homo sapiens
atactacacattgactatattt

SEQ ID NO: 9013741 - DNA, 22 bp, Homo sapiens
atactacattattagagcctgg

SEQ ID NO: 9013742 - DNA, 21 bp, Homo sapiens
atactacatttctctgacttt

SEQ ID NO: 9013743 - DNA, 21 bp, Homo sapiens
atactacatttctctgacttt

SEQ ID NO: 9013744 - DNA, 22 bp, Homo sapiens
atactacatttgaaaattgcag

SEQ ID NO: 9013745 - DNA, 22 bp, Homo sapiens
atactacatttgaaaattgcag

SEQ ID NO: 9013746 - DNA, 22 bp, Homo sapiens
atactacatactatgtaaacat

SEQ ID NO: 9013747 - DNA, 22 bp, Homo sapiens
atactacatactatgtaaacat

SEQ ID NO: 9013748 - DNA, 22 bp, Homo sapiens
atactacatcacagccaagaag

SEQ ID NO: 9013749 - DNA, 22 bp, Homo sapiens
atactacatactatgtaaacat

SEQ ID NO: 9013750 - DNA, 22 bp, Homo sapiens
atactaaagtatagaacttagt

SEQ ID NO: 9013751 - DNA, 22 bp, Homo sapiens
atactaagctcattacattttg

SEQ ID NO: 9013752 - DNA, 22 bp, Homo sapiens
atactaagcccaagaacacatg

SEQ ID NO: 9013753 - DNA, 22 bp, Homo sapiens
atactacaaggtatgtgctaaa

SEQ ID NO: 9013754 - DNA, 22 bp, Homo sapiens
atactacaatcataattgtaca

SEQ ID NO: 9013755 - DNA, 22 bp, Homo sapiens
atactacaatcataattgtaca

SEQ ID NO: 9013756 - DNA, 22 bp, Homo sapiens
atactacaatcataattgtaca

SEQ ID NO: 9013757 - DNA, 22 bp, Homo sapiens
ctcctgggtcattgccagcaaa

SEQ ID NO: 9013758 - DNA, 22 bp, Homo sapiens
ctcctgggtcattgccagcaaa

SEQ ID NO: 9013759 - DNA, 22 bp, Homo sapiens
ctcctgggtcattgccagcaaa

SEQ ID NO: 9013760 - DNA, 22 bp, Homo sapiens
ctcctgggggacagcggcaggg

SEQ ID NO: 9013761 - DNA, 22 bp, Homo sapiens
ctcctgggggacagcggcaggg

SEQ ID NO: 9013762 - DNA, 22 bp, Homo sapiens
ctcctgggggacagcggcaggg

SEQ ID NO: 9013763 - DNA, 22 bp, Homo sapiens
ctcctgggggacagcggcaggg

SEQ ID NO: 9013764 - DNA, 22 bp, Homo sapiens
ctcctgggggacagcggcaggg

SEQ ID NO: 9013765 - DNA, 22 bp, Homo sapiens
ctcctggggccatggaaggaac

SEQ ID NO: 9013766 - DNA, 22 bp, Homo sapiens
ctcctggggccatggaaggaac

SEQ ID NO: 9013767 - DNA, 22 bp, Homo sapiens
ctcctggggccatggaaggaac

SEQ ID NO: 9013768 - DNA, 22 bp, Homo sapiens
ctcctggggcacttagaagcaa

SEQ ID NO: 9013769 - DNA, 22 bp, Homo sapiens
ctcctggggcacttagaagcaa

SEQ ID NO: 9013770 - DNA, 22 bp, Homo sapiens
ctcctgggcttcgaaggctccc

SEQ ID NO: 9013771 - DNA, 22 bp, Homo sapiens
ctcctgggcttcgaaggctccc

SEQ ID NO: 9013772 - DNA, 20 bp, Homo sapiens
ctcctgggactgctggttat

SEQ ID NO: 9013773 - DNA, 22 bp, Homo sapiens
ctcctgggcttcgaaggctccc

SEQ ID NO: 9013774 - DNA, 22 bp, Homo sapiens
ctcctgggcttcgaaggctccc

SEQ ID NO: 9013775 - DNA, 22 bp, Homo sapiens
ctcctggggcacttagaagcaa

SEQ ID NO: 9013776 - DNA, 22 bp, Homo sapiens
ctcctgggaaaggctggacaca

SEQ ID NO: 9013777 - DNA, 22 bp, Homo sapiens
ctcctgggaaaggctggacaca

SEQ ID NO: 9013778 - DNA, 22 bp, Homo sapiens
ctcctggctttcccagaccagg

SEQ ID NO: 9013779 - DNA, 22 bp, Homo sapiens
ctcctggctttcccagaccagg

SEQ ID NO: 9013780 - DNA, 22 bp, Homo sapiens
ctcctgggaaatgaaggggcag

SEQ ID NO: 9013781 - DNA, 22 bp, Homo sapiens
ctcctgggaaaggctggacaca

SEQ ID NO: 9013782 - DNA, 22 bp, Homo sapiens
ctcctgggaaaggctggacaca

SEQ ID NO: 9013783 - DNA, 22 bp, Homo sapiens
ctcctgggaaatgaaggggcag

SEQ ID NO: 9013784 - DNA, 22 bp, Homo sapiens
ctcctgggaatttagttgtgag

SEQ ID NO: 9013785 - DNA, 22 bp, Homo sapiens
ctcctgggaaatgaaggggcag

SEQ ID NO: 9013786 - DNA, 22 bp, Homo sapiens
ctcctgggaaatgaaggggcag

SEQ ID NO: 9013787 - DNA, 20 bp, Homo sapiens
ctcctgggactgctggttat

SEQ ID NO: 9013788 - DNA, 20 bp, Homo sapiens
ctcctgggactgctggttat

SEQ ID NO: 9013789 - DNA, 20 bp, Homo sapiens
ctcctgggactgctggttat

SEQ ID NO: 9013790 - DNA, 22 bp, Homo sapiens
ctcctgggaatttagttgtgag

SEQ ID NO: 9013791 - DNA, 22 bp, Homo sapiens
ctcctgggaatttagttgtgag

SEQ ID NO: 9013792 - DNA, 22 bp, Homo sapiens
ctcctgggaatttagttgtgag

SEQ ID NO: 9013793 - DNA, 22 bp, Homo sapiens
ctctcagacacccatttggaaa

SEQ ID NO: 9013794 - DNA, 22 bp, Homo sapiens
ctctcagactgaagggcctgtg

SEQ ID NO: 9013795 - DNA, 22 bp, Homo sapiens
ctctcagactgaagggcctgtg

SEQ ID NO: 9013796 - DNA, 22 bp, Homo sapiens
ctctcagatggagtgtgaatgg

SEQ ID NO: 9013797 - DNA, 22 bp, Homo sapiens
ctctcagcaggaaagcatgcaa

SEQ ID NO: 9013798 - DNA, 19 bp, Homo sapiens
agtggcagatctggaagta

SEQ ID NO: 9013799 - DNA, 19 bp, Homo sapiens
agtggcagatctggaagta

SEQ ID NO: 9013800 - DNA, 22 bp, Homo sapiens
ctctcagaagtagcacgtgggc

SEQ ID NO: 9013801 - DNA, 22 bp, Homo sapiens
ctctcagaagtttatgtcagaa

SEQ ID NO: 9013802 - DNA, 22 bp, Homo sapiens
ctctcagaagtttatgtcagaa

SEQ ID NO: 9013803 - DNA, 19 bp, Homo sapiens
agtggcagatctggaagta

SEQ ID NO: 9013804 - DNA, 19 bp, Homo sapiens
agtggcagatctggaagta

SEQ ID NO: 9013805 - DNA, 19 bp, Homo sapiens
agtggcagatctggaagta

SEQ ID NO: 9013806 - DNA, 22 bp, Homo sapiens
agtggcagatctctggtctgga

SEQ ID NO: 9013807 - DNA, 22 bp, Homo sapiens
agtggcagatctctggtctgga

SEQ ID NO: 9013808 - DNA, 22 bp, Homo sapiens
agtggcagatctctggtctgga

SEQ ID NO: 9013809 - DNA, 22 bp, Homo sapiens
agtggcagagtgcactcaggca

SEQ ID NO: 9013810 - DNA, 22 bp, Homo sapiens
agtggcagagtgcactcaggca

SEQ ID NO: 9013811 - DNA, 22 bp, Homo sapiens
agtggcagagtgcactcaggca

SEQ ID NO: 9013812 - DNA, 22 bp, Homo sapiens
agtggcagagtgcactcaggca

SEQ ID NO: 9013813 - DNA, 22 bp, Homo sapiens
agtggcagagtgcactcaggca

SEQ ID NO: 9013814 - DNA, 22 bp, Homo sapiens
agtggcagagtgcactcaggca

SEQ ID NO: 9013815 - DNA, 22 bp, Homo sapiens
agtggcagagtcagggtttgga

SEQ ID NO: 9013816 - DNA, 22 bp, Homo sapiens
agtggcagagtcagggtttgga

SEQ ID NO: 9013817 - DNA, 22 bp, Homo sapiens
agtggcagagtcagggtttgga

SEQ ID NO: 9013818 - DNA, 22 bp, Homo sapiens
agtggcagagtgcactcaggca

SEQ ID NO: 9013819 - DNA, 22 bp, Homo sapiens
agtggcagaggttgactgcagt

SEQ ID NO: 9013820 - DNA, 22 bp, Homo sapiens
agtggcagaggttgactgcagt

SEQ ID NO: 9013821 - DNA, 22 bp, Homo sapiens
agtggcagaggttgactgcagt

SEQ ID NO: 9013822 - DNA, 22 bp, Homo sapiens
agtggcagaggttgactgcagt

SEQ ID NO: 9013823 - DNA, 22 bp, Homo sapiens
agtggcagaggttgactgcagt

SEQ ID NO: 9013824 - DNA, 22 bp, Homo sapiens
agtggcagaagccaagtctgca

SEQ ID NO: 9013825 - DNA, 22 bp, Homo sapiens
agtggcagaagccaagtctgca

SEQ ID NO: 9013826 - DNA, 22 bp, Homo sapiens
agtggcagagctgtgtcttgaa

SEQ ID NO: 9013827 - DNA, 22 bp, Homo sapiens
agtggcagaggttgactgcagt

SEQ ID NO: 9013828 - DNA, 20 bp, Homo sapiens
ctcctggtccaggagcctga

SEQ ID NO: 9013829 - DNA, 22 bp, Homo sapiens
ctcctgggtcattgccagcaaa

SEQ ID NO: 9013830 - DNA, 22 bp, Homo sapiens
ctcctgggtcattgccagcaaa

SEQ ID NO: 9013831 - DNA, 22 bp, Homo sapiens
ctcctgggtcattgccagcaaa

SEQ ID NO: 9013832 - DNA, 23 bp, Homo sapiens
ctcctggtgctgctatcaggggt

SEQ ID NO: 9013833 - DNA, 22 bp, Homo sapiens
ctcctggtgctggggctgccgc

SEQ ID NO: 9013834 - DNA, 22 bp, Homo sapiens
ctcctggtgctggggctgccgc

SEQ ID NO: 9013835 - DNA, 22 bp, Homo sapiens
ctcctggtgactcccagataaa

SEQ ID NO: 9013836 - DNA, 20 bp, Homo sapiens
ctcctggtccaggagcctga

SEQ ID NO: 9013837 - DNA, 22 bp, Homo sapiens
ctccctcatatacccagcgaga

SEQ ID NO: 9013838 - DNA, 22 bp, Homo sapiens
ctccctcatatacccagcgaga

SEQ ID NO: 9013839 - DNA, 22 bp, Homo sapiens
ctccctcaggccttagccctgc

SEQ ID NO: 9013840 - DNA, 22 bp, Homo sapiens
ctccctcaggccttagccctgc

SEQ ID NO: 9013841 - DNA, 22 bp, Homo sapiens
ctccctccctacgtgagctcac

SEQ ID NO: 9013842 - DNA, 22 bp, Homo sapiens
ctccctccaaataagactcggg

SEQ ID NO: 9013843 - DNA, 22 bp, Homo sapiens
ctccctccaaataagactcggg

SEQ ID NO: 9013844 - DNA, 22 bp, Homo sapiens
ctccctcatatacccagcgaga

SEQ ID NO: 9013845 - DNA, 22 bp, Homo sapiens
ctccctctcaccggagccctgg

SEQ ID NO: 9013846 - DNA, 22 bp, Homo sapiens
ctccctcctcaaatatctttgt

SEQ ID NO: 9013847 - DNA, 22 bp, Homo sapiens
ctccctcctcaaatatctttgt

SEQ ID NO: 9013848 - DNA, 22 bp, Homo sapiens
ctccctctcaccggagccctgg

SEQ ID NO: 9013849 - DNA, 22 bp, Homo sapiens
ctccctccctacgtgagctcac

SEQ ID NO: 9013850 - DNA, 22 bp, Homo sapiens
ctccctccctacgtgagctcac

SEQ ID NO: 9013851 - DNA, 22 bp, Homo sapiens
ctccctccctacgtgagctcac

SEQ ID NO: 9013852 - DNA, 22 bp, Homo sapiens
ctccctccctacgtgagctcac

SEQ ID NO: 9013853 - DNA, 18 bp, Homo sapiens
ctccagggaactcagtca

SEQ ID NO: 9013854 - DNA, 18 bp, Homo sapiens
ctccagggaactcagtca

SEQ ID NO: 9013855 - DNA, 20 bp, Homo sapiens
ctccagggaacagactggag

SEQ ID NO: 9013856 - DNA, 18 bp, Homo sapiens
ctccagggaactcagtca

SEQ ID NO: 9013857 - DNA, 20 bp, Homo sapiens
ctccagggaacagactggag

SEQ ID NO: 9013858 - DNA, 20 bp, Homo sapiens
ctccagggaacagactggag

SEQ ID NO: 9013859 - DNA, 20 bp, Homo sapiens
ctccagggaacagactggag

SEQ ID NO: 9013860 - DNA, 20 bp, Homo sapiens
ctccagggaacagactggag

SEQ ID NO: 9013861 - DNA, 22 bp, Homo sapiens
ctccctcagaggagcacctgtt

SEQ ID NO: 9013862 - DNA, 22 bp, Homo sapiens
ctccctcaccatgacccgctgt

SEQ ID NO: 9013863 - DNA, 22 bp, Homo sapiens
ctccctcagaggagcacctgtt

SEQ ID NO: 9013864 - DNA, 22 bp, Homo sapiens
ctccctcaccatgacccgctgt

SEQ ID NO: 9013865 - DNA, 22 bp, Homo sapiens
ctccctcaccatgacccgctgt

SEQ ID NO: 9013866 - DNA, 22 bp, Homo sapiens
ctcccaggttgattctttccct

SEQ ID NO: 9013867 - DNA, 22 bp, Homo sapiens
ctccctcacacccttgcccaga

SEQ ID NO: 9013868 - DNA, 22 bp, Homo sapiens
ctcccaggttgattctttccct

SEQ ID NO: 9013869 - DNA, 22 bp, Homo sapiens
ctcctgccaccgcggtgtcctg

SEQ ID NO: 9013870 - DNA, 22 bp, Homo sapiens
ctcctgccaccgcggtgtcctg

SEQ ID NO: 9013871 - DNA, 22 bp, Homo sapiens
ctcctgcccacgtgctacttct

SEQ ID NO: 9013872 - DNA, 22 bp, Homo sapiens
ctcctgccaccgcggtgtcctg

SEQ ID NO: 9013873 - DNA, 22 bp, Homo sapiens
ctcctcagactttccttgtccg

SEQ ID NO: 9013874 - DNA, 22 bp, Homo sapiens
ctcctcagactttccttgtccg

SEQ ID NO: 9013875 - DNA, 22 bp, Homo sapiens
ctcctcagaacagccttggctg

SEQ ID NO: 9013876 - DNA, 22 bp, Homo sapiens
ctcctcagaacagccttggctg

SEQ ID NO: 9013877 - DNA, 22 bp, Homo sapiens
ctcctcagaacagccttggctg

SEQ ID NO: 9013878 - DNA, 22 bp, Homo sapiens
ctcctcagaacagccttggctg

SEQ ID NO: 9013879 - DNA, 22 bp, Homo sapiens
ctcctcagaagagggtaacaca

SEQ ID NO: 9013880 - DNA, 22 bp, Homo sapiens
ctcctcagaagagggtaacaca

SEQ ID NO: 9013881 - DNA, 22 bp, Homo sapiens
ctcctgcctgtgggactgagga

SEQ ID NO: 9013882 - DNA, 22 bp, Homo sapiens
ctcctggctcgcccccagctga

SEQ ID NO: 9013883 - DNA, 22 bp, Homo sapiens
ctcctgcctgtgggactgagga

SEQ ID NO: 9013884 - DNA, 18 bp, Homo sapiens
ctcctggctgatggtgag

SEQ ID NO: 9013885 - DNA, 19 bp, Homo sapiens
ctcctggctctgtcatttt

SEQ ID NO: 9013886 - DNA, 18 bp, Homo sapiens
ctcctggctgatggtgag

SEQ ID NO: 9013887 - DNA, 22 bp, Homo sapiens
ctcctacagtgtttgagtccag

SEQ ID NO: 9013888 - DNA, 22 bp, Homo sapiens
ctcctagatgtcttcagagaaa

SEQ ID NO: 9013889 - DNA, 22 bp, Homo sapiens
ctccgtgctattttagtatcgc

SEQ ID NO: 9013890 - DNA, 22 bp, Homo sapiens
ctccgtggctgtggacgcagcc

SEQ ID NO: 9013891 - DNA, 22 bp, Homo sapiens
ctcctaggacgccgctgctcct

SEQ ID NO: 9013892 - DNA, 22 bp, Homo sapiens
ctcctaggtaacagggtggttt

SEQ ID NO: 9013893 - DNA, 22 bp, Homo sapiens
ctcctaggtgctcactggggtc

SEQ ID NO: 9013894 - DNA, 22 bp, Homo sapiens
ctcctagtgcacacctgtccac

SEQ ID NO: 9013895 - DNA, 22 bp, Homo sapiens
ctcctagtgcacacctgtccac

SEQ ID NO: 9013896 - DNA, 22 bp, Homo sapiens
ctcctaggtgctcactggggtc

SEQ ID NO: 9013897 - DNA, 22 bp, Homo sapiens
ctcctaggtgctcactggggtc

SEQ ID NO: 9013898 - DNA, 22 bp, Homo sapiens
ctcctcacacccactgcaacca

SEQ ID NO: 9013899 - DNA, 22 bp, Homo sapiens
ctcctcacacccactgcaacca

SEQ ID NO: 9013900 - DNA, 22 bp, Homo sapiens
ctcctcactttccagactgggc

SEQ ID NO: 9013901 - DNA, 22 bp, Homo sapiens
ctcctcactttccagactgggc

SEQ ID NO: 9013902 - DNA, 22 bp, Homo sapiens
ctcctcagaacagccttggctg

SEQ ID NO: 9013903 - DNA, 22 bp, Homo sapiens
agtccctctgggagcaggactg

SEQ ID NO: 9013904 - DNA, 22 bp, Homo sapiens
agtccctctgggagcaggactg

SEQ ID NO: 9013905 - DNA, 22 bp, Homo sapiens
agtccctccaacacagtattag

SEQ ID NO: 9013906 - DNA, 21 bp, Homo sapiens
agtcccctgtccttacttcta

SEQ ID NO: 9013907 - DNA, 21 bp, Homo sapiens
agtcccctgtccttacttcta

SEQ ID NO: 9013908 - DNA, 22 bp, Homo sapiens
agtccctccaacacagtattag

SEQ ID NO: 9013909 - DNA, 22 bp, Homo sapiens
agtccctggattgtctctgtca

SEQ ID NO: 9013910 - DNA, 22 bp, Homo sapiens
agtccctggattgtctctgtca

SEQ ID NO: 9013911 - DNA, 23 bp, Homo sapiens
agtcccctacatagttcctgggg

SEQ ID NO: 9013912 - DNA, 22 bp, Homo sapiens
agtccccctctgagcccaggga

SEQ ID NO: 9013913 - DNA, 22 bp, Homo sapiens
agtcccctctcgcttggctgag

SEQ ID NO: 9013914 - DNA, 22 bp, Homo sapiens
agtcccctctaacccaacttta

SEQ ID NO: 9013915 - DNA, 22 bp, Homo sapiens
agtcccctggcaggagggacgt

SEQ ID NO: 9013916 - DNA, 22 bp, Homo sapiens
agtccctgtactttccactgcc

SEQ ID NO: 9013917 - DNA, 22 bp, Homo sapiens
agtccctttagtctggagagct

SEQ ID NO: 9013918 - DNA, 22 bp, Homo sapiens
agtcccttctcaaagtgtgcgg

SEQ ID NO: 9013919 - DNA, 22 bp, Homo sapiens
agtcccttctcaaagtgtgcgg

SEQ ID NO: 9013920 - DNA, 22 bp, Homo sapiens
agtccctgtactttccactgcc

SEQ ID NO: 9013921 - DNA, 22 bp, Homo sapiens
agtccgtggccagactcaagag

SEQ ID NO: 9013922 - DNA, 22 bp, Homo sapiens
agtccgtggccagactcaagag

SEQ ID NO: 9013923 - DNA, 22 bp, Homo sapiens
agtccggtcagggggctgctgt

SEQ ID NO: 9013924 - DNA, 22 bp, Homo sapiens
agtccgcctgctgccgtggcag

SEQ ID NO: 9013925 - DNA, 20 bp, Homo sapiens
agtccctttggtcaggtatt

SEQ ID NO: 9013926 - DNA, 22 bp, Homo sapiens
agtccgcctgctgccgtggcag

SEQ ID NO: 9013927 - DNA, 22 bp, Homo sapiens
agtcctggacttggagtcaggg

SEQ ID NO: 9013928 - DNA, 22 bp, Homo sapiens
agtcctggcatataggtcctca

SEQ ID NO: 9013929 - DNA, 22 bp, Homo sapiens
agtcctggcatataggtcctca

SEQ ID NO: 9013930 - DNA, 18 bp, Homo sapiens
agtcctggagatcaccaa

SEQ ID NO: 9013931 - DNA, 22 bp, Homo sapiens
agtcctggcatggaattgtccc

SEQ ID NO: 9013932 - DNA, 22 bp, Homo sapiens
agtcctggcatataggtcctca

SEQ ID NO: 9013933 - DNA, 22 bp, Homo sapiens
agtcctggcatataggtcctca

SEQ ID NO: 9013934 - DNA, 22 bp, Homo sapiens
agtcctgatgctctggcaggag

SEQ ID NO: 9013935 - DNA, 22 bp, Homo sapiens
agtcctgatgctctggcaggag

SEQ ID NO: 9013936 - DNA, 22 bp, Homo sapiens
agtcctaggccctgctccagat

SEQ ID NO: 9013937 - DNA, 22 bp, Homo sapiens
agtcctagccctggatccatca

SEQ ID NO: 9013938 - DNA, 22 bp, Homo sapiens
agtcctagacttttctgccact

SEQ ID NO: 9013939 - DNA, 20 bp, Homo sapiens
ctcatgtggcaccaggcact

SEQ ID NO: 9013940 - DNA, 18 bp, Homo sapiens
ctcatgtgtggtcccagc

SEQ ID NO: 9013941 - DNA, 22 bp, Homo sapiens
ctcattagacaggtatacttta

SEQ ID NO: 9013942 - DNA, 22 bp, Homo sapiens
ctcatgtgtctggtaggagctt

SEQ ID NO: 9013943 - DNA, 22 bp, Homo sapiens
ctcattaaaggaaatcacctgc

SEQ ID NO: 9013944 - DNA, 22 bp, Homo sapiens
ctcatgtaagagagcattagtt

SEQ ID NO: 9013945 - DNA, 22 bp, Homo sapiens
ctcatggcagagtcacctgtcc

SEQ ID NO: 9013946 - DNA, 22 bp, Homo sapiens
ctcatgtcccagacttaatcag

SEQ ID NO: 9013947 - DNA, 22 bp, Homo sapiens
ctcatgtcttcacccattctaa

SEQ ID NO: 9013948 - DNA, 22 bp, Homo sapiens
ctcatgtcaggggtgtcaatgt

SEQ ID NO: 9013949 - DNA, 22 bp, Homo sapiens
ctcattcattcccgcagccacc

SEQ ID NO: 9013950 - DNA, 22 bp, Homo sapiens
ctcattctttcacagtctgtgg

SEQ ID NO: 9013951 - DNA, 22 bp, Homo sapiens
ctcattgcaacctccgcctccc

SEQ ID NO: 9013952 - DNA, 22 bp, Homo sapiens
ctcattgcaacctccgcctccc

SEQ ID NO: 9013953 - DNA, 22 bp, Homo sapiens
ctcattgcaacctccgcctccc

SEQ ID NO: 9013954 - DNA, 22 bp, Homo sapiens
ctcattgcagctgcattactgt

SEQ ID NO: 9013955 - DNA, 22 bp, Homo sapiens
ctcattgcaacctccgcctccc

SEQ ID NO: 9013956 - DNA, 22 bp, Homo sapiens
ctcattgcccagatccccacag

SEQ ID NO: 9013957 - DNA, 22 bp, Homo sapiens
ctcatgatttgagtagtaaact

SEQ ID NO: 9013958 - DNA, 22 bp, Homo sapiens
ctcatgatgtagcgaatgagaa

SEQ ID NO: 9013959 - DNA, 18 bp, Homo sapiens
ctcagtgtttgctgaaaa

SEQ ID NO: 9013960 - DNA, 22 bp, Homo sapiens
ctcatgcccagagccactgttg

SEQ ID NO: 9013961 - DNA, 22 bp, Homo sapiens
agtcctgggtccagcaggtcct

SEQ ID NO: 9013962 - DNA, 22 bp, Homo sapiens
agtcctgggtccagcaggtcct

SEQ ID NO: 9013963 - DNA, 22 bp, Homo sapiens
agtcctgggtccagcaggtcct

SEQ ID NO: 9013964 - DNA, 18 bp, Homo sapiens
ctcagtgtttgctgaaaa

SEQ ID NO: 9013965 - DNA, 22 bp, Homo sapiens
ctcagtgttaaatataaggtat

SEQ ID NO: 9013966 - DNA, 18 bp, Homo sapiens
agtcctggctctaccacc

SEQ ID NO: 9013967 - DNA, 22 bp, Homo sapiens
agtcctggctctacgggcttca

SEQ ID NO: 9013968 - DNA, 22 bp, Homo sapiens
agtcctggccccaaggaaggat

SEQ ID NO: 9013969 - DNA, 22 bp, Homo sapiens
ctccagctgccaccagatgttt

SEQ ID NO: 9013970 - DNA, 22 bp, Homo sapiens
ctccagctcttaactgcggaag

SEQ ID NO: 9013971 - DNA, 22 bp, Homo sapiens
ctccagctcttaactgcggaag

SEQ ID NO: 9013972 - DNA, 22 bp, Homo sapiens
ctccagctcttaactgcggaag

SEQ ID NO: 9013973 - DNA, 22 bp, Homo sapiens
ctccagctcttaactgcggaag

SEQ ID NO: 9013974 - DNA, 22 bp, Homo sapiens
ctccagagatccattgaatgta

SEQ ID NO: 9013975 - DNA, 22 bp, Homo sapiens
ctccagagatccattgaatgta

SEQ ID NO: 9013976 - DNA, 22 bp, Homo sapiens
ctccagagatacacggtcttgc

SEQ ID NO: 9013977 - DNA, 22 bp, Homo sapiens
ctccagcctcatctcctggctg

SEQ ID NO: 9013978 - DNA, 22 bp, Homo sapiens
agtcttcatttagttgatccag

SEQ ID NO: 9013979 - DNA, 22 bp, Homo sapiens
agtcttcatttgtgttcaagac

SEQ ID NO: 9013980 - DNA, 22 bp, Homo sapiens
agtcttcatttgtgttcaagac

SEQ ID NO: 9013981 - DNA, 22 bp, Homo sapiens
agtcttctcatttcacatgctt

SEQ ID NO: 9013982 - DNA, 22 bp, Homo sapiens
agtcttctgaataagaatcact

SEQ ID NO: 9013983 - DNA, 22 bp, Homo sapiens
agtcttctcatttcacatgctt

SEQ ID NO: 9013984 - DNA, 22 bp, Homo sapiens
agtcttctcatttcacatgctt

SEQ ID NO: 9013985 - DNA, 21 bp, Homo sapiens
agtcttctccagaggctgggg

SEQ ID NO: 9013986 - DNA, 22 bp, Homo sapiens
agtcttcagcagggttaaaccc

SEQ ID NO: 9013987 - DNA, 22 bp, Homo sapiens
agtcttcagcagggttaaaccc

SEQ ID NO: 9013988 - DNA, 22 bp, Homo sapiens
agtcttcagcagggttaaaccc

SEQ ID NO: 9013989 - DNA, 22 bp, Homo sapiens
agtcttcagcagccttctcagg

SEQ ID NO: 9013990 - DNA, 23 bp, Homo sapiens
agtcttcattgtatttccagacc

SEQ ID NO: 9013991 - DNA, 19 bp, Homo sapiens
agtcttcatctgccaggcc

SEQ ID NO: 9013992 - DNA, 22 bp, Homo sapiens
agtcttcagagaaattaactct

SEQ ID NO: 9013993 - DNA, 22 bp, Homo sapiens
agtcttcactcttcactactat

SEQ ID NO: 9013994 - DNA, 22 bp, Homo sapiens
agtcttatgtttgtgaagaact

SEQ ID NO: 9013995 - DNA, 22 bp, Homo sapiens
agtcttatggccatctctgatt

SEQ ID NO: 9013996 - DNA, 22 bp, Homo sapiens
agtcttagtatggttttaggtt

SEQ ID NO: 9013997 - DNA, 22 bp, Homo sapiens
agtcttaggctccattagtaga

SEQ ID NO: 9013998 - DNA, 22 bp, Homo sapiens
agtcttatggttaaatagatgc

SEQ ID NO: 9013999 - DNA, 21 bp, Homo sapiens
agtcttaggcacagctgtgtc

SEQ ID NO: 9014000 - DNA, 22 bp, Homo sapiens
agtcttaggctccattagtaga

SEQ ID NO: 9014001 - DNA, 22 bp, Homo sapiens
agtcttagattttattttggtc

SEQ ID NO: 9014002 - DNA, 21 bp, Homo sapiens
agtcttaggcacagctgtgtc

SEQ ID NO: 9014003 - DNA, 22 bp, Homo sapiens
agtcttagagtctgtgtcatga

SEQ ID NO: 9014004 - DNA, 22 bp, Homo sapiens
agtcttagaactacagtgccta

SEQ ID NO: 9014005 - DNA, 22 bp, Homo sapiens
agtcttagaactacagtgccta

SEQ ID NO: 9014006 - DNA, 22 bp, Homo sapiens
ctccaggcgggaggcggttcca

SEQ ID NO: 9014007 - DNA, 22 bp, Homo sapiens
ctccaggcgggaggcggttcca

SEQ ID NO: 9014008 - DNA, 22 bp, Homo sapiens
ctccaggctcgtccaagatcga

SEQ ID NO: 9014009 - DNA, 22 bp, Homo sapiens
ctccaggctcgtccaagatcga

SEQ ID NO: 9014010 - DNA, 22 bp, Homo sapiens
ctccaggctcgtccaagatcga

SEQ ID NO: 9014011 - DNA, 22 bp, Homo sapiens
ctccaggctggatccaagtcaa

SEQ ID NO: 9014012 - DNA, 22 bp, Homo sapiens
ctccaggctggatccaagtcaa

SEQ ID NO: 9014013 - DNA, 22 bp, Homo sapiens
ctccaggaacagcaccctgctg

SEQ ID NO: 9014014 - DNA, 22 bp, Homo sapiens
ctccaggaacagcaccctgctg

SEQ ID NO: 9014015 - DNA, 22 bp, Homo sapiens
ctccaggaaagtcaggcttaga

SEQ ID NO: 9014016 - DNA, 22 bp, Homo sapiens
ctccaggaaagtcaggcttaga

SEQ ID NO: 9014017 - DNA, 22 bp, Homo sapiens
ctccaggaaagtcaggcttaga

SEQ ID NO: 9014018 - DNA, 22 bp, Homo sapiens
ctccaggacactaacccaggct

SEQ ID NO: 9014019 - DNA, 22 bp, Homo sapiens
ctccaggctggggtgcaggttg

SEQ ID NO: 9014020 - DNA, 22 bp, Homo sapiens
ctccaggctggggtgcaggttg

SEQ ID NO: 9014021 - DNA, 22 bp, Homo sapiens
ctccaggctggatccaagtcaa

SEQ ID NO: 9014022 - DNA, 22 bp, Homo sapiens
ctccaggctggatccaagtcaa

SEQ ID NO: 9014023 - DNA, 22 bp, Homo sapiens
ctccaggctggatccaagtcaa

SEQ ID NO: 9014024 - DNA, 22 bp, Homo sapiens
ctccaggctggggtgcaggttg

SEQ ID NO: 9014025 - DNA, 22 bp, Homo sapiens
ctccaggcttcaagggccggcc

SEQ ID NO: 9014026 - DNA, 22 bp, Homo sapiens
ctccagggaaaggggcgtccgc

SEQ ID NO: 9014027 - DNA, 22 bp, Homo sapiens
ctccagggaaaggggcgtccgc

SEQ ID NO: 9014028 - DNA, 22 bp, Homo sapiens
ctccaggctggggtgcaggttg

SEQ ID NO: 9014029 - DNA, 22 bp, Homo sapiens
ctccagctgccaccagatgttt

SEQ ID NO: 9014030 - DNA, 22 bp, Homo sapiens
ctccagcttccctcagctgtgg

SEQ ID NO: 9014031 - DNA, 22 bp, Homo sapiens
ctccagcttctgcccagagact

SEQ ID NO: 9014032 - DNA, 22 bp, Homo sapiens
ctccagcttccctcagctgtgg

SEQ ID NO: 9014033 - DNA, 22 bp, Homo sapiens
ctccagcttccctcagctgtgg

SEQ ID NO: 9014034 - DNA, 22 bp, Homo sapiens
ctccagcttctgcccagagact

SEQ ID NO: 9014035 - DNA, 22 bp, Homo sapiens
ctccagctttagctctccaggg

SEQ ID NO: 9014036 - DNA, 22 bp, Homo sapiens
ctccagctttagctctccaggg

SEQ ID NO: 9014037 - DNA, 22 bp, Homo sapiens
ctccagctttagctctccaggg

SEQ ID NO: 9014038 - DNA, 22 bp, Homo sapiens
ctccagctttagctctccaggg

SEQ ID NO: 9014039 - DNA, 22 bp, Homo sapiens
ctccagctttttcccagttggc

SEQ ID NO: 9014040 - DNA, 22 bp, Homo sapiens
ctccaggaaagcctgaggcccg

SEQ ID NO: 9014041 - DNA, 22 bp, Homo sapiens
ctccaggaaagcctgaggcccg

SEQ ID NO: 9014042 - DNA, 22 bp, Homo sapiens
ctccaggaaagcctgaggcccg

SEQ ID NO: 9014043 - DNA, 22 bp, Homo sapiens
ctccaggaaaatagggaatgag

SEQ ID NO: 9014044 - DNA, 22 bp, Homo sapiens
ctccaggaaaatagggaatgag

SEQ ID NO: 9014045 - DNA, 19 bp, Homo sapiens
ctctgggctgcatcttggt

SEQ ID NO: 9014046 - DNA, 22 bp, Homo sapiens
ctctgggcttacctgcttcctg

SEQ ID NO: 9014047 - DNA, 22 bp, Homo sapiens
ctctgggcttacctgcttcctg

SEQ ID NO: 9014048 - DNA, 22 bp, Homo sapiens
ctctgggcttcaagtcagattt

SEQ ID NO: 9014049 - DNA, 22 bp, Homo sapiens
ctctgggcttacctgcttcctg

SEQ ID NO: 9014050 - DNA, 22 bp, Homo sapiens
ctctgggcttgttgacctgcac

SEQ ID NO: 9014051 - DNA, 22 bp, Homo sapiens
ctctgggcttcctttgtgggtt

SEQ ID NO: 9014052 - DNA, 22 bp, Homo sapiens
ctctgggcttcctttgtgggtt

SEQ ID NO: 9014053 - DNA, 22 bp, Homo sapiens
ctctgggcttcaagtcagattt

SEQ ID NO: 9014054 - DNA, 22 bp, Homo sapiens
ctctgggaccatggcaagtgcg

SEQ ID NO: 9014055 - DNA, 22 bp, Homo sapiens
ctctgggaccatggcaagtgcg

SEQ ID NO: 9014056 - DNA, 22 bp, Homo sapiens
ctctgggactagaaccccaggg

SEQ ID NO: 9014057 - DNA, 22 bp, Homo sapiens
ctctgggaccatggcaagtgcg

SEQ ID NO: 9014058 - DNA, 22 bp, Homo sapiens
ctctgggaccatggcaagtgcg

SEQ ID NO: 9014059 - DNA, 22 bp, Homo sapiens
ctctgggagaggacacttggag

SEQ ID NO: 9014060 - DNA, 22 bp, Homo sapiens
ctctgggagaggacacttggag

SEQ ID NO: 9014061 - DNA, 22 bp, Homo sapiens
ctctgggactagaaccccaggg

SEQ ID NO: 9014062 - DNA, 22 bp, Homo sapiens
ctctgggagaggacacttggag

SEQ ID NO: 9014063 - DNA, 22 bp, Homo sapiens
ctctgggacatcccttggccta

SEQ ID NO: 9014064 - DNA, 22 bp, Homo sapiens
ctctgggacatcccttggccta

SEQ ID NO: 9014065 - DNA, 22 bp, Homo sapiens
ctctgggacatcccttggccta

SEQ ID NO: 9014066 - DNA, 22 bp, Homo sapiens
ctctgggaccacgtgactctgc

SEQ ID NO: 9014067 - DNA, 22 bp, Homo sapiens
ctctgggaccacgtgactctgc

SEQ ID NO: 9014068 - DNA, 22 bp, Homo sapiens
ctctgggaccacgtgactctgc

SEQ ID NO: 9014069 - DNA, 22 bp, Homo sapiens
ctctgggaagggctgagcactg

SEQ ID NO: 9014070 - DNA, 22 bp, Homo sapiens
ctctgggaaagattgtgcaggc

SEQ ID NO: 9014071 - DNA, 22 bp, Homo sapiens
ctctgggaaagattgtgcaggc

SEQ ID NO: 9014072 - DNA, 22 bp, Homo sapiens
ctctggctttgctcatgcatcc

SEQ ID NO: 9014073 - DNA, 22 bp, Homo sapiens
ctctgggaaagattgtgcaggc

SEQ ID NO: 9014074 - DNA, 22 bp, Homo sapiens
ctctggctttgctcatgcatcc

SEQ ID NO: 9014075 - DNA, 22 bp, Homo sapiens
ctctgggaagggctgagcactg

SEQ ID NO: 9014076 - DNA, 22 bp, Homo sapiens
ctctgggaagggctgagcactg

SEQ ID NO: 9014077 - DNA, 22 bp, Homo sapiens
ctctgggaagggctgagcactg

SEQ ID NO: 9014078 - DNA, 22 bp, Homo sapiens
ctctgggaagggctgagcactg

SEQ ID NO: 9014079 - DNA, 22 bp, Homo sapiens
ctctggcttgttaatgcatatt

SEQ ID NO: 9014080 - DNA, 22 bp, Homo sapiens
ctctggcttgttaatgcatatt

SEQ ID NO: 9014081 - DNA, 22 bp, Homo sapiens
ctctggcttgttaatgcatatt

SEQ ID NO: 9014082 - DNA, 22 bp, Homo sapiens
ctctggcttgttaatgcatatt

SEQ ID NO: 9014083 - DNA, 22 bp, Homo sapiens
ctctggctttaaggatgccaca

SEQ ID NO: 9014084 - DNA, 22 bp, Homo sapiens
ctctggctttaaggatgccaca

SEQ ID NO: 9014085 - DNA, 22 bp, Homo sapiens
ctctggctttgctcatgcatcc

SEQ ID NO: 9014086 - DNA, 22 bp, Homo sapiens
ctctggctttcccagggaggag

SEQ ID NO: 9014087 - DNA, 22 bp, Homo sapiens
ctctggctttgctcatgcatcc

SEQ ID NO: 9014088 - DNA, 22 bp, Homo sapiens
ctctggggaagcagccagctgg

SEQ ID NO: 9014089 - DNA, 22 bp, Homo sapiens
ctctgggcttgttgacctgcac

SEQ ID NO: 9014090 - DNA, 22 bp, Homo sapiens
ctctgggcttgttgacctgcac

SEQ ID NO: 9014091 - DNA, 22 bp, Homo sapiens
ctctgggcttgttgacctgcac

SEQ ID NO: 9014092 - DNA, 22 bp, Homo sapiens
ctctgggcttgttgacctgcac

SEQ ID NO: 9014093 - DNA, 22 bp, Homo sapiens
ctctggggaagcagccagctgg

SEQ ID NO: 9014094 - DNA, 22 bp, Homo sapiens
ctctggggaagcagccagctgg

SEQ ID NO: 9014095 - DNA, 22 bp, Homo sapiens
ctctggggtgcttcgacacttc

SEQ ID NO: 9014096 - DNA, 17 bp, Homo sapiens
ctctggggacagttcta

SEQ ID NO: 9014097 - DNA, 22 bp, Homo sapiens
ctctggggtggaggaggctgac

SEQ ID NO: 9014098 - DNA, 22 bp, Homo sapiens
ctctggggttaagcttccatgg

SEQ ID NO: 9014099 - DNA, 22 bp, Homo sapiens
ctctttggtgcaccttgcagtc

SEQ ID NO: 9014100 - DNA, 22 bp, Homo sapiens
ctctttggtgcaccttgcagtc

SEQ ID NO: 9014101 - DNA, 23 bp, Homo sapiens
ctgaaataccagaaaatcagtgt

SEQ ID NO: 9014102 - DNA, 23 bp, Homo sapiens
ctgaaataccagaaaatcagtgt

SEQ ID NO: 9014103 - DNA, 23 bp, Homo sapiens
ctgaaataccagaaaatcagtgt

SEQ ID NO: 9014104 - DNA, 23 bp, Homo sapiens
ctgaaataccagaaaatcagtgt

SEQ ID NO: 9014105 - DNA, 22 bp, Homo sapiens
ctgaaataaagttgctaaaatt

SEQ ID NO: 9014106 - DNA, 22 bp, Homo sapiens
ctgaaataaagttgctaaaatt

SEQ ID NO: 9014107 - DNA, 22 bp, Homo sapiens
ctgaaagggagaacaccaagag

SEQ ID NO: 9014108 - DNA, 22 bp, Homo sapiens
ctgaaaggcagtgggtagtgtg

SEQ ID NO: 9014109 - DNA, 22 bp, Homo sapiens
ctctttggttaatcacacagat

SEQ ID NO: 9014110 - DNA, 22 bp, Homo sapiens
ctgaaagggttacatagtaagt

SEQ ID NO: 9014111 - DNA, 22 bp, Homo sapiens
ctgaaaggtataaataagactt

SEQ ID NO: 9014112 - DNA, 22 bp, Homo sapiens
ctgaaatagtttcatagaactt

SEQ ID NO: 9014113 - DNA, 22 bp, Homo sapiens
ctgaaatatagatgtgaacagt

SEQ ID NO: 9014114 - DNA, 22 bp, Homo sapiens
ctgaaatagtttcatagaactt

SEQ ID NO: 9014115 - DNA, 23 bp, Homo sapiens
ctgaaataccagaaaatcagtgt

SEQ ID NO: 9014116 - DNA, 22 bp, Homo sapiens
ctgaaatcaattttgattatct

SEQ ID NO: 9014117 - DNA, 22 bp, Homo sapiens
ctgaaatcaattttgattatct

SEQ ID NO: 9014118 - DNA, 22 bp, Homo sapiens
ctgaaatgacggtttggggcaa

SEQ ID NO: 9014119 - DNA, 17 bp, Homo sapiens
ctgaaatattatgataa

SEQ ID NO: 9014120 - DNA, 17 bp, Homo sapiens
ctgaaatattatgataa

SEQ ID NO: 9014121 - DNA, 22 bp, Homo sapiens
ctgaaatattttaatctcagga

SEQ ID NO: 9014122 - DNA, 22 bp, Homo sapiens
ctctgcaggcctgtgaagggtg

SEQ ID NO: 9014123 - DNA, 22 bp, Homo sapiens
ctctgcaggcacccagggtggg

SEQ ID NO: 9014124 - DNA, 22 bp, Homo sapiens
ctctgcaggcacccagggtggg

SEQ ID NO: 9014125 - DNA, 23 bp, Homo sapiens
ctctgcaggagagtgggcagggc

SEQ ID NO: 9014126 - DNA, 23 bp, Homo sapiens
ctctgcaggagagtgggcagggc

SEQ ID NO: 9014127 - DNA, 23 bp, Homo sapiens
ctctgcaggagagtgggcagggc

SEQ ID NO: 9014128 - DNA, 21 bp, Homo sapiens
ctctgcagccctgcttccagg

SEQ ID NO: 9014129 - DNA, 23 bp, Homo sapiens
ctctgcaggagagtgggcagggc

SEQ ID NO: 9014130 - DNA, 22 bp, Homo sapiens
ctctgcaggccttgagtgtggt

SEQ ID NO: 9014131 - DNA, 22 bp, Homo sapiens
ctctgcaggggaggcatgcact

SEQ ID NO: 9014132 - DNA, 22 bp, Homo sapiens
ctctgcaggccttgagtgtggt

SEQ ID NO: 9014133 - DNA, 17 bp, Homo sapiens
ctctgcagtgcatggct

SEQ ID NO: 9014134 - DNA, 17 bp, Homo sapiens
ctctgcagtgcatggct

SEQ ID NO: 9014135 - DNA, 17 bp, Homo sapiens
ctctgcagtgcatggct

SEQ ID NO: 9014136 - DNA, 22 bp, Homo sapiens
ctctgcagtgtaacagcgcttg

SEQ ID NO: 9014137 - DNA, 22 bp, Homo sapiens
ctctgcagtgtaacagcgcttg

SEQ ID NO: 9014138 - DNA, 21 bp, Homo sapiens
ctctgcagtgcccaccttgcc

SEQ ID NO: 9014139 - DNA, 21 bp, Homo sapiens
ctctgcagtgcccaccttgcc

SEQ ID NO: 9014140 - DNA, 22 bp, Homo sapiens
ctctcaggcttgggtcgtggca

SEQ ID NO: 9014141 - DNA, 15 bp, Homo sapiens
ctctcaggcaggcag

SEQ ID NO: 9014142 - DNA, 19 bp, Homo sapiens
ctctcagcctgtctccttg

SEQ ID NO: 9014143 - DNA, 22 bp, Homo sapiens
ctctcagggacccagccagcct

SEQ ID NO: 9014144 - DNA, 22 bp, Homo sapiens
ctctcagggcaggtggcctttc

SEQ ID NO: 9014145 - DNA, 22 bp, Homo sapiens
ctctcagggcaggtggcctttc

SEQ ID NO: 9014146 - DNA, 22 bp, Homo sapiens
ctctcaggtagagcccaagaat

SEQ ID NO: 9014147 - DNA, 22 bp, Homo sapiens
ctctcagtaaatttctgcccca

SEQ ID NO: 9014148 - DNA, 22 bp, Homo sapiens
ctctcagtgccacacagccatt

SEQ ID NO: 9014149 - DNA, 22 bp, Homo sapiens
ctctccaagttatcaagatgaa

SEQ ID NO: 9014150 - DNA, 22 bp, Homo sapiens
ctctgagcagcggtgccgaagt

SEQ ID NO: 9014151 - DNA, 22 bp, Homo sapiens
ctctgagcccgctgcagcccca

SEQ ID NO: 9014152 - DNA, 22 bp, Homo sapiens
ctctgagcagaggccgtggcta

SEQ ID NO: 9014153 - DNA, 22 bp, Homo sapiens
ctctgagcccgctgcagcccca

SEQ ID NO: 9014154 - DNA, 22 bp, Homo sapiens
ctctgagcccgctgcagcccca

SEQ ID NO: 9014155 - DNA, 21 bp, Homo sapiens
ctctgcagccctgcttccagg

SEQ ID NO: 9014156 - DNA, 22 bp, Homo sapiens
ctctcagtcctgcgcgcctctg

SEQ ID NO: 9014157 - DNA, 22 bp, Homo sapiens
ctctcagtgccacacagccatt

SEQ ID NO: 9014158 - DNA, 22 bp, Homo sapiens
ctctcagtgcctgccctaggct

SEQ ID NO: 9014159 - DNA, 22 bp, Homo sapiens
ctctcagtgccacacagccatt

SEQ ID NO: 9014160 - DNA, 22 bp, Homo sapiens
ctctccaagttatcaagatgaa

SEQ ID NO: 9014161 - DNA, 22 bp, Homo sapiens
ctctcagtttcctcaactgtaa

SEQ ID NO: 9014162 - DNA, 22 bp, Homo sapiens
ctctcagtttcctcaactgtaa

SEQ ID NO: 9014163 - DNA, 22 bp, Homo sapiens
ctctgcctgtctcatcctgcaa

SEQ ID NO: 9014164 - DNA, 22 bp, Homo sapiens
ctctgcctgtctcatcctgcaa

SEQ ID NO: 9014165 - DNA, 22 bp, Homo sapiens
ctctgcctgtctcatcctgcaa

SEQ ID NO: 9014166 - DNA, 22 bp, Homo sapiens
ctctgcctgcccaccgacccat

SEQ ID NO: 9014167 - DNA, 22 bp, Homo sapiens
ctctgcctgcccaccgacccat

SEQ ID NO: 9014168 - DNA, 22 bp, Homo sapiens
ctctgcctgtgtcgccaccaca

SEQ ID NO: 9014169 - DNA, 22 bp, Homo sapiens
ctctgcctgtgtcgccaccaca

SEQ ID NO: 9014170 - DNA, 22 bp, Homo sapiens
ctctgcctgtgtcgccaccaca

SEQ ID NO: 9014171 - DNA, 22 bp, Homo sapiens
ctctgcatgccacatgagtgac

SEQ ID NO: 9014172 - DNA, 22 bp, Homo sapiens
ctctgcatgccacatgagtgac

SEQ ID NO: 9014173 - DNA, 22 bp, Homo sapiens
ctctgcatcaggcattatggat

SEQ ID NO: 9014174 - DNA, 22 bp, Homo sapiens
ctctgcatcagcttcattctgt

SEQ ID NO: 9014175 - DNA, 22 bp, Homo sapiens
ctctgcagtgtaacagcgcttg

SEQ ID NO: 9014176 - DNA, 22 bp, Homo sapiens
ctctgcagtgtaacagcgcttg

SEQ ID NO: 9014177 - DNA, 22 bp, Homo sapiens
ctctgcatcagcttcattctgt

SEQ ID NO: 9014178 - DNA, 22 bp, Homo sapiens
ctctgccaagatgacaggtaag

SEQ ID NO: 9014179 - DNA, 22 bp, Homo sapiens
ctctgcattttaacagatgatt

SEQ ID NO: 9014180 - DNA, 22 bp, Homo sapiens
ctctgcattttaacagatgatt

SEQ ID NO: 9014181 - DNA, 22 bp, Homo sapiens
ctctgcctgccactgttcaggc

SEQ ID NO: 9014182 - DNA, 22 bp, Homo sapiens
ctctgcctgccactgttcaggc

SEQ ID NO: 9014183 - DNA, 20 bp, Homo sapiens
ctctggcaaaggatgcctat

SEQ ID NO: 9014184 - DNA, 22 bp, Homo sapiens
ctctggattgctgtgagatgct

SEQ ID NO: 9014185 - DNA, 23 bp, Homo sapiens
ctctggatcctgtagctcctggc

SEQ ID NO: 9014186 - DNA, 22 bp, Homo sapiens
ctctggatctgccctgacgcca

SEQ ID NO: 9014187 - DNA, 22 bp, Homo sapiens
ctctgctgatctcagctgggct

SEQ ID NO: 9014188 - DNA, 22 bp, Homo sapiens
ctctgctgatctcagctgggct

SEQ ID NO: 9014189 - DNA, 22 bp, Homo sapiens
ctctgctgatctcagctgggct

SEQ ID NO: 9014190 - DNA, 22 bp, Homo sapiens
ctctgctgatctcagctgggct

SEQ ID NO: 9014191 - DNA, 21 bp, Homo sapiens
ctctgctgagtcctaggattc

SEQ ID NO: 9014192 - DNA, 22 bp, Homo sapiens
ctctgctcagatgatttatcaa

SEQ ID NO: 9014193 - DNA, 22 bp, Homo sapiens
ctctgctcaccagccatgtgat

SEQ ID NO: 9014194 - DNA, 22 bp, Homo sapiens
ctctgctcaccagccatgtgat

SEQ ID NO: 9014195 - DNA, 22 bp, Homo sapiens
ctctgctcaccagccatgtgat

SEQ ID NO: 9014196 - DNA, 22 bp, Homo sapiens
ctctgctcaccagccatgtgat

SEQ ID NO: 9014197 - DNA, 22 bp, Homo sapiens
ctctgctgagccagagtcccca

SEQ ID NO: 9014198 - DNA, 22 bp, Homo sapiens
ctctgctgagccagagtcccca

SEQ ID NO: 9014199 - DNA, 22 bp, Homo sapiens
ctctgctcaccagccatgtgat

SEQ ID NO: 9014200 - DNA, 22 bp, Homo sapiens
ctctgctaagcatgaacaatta

SEQ ID NO: 9014201 - DNA, 22 bp, Homo sapiens
ctctgcgtggctgggcccaggg

SEQ ID NO: 9014202 - DNA, 22 bp, Homo sapiens
ctgaggagaggtggcctgtgtt

SEQ ID NO: 9014203 - DNA, 22 bp, Homo sapiens
ctgaggagaggtggcctgtgtt

SEQ ID NO: 9014204 - DNA, 22 bp, Homo sapiens
ctgaggagaggtggcctgtgtt

SEQ ID NO: 9014205 - DNA, 22 bp, Homo sapiens
ctgaggagaggtggcctgtgtt

SEQ ID NO: 9014206 - DNA, 22 bp, Homo sapiens
ctgaggagaggtggcctgtgtt

SEQ ID NO: 9014207 - DNA, 22 bp, Homo sapiens
ctgaggagaggtggcctgtgtt

SEQ ID NO: 9014208 - DNA, 22 bp, Homo sapiens
ctgaggagaccatcaactaatt

SEQ ID NO: 9014209 - DNA, 22 bp, Homo sapiens
ctgaggagacagaagccaaata

SEQ ID NO: 9014210 - DNA, 22 bp, Homo sapiens
ctgaggagacagaagccaaata

SEQ ID NO: 9014211 - DNA, 22 bp, Homo sapiens
ctgaggagacagaagccaaata

SEQ ID NO: 9014212 - DNA, 22 bp, Homo sapiens
ctgaggagacagaagccaaata

SEQ ID NO: 9014213 - DNA, 22 bp, Homo sapiens
ctgaggagaccatcaactaatt

SEQ ID NO: 9014214 - DNA, 22 bp, Homo sapiens
ctgaggagaccatcaactaatt

SEQ ID NO: 9014215 - DNA, 22 bp, Homo sapiens
ctgaggagagatcacgtggtgt

SEQ ID NO: 9014216 - DNA, 22 bp, Homo sapiens
ctgaggagagatcacgtggtgt

SEQ ID NO: 9014217 - DNA, 22 bp, Homo sapiens
ctgagctgggactcagtagcaa

SEQ ID NO: 9014218 - DNA, 22 bp, Homo sapiens
ctgagctgggactcagtagcaa

SEQ ID NO: 9014219 - DNA, 22 bp, Homo sapiens
ctgagctgggactcagtagcaa

SEQ ID NO: 9014220 - DNA, 22 bp, Homo sapiens
ctgagcagcagggagactggtg

SEQ ID NO: 9014221 - DNA, 22 bp, Homo sapiens
ctgagcagccccaccagccatt

SEQ ID NO: 9014222 - DNA, 22 bp, Homo sapiens
ctgagcagcagggagactggtg

SEQ ID NO: 9014223 - DNA, 22 bp, Homo sapiens
ctgagcagcagggagactggtg

SEQ ID NO: 9014224 - DNA, 17 bp, Homo sapiens
ctgaggagaacagaaag

SEQ ID NO: 9014225 - DNA, 17 bp, Homo sapiens
ctgaggagaacagaaag

SEQ ID NO: 9014226 - DNA, 17 bp, Homo sapiens
ctgaggagaacagaaag

SEQ ID NO: 9014227 - DNA, 22 bp, Homo sapiens
ctgaggagaacaatgagatcaa

SEQ ID NO: 9014228 - DNA, 22 bp, Homo sapiens
ctgaggagaacaatgagatcaa

SEQ ID NO: 9014229 - DNA, 22 bp, Homo sapiens
ctgaggagaacaatgagatcaa

SEQ ID NO: 9014230 - DNA, 22 bp, Homo sapiens
agttatataactatctagatgc

SEQ ID NO: 9014231 - DNA, 19 bp, Homo sapiens
ctgagcagagggaggaact

SEQ ID NO: 9014232 - DNA, 19 bp, Homo sapiens
ctgagcagagggaggaact

SEQ ID NO: 9014233 - DNA, 22 bp, Homo sapiens
ctgagcagaggtcaagatactt

SEQ ID NO: 9014234 - DNA, 22 bp, Homo sapiens
ctgagcagatgaccagccccag

SEQ ID NO: 9014235 - DNA, 22 bp, Homo sapiens
ctgagcagatgaccagccccag

SEQ ID NO: 9014236 - DNA, 22 bp, Homo sapiens
ctgagcagaggtcaagatactt

SEQ ID NO: 9014237 - DNA, 22 bp, Homo sapiens
agttatataactatctagatgc

SEQ ID NO: 9014238 - DNA, 22 bp, Homo sapiens
ctgagcagcaacccagagcctc

SEQ ID NO: 9014239 - DNA, 22 bp, Homo sapiens
ctgagcagcaacccagagcctc

SEQ ID NO: 9014240 - DNA, 22 bp, Homo sapiens
ctgagcagcaacccagagcctc

SEQ ID NO: 9014241 - DNA, 22 bp, Homo sapiens
ctgagcagatgttgcccagaag

SEQ ID NO: 9014242 - DNA, 22 bp, Homo sapiens
ctgagcagatgttgcccagaag

SEQ ID NO: 9014243 - DNA, 22 bp, Homo sapiens
ctgagcagatgttgcccagaag

SEQ ID NO: 9014244 - DNA, 22 bp, Homo sapiens
ctgagcagcaacccagagcctc

SEQ ID NO: 9014245 - DNA, 22 bp, Homo sapiens
ctgagcagcaacccagagcctc

SEQ ID NO: 9014246 - DNA, 22 bp, Homo sapiens
ctgagcagcacagggcgccagg

SEQ ID NO: 9014247 - DNA, 22 bp, Homo sapiens
ctgagcagcaattgctggccca

SEQ ID NO: 9014248 - DNA, 22 bp, Homo sapiens
ctgagcagcaattgctggccca

SEQ ID NO: 9014249 - DNA, 22 bp, Homo sapiens
ctgagcagcaccttcaagaaac

SEQ ID NO: 9014250 - DNA, 22 bp, Homo sapiens
ctgagcagcaccttcaagaaac

SEQ ID NO: 9014251 - DNA, 22 bp, Homo sapiens
ctgagcagcagggagactggtg

SEQ ID NO: 9014252 - DNA, 20 bp, Homo sapiens
agttagcaggtgctggtgtc

SEQ ID NO: 9014253 - DNA, 22 bp, Homo sapiens
agttagcagcttattagaaaca

SEQ ID NO: 9014254 - DNA, 22 bp, Homo sapiens
agttagtatacaaagtaacagc

SEQ ID NO: 9014255 - DNA, 22 bp, Homo sapiens
agttaggagtataggaatgcct

SEQ ID NO: 9014256 - DNA, 23 bp, Homo sapiens
agttaggtcaagttaggtcaatt

SEQ ID NO: 9014257 - DNA, 22 bp, Homo sapiens
agttagaatggatgttgagagc

SEQ ID NO: 9014258 - DNA, 22 bp, Homo sapiens
agttagaatggatgttgagagc

SEQ ID NO: 9014259 - DNA, 22 bp, Homo sapiens
agttagaatataattatgttaa

SEQ ID NO: 9014260 - DNA, 22 bp, Homo sapiens
agttagaatataattatgttaa

SEQ ID NO: 9014261 - DNA, 22 bp, Homo sapiens
agttagagcgcatattttatta

SEQ ID NO: 9014262 - DNA, 22 bp, Homo sapiens
agttagagacacatgcacatgc

SEQ ID NO: 9014263 - DNA, 22 bp, Homo sapiens
agttagaatggatgttgagagc

SEQ ID NO: 9014264 - DNA, 22 bp, Homo sapiens
agttatataactatctagatgc

SEQ ID NO: 9014265 - DNA, 20 bp, Homo sapiens
agttatagtatctagccatg

SEQ ID NO: 9014266 - DNA, 22 bp, Homo sapiens
agttatataactatctagatgc

SEQ ID NO: 9014267 - DNA, 22 bp, Homo sapiens
agttatagaaccaggtcctcac

SEQ ID NO: 9014268 - DNA, 22 bp, Homo sapiens
agttatagccatattctaagat

SEQ ID NO: 9014269 - DNA, 22 bp, Homo sapiens
agttataggtggttttgagaat

SEQ ID NO: 9014270 - DNA, 20 bp, Homo sapiens
agttatagtatctagccatg

SEQ ID NO: 9014271 - DNA, 20 bp, Homo sapiens
agttatagtatctagccatg

SEQ ID NO: 9014272 - DNA, 22 bp, Homo sapiens
agttataccttatacacatatg

SEQ ID NO: 9014273 - DNA, 22 bp, Homo sapiens
agttataatctgctactgatat

SEQ ID NO: 9014274 - DNA, 22 bp, Homo sapiens
agttataaaaggagcactgatt

SEQ ID NO: 9014275 - DNA, 22 bp, Homo sapiens
agttataatctgctactgatat

SEQ ID NO: 9014276 - DNA, 22 bp, Homo sapiens
agttagaagtgtgtcatctgtg

SEQ ID NO: 9014277 - DNA, 22 bp, Homo sapiens
agttagaagtgtgtcatctgtg

SEQ ID NO: 9014278 - DNA, 22 bp, Homo sapiens
agttagaatagtcagattgtag

SEQ ID NO: 9014279 - DNA, 22 bp, Homo sapiens
agttagaatagtcagattgtag

SEQ ID NO: 9014280 - DNA, 18 bp, Homo sapiens
agttagaaatgaaggcca

SEQ ID NO: 9014281 - DNA, 22 bp, Homo sapiens
agttagaaagtaaatcatttga

SEQ ID NO: 9014282 - DNA, 22 bp, Homo sapiens
agttaagagtgtgaaaatgtta

SEQ ID NO: 9014283 - DNA, 22 bp, Homo sapiens
agttaaggataccaggccaaaa

SEQ ID NO: 9014284 - DNA, 22 bp, Homo sapiens
agttactcaaggctgatataag

SEQ ID NO: 9014285 - DNA, 22 bp, Homo sapiens
agttaaggatggctggaggcgt

SEQ ID NO: 9014286 - DNA, 22 bp, Homo sapiens
agttactcactgagggtttatt

SEQ ID NO: 9014287 - DNA, 22 bp, Homo sapiens
agttagaaagtaaatcatttga

SEQ ID NO: 9014288 - DNA, 22 bp, Homo sapiens
agttactttctgatcagtgtgt

SEQ ID NO: 9014289 - DNA, 22 bp, Homo sapiens
agttacttgagacgtttatgaa

SEQ ID NO: 9014290 - DNA, 22 bp, Homo sapiens
agttacttgagacgtttatgaa

SEQ ID NO: 9014291 - DNA, 22 bp, Homo sapiens
agttacttgagacgtttatgaa

SEQ ID NO: 9014292 - DNA, 22 bp, Homo sapiens
ctgagaaaggacctcaaacagg

SEQ ID NO: 9014293 - DNA, 22 bp, Homo sapiens
ctgagaaaccaggtgctctgat

SEQ ID NO: 9014294 - DNA, 22 bp, Homo sapiens
ctgagaaaccaggtgctctgat

SEQ ID NO: 9014295 - DNA, 22 bp, Homo sapiens
agttaactcattttataatgcc

SEQ ID NO: 9014296 - DNA, 22 bp, Homo sapiens
ctgagaaacatatttccatcta

SEQ ID NO: 9014297 - DNA, 22 bp, Homo sapiens
ctgagaaaccaggtgctctgat

SEQ ID NO: 9014298 - DNA, 22 bp, Homo sapiens
ctgagaaacatatttccatcta

SEQ ID NO: 9014299 - DNA, 22 bp, Homo sapiens
ctgagaaacatatttccatcta

SEQ ID NO: 9014300 - DNA, 22 bp, Homo sapiens
ctgagaaaccaggtgctctgat

SEQ ID NO: 9014301 - DNA, 22 bp, Homo sapiens
agtgtctgctttgagtcaggtg

SEQ ID NO: 9014302 - DNA, 22 bp, Homo sapiens
agtgtctgctttgagtcaggtg

SEQ ID NO: 9014303 - DNA, 22 bp, Homo sapiens
agtgtctgctttgagtcaggtg

SEQ ID NO: 9014304 - DNA, 22 bp, Homo sapiens
agtgtctgctttgagtcaggtg

SEQ ID NO: 9014305 - DNA, 22 bp, Homo sapiens
agtgtctgctttgagtcaggtg

SEQ ID NO: 9014306 - DNA, 22 bp, Homo sapiens
agtgtctgcttatcagttcttg

SEQ ID NO: 9014307 - DNA, 20 bp, Homo sapiens
agtgtctggattttgtaacc

SEQ ID NO: 9014308 - DNA, 20 bp, Homo sapiens
agtgtctgggcctcaggccc

SEQ ID NO: 9014309 - DNA, 20 bp, Homo sapiens
agtgtctggattttgtaacc

SEQ ID NO: 9014310 - DNA, 18 bp, Homo sapiens
agtgtctggatatttggg

SEQ ID NO: 9014311 - DNA, 18 bp, Homo sapiens
agtgtctggatatttggg

SEQ ID NO: 9014312 - DNA, 22 bp, Homo sapiens
agtgtctggaggcattcttggt

SEQ ID NO: 9014313 - DNA, 22 bp, Homo sapiens
ctgaatccacacaaggtgatgg

SEQ ID NO: 9014314 - DNA, 22 bp, Homo sapiens
ctgaaggaagcaggtggcctgt

SEQ ID NO: 9014315 - DNA, 22 bp, Homo sapiens
ctgaagctttacttcaaataca

SEQ ID NO: 9014316 - DNA, 22 bp, Homo sapiens
ctgaagctttacttcaaataca

SEQ ID NO: 9014317 - DNA, 20 bp, Homo sapiens
agtgtctgggcctcaggccc

SEQ ID NO: 9014318 - DNA, 20 bp, Homo sapiens
agtgtctgggcctcaggccc

SEQ ID NO: 9014319 - DNA, 22 bp, Homo sapiens
ctgaatccattcatgcaagata

SEQ ID NO: 9014320 - DNA, 22 bp, Homo sapiens
ctgaatgaatggtttgtcttat

SEQ ID NO: 9014321 - DNA, 22 bp, Homo sapiens
ctgaatgagggattctgagggc

SEQ ID NO: 9014322 - DNA, 22 bp, Homo sapiens
agtgtctgcgggcagaggagcg

SEQ ID NO: 9014323 - DNA, 22 bp, Homo sapiens
agtgtctgctaggttcatcaac

SEQ ID NO: 9014324 - DNA, 22 bp, Homo sapiens
agtgtctgcgggcagaggagcg

SEQ ID NO: 9014325 - DNA, 22 bp, Homo sapiens
agtgtctgcgggcagaggagcg

SEQ ID NO: 9014326 - DNA, 22 bp, Homo sapiens
agtgtctgcggcggggaggcgg

SEQ ID NO: 9014327 - DNA, 22 bp, Homo sapiens
agtgtctgcctgggaggagcat

SEQ ID NO: 9014328 - DNA, 22 bp, Homo sapiens
agtgtctgcgggcagaggagcg

SEQ ID NO: 9014329 - DNA, 22 bp, Homo sapiens
agtgtctgctcagacagctaca

SEQ ID NO: 9014330 - DNA, 22 bp, Homo sapiens
agtgtctgctaggttcatcaac

SEQ ID NO: 9014331 - DNA, 22 bp, Homo sapiens
agtgtctgcttatcagttcttg

SEQ ID NO: 9014332 - DNA, 22 bp, Homo sapiens
agtgtctgcttatcagttcttg

SEQ ID NO: 9014333 - DNA, 22 bp, Homo sapiens
agtgtctgctcagacagctaca

SEQ ID NO: 9014334 - DNA, 22 bp, Homo sapiens
agtgtctgctcagacagctaca

SEQ ID NO: 9014335 - DNA, 22 bp, Homo sapiens
agtgtctgcctgggaggagcat

SEQ ID NO: 9014336 - DNA, 22 bp, Homo sapiens
agtgtctgcctgggaggagcat

SEQ ID NO: 9014337 - DNA, 22 bp, Homo sapiens
ctgaaattctgcctctgcacaa

SEQ ID NO: 9014338 - DNA, 22 bp, Homo sapiens
agtgtctgcctgggaggagcat

SEQ ID NO: 9014339 - DNA, 23 bp, Homo sapiens
ctgaaattcagatgctaaagata

SEQ ID NO: 9014340 - DNA, 22 bp, Homo sapiens
ctgaaattccatttcagccaca

SEQ ID NO: 9014341 - DNA, 22 bp, Homo sapiens
ctgaaattattgtttaatcaaa

SEQ ID NO: 9014342 - DNA, 22 bp, Homo sapiens
ctgaaattattgtttaatcaaa

SEQ ID NO: 9014343 - DNA, 22 bp, Homo sapiens
ctgaaattattgtttaatcaaa

SEQ ID NO: 9014344 - DNA, 22 bp, Homo sapiens
ctgaaatggttgcctggagaat

SEQ ID NO: 9014345 - DNA, 22 bp, Homo sapiens
ctgaattaagcattacatacat

SEQ ID NO: 9014346 - DNA, 22 bp, Homo sapiens
ctgaatgatataagatctttct

SEQ ID NO: 9014347 - DNA, 21 bp, Homo sapiens
ctgaattatgtgcttaccttt

SEQ ID NO: 9014348 - DNA, 18 bp, Homo sapiens
ctgaattatctcatcatt

SEQ ID NO: 9014349 - DNA, 22 bp, Homo sapiens
ctgaattagatgaaaaaggctc

SEQ ID NO: 9014350 - DNA, 18 bp, Homo sapiens
ctgaattatctcatcatt

SEQ ID NO: 9014351 - DNA, 22 bp, Homo sapiens
ctgaattaatacacagaatggc

SEQ ID NO: 9014352 - DNA, 22 bp, Homo sapiens
ctgaattacttattagtgggga

SEQ ID NO: 9014353 - DNA, 22 bp, Homo sapiens
ctgaattactgaaggtcaactt

SEQ ID NO: 9014354 - DNA, 22 bp, Homo sapiens
ctgaattaatacacagaatggc

SEQ ID NO: 9014355 - DNA, 22 bp, Homo sapiens
ctgaattaatacacagaatggc

SEQ ID NO: 9014356 - DNA, 22 bp, Homo sapiens
ctgaattctgccttgaggcctt

SEQ ID NO: 9014357 - DNA, 22 bp, Homo sapiens
ctgaattatttaaggtgaaggg

SEQ ID NO: 9014358 - DNA, 22 bp, Homo sapiens
ctgacaaaccactgctccagct

SEQ ID NO: 9014359 - DNA, 22 bp, Homo sapiens
ctgacaaaccactgctccagct

SEQ ID NO: 9014360 - DNA, 22 bp, Homo sapiens
ctgacaaacttaattttctgaa

SEQ ID NO: 9014361 - DNA, 22 bp, Homo sapiens
ctgacaaacttaattttctgaa

SEQ ID NO: 9014362 - DNA, 22 bp, Homo sapiens
ctgacaaaggcaaggcaggggg

SEQ ID NO: 9014363 - DNA, 22 bp, Homo sapiens
ctgacaaaggcaaggcaggggg

SEQ ID NO: 9014364 - DNA, 22 bp, Homo sapiens
ctgacaaaggcaaggcaggggg

SEQ ID NO: 9014365 - DNA, 20 bp, Homo sapiens
ctgacagaaaatatttcatc

SEQ ID NO: 9014366 - DNA, 22 bp, Homo sapiens
ctgacttttccaaataatactt

SEQ ID NO: 9014367 - DNA, 22 bp, Homo sapiens
ctgactttgctcataggtcaaa

SEQ ID NO: 9014368 - DNA, 22 bp, Homo sapiens
ctgacttttccaaataatactt

SEQ ID NO: 9014369 - DNA, 22 bp, Homo sapiens
ctgacttttttcagccacagtg

SEQ ID NO: 9014370 - DNA, 22 bp, Homo sapiens
ctgactttgacttggtcattga

SEQ ID NO: 9014371 - DNA, 22 bp, Homo sapiens
ctgactttgctcataggtcaaa

SEQ ID NO: 9014372 - DNA, 22 bp, Homo sapiens
ctgacttttccaaataatactt

SEQ ID NO: 9014373 - DNA, 20 bp, Homo sapiens
ctgacagaaaatatttcatc

SEQ ID NO: 9014374 - DNA, 22 bp, Homo sapiens
ctgacagaatcattaagaccat

SEQ ID NO: 9014375 - DNA, 20 bp, Homo sapiens
ctgacagaaaatatttcatc

SEQ ID NO: 9014376 - DNA, 22 bp, Homo sapiens
ctgactttagaacccaaaaagt

SEQ ID NO: 9014377 - DNA, 22 bp, Homo sapiens
ctgactttagaacccaaaaagt

SEQ ID NO: 9014378 - DNA, 22 bp, Homo sapiens
ctgagaaaagacatttctagat

SEQ ID NO: 9014379 - DNA, 22 bp, Homo sapiens
ctgagaaaagacatttctagat

SEQ ID NO: 9014380 - DNA, 22 bp, Homo sapiens
ctgacttttttcagccacagtg

SEQ ID NO: 9014381 - DNA, 22 bp, Homo sapiens
ctgagaaaagctttcttataca

SEQ ID NO: 9014382 - DNA, 22 bp, Homo sapiens
ctgagaaaagacatttctagat

SEQ ID NO: 9014383 - DNA, 22 bp, Homo sapiens
ctgagaaaagtatgagctctgg

SEQ ID NO: 9014384 - DNA, 22 bp, Homo sapiens
ctgagaaaagctttcttataca

SEQ ID NO: 9014385 - DNA, 22 bp, Homo sapiens
ctgagaaaagctttcttataca

SEQ ID NO: 9014386 - DNA, 22 bp, Homo sapiens
ctgagaaaagtatgagctctgg

SEQ ID NO: 9014387 - DNA, 22 bp, Homo sapiens
ctgagaaaatttcaggaagtgt

SEQ ID NO: 9014388 - DNA, 22 bp, Homo sapiens
ctgagaaaatttcaggaagtgt

SEQ ID NO: 9014389 - DNA, 22 bp, Homo sapiens
ctgagaaaagtatgagctctgg

SEQ ID NO: 9014390 - DNA, 22 bp, Homo sapiens
ctgagaaaagtatgagctctgg

SEQ ID NO: 9014391 - DNA, 22 bp, Homo sapiens
ctgagaaaagtatgagctctgg

SEQ ID NO: 9014392 - DNA, 22 bp, Homo sapiens
aggtgggcaatgaggcctgagt

SEQ ID NO: 9014393 - DNA, 22 bp, Homo sapiens
aggtgggcacacctcccttctc

SEQ ID NO: 9014394 - DNA, 22 bp, Homo sapiens
aggtgggcacacctcccttctc

SEQ ID NO: 9014395 - DNA, 22 bp, Homo sapiens
aggtggggaggagtgtctcttt

SEQ ID NO: 9014396 - DNA, 22 bp, Homo sapiens
aggtggggaggagtgtctcttt

SEQ ID NO: 9014397 - DNA, 22 bp, Homo sapiens
aggtggggaggagtgtctcttt

SEQ ID NO: 9014398 - DNA, 22 bp, Homo sapiens
aggtggggaggagtgtctcttt

SEQ ID NO: 9014399 - DNA, 22 bp, Homo sapiens
aggtggggaggagtgtctcttt

SEQ ID NO: 9014400 - DNA, 21 bp, Homo sapiens
cctgtgccaaagtgtgttagg

SEQ ID NO: 9014401 - DNA, 22 bp, Homo sapiens
cctgtgccagccccttctgctg

SEQ ID NO: 9014402 - DNA, 22 bp, Homo sapiens
cctgtgccagccccttctgctg

SEQ ID NO: 9014403 - DNA, 22 bp, Homo sapiens
cctgtgccagccccttctgctg

SEQ ID NO: 9014404 - DNA, 22 bp, Homo sapiens
aggtgggcaatgaggcctgagt

SEQ ID NO: 9014405 - DNA, 21 bp, Homo sapiens
cctgtgccaaagtgtgttagg

SEQ ID NO: 9014406 - DNA, 22 bp, Homo sapiens
cctgtgccaaaatctaggcagt

SEQ ID NO: 9014407 - DNA, 22 bp, Homo sapiens
cctgtgccaaaatctaggcagt

SEQ ID NO: 9014408 - DNA, 22 bp, Homo sapiens
cctgtgccaaaaggctgcttat

SEQ ID NO: 9014409 - DNA, 22 bp, Homo sapiens
cctgtgccaaaaggctgcttat

SEQ ID NO: 9014410 - DNA, 22 bp, Homo sapiens
cctgtgcattgagtttgcaccc

SEQ ID NO: 9014411 - DNA, 22 bp, Homo sapiens
cctgtgcatgccagggtacacc

SEQ ID NO: 9014412 - DNA, 22 bp, Homo sapiens
cctgtgcattgcagggtgttca

SEQ ID NO: 9014413 - DNA, 22 bp, Homo sapiens
cctgtgcattgcagggtgttca

SEQ ID NO: 9014414 - DNA, 22 bp, Homo sapiens
cctgtgcatgccagggtacacc

SEQ ID NO: 9014415 - DNA, 22 bp, Homo sapiens
cctgtgcatgccagggtacacc

SEQ ID NO: 9014416 - DNA, 22 bp, Homo sapiens
cctgtgcattgaccacactctc

SEQ ID NO: 9014417 - DNA, 21 bp, Homo sapiens
aggtggggctgcacctctgct

SEQ ID NO: 9014418 - DNA, 21 bp, Homo sapiens
aggtggggctgcacctctgct

SEQ ID NO: 9014419 - DNA, 21 bp, Homo sapiens
aggtggggctgcacctctgct

SEQ ID NO: 9014420 - DNA, 22 bp, Homo sapiens
aggtggggcccaccaatttgca

SEQ ID NO: 9014421 - DNA, 22 bp, Homo sapiens
aggtggggcccaccaatttgca

SEQ ID NO: 9014422 - DNA, 22 bp, Homo sapiens
aggtggggaggagtgtctcttt

SEQ ID NO: 9014423 - DNA, 22 bp, Homo sapiens
aggtggggagtatatgtaattg

SEQ ID NO: 9014424 - DNA, 22 bp, Homo sapiens
aggtggggagtatatgtaattg

SEQ ID NO: 9014425 - DNA, 22 bp, Homo sapiens
aggtggggccaaatgctacagt

SEQ ID NO: 9014426 - DNA, 22 bp, Homo sapiens
aggtggggccaaatgctacagt

SEQ ID NO: 9014427 - DNA, 22 bp, Homo sapiens
aggtggggccaaatgctacagt

SEQ ID NO: 9014428 - DNA, 22 bp, Homo sapiens
aggtggggccaaatgctacagt

SEQ ID NO: 9014429 - DNA, 22 bp, Homo sapiens
cctgtctccctggcatggctca

SEQ ID NO: 9014430 - DNA, 22 bp, Homo sapiens
cctgtctccctggcatggctca

SEQ ID NO: 9014431 - DNA, 20 bp, Homo sapiens
cctgtctcctcttacctggc

SEQ ID NO: 9014432 - DNA, 22 bp, Homo sapiens
cctgtctccctggcatggctca

SEQ ID NO: 9014433 - DNA, 22 bp, Homo sapiens
cctgtctccctggcatggctca

SEQ ID NO: 9014434 - DNA, 22 bp, Homo sapiens
cctgtctccctggcatggctca

SEQ ID NO: 9014435 - DNA, 20 bp, Homo sapiens
cctgtctcacgttccgcccc

SEQ ID NO: 9014436 - DNA, 20 bp, Homo sapiens
cctgtctcacgttccgcccc

SEQ ID NO: 9014437 - DNA, 22 bp, Homo sapiens
cctgtcctccggagcgggctgt

SEQ ID NO: 9014438 - DNA, 20 bp, Homo sapiens
cctgtctcacgttccgcccc

SEQ ID NO: 9014439 - DNA, 22 bp, Homo sapiens
cctgtctatcaagacatcttca

SEQ ID NO: 9014440 - DNA, 22 bp, Homo sapiens
cctgtctaccagtcacttagcg

SEQ ID NO: 9014441 - DNA, 22 bp, Homo sapiens
cctgtcctccggagcgggctgt

SEQ ID NO: 9014442 - DNA, 22 bp, Homo sapiens
cctgtcctccaagagcacatct

SEQ ID NO: 9014443 - DNA, 22 bp, Homo sapiens
cctgtcatactaacgtagtggg

SEQ ID NO: 9014444 - DNA, 22 bp, Homo sapiens
cctgtcattttctcctgtcagc

SEQ ID NO: 9014445 - DNA, 22 bp, Homo sapiens
cctgtcccccaggcctgtacca

SEQ ID NO: 9014446 - DNA, 22 bp, Homo sapiens
cctgtcccaagcagggctggcc

SEQ ID NO: 9014447 - DNA, 22 bp, Homo sapiens
cctgtcccaagcagggctggcc

SEQ ID NO: 9014448 - DNA, 22 bp, Homo sapiens
cctgtcccaagcagggctggcc

SEQ ID NO: 9014449 - DNA, 22 bp, Homo sapiens
cctgtcccaagcagggctggcc

SEQ ID NO: 9014450 - DNA, 22 bp, Homo sapiens
cctgtcccctcacaatgccact

SEQ ID NO: 9014451 - DNA, 22 bp, Homo sapiens
cctgtcccccaggcctgtacca

SEQ ID NO: 9014452 - DNA, 22 bp, Homo sapiens
cctgtcccctcacaatgccact

SEQ ID NO: 9014453 - DNA, 22 bp, Homo sapiens
cctgtgagtcaacccctccttg

SEQ ID NO: 9014454 - DNA, 22 bp, Homo sapiens
cctgtgagtcaacccctccttg

SEQ ID NO: 9014455 - DNA, 22 bp, Homo sapiens
cctgtgagtttacattctggcc

SEQ ID NO: 9014456 - DNA, 19 bp, Homo sapiens
cctgtgcacatgtgtcctt

SEQ ID NO: 9014457 - DNA, 22 bp, Homo sapiens
cctgtgcaatgttgaggtttca

SEQ ID NO: 9014458 - DNA, 19 bp, Homo sapiens
cctgtgcacatgtgtcctt

SEQ ID NO: 9014459 - DNA, 22 bp, Homo sapiens
cctgtgcaatgttgaggtttca

SEQ ID NO: 9014460 - DNA, 22 bp, Homo sapiens
cctgtgcatccggtggtcattg

SEQ ID NO: 9014461 - DNA, 22 bp, Homo sapiens
cctgtgcatgccagggtacacc

SEQ ID NO: 9014462 - DNA, 22 bp, Homo sapiens
cctgtgcatccggtggtcattg

SEQ ID NO: 9014463 - DNA, 22 bp, Homo sapiens
cctgtgcagcccttgccagttt

SEQ ID NO: 9014464 - DNA, 22 bp, Homo sapiens
cctgtgcactatctgcattttt

SEQ ID NO: 9014465 - DNA, 22 bp, Homo sapiens
cctgtgcaggctccataataga

SEQ ID NO: 9014466 - DNA, 20 bp, Homo sapiens
cctgtctcctcttacctggc

SEQ ID NO: 9014467 - DNA, 22 bp, Homo sapiens
cctgtgacgtgtctcctggcac

SEQ ID NO: 9014468 - DNA, 22 bp, Homo sapiens
cctgtgacgtgtctcctggcac

SEQ ID NO: 9014469 - DNA, 22 bp, Homo sapiens
cctgtgacgtgtctcctggcac

SEQ ID NO: 9014470 - DNA, 22 bp, Homo sapiens
cctgtgactctgtctgatggtc

SEQ ID NO: 9014471 - DNA, 22 bp, Homo sapiens
cctgtgacttggcaaacctcca

SEQ ID NO: 9014472 - DNA, 22 bp, Homo sapiens
cctgtgagagggcgagtgtaga

SEQ ID NO: 9014473 - DNA, 22 bp, Homo sapiens
cctgtgaggtcatctgtggtaa

SEQ ID NO: 9014474 - DNA, 22 bp, Homo sapiens
cctgtgaggtcttgcatgtgaa

SEQ ID NO: 9014475 - DNA, 22 bp, Homo sapiens
cctggctctgcgtgcagctccg

SEQ ID NO: 9014476 - DNA, 22 bp, Homo sapiens
cctggctctgcgtgcagctccg

SEQ ID NO: 9014477 - DNA, 22 bp, Homo sapiens
cctggctctgcgtgcagctccg

SEQ ID NO: 9014478 - DNA, 22 bp, Homo sapiens
cctggctctgcgtgcagctccg

SEQ ID NO: 9014479 - DNA, 22 bp, Homo sapiens
cctggctctgggatcttcgctt

SEQ ID NO: 9014480 - DNA, 22 bp, Homo sapiens
cctggctctgggatcttcgctt

SEQ ID NO: 9014481 - DNA, 22 bp, Homo sapiens
cctggctctggttccctcagct

SEQ ID NO: 9014482 - DNA, 22 bp, Homo sapiens
cctggctctggttccctcagct

SEQ ID NO: 9014483 - DNA, 22 bp, Homo sapiens
cctggctctggtgaggagaagt

SEQ ID NO: 9014484 - DNA, 22 bp, Homo sapiens
cctggctctggttccctcagct

SEQ ID NO: 9014485 - DNA, 22 bp, Homo sapiens
cctggctctgtcctcgcgcaaa

SEQ ID NO: 9014486 - DNA, 22 bp, Homo sapiens
cctggctctgtcctcgcgcaaa

SEQ ID NO: 9014487 - DNA, 22 bp, Homo sapiens
cctggctctgtcctcgcgcaaa

SEQ ID NO: 9014488 - DNA, 22 bp, Homo sapiens
cctggctctggttccctcagct

SEQ ID NO: 9014489 - DNA, 22 bp, Homo sapiens
cctgggcataaatcactccaag

SEQ ID NO: 9014490 - DNA, 22 bp, Homo sapiens
cctgggcataaatcactccaag

SEQ ID NO: 9014491 - DNA, 22 bp, Homo sapiens
cctgggcataaatcactccaag

SEQ ID NO: 9014492 - DNA, 22 bp, Homo sapiens
cctgggcataaatcactccaag

SEQ ID NO: 9014493 - DNA, 22 bp, Homo sapiens
cctgggctcaagtgatggtccc

SEQ ID NO: 9014494 - DNA, 22 bp, Homo sapiens
cctgggctccactccaagagca

SEQ ID NO: 9014495 - DNA, 20 bp, Homo sapiens
cctgggctccaggagccccg

SEQ ID NO: 9014496 - DNA, 22 bp, Homo sapiens
cctgggctccactccaagagca

SEQ ID NO: 9014497 - DNA, 22 bp, Homo sapiens
cctgggctcaggcttgggcagc

SEQ ID NO: 9014498 - DNA, 22 bp, Homo sapiens
cctgggctcaggcttgggcagc

SEQ ID NO: 9014499 - DNA, 22 bp, Homo sapiens
cctgggctccactccaagagca

SEQ ID NO: 9014500 - DNA, 22 bp, Homo sapiens
cctgggctcaggcttgggcagc

SEQ ID NO: 9014501 - DNA, 22 bp, Homo sapiens
cctgggctcaggcttgggcagc

SEQ ID NO: 9014502 - DNA, 22 bp, Homo sapiens
cctgggctcaggcttgggcagc

SEQ ID NO: 9014503 - DNA, 22 bp, Homo sapiens
cctgggctcaggcttgggcagc

SEQ ID NO: 9014504 - DNA, 22 bp, Homo sapiens
cctgggctcaggcttgggcagc

SEQ ID NO: 9014505 - DNA, 22 bp, Homo sapiens
cctgggctcaggcttgggcagc

SEQ ID NO: 9014506 - DNA, 22 bp, Homo sapiens
cctgggctcaagtgatggtccc

SEQ ID NO: 9014507 - DNA, 22 bp, Homo sapiens
cctgggctcaagtgatggtccc

SEQ ID NO: 9014508 - DNA, 22 bp, Homo sapiens
cctgggctcaagtgatggtccc

SEQ ID NO: 9014509 - DNA, 22 bp, Homo sapiens
cctgggctcacagccaaggctc

SEQ ID NO: 9014510 - DNA, 22 bp, Homo sapiens
cctgggctcacagccaaggctc

SEQ ID NO: 9014511 - DNA, 22 bp, Homo sapiens
cctgggctcacagccaaggctc

SEQ ID NO: 9014512 - DNA, 22 bp, Homo sapiens
cctgggctcacagccaaggctc

SEQ ID NO: 9014513 - DNA, 22 bp, Homo sapiens
cctgggctcacagccaaggctc

SEQ ID NO: 9014514 - DNA, 22 bp, Homo sapiens
cctgggctcaccatgccttgga

SEQ ID NO: 9014515 - DNA, 22 bp, Homo sapiens
cctggtgccggtagacgcgcag

SEQ ID NO: 9014516 - DNA, 22 bp, Homo sapiens
cctgggctttgagggcaggatg

SEQ ID NO: 9014517 - DNA, 22 bp, Homo sapiens
cctggtgctgctatcaggggta

SEQ ID NO: 9014518 - DNA, 22 bp, Homo sapiens
cctggtgccggtagacgcgcag

SEQ ID NO: 9014519 - DNA, 22 bp, Homo sapiens
cctgtcagggtttgcctcagaa

SEQ ID NO: 9014520 - DNA, 22 bp, Homo sapiens
cctgtcagggtttgcctcagaa

SEQ ID NO: 9014521 - DNA, 22 bp, Homo sapiens
cctgtcagctgatggctatgta

SEQ ID NO: 9014522 - DNA, 22 bp, Homo sapiens
cctgtcagctgatggctatgta

SEQ ID NO: 9014523 - DNA, 22 bp, Homo sapiens
cctgtcagttgctgtcagggat

SEQ ID NO: 9014524 - DNA, 22 bp, Homo sapiens
cctgtcagttgctgtcagggat

SEQ ID NO: 9014525 - DNA, 22 bp, Homo sapiens
cctgtcagttgctgtcagggat

SEQ ID NO: 9014526 - DNA, 22 bp, Homo sapiens
cctgtcagttgctgtcagggat

SEQ ID NO: 9014527 - DNA, 22 bp, Homo sapiens
cctgtcagttgctgtcagggat

SEQ ID NO: 9014528 - DNA, 22 bp, Homo sapiens
cctgtcagttgctgtcagggat

SEQ ID NO: 9014529 - DNA, 22 bp, Homo sapiens
cctgggctttcaaaaccagcct

SEQ ID NO: 9014530 - DNA, 22 bp, Homo sapiens
cctgggctttcaaaaccagcct

SEQ ID NO: 9014531 - DNA, 22 bp, Homo sapiens
cctgggctttcaaaaccagcct

SEQ ID NO: 9014532 - DNA, 22 bp, Homo sapiens
cctgggctttcggcggcttcct

SEQ ID NO: 9014533 - DNA, 22 bp, Homo sapiens
cctgggctttcaaaaccagcct

SEQ ID NO: 9014534 - DNA, 22 bp, Homo sapiens
cctgggctttcaaaaccagcct

SEQ ID NO: 9014535 - DNA, 22 bp, Homo sapiens
cctgggctttcggcggcttcct

SEQ ID NO: 9014536 - DNA, 22 bp, Homo sapiens
cctgggctttcggcggcttcct

SEQ ID NO: 9014537 - DNA, 22 bp, Homo sapiens
cctgggctttgagggcaggatg

SEQ ID NO: 9014538 - DNA, 22 bp, Homo sapiens
cctgggctttgagggcaggatg

SEQ ID NO: 9014539 - DNA, 22 bp, Homo sapiens
cctgggctttgagggcaggatg

SEQ ID NO: 9014540 - DNA, 22 bp, Homo sapiens
cctgggcttctgtctagatgtt

SEQ ID NO: 9014541 - DNA, 22 bp, Homo sapiens
cctgggctcgcgcacttcaccc

SEQ ID NO: 9014542 - DNA, 22 bp, Homo sapiens
cctgggcttctgtctagatgtt

SEQ ID NO: 9014543 - DNA, 22 bp, Homo sapiens
cctgggctcgcgcacttcaccc

SEQ ID NO: 9014544 - DNA, 22 bp, Homo sapiens
cctgggcttctgtctagatgtt

SEQ ID NO: 9014545 - DNA, 22 bp, Homo sapiens
cctgggcttctgtctagatgtt

SEQ ID NO: 9014546 - DNA, 20 bp, Homo sapiens
cctgggctccaggagccccg

SEQ ID NO: 9014547 - DNA, 22 bp, Homo sapiens
cctgggctccactccaagagca

SEQ ID NO: 9014548 - DNA, 20 bp, Homo sapiens
cctgggctccaggagccccg

SEQ ID NO: 9014549 - DNA, 20 bp, Homo sapiens
cctgggctccaggagccccg

SEQ ID NO: 9014550 - DNA, 22 bp, Homo sapiens
cctgggctcgcgcacttcaccc

SEQ ID NO: 9014551 - DNA, 20 bp, Homo sapiens
cctgggctccaggagccccg

SEQ ID NO: 9014552 - DNA, 22 bp, Homo sapiens
cctgggcttgcatctgtgctgg

SEQ ID NO: 9014553 - DNA, 22 bp, Homo sapiens
cctgggcttgcatctgtgctgg

SEQ ID NO: 9014554 - DNA, 22 bp, Homo sapiens
cctgggcttgcatctgtgctgg

SEQ ID NO: 9014555 - DNA, 22 bp, Homo sapiens
cctgggcttctgtctagatgtt

SEQ ID NO: 9014556 - DNA, 22 bp, Homo sapiens
cctgggcttgcatctgtgctgg

SEQ ID NO: 9014557 - DNA, 22 bp, Homo sapiens
cctgggcttggttgttgagaac

SEQ ID NO: 9014558 - DNA, 22 bp, Homo sapiens
cctgggcttggttgttgagaac

SEQ ID NO: 9014559 - DNA, 22 bp, Homo sapiens
cctgggcttggttgttgagaac

SEQ ID NO: 9014560 - DNA, 22 bp, Homo sapiens
cctgggcttgcatctgtgctgg

SEQ ID NO: 9014561 - DNA, 22 bp, Homo sapiens
cctgggcttggttgttgagaac

SEQ ID NO: 9014562 - DNA, 22 bp, Homo sapiens
cctgccagccagatcactcgcc

SEQ ID NO: 9014563 - DNA, 22 bp, Homo sapiens
cctgccagcccccatagagaca

SEQ ID NO: 9014564 - DNA, 22 bp, Homo sapiens
cctgccagcccccatagagaca

SEQ ID NO: 9014565 - DNA, 22 bp, Homo sapiens
cctgccagcccgcgttcatgcc

SEQ ID NO: 9014566 - DNA, 22 bp, Homo sapiens
cctgccagcatcttcagcccct

SEQ ID NO: 9014567 - DNA, 22 bp, Homo sapiens
cctgccagcatcttcagcccct

SEQ ID NO: 9014568 - DNA, 22 bp, Homo sapiens
cctgccagcatggcttatctcc

SEQ ID NO: 9014569 - DNA, 22 bp, Homo sapiens
cctgccagccagatcactcgcc

SEQ ID NO: 9014570 - DNA, 22 bp, Homo sapiens
cctgccagatcccctgagctga

SEQ ID NO: 9014571 - DNA, 22 bp, Homo sapiens
cctgccagatcccctgagctga

SEQ ID NO: 9014572 - DNA, 22 bp, Homo sapiens
cctgccagatcccctgagctga

SEQ ID NO: 9014573 - DNA, 22 bp, Homo sapiens
cctgccagagcagcttgtcctc

SEQ ID NO: 9014574 - DNA, 23 bp, Homo sapiens
cctgcagctgctggggctccacc

SEQ ID NO: 9014575 - DNA, 22 bp, Homo sapiens
cctgcagcctcttctgaaaatc

SEQ ID NO: 9014576 - DNA, 22 bp, Homo sapiens
cctgcagccgtcctgtttgtct

SEQ ID NO: 9014577 - DNA, 23 bp, Homo sapiens
cctgcagctgccacgccctgctc

SEQ ID NO: 9014578 - DNA, 23 bp, Homo sapiens
cctgcagctgctggggctccacc

SEQ ID NO: 9014579 - DNA, 23 bp, Homo sapiens
cctgcagctgccacgccctgctc

SEQ ID NO: 9014580 - DNA, 22 bp, Homo sapiens
cctgcagagcaggagaggcatc

SEQ ID NO: 9014581 - DNA, 22 bp, Homo sapiens
cctgcagagccacgtgccagcg

SEQ ID NO: 9014582 - DNA, 22 bp, Homo sapiens
aggggtcttgggagtcctggct

SEQ ID NO: 9014583 - DNA, 22 bp, Homo sapiens
cctgagtctgtgttttcctaag

SEQ ID NO: 9014584 - DNA, 22 bp, Homo sapiens
cctgcagaccacactcagtcct

SEQ ID NO: 9014585 - DNA, 22 bp, Homo sapiens
cctgcagagcaggagaggcatc

SEQ ID NO: 9014586 - DNA, 22 bp, Homo sapiens
cctgcagagcaggagaggcatc

SEQ ID NO: 9014587 - DNA, 22 bp, Homo sapiens
cctgcagagggactggcaggaa

SEQ ID NO: 9014588 - DNA, 22 bp, Homo sapiens
cctgcagagccacgtgccagcg

SEQ ID NO: 9014589 - DNA, 22 bp, Homo sapiens
cctgcagagccacgtgccagcg

SEQ ID NO: 9014590 - DNA, 22 bp, Homo sapiens
cctgcagagggactggcaggaa

SEQ ID NO: 9014591 - DNA, 22 bp, Homo sapiens
cctgagtcttcccaaaactcct

SEQ ID NO: 9014592 - DNA, 22 bp, Homo sapiens
cctgcagagggactggcaggaa

SEQ ID NO: 9014593 - DNA, 22 bp, Homo sapiens
cctgcagaggtcaggccagaaa

SEQ ID NO: 9014594 - DNA, 22 bp, Homo sapiens
cctgcagaggtcaggccagaaa

SEQ ID NO: 9014595 - DNA, 21 bp, Homo sapiens
cctgcagcaccagaaggagat

SEQ ID NO: 9014596 - DNA, 21 bp, Homo sapiens
cctgcagcaccagaaggagat

SEQ ID NO: 9014597 - DNA, 21 bp, Homo sapiens
cctgcagcaccagaaggagat

SEQ ID NO: 9014598 - DNA, 18 bp, Homo sapiens
cctgcagcccaggaggcc

SEQ ID NO: 9014599 - DNA, 18 bp, Homo sapiens
cctgcagcccaggaggcc

SEQ ID NO: 9014600 - DNA, 22 bp, Homo sapiens
cctgcagcccttcaaaggctga

SEQ ID NO: 9014601 - DNA, 18 bp, Homo sapiens
cctgcagcccaggaggcc

SEQ ID NO: 9014602 - DNA, 18 bp, Homo sapiens
cctgcagcccaggaggcc

SEQ ID NO: 9014603 - DNA, 18 bp, Homo sapiens
cctgcagcccaggaggcc

SEQ ID NO: 9014604 - DNA, 22 bp, Homo sapiens
aggtagggttaatggagatata

SEQ ID NO: 9014605 - DNA, 22 bp, Homo sapiens
aggtaggttaaatttctttatc

SEQ ID NO: 9014606 - DNA, 22 bp, Homo sapiens
aggtagggttaatggagatata

SEQ ID NO: 9014607 - DNA, 23 bp, Homo sapiens
aggtaggttattgctgctacctg

SEQ ID NO: 9014608 - DNA, 23 bp, Homo sapiens
aggtaggttattgctgctacctg

SEQ ID NO: 9014609 - DNA, 23 bp, Homo sapiens
aggtaggttattgctgctacctg

SEQ ID NO: 9014610 - DNA, 23 bp, Homo sapiens
aggtaggttattgctgctacctg

SEQ ID NO: 9014611 - DNA, 23 bp, Homo sapiens
aggtaggttattgctgctacctg

SEQ ID NO: 9014612 - DNA, 22 bp, Homo sapiens
aggtagggttaatggagatata

SEQ ID NO: 9014613 - DNA, 22 bp, Homo sapiens
aggtagggctaggctgcgtctg

SEQ ID NO: 9014614 - DNA, 22 bp, Homo sapiens
aggtagggggtttgggaactgc

SEQ ID NO: 9014615 - DNA, 22 bp, Homo sapiens
aggtagggggtttgggaactgc

SEQ ID NO: 9014616 - DNA, 22 bp, Homo sapiens
aggtagggaagaaggcatgaaa

SEQ ID NO: 9014617 - DNA, 22 bp, Homo sapiens
aggtagggaagaaggcatgaaa

SEQ ID NO: 9014618 - DNA, 22 bp, Homo sapiens
aggtagggaagaaggcatgaaa

SEQ ID NO: 9014619 - DNA, 22 bp, Homo sapiens
aggtagggaagaaggcatgaaa

SEQ ID NO: 9014620 - DNA, 22 bp, Homo sapiens
aggtagggaagaaggcatgaaa

SEQ ID NO: 9014621 - DNA, 22 bp, Homo sapiens
aggtagggaagaaggcatgaaa

SEQ ID NO: 9014622 - DNA, 22 bp, Homo sapiens
aggtagggaagaaggcatgaaa

SEQ ID NO: 9014623 - DNA, 19 bp, Homo sapiens
aggtaggcagtggcatgga

SEQ ID NO: 9014624 - DNA, 22 bp, Homo sapiens
cctgccagcccgcgttcatgcc

SEQ ID NO: 9014625 - DNA, 22 bp, Homo sapiens
cctgccagcgcttatctctcgg

SEQ ID NO: 9014626 - DNA, 22 bp, Homo sapiens
cctgccagcgcttatctctcgg

SEQ ID NO: 9014627 - DNA, 22 bp, Homo sapiens
cctgccagctgggtaccttcat

SEQ ID NO: 9014628 - DNA, 22 bp, Homo sapiens
cctgccagctgtgggccagcct

SEQ ID NO: 9014629 - DNA, 22 bp, Homo sapiens
cctgccagctgtgggccagcct

SEQ ID NO: 9014630 - DNA, 21 bp, Homo sapiens
cctgccaggaaactgagtgtc

SEQ ID NO: 9014631 - DNA, 22 bp, Homo sapiens
cctgccagctgtgggccagcct

SEQ ID NO: 9014632 - DNA, 21 bp, Homo sapiens
cctgccaggaaactgagtgtc

SEQ ID NO: 9014633 - DNA, 22 bp, Homo sapiens
cctgccagctgtgggccagcct

SEQ ID NO: 9014634 - DNA, 22 bp, Homo sapiens
aggtacagggtgaaagtttatg

SEQ ID NO: 9014635 - DNA, 21 bp, Homo sapiens
aggtacaggtcttgtgagtct

SEQ ID NO: 9014636 - DNA, 22 bp, Homo sapiens
aggtacagcaatataagaggtc

SEQ ID NO: 9014637 - DNA, 22 bp, Homo sapiens
aggtaggatgggtggagatgat

SEQ ID NO: 9014638 - DNA, 22 bp, Homo sapiens
aggtaggatagataggaagacc

SEQ ID NO: 9014639 - DNA, 22 bp, Homo sapiens
aggtccagttttctgacaaggg

SEQ ID NO: 9014640 - DNA, 22 bp, Homo sapiens
aggtccagttttctgacaaggg

SEQ ID NO: 9014641 - DNA, 21 bp, Homo sapiens
aggtcccaggtttgggcagca

SEQ ID NO: 9014642 - DNA, 22 bp, Homo sapiens
aggtcccaggcatagctggtct

SEQ ID NO: 9014643 - DNA, 22 bp, Homo sapiens
aggtcccaggcatagctggtct

SEQ ID NO: 9014644 - DNA, 22 bp, Homo sapiens
aggtccatggcagcgggtactt

SEQ ID NO: 9014645 - DNA, 21 bp, Homo sapiens
aggtcccaggtttgggcagca

SEQ ID NO: 9014646 - DNA, 21 bp, Homo sapiens
aggtccctaattaattgacct

SEQ ID NO: 9014647 - DNA, 22 bp, Homo sapiens
aggtccctaatcatttcacttt

SEQ ID NO: 9014648 - DNA, 22 bp, Homo sapiens
aggtccctaatcatttcacttt

SEQ ID NO: 9014649 - DNA, 22 bp, Homo sapiens
aggtccctgcagcagactgcca

SEQ ID NO: 9014650 - DNA, 22 bp, Homo sapiens
aggtccctgcaaagctattcag

SEQ ID NO: 9014651 - DNA, 22 bp, Homo sapiens
aggtccctggtaattgacacac

SEQ ID NO: 9014652 - DNA, 22 bp, Homo sapiens
aggtccctggctagcactggaa

SEQ ID NO: 9014653 - DNA, 22 bp, Homo sapiens
aggtccctacttatctgaaggc

SEQ ID NO: 9014654 - DNA, 22 bp, Homo sapiens
cctggctctgaggtatgcctgg

SEQ ID NO: 9014655 - DNA, 22 bp, Homo sapiens
aggtcctgagggttcgtctgca

SEQ ID NO: 9014656 - DNA, 22 bp, Homo sapiens
aggtcctctgtgcctgctggcg

SEQ ID NO: 9014657 - DNA, 19 bp, Homo sapiens
aggtccctgtcacctctca

SEQ ID NO: 9014658 - DNA, 22 bp, Homo sapiens
cctggctctgcagccactccag

SEQ ID NO: 9014659 - DNA, 22 bp, Homo sapiens
cctggctctgcagccactccag

SEQ ID NO: 9014660 - DNA, 22 bp, Homo sapiens
cctggctctgccacttactgcc

SEQ ID NO: 9014661 - DNA, 22 bp, Homo sapiens
cctggctctgccacttactgcc

SEQ ID NO: 9014662 - DNA, 22 bp, Homo sapiens
cctggctctgcagccactccag

SEQ ID NO: 9014663 - DNA, 22 bp, Homo sapiens
cctggctctgcagccactccag

SEQ ID NO: 9014664 - DNA, 22 bp, Homo sapiens
cctggctctgccgtaaccacca

SEQ ID NO: 9014665 - DNA, 22 bp, Homo sapiens
cctggctctgcgtgcagctccg

SEQ ID NO: 9014666 - DNA, 22 bp, Homo sapiens
cctggcaacatttcaaggtctt

SEQ ID NO: 9014667 - DNA, 22 bp, Homo sapiens
cctggattggctgcccatgctc

SEQ ID NO: 9014668 - DNA, 22 bp, Homo sapiens
cctggatgatccatgtcatgga

SEQ ID NO: 9014669 - DNA, 22 bp, Homo sapiens
cctggatgatccatgtcatgga

SEQ ID NO: 9014670 - DNA, 22 bp, Homo sapiens
cctggcaagtgggctcccagat

SEQ ID NO: 9014671 - DNA, 22 bp, Homo sapiens
cctggcacaagagcagcattgg

SEQ ID NO: 9014672 - DNA, 18 bp, Homo sapiens
aggtcatggtcatgggcg

SEQ ID NO: 9014673 - DNA, 22 bp, Homo sapiens
cctggcacagagcggtggtcac

SEQ ID NO: 9014674 - DNA, 22 bp, Homo sapiens
aggtccagttttctgacaaggg

SEQ ID NO: 9014675 - DNA, 22 bp, Homo sapiens
aggtccagttttctgacaaggg

SEQ ID NO: 9014676 - DNA, 22 bp, Homo sapiens
cctggagtaccgtggccatcca

SEQ ID NO: 9014677 - DNA, 22 bp, Homo sapiens
cctggagtaccgtggccatcca

SEQ ID NO: 9014678 - DNA, 21 bp, Homo sapiens
aggtagtaaatgtttgctcct

SEQ ID NO: 9014679 - DNA, 22 bp, Homo sapiens
aggtagtaaagttcttgatcct

SEQ ID NO: 9014680 - DNA, 23 bp, Homo sapiens
aggtaggttattgctgctacctg

SEQ ID NO: 9014681 - DNA, 22 bp, Homo sapiens
aggtagtagcatgtatcagtac

SEQ ID NO: 9014682 - DNA, 22 bp, Homo sapiens
aggtagtattcatgattaaatt

SEQ ID NO: 9014683 - DNA, 19 bp, Homo sapiens
cctggagtcgcgctgcctc

SEQ ID NO: 9014684 - DNA, 19 bp, Homo sapiens
cctggagtcgcgctgcctc

SEQ ID NO: 9014685 - DNA, 22 bp, Homo sapiens
cctggagtgacaggtgtagcct

SEQ ID NO: 9014686 - DNA, 22 bp, Homo sapiens
cctggagtctgtgactttcctc

SEQ ID NO: 9014687 - DNA, 23 bp, Homo sapiens
cctggagtactaaggggatggaa

SEQ ID NO: 9014688 - DNA, 23 bp, Homo sapiens
cctggagtactaaggggatggaa

SEQ ID NO: 9014689 - DNA, 22 bp, Homo sapiens
cctggagttttttggttgactc

SEQ ID NO: 9014690 - DNA, 22 bp, Homo sapiens
cctggagttgaaggaaggtggg

SEQ ID NO: 9014691 - DNA, 22 bp, Homo sapiens
cctggagtgacaggtgtagcct

SEQ ID NO: 9014692 - DNA, 18 bp, Homo sapiens
cctggagtgtgttaggct

SEQ ID NO: 9014693 - DNA, 22 bp, Homo sapiens
cctggagtggggtccgtgcatg

SEQ ID NO: 9014694 - DNA, 22 bp, Homo sapiens
cctggatcagtcactgttgctg

SEQ ID NO: 9014695 - DNA, 22 bp, Homo sapiens
cctggatagctactggccaggc

SEQ ID NO: 9014696 - DNA, 22 bp, Homo sapiens
cctggatgatccatgtcatgga

SEQ ID NO: 9014697 - DNA, 22 bp, Homo sapiens
cctggatctcctctattcatat

SEQ ID NO: 9014698 - DNA, 22 bp, Homo sapiens
ctacatttggagagtataggaa

SEQ ID NO: 9014699 - DNA, 22 bp, Homo sapiens
ctacatttggagagtataggaa

SEQ ID NO: 9014700 - DNA, 22 bp, Homo sapiens
ctacatttggagagtataggaa

SEQ ID NO: 9014701 - DNA, 22 bp, Homo sapiens
ctacatttgttcaaataagctg

SEQ ID NO: 9014702 - DNA, 22 bp, Homo sapiens
ctacatttgttcaaataagctg

SEQ ID NO: 9014703 - DNA, 22 bp, Homo sapiens
ctacatttgttcaaataagctg

SEQ ID NO: 9014704 - DNA, 22 bp, Homo sapiens
ctacagaatggagggtcagaga

SEQ ID NO: 9014705 - DNA, 22 bp, Homo sapiens
ctacagaatggagggtcagaga

SEQ ID NO: 9014706 - DNA, 22 bp, Homo sapiens
ctacagaattcaacaaatggtt

SEQ ID NO: 9014707 - DNA, 22 bp, Homo sapiens
ctacatttcccagctgccttcc

SEQ ID NO: 9014708 - DNA, 22 bp, Homo sapiens
ctacagaattcaacaaatggtt

SEQ ID NO: 9014709 - DNA, 22 bp, Homo sapiens
ctacagacccaccttggaagaa

SEQ ID NO: 9014710 - DNA, 22 bp, Homo sapiens
ctacatttggagagtataggaa

SEQ ID NO: 9014711 - DNA, 22 bp, Homo sapiens
ctacatttcccagctgccttcc

SEQ ID NO: 9014712 - DNA, 22 bp, Homo sapiens
ctacatttcccagctgccttcc

SEQ ID NO: 9014713 - DNA, 22 bp, Homo sapiens
ctacattttgtgattatgaaat

SEQ ID NO: 9014714 - DNA, 22 bp, Homo sapiens
ctacattttgtgattatgaaat

SEQ ID NO: 9014715 - DNA, 22 bp, Homo sapiens
ctacattttgtgattatgaaat

SEQ ID NO: 9014716 - DNA, 22 bp, Homo sapiens
ctacattttgtgattatgaaat

SEQ ID NO: 9014717 - DNA, 22 bp, Homo sapiens
ctacattttaataagctgctta

SEQ ID NO: 9014718 - DNA, 22 bp, Homo sapiens
ctacattttaataagctgctta

SEQ ID NO: 9014719 - DNA, 22 bp, Homo sapiens
ctacatttgttctatagctttt

SEQ ID NO: 9014720 - DNA, 22 bp, Homo sapiens
ctacatttgttctatagctttt

SEQ ID NO: 9014721 - DNA, 22 bp, Homo sapiens
ctacatttgttctatagctttt

SEQ ID NO: 9014722 - DNA, 22 bp, Homo sapiens
ctacattttaataagctgctta

SEQ ID NO: 9014723 - DNA, 22 bp, Homo sapiens
ctacatttgttctatagctttt

SEQ ID NO: 9014724 - DNA, 22 bp, Homo sapiens
ctagaaatgtagattcttagtg

SEQ ID NO: 9014725 - DNA, 22 bp, Homo sapiens
ctagaaatgtagattcttagtg

SEQ ID NO: 9014726 - DNA, 22 bp, Homo sapiens
ctagaaatgtagattcttagtg

SEQ ID NO: 9014727 - DNA, 22 bp, Homo sapiens
ctagaaatgtagattcttagtg

SEQ ID NO: 9014728 - DNA, 22 bp, Homo sapiens
ctagaaattctgattcagtagg

SEQ ID NO: 9014729 - DNA, 22 bp, Homo sapiens
ctagaaattctgattcagtagg

SEQ ID NO: 9014730 - DNA, 22 bp, Homo sapiens
ctagaaattctgattcagtagg

SEQ ID NO: 9014731 - DNA, 22 bp, Homo sapiens
ctagaaattctgattcagtagg

SEQ ID NO: 9014732 - DNA, 22 bp, Homo sapiens
ctagaaattctgattcagtagg

SEQ ID NO: 9014733 - DNA, 22 bp, Homo sapiens
ctagaaattctgattcagtagg

SEQ ID NO: 9014734 - DNA, 22 bp, Homo sapiens
ctagaacaaattaggaggcata

SEQ ID NO: 9014735 - DNA, 22 bp, Homo sapiens
ctagaacagaaagtacaggaaa

SEQ ID NO: 9014736 - DNA, 22 bp, Homo sapiens
ctagaaatgctcaagagaaagt

SEQ ID NO: 9014737 - DNA, 22 bp, Homo sapiens
ctagaaatgctcaagagaaagt

SEQ ID NO: 9014738 - DNA, 22 bp, Homo sapiens
ctagaaatgctcaagagaaagt

SEQ ID NO: 9014739 - DNA, 22 bp, Homo sapiens
ctagaaatctctgtttacatca

SEQ ID NO: 9014740 - DNA, 22 bp, Homo sapiens
ctagaaatctctgtttacatca

SEQ ID NO: 9014741 - DNA, 22 bp, Homo sapiens
ctagaaatctctgtttacatca

SEQ ID NO: 9014742 - DNA, 22 bp, Homo sapiens
ctagaaatctctgtttacatca

SEQ ID NO: 9014743 - DNA, 22 bp, Homo sapiens
ctagaaatctctgtttacatca

SEQ ID NO: 9014744 - DNA, 22 bp, Homo sapiens
ctacccagcacctaggctgcct

SEQ ID NO: 9014745 - DNA, 22 bp, Homo sapiens
ctacccagatccaggatggcta

SEQ ID NO: 9014746 - DNA, 22 bp, Homo sapiens
ctacccagatccaggatggcta

SEQ ID NO: 9014747 - DNA, 22 bp, Homo sapiens
ctacccagatccaggatggcta

SEQ ID NO: 9014748 - DNA, 22 bp, Homo sapiens
ctagaaatattttacagtcaag

SEQ ID NO: 9014749 - DNA, 22 bp, Homo sapiens
ctagaaatattttacagtcaag

SEQ ID NO: 9014750 - DNA, 22 bp, Homo sapiens
ctagaaatattttacagtcaag

SEQ ID NO: 9014751 - DNA, 22 bp, Homo sapiens
ctacatttttcaccgagcctct

SEQ ID NO: 9014752 - DNA, 22 bp, Homo sapiens
ctacatttttcaccgagcctct

SEQ ID NO: 9014753 - DNA, 22 bp, Homo sapiens
ctacatttttcaccgagcctct

SEQ ID NO: 9014754 - DNA, 22 bp, Homo sapiens
ctacccacaaggctttgggcac

SEQ ID NO: 9014755 - DNA, 22 bp, Homo sapiens
ctacccagagtgaatctcttaa

SEQ ID NO: 9014756 - DNA, 22 bp, Homo sapiens
ctaccagcttctttgtctggga

SEQ ID NO: 9014757 - DNA, 22 bp, Homo sapiens
ctaaggaaatatgtcacttgct

SEQ ID NO: 9014758 - DNA, 22 bp, Homo sapiens
ctaaggaaaggaaatacagtaa

SEQ ID NO: 9014759 - DNA, 22 bp, Homo sapiens
ctaaggaaaggaaatacagtaa

SEQ ID NO: 9014760 - DNA, 22 bp, Homo sapiens
ctaaggaaaaggatatatatgt

SEQ ID NO: 9014761 - DNA, 22 bp, Homo sapiens
ctaaggaaaaggatatatatgt

SEQ ID NO: 9014762 - DNA, 22 bp, Homo sapiens
ctaagcataatggtgctttaag

SEQ ID NO: 9014763 - DNA, 22 bp, Homo sapiens
ctaaggaaatatgtcacttgct

SEQ ID NO: 9014764 - DNA, 22 bp, Homo sapiens
ctaaggaacaccaggagatggt

SEQ ID NO: 9014765 - DNA, 22 bp, Homo sapiens
ctaaggaacagatgtcagcaga

SEQ ID NO: 9014766 - DNA, 22 bp, Homo sapiens
ctaaggaacatcacaggccgtc

SEQ ID NO: 9014767 - DNA, 22 bp, Homo sapiens
ctaaggaagtgacagtgggatt

SEQ ID NO: 9014768 - DNA, 22 bp, Homo sapiens
ctaaggaagtgacagtgggatt

SEQ ID NO: 9014769 - DNA, 22 bp, Homo sapiens
ctaaggaagtgacagtgggatt

SEQ ID NO: 9014770 - DNA, 22 bp, Homo sapiens
ctaaggaattcaaatagttagt

SEQ ID NO: 9014771 - DNA, 22 bp, Homo sapiens
ctaaggaatcctaaaacagctg

SEQ ID NO: 9014772 - DNA, 22 bp, Homo sapiens
agtatgcaaattatttcattgt

SEQ ID NO: 9014773 - DNA, 22 bp, Homo sapiens
ctaaggaattggagcatgtgtt

SEQ ID NO: 9014774 - DNA, 22 bp, Homo sapiens
ctaaggaatcctaaaacagctg

SEQ ID NO: 9014775 - DNA, 22 bp, Homo sapiens
ctaaggaattggagcatgtgtt

SEQ ID NO: 9014776 - DNA, 22 bp, Homo sapiens
agtatgcatatttcaaagtaag

SEQ ID NO: 9014777 - DNA, 22 bp, Homo sapiens
agtatgcacctcactgtcaggc

SEQ ID NO: 9014778 - DNA, 22 bp, Homo sapiens
agtatgcatatttcaaagtaag

SEQ ID NO: 9014779 - DNA, 22 bp, Homo sapiens
agtatgtcagagtgaaaatggt

SEQ ID NO: 9014780 - DNA, 22 bp, Homo sapiens
agtatgtaattttcaatgtgtt

SEQ ID NO: 9014781 - DNA, 22 bp, Homo sapiens
agtatggggctgtgtgtgcaca

SEQ ID NO: 9014782 - DNA, 22 bp, Homo sapiens
agtatgtgtccccccaggagcc

SEQ ID NO: 9014783 - DNA, 22 bp, Homo sapiens
agtattctggaattctatgtga

SEQ ID NO: 9014784 - DNA, 23 bp, Homo sapiens
agtattcaaaaggcaagctatat

SEQ ID NO: 9014785 - DNA, 23 bp, Homo sapiens
agtattcaaaaggcaagctatat

SEQ ID NO: 9014786 - DNA, 23 bp, Homo sapiens
agtattcaaaaggcaagctatat

SEQ ID NO: 9014787 - DNA, 23 bp, Homo sapiens
agtattcaaaaggcaagctatat

SEQ ID NO: 9014788 - DNA, 22 bp, Homo sapiens
agtatttagagacacaagatgg

SEQ ID NO: 9014789 - DNA, 22 bp, Homo sapiens
agtatttagagacacaagacgg

SEQ ID NO: 9014790 - DNA, 22 bp, Homo sapiens
agtatttcctggcttatctgct

SEQ ID NO: 9014791 - DNA, 22 bp, Homo sapiens
ctacagaatctacctcaagcca

SEQ ID NO: 9014792 - DNA, 22 bp, Homo sapiens
agtatttagctgactcgctaca

SEQ ID NO: 9014793 - DNA, 22 bp, Homo sapiens
agtatttagcatagtggttagt

SEQ ID NO: 9014794 - DNA, 22 bp, Homo sapiens
agtatttagcatagtggttagt

SEQ ID NO: 9014795 - DNA, 22 bp, Homo sapiens
agtatttagagacacaagatgg

SEQ ID NO: 9014796 - DNA, 22 bp, Homo sapiens
agtatttagagacacaagatgg

SEQ ID NO: 9014797 - DNA, 22 bp, Homo sapiens
agtatttagagacacaagatgg

SEQ ID NO: 9014798 - DNA, 22 bp, Homo sapiens
agtatttagagacacaagatgg

SEQ ID NO: 9014799 - DNA, 22 bp, Homo sapiens
ctagtccactgtcctgcctcca

SEQ ID NO: 9014800 - DNA, 22 bp, Homo sapiens
ctagtccagtctcaaaatgcta

SEQ ID NO: 9014801 - DNA, 20 bp, Homo sapiens
ctagtctcacatccctggca

SEQ ID NO: 9014802 - DNA, 22 bp, Homo sapiens
ctagtctctggaggtcagggct

SEQ ID NO: 9014803 - DNA, 22 bp, Homo sapiens
ctagtcactcagcactgacaaa

SEQ ID NO: 9014804 - DNA, 22 bp, Homo sapiens
agtcccagctactcaagaggct

SEQ ID NO: 9014805 - DNA, 22 bp, Homo sapiens
agtcccagctactcaagaggct

SEQ ID NO: 9014806 - DNA, 22 bp, Homo sapiens
agtcccagctactcaagaggct

SEQ ID NO: 9014807 - DNA, 22 bp, Homo sapiens
agtcccagctactcaagaggct

SEQ ID NO: 9014808 - DNA, 22 bp, Homo sapiens
agtcccagctactcaagaggct

SEQ ID NO: 9014809 - DNA, 22 bp, Homo sapiens
ctaggtggtggtgggttgacat

SEQ ID NO: 9014810 - DNA, 22 bp, Homo sapiens
ctaggtgatccactgctctctt

SEQ ID NO: 9014811 - DNA, 22 bp, Homo sapiens
ctaggtttaactttcacagaaa

SEQ ID NO: 9014812 - DNA, 22 bp, Homo sapiens
ctagtaaagtactcaaatagcc

SEQ ID NO: 9014813 - DNA, 22 bp, Homo sapiens
ctagtaaagtactcaaatagcc

SEQ ID NO: 9014814 - DNA, 22 bp, Homo sapiens
ctaggttaaagcggttttatgt

SEQ ID NO: 9014815 - DNA, 22 bp, Homo sapiens
ctagtaaagctatgattctgcc

SEQ ID NO: 9014816 - DNA, 22 bp, Homo sapiens
ctagtaaagtactcaaatagcc

SEQ ID NO: 9014817 - DNA, 22 bp, Homo sapiens
ctagtaaggaataaattatgat

SEQ ID NO: 9014818 - DNA, 22 bp, Homo sapiens
ctagtcacacagtaaggacggg

SEQ ID NO: 9014819 - DNA, 22 bp, Homo sapiens
ctagtattacatttttgtgtgt

SEQ ID NO: 9014820 - DNA, 22 bp, Homo sapiens
ctagtcacgtctttcagttacc

SEQ ID NO: 9014821 - DNA, 22 bp, Homo sapiens
ctagtattaagtgtgagtaaaa

SEQ ID NO: 9014822 - DNA, 22 bp, Homo sapiens
ctagggtcaggggcctgcgtcg

SEQ ID NO: 9014823 - DNA, 22 bp, Homo sapiens
ctagggtcaggggcctgcgtcg

SEQ ID NO: 9014824 - DNA, 22 bp, Homo sapiens
ctagggtcaggggcctgcgtcg

SEQ ID NO: 9014825 - DNA, 22 bp, Homo sapiens
ctagggtcaggggcctgcgtcg

SEQ ID NO: 9014826 - DNA, 22 bp, Homo sapiens
ctagggtctgttttccaggtgt

SEQ ID NO: 9014827 - DNA, 22 bp, Homo sapiens
ctaggggcatgaaatagagaat

SEQ ID NO: 9014828 - DNA, 22 bp, Homo sapiens
ctagggtcaggggcctgcgtcg

SEQ ID NO: 9014829 - DNA, 22 bp, Homo sapiens
ctagggtcaggggcctgcgtcg

SEQ ID NO: 9014830 - DNA, 22 bp, Homo sapiens
ctagggtgtgcagattttgcct

SEQ ID NO: 9014831 - DNA, 22 bp, Homo sapiens
ctagggtggatttgtgcagagt

SEQ ID NO: 9014832 - DNA, 22 bp, Homo sapiens
ctagggtggatttgtgcagagt

SEQ ID NO: 9014833 - DNA, 22 bp, Homo sapiens
ctagggtgtgcagattttgcct

SEQ ID NO: 9014834 - DNA, 22 bp, Homo sapiens
ctaggtgatccactgctctctt

SEQ ID NO: 9014835 - DNA, 22 bp, Homo sapiens
ctaggtgatccactgctctctt

SEQ ID NO: 9014836 - DNA, 22 bp, Homo sapiens
ctaggtacttagtaaatattaa

SEQ ID NO: 9014837 - DNA, 22 bp, Homo sapiens
agtccattaactgtgttaacag

SEQ ID NO: 9014838 - DNA, 22 bp, Homo sapiens
agtcccaacagcttacaaggaa

SEQ ID NO: 9014839 - DNA, 22 bp, Homo sapiens
agtccatggttctgactcatct

SEQ ID NO: 9014840 - DNA, 22 bp, Homo sapiens
agtccatggttgtagttctctc

SEQ ID NO: 9014841 - DNA, 22 bp, Homo sapiens
agtccatgctgtctacagaatc

SEQ ID NO: 9014842 - DNA, 18 bp, Homo sapiens
agtccatgcatggctata

SEQ ID NO: 9014843 - DNA, 18 bp, Homo sapiens
agtccatgcatggctata

SEQ ID NO: 9014844 - DNA, 19 bp, Homo sapiens
agtccatgaatggaggatg

SEQ ID NO: 9014845 - DNA, 19 bp, Homo sapiens
agtccatgaatggaggatg

SEQ ID NO: 9014846 - DNA, 22 bp, Homo sapiens
agtccatagtttacattacagc

SEQ ID NO: 9014847 - DNA, 19 bp, Homo sapiens
agtccatgaatggaggatg

SEQ ID NO: 9014848 - DNA, 22 bp, Homo sapiens
ctagaaggaagcccagcacttc

SEQ ID NO: 9014849 - DNA, 20 bp, Homo sapiens
ctagaagcagaattgctgat

SEQ ID NO: 9014850 - DNA, 22 bp, Homo sapiens
ctagaagcaactagatctgttt

SEQ ID NO: 9014851 - DNA, 22 bp, Homo sapiens
ctagaagttggggctagggata

SEQ ID NO: 9014852 - DNA, 22 bp, Homo sapiens
ctagaatactcgtattattccc

SEQ ID NO: 9014853 - DNA, 22 bp, Homo sapiens
ctagaagttggggctagggata

SEQ ID NO: 9014854 - DNA, 22 bp, Homo sapiens
ctagaacctaggagtactaaag

SEQ ID NO: 9014855 - DNA, 22 bp, Homo sapiens
ctagaacagtcaaagtgagctc

SEQ ID NO: 9014856 - DNA, 22 bp, Homo sapiens
ctagaacagaaagtacaggaaa

SEQ ID NO: 9014857 - DNA, 22 bp, Homo sapiens
ctagaacagaaagtacaggaaa

SEQ ID NO: 9014858 - DNA, 22 bp, Homo sapiens
ctagaacaaattaggaggcata

SEQ ID NO: 9014859 - DNA, 20 bp, Homo sapiens
ctagaactgagaaatttaaa

SEQ ID NO: 9014860 - DNA, 22 bp, Homo sapiens
ctagaagcaactagatctgttt

SEQ ID NO: 9014861 - DNA, 22 bp, Homo sapiens
ctagaacagtcaaagtgagctc

SEQ ID NO: 9014862 - DNA, 22 bp, Homo sapiens
ctagaacctaggagtactaaag

SEQ ID NO: 9014863 - DNA, 22 bp, Homo sapiens
ctagaactacatcttttaatag

SEQ ID NO: 9014864 - DNA, 22 bp, Homo sapiens
ctagaatcccaaatggactggg

SEQ ID NO: 9014865 - DNA, 22 bp, Homo sapiens
ctagaatatcatatgaagagac

SEQ ID NO: 9014866 - DNA, 22 bp, Homo sapiens
ctagaatactcgtattattccc

SEQ ID NO: 9014867 - DNA, 22 bp, Homo sapiens
ctagaatatcatatgaagagac

SEQ ID NO: 9014868 - DNA, 22 bp, Homo sapiens
ctagaatctatgtcaggaactc

SEQ ID NO: 9014869 - DNA, 22 bp, Homo sapiens
ctagaatctccaagtttactca

SEQ ID NO: 9014870 - DNA, 22 bp, Homo sapiens
ctagaatctgggatttctgact

SEQ ID NO: 9014871 - DNA, 22 bp, Homo sapiens
agtccaccacccatgctcctct

SEQ ID NO: 9014872 - DNA, 22 bp, Homo sapiens
ctagaattgcattctatgaata

SEQ ID NO: 9014873 - DNA, 22 bp, Homo sapiens
agtccaaggttcatggcacaga

SEQ ID NO: 9014874 - DNA, 22 bp, Homo sapiens
agtccaccggcagagatgctga

SEQ ID NO: 9014875 - DNA, 22 bp, Homo sapiens
agtccagaacttcagctagttt

SEQ ID NO: 9014876 - DNA, 22 bp, Homo sapiens
agtccaggctcttcctgaagaa

SEQ ID NO: 9014877 - DNA, 22 bp, Homo sapiens
agtccaggtggaccttggccag

SEQ ID NO: 9014878 - DNA, 22 bp, Homo sapiens
agtccagtctcttctggtgagt

SEQ ID NO: 9014879 - DNA, 22 bp, Homo sapiens
agtccagtctcttctggtgagt

SEQ ID NO: 9014880 - DNA, 22 bp, Homo sapiens
agtccagtcttgttggcacggt

SEQ ID NO: 9014881 - DNA, 22 bp, Homo sapiens
agtccagtcggcctggagaaat

SEQ ID NO: 9014882 - DNA, 22 bp, Homo sapiens
agtccatacattgagaataaca

SEQ ID NO: 9014883 - DNA, 22 bp, Homo sapiens
agtccataacttcagagtgtca

SEQ ID NO: 9014884 - DNA, 22 bp, Homo sapiens
agtccagtcttgttggcacggt

SEQ ID NO: 9014885 - DNA, 22 bp, Homo sapiens
agtccagtgtcaaggtgccatt

SEQ ID NO: 9014886 - DNA, 22 bp, Homo sapiens
agtccagtgtgttctggcagca

SEQ ID NO: 9014887 - DNA, 22 bp, Homo sapiens
agtccagtgtgttctggcagca

SEQ ID NO: 9014888 - DNA, 22 bp, Homo sapiens
agtccagggcttagtcagcggg

SEQ ID NO: 9014889 - DNA, 22 bp, Homo sapiens
agtccaggtctctgagtcacaa

SEQ ID NO: 9014890 - DNA, 22 bp, Homo sapiens
agtccagggcttagtcagcggg

SEQ ID NO: 9014891 - DNA, 22 bp, Homo sapiens
agtccagggctctctgtgggat

SEQ ID NO: 9014892 - DNA, 22 bp, Homo sapiens
agtccagggctctctgtgggat

SEQ ID NO: 9014893 - DNA, 22 bp, Homo sapiens
agtccagggctctctgtgggat

SEQ ID NO: 9014894 - DNA, 22 bp, Homo sapiens
agtccagggagcccaggctttg

SEQ ID NO: 9014895 - DNA, 22 bp, Homo sapiens
agtccagggctctctgtgggat

SEQ ID NO: 9014896 - DNA, 22 bp, Homo sapiens
agtccagggctctctgtgggat

SEQ ID NO: 9014897 - DNA, 22 bp, Homo sapiens
agtccaggctcttcctgaagaa

SEQ ID NO: 9014898 - DNA, 22 bp, Homo sapiens
agtccaggctcttcctgaagaa

SEQ ID NO: 9014899 - DNA, 22 bp, Homo sapiens
agtccagggagcccaggctttg

SEQ ID NO: 9014900 - DNA, 22 bp, Homo sapiens
agtccagggagcccaggctttg

SEQ ID NO: 9014901 - DNA, 19 bp, Homo sapiens
agtacagaaaagagccctg

SEQ ID NO: 9014902 - DNA, 22 bp, Homo sapiens
agtacagggagtttgttgtgtt

SEQ ID NO: 9014903 - DNA, 22 bp, Homo sapiens
agtacagtagatgtaggaatag

SEQ ID NO: 9014904 - DNA, 22 bp, Homo sapiens
agtacagtagggtgctgttagt

SEQ ID NO: 9014905 - DNA, 22 bp, Homo sapiens
agtacagtagggtgctgttagt

SEQ ID NO: 9014906 - DNA, 22 bp, Homo sapiens
agtacagtagatgtaggaatag

SEQ ID NO: 9014907 - DNA, 22 bp, Homo sapiens
agtacagtcaggaagctgctgt

SEQ ID NO: 9014908 - DNA, 22 bp, Homo sapiens
agtacagtagggtgctgttagt

SEQ ID NO: 9014909 - DNA, 22 bp, Homo sapiens
agtacagtgctcagtaatctaa

SEQ ID NO: 9014910 - DNA, 22 bp, Homo sapiens
agtacagtggtcataatataaa

SEQ ID NO: 9014911 - DNA, 22 bp, Homo sapiens
agtacagtgctcagtaatctaa

SEQ ID NO: 9014912 - DNA, 22 bp, Homo sapiens
agtacagtcaggaagctgctgt

SEQ ID NO: 9014913 - DNA, 22 bp, Homo sapiens
agtacagtcaggaagctgctgt

SEQ ID NO: 9014914 - DNA, 22 bp, Homo sapiens
agtacagatttagacacgatag

SEQ ID NO: 9014915 - DNA, 22 bp, Homo sapiens
agtacagatttagacacgatag

SEQ ID NO: 9014916 - DNA, 22 bp, Homo sapiens
agtacactggcaaatgtggtgg

SEQ ID NO: 9014917 - DNA, 22 bp, Homo sapiens
agtacagacctgtctcttcctg

SEQ ID NO: 9014918 - DNA, 22 bp, Homo sapiens
agtacacagtatatggtgagat

SEQ ID NO: 9014919 - DNA, 22 bp, Homo sapiens
agtacacagtatatggtgagat

SEQ ID NO: 9014920 - DNA, 19 bp, Homo sapiens
agtacagaaaagagccctg

SEQ ID NO: 9014921 - DNA, 22 bp, Homo sapiens
agtacaatttaatgaagatagc

SEQ ID NO: 9014922 - DNA, 22 bp, Homo sapiens
agtacaattatatttagatggt

SEQ ID NO: 9014923 - DNA, 22 bp, Homo sapiens
agtacaatttaatgaagatagc

SEQ ID NO: 9014924 - DNA, 22 bp, Homo sapiens
agtacaatttaatgaagatagc

SEQ ID NO: 9014925 - DNA, 22 bp, Homo sapiens
agtacacaagacacatttaaaa

SEQ ID NO: 9014926 - DNA, 22 bp, Homo sapiens
agtacacaagacacatttaaaa

SEQ ID NO: 9014927 - DNA, 22 bp, Homo sapiens
agtacacagaattctacttgtt

SEQ ID NO: 9014928 - DNA, 22 bp, Homo sapiens
agtacacacagtagaatagagt

SEQ ID NO: 9014929 - DNA, 22 bp, Homo sapiens
agtacacacagtagaatagagt

SEQ ID NO: 9014930 - DNA, 22 bp, Homo sapiens
agtacacacagtagaatagagt

SEQ ID NO: 9014931 - DNA, 22 bp, Homo sapiens
agtacacagagttattttgtgt

SEQ ID NO: 9014932 - DNA, 22 bp, Homo sapiens
agtacacagtagactttctcat

SEQ ID NO: 9014933 - DNA, 22 bp, Homo sapiens
ctaaacttcatatgttgcttta

SEQ ID NO: 9014934 - DNA, 22 bp, Homo sapiens
ctaagaaatgttgtgaatgcca

SEQ ID NO: 9014935 - DNA, 22 bp, Homo sapiens
ctaaacttcttggcaattttat

SEQ ID NO: 9014936 - DNA, 22 bp, Homo sapiens
ctaaacttcttggcaattttat

SEQ ID NO: 9014937 - DNA, 22 bp, Homo sapiens
ctaagaaatgttgtgaatgcca

SEQ ID NO: 9014938 - DNA, 22 bp, Homo sapiens
ctaagaaatgttgtgaatgcca

SEQ ID NO: 9014939 - DNA, 22 bp, Homo sapiens
ctaagaaatgttgtgaatgcca

SEQ ID NO: 9014940 - DNA, 22 bp, Homo sapiens
ctaagaaggaggaaaagtgcca

SEQ ID NO: 9014941 - DNA, 22 bp, Homo sapiens
ctaagacatgccctgcatgata

SEQ ID NO: 9014942 - DNA, 22 bp, Homo sapiens
ctaagaagtcaggggacagagg

SEQ ID NO: 9014943 - DNA, 22 bp, Homo sapiens
ctaagactctgcaaatcagctt

SEQ ID NO: 9014944 - DNA, 22 bp, Homo sapiens
ctaagaggaagtactctgttat

SEQ ID NO: 9014945 - DNA, 20 bp, Homo sapiens
ctaagaggaggactaggttt

SEQ ID NO: 9014946 - DNA, 18 bp, Homo sapiens
ctaagaggtcgtttctca

SEQ ID NO: 9014947 - DNA, 20 bp, Homo sapiens
ctaagaggtccttccacatc

SEQ ID NO: 9014948 - DNA, 21 bp, Homo sapiens
ctaagcaaggagcaggggtag

SEQ ID NO: 9014949 - DNA, 22 bp, Homo sapiens
ctaagcaagaatgagtgcaaca

SEQ ID NO: 9014950 - DNA, 22 bp, Homo sapiens
ctaagcaagaatgagtgcaaca

SEQ ID NO: 9014951 - DNA, 22 bp, Homo sapiens
ctaagactctgcaaatcagctt

SEQ ID NO: 9014952 - DNA, 22 bp, Homo sapiens
cgggctccgggtctttgcagtc

SEQ ID NO: 9014953 - DNA, 22 bp, Homo sapiens
cgggctcaggaggaaacaggag

SEQ ID NO: 9014954 - DNA, 18 bp, Homo sapiens
cgggcgggcgcctggccc

SEQ ID NO: 9014955 - DNA, 22 bp, Homo sapiens
cgggcgcactccgggcagctgt

SEQ ID NO: 9014956 - DNA, 22 bp, Homo sapiens
cgggcgcactccgggcagctgt

SEQ ID NO: 9014957 - DNA, 20 bp, Homo sapiens
agtacaatgtatgattcaga

SEQ ID NO: 9014958 - DNA, 22 bp, Homo sapiens
agtacaatgtctgacacagtag

SEQ ID NO: 9014959 - DNA, 22 bp, Homo sapiens
agtacaatgtctgacacagtag

SEQ ID NO: 9014960 - DNA, 22 bp, Homo sapiens
agtacaatgtctgacacagtag

SEQ ID NO: 9014961 - DNA, 23 bp, Homo sapiens
agtacaataagtataattctttc

SEQ ID NO: 9014962 - DNA, 22 bp, Homo sapiens
agtacaagtgatgtggtaaaaa

SEQ ID NO: 9014963 - DNA, 22 bp, Homo sapiens
agtacaagtgatgtggtaaaaa

SEQ ID NO: 9014964 - DNA, 22 bp, Homo sapiens
agtacaagtagaatgctacaag

SEQ ID NO: 9014965 - DNA, 22 bp, Homo sapiens
agtacaagtagaatgctacaag

SEQ ID NO: 9014966 - DNA, 22 bp, Homo sapiens
agtacaactagaaataggtgta

SEQ ID NO: 9014967 - DNA, 22 bp, Homo sapiens
agtacaaattatagcgcttgga

SEQ ID NO: 9014968 - DNA, 22 bp, Homo sapiens
agtacaaattatagcgcttgga

SEQ ID NO: 9014969 - DNA, 22 bp, Homo sapiens
agtacaaattatagcgcttgga

SEQ ID NO: 9014970 - DNA, 21 bp, Homo sapiens
cgggctggccgggccctcacc

SEQ ID NO: 9014971 - DNA, 21 bp, Homo sapiens
cgggctggccgggccctcacc

SEQ ID NO: 9014972 - DNA, 21 bp, Homo sapiens
cgggctggccgggccctcacc

SEQ ID NO: 9014973 - DNA, 21 bp, Homo sapiens
cgggctggccgggccctcacc

SEQ ID NO: 9014974 - DNA, 22 bp, Homo sapiens
cgggcagattgggaaggttcat

SEQ ID NO: 9014975 - DNA, 22 bp, Homo sapiens
cgggcagcggcgtggccatggt

SEQ ID NO: 9014976 - DNA, 22 bp, Homo sapiens
cgggcagatcacacagggcttg

SEQ ID NO: 9014977 - DNA, 22 bp, Homo sapiens
cgggcacacacttgacaggttc

SEQ ID NO: 9014978 - DNA, 22 bp, Homo sapiens
cgggcaaggcgagactaggccc

SEQ ID NO: 9014979 - DNA, 17 bp, Homo sapiens
cgggcatggagggcagg

SEQ ID NO: 9014980 - DNA, 17 bp, Homo sapiens
cgggcatggagggcagg

SEQ ID NO: 9014981 - DNA, 17 bp, Homo sapiens
cgggcatggagggcagg

SEQ ID NO: 9014982 - DNA, 17 bp, Homo sapiens
cgggcatggagggcagg

SEQ ID NO: 9014983 - DNA, 22 bp, Homo sapiens
cgggcagtgtggctccagagtc

SEQ ID NO: 9014984 - DNA, 17 bp, Homo sapiens
cgggcatggagggcagg

SEQ ID NO: 9014985 - DNA, 17 bp, Homo sapiens
cgggcatggagggcagg

SEQ ID NO: 9014986 - DNA, 17 bp, Homo sapiens
cgggcatggagggcagg

SEQ ID NO: 9014987 - DNA, 17 bp, Homo sapiens
cgggcatggagggcagg

SEQ ID NO: 9014988 - DNA, 17 bp, Homo sapiens
cgggcccgcggccgctc

SEQ ID NO: 9014989 - DNA, 22 bp, Homo sapiens
cgggccctttaaggatgtgtcg

SEQ ID NO: 9014990 - DNA, 22 bp, Homo sapiens
cgggccctttaaggatgtgtcg

SEQ ID NO: 9014991 - DNA, 22 bp, Homo sapiens
cgggccctactcaaagcttgca

SEQ ID NO: 9014992 - DNA, 19 bp, Homo sapiens
cctgttcttggctgaggct

SEQ ID NO: 9014993 - DNA, 19 bp, Homo sapiens
cctgttcttggctgaggct

SEQ ID NO: 9014994 - DNA, 19 bp, Homo sapiens
cctgttcttggctgaggct

SEQ ID NO: 9014995 - DNA, 22 bp, Homo sapiens
cctgttctgttaattaaacttt

SEQ ID NO: 9014996 - DNA, 22 bp, Homo sapiens
cctgttctgtggctctcaaagg

SEQ ID NO: 9014997 - DNA, 22 bp, Homo sapiens
cctgttctgtagtgagtttgag

SEQ ID NO: 9014998 - DNA, 22 bp, Homo sapiens
cctgttctaatcttggggcaga

SEQ ID NO: 9014999 - DNA, 22 bp, Homo sapiens
cctgttctaatcttggggcaga

SEQ ID NO: 9015000 - DNA, 21 bp, Homo sapiens
cctgttcacagatctgtaact

SEQ ID NO: 9015001 - DNA, 22 bp, Homo sapiens
cctgttcaccctccatgcacag

SEQ ID NO: 9015002 - DNA, 18 bp, Homo sapiens
cctgttacacactggggt

SEQ ID NO: 9015003 - DNA, 22 bp, Homo sapiens
cctgttcaagttgcagggctgg

SEQ ID NO: 9015004 - DNA, 18 bp, Homo sapiens
cctgtgtgtgttgcaggc

SEQ ID NO: 9015005 - DNA, 18 bp, Homo sapiens
cctgtgtgtgttgcaggc

SEQ ID NO: 9015006 - DNA, 18 bp, Homo sapiens
cctgtgtgtgttgcaggc

SEQ ID NO: 9015007 - DNA, 22 bp, Homo sapiens
cctgtgttagttatgggtctct

SEQ ID NO: 9015008 - DNA, 22 bp, Homo sapiens
cctgtgttagttatgggtctct

SEQ ID NO: 9015009 - DNA, 22 bp, Homo sapiens
cctgtgttagttatgggtctct

SEQ ID NO: 9015010 - DNA, 22 bp, Homo sapiens
cctgtgttctaatccatctcag

SEQ ID NO: 9015011 - DNA, 19 bp, Homo sapiens
cctgtgttgggagtgtgag

SEQ ID NO: 9015012 - DNA, 22 bp, Homo sapiens
cctgtgtttagatatgatgctg

SEQ ID NO: 9015013 - DNA, 19 bp, Homo sapiens
cgcaggagccgaggtgacc

SEQ ID NO: 9015014 - DNA, 19 bp, Homo sapiens
cgcaggagccgaggtgacc

SEQ ID NO: 9015015 - DNA, 19 bp, Homo sapiens
cgcaggagccgaggtgacc

SEQ ID NO: 9015016 - DNA, 19 bp, Homo sapiens
cgcaggagccgaggtgacc

SEQ ID NO: 9015017 - DNA, 19 bp, Homo sapiens
cgcaggagccgaggtgacc

SEQ ID NO: 9015018 - DNA, 22 bp, Homo sapiens
cgcaggcaagagagtacagtta

SEQ ID NO: 9015019 - DNA, 22 bp, Homo sapiens
cgcaggctccggggtgccctgg

SEQ ID NO: 9015020 - DNA, 22 bp, Homo sapiens
cgcaggctcggttcacagagca

SEQ ID NO: 9015021 - DNA, 22 bp, Homo sapiens
cgcaggcacagagtggacagcg

SEQ ID NO: 9015022 - DNA, 22 bp, Homo sapiens
cgaggccatgcatgctgaggac

SEQ ID NO: 9015023 - DNA, 22 bp, Homo sapiens
cgcagctgtccatgtgtggggg

SEQ ID NO: 9015024 - DNA, 22 bp, Homo sapiens
cgaggccatgcatgctgaggac

SEQ ID NO: 9015025 - DNA, 20 bp, Homo sapiens
cctgttggatgaggtccaga

SEQ ID NO: 9015026 - DNA, 22 bp, Homo sapiens
cctgttgtggaaaaagcctgat

SEQ ID NO: 9015027 - DNA, 22 bp, Homo sapiens
cctgttggaaggtgtaggcccc

SEQ ID NO: 9015028 - DNA, 22 bp, Homo sapiens
cctgttgctctgcatgagttta

SEQ ID NO: 9015029 - DNA, 22 bp, Homo sapiens
cctgttgagagagctcactgag

SEQ ID NO: 9015030 - DNA, 22 bp, Homo sapiens
cctgttcttgtctcattggcta

SEQ ID NO: 9015031 - DNA, 22 bp, Homo sapiens
cgcaggctggcgcggagtggca

SEQ ID NO: 9015032 - DNA, 22 bp, Homo sapiens
cgcaggctggcgcggagtggca

SEQ ID NO: 9015033 - DNA, 22 bp, Homo sapiens
cgcaggctgcagccaagaagag

SEQ ID NO: 9015034 - DNA, 22 bp, Homo sapiens
cgcaggctcggttcacagagca

SEQ ID NO: 9015035 - DNA, 22 bp, Homo sapiens
cgcaggctggcgcggagtggca

SEQ ID NO: 9015036 - DNA, 19 bp, Homo sapiens
cgcaggcttcgggtcgctc

SEQ ID NO: 9015037 - DNA, 19 bp, Homo sapiens
cgcaggcttcgggtcgctc

SEQ ID NO: 9015038 - DNA, 22 bp, Homo sapiens
cgcaggctttagaatctgctac

SEQ ID NO: 9015039 - DNA, 22 bp, Homo sapiens
cgcaggctttagaatctgctac

SEQ ID NO: 9015040 - DNA, 22 bp, Homo sapiens
cgcagggatttcaaggggcctt

SEQ ID NO: 9015041 - DNA, 22 bp, Homo sapiens
cgcaggggaggaaggtacacct

SEQ ID NO: 9015042 - DNA, 22 bp, Homo sapiens
cgcaggggaggaaggtacacct

SEQ ID NO: 9015043 - DNA, 22 bp, Homo sapiens
cgcagggccgcgagcgggacca

SEQ ID NO: 9015044 - DNA, 22 bp, Homo sapiens
cgcaggggaggaaggtacacct

SEQ ID NO: 9015045 - DNA, 22 bp, Homo sapiens
aggtttctgcagcatagtggca

SEQ ID NO: 9015046 - DNA, 22 bp, Homo sapiens
aggtttctgctgtcctccttct

SEQ ID NO: 9015047 - DNA, 22 bp, Homo sapiens
aggtttctgcaatgtgtgtaca

SEQ ID NO: 9015048 - DNA, 22 bp, Homo sapiens
aggtttgggagtagaaatcaga

SEQ ID NO: 9015049 - DNA, 22 bp, Homo sapiens
aggtttgggttcattgctggct

SEQ ID NO: 9015050 - DNA, 22 bp, Homo sapiens
aggtttgggttcattgctggct

SEQ ID NO: 9015051 - DNA, 22 bp, Homo sapiens
aggtttggtttgacaagactga

SEQ ID NO: 9015052 - DNA, 22 bp, Homo sapiens
aggtttggtttgacaagactga

SEQ ID NO: 9015053 - DNA, 22 bp, Homo sapiens
aggtttctttatgctgctagaa

SEQ ID NO: 9015054 - DNA, 22 bp, Homo sapiens
aggtttcttcttaggaatatgt

SEQ ID NO: 9015055 - DNA, 21 bp, Homo sapiens
aggtttctgtgagcagagcag

SEQ ID NO: 9015056 - DNA, 22 bp, Homo sapiens
aggtttctggatttattatggc

SEQ ID NO: 9015057 - DNA, 22 bp, Homo sapiens
aggtttctggaaaggttttgct

SEQ ID NO: 9015058 - DNA, 22 bp, Homo sapiens
agtaaaaagttcagaatggttg

SEQ ID NO: 9015059 - DNA, 22 bp, Homo sapiens
agtaaaaagttcagaatggttg

SEQ ID NO: 9015060 - DNA, 22 bp, Homo sapiens
agtaaaaagttcagaatggttg

SEQ ID NO: 9015061 - DNA, 22 bp, Homo sapiens
agtaaaaagttcagaatggttg

SEQ ID NO: 9015062 - DNA, 22 bp, Homo sapiens
cggctcagctagcttggcccca

SEQ ID NO: 9015063 - DNA, 22 bp, Homo sapiens
cggctcagctagcttggcccca

SEQ ID NO: 9015064 - DNA, 22 bp, Homo sapiens
agtaaaaagttcagaatggttg

SEQ ID NO: 9015065 - DNA, 22 bp, Homo sapiens
agtaaaaatatgcttgtggcta

SEQ ID NO: 9015066 - DNA, 22 bp, Homo sapiens
cccaggaagttgatgcagagga

SEQ ID NO: 9015067 - DNA, 22 bp, Homo sapiens
cccaggaagttgatgcagagga

SEQ ID NO: 9015068 - DNA, 22 bp, Homo sapiens
cccaggaagttgagactgcagt

SEQ ID NO: 9015069 - DNA, 22 bp, Homo sapiens
cccaggaagttgatgcagagga

SEQ ID NO: 9015070 - DNA, 22 bp, Homo sapiens
cccaggaagttgatgcagagga

SEQ ID NO: 9015071 - DNA, 22 bp, Homo sapiens
cccaggaagtggaggttgcagt

SEQ ID NO: 9015072 - DNA, 22 bp, Homo sapiens
cccaggaagtggaggttgcagt

SEQ ID NO: 9015073 - DNA, 22 bp, Homo sapiens
cccaggaaggtggtctgtggct

SEQ ID NO: 9015074 - DNA, 22 bp, Homo sapiens
cccaggaagggatgccaaggaa

SEQ ID NO: 9015075 - DNA, 22 bp, Homo sapiens
cccaggaagggatgccaaggaa

SEQ ID NO: 9015076 - DNA, 22 bp, Homo sapiens
cccaggaagagtgagtggcatt

SEQ ID NO: 9015077 - DNA, 22 bp, Homo sapiens
cccaggaagaggggtcaggtgt

SEQ ID NO: 9015078 - DNA, 22 bp, Homo sapiens
cccaggaagaaattctgatttg

SEQ ID NO: 9015079 - DNA, 22 bp, Homo sapiens
cccaggaagcccagaattctgg

SEQ ID NO: 9015080 - DNA, 22 bp, Homo sapiens
cccaggaagcccagaattctgg

SEQ ID NO: 9015081 - DNA, 23 bp, Homo sapiens
cccaggaagccaaagaaatatag

SEQ ID NO: 9015082 - DNA, 22 bp, Homo sapiens
cccaggaagagtgagtggcatt

SEQ ID NO: 9015083 - DNA, 22 bp, Homo sapiens
cccaggaagagtgagtggcatt

SEQ ID NO: 9015084 - DNA, 22 bp, Homo sapiens
cccaggaagagtgagtggcatt

SEQ ID NO: 9015085 - DNA, 19 bp, Homo sapiens
cccaggaagcggaggttgc

SEQ ID NO: 9015086 - DNA, 22 bp, Homo sapiens
cccaggaagcggagattgcaga

SEQ ID NO: 9015087 - DNA, 22 bp, Homo sapiens
cccaggaagcggagattgcaga

SEQ ID NO: 9015088 - DNA, 22 bp, Homo sapiens
cccaggaagggatgccaaggaa

SEQ ID NO: 9015089 - DNA, 22 bp, Homo sapiens
cccaggaagggatgccaaggaa

SEQ ID NO: 9015090 - DNA, 22 bp, Homo sapiens
cccaggaagggatgccaaggaa

SEQ ID NO: 9015091 - DNA, 22 bp, Homo sapiens
cccaggaagggatgccaaggaa

SEQ ID NO: 9015092 - DNA, 19 bp, Homo sapiens
cccaggaagcggaggttgc

SEQ ID NO: 9015093 - DNA, 22 bp, Homo sapiens
cccaggaaggagctgtgtattt

SEQ ID NO: 9015094 - DNA, 22 bp, Homo sapiens
cccaggaaggagctgtgtattt

SEQ ID NO: 9015095 - DNA, 22 bp, Homo sapiens
cccaggaaatgggctcttgcct

SEQ ID NO: 9015096 - DNA, 22 bp, Homo sapiens
cccaggaaatgaacttctgatt

SEQ ID NO: 9015097 - DNA, 22 bp, Homo sapiens
cccaggaacagcacagaacagc

SEQ ID NO: 9015098 - DNA, 22 bp, Homo sapiens
cccaggaacagcacagaacagc

SEQ ID NO: 9015099 - DNA, 22 bp, Homo sapiens
cccaggaacagcacagaacagc

SEQ ID NO: 9015100 - DNA, 22 bp, Homo sapiens
cccaggaacagcacagaacagc

SEQ ID NO: 9015101 - DNA, 22 bp, Homo sapiens
cccaggaactccagagctcctc

SEQ ID NO: 9015102 - DNA, 22 bp, Homo sapiens
cccaggaactccagagctcctc

SEQ ID NO: 9015103 - DNA, 22 bp, Homo sapiens
cccaggaagaaattctgatttg

SEQ ID NO: 9015104 - DNA, 22 bp, Homo sapiens
cccaggaacagggctcagaccc

SEQ ID NO: 9015105 - DNA, 22 bp, Homo sapiens
cccaggaacagggctcagaccc

SEQ ID NO: 9015106 - DNA, 22 bp, Homo sapiens
cccaggaacctaccagctcgag

SEQ ID NO: 9015107 - DNA, 22 bp, Homo sapiens
cccaggaacagggctcagaccc

SEQ ID NO: 9015108 - DNA, 22 bp, Homo sapiens
agggaaagtaagcatttcatta

SEQ ID NO: 9015109 - DNA, 22 bp, Homo sapiens
agggaaagtaagcatttcatta

SEQ ID NO: 9015110 - DNA, 22 bp, Homo sapiens
agggaaaggtagtgaggtcaca

SEQ ID NO: 9015111 - DNA, 22 bp, Homo sapiens
agggaaagtaagcatttcatta

SEQ ID NO: 9015112 - DNA, 22 bp, Homo sapiens
agggaaataatctattctgagg

SEQ ID NO: 9015113 - DNA, 22 bp, Homo sapiens
cccaggaaatatgtttcttaac

SEQ ID NO: 9015114 - DNA, 22 bp, Homo sapiens
cccaggaaatcaggctttctag

SEQ ID NO: 9015115 - DNA, 22 bp, Homo sapiens
cccaggaaatatgtttcttaac

SEQ ID NO: 9015116 - DNA, 22 bp, Homo sapiens
cccaggaaatcaggctttctag

SEQ ID NO: 9015117 - DNA, 23 bp, Homo sapiens
agggaaagtagtaatggcctttg

SEQ ID NO: 9015118 - DNA, 23 bp, Homo sapiens
agggaaagtagtaatggcctttg

SEQ ID NO: 9015119 - DNA, 23 bp, Homo sapiens
agggaaagtagtaatggcctttg

SEQ ID NO: 9015120 - DNA, 22 bp, Homo sapiens
aggcttttagaatcttatttct

SEQ ID NO: 9015121 - DNA, 22 bp, Homo sapiens
aggcttttatacattgctgacc

SEQ ID NO: 9015122 - DNA, 22 bp, Homo sapiens
aggcttttctccagaatgtact

SEQ ID NO: 9015123 - DNA, 22 bp, Homo sapiens
aggcttttctccagaatgtact

SEQ ID NO: 9015124 - DNA, 22 bp, Homo sapiens
aggcttttatacattgctgacc

SEQ ID NO: 9015125 - DNA, 22 bp, Homo sapiens
aggctttgttttatctcattta

SEQ ID NO: 9015126 - DNA, 22 bp, Homo sapiens
aggcttttgtggtgtggaatgg

SEQ ID NO: 9015127 - DNA, 22 bp, Homo sapiens
aggcttttctccagaatgtact

SEQ ID NO: 9015128 - DNA, 22 bp, Homo sapiens
aggcttttgctctggctcctct

SEQ ID NO: 9015129 - DNA, 22 bp, Homo sapiens
aggcttttggagaagcatatgc

SEQ ID NO: 9015130 - DNA, 21 bp, Homo sapiens
agggaaaaggctgagtgaggg

SEQ ID NO: 9015131 - DNA, 22 bp, Homo sapiens
agggaaaggctgatgctgtggg

SEQ ID NO: 9015132 - DNA, 22 bp, Homo sapiens
agggaaaggtagtgaggtcaca

SEQ ID NO: 9015133 - DNA, 21 bp, Homo sapiens
agggaaagaaaatgagctaat

SEQ ID NO: 9015134 - DNA, 21 bp, Homo sapiens
agggaaagaaaatgagctaat

SEQ ID NO: 9015135 - DNA, 21 bp, Homo sapiens
agggaaagaaaatgagctaat

SEQ ID NO: 9015136 - DNA, 21 bp, Homo sapiens
agggaaagaaaatgagctaat

SEQ ID NO: 9015137 - DNA, 22 bp, Homo sapiens
agggaaaggctgatgctgtggg

SEQ ID NO: 9015138 - DNA, 22 bp, Homo sapiens
cccagagtctctgctcttgcct

SEQ ID NO: 9015139 - DNA, 22 bp, Homo sapiens
cccagagtcacatggggtgttc

SEQ ID NO: 9015140 - DNA, 23 bp, Homo sapiens
cccagagtcatctgtagctgtgg

SEQ ID NO: 9015141 - DNA, 22 bp, Homo sapiens
cccagagtatttgtgatgttag

SEQ ID NO: 9015142 - DNA, 22 bp, Homo sapiens
cccagagtcaagcttaccatta

SEQ ID NO: 9015143 - DNA, 22 bp, Homo sapiens
cccagagtggacggtggcccct

SEQ ID NO: 9015144 - DNA, 22 bp, Homo sapiens
cccagagtggagggtgcagaat

SEQ ID NO: 9015145 - DNA, 22 bp, Homo sapiens
cccagagttcaaaccctgcgtc

SEQ ID NO: 9015146 - DNA, 22 bp, Homo sapiens
cccagagttggtcaggggaccc

SEQ ID NO: 9015147 - DNA, 22 bp, Homo sapiens
cccagagttggtcaggggaccc

SEQ ID NO: 9015148 - DNA, 22 bp, Homo sapiens
aggcttggctctcctatgagaa

SEQ ID NO: 9015149 - DNA, 22 bp, Homo sapiens
aggcttggctctcctatgagaa

SEQ ID NO: 9015150 - DNA, 22 bp, Homo sapiens
aggcttggctggcagccctggg

SEQ ID NO: 9015151 - DNA, 22 bp, Homo sapiens
cccagatgcaggttcaagagta

SEQ ID NO: 9015152 - DNA, 22 bp, Homo sapiens
aggcttggctggcagccctggg

SEQ ID NO: 9015153 - DNA, 22 bp, Homo sapiens
aggcttggctggcagccctggg

SEQ ID NO: 9015154 - DNA, 22 bp, Homo sapiens
aggctttcctgtcactcatgct

SEQ ID NO: 9015155 - DNA, 22 bp, Homo sapiens
aggctttgcaaaaaagctcata

SEQ ID NO: 9015156 - DNA, 22 bp, Homo sapiens
aggctttgcaaaaaagctcata

SEQ ID NO: 9015157 - DNA, 22 bp, Homo sapiens
aggctttgcaaaaaagctcata

SEQ ID NO: 9015158 - DNA, 22 bp, Homo sapiens
agggagccttcctggctgtggt

SEQ ID NO: 9015159 - DNA, 22 bp, Homo sapiens
agggagccctgaaccagagggt

SEQ ID NO: 9015160 - DNA, 22 bp, Homo sapiens
agggagccctgaaccagagggt

SEQ ID NO: 9015161 - DNA, 22 bp, Homo sapiens
agggagccttcctggctgtggt

SEQ ID NO: 9015162 - DNA, 22 bp, Homo sapiens
agggagctgagagctactattt

SEQ ID NO: 9015163 - DNA, 22 bp, Homo sapiens
agggagctgagctgtgagcagc

SEQ ID NO: 9015164 - DNA, 22 bp, Homo sapiens
cccaggcctggtctgggccagt

SEQ ID NO: 9015165 - DNA, 22 bp, Homo sapiens
cccaggcctggtctgggccagt

SEQ ID NO: 9015166 - DNA, 22 bp, Homo sapiens
agggagccctgaaccagagggt

SEQ ID NO: 9015167 - DNA, 22 bp, Homo sapiens
cccaggcctggtctgggccagt

SEQ ID NO: 9015168 - DNA, 22 bp, Homo sapiens
cccaggcctggtctgggccagt

SEQ ID NO: 9015169 - DNA, 22 bp, Homo sapiens
cccaggcctggtctgggccagt

SEQ ID NO: 9015170 - DNA, 22 bp, Homo sapiens
cccaggcctggtctgggccagt

SEQ ID NO: 9015171 - DNA, 22 bp, Homo sapiens
cccaggccccagggcttgtcag

SEQ ID NO: 9015172 - DNA, 22 bp, Homo sapiens
cccaggccccagggcttgtcag

SEQ ID NO: 9015173 - DNA, 22 bp, Homo sapiens
cccaggccctggcagagcttgt

SEQ ID NO: 9015174 - DNA, 22 bp, Homo sapiens
cccaggccccagggcttgtcag

SEQ ID NO: 9015175 - DNA, 22 bp, Homo sapiens
cccaggccctggcagagcttgt

SEQ ID NO: 9015176 - DNA, 22 bp, Homo sapiens
cccaggccctggcagagcttgt

SEQ ID NO: 9015177 - DNA, 22 bp, Homo sapiens
cccaggccctggcagagcttgt

SEQ ID NO: 9015178 - DNA, 22 bp, Homo sapiens
cccaggcctggtctgggccagt

SEQ ID NO: 9015179 - DNA, 17 bp, Homo sapiens
cccaggccgccgggagc

SEQ ID NO: 9015180 - DNA, 17 bp, Homo sapiens
cccaggccgccgggagc

SEQ ID NO: 9015181 - DNA, 22 bp, Homo sapiens
agggagcttccgaactacagct

SEQ ID NO: 9015182 - DNA, 22 bp, Homo sapiens
agggagctgtggtcagctcagt

SEQ ID NO: 9015183 - DNA, 22 bp, Homo sapiens
agggagctgtggtcagctcagt

SEQ ID NO: 9015184 - DNA, 22 bp, Homo sapiens
agggagctgtggtcagctcagt

SEQ ID NO: 9015185 - DNA, 22 bp, Homo sapiens
agggagcttctacttcaaggca

SEQ ID NO: 9015186 - DNA, 22 bp, Homo sapiens
agggagcttctggcctcagcct

SEQ ID NO: 9015187 - DNA, 22 bp, Homo sapiens
agggagctgggccacactgatc

SEQ ID NO: 9015188 - DNA, 22 bp, Homo sapiens
agggagctggtatttataatga

SEQ ID NO: 9015189 - DNA, 22 bp, Homo sapiens
agggagctgggccacactgatc

SEQ ID NO: 9015190 - DNA, 21 bp, Homo sapiens
agggagctggccacacagcct

SEQ ID NO: 9015191 - DNA, 21 bp, Homo sapiens
agggagctggccacacagcct

SEQ ID NO: 9015192 - DNA, 21 bp, Homo sapiens
agggagctggccacacagcct

SEQ ID NO: 9015193 - DNA, 22 bp, Homo sapiens
agggagctgctctgcttccgtg

SEQ ID NO: 9015194 - DNA, 22 bp, Homo sapiens
agggagctgagctgtgagcagc

SEQ ID NO: 9015195 - DNA, 22 bp, Homo sapiens
agggagctgagctgtgagcagc

SEQ ID NO: 9015196 - DNA, 22 bp, Homo sapiens
agggacctcttcttgcagctga

SEQ ID NO: 9015197 - DNA, 22 bp, Homo sapiens
agggaccttgatgggtttggga

SEQ ID NO: 9015198 - DNA, 22 bp, Homo sapiens
agggactatttacccatctcac

SEQ ID NO: 9015199 - DNA, 22 bp, Homo sapiens
agggaccttgatgggtttggga

SEQ ID NO: 9015200 - DNA, 22 bp, Homo sapiens
agggactatttacccatctcac

SEQ ID NO: 9015201 - DNA, 22 bp, Homo sapiens
agggaccctgatgactgaggag

SEQ ID NO: 9015202 - DNA, 22 bp, Homo sapiens
agggaccctgatgactgaggag

SEQ ID NO: 9015203 - DNA, 22 bp, Homo sapiens
agggacccatagagagaccagt

SEQ ID NO: 9015204 - DNA, 22 bp, Homo sapiens
agggacccatagagagaccagt

SEQ ID NO: 9015205 - DNA, 22 bp, Homo sapiens
agggaccaggggtagctgagat

SEQ ID NO: 9015206 - DNA, 22 bp, Homo sapiens
agggaccaggggtagctgagat

SEQ ID NO: 9015207 - DNA, 22 bp, Homo sapiens
agggaccaggggtagctgagat

SEQ ID NO: 9015208 - DNA, 22 bp, Homo sapiens
agggacccatagagagaccagt

SEQ ID NO: 9015209 - DNA, 22 bp, Homo sapiens
agggactccgtgcacagtggtt

SEQ ID NO: 9015210 - DNA, 22 bp, Homo sapiens
agggactatttacccatctcac

SEQ ID NO: 9015211 - DNA, 22 bp, Homo sapiens
cccaggccagaacttggttgct

SEQ ID NO: 9015212 - DNA, 22 bp, Homo sapiens
cccaggccagaacttggttgct

SEQ ID NO: 9015213 - DNA, 22 bp, Homo sapiens
cccaggccagaacttggttgct

SEQ ID NO: 9015214 - DNA, 22 bp, Homo sapiens
cccaggccagaacttggttgct

SEQ ID NO: 9015215 - DNA, 22 bp, Homo sapiens
cccaggccccagggcttgtcag

SEQ ID NO: 9015216 - DNA, 22 bp, Homo sapiens
cccaggccccagggcttgtcag

SEQ ID NO: 9015217 - DNA, 22 bp, Homo sapiens
agggacatctcacaaacaactt

SEQ ID NO: 9015218 - DNA, 22 bp, Homo sapiens
agggacagttacatcatcagac

SEQ ID NO: 9015219 - DNA, 22 bp, Homo sapiens
agggacagttacatcatcagac

SEQ ID NO: 9015220 - DNA, 22 bp, Homo sapiens
agggacagttacatcatcagac

SEQ ID NO: 9015221 - DNA, 22 bp, Homo sapiens
agggacagttacatcatcagac

SEQ ID NO: 9015222 - DNA, 22 bp, Homo sapiens
agggacagttacatcatcagac

SEQ ID NO: 9015223 - DNA, 22 bp, Homo sapiens
agggacagttacatcatcagac

SEQ ID NO: 9015224 - DNA, 22 bp, Homo sapiens
agggaccaatcaccgacaggct

SEQ ID NO: 9015225 - DNA, 22 bp, Homo sapiens
agggaccaatcaccgacaggct

SEQ ID NO: 9015226 - DNA, 22 bp, Homo sapiens
agggaccacatcccctctgtgg

SEQ ID NO: 9015227 - DNA, 22 bp, Homo sapiens
agggaccacatcccctctgtgg

SEQ ID NO: 9015228 - DNA, 22 bp, Homo sapiens
agggaccaatcaccgacaggct

SEQ ID NO: 9015229 - DNA, 22 bp, Homo sapiens
agggaccagcgtgagtctgagg

SEQ ID NO: 9015230 - DNA, 22 bp, Homo sapiens
agggaccagcgtgagtctgagg

SEQ ID NO: 9015231 - DNA, 22 bp, Homo sapiens
agggaccagcgtgagtctgagg

SEQ ID NO: 9015232 - DNA, 22 bp, Homo sapiens
agggaccagcctgcccagggct

SEQ ID NO: 9015233 - DNA, 22 bp, Homo sapiens
agggaccacatcccctctgtgg

SEQ ID NO: 9015234 - DNA, 22 bp, Homo sapiens
agggaccagcctgcccagggct

SEQ ID NO: 9015235 - DNA, 22 bp, Homo sapiens
agggacagtctactgttcactg

SEQ ID NO: 9015236 - DNA, 22 bp, Homo sapiens
agggacagtctactgttcactg

SEQ ID NO: 9015237 - DNA, 22 bp, Homo sapiens
agggacagtctactgttcactg

SEQ ID NO: 9015238 - DNA, 22 bp, Homo sapiens
agggacagtctactgttcactg

SEQ ID NO: 9015239 - DNA, 22 bp, Homo sapiens
agggacagttacatcatcagac

SEQ ID NO: 9015240 - DNA, 22 bp, Homo sapiens
agggacagtctactgttcactg

SEQ ID NO: 9015241 - DNA, 22 bp, Homo sapiens
agggacagtctactgttcactg

SEQ ID NO: 9015242 - DNA, 22 bp, Homo sapiens
agggacagttacatcatcagac

SEQ ID NO: 9015243 - DNA, 22 bp, Homo sapiens
agggaatggatgatggcaggtt

SEQ ID NO: 9015244 - DNA, 22 bp, Homo sapiens
agggacagtctactgttcactg

SEQ ID NO: 9015245 - DNA, 22 bp, Homo sapiens
agggaatggatgatggcaggtt

SEQ ID NO: 9015246 - DNA, 22 bp, Homo sapiens
agggaatggatgatggcaggtt

SEQ ID NO: 9015247 - DNA, 22 bp, Homo sapiens
cccaggaatgagcaggcagggg

SEQ ID NO: 9015248 - DNA, 22 bp, Homo sapiens
cccaggaatgagcaggcagggg

SEQ ID NO: 9015249 - DNA, 22 bp, Homo sapiens
agggcagaaatattgatactgt

SEQ ID NO: 9015250 - DNA, 22 bp, Homo sapiens
agggcagaagtacagacactta

SEQ ID NO: 9015251 - DNA, 22 bp, Homo sapiens
agggcagaaatcgattacacct

SEQ ID NO: 9015252 - DNA, 22 bp, Homo sapiens
agggcagaagtacagacactta

SEQ ID NO: 9015253 - DNA, 22 bp, Homo sapiens
agggcagaagtacagacactta

SEQ ID NO: 9015254 - DNA, 22 bp, Homo sapiens
agggcagaccacgtgcaaggat

SEQ ID NO: 9015255 - DNA, 22 bp, Homo sapiens
agggcagaagtacagacactta

SEQ ID NO: 9015256 - DNA, 22 bp, Homo sapiens
agggcagaccacgtgcaaggat

SEQ ID NO: 9015257 - DNA, 22 bp, Homo sapiens
agggcagactaggatggaagtg

SEQ ID NO: 9015258 - DNA, 22 bp, Homo sapiens
agggcagactaggatggaagtg

SEQ ID NO: 9015259 - DNA, 22 bp, Homo sapiens
agggcagactaggatggaagtg

SEQ ID NO: 9015260 - DNA, 22 bp, Homo sapiens
agggcagactaggatggaagtg

SEQ ID NO: 9015261 - DNA, 22 bp, Homo sapiens
agggcagaccacgtgcaaggat

SEQ ID NO: 9015262 - DNA, 22 bp, Homo sapiens
agggcagaccacgtgcaaggat

SEQ ID NO: 9015263 - DNA, 22 bp, Homo sapiens
agggcagaccacgtgcaaggat

SEQ ID NO: 9015264 - DNA, 22 bp, Homo sapiens
agggcagaccacgtgcaaggat

SEQ ID NO: 9015265 - DNA, 22 bp, Homo sapiens
agggcagactaggatggaagtg

SEQ ID NO: 9015266 - DNA, 22 bp, Homo sapiens
agggcagactaggatggaagtg

SEQ ID NO: 9015267 - DNA, 22 bp, Homo sapiens
agggcagaccacgtgcaaggat

SEQ ID NO: 9015268 - DNA, 22 bp, Homo sapiens
agggcagactaggatggaagtg

SEQ ID NO: 9015269 - DNA, 22 bp, Homo sapiens
agggcagaccacgtgcaaggat

SEQ ID NO: 9015270 - DNA, 22 bp, Homo sapiens
cccctgccagctatccctgaac

SEQ ID NO: 9015271 - DNA, 22 bp, Homo sapiens
cccctgccatagtcaaatctaa

SEQ ID NO: 9015272 - DNA, 22 bp, Homo sapiens
cccctgccatagtcaaatctaa

SEQ ID NO: 9015273 - DNA, 22 bp, Homo sapiens
cccctgctggcctgctggtttc

SEQ ID NO: 9015274 - DNA, 22 bp, Homo sapiens
cccctgccatagtcaaatctaa

SEQ ID NO: 9015275 - DNA, 21 bp, Homo sapiens
cccctgggagccctgtcagta

SEQ ID NO: 9015276 - DNA, 21 bp, Homo sapiens
cccctgggagccctgtcagta

SEQ ID NO: 9015277 - DNA, 21 bp, Homo sapiens
cccctgggagccctgtcagta

SEQ ID NO: 9015278 - DNA, 22 bp, Homo sapiens
cccctgccagctatccctgaac

SEQ ID NO: 9015279 - DNA, 22 bp, Homo sapiens
cccctgccagctatccctgaac

SEQ ID NO: 9015280 - DNA, 22 bp, Homo sapiens
cccctgccagctatccctgaac

SEQ ID NO: 9015281 - DNA, 22 bp, Homo sapiens
cccctgagattctggcttggga

SEQ ID NO: 9015282 - DNA, 22 bp, Homo sapiens
cccctgagattctggcttggga

SEQ ID NO: 9015283 - DNA, 22 bp, Homo sapiens
cccctgagattctggcttggga

SEQ ID NO: 9015284 - DNA, 22 bp, Homo sapiens
cccctgagattctggcttggga

SEQ ID NO: 9015285 - DNA, 22 bp, Homo sapiens
cccctgccagctatccctgaac

SEQ ID NO: 9015286 - DNA, 22 bp, Homo sapiens
agggcagagaaatgtagttgag

SEQ ID NO: 9015287 - DNA, 22 bp, Homo sapiens
cccctcttgtgggctcaggtca

SEQ ID NO: 9015288 - DNA, 22 bp, Homo sapiens
agggcagagaaatgtagttgag

SEQ ID NO: 9015289 - DNA, 22 bp, Homo sapiens
cccctcttgtgggctcaggtca

SEQ ID NO: 9015290 - DNA, 22 bp, Homo sapiens
agggcagagaaatgtagttgag

SEQ ID NO: 9015291 - DNA, 22 bp, Homo sapiens
cccctgaagacaatggagaggt

SEQ ID NO: 9015292 - DNA, 22 bp, Homo sapiens
cccaggtgggttggcctctgtc

SEQ ID NO: 9015293 - DNA, 22 bp, Homo sapiens
cccaggtgggttggcctctgtc

SEQ ID NO: 9015294 - DNA, 22 bp, Homo sapiens
cccaggtgggcacctcgaggaa

SEQ ID NO: 9015295 - DNA, 21 bp, Homo sapiens
cccaggtgggatggttgcctc

SEQ ID NO: 9015296 - DNA, 21 bp, Homo sapiens
cccaggtgggatggttgcctc

SEQ ID NO: 9015297 - DNA, 22 bp, Homo sapiens
cccaggtggcagaagctgcagt

SEQ ID NO: 9015298 - DNA, 22 bp, Homo sapiens
cccaggtggcagaagctgcagt

SEQ ID NO: 9015299 - DNA, 21 bp, Homo sapiens
cccaggtgggatggttgcctc

SEQ ID NO: 9015300 - DNA, 21 bp, Homo sapiens
cccaggtgggatggttgcctc

SEQ ID NO: 9015301 - DNA, 22 bp, Homo sapiens
cccaggtggcagaagctgcagt

SEQ ID NO: 9015302 - DNA, 22 bp, Homo sapiens
cccaggtgctgaaggaggccgc

SEQ ID NO: 9015303 - DNA, 22 bp, Homo sapiens
cccaggtgctgaaggaggccgc

SEQ ID NO: 9015304 - DNA, 22 bp, Homo sapiens
cccaggtgctgcgtgaagcctc

SEQ ID NO: 9015305 - DNA, 22 bp, Homo sapiens
cccaggtctgtgccagctctga

SEQ ID NO: 9015306 - DNA, 22 bp, Homo sapiens
cccaggtctgtgccagctctga

SEQ ID NO: 9015307 - DNA, 22 bp, Homo sapiens
agggagctttcaggtagcttaa

SEQ ID NO: 9015308 - DNA, 22 bp, Homo sapiens
cccaggtgctgaaggaggccgc

SEQ ID NO: 9015309 - DNA, 22 bp, Homo sapiens
agggagctttaccccagatcac

SEQ ID NO: 9015310 - DNA, 21 bp, Homo sapiens
agggagctttaggtagaagtt

SEQ ID NO: 9015311 - DNA, 21 bp, Homo sapiens
agggagctttaggtagaagtt

SEQ ID NO: 9015312 - DNA, 22 bp, Homo sapiens
agggagctttcaggtagcttaa

SEQ ID NO: 9015313 - DNA, 21 bp, Homo sapiens
agggagctttaggtagaagtt

SEQ ID NO: 9015314 - DNA, 22 bp, Homo sapiens
agggagcttgtgtttcttttag

SEQ ID NO: 9015315 - DNA, 20 bp, Homo sapiens
cccaggtgtctgaagctctg

SEQ ID NO: 9015316 - DNA, 20 bp, Homo sapiens
cccaggtgtctgaagctctg

SEQ ID NO: 9015317 - DNA, 20 bp, Homo sapiens
cccaggtgtctgaagctctg

SEQ ID NO: 9015318 - DNA, 23 bp, Homo sapiens
cccaggtgtggaggcggtggcag

SEQ ID NO: 9015319 - DNA, 23 bp, Homo sapiens
cccaggtgtggaggcggtggcag

SEQ ID NO: 9015320 - DNA, 22 bp, Homo sapiens
cccaggtgggcacctcgaggaa

SEQ ID NO: 9015321 - DNA, 23 bp, Homo sapiens
cccaggtgtggaggcggtggcag

SEQ ID NO: 9015322 - DNA, 19 bp, Homo sapiens
cccaggtgtttgaggctgc

SEQ ID NO: 9015323 - DNA, 19 bp, Homo sapiens
cccaggtgtttgaggctgc

SEQ ID NO: 9015324 - DNA, 19 bp, Homo sapiens
cccaggtgtttgaggctgc

SEQ ID NO: 9015325 - DNA, 22 bp, Homo sapiens
cccaggtgtttgtggcagaggt

SEQ ID NO: 9015326 - DNA, 22 bp, Homo sapiens
cccagtaatcggagagtactta

SEQ ID NO: 9015327 - DNA, 22 bp, Homo sapiens
cccagtaacttgcctaagttgc

SEQ ID NO: 9015328 - DNA, 22 bp, Homo sapiens
agggcagaaaccaccttgatgg

SEQ ID NO: 9015329 - DNA, 22 bp, Homo sapiens
agggcagaaaccaccttgatgg

SEQ ID NO: 9015330 - DNA, 20 bp, Homo sapiens
agggcacttttgctggagca

SEQ ID NO: 9015331 - DNA, 20 bp, Homo sapiens
agggcacttttgctggagca

SEQ ID NO: 9015332 - DNA, 20 bp, Homo sapiens
agggcacttttgctggagca

SEQ ID NO: 9015333 - DNA, 22 bp, Homo sapiens
agggcagaaaccaccttgatgg

SEQ ID NO: 9015334 - DNA, 22 bp, Homo sapiens
agggcactttacccatagcttg

SEQ ID NO: 9015335 - DNA, 22 bp, Homo sapiens
agggcactttacccatagcttg

SEQ ID NO: 9015336 - DNA, 22 bp, Homo sapiens
agggatggtggaggttgcaagt

SEQ ID NO: 9015337 - DNA, 22 bp, Homo sapiens
agggatgggtctaacccagaac

SEQ ID NO: 9015338 - DNA, 22 bp, Homo sapiens
cccagtaagaagctggcaccag

SEQ ID NO: 9015339 - DNA, 22 bp, Homo sapiens
agggatgggtctaacccagaac

SEQ ID NO: 9015340 - DNA, 22 bp, Homo sapiens
agggatggtggaggaatttcaa

SEQ ID NO: 9015341 - DNA, 22 bp, Homo sapiens
agggatggtggaggaatttcaa

SEQ ID NO: 9015342 - DNA, 22 bp, Homo sapiens
agggatggtggaggaatttcaa

SEQ ID NO: 9015343 - DNA, 22 bp, Homo sapiens
agggccaccagggagtctcagg

SEQ ID NO: 9015344 - DNA, 22 bp, Homo sapiens
agggccaccagagcagggcagt

SEQ ID NO: 9015345 - DNA, 22 bp, Homo sapiens
agggccaccagagcagggcagt

SEQ ID NO: 9015346 - DNA, 22 bp, Homo sapiens
agggccaccagagcagggcagt

SEQ ID NO: 9015347 - DNA, 22 bp, Homo sapiens
agggccacagtggggcctgaga

SEQ ID NO: 9015348 - DNA, 22 bp, Homo sapiens
agggccacagtggggcctgaga

SEQ ID NO: 9015349 - DNA, 22 bp, Homo sapiens
agggcattggcacagatctgct

SEQ ID NO: 9015350 - DNA, 22 bp, Homo sapiens
agggccaagtccaggacctcgg

SEQ ID NO: 9015351 - DNA, 22 bp, Homo sapiens
agggccaagtccaggacctcgg

SEQ ID NO: 9015352 - DNA, 22 bp, Homo sapiens
agggcatgtgggagaggagcct

SEQ ID NO: 9015353 - DNA, 22 bp, Homo sapiens
agggccacagtaatgctgagta

SEQ ID NO: 9015354 - DNA, 22 bp, Homo sapiens
agggccactggctgacggctgc

SEQ ID NO: 9015355 - DNA, 23 bp, Homo sapiens
agggccactgggaaggattactg

SEQ ID NO: 9015356 - DNA, 22 bp, Homo sapiens
agggccaccagagcagggcagt

SEQ ID NO: 9015357 - DNA, 22 bp, Homo sapiens
agggccaccagggagtctcagg

SEQ ID NO: 9015358 - DNA, 22 bp, Homo sapiens
agggccacctctctgggttccc

SEQ ID NO: 9015359 - DNA, 22 bp, Homo sapiens
agggccacctctctgggttccc

SEQ ID NO: 9015360 - DNA, 22 bp, Homo sapiens
ccctgaggatagggcaggaccc

SEQ ID NO: 9015361 - DNA, 22 bp, Homo sapiens
ccctgaggatagggcaggaccc

SEQ ID NO: 9015362 - DNA, 22 bp, Homo sapiens
ccctgaggatagggcaggaccc

SEQ ID NO: 9015363 - DNA, 22 bp, Homo sapiens
ccctgaggatagggcaggaccc

SEQ ID NO: 9015364 - DNA, 22 bp, Homo sapiens
ccctgaggatagggcaggaccc

SEQ ID NO: 9015365 - DNA, 22 bp, Homo sapiens
ccctgaggatagggcaggaccc

SEQ ID NO: 9015366 - DNA, 22 bp, Homo sapiens
ccctgaggatagggcaggaccc

SEQ ID NO: 9015367 - DNA, 22 bp, Homo sapiens
ccctgaggatagggcaggaccc

SEQ ID NO: 9015368 - DNA, 22 bp, Homo sapiens
cccctggggatcagctggaatt

SEQ ID NO: 9015369 - DNA, 22 bp, Homo sapiens
cccctgggtccaggcttctctg

SEQ ID NO: 9015370 - DNA, 20 bp, Homo sapiens
ccccttcatctacagcctga

SEQ ID NO: 9015371 - DNA, 22 bp, Homo sapiens
agggcagctgtgagccactgtg

SEQ ID NO: 9015372 - DNA, 22 bp, Homo sapiens
cccctgtgttgttcaagggtca

SEQ ID NO: 9015373 - DNA, 19 bp, Homo sapiens
ccccttaggggttaagcct

SEQ ID NO: 9015374 - DNA, 22 bp, Homo sapiens
agggcagctgtgagccactgtg

SEQ ID NO: 9015375 - DNA, 22 bp, Homo sapiens
agggcagctgtgagccactgtg

SEQ ID NO: 9015376 - DNA, 22 bp, Homo sapiens
agggcagctgtgagccactgtg

SEQ ID NO: 9015377 - DNA, 22 bp, Homo sapiens
agggcatggggttaacctggga

SEQ ID NO: 9015378 - DNA, 22 bp, Homo sapiens
agggcatggggttaacctggga

SEQ ID NO: 9015379 - DNA, 22 bp, Homo sapiens
agggcatgtgggagaggagcct

SEQ ID NO: 9015380 - DNA, 22 bp, Homo sapiens
agggcatgtgggagaggagcct

SEQ ID NO: 9015381 - DNA, 22 bp, Homo sapiens
agggcatgtgggagaggagcct

SEQ ID NO: 9015382 - DNA, 22 bp, Homo sapiens
agggcatgtgggagaggagcct

SEQ ID NO: 9015383 - DNA, 22 bp, Homo sapiens
agggcatgtgggagaggagcct

SEQ ID NO: 9015384 - DNA, 22 bp, Homo sapiens
agggcatgtgggagaggagcct

SEQ ID NO: 9015385 - DNA, 22 bp, Homo sapiens
agggcatgtgggagaggagcct

SEQ ID NO: 9015386 - DNA, 22 bp, Homo sapiens
ccctgaggcaaaggctagagtt

SEQ ID NO: 9015387 - DNA, 19 bp, Homo sapiens
ccctgaggcaaaagccttt

SEQ ID NO: 9015388 - DNA, 19 bp, Homo sapiens
ccctgaggcaaaagccttt

SEQ ID NO: 9015389 - DNA, 22 bp, Homo sapiens
ccctgaggcaaaggctagagtt

SEQ ID NO: 9015390 - DNA, 22 bp, Homo sapiens
ccctgaggcaaaggctagagtt

SEQ ID NO: 9015391 - DNA, 22 bp, Homo sapiens
ccctgaggcaaaggctagagtt

SEQ ID NO: 9015392 - DNA, 22 bp, Homo sapiens
ccctgaggcaaaggctagagtt

SEQ ID NO: 9015393 - DNA, 22 bp, Homo sapiens
ccctgaggcacaggccacgtat

SEQ ID NO: 9015394 - DNA, 22 bp, Homo sapiens
ccctgaggcacaggccacgtat

SEQ ID NO: 9015395 - DNA, 22 bp, Homo sapiens
ccctgaggccctcctggggtct

SEQ ID NO: 9015396 - DNA, 22 bp, Homo sapiens
ccctgaggccctcctggggtct

SEQ ID NO: 9015397 - DNA, 22 bp, Homo sapiens
ccctgaggccctcctggggtct

SEQ ID NO: 9015398 - DNA, 22 bp, Homo sapiens
ccctgaggccctcctggggtct

SEQ ID NO: 9015399 - DNA, 22 bp, Homo sapiens
ccctgaggcctcaggttcattg

SEQ ID NO: 9015400 - DNA, 18 bp, Homo sapiens
ccctgaggctagcatgct

SEQ ID NO: 9015401 - DNA, 22 bp, Homo sapiens
ccctgaggcagtaggagctttt

SEQ ID NO: 9015402 - DNA, 22 bp, Homo sapiens
ccctgaggcagtaggagctttt

SEQ ID NO: 9015403 - DNA, 22 bp, Homo sapiens
ccctgaggcagtaggagctttt

SEQ ID NO: 9015404 - DNA, 22 bp, Homo sapiens
ccctgaggcagtaggagctttt

SEQ ID NO: 9015405 - DNA, 22 bp, Homo sapiens
ccctgaggcagtaggagctttt

SEQ ID NO: 9015406 - DNA, 22 bp, Homo sapiens
ccctgaggcagtaggagctttt

SEQ ID NO: 9015407 - DNA, 22 bp, Homo sapiens
ccctgaggggcttactttgccc

SEQ ID NO: 9015408 - DNA, 22 bp, Homo sapiens
ccctgaggcctcaggttcattg

SEQ ID NO: 9015409 - DNA, 22 bp, Homo sapiens
ccctgaggggagtggtgaggtg

SEQ ID NO: 9015410 - DNA, 22 bp, Homo sapiens
ccctgaggggagtggtgaggtg

SEQ ID NO: 9015411 - DNA, 22 bp, Homo sapiens
ccctgaggggagtggtgaggtg

SEQ ID NO: 9015412 - DNA, 22 bp, Homo sapiens
ccctgaggggcttactttgccc

SEQ ID NO: 9015413 - DNA, 22 bp, Homo sapiens
ccctgagtcatcattgcggaag

SEQ ID NO: 9015414 - DNA, 22 bp, Homo sapiens
ccctgagtcatcattgcggaag

SEQ ID NO: 9015415 - DNA, 22 bp, Homo sapiens
ccctgatagcccctatcatcag

SEQ ID NO: 9015416 - DNA, 22 bp, Homo sapiens
ccctgagttagtacagttgagt

SEQ ID NO: 9015417 - DNA, 22 bp, Homo sapiens
ccctgagttagtacagttgagt

SEQ ID NO: 9015418 - DNA, 22 bp, Homo sapiens
ccctgaggctgaggataggtgg

SEQ ID NO: 9015419 - DNA, 22 bp, Homo sapiens
ccctgaggggagtggtgaggtg

SEQ ID NO: 9015420 - DNA, 22 bp, Homo sapiens
ccctgaggggagtggtgaggtg

SEQ ID NO: 9015421 - DNA, 22 bp, Homo sapiens
ccctgaggggagtggtgaggtg

SEQ ID NO: 9015422 - DNA, 22 bp, Homo sapiens
ccctgaggctgaggataggtgg

SEQ ID NO: 9015423 - DNA, 18 bp, Homo sapiens
ccctgaggctagcatgct

SEQ ID NO: 9015424 - DNA, 22 bp, Homo sapiens
ccctgaggctgaggataggtgg

SEQ ID NO: 9015425 - DNA, 18 bp, Homo sapiens
ccctgaggctagcatgct

SEQ ID NO: 9015426 - DNA, 22 bp, Homo sapiens
ccctgaggctgaggataggtgg

SEQ ID NO: 9015427 - DNA, 22 bp, Homo sapiens
agggcccacagttcctatggcc

SEQ ID NO: 9015428 - DNA, 23 bp, Homo sapiens
agggcccaagcctggacagcagg

SEQ ID NO: 9015429 - DNA, 23 bp, Homo sapiens
agggcccaagcctggacagcagg

SEQ ID NO: 9015430 - DNA, 23 bp, Homo sapiens
agggcccaagcctggacagcagg

SEQ ID NO: 9015431 - DNA, 22 bp, Homo sapiens
agggccagtaaatgtttcctca

SEQ ID NO: 9015432 - DNA, 23 bp, Homo sapiens
agggccaggtgcggaaacagctc

SEQ ID NO: 9015433 - DNA, 23 bp, Homo sapiens
agggccaggtgcggaaacagctc

SEQ ID NO: 9015434 - DNA, 23 bp, Homo sapiens
agggccaggtgcggaaacagctc

SEQ ID NO: 9015435 - DNA, 23 bp, Homo sapiens
agggccaggtgcggaaacagctc

SEQ ID NO: 9015436 - DNA, 23 bp, Homo sapiens
agggccaggtgcggaaacagctc

SEQ ID NO: 9015437 - DNA, 22 bp, Homo sapiens
agggccagggaagctgtatttt

SEQ ID NO: 9015438 - DNA, 22 bp, Homo sapiens
agggccagggaagctgtatttt

SEQ ID NO: 9015439 - DNA, 23 bp, Homo sapiens
agggccaggtgcggaaacagctc

SEQ ID NO: 9015440 - DNA, 22 bp, Homo sapiens
agggccagggaagctgtatttt

SEQ ID NO: 9015441 - DNA, 22 bp, Homo sapiens
ccctgatgacacgggcatcagg

SEQ ID NO: 9015442 - DNA, 20 bp, Homo sapiens
agggcccaggaagagagtta

SEQ ID NO: 9015443 - DNA, 20 bp, Homo sapiens
agggcccaggaagagagtta

SEQ ID NO: 9015444 - DNA, 20 bp, Homo sapiens
agggcccaggaagagagtta

SEQ ID NO: 9015445 - DNA, 22 bp, Homo sapiens
agggcccaggacagcatcaggg

SEQ ID NO: 9015446 - DNA, 22 bp, Homo sapiens
agggcccaggacagcatcaggg

SEQ ID NO: 9015447 - DNA, 22 bp, Homo sapiens
agggcccaggacagcatcaggg

SEQ ID NO: 9015448 - DNA, 22 bp, Homo sapiens
agggcccaggacagcatcaggg

SEQ ID NO: 9015449 - DNA, 22 bp, Homo sapiens
agggcccaccttggtgctgagg

SEQ ID NO: 9015450 - DNA, 22 bp, Homo sapiens
agggcccagcagcatttcagtg

SEQ ID NO: 9015451 - DNA, 22 bp, Homo sapiens
agggcccacagttcctatggcc

SEQ ID NO: 9015452 - DNA, 22 bp, Homo sapiens
agggcccacagttcctatggcc

SEQ ID NO: 9015453 - DNA, 22 bp, Homo sapiens
aggggcctggttggcctctgtt

SEQ ID NO: 9015454 - DNA, 22 bp, Homo sapiens
aggggcctggttggcctctgtt

SEQ ID NO: 9015455 - DNA, 18 bp, Homo sapiens
aggggcagcttgtgtgga

SEQ ID NO: 9015456 - DNA, 18 bp, Homo sapiens
aggggcagcttgtgtgga

SEQ ID NO: 9015457 - DNA, 18 bp, Homo sapiens
aggggcagcttgtgtgga

SEQ ID NO: 9015458 - DNA, 18 bp, Homo sapiens
aggggcagcttgtgtgga

SEQ ID NO: 9015459 - DNA, 22 bp, Homo sapiens
aggggcctggttggcctctgtt

SEQ ID NO: 9015460 - DNA, 22 bp, Homo sapiens
aggggcgaggggagccgtgcca

SEQ ID NO: 9015461 - DNA, 22 bp, Homo sapiens
aggggcgctgcggtcctcagcc

SEQ ID NO: 9015462 - DNA, 22 bp, Homo sapiens
aggggcggcctgcctgaagcag

SEQ ID NO: 9015463 - DNA, 22 bp, Homo sapiens
aggggcgtctgtaggcagtggg

SEQ ID NO: 9015464 - DNA, 22 bp, Homo sapiens
aggggcgtctgtaggcagtggg

SEQ ID NO: 9015465 - DNA, 22 bp, Homo sapiens
aggggcgtgctcttccccgacg

SEQ ID NO: 9015466 - DNA, 22 bp, Homo sapiens
aggggctcaaagtgtgcaggga

SEQ ID NO: 9015467 - DNA, 22 bp, Homo sapiens
aggggctcaagcagtgtggtct

SEQ ID NO: 9015468 - DNA, 22 bp, Homo sapiens
aggggctcagttactttggcag

SEQ ID NO: 9015469 - DNA, 22 bp, Homo sapiens
aggggctcagttactttggcag

SEQ ID NO: 9015470 - DNA, 22 bp, Homo sapiens
aggggctcagttactttggcag

SEQ ID NO: 9015471 - DNA, 22 bp, Homo sapiens
aggggctcctttgtgctgcgtc

SEQ ID NO: 9015472 - DNA, 22 bp, Homo sapiens
aggggctcctttgtgctgcgtc

SEQ ID NO: 9015473 - DNA, 22 bp, Homo sapiens
aggggctcctttgtgctgcgtc

SEQ ID NO: 9015474 - DNA, 22 bp, Homo sapiens
aggggctctaaagatcatggaa

SEQ ID NO: 9015475 - DNA, 22 bp, Homo sapiens
aggggctctaaagatcatggaa

SEQ ID NO: 9015476 - DNA, 22 bp, Homo sapiens
aggggctcctggcctggagagc

SEQ ID NO: 9015477 - DNA, 22 bp, Homo sapiens
aggggctcctggcctggagagc

SEQ ID NO: 9015478 - DNA, 22 bp, Homo sapiens
aggggctcctggcctggagagc

SEQ ID NO: 9015479 - DNA, 22 bp, Homo sapiens
aggggctctgagtgggccagga

SEQ ID NO: 9015480 - DNA, 22 bp, Homo sapiens
aggggctctgagtgggccagga

SEQ ID NO: 9015481 - DNA, 22 bp, Homo sapiens
aggggctctgagtgggccagga

SEQ ID NO: 9015482 - DNA, 22 bp, Homo sapiens
aggggctgactggaaagtgcca

SEQ ID NO: 9015483 - DNA, 22 bp, Homo sapiens
aggggctgactggaaagtgcca

SEQ ID NO: 9015484 - DNA, 22 bp, Homo sapiens
aggggctgcctggcttggcact

SEQ ID NO: 9015485 - DNA, 22 bp, Homo sapiens
aggggctgcctggcttggcact

SEQ ID NO: 9015486 - DNA, 22 bp, Homo sapiens
aggggctgcctggcttggcact

SEQ ID NO: 9015487 - DNA, 22 bp, Homo sapiens
cctctgtgggccgggcctgctg

SEQ ID NO: 9015488 - DNA, 22 bp, Homo sapiens
aggggaagagccctttacatgg

SEQ ID NO: 9015489 - DNA, 22 bp, Homo sapiens
aggggaagagccctttacatgg

SEQ ID NO: 9015490 - DNA, 22 bp, Homo sapiens
aggggaaatctctcgccatctg

SEQ ID NO: 9015491 - DNA, 22 bp, Homo sapiens
aggggaaatctctcgccatctg

SEQ ID NO: 9015492 - DNA, 22 bp, Homo sapiens
aggggaaatgccttggtggtac

SEQ ID NO: 9015493 - DNA, 22 bp, Homo sapiens
aggggaaatgccttggtggtac

SEQ ID NO: 9015494 - DNA, 22 bp, Homo sapiens
aggggaagattatacttttgaa

SEQ ID NO: 9015495 - DNA, 22 bp, Homo sapiens
aggggaaggccagcctgtagag

SEQ ID NO: 9015496 - DNA, 22 bp, Homo sapiens
aggggaaggccagcctgtagag

SEQ ID NO: 9015497 - DNA, 22 bp, Homo sapiens
aggggaaggccagcctgtagag

SEQ ID NO: 9015498 - DNA, 22 bp, Homo sapiens
aggggaaggccagcctgtagag

SEQ ID NO: 9015499 - DNA, 22 bp, Homo sapiens
aggggaatgggtagactgttga

SEQ ID NO: 9015500 - DNA, 22 bp, Homo sapiens
cctcctggtgacaaggcaaagc

SEQ ID NO: 9015501 - DNA, 22 bp, Homo sapiens
cctcctggtgacaaggcaaagc

SEQ ID NO: 9015502 - DNA, 22 bp, Homo sapiens
cctcctggtgacaaggcaaagc

SEQ ID NO: 9015503 - DNA, 22 bp, Homo sapiens
aggggaatgggtagactgttga

SEQ ID NO: 9015504 - DNA, 22 bp, Homo sapiens
aggggaatgggtagactgttga

SEQ ID NO: 9015505 - DNA, 21 bp, Homo sapiens
aggggaagtagagttttgatt

SEQ ID NO: 9015506 - DNA, 21 bp, Homo sapiens
aggggaagtagagttttgatt

SEQ ID NO: 9015507 - DNA, 22 bp, Homo sapiens
aggggaaggccagcctgtagag

SEQ ID NO: 9015508 - DNA, 22 bp, Homo sapiens
cctcctgttgtcaccaggcgtg

SEQ ID NO: 9015509 - DNA, 19 bp, Homo sapiens
cctcctgtggcgggtgggg

SEQ ID NO: 9015510 - DNA, 19 bp, Homo sapiens
cctcctgtggcgggtgggg

SEQ ID NO: 9015511 - DNA, 22 bp, Homo sapiens
cctcctggtgggcgcttctggc

SEQ ID NO: 9015512 - DNA, 22 bp, Homo sapiens
cctcctggttgcaatgaaatgg

SEQ ID NO: 9015513 - DNA, 22 bp, Homo sapiens
cctcctggttgcaatgaaatgg

SEQ ID NO: 9015514 - DNA, 22 bp, Homo sapiens
cctcctggtgggcgcttctggc

SEQ ID NO: 9015515 - DNA, 22 bp, Homo sapiens
cctcctggtgggcgcttctggc

SEQ ID NO: 9015516 - DNA, 22 bp, Homo sapiens
cctcctggtgggcgcttctggc

SEQ ID NO: 9015517 - DNA, 22 bp, Homo sapiens
cctcctggtgggcgcttctggc

SEQ ID NO: 9015518 - DNA, 22 bp, Homo sapiens
cctcctgttgtcctgctggggc

SEQ ID NO: 9015519 - DNA, 22 bp, Homo sapiens
cctcctgttgtcaccaggcgtg

SEQ ID NO: 9015520 - DNA, 22 bp, Homo sapiens
cctccttcctgggacagagctg

SEQ ID NO: 9015521 - DNA, 22 bp, Homo sapiens
cctccttctctttttgcagagc

SEQ ID NO: 9015522 - DNA, 22 bp, Homo sapiens
cctccttcctgggacagagctg

SEQ ID NO: 9015523 - DNA, 22 bp, Homo sapiens
cctccttctggggccttctgct

SEQ ID NO: 9015524 - DNA, 18 bp, Homo sapiens
aggggcagcttgtgtgga

SEQ ID NO: 9015525 - DNA, 22 bp, Homo sapiens
agggggtgatcaaggtgcggcg

SEQ ID NO: 9015526 - DNA, 22 bp, Homo sapiens
agggggtgatcaaggtgcggcg

SEQ ID NO: 9015527 - DNA, 22 bp, Homo sapiens
agggggtgatcaaggtgcggcg

SEQ ID NO: 9015528 - DNA, 22 bp, Homo sapiens
agggggtgcatttgtgaatgaa

SEQ ID NO: 9015529 - DNA, 22 bp, Homo sapiens
agggggtgcccagatgaaggat

SEQ ID NO: 9015530 - DNA, 22 bp, Homo sapiens
agggggtgcccagatgaaggat

SEQ ID NO: 9015531 - DNA, 22 bp, Homo sapiens
agggggtgcccagatgaaggat

SEQ ID NO: 9015532 - DNA, 22 bp, Homo sapiens
agggggtgcatttgtgaatgaa

SEQ ID NO: 9015533 - DNA, 22 bp, Homo sapiens
agggggtgcatttgtgaatgaa

SEQ ID NO: 9015534 - DNA, 22 bp, Homo sapiens
agggggtgctacttccagagtt

SEQ ID NO: 9015535 - DNA, 22 bp, Homo sapiens
agggggtgctacttccagagtt

SEQ ID NO: 9015536 - DNA, 22 bp, Homo sapiens
agggggtgctacttccagagtt

SEQ ID NO: 9015537 - DNA, 22 bp, Homo sapiens
agggggtgggaagtctagaatc

SEQ ID NO: 9015538 - DNA, 22 bp, Homo sapiens
agggggtgggaagtctagaatc

SEQ ID NO: 9015539 - DNA, 22 bp, Homo sapiens
agggggtgtctctgattgggtt

SEQ ID NO: 9015540 - DNA, 22 bp, Homo sapiens
agggggtgtctctgattgggtt

SEQ ID NO: 9015541 - DNA, 22 bp, Homo sapiens
agggggtgtctctgattgggtt

SEQ ID NO: 9015542 - DNA, 22 bp, Homo sapiens
agggggtgtctctgattgggtt

SEQ ID NO: 9015543 - DNA, 22 bp, Homo sapiens
aggggtctatcctgagatggtc

SEQ ID NO: 9015544 - DNA, 22 bp, Homo sapiens
aggggtctatcctgagatggtc

SEQ ID NO: 9015545 - DNA, 22 bp, Homo sapiens
aggggtctatcctgagatggtc

SEQ ID NO: 9015546 - DNA, 20 bp, Homo sapiens
aggggtctagcagcagtgct

SEQ ID NO: 9015547 - DNA, 22 bp, Homo sapiens
aggggtcagtgaccattgagga

SEQ ID NO: 9015548 - DNA, 22 bp, Homo sapiens
aggggtagtaggataacaaatt

SEQ ID NO: 9015549 - DNA, 16 bp, Homo sapiens
aggggtacagttcatc

SEQ ID NO: 9015550 - DNA, 22 bp, Homo sapiens
aggggtagagattgctggtgta

SEQ ID NO: 9015551 - DNA, 22 bp, Homo sapiens
aggggtagagattgctggtgta

SEQ ID NO: 9015552 - DNA, 22 bp, Homo sapiens
aggggtagagattgctggtgta

SEQ ID NO: 9015553 - DNA, 22 bp, Homo sapiens
cctgagtctgtgttttcctaag

SEQ ID NO: 9015554 - DNA, 22 bp, Homo sapiens
cctgcagaccacactcagtcct

SEQ ID NO: 9015555 - DNA, 22 bp, Homo sapiens
aggggtgaaggcccgataggag

SEQ ID NO: 9015556 - DNA, 22 bp, Homo sapiens
cctgagtcccctcattcactct

SEQ ID NO: 9015557 - DNA, 22 bp, Homo sapiens
aggggtcttgaggactccagca

SEQ ID NO: 9015558 - DNA, 22 bp, Homo sapiens
aggggtctttaggaacgtcggg

SEQ ID NO: 9015559 - DNA, 22 bp, Homo sapiens
aggggtctttaggaacgtcggg

SEQ ID NO: 9015560 - DNA, 22 bp, Homo sapiens
aggggtcttgggagtcctggct

SEQ ID NO: 9015561 - DNA, 22 bp, Homo sapiens
cctctgtgtcctggtcattgaa

SEQ ID NO: 9015562 - DNA, 20 bp, Homo sapiens
cctctgtgtcctgtgtcata

SEQ ID NO: 9015563 - DNA, 20 bp, Homo sapiens
cctctgtgtcctgtgtcata

SEQ ID NO: 9015564 - DNA, 22 bp, Homo sapiens
cctctgtgtcctggtcattgaa

SEQ ID NO: 9015565 - DNA, 22 bp, Homo sapiens
cctctgtgggccgggcctgctg

SEQ ID NO: 9015566 - DNA, 22 bp, Homo sapiens
cctctgtgtcagggaagagact

SEQ ID NO: 9015567 - DNA, 22 bp, Homo sapiens
cctctgtggtctgtctaatgca

SEQ ID NO: 9015568 - DNA, 22 bp, Homo sapiens
cctctgtgtgatgcgcaaagta

SEQ ID NO: 9015569 - DNA, 22 bp, Homo sapiens
cctctgtgtgatgcgcaaagta

SEQ ID NO: 9015570 - DNA, 22 bp, Homo sapiens
cctctgtgtctccaagaggcct

SEQ ID NO: 9015571 - DNA, 22 bp, Homo sapiens
cctctgtgtctccaagaggcct

SEQ ID NO: 9015572 - DNA, 22 bp, Homo sapiens
cctctgtgtctccaagaggcct

SEQ ID NO: 9015573 - DNA, 22 bp, Homo sapiens
cctcttaattgtactccttcag

SEQ ID NO: 9015574 - DNA, 22 bp, Homo sapiens
cctctgtgtgtgcatgcatgcg

SEQ ID NO: 9015575 - DNA, 22 bp, Homo sapiens
cctctgtgtgtgcatgcatgcg

SEQ ID NO: 9015576 - DNA, 22 bp, Homo sapiens
cctctgtgtgtgcatgcatgcg

SEQ ID NO: 9015577 - DNA, 22 bp, Homo sapiens
cctctgtgtgtgcatgcatgcg

SEQ ID NO: 9015578 - DNA, 22 bp, Homo sapiens
cctctgtgtgtgcatgcatgcg

SEQ ID NO: 9015579 - DNA, 22 bp, Homo sapiens
agggggtcgtccggaagacctg

SEQ ID NO: 9015580 - DNA, 22 bp, Homo sapiens
agggggtcgtccggaagacctg

SEQ ID NO: 9015581 - DNA, 22 bp, Homo sapiens
agggggctggagacacctcctc

SEQ ID NO: 9015582 - DNA, 22 bp, Homo sapiens
agggggctggagacacctcctc

SEQ ID NO: 9015583 - DNA, 22 bp, Homo sapiens
aggggggtggatcacctgaggt

SEQ ID NO: 9015584 - DNA, 22 bp, Homo sapiens
aggggggtggatcacctgaggt

SEQ ID NO: 9015585 - DNA, 22 bp, Homo sapiens
agggggtgaatgtctgtctaca

SEQ ID NO: 9015586 - DNA, 22 bp, Homo sapiens
agggggtgaatgtctgtctaca

SEQ ID NO: 9015587 - DNA, 22 bp, Homo sapiens
agggggtgatcaaggtgcggcg

SEQ ID NO: 9015588 - DNA, 22 bp, Homo sapiens
agggggtgaatgtctgtctaca

SEQ ID NO: 9015589 - DNA, 22 bp, Homo sapiens
agggggtctcctatcatggaag

SEQ ID NO: 9015590 - DNA, 22 bp, Homo sapiens
agggggtgaatgtctgtctaca

SEQ ID NO: 9015591 - DNA, 22 bp, Homo sapiens
agggggctgccaaggaatgtaa

SEQ ID NO: 9015592 - DNA, 22 bp, Homo sapiens
agggggctgccaaggaatgtaa

SEQ ID NO: 9015593 - DNA, 22 bp, Homo sapiens
agggggctgccaaggaatgtaa

SEQ ID NO: 9015594 - DNA, 22 bp, Homo sapiens
agggggctccttggtgtgcaga

SEQ ID NO: 9015595 - DNA, 22 bp, Homo sapiens
agggggagcttggctactcctg

SEQ ID NO: 9015596 - DNA, 22 bp, Homo sapiens
agggggagacatgtgtgtgttt

SEQ ID NO: 9015597 - DNA, 22 bp, Homo sapiens
agggggagcttggctactcctg

SEQ ID NO: 9015598 - DNA, 22 bp, Homo sapiens
agggggagcttggctactcctg

SEQ ID NO: 9015599 - DNA, 22 bp, Homo sapiens
cctcttcacctcgggcacactg

SEQ ID NO: 9015600 - DNA, 22 bp, Homo sapiens
agggggagacatgtgtgtgttt

SEQ ID NO: 9015601 - DNA, 22 bp, Homo sapiens
cctcttcagcaaagttcggccc

SEQ ID NO: 9015602 - DNA, 17 bp, Homo sapiens
agggggaacctgggagg

SEQ ID NO: 9015603 - DNA, 22 bp, Homo sapiens
cctcttcacctcgggcacactg

SEQ ID NO: 9015604 - DNA, 22 bp, Homo sapiens
cctcttcagcaaagttcggccc

SEQ ID NO: 9015605 - DNA, 22 bp, Homo sapiens
agggctgagaatgacagggccg

SEQ ID NO: 9015606 - DNA, 22 bp, Homo sapiens
agggctgagactaaggccagat

SEQ ID NO: 9015607 - DNA, 22 bp, Homo sapiens
agggctgagactaaggccagat

SEQ ID NO: 9015608 - DNA, 22 bp, Homo sapiens
agggctgacctaagctccactt

SEQ ID NO: 9015609 - DNA, 20 bp, Homo sapiens
agggctgagaagggactagc

SEQ ID NO: 9015610 - DNA, 20 bp, Homo sapiens
agggctgagaagggactagc

SEQ ID NO: 9015611 - DNA, 20 bp, Homo sapiens
agggctgagaagggactagc

SEQ ID NO: 9015612 - DNA, 20 bp, Homo sapiens
agggctgagaagggactagc

SEQ ID NO: 9015613 - DNA, 18 bp, Homo sapiens
cctcagggagatccagtg

SEQ ID NO: 9015614 - DNA, 22 bp, Homo sapiens
cctcagggaggcctctgtggct

SEQ ID NO: 9015615 - DNA, 22 bp, Homo sapiens
cctcagggaggcctctgtggct

SEQ ID NO: 9015616 - DNA, 22 bp, Homo sapiens
cctcagggaggcctctgtggct

SEQ ID NO: 9015617 - DNA, 18 bp, Homo sapiens
cctcagggagatccagtg

SEQ ID NO: 9015618 - DNA, 22 bp, Homo sapiens
agggctgagcccaggcatgtag

SEQ ID NO: 9015619 - DNA, 22 bp, Homo sapiens
agggctgagcccaggcatgtag

SEQ ID NO: 9015620 - DNA, 22 bp, Homo sapiens
agggctgagactaaggccagat

SEQ ID NO: 9015621 - DNA, 22 bp, Homo sapiens
cctacagttatattcttgattg

SEQ ID NO: 9015622 - DNA, 22 bp, Homo sapiens
cctacagttatattcttgattg

SEQ ID NO: 9015623 - DNA, 22 bp, Homo sapiens
cctacagttatattcttgattg

SEQ ID NO: 9015624 - DNA, 22 bp, Homo sapiens
cctacagttatattcttgattg

SEQ ID NO: 9015625 - DNA, 18 bp, Homo sapiens
cctacatcattgtgagag

SEQ ID NO: 9015626 - DNA, 22 bp, Homo sapiens
cctactctgagcgcctccgcat

SEQ ID NO: 9015627 - DNA, 22 bp, Homo sapiens
cctactctgagcgcctccgcat

SEQ ID NO: 9015628 - DNA, 22 bp, Homo sapiens
cctacctggggcaggcctcggg

SEQ ID NO: 9015629 - DNA, 22 bp, Homo sapiens
cctactccctttctagagtatg

SEQ ID NO: 9015630 - DNA, 22 bp, Homo sapiens
cctaccagtaggaggccagaga

SEQ ID NO: 9015631 - DNA, 22 bp, Homo sapiens
cctaccagtaggaggccagaga

SEQ ID NO: 9015632 - DNA, 22 bp, Homo sapiens
cctactctgagcgcctccgcat

SEQ ID NO: 9015633 - DNA, 22 bp, Homo sapiens
cctactctgagcgcctccgcat

SEQ ID NO: 9015634 - DNA, 22 bp, Homo sapiens
cctactctgagcgcctccgcat

SEQ ID NO: 9015635 - DNA, 22 bp, Homo sapiens
cctagaacacaacctatattag

SEQ ID NO: 9015636 - DNA, 22 bp, Homo sapiens
cctagaatgtacttaatagatg

SEQ ID NO: 9015637 - DNA, 22 bp, Homo sapiens
agggctcttcctttgcctctca

SEQ ID NO: 9015638 - DNA, 22 bp, Homo sapiens
agggctcttcctttgcctctca

SEQ ID NO: 9015639 - DNA, 22 bp, Homo sapiens
agggctgacctaagctccactt

SEQ ID NO: 9015640 - DNA, 22 bp, Homo sapiens
agggctgacagtggcgtggcgt

SEQ ID NO: 9015641 - DNA, 22 bp, Homo sapiens
agggctctttaggccgaggcca

SEQ ID NO: 9015642 - DNA, 22 bp, Homo sapiens
cctcaggggtcactgtgaggag

SEQ ID NO: 9015643 - DNA, 22 bp, Homo sapiens
cctcaggggtcactgtgaggag

SEQ ID NO: 9015644 - DNA, 23 bp, Homo sapiens
cctcaggggacctgtgagcctga

SEQ ID NO: 9015645 - DNA, 22 bp, Homo sapiens
cctcaggggcttttcgttgttg

SEQ ID NO: 9015646 - DNA, 22 bp, Homo sapiens
cctcaggggtcactgtgaggag

SEQ ID NO: 9015647 - DNA, 18 bp, Homo sapiens
cctcaggggacctggcag

SEQ ID NO: 9015648 - DNA, 18 bp, Homo sapiens
cctcaggggacctggcag

SEQ ID NO: 9015649 - DNA, 18 bp, Homo sapiens
cctcaggggacctggcag

SEQ ID NO: 9015650 - DNA, 22 bp, Homo sapiens
cctcaggggtgcccacagctgc

SEQ ID NO: 9015651 - DNA, 23 bp, Homo sapiens
cctcagggtctagcagagagaag

SEQ ID NO: 9015652 - DNA, 22 bp, Homo sapiens
cctcagggtctgaggagaccgt

SEQ ID NO: 9015653 - DNA, 22 bp, Homo sapiens
cctcagggtctgaggagaccgt

SEQ ID NO: 9015654 - DNA, 22 bp, Homo sapiens
aggggaaagaacagtcttcagg

SEQ ID NO: 9015655 - DNA, 22 bp, Homo sapiens
aggggaaaatgagttagtgtgt

SEQ ID NO: 9015656 - DNA, 22 bp, Homo sapiens
aggggaaaagtgttgtctctag

SEQ ID NO: 9015657 - DNA, 22 bp, Homo sapiens
agggctttgcaatgcacagtgg

SEQ ID NO: 9015658 - DNA, 22 bp, Homo sapiens
agggctgggctgcttgttgtca

SEQ ID NO: 9015659 - DNA, 22 bp, Homo sapiens
agggctgggctgcttgttgtca

SEQ ID NO: 9015660 - DNA, 22 bp, Homo sapiens
agggctgggctgcttgttgtca

SEQ ID NO: 9015661 - DNA, 22 bp, Homo sapiens
agggctgggctgcttgttgtca

SEQ ID NO: 9015662 - DNA, 22 bp, Homo sapiens
cctcagtctatttccagcaggt

SEQ ID NO: 9015663 - DNA, 22 bp, Homo sapiens
cctcagtctatttccagcaggt

SEQ ID NO: 9015664 - DNA, 22 bp, Homo sapiens
cctcagtctatttccagcaggt

SEQ ID NO: 9015665 - DNA, 22 bp, Homo sapiens
cctcagtcattggcctacactt

SEQ ID NO: 9015666 - DNA, 22 bp, Homo sapiens
cctcagtcattggcctacactt

SEQ ID NO: 9015667 - DNA, 22 bp, Homo sapiens
cctcaggtgtgggccagctgtc

SEQ ID NO: 9015668 - DNA, 22 bp, Homo sapiens
cctcagtcattggcctacactt

SEQ ID NO: 9015669 - DNA, 21 bp, Homo sapiens
agggcctgtgctctccaggtc

SEQ ID NO: 9015670 - DNA, 21 bp, Homo sapiens
agggcctgtgctctccaggtc

SEQ ID NO: 9015671 - DNA, 21 bp, Homo sapiens
agggcctgtgctctccaggtc

SEQ ID NO: 9015672 - DNA, 21 bp, Homo sapiens
agggcctgtgctctccaggtc

SEQ ID NO: 9015673 - DNA, 21 bp, Homo sapiens
agggcctgtgctctccaggtc

SEQ ID NO: 9015674 - DNA, 22 bp, Homo sapiens
agggcctgtctgtagaactgaa

SEQ ID NO: 9015675 - DNA, 22 bp, Homo sapiens
agggcctgtgaattctccctgc

SEQ ID NO: 9015676 - DNA, 22 bp, Homo sapiens
agggcctgtgaattctccctgc

SEQ ID NO: 9015677 - DNA, 22 bp, Homo sapiens
agggcctgtcagcggtgtcctg

SEQ ID NO: 9015678 - DNA, 22 bp, Homo sapiens
agggcctgtcagcggtgtcctg

SEQ ID NO: 9015679 - DNA, 22 bp, Homo sapiens
agggcctgggaagaggaaccct

SEQ ID NO: 9015680 - DNA, 22 bp, Homo sapiens
agggcctgtctgtagaactgaa

SEQ ID NO: 9015681 - DNA, 22 bp, Homo sapiens
agggcctgtctgtagaactgaa

SEQ ID NO: 9015682 - DNA, 22 bp, Homo sapiens
agggcctgtccgctcccgcccg

SEQ ID NO: 9015683 - DNA, 22 bp, Homo sapiens
agggcctgtcagcggtgtcctg

SEQ ID NO: 9015684 - DNA, 22 bp, Homo sapiens
agggcctgtccgctcccgcccg

SEQ ID NO: 9015685 - DNA, 22 bp, Homo sapiens
cctaagtattttcagtgttaac

SEQ ID NO: 9015686 - DNA, 22 bp, Homo sapiens
cctaagtattttcagtgttaac

SEQ ID NO: 9015687 - DNA, 22 bp, Homo sapiens
cctaattatctcccaaagatcc

SEQ ID NO: 9015688 - DNA, 22 bp, Homo sapiens
cctaattatctcccaaagatcc

SEQ ID NO: 9015689 - DNA, 22 bp, Homo sapiens
cctacacatctcacctcacagg

SEQ ID NO: 9015690 - DNA, 22 bp, Homo sapiens
cctaatttgattttaaatagcc

SEQ ID NO: 9015691 - DNA, 21 bp, Homo sapiens
cctacagatggatatatattc

SEQ ID NO: 9015692 - DNA, 22 bp, Homo sapiens
cctacaggaaattgtatcaaaa

SEQ ID NO: 9015693 - DNA, 22 bp, Homo sapiens
cctacagacaaaccagtgacta

SEQ ID NO: 9015694 - DNA, 22 bp, Homo sapiens
cctacagacaaaccagtgacta

SEQ ID NO: 9015695 - DNA, 22 bp, Homo sapiens
cctacagagcagcaggaccaga

SEQ ID NO: 9015696 - DNA, 22 bp, Homo sapiens
cctacagttatattcttgattg

SEQ ID NO: 9015697 - DNA, 22 bp, Homo sapiens
cctacagttatattcttgattg

SEQ ID NO: 9015698 - DNA, 22 bp, Homo sapiens
cctacagttatattcttgattg

SEQ ID NO: 9015699 - DNA, 22 bp, Homo sapiens
agggcctgtgcttcctgagata

SEQ ID NO: 9015700 - DNA, 22 bp, Homo sapiens
cctaaggaccagggcttccagc

SEQ ID NO: 9015701 - DNA, 20 bp, Homo sapiens
agggcctgttgcaagcgttt

SEQ ID NO: 9015702 - DNA, 22 bp, Homo sapiens
cctaagtaagttgactttcaga

SEQ ID NO: 9015703 - DNA, 22 bp, Homo sapiens
agggcctgtgcttcctgagata

SEQ ID NO: 9015704 - DNA, 20 bp, Homo sapiens
agggcctgttgcaagcgttt

SEQ ID NO: 9015705 - DNA, 22 bp, Homo sapiens
agggcctgtgctgagtagacga

SEQ ID NO: 9015706 - DNA, 22 bp, Homo sapiens
agggcctgtgctgagtagacga

SEQ ID NO: 9015707 - DNA, 22 bp, Homo sapiens
agggcctgtgctgagtagacga

SEQ ID NO: 9015708 - DNA, 22 bp, Homo sapiens
agggcctgtgctgagtagacga

SEQ ID NO: 9015709 - DNA, 22 bp, Homo sapiens
agggcctgtgctgagtagacga

SEQ ID NO: 9015710 - DNA, 22 bp, Homo sapiens
agggcctgtgctgagtagacga

SEQ ID NO: 9015711 - DNA, 22 bp, Homo sapiens
agggcctgtgcttcctgagata

SEQ ID NO: 9015712 - DNA, 19 bp, Homo sapiens
ccctggcaggcaagcctgg

SEQ ID NO: 9015713 - DNA, 22 bp, Homo sapiens
ccctggcagcaatcactggtgt

SEQ ID NO: 9015714 - DNA, 19 bp, Homo sapiens
ccctggcaggcaagcctgg

SEQ ID NO: 9015715 - DNA, 22 bp, Homo sapiens
ccctggcagagggggcaggtgc

SEQ ID NO: 9015716 - DNA, 22 bp, Homo sapiens
ccctggcagagggggcaggtgc

SEQ ID NO: 9015717 - DNA, 22 bp, Homo sapiens
ccctggccagggcacagggagg

SEQ ID NO: 9015718 - DNA, 22 bp, Homo sapiens
agggcctggcttcactttctca

SEQ ID NO: 9015719 - DNA, 22 bp, Homo sapiens
ccctggccagggcacagggagg

SEQ ID NO: 9015720 - DNA, 22 bp, Homo sapiens
ccctggccagctcatgtctgag

SEQ ID NO: 9015721 - DNA, 22 bp, Homo sapiens
ccctggccagctcatgtctgag

SEQ ID NO: 9015722 - DNA, 22 bp, Homo sapiens
ccctggcagagggggcaggtgc

SEQ ID NO: 9015723 - DNA, 22 bp, Homo sapiens
ccctggcataaaacttctccag

SEQ ID NO: 9015724 - DNA, 22 bp, Homo sapiens
ccctggcataaaacttctccag

SEQ ID NO: 9015725 - DNA, 22 bp, Homo sapiens
ccctggcatgcatgtccctggc

SEQ ID NO: 9015726 - DNA, 22 bp, Homo sapiens
ccctggcactagcgacggccat

SEQ ID NO: 9015727 - DNA, 22 bp, Homo sapiens
ccctggcactagcgacggccat

SEQ ID NO: 9015728 - DNA, 22 bp, Homo sapiens
ccctggcactagcgacggccat

SEQ ID NO: 9015729 - DNA, 22 bp, Homo sapiens
ccctggcacatgcgctgtgtgg

SEQ ID NO: 9015730 - DNA, 22 bp, Homo sapiens
agggccccagtaagattacatg

SEQ ID NO: 9015731 - DNA, 22 bp, Homo sapiens
agggccccatagtcactgcccg

SEQ ID NO: 9015732 - DNA, 22 bp, Homo sapiens
agggcccatgtgggagcacttg

SEQ ID NO: 9015733 - DNA, 22 bp, Homo sapiens
agggcccagtggagagctgagc

SEQ ID NO: 9015734 - DNA, 22 bp, Homo sapiens
agggcccagtggagagctgagc

SEQ ID NO: 9015735 - DNA, 22 bp, Homo sapiens
agggcccagtggagagctgagc

SEQ ID NO: 9015736 - DNA, 22 bp, Homo sapiens
agggcccatgtcgggcgctctg

SEQ ID NO: 9015737 - DNA, 22 bp, Homo sapiens
agggcccatgtgggagcacttg

SEQ ID NO: 9015738 - DNA, 22 bp, Homo sapiens
agggcccatgtgggagcacttg

SEQ ID NO: 9015739 - DNA, 22 bp, Homo sapiens
agggcccatgtgggagcacttg

SEQ ID NO: 9015740 - DNA, 22 bp, Homo sapiens
agggcccatagatcgtcagctt

SEQ ID NO: 9015741 - DNA, 22 bp, Homo sapiens
agggcccatagatcgtcagctt

SEQ ID NO: 9015742 - DNA, 22 bp, Homo sapiens
agggcccatagatcgtcagctt

SEQ ID NO: 9015743 - DNA, 22 bp, Homo sapiens
agggcccatagatcgtcagctt

SEQ ID NO: 9015744 - DNA, 22 bp, Homo sapiens
cccaataaaattcattttcatt

SEQ ID NO: 9015745 - DNA, 22 bp, Homo sapiens
cccaatggctggatggagggat

SEQ ID NO: 9015746 - DNA, 22 bp, Homo sapiens
cccaataaaattcattttcatt

SEQ ID NO: 9015747 - DNA, 22 bp, Homo sapiens
cccacacaaatcatggggagaa

SEQ ID NO: 9015748 - DNA, 22 bp, Homo sapiens
cccacacacatttatgatagga

SEQ ID NO: 9015749 - DNA, 22 bp, Homo sapiens
cccacacaaatcatggggagaa

SEQ ID NO: 9015750 - DNA, 22 bp, Homo sapiens
cccacacactggctgctgccaa

SEQ ID NO: 9015751 - DNA, 22 bp, Homo sapiens
cccacacacatttatgatagga

SEQ ID NO: 9015752 - DNA, 22 bp, Homo sapiens
cccacacatttttcacttaccg

SEQ ID NO: 9015753 - DNA, 22 bp, Homo sapiens
cccacacatttttcacttaccg

SEQ ID NO: 9015754 - DNA, 20 bp, Homo sapiens
cccacacccttcccacttgg

SEQ ID NO: 9015755 - DNA, 18 bp, Homo sapiens
cccacacagcagtagctc

SEQ ID NO: 9015756 - DNA, 22 bp, Homo sapiens
cccacacatttttcacttaccg

SEQ ID NO: 9015757 - DNA, 22 bp, Homo sapiens
cccacacactggctgctgccaa

SEQ ID NO: 9015758 - DNA, 18 bp, Homo sapiens
cccacacagcagtagctc

SEQ ID NO: 9015759 - DNA, 18 bp, Homo sapiens
cccacacagcagtagctc

SEQ ID NO: 9015760 - DNA, 22 bp, Homo sapiens
ccagtgtctagcagatgacagg

SEQ ID NO: 9015761 - DNA, 22 bp, Homo sapiens
ccagtgtccttcctttccatgg

SEQ ID NO: 9015762 - DNA, 22 bp, Homo sapiens
ccagtgtatttttgggacctgc

SEQ ID NO: 9015763 - DNA, 22 bp, Homo sapiens
ccagtgtcagaaagattatcct

SEQ ID NO: 9015764 - DNA, 22 bp, Homo sapiens
ccagtgtcttcagagtaaatct

SEQ ID NO: 9015765 - DNA, 22 bp, Homo sapiens
ccagtgtgaaaggtcatttatc

SEQ ID NO: 9015766 - DNA, 22 bp, Homo sapiens
ccagtgtgaccatctgttagct

SEQ ID NO: 9015767 - DNA, 22 bp, Homo sapiens
ccagtgtgcaatctctggctta

SEQ ID NO: 9015768 - DNA, 22 bp, Homo sapiens
ccattttattagtgacatttag

SEQ ID NO: 9015769 - DNA, 22 bp, Homo sapiens
ccattttattagtgacatttag

SEQ ID NO: 9015770 - DNA, 22 bp, Homo sapiens
cccaagttgcttgttccaagac

SEQ ID NO: 9015771 - DNA, 22 bp, Homo sapiens
ccattttgtctgacttcttgct

SEQ ID NO: 9015772 - DNA, 22 bp, Homo sapiens
ccagtgtattatttgagaaatt

SEQ ID NO: 9015773 - DNA, 22 bp, Homo sapiens
ccagtgggtaggccatggtgag

SEQ ID NO: 9015774 - DNA, 20 bp, Homo sapiens
ccagtgggaagtgattaggt

SEQ ID NO: 9015775 - DNA, 22 bp, Homo sapiens
aggctgccgcagccaatggttg

SEQ ID NO: 9015776 - DNA, 22 bp, Homo sapiens
ccagtgggagggagctaggcca

SEQ ID NO: 9015777 - DNA, 22 bp, Homo sapiens
ccagtgggtaggccatggtgag

SEQ ID NO: 9015778 - DNA, 22 bp, Homo sapiens
ccagtgggtaggccatggtgag

SEQ ID NO: 9015779 - DNA, 22 bp, Homo sapiens
ccagtgggagggagctaggcca

SEQ ID NO: 9015780 - DNA, 22 bp, Homo sapiens
aggctgccgcagccaatggttg

SEQ ID NO: 9015781 - DNA, 22 bp, Homo sapiens
aggctgccctgccgccagtggg

SEQ ID NO: 9015782 - DNA, 22 bp, Homo sapiens
aggctgccctgccgccagtggg

SEQ ID NO: 9015783 - DNA, 19 bp, Homo sapiens
aggctgcccagtctctgcc

SEQ ID NO: 9015784 - DNA, 22 bp, Homo sapiens
aggctgccctgccgccagtggg

SEQ ID NO: 9015785 - DNA, 19 bp, Homo sapiens
aggctgcccagtctctgcc

SEQ ID NO: 9015786 - DNA, 19 bp, Homo sapiens
aggctgcccagtctctgcc

SEQ ID NO: 9015787 - DNA, 20 bp, Homo sapiens
aggctgccaggtctcacatc

SEQ ID NO: 9015788 - DNA, 20 bp, Homo sapiens
aggctgccaggtctcacatc

SEQ ID NO: 9015789 - DNA, 22 bp, Homo sapiens
aggctgcaggtctgggtcatgt

SEQ ID NO: 9015790 - DNA, 22 bp, Homo sapiens
aggctgcagtgcaggtaggatt

SEQ ID NO: 9015791 - DNA, 22 bp, Homo sapiens
aggctgcagtgcaggtaggatt

SEQ ID NO: 9015792 - DNA, 22 bp, Homo sapiens
aggctgcagaggtgctgccaga

SEQ ID NO: 9015793 - DNA, 22 bp, Homo sapiens
aggctgcagaggtgctgccaga

SEQ ID NO: 9015794 - DNA, 23 bp, Homo sapiens
aggctgcagaagaatagggtcat

SEQ ID NO: 9015795 - DNA, 23 bp, Homo sapiens
aggctgcagaagaatagggtcat

SEQ ID NO: 9015796 - DNA, 22 bp, Homo sapiens
aggctgagtcgggaggatcact

SEQ ID NO: 9015797 - DNA, 22 bp, Homo sapiens
aggctgccagaagccttcagga

SEQ ID NO: 9015798 - DNA, 20 bp, Homo sapiens
aggctgccaggtctcacatc

SEQ ID NO: 9015799 - DNA, 20 bp, Homo sapiens
aggctgccaggtctcacatc

SEQ ID NO: 9015800 - DNA, 22 bp, Homo sapiens
aggctgccagaagccttcagga

SEQ ID NO: 9015801 - DNA, 20 bp, Homo sapiens
aggctgccaggtctcacatc

SEQ ID NO: 9015802 - DNA, 22 bp, Homo sapiens
aggctgccaaagcttctgtctc

SEQ ID NO: 9015803 - DNA, 22 bp, Homo sapiens
aggctgccaaagcttctgtctc

SEQ ID NO: 9015804 - DNA, 22 bp, Homo sapiens
cccacgtcgaacttgctccaga

SEQ ID NO: 9015805 - DNA, 22 bp, Homo sapiens
cccacgtcgaacttgctccaga

SEQ ID NO: 9015806 - DNA, 20 bp, Homo sapiens
cccacacccttcccacttgg

SEQ ID NO: 9015807 - DNA, 22 bp, Homo sapiens
cccacgtcgaacttgctccaga

SEQ ID NO: 9015808 - DNA, 22 bp, Homo sapiens
cccactccctacgacacgctcc

SEQ ID NO: 9015809 - DNA, 22 bp, Homo sapiens
cccactccctacgacacgctcc

SEQ ID NO: 9015810 - DNA, 22 bp, Homo sapiens
cccactccctgcacgcctgccg

SEQ ID NO: 9015811 - DNA, 22 bp, Homo sapiens
cccactccctgcacgcctgccg

SEQ ID NO: 9015812 - DNA, 22 bp, Homo sapiens
cccacctctcagagagccttgc

SEQ ID NO: 9015813 - DNA, 22 bp, Homo sapiens
cccacactctgagaaatgctga

SEQ ID NO: 9015814 - DNA, 22 bp, Homo sapiens
cccaccctgggaagctaggcag

SEQ ID NO: 9015815 - DNA, 22 bp, Homo sapiens
cccaccctgggaagctaggcag

SEQ ID NO: 9015816 - DNA, 22 bp, Homo sapiens
aggctgtgcattttggagggcc

SEQ ID NO: 9015817 - DNA, 22 bp, Homo sapiens
aggctgtgcattttggagggcc

SEQ ID NO: 9015818 - DNA, 22 bp, Homo sapiens
aggctgtgcattttggagggcc

SEQ ID NO: 9015819 - DNA, 22 bp, Homo sapiens
aggctgtgcacagggcacctgc

SEQ ID NO: 9015820 - DNA, 22 bp, Homo sapiens
aggctgtgcacagggcacctgc

SEQ ID NO: 9015821 - DNA, 22 bp, Homo sapiens
aggctgtgactacgcagggaag

SEQ ID NO: 9015822 - DNA, 22 bp, Homo sapiens
aggctgtgactacgcagggaag

SEQ ID NO: 9015823 - DNA, 22 bp, Homo sapiens
aggctgtgactacgcagggaag

SEQ ID NO: 9015824 - DNA, 22 bp, Homo sapiens
aggctgtgactacgcagggaag

SEQ ID NO: 9015825 - DNA, 21 bp, Homo sapiens
aggctgtgacttacactatct

SEQ ID NO: 9015826 - DNA, 22 bp, Homo sapiens
aggctgtgcacagggcacctgc

SEQ ID NO: 9015827 - DNA, 22 bp, Homo sapiens
cccactccctgcacgcctgccg

SEQ ID NO: 9015828 - DNA, 22 bp, Homo sapiens
cccactccctgcacgcctgccg

SEQ ID NO: 9015829 - DNA, 22 bp, Homo sapiens
cccactcctggagctagggctc

SEQ ID NO: 9015830 - DNA, 22 bp, Homo sapiens
cccactcctggagctagggctc

SEQ ID NO: 9015831 - DNA, 22 bp, Homo sapiens
cccactcctggagctagggctc

SEQ ID NO: 9015832 - DNA, 22 bp, Homo sapiens
cccactctggctcccttctagt

SEQ ID NO: 9015833 - DNA, 22 bp, Homo sapiens
cccactctggctcccttctagt

SEQ ID NO: 9015834 - DNA, 22 bp, Homo sapiens
cccactctggctcccttctagt

SEQ ID NO: 9015835 - DNA, 22 bp, Homo sapiens
cccactgagggttaatgcctgc

SEQ ID NO: 9015836 - DNA, 22 bp, Homo sapiens
aggctgtgacagggtcatggag

SEQ ID NO: 9015837 - DNA, 22 bp, Homo sapiens
cccactgctgctctccatggca

SEQ ID NO: 9015838 - DNA, 22 bp, Homo sapiens
aggctgtgacagggtcatggag

SEQ ID NO: 9015839 - DNA, 22 bp, Homo sapiens
aggctgtgacagggtcatggag

SEQ ID NO: 9015840 - DNA, 20 bp, Homo sapiens
cccagaggttgcggcaggag

SEQ ID NO: 9015841 - DNA, 20 bp, Homo sapiens
cccagaggttgcggcaggag

SEQ ID NO: 9015842 - DNA, 20 bp, Homo sapiens
cccagaggttgcggcaggag

SEQ ID NO: 9015843 - DNA, 20 bp, Homo sapiens
cccagaggttgcggcaggag

SEQ ID NO: 9015844 - DNA, 22 bp, Homo sapiens
cccagaggttccttagggacca

SEQ ID NO: 9015845 - DNA, 22 bp, Homo sapiens
cccagaggttccttagggacca

SEQ ID NO: 9015846 - DNA, 22 bp, Homo sapiens
cccagaggttccttagggacca

SEQ ID NO: 9015847 - DNA, 22 bp, Homo sapiens
cccagaggtgcttcagaggtgc

SEQ ID NO: 9015848 - DNA, 22 bp, Homo sapiens
cccagaggttccttagggacca

SEQ ID NO: 9015849 - DNA, 22 bp, Homo sapiens
cccagaggttccttagggacca

SEQ ID NO: 9015850 - DNA, 22 bp, Homo sapiens
aggctgtggtgatgattgggtc

SEQ ID NO: 9015851 - DNA, 22 bp, Homo sapiens
aggctgtggtgctgaaggaggg

SEQ ID NO: 9015852 - DNA, 22 bp, Homo sapiens
aggctgtggggttctgctttca

SEQ ID NO: 9015853 - DNA, 22 bp, Homo sapiens
aggctgtggtgctgaaggaggg

SEQ ID NO: 9015854 - DNA, 22 bp, Homo sapiens
aggctgtggtgctgaaggaggg

SEQ ID NO: 9015855 - DNA, 22 bp, Homo sapiens
aggctgtggtgctgaaggaggg

SEQ ID NO: 9015856 - DNA, 22 bp, Homo sapiens
cccagaggtgacatcccattct

SEQ ID NO: 9015857 - DNA, 22 bp, Homo sapiens
cccagaggtgcttcagaggtgc

SEQ ID NO: 9015858 - DNA, 22 bp, Homo sapiens
cccagaggtgaaggaggtggga

SEQ ID NO: 9015859 - DNA, 22 bp, Homo sapiens
cccagaggtgacatcccattct

SEQ ID NO: 9015860 - DNA, 22 bp, Homo sapiens
aggctgtgggaatggctgcttg

SEQ ID NO: 9015861 - DNA, 22 bp, Homo sapiens
aggctgtgggacagttaggaga

SEQ ID NO: 9015862 - DNA, 22 bp, Homo sapiens
aggctgtgggagttgagagtct

SEQ ID NO: 9015863 - DNA, 22 bp, Homo sapiens
aggctgtgggagttgagagtct

SEQ ID NO: 9015864 - DNA, 22 bp, Homo sapiens
aggctgtgggaatggctgcttg

SEQ ID NO: 9015865 - DNA, 22 bp, Homo sapiens
aggctgtggccctggtctagca

SEQ ID NO: 9015866 - DNA, 22 bp, Homo sapiens
aggctgtggccctggtctagca

SEQ ID NO: 9015867 - DNA, 22 bp, Homo sapiens
aggctgtgggaatggctgcttg

SEQ ID NO: 9015868 - DNA, 22 bp, Homo sapiens
aggctgtgggaatggctgcttg

SEQ ID NO: 9015869 - DNA, 22 bp, Homo sapiens
aggctgtgctcagccaatggga

SEQ ID NO: 9015870 - DNA, 22 bp, Homo sapiens
aggctgtgcgaggtctcagagt

SEQ ID NO: 9015871 - DNA, 22 bp, Homo sapiens
aggctgtgcgaggtctcagagt

SEQ ID NO: 9015872 - DNA, 22 bp, Homo sapiens
aggctgtgcgaggtctcagagt

SEQ ID NO: 9015873 - DNA, 22 bp, Homo sapiens
aggctgtgcgaggtctcagagt

SEQ ID NO: 9015874 - DNA, 22 bp, Homo sapiens
aggctgtggccctggtctagca

SEQ ID NO: 9015875 - DNA, 22 bp, Homo sapiens
aggctgtggccctggtctagca

SEQ ID NO: 9015876 - DNA, 22 bp, Homo sapiens
aggctgtggcatcacatcagga

SEQ ID NO: 9015877 - DNA, 22 bp, Homo sapiens
ccaggtgcaaactcccagcagg

SEQ ID NO: 9015878 - DNA, 22 bp, Homo sapiens
ccaggtgctagcaatcactgtc

SEQ ID NO: 9015879 - DNA, 22 bp, Homo sapiens
ccaggtgcctccagtcacagtg

SEQ ID NO: 9015880 - DNA, 22 bp, Homo sapiens
ccaggtgcctccagtcacagtg

SEQ ID NO: 9015881 - DNA, 16 bp, Homo sapiens
ccaggtggggctgtga

SEQ ID NO: 9015882 - DNA, 22 bp, Homo sapiens
ccagggcagccaacccagatgc

SEQ ID NO: 9015883 - DNA, 22 bp, Homo sapiens
ccagggcagcagaattggggca

SEQ ID NO: 9015884 - DNA, 22 bp, Homo sapiens
ccagggcagcagaattggggca

SEQ ID NO: 9015885 - DNA, 22 bp, Homo sapiens
ccagggcagcagaattggggca

SEQ ID NO: 9015886 - DNA, 22 bp, Homo sapiens
ccagggcagcagaattggggca

SEQ ID NO: 9015887 - DNA, 22 bp, Homo sapiens
ccagggcagaaaaagagggaat

SEQ ID NO: 9015888 - DNA, 22 bp, Homo sapiens
ccagggcagccaacccagatgc

SEQ ID NO: 9015889 - DNA, 22 bp, Homo sapiens
ccagggcagccaacccagatgc

SEQ ID NO: 9015890 - DNA, 22 bp, Homo sapiens
ccagggcagccaacccagatgc

SEQ ID NO: 9015891 - DNA, 22 bp, Homo sapiens
ccagggcagccaacccagatgc

SEQ ID NO: 9015892 - DNA, 22 bp, Homo sapiens
ccagggcagccaacccagatgc

SEQ ID NO: 9015893 - DNA, 22 bp, Homo sapiens
ccagggcagcgcccctccacgc

SEQ ID NO: 9015894 - DNA, 22 bp, Homo sapiens
ccagggcagcgcccctccacgc

SEQ ID NO: 9015895 - DNA, 22 bp, Homo sapiens
ccagggcagaaaaagagggaat

SEQ ID NO: 9015896 - DNA, 22 bp, Homo sapiens
ccagggcagaaaaagagggaat

SEQ ID NO: 9015897 - DNA, 22 bp, Homo sapiens
ccagggcagaaaaagagggaat

SEQ ID NO: 9015898 - DNA, 22 bp, Homo sapiens
ccagggcagcagaattggggca

SEQ ID NO: 9015899 - DNA, 22 bp, Homo sapiens
ccagggcagaaaaagagggaat

SEQ ID NO: 9015900 - DNA, 22 bp, Homo sapiens
ccagggcagaaaaagagggaat

SEQ ID NO: 9015901 - DNA, 22 bp, Homo sapiens
ccagggcacttaggcccagccc

SEQ ID NO: 9015902 - DNA, 22 bp, Homo sapiens
ccagggcacttaggcccagccc

SEQ ID NO: 9015903 - DNA, 22 bp, Homo sapiens
ccagggcacttaggcccagccc

SEQ ID NO: 9015904 - DNA, 22 bp, Homo sapiens
ccagggcacttaggcccagccc

SEQ ID NO: 9015905 - DNA, 22 bp, Homo sapiens
ccagggcacttaggcccagccc

SEQ ID NO: 9015906 - DNA, 22 bp, Homo sapiens
ccagggcacttaggcccagccc

SEQ ID NO: 9015907 - DNA, 22 bp, Homo sapiens
ccagggcacttaggcccagccc

SEQ ID NO: 9015908 - DNA, 22 bp, Homo sapiens
ccagggcacttaggcccagccc

SEQ ID NO: 9015909 - DNA, 22 bp, Homo sapiens
aggctctgtcaggcggagcagc

SEQ ID NO: 9015910 - DNA, 22 bp, Homo sapiens
aggctctgtcaggcggagcagc

SEQ ID NO: 9015911 - DNA, 19 bp, Homo sapiens
aggctctgtaggagagggc

SEQ ID NO: 9015912 - DNA, 20 bp, Homo sapiens
ccaggtggtgcctggagagg

SEQ ID NO: 9015913 - DNA, 18 bp, Homo sapiens
ccaggtggtgacagagat

SEQ ID NO: 9015914 - DNA, 22 bp, Homo sapiens
ccaggtggtgaaagtgggccct

SEQ ID NO: 9015915 - DNA, 20 bp, Homo sapiens
ccaggtggtgcctggagagg

SEQ ID NO: 9015916 - DNA, 22 bp, Homo sapiens
ccaggtggtgcctctgttcgca

SEQ ID NO: 9015917 - DNA, 20 bp, Homo sapiens
ccaggtggtgcctggagagg

SEQ ID NO: 9015918 - DNA, 18 bp, Homo sapiens
ccaggtggtgacagagat

SEQ ID NO: 9015919 - DNA, 22 bp, Homo sapiens
ccagtaaaaagcgacaggaagt

SEQ ID NO: 9015920 - DNA, 22 bp, Homo sapiens
ccagtaaaccaagtgtttacta

SEQ ID NO: 9015921 - DNA, 22 bp, Homo sapiens
ccaggttcaaatagctgtgtga

SEQ ID NO: 9015922 - DNA, 22 bp, Homo sapiens
ccaggttcaaatagctgtgtga

SEQ ID NO: 9015923 - DNA, 22 bp, Homo sapiens
ccagtaacacctcgcagactcc

SEQ ID NO: 9015924 - DNA, 22 bp, Homo sapiens
ccagtacacctcacttcccttt

SEQ ID NO: 9015925 - DNA, 23 bp, Homo sapiens
ccagtaaacccttcctcagtgtc

SEQ ID NO: 9015926 - DNA, 22 bp, Homo sapiens
ccagtaaattacttgatgtcat

SEQ ID NO: 9015927 - DNA, 22 bp, Homo sapiens
ccagtaaattacttgatgtcat

SEQ ID NO: 9015928 - DNA, 22 bp, Homo sapiens
ccagtacttgctacctcaattg

SEQ ID NO: 9015929 - DNA, 18 bp, Homo sapiens
ccagtacctcctcctctc

SEQ ID NO: 9015930 - DNA, 22 bp, Homo sapiens
ccagtacatcgcatggtgacca

SEQ ID NO: 9015931 - DNA, 19 bp, Homo sapiens
ccagtagtatagcacagtc

SEQ ID NO: 9015932 - DNA, 19 bp, Homo sapiens
ccagtagagacagctgcag

SEQ ID NO: 9015933 - DNA, 19 bp, Homo sapiens
ccagtagagacagctgcag

SEQ ID NO: 9015934 - DNA, 22 bp, Homo sapiens
ccagtactttgtgcaacaaatg

SEQ ID NO: 9015935 - DNA, 17 bp, Homo sapiens
ccagtagcctgagatgt

SEQ ID NO: 9015936 - DNA, 17 bp, Homo sapiens
ccagtcacaccaccctt

SEQ ID NO: 9015937 - DNA, 22 bp, Homo sapiens
ccagtcacaggtgtgtttatat

SEQ ID NO: 9015938 - DNA, 22 bp, Homo sapiens
aggctgagtgctcccctagatg

SEQ ID NO: 9015939 - DNA, 22 bp, Homo sapiens
ccagtattgtgaaattgatgtc

SEQ ID NO: 9015940 - DNA, 17 bp, Homo sapiens
ccagtcacaccaccctt

SEQ ID NO: 9015941 - DNA, 21 bp, Homo sapiens
ccagtattatttctctatgta

SEQ ID NO: 9015942 - DNA, 22 bp, Homo sapiens
aggctcagcccctgggaggaga

SEQ ID NO: 9015943 - DNA, 22 bp, Homo sapiens
aggctcagcccctgggaggaga

SEQ ID NO: 9015944 - DNA, 22 bp, Homo sapiens
aggctcagcccctgggaggaga

SEQ ID NO: 9015945 - DNA, 22 bp, Homo sapiens
aggctcagcccctgggaggaga

SEQ ID NO: 9015946 - DNA, 22 bp, Homo sapiens
aggctcagcctgggcctagagc

SEQ ID NO: 9015947 - DNA, 22 bp, Homo sapiens
aggctcagcctgggcctagagc

SEQ ID NO: 9015948 - DNA, 22 bp, Homo sapiens
aggctcagcctgggcctagagc

SEQ ID NO: 9015949 - DNA, 22 bp, Homo sapiens
aggctcagcccctgggaggaga

SEQ ID NO: 9015950 - DNA, 22 bp, Homo sapiens
aggctcagcccaaggtggagag

SEQ ID NO: 9015951 - DNA, 22 bp, Homo sapiens
aggctcagcccaaggtggagag

SEQ ID NO: 9015952 - DNA, 22 bp, Homo sapiens
aggctcagcccaaggtggagag

SEQ ID NO: 9015953 - DNA, 22 bp, Homo sapiens
aggctcagcatctgattcatat

SEQ ID NO: 9015954 - DNA, 22 bp, Homo sapiens
aggctcagcccaaggtggagag

SEQ ID NO: 9015955 - DNA, 22 bp, Homo sapiens
aggctcagcccaaggtggagag

SEQ ID NO: 9015956 - DNA, 22 bp, Homo sapiens
aggctcagcatctgattcatat

SEQ ID NO: 9015957 - DNA, 21 bp, Homo sapiens
aggctcagcaggtgtataaag

SEQ ID NO: 9015958 - DNA, 21 bp, Homo sapiens
aggctcagcaggtgtataaag

SEQ ID NO: 9015959 - DNA, 22 bp, Homo sapiens
aggctctgggaagcagtgagtt

SEQ ID NO: 9015960 - DNA, 22 bp, Homo sapiens
aggctctgggaacagacgggtg

SEQ ID NO: 9015961 - DNA, 22 bp, Homo sapiens
aggctctgcttttctggatata

SEQ ID NO: 9015962 - DNA, 22 bp, Homo sapiens
aggctctgggaacagacgggtg

SEQ ID NO: 9015963 - DNA, 22 bp, Homo sapiens
aggctctgggaagcagtgagtt

SEQ ID NO: 9015964 - DNA, 22 bp, Homo sapiens
aggctctgggaagcagtgagtt

SEQ ID NO: 9015965 - DNA, 22 bp, Homo sapiens
aggctctgggaagcagtgagtt

SEQ ID NO: 9015966 - DNA, 22 bp, Homo sapiens
aggctctgggaagcagtgagtt

SEQ ID NO: 9015967 - DNA, 22 bp, Homo sapiens
aggctctggttggcaagtaaag

SEQ ID NO: 9015968 - DNA, 19 bp, Homo sapiens
aggctctgtaggagagggc

SEQ ID NO: 9015969 - DNA, 22 bp, Homo sapiens
aggctctggttggcaagtaaag

SEQ ID NO: 9015970 - DNA, 22 bp, Homo sapiens
aggctctggttggcaagtaaag

SEQ ID NO: 9015971 - DNA, 22 bp, Homo sapiens
aggctctgggctctagattttg

SEQ ID NO: 9015972 - DNA, 22 bp, Homo sapiens
aggctctgggctctagattttg

SEQ ID NO: 9015973 - DNA, 22 bp, Homo sapiens
aggctctgggctctagattttg

SEQ ID NO: 9015974 - DNA, 22 bp, Homo sapiens
aggctctggtgcagctgtaact

SEQ ID NO: 9015975 - DNA, 22 bp, Homo sapiens
aggctctggtgcagctgtaact

SEQ ID NO: 9015976 - DNA, 22 bp, Homo sapiens
aggctctggttcatcatgatgg

SEQ ID NO: 9015977 - DNA, 22 bp, Homo sapiens
ccaggcctgtgcaaggagggag

SEQ ID NO: 9015978 - DNA, 22 bp, Homo sapiens
ccaggcctgtgcaaggagggag

SEQ ID NO: 9015979 - DNA, 22 bp, Homo sapiens
ccaggcctgtgcaaggagggag

SEQ ID NO: 9015980 - DNA, 22 bp, Homo sapiens
ccaggcctgtgcaaggagggag

SEQ ID NO: 9015981 - DNA, 22 bp, Homo sapiens
ccaggcctgtgttgtgtggagg

SEQ ID NO: 9015982 - DNA, 22 bp, Homo sapiens
ccaggcctgtgcaaggagggag

SEQ ID NO: 9015983 - DNA, 22 bp, Homo sapiens
ccaggccttccagtacgcagaa

SEQ ID NO: 9015984 - DNA, 22 bp, Homo sapiens
ccaggcctgtgttgtgtggagg

SEQ ID NO: 9015985 - DNA, 22 bp, Homo sapiens
ccaggcctgtgttgtgtggagg

SEQ ID NO: 9015986 - DNA, 20 bp, Homo sapiens
ccaggcctgggcctgctcta

SEQ ID NO: 9015987 - DNA, 20 bp, Homo sapiens
ccaggcctgggcctgctcta

SEQ ID NO: 9015988 - DNA, 20 bp, Homo sapiens
ccaggcctgggcctgctcta

SEQ ID NO: 9015989 - DNA, 20 bp, Homo sapiens
ccaggcctgggcctgctcta

SEQ ID NO: 9015990 - DNA, 22 bp, Homo sapiens
ccaggcctcccttttccagcca

SEQ ID NO: 9015991 - DNA, 22 bp, Homo sapiens
ccaggcctcacctgcccaccta

SEQ ID NO: 9015992 - DNA, 22 bp, Homo sapiens
ccaggcctcacctgcccaccta

SEQ ID NO: 9015993 - DNA, 22 bp, Homo sapiens
ccaggcctcccttttccagcca

SEQ ID NO: 9015994 - DNA, 20 bp, Homo sapiens
ccaggcctgggcctgctcta

SEQ ID NO: 9015995 - DNA, 22 bp, Homo sapiens
ccaggccttctgaggacactct

SEQ ID NO: 9015996 - DNA, 22 bp, Homo sapiens
ccaggccttctgaggacactct

SEQ ID NO: 9015997 - DNA, 22 bp, Homo sapiens
ccaggccttccagtacgcagaa

SEQ ID NO: 9015998 - DNA, 22 bp, Homo sapiens
ccaggcctttcttcttggtctg

SEQ ID NO: 9015999 - DNA, 22 bp, Homo sapiens
ccaggccttctgaggacactct

SEQ ID NO: 9016000 - DNA, 22 bp, Homo sapiens
ccaggcctttcttcttggtctg

SEQ ID NO: 9016001 - DNA, 22 bp, Homo sapiens
aggctcagatccttgtgtcctg

SEQ ID NO: 9016002 - DNA, 22 bp, Homo sapiens
ccaggcgtggcttcagcagccc

SEQ ID NO: 9016003 - DNA, 22 bp, Homo sapiens
ccaggcctttcttcttggtctg

SEQ ID NO: 9016004 - DNA, 22 bp, Homo sapiens
ccaggcctttcttcttggtctg

SEQ ID NO: 9016005 - DNA, 22 bp, Homo sapiens
aggctcagattcacatttggtt

SEQ ID NO: 9016006 - DNA, 22 bp, Homo sapiens
aggctcagattcacatttggtt

SEQ ID NO: 9016007 - DNA, 22 bp, Homo sapiens
aggctcagatccttgtgtcctg

SEQ ID NO: 9016008 - DNA, 22 bp, Homo sapiens
aggctcagattcacatttggtt

SEQ ID NO: 9016009 - DNA, 22 bp, Homo sapiens
aggctcagatccttgtgtcctg

SEQ ID NO: 9016010 - DNA, 22 bp, Homo sapiens
aggctcagatccttgtgtcctg

SEQ ID NO: 9016011 - DNA, 22 bp, Homo sapiens
ccagccagtatattccaaagcc

SEQ ID NO: 9016012 - DNA, 22 bp, Homo sapiens
ccagccagtatattccaaagcc

SEQ ID NO: 9016013 - DNA, 22 bp, Homo sapiens
ccagccagtatattccaaagcc

SEQ ID NO: 9016014 - DNA, 22 bp, Homo sapiens
ccagccagggaaactttttctt

SEQ ID NO: 9016015 - DNA, 22 bp, Homo sapiens
ccagccaggctggctgtggagg

SEQ ID NO: 9016016 - DNA, 22 bp, Homo sapiens
ccagccagctggttggacgcct

SEQ ID NO: 9016017 - DNA, 22 bp, Homo sapiens
ccagccaggcattgcaaactga

SEQ ID NO: 9016018 - DNA, 22 bp, Homo sapiens
ccagccaggcattgcaaactga

SEQ ID NO: 9016019 - DNA, 22 bp, Homo sapiens
ccagccaggctggctgtggagg

SEQ ID NO: 9016020 - DNA, 22 bp, Homo sapiens
ccagccaggctggctgtggagg

SEQ ID NO: 9016021 - DNA, 22 bp, Homo sapiens
ccagccagccttgatctgagta

SEQ ID NO: 9016022 - DNA, 22 bp, Homo sapiens
ccagccagccttgatctgagta

SEQ ID NO: 9016023 - DNA, 22 bp, Homo sapiens
ccagccagctgcccttggggcc

SEQ ID NO: 9016024 - DNA, 22 bp, Homo sapiens
ccagccagcaagctcccagttc

SEQ ID NO: 9016025 - DNA, 22 bp, Homo sapiens
ccagccagccttgatctgagta

SEQ ID NO: 9016026 - DNA, 22 bp, Homo sapiens
ccagccagccttgatctgagta

SEQ ID NO: 9016027 - DNA, 22 bp, Homo sapiens
ccagccagctggttggacgcct

SEQ ID NO: 9016028 - DNA, 22 bp, Homo sapiens
ccagccagctggttggacgcct

SEQ ID NO: 9016029 - DNA, 22 bp, Homo sapiens
ccagccagctggttggacgcct

SEQ ID NO: 9016030 - DNA, 22 bp, Homo sapiens
ccagccagctgcccttggggcc

SEQ ID NO: 9016031 - DNA, 22 bp, Homo sapiens
ccagccagctggttggacgcct

SEQ ID NO: 9016032 - DNA, 22 bp, Homo sapiens
ccagccagctggttggacgcct

SEQ ID NO: 9016033 - DNA, 22 bp, Homo sapiens
ccagccagatgataagctctat

SEQ ID NO: 9016034 - DNA, 22 bp, Homo sapiens
ccagccagcaagctcccagttc

SEQ ID NO: 9016035 - DNA, 22 bp, Homo sapiens
ccagccagcaagctcccagttc

SEQ ID NO: 9016036 - DNA, 22 bp, Homo sapiens
ccagccagcaagctcccagttc

SEQ ID NO: 9016037 - DNA, 22 bp, Homo sapiens
ccagccagcaagctcccagttc

SEQ ID NO: 9016038 - DNA, 22 bp, Homo sapiens
ccagcagggaaaaacccaccaa

SEQ ID NO: 9016039 - DNA, 22 bp, Homo sapiens
ccagcagggaaaaacccaccaa

SEQ ID NO: 9016040 - DNA, 22 bp, Homo sapiens
ccagccactgggccactgccag

SEQ ID NO: 9016041 - DNA, 22 bp, Homo sapiens
ccagccactgggccactgccag

SEQ ID NO: 9016042 - DNA, 22 bp, Homo sapiens
ccagccagatgataagctctat

SEQ ID NO: 9016043 - DNA, 22 bp, Homo sapiens
ccagccagatgataagctctat

SEQ ID NO: 9016044 - DNA, 22 bp, Homo sapiens
ccagccagaagtccgggcttct

SEQ ID NO: 9016045 - DNA, 22 bp, Homo sapiens
ccagccagaagtccgggcttct

SEQ ID NO: 9016046 - DNA, 22 bp, Homo sapiens
ccagccagaagtccgggcttct

SEQ ID NO: 9016047 - DNA, 22 bp, Homo sapiens
ccagagtcccttgcagctcagt

SEQ ID NO: 9016048 - DNA, 22 bp, Homo sapiens
ccagagtcccttgcagctcagt

SEQ ID NO: 9016049 - DNA, 22 bp, Homo sapiens
ccagagtcccttgcagctcagt

SEQ ID NO: 9016050 - DNA, 22 bp, Homo sapiens
ccagagtctatgagtcctcatt

SEQ ID NO: 9016051 - DNA, 22 bp, Homo sapiens
ccagagtctatgagtcctcatt

SEQ ID NO: 9016052 - DNA, 22 bp, Homo sapiens
ccagcaggcagtcatatccttt

SEQ ID NO: 9016053 - DNA, 22 bp, Homo sapiens
ccagcagggaaaaacccaccaa

SEQ ID NO: 9016054 - DNA, 22 bp, Homo sapiens
ccagcagggaaaaacccaccaa

SEQ ID NO: 9016055 - DNA, 23 bp, Homo sapiens
ccagccctccaccagctctaggc

SEQ ID NO: 9016056 - DNA, 23 bp, Homo sapiens
ccagccctccaccagctctaggc

SEQ ID NO: 9016057 - DNA, 23 bp, Homo sapiens
ccagccctccaccagctctaggc

SEQ ID NO: 9016058 - DNA, 23 bp, Homo sapiens
ccagccctccaccagctctaggc

SEQ ID NO: 9016059 - DNA, 23 bp, Homo sapiens
ccagccctccaccagctctaggc

SEQ ID NO: 9016060 - DNA, 22 bp, Homo sapiens
ccagccctcctccatcagagga

SEQ ID NO: 9016061 - DNA, 22 bp, Homo sapiens
ccagccctcctccatcagagga

SEQ ID NO: 9016062 - DNA, 22 bp, Homo sapiens
ccagccctcctccatcagagga

SEQ ID NO: 9016063 - DNA, 22 bp, Homo sapiens
ccagccctgaaccctgctgcat

SEQ ID NO: 9016064 - DNA, 22 bp, Homo sapiens
ccagccctgattagagaatgtc

SEQ ID NO: 9016065 - DNA, 22 bp, Homo sapiens
ccagccctgattagagaatgtc

SEQ ID NO: 9016066 - DNA, 22 bp, Homo sapiens
ccagccctgaaccctgctgcat

SEQ ID NO: 9016067 - DNA, 22 bp, Homo sapiens
ccagccctgaaccctgctgcat

SEQ ID NO: 9016068 - DNA, 22 bp, Homo sapiens
ccagccctcggtagtcccatag

SEQ ID NO: 9016069 - DNA, 22 bp, Homo sapiens
ccagccctgaaccctgctgcat

SEQ ID NO: 9016070 - DNA, 22 bp, Homo sapiens
ccagccctgaaccctgctgcat

SEQ ID NO: 9016071 - DNA, 22 bp, Homo sapiens
ccagccctcggtagtcccatag

SEQ ID NO: 9016072 - DNA, 22 bp, Homo sapiens
ccagccctcggtagtcccatag

SEQ ID NO: 9016073 - DNA, 22 bp, Homo sapiens
ccagccctcggtagtcccatag

SEQ ID NO: 9016074 - DNA, 22 bp, Homo sapiens
ccagccctcggtagtcccatag

SEQ ID NO: 9016075 - DNA, 22 bp, Homo sapiens
aggccctgcccagagctcctcg

SEQ ID NO: 9016076 - DNA, 22 bp, Homo sapiens
aggccctgcccagagctcctcg

SEQ ID NO: 9016077 - DNA, 22 bp, Homo sapiens
aggccctgcccagagctcctcg

SEQ ID NO: 9016078 - DNA, 22 bp, Homo sapiens
aggccctgacctgggagatcta

SEQ ID NO: 9016079 - DNA, 22 bp, Homo sapiens
aggccctgacctgggagatcta

SEQ ID NO: 9016080 - DNA, 22 bp, Homo sapiens
aggccctgacctgggagatcta

SEQ ID NO: 9016081 - DNA, 18 bp, Homo sapiens
ccagccctgcagcacctg

SEQ ID NO: 9016082 - DNA, 22 bp, Homo sapiens
aggccctgacctgggagatcta

SEQ ID NO: 9016083 - DNA, 18 bp, Homo sapiens
ccagccctgcagcacctg

SEQ ID NO: 9016084 - DNA, 18 bp, Homo sapiens
ccagccctgcagcacctg

SEQ ID NO: 9016085 - DNA, 18 bp, Homo sapiens
ccagccctgcagcacctg

SEQ ID NO: 9016086 - DNA, 18 bp, Homo sapiens
ccagccctgcagcacctg

SEQ ID NO: 9016087 - DNA, 23 bp, Homo sapiens
aggccctgcctgtccctcttttt

SEQ ID NO: 9016088 - DNA, 22 bp, Homo sapiens
aggccctgcggaaatgatcatt

SEQ ID NO: 9016089 - DNA, 22 bp, Homo sapiens
aggccctgcggaaatgatcatt

SEQ ID NO: 9016090 - DNA, 22 bp, Homo sapiens
aggccctgctgaggcctccctc

SEQ ID NO: 9016091 - DNA, 22 bp, Homo sapiens
aggccctgctgaggcctccctc

SEQ ID NO: 9016092 - DNA, 23 bp, Homo sapiens
aggccctgcctgtccctcttttt

SEQ ID NO: 9016093 - DNA, 23 bp, Homo sapiens
aggccctgcctgtccctcttttt

SEQ ID NO: 9016094 - DNA, 22 bp, Homo sapiens
aggccctgcccagtgccacaag

SEQ ID NO: 9016095 - DNA, 22 bp, Homo sapiens
aggccctgcccagtgccacaag

SEQ ID NO: 9016096 - DNA, 22 bp, Homo sapiens
aggccctgcccagtgccacaag

SEQ ID NO: 9016097 - DNA, 22 bp, Homo sapiens
aggccctgcccagtgccacaag

SEQ ID NO: 9016098 - DNA, 22 bp, Homo sapiens
aggccctgcccagagctcctcg

SEQ ID NO: 9016099 - DNA, 22 bp, Homo sapiens
aggccctgcccagtgccacaag

SEQ ID NO: 9016100 - DNA, 22 bp, Homo sapiens
aggccctgcccagagctcctcg

SEQ ID NO: 9016101 - DNA, 22 bp, Homo sapiens
aggcaggtcccctggaaggcac

SEQ ID NO: 9016102 - DNA, 22 bp, Homo sapiens
aggcaggtcccctggaaggcac

SEQ ID NO: 9016103 - DNA, 22 bp, Homo sapiens
aggcaggtcacatgcttggcga

SEQ ID NO: 9016104 - DNA, 22 bp, Homo sapiens
aggcaggtcacatgcttggcga

SEQ ID NO: 9016105 - DNA, 22 bp, Homo sapiens
aggcaggtcccctggaaggcac

SEQ ID NO: 9016106 - DNA, 22 bp, Homo sapiens
aggcaggtcccctggaaggcac

SEQ ID NO: 9016107 - DNA, 22 bp, Homo sapiens
aggcaggtcccctggaaggcac

SEQ ID NO: 9016108 - DNA, 22 bp, Homo sapiens
aggcaggtcccctggaaggcac

SEQ ID NO: 9016109 - DNA, 22 bp, Homo sapiens
aggcaggtcccctggaaggcac

SEQ ID NO: 9016110 - DNA, 22 bp, Homo sapiens
aggcaggtgagtcaaaacagac

SEQ ID NO: 9016111 - DNA, 22 bp, Homo sapiens
aggcaggtcacatgcttggcga

SEQ ID NO: 9016112 - DNA, 22 bp, Homo sapiens
aggcaggtagaaggatctttat

SEQ ID NO: 9016113 - DNA, 22 bp, Homo sapiens
ccactcccttccggtccagggc

SEQ ID NO: 9016114 - DNA, 22 bp, Homo sapiens
aggcaggtagaaggatctttat

SEQ ID NO: 9016115 - DNA, 20 bp, Homo sapiens
ccactccaggtgattctgat

SEQ ID NO: 9016116 - DNA, 21 bp, Homo sapiens
ccactcatgactccactcacc

SEQ ID NO: 9016117 - DNA, 20 bp, Homo sapiens
ccactccaggtgattctgat

SEQ ID NO: 9016118 - DNA, 22 bp, Homo sapiens
ccactcccttccggtccagggc

SEQ ID NO: 9016119 - DNA, 22 bp, Homo sapiens
ccactcccttccggtccagggc

SEQ ID NO: 9016120 - DNA, 19 bp, Homo sapiens
ccagaggcagcttctgtaa

SEQ ID NO: 9016121 - DNA, 19 bp, Homo sapiens
ccagaggcagcttctgtaa

SEQ ID NO: 9016122 - DNA, 22 bp, Homo sapiens
ccagaggcagacttacactcca

SEQ ID NO: 9016123 - DNA, 22 bp, Homo sapiens
ccagaggatgctggtcagcctc

SEQ ID NO: 9016124 - DNA, 22 bp, Homo sapiens
ccagaggcatgttcaaagcaat

SEQ ID NO: 9016125 - DNA, 22 bp, Homo sapiens
ccagaggcatgttcaaagcaat

SEQ ID NO: 9016126 - DNA, 18 bp, Homo sapiens
ccagaggcccgggcaggc

SEQ ID NO: 9016127 - DNA, 19 bp, Homo sapiens
ccagaggcagcttctgtaa

SEQ ID NO: 9016128 - DNA, 22 bp, Homo sapiens
ccagaggcatgttcaaagcaat

SEQ ID NO: 9016129 - DNA, 19 bp, Homo sapiens
aggcaggtgcagaggtccc

SEQ ID NO: 9016130 - DNA, 20 bp, Homo sapiens
ccagagctgatggctgcccg

SEQ ID NO: 9016131 - DNA, 20 bp, Homo sapiens
ccagagctgatggctgcccg

SEQ ID NO: 9016132 - DNA, 22 bp, Homo sapiens
ccagaggatgctggtcagcctc

SEQ ID NO: 9016133 - DNA, 22 bp, Homo sapiens
ccagaggatgctggtcagcctc

SEQ ID NO: 9016134 - DNA, 22 bp, Homo sapiens
ccagaggatgctggtcagcctc

SEQ ID NO: 9016135 - DNA, 20 bp, Homo sapiens
ccagagctgatggctgcccg

SEQ ID NO: 9016136 - DNA, 20 bp, Homo sapiens
ccagagctgatggctgcccg

SEQ ID NO: 9016137 - DNA, 18 bp, Homo sapiens
ccagaggcccgggcaggc

SEQ ID NO: 9016138 - DNA, 18 bp, Homo sapiens
ccagaggcccgggcaggc

SEQ ID NO: 9016139 - DNA, 18 bp, Homo sapiens
ccagaggcccgggcaggc

SEQ ID NO: 9016140 - DNA, 18 bp, Homo sapiens
ccagaggcccgggcaggc

SEQ ID NO: 9016141 - DNA, 21 bp, Homo sapiens
ccagaggcctctcttggccac

SEQ ID NO: 9016142 - DNA, 21 bp, Homo sapiens
ccagaggcctctcttggccac

SEQ ID NO: 9016143 - DNA, 21 bp, Homo sapiens
ccagaggcctctcttggccac

SEQ ID NO: 9016144 - DNA, 16 bp, Homo sapiens
ccagaggcctggcctc

SEQ ID NO: 9016145 - DNA, 16 bp, Homo sapiens
ccagaggcctggcctc

SEQ ID NO: 9016146 - DNA, 22 bp, Homo sapiens
ccagaggcggaggtttgcagtg

SEQ ID NO: 9016147 - DNA, 22 bp, Homo sapiens
ccagaggcggaggtttgcagtg

SEQ ID NO: 9016148 - DNA, 22 bp, Homo sapiens
ccagaggcggaggtttgcagtg

SEQ ID NO: 9016149 - DNA, 21 bp, Homo sapiens
ccagaggcctctcttggccac

SEQ ID NO: 9016150 - DNA, 21 bp, Homo sapiens
ccagaggcctctcttggccac

SEQ ID NO: 9016151 - DNA, 22 bp, Homo sapiens
ccagaggtgggagtgatctggt

SEQ ID NO: 9016152 - DNA, 22 bp, Homo sapiens
ccagaggtggaagattgttttg

SEQ ID NO: 9016153 - DNA, 22 bp, Homo sapiens
ccagaggtggaagattgttttg

SEQ ID NO: 9016154 - DNA, 22 bp, Homo sapiens
ccagaggctggcaagggctcct

SEQ ID NO: 9016155 - DNA, 22 bp, Homo sapiens
ccagaggtgctgggagaggtct

SEQ ID NO: 9016156 - DNA, 22 bp, Homo sapiens
ccagaggctggcaagggctcct

SEQ ID NO: 9016157 - DNA, 22 bp, Homo sapiens
ccagaggctggcaagggctcct

SEQ ID NO: 9016158 - DNA, 22 bp, Homo sapiens
ccagaggctggcaagggctcct

SEQ ID NO: 9016159 - DNA, 20 bp, Homo sapiens
ccagaggctgacagactttg

SEQ ID NO: 9016160 - DNA, 20 bp, Homo sapiens
ccagaggctgacagactttg

SEQ ID NO: 9016161 - DNA, 20 bp, Homo sapiens
ccagaggctgacagactttg

SEQ ID NO: 9016162 - DNA, 20 bp, Homo sapiens
ccagaggctgacagactttg

SEQ ID NO: 9016163 - DNA, 22 bp, Homo sapiens
ccagaggcggaggtttgcagtg

SEQ ID NO: 9016164 - DNA, 22 bp, Homo sapiens
ccagaggttactttgccttgga

SEQ ID NO: 9016165 - DNA, 22 bp, Homo sapiens
ccagaggttactttgccttgga

SEQ ID NO: 9016166 - DNA, 22 bp, Homo sapiens
ccagaggttacaccctcagccc

SEQ ID NO: 9016167 - DNA, 22 bp, Homo sapiens
ccagaggttacaccctcagccc

SEQ ID NO: 9016168 - DNA, 22 bp, Homo sapiens
ccagaggtggtggtgtctagaa

SEQ ID NO: 9016169 - DNA, 22 bp, Homo sapiens
ccagaggtggtggtgtctagaa

SEQ ID NO: 9016170 - DNA, 22 bp, Homo sapiens
ccagaggtggtgggtgctacag

SEQ ID NO: 9016171 - DNA, 22 bp, Homo sapiens
ccagaggtggtcatagaaagca

SEQ ID NO: 9016172 - DNA, 22 bp, Homo sapiens
ccagaggtggtcatagaaagca

SEQ ID NO: 9016173 - DNA, 22 bp, Homo sapiens
ccagaggtgggagtgatctggt

SEQ ID NO: 9016174 - DNA, 22 bp, Homo sapiens
ccagaggtggtggtgtctagaa

SEQ ID NO: 9016175 - DNA, 22 bp, Homo sapiens
ccagaggtggtgggtgctacag

SEQ ID NO: 9016176 - DNA, 22 bp, Homo sapiens
ccagaggtggtgggtgctacag

SEQ ID NO: 9016177 - DNA, 19 bp, Homo sapiens
ccagagtcatgtctccccc

SEQ ID NO: 9016178 - DNA, 22 bp, Homo sapiens
ccagagtcaggagctcatgtga

SEQ ID NO: 9016179 - DNA, 22 bp, Homo sapiens
ccagagtcaggagctcatgtga

SEQ ID NO: 9016180 - DNA, 19 bp, Homo sapiens
ccagaggtttgctgggcct

SEQ ID NO: 9016181 - DNA, 19 bp, Homo sapiens
ccagaggtttgctgggcct

SEQ ID NO: 9016182 - DNA, 19 bp, Homo sapiens
ccagaggtttgctgggcct

SEQ ID NO: 9016183 - DNA, 19 bp, Homo sapiens
ccagaggtttgctgggcct

SEQ ID NO: 9016184 - DNA, 21 bp, Homo sapiens
ccagaggttctgggcctccct

SEQ ID NO: 9016185 - DNA, 21 bp, Homo sapiens
ccagaggttctgggcctccct

SEQ ID NO: 9016186 - DNA, 22 bp, Homo sapiens
ccagaggttccaggctagggag

SEQ ID NO: 9016187 - DNA, 21 bp, Homo sapiens
ccagaggttctgggcctccct

SEQ ID NO: 9016188 - DNA, 22 bp, Homo sapiens
ccagaggttccaggctagggag

SEQ ID NO: 9016189 - DNA, 22 bp, Homo sapiens
ccagaggttccaggctagggag

SEQ ID NO: 9016190 - DNA, 22 bp, Homo sapiens
ccagaggttccaggctagggag

SEQ ID NO: 9016191 - DNA, 23 bp, Homo sapiens
ccagctcccaggtctgaggactg

SEQ ID NO: 9016192 - DNA, 23 bp, Homo sapiens
ccagctcccaggtctgaggactg

SEQ ID NO: 9016193 - DNA, 22 bp, Homo sapiens
ccagctcccgcaggctgcacag

SEQ ID NO: 9016194 - DNA, 22 bp, Homo sapiens
ccagctcccgcaggctgcacag

SEQ ID NO: 9016195 - DNA, 22 bp, Homo sapiens
ccagctcccctcagcaggtaat

SEQ ID NO: 9016196 - DNA, 22 bp, Homo sapiens
ccagctcccctcagcaggtaat

SEQ ID NO: 9016197 - DNA, 22 bp, Homo sapiens
ccagctcccgcaggctgcacag

SEQ ID NO: 9016198 - DNA, 22 bp, Homo sapiens
ccagctcccgcaggctgcacag

SEQ ID NO: 9016199 - DNA, 22 bp, Homo sapiens
ccagctcccgcaggctgcacag

SEQ ID NO: 9016200 - DNA, 22 bp, Homo sapiens
ccagctccctgaagcctggtct

SEQ ID NO: 9016201 - DNA, 22 bp, Homo sapiens
ccagctccctgaagcctggtct

SEQ ID NO: 9016202 - DNA, 22 bp, Homo sapiens
ccagctcccgcaggctgcacag

SEQ ID NO: 9016203 - DNA, 22 bp, Homo sapiens
ccagctccctgaagcctggtct

SEQ ID NO: 9016204 - DNA, 22 bp, Homo sapiens
ccagctccctgaagcctggtct

SEQ ID NO: 9016205 - DNA, 22 bp, Homo sapiens
ccagctccctgaagcctggtct

SEQ ID NO: 9016206 - DNA, 22 bp, Homo sapiens
ccagctccctgaagcctggtct

SEQ ID NO: 9016207 - DNA, 22 bp, Homo sapiens
ccagctccgggagttgctgctg

SEQ ID NO: 9016208 - DNA, 22 bp, Homo sapiens
ccagctccgggagttgctgctg

SEQ ID NO: 9016209 - DNA, 22 bp, Homo sapiens
ccagctccctgaagcctggtct

SEQ ID NO: 9016210 - DNA, 22 bp, Homo sapiens
aggccctgctttccagagctca

SEQ ID NO: 9016211 - DNA, 22 bp, Homo sapiens
aggccctggacactcaagccgg

SEQ ID NO: 9016212 - DNA, 22 bp, Homo sapiens
aggccctggacactcaagccgg

SEQ ID NO: 9016213 - DNA, 22 bp, Homo sapiens
aggccctgctgaggcctccctc

SEQ ID NO: 9016214 - DNA, 22 bp, Homo sapiens
aggccctgctgaggcctccctc

SEQ ID NO: 9016215 - DNA, 22 bp, Homo sapiens
aggccctgctttccagagctca

SEQ ID NO: 9016216 - DNA, 22 bp, Homo sapiens
aggccctgctttccagagctca

SEQ ID NO: 9016217 - DNA, 22 bp, Homo sapiens
aggccctgctttccagagctca

SEQ ID NO: 9016218 - DNA, 22 bp, Homo sapiens
aggccctgctttccagagctca

SEQ ID NO: 9016219 - DNA, 22 bp, Homo sapiens
ccagctccattgcttagtgtaa

SEQ ID NO: 9016220 - DNA, 22 bp, Homo sapiens
ccagctccaggtagatgggcag

SEQ ID NO: 9016221 - DNA, 22 bp, Homo sapiens
ccagctccaggtagatgggcag

SEQ ID NO: 9016222 - DNA, 22 bp, Homo sapiens
ccagctccaggtagatgggcag

SEQ ID NO: 9016223 - DNA, 21 bp, Homo sapiens
aggccctggaggtcagagaaa

SEQ ID NO: 9016224 - DNA, 21 bp, Homo sapiens
aggccctggaggtcagagaaa

SEQ ID NO: 9016225 - DNA, 22 bp, Homo sapiens
ccagctccaggactgggagctg

SEQ ID NO: 9016226 - DNA, 22 bp, Homo sapiens
ccaggaggtgctggaagaaagc

SEQ ID NO: 9016227 - DNA, 22 bp, Homo sapiens
ccaggaggtgctggaagaaagc

SEQ ID NO: 9016228 - DNA, 22 bp, Homo sapiens
ccaggaggtggagattgcagtg

SEQ ID NO: 9016229 - DNA, 22 bp, Homo sapiens
ccaggaggtggagattgcagtg

SEQ ID NO: 9016230 - DNA, 22 bp, Homo sapiens
ccaggaggtggagattgcagtg

SEQ ID NO: 9016231 - DNA, 22 bp, Homo sapiens
ccaggaggtggaggttgcggtg

SEQ ID NO: 9016232 - DNA, 22 bp, Homo sapiens
ccaggaggtggaggttgcggtg

SEQ ID NO: 9016233 - DNA, 22 bp, Homo sapiens
ccaggaggtggaggttgcggtg

SEQ ID NO: 9016234 - DNA, 22 bp, Homo sapiens
ccaggaggtggagattgcagtg

SEQ ID NO: 9016235 - DNA, 22 bp, Homo sapiens
ccaggaggtggagattgcagtg

SEQ ID NO: 9016236 - DNA, 22 bp, Homo sapiens
ccaggaggtggagattgcagtg

SEQ ID NO: 9016237 - DNA, 22 bp, Homo sapiens
ccaggaggtggagattgcagtg

SEQ ID NO: 9016238 - DNA, 22 bp, Homo sapiens
aggcctgggacgggagccgtga

SEQ ID NO: 9016239 - DNA, 22 bp, Homo sapiens
aggcctgggcaagaaggggcgt

SEQ ID NO: 9016240 - DNA, 22 bp, Homo sapiens
ccaggaggttgaggctgcagtg

SEQ ID NO: 9016241 - DNA, 22 bp, Homo sapiens
ccaggaggtggcaggacttgcc

SEQ ID NO: 9016242 - DNA, 22 bp, Homo sapiens
ccaggaggtggcaggacttgcc

SEQ ID NO: 9016243 - DNA, 22 bp, Homo sapiens
ccaggaggtggcaggacttgcc

SEQ ID NO: 9016244 - DNA, 22 bp, Homo sapiens
ccaggaggtggcaggacttgcc

SEQ ID NO: 9016245 - DNA, 22 bp, Homo sapiens
ccaggaggtggcaggacttgcc

SEQ ID NO: 9016246 - DNA, 22 bp, Homo sapiens
ccaggaggtggcaggacttgcc

SEQ ID NO: 9016247 - DNA, 22 bp, Homo sapiens
ccaggaggtggcaggacttgcc

SEQ ID NO: 9016248 - DNA, 22 bp, Homo sapiens
ccaggagggaggagttcctgag

SEQ ID NO: 9016249 - DNA, 22 bp, Homo sapiens
ccaggagggaggagttcctgag

SEQ ID NO: 9016250 - DNA, 22 bp, Homo sapiens
ccaggagggaggagttcctgag

SEQ ID NO: 9016251 - DNA, 22 bp, Homo sapiens
ccaggaggggtctctgtctccc

SEQ ID NO: 9016252 - DNA, 22 bp, Homo sapiens
ccaggagggaggagttcctgag

SEQ ID NO: 9016253 - DNA, 22 bp, Homo sapiens
ccaggaggggtctctgtctccc

SEQ ID NO: 9016254 - DNA, 22 bp, Homo sapiens
ccaggaggatgaggggcataga

SEQ ID NO: 9016255 - DNA, 22 bp, Homo sapiens
ccaggaggatgaggggcataga

SEQ ID NO: 9016256 - DNA, 22 bp, Homo sapiens
ccaggaggatgaggggcataga

SEQ ID NO: 9016257 - DNA, 22 bp, Homo sapiens
ccaggaggatgaggggcataga

SEQ ID NO: 9016258 - DNA, 22 bp, Homo sapiens
ccaggaggatcatcctgttttc

SEQ ID NO: 9016259 - DNA, 22 bp, Homo sapiens
ccaggaggatcatcctgttttc

SEQ ID NO: 9016260 - DNA, 22 bp, Homo sapiens
ccagctccgggagttgctgctg

SEQ ID NO: 9016261 - DNA, 22 bp, Homo sapiens
ccaggagggtggttactcaatc

SEQ ID NO: 9016262 - DNA, 22 bp, Homo sapiens
ccaggagggtggttactcaatc

SEQ ID NO: 9016263 - DNA, 22 bp, Homo sapiens
ccaggagggtggttactcaatc

SEQ ID NO: 9016264 - DNA, 22 bp, Homo sapiens
ccaggagggtggttactcaatc

SEQ ID NO: 9016265 - DNA, 22 bp, Homo sapiens
ccaggaggtctgagtgtggaca

SEQ ID NO: 9016266 - DNA, 22 bp, Homo sapiens
ccaggaggggtctctgtctccc

SEQ ID NO: 9016267 - DNA, 22 bp, Homo sapiens
ccaggaggggtctctgtctccc

SEQ ID NO: 9016268 - DNA, 22 bp, Homo sapiens
ccaggaggtgaaacttcaccag

SEQ ID NO: 9016269 - DNA, 22 bp, Homo sapiens
ccaggaggtgaaacttcaccag

SEQ ID NO: 9016270 - DNA, 22 bp, Homo sapiens
ccaggaggtctgagtgtggaca

SEQ ID NO: 9016271 - DNA, 22 bp, Homo sapiens
ccaggaggtctgagtgtggaca

SEQ ID NO: 9016272 - DNA, 22 bp, Homo sapiens
ccaggaggtctgagtgtggaca

SEQ ID NO: 9016273 - DNA, 22 bp, Homo sapiens
ccaggaggtctgagtgtggaca

SEQ ID NO: 9016274 - DNA, 22 bp, Homo sapiens
ccaggaggtctgagtgtggaca

SEQ ID NO: 9016275 - DNA, 22 bp, Homo sapiens
aggcctgggtctcgtgcctacc

SEQ ID NO: 9016276 - DNA, 22 bp, Homo sapiens
aggcctgggtctcgtgcctacc

SEQ ID NO: 9016277 - DNA, 22 bp, Homo sapiens
aggcctgggtctcgtgcctacc

SEQ ID NO: 9016278 - DNA, 19 bp, Homo sapiens
aggcctggggttttgcact

SEQ ID NO: 9016279 - DNA, 22 bp, Homo sapiens
aggcctgggtctcgtgcctacc

SEQ ID NO: 9016280 - DNA, 19 bp, Homo sapiens
aggcctggggttttgcact

SEQ ID NO: 9016281 - DNA, 19 bp, Homo sapiens
aggcctggggttttgcact

SEQ ID NO: 9016282 - DNA, 22 bp, Homo sapiens
aggcctgggcaagaaggggcgt

SEQ ID NO: 9016283 - DNA, 22 bp, Homo sapiens
aggcctgggcaagaaggggcgt

SEQ ID NO: 9016284 - DNA, 22 bp, Homo sapiens
aggcctgggcaagaaggggcgt

SEQ ID NO: 9016285 - DNA, 22 bp, Homo sapiens
aggcctgggcaagaaggggcgt

SEQ ID NO: 9016286 - DNA, 22 bp, Homo sapiens
aggcctggtgaatgaagtatct

SEQ ID NO: 9016287 - DNA, 22 bp, Homo sapiens
aggcctggtgaatgaagtatct

SEQ ID NO: 9016288 - DNA, 22 bp, Homo sapiens
aggcctggtgtgccggatgcag

SEQ ID NO: 9016289 - DNA, 22 bp, Homo sapiens
aggcctggtgaatgaagtatct

SEQ ID NO: 9016290 - DNA, 22 bp, Homo sapiens
aggcctgggtgttcaccagaag

SEQ ID NO: 9016291 - DNA, 22 bp, Homo sapiens
aggcctggtgaatgaagtatct

SEQ ID NO: 9016292 - DNA, 22 bp, Homo sapiens
aggcctggtgaatgaagtatct

SEQ ID NO: 9016293 - DNA, 22 bp, Homo sapiens
aggcctgggtgttcaccagaag

SEQ ID NO: 9016294 - DNA, 22 bp, Homo sapiens
aggcctgggtgttcaccagaag

SEQ ID NO: 9016295 - DNA, 22 bp, Homo sapiens
aggcctgggtgttcaccagaag

SEQ ID NO: 9016296 - DNA, 22 bp, Homo sapiens
aggcctgggtctcgtgcctacc

SEQ ID NO: 9016297 - DNA, 22 bp, Homo sapiens
aggcctgggtctcgtgcctacc

SEQ ID NO: 9016298 - DNA, 22 bp, Homo sapiens
aggctcagagatgagtaagcac

SEQ ID NO: 9016299 - DNA, 22 bp, Homo sapiens
aggctcagagatgagtaagcac

SEQ ID NO: 9016300 - DNA, 22 bp, Homo sapiens
aggctcagagatgagtaagcac

SEQ ID NO: 9016301 - DNA, 22 bp, Homo sapiens
aggctcagagatgagtaagcac

SEQ ID NO: 9016302 - DNA, 22 bp, Homo sapiens
aggctcagagatgagtaagcac

SEQ ID NO: 9016303 - DNA, 21 bp, Homo sapiens
aggctcagagatcaaacagta

SEQ ID NO: 9016304 - DNA, 21 bp, Homo sapiens
aggctcagagatcaaacagta

SEQ ID NO: 9016305 - DNA, 21 bp, Homo sapiens
aggctcagagatcaaacagta

SEQ ID NO: 9016306 - DNA, 21 bp, Homo sapiens
aggctcagagatcaaacagta

SEQ ID NO: 9016307 - DNA, 22 bp, Homo sapiens
aggctcagagagctgtgtccat

SEQ ID NO: 9016308 - DNA, 22 bp, Homo sapiens
aggctcagagagctgtgtccat

SEQ ID NO: 9016309 - DNA, 21 bp, Homo sapiens
aggctcagagatcaaacagta

SEQ ID NO: 9016310 - DNA, 22 bp, Homo sapiens
aggctagaggcttctggcttca

SEQ ID NO: 9016311 - DNA, 22 bp, Homo sapiens
aggctagaggcttctggcttca

SEQ ID NO: 9016312 - DNA, 22 bp, Homo sapiens
aggctagaggcttctggcttca

SEQ ID NO: 9016313 - DNA, 22 bp, Homo sapiens
aggcctggtgaatgaagtatct

SEQ ID NO: 9016314 - DNA, 22 bp, Homo sapiens
aggcctggtgtgccggatgcag

SEQ ID NO: 9016315 - DNA, 22 bp, Homo sapiens
aggcctggtgtgccggatgcag

SEQ ID NO: 9016316 - DNA, 22 bp, Homo sapiens
aggctcagagagctgtgtccat

SEQ ID NO: 9016317 - DNA, 22 bp, Homo sapiens
aggctcagagagctgtgtccat

SEQ ID NO: 9016318 - DNA, 21 bp, Homo sapiens
aggctcagagagaaactcttg

SEQ ID NO: 9016319 - DNA, 21 bp, Homo sapiens
aggctcagagagaaactcttg

SEQ ID NO: 9016320 - DNA, 22 bp, Homo sapiens
aggctcagaggtgagcatctgc

SEQ ID NO: 9016321 - DNA, 22 bp, Homo sapiens
aggctcagaggtgagcatctgc

SEQ ID NO: 9016322 - DNA, 22 bp, Homo sapiens
aggctcagaggtgagcatctgc

SEQ ID NO: 9016323 - DNA, 20 bp, Homo sapiens
aggctcagatacccagggaa

SEQ ID NO: 9016324 - DNA, 20 bp, Homo sapiens
aggctcagatacccagggaa

SEQ ID NO: 9016325 - DNA, 22 bp, Homo sapiens
ccaggcacaggtgggcctcaga

SEQ ID NO: 9016326 - DNA, 22 bp, Homo sapiens
ccaggcacaggtgggcctcaga

SEQ ID NO: 9016327 - DNA, 22 bp, Homo sapiens
ccaggcacaggtgggcctcaga

SEQ ID NO: 9016328 - DNA, 22 bp, Homo sapiens
ccaggcaccaaagtatgcttta

SEQ ID NO: 9016329 - DNA, 22 bp, Homo sapiens
ccaggcacaggtgggcctcaga

SEQ ID NO: 9016330 - DNA, 20 bp, Homo sapiens
aggctcagatacccagggaa

SEQ ID NO: 9016331 - DNA, 20 bp, Homo sapiens
aggctcagatacccagggaa

SEQ ID NO: 9016332 - DNA, 22 bp, Homo sapiens
ccaggcacaggtgggcctcaga

SEQ ID NO: 9016333 - DNA, 22 bp, Homo sapiens
ccaggcacaggtgggcctcaga

SEQ ID NO: 9016334 - DNA, 20 bp, Homo sapiens
aggctcagagcagtagtaca

SEQ ID NO: 9016335 - DNA, 20 bp, Homo sapiens
aggctcagagcagtagtaca

SEQ ID NO: 9016336 - DNA, 16 bp, Homo sapiens
aggctcagaggctgga

SEQ ID NO: 9016337 - DNA, 16 bp, Homo sapiens
aggctcagaggctgga

SEQ ID NO: 9016338 - DNA, 20 bp, Homo sapiens
aggctcagagcagtagtaca

SEQ ID NO: 9016339 - DNA, 20 bp, Homo sapiens
aggctcagagcagtagtaca

SEQ ID NO: 9016340 - DNA, 16 bp, Homo sapiens
aggctcagaggctgga

SEQ ID NO: 9016341 - DNA, 16 bp, Homo sapiens
aggctcagaggctgga

SEQ ID NO: 9016342 - DNA, 16 bp, Homo sapiens
aggctcagaggctgga

SEQ ID NO: 9016343 - DNA, 22 bp, Homo sapiens
aggctcagaggtgagcatctgc

SEQ ID NO: 9016344 - DNA, 20 bp, Homo sapiens
ccaggcactgtcccatgcag

SEQ ID NO: 9016345 - DNA, 22 bp, Homo sapiens
ccaggcactggctgggttcttt

SEQ ID NO: 9016346 - DNA, 22 bp, Homo sapiens
ccaggcactggctgggttcttt

SEQ ID NO: 9016347 - DNA, 22 bp, Homo sapiens
ccaggcactcagagactgggac

SEQ ID NO: 9016348 - DNA, 22 bp, Homo sapiens
ccaggcactcagagactgggac

SEQ ID NO: 9016349 - DNA, 22 bp, Homo sapiens
ccaggcactcagagactgggac

SEQ ID NO: 9016350 - DNA, 22 bp, Homo sapiens
ccaggcactgctcgaggtgcta

SEQ ID NO: 9016351 - DNA, 22 bp, Homo sapiens
ccaggcactgctcgaggtgcta

SEQ ID NO: 9016352 - DNA, 18 bp, Homo sapiens
ccaggcacctttaaatat

SEQ ID NO: 9016353 - DNA, 22 bp, Homo sapiens
ccaggcaccatgttcttaggac

SEQ ID NO: 9016354 - DNA, 22 bp, Homo sapiens
ccaggcaccatgttcttaggac

SEQ ID NO: 9016355 - DNA, 22 bp, Homo sapiens
ccaggcaccaaagtatgcttta

SEQ ID NO: 9016356 - DNA, 22 bp, Homo sapiens
ccaggcaccatgttcttaggac

SEQ ID NO: 9016357 - DNA, 22 bp, Homo sapiens
ccaggcactcacggggcactgg

SEQ ID NO: 9016358 - DNA, 22 bp, Homo sapiens
ccaggcacggtggctcatgcct

SEQ ID NO: 9016359 - DNA, 22 bp, Homo sapiens
ccaggcactcacggggcactgg

SEQ ID NO: 9016360 - DNA, 22 bp, Homo sapiens
ccaggcacggtggctcatgcct

SEQ ID NO: 9016361 - DNA, 22 bp, Homo sapiens
ccaggcacggtggctcatgcct

SEQ ID NO: 9016362 - DNA, 22 bp, Homo sapiens
ccaggcacggtggctcatgcct

SEQ ID NO: 9016363 - DNA, 22 bp, Homo sapiens
caggagccagctgtcccaacca

SEQ ID NO: 9016364 - DNA, 22 bp, Homo sapiens
caggagcccagagtcctcagct

SEQ ID NO: 9016365 - DNA, 22 bp, Homo sapiens
caggagtctgttcctcatttgt

SEQ ID NO: 9016366 - DNA, 22 bp, Homo sapiens
caggagtgaaatgaggcccagg

SEQ ID NO: 9016367 - DNA, 22 bp, Homo sapiens
caggagtctgttcctcatttgt

SEQ ID NO: 9016368 - DNA, 22 bp, Homo sapiens
caggatggccccggggctgtgc

SEQ ID NO: 9016369 - DNA, 22 bp, Homo sapiens
caggatggccccggggctgtgc

SEQ ID NO: 9016370 - DNA, 22 bp, Homo sapiens
caggatggccccggggctgtgc

SEQ ID NO: 9016371 - DNA, 22 bp, Homo sapiens
caggatggagggagggctgtta

SEQ ID NO: 9016372 - DNA, 22 bp, Homo sapiens
caggatggagagttgttggttg

SEQ ID NO: 9016373 - DNA, 22 bp, Homo sapiens
caggatggagagttgttggttg

SEQ ID NO: 9016374 - DNA, 22 bp, Homo sapiens
caggatggagggagggctgtta

SEQ ID NO: 9016375 - DNA, 22 bp, Homo sapiens
caggatggagggagggctgtta

SEQ ID NO: 9016376 - DNA, 22 bp, Homo sapiens
caggatggagggagggctgtta

SEQ ID NO: 9016377 - DNA, 22 bp, Homo sapiens
caggagccacattccaccttga

SEQ ID NO: 9016378 - DNA, 22 bp, Homo sapiens
caggagccacattccaccttga

SEQ ID NO: 9016379 - DNA, 22 bp, Homo sapiens
caggagcatgctgatgccagaa

SEQ ID NO: 9016380 - DNA, 22 bp, Homo sapiens
caggagccagaggcggatggag

SEQ ID NO: 9016381 - DNA, 22 bp, Homo sapiens
caggagcatgctgatgccagaa

SEQ ID NO: 9016382 - DNA, 22 bp, Homo sapiens
caggagcatgctgatgccagaa

SEQ ID NO: 9016383 - DNA, 22 bp, Homo sapiens
caggagcaggcccaaggacaca

SEQ ID NO: 9016384 - DNA, 22 bp, Homo sapiens
caggagcaggcccaaggacaca

SEQ ID NO: 9016385 - DNA, 22 bp, Homo sapiens
caggagcaggcccaaggacaca

SEQ ID NO: 9016386 - DNA, 22 bp, Homo sapiens
caggagcaggcccaaggacaca

SEQ ID NO: 9016387 - DNA, 18 bp, Homo sapiens
caggagcaggagttgaac

SEQ ID NO: 9016388 - DNA, 18 bp, Homo sapiens
caggagcaggagttgaac

SEQ ID NO: 9016389 - DNA, 18 bp, Homo sapiens
caggagcaggagttgaac

SEQ ID NO: 9016390 - DNA, 22 bp, Homo sapiens
caggagcagagggtggtcagca

SEQ ID NO: 9016391 - DNA, 22 bp, Homo sapiens
caggagcagagggtggtcagca

SEQ ID NO: 9016392 - DNA, 22 bp, Homo sapiens
caggagcagagggtggtcagca

SEQ ID NO: 9016393 - DNA, 22 bp, Homo sapiens
caggagcagagggtggtcagca

SEQ ID NO: 9016394 - DNA, 22 bp, Homo sapiens
caggagcagagggtggtcagca

SEQ ID NO: 9016395 - DNA, 22 bp, Homo sapiens
caggagcaaggagcagtgggat

SEQ ID NO: 9016396 - DNA, 22 bp, Homo sapiens
caggatgggatgtagtgggccc

SEQ ID NO: 9016397 - DNA, 22 bp, Homo sapiens
caggatgggatgtagtgggccc

SEQ ID NO: 9016398 - DNA, 22 bp, Homo sapiens
caggatgggatgtagtgggccc

SEQ ID NO: 9016399 - DNA, 22 bp, Homo sapiens
caggatgggatgtagtgggccc

SEQ ID NO: 9016400 - DNA, 22 bp, Homo sapiens
caggatggccccggggctgtgc

SEQ ID NO: 9016401 - DNA, 22 bp, Homo sapiens
caggatgggatgtagtgggccc

SEQ ID NO: 9016402 - DNA, 22 bp, Homo sapiens
caggatgggatgtagtgggccc

SEQ ID NO: 9016403 - DNA, 22 bp, Homo sapiens
caggatgggatgtagtgggccc

SEQ ID NO: 9016404 - DNA, 22 bp, Homo sapiens
caggatgggtgtcggccagcac

SEQ ID NO: 9016405 - DNA, 22 bp, Homo sapiens
caggatgggtgtcggccagcac

SEQ ID NO: 9016406 - DNA, 22 bp, Homo sapiens
caggcacaattatttccctttc

SEQ ID NO: 9016407 - DNA, 22 bp, Homo sapiens
caggcacaatgagcgccatctt

SEQ ID NO: 9016408 - DNA, 22 bp, Homo sapiens
caggatggtcagatgcattgtc

SEQ ID NO: 9016409 - DNA, 22 bp, Homo sapiens
caggcacacagcacatggcctg

SEQ ID NO: 9016410 - DNA, 22 bp, Homo sapiens
caggcacacagcacatggcctg

SEQ ID NO: 9016411 - DNA, 22 bp, Homo sapiens
caggcacacagcacatggcctg

SEQ ID NO: 9016412 - DNA, 22 bp, Homo sapiens
caggcacacagcacatggcctg

SEQ ID NO: 9016413 - DNA, 22 bp, Homo sapiens
caggatgggtgtcggccagcac

SEQ ID NO: 9016414 - DNA, 22 bp, Homo sapiens
caggatgggtgtcggccagcac

SEQ ID NO: 9016415 - DNA, 22 bp, Homo sapiens
caggatggtcagatgcattgtc

SEQ ID NO: 9016416 - DNA, 22 bp, Homo sapiens
caggatggtcagatgcattgtc

SEQ ID NO: 9016417 - DNA, 22 bp, Homo sapiens
caggatggtctcgatctcctga

SEQ ID NO: 9016418 - DNA, 22 bp, Homo sapiens
caggcacacatccgtgagagat

SEQ ID NO: 9016419 - DNA, 22 bp, Homo sapiens
caggcacacatccgtgagagat

SEQ ID NO: 9016420 - DNA, 22 bp, Homo sapiens
caggcacacatccgtgagagat

SEQ ID NO: 9016421 - DNA, 22 bp, Homo sapiens
caggcacacatccgtgagagat

SEQ ID NO: 9016422 - DNA, 22 bp, Homo sapiens
caggcacacatccgtgagagat

SEQ ID NO: 9016423 - DNA, 22 bp, Homo sapiens
caggcacacatccgtgagagat

SEQ ID NO: 9016424 - DNA, 22 bp, Homo sapiens
caggcacacaggctccctgggc

SEQ ID NO: 9016425 - DNA, 22 bp, Homo sapiens
caggcacacaggctccctgggc

SEQ ID NO: 9016426 - DNA, 22 bp, Homo sapiens
caggcacacaggctccctgggc

SEQ ID NO: 9016427 - DNA, 22 bp, Homo sapiens
caggcacacaggctccctgggc

SEQ ID NO: 9016428 - DNA, 22 bp, Homo sapiens
caggcacacccactggtgcaga

SEQ ID NO: 9016429 - DNA, 20 bp, Homo sapiens
caggcacactcattcctgct

SEQ ID NO: 9016430 - DNA, 22 bp, Homo sapiens
caggcacacccactggtgcaga

SEQ ID NO: 9016431 - DNA, 22 bp, Homo sapiens
caggcagagtgaggtggtctaa

SEQ ID NO: 9016432 - DNA, 20 bp, Homo sapiens
caggcacactcattcctgct

SEQ ID NO: 9016433 - DNA, 22 bp, Homo sapiens
caggcagagtgaggtggtctaa

SEQ ID NO: 9016434 - DNA, 22 bp, Homo sapiens
cagctgttgcagcactgagaga

SEQ ID NO: 9016435 - DNA, 22 bp, Homo sapiens
cagctgttgcagcactgagaga

SEQ ID NO: 9016436 - DNA, 22 bp, Homo sapiens
cagctgttgatctcttaagcct

SEQ ID NO: 9016437 - DNA, 22 bp, Homo sapiens
cagctgttgactggtacatgaa

SEQ ID NO: 9016438 - DNA, 22 bp, Homo sapiens
cagctgttgactggtacatgaa

SEQ ID NO: 9016439 - DNA, 22 bp, Homo sapiens
cagctgttcttgggacagacag

SEQ ID NO: 9016440 - DNA, 22 bp, Homo sapiens
cagctgttcggggctggcatgt

SEQ ID NO: 9016441 - DNA, 22 bp, Homo sapiens
cagctgttcttgggacagacag

SEQ ID NO: 9016442 - DNA, 22 bp, Homo sapiens
cagctgttcttgggacagacag

SEQ ID NO: 9016443 - DNA, 22 bp, Homo sapiens
caggacctggaatgcttgtgaa

SEQ ID NO: 9016444 - DNA, 22 bp, Homo sapiens
caggactatgttcaacagatag

SEQ ID NO: 9016445 - DNA, 22 bp, Homo sapiens
caggactcttgtcatcatcagt

SEQ ID NO: 9016446 - DNA, 22 bp, Homo sapiens
caggactcacttctcacatccc

SEQ ID NO: 9016447 - DNA, 22 bp, Homo sapiens
caggacctaactcacctgtctc

SEQ ID NO: 9016448 - DNA, 22 bp, Homo sapiens
caggacctgaagacaggcaggt

SEQ ID NO: 9016449 - DNA, 22 bp, Homo sapiens
caggacagctcaacacctcctc

SEQ ID NO: 9016450 - DNA, 22 bp, Homo sapiens
caggaccccatattcactgaac

SEQ ID NO: 9016451 - DNA, 22 bp, Homo sapiens
caggactggctcgcagtgggtg

SEQ ID NO: 9016452 - DNA, 22 bp, Homo sapiens
caggagaaacataattttctgg

SEQ ID NO: 9016453 - DNA, 22 bp, Homo sapiens
caggagaaacataattttctgg

SEQ ID NO: 9016454 - DNA, 22 bp, Homo sapiens
caggagaaacataattttctgg

SEQ ID NO: 9016455 - DNA, 22 bp, Homo sapiens
caggagaaatgtggctgctacc

SEQ ID NO: 9016456 - DNA, 22 bp, Homo sapiens
caggagaaatgtggctgctacc

SEQ ID NO: 9016457 - DNA, 22 bp, Homo sapiens
caggagcaaggagcagtgggat

SEQ ID NO: 9016458 - DNA, 22 bp, Homo sapiens
caggagcaaggagcagtgggat

SEQ ID NO: 9016459 - DNA, 22 bp, Homo sapiens
caggactggaagtctcaagaga

SEQ ID NO: 9016460 - DNA, 22 bp, Homo sapiens
caggactggctcgcagtgggtg

SEQ ID NO: 9016461 - DNA, 22 bp, Homo sapiens
caggactggctcgcagtgggtg

SEQ ID NO: 9016462 - DNA, 22 bp, Homo sapiens
caggactggctcgcagtgggtg

SEQ ID NO: 9016463 - DNA, 22 bp, Homo sapiens
caggactggctcgcagtgggtg

SEQ ID NO: 9016464 - DNA, 22 bp, Homo sapiens
caggactgatgttcctccagcc

SEQ ID NO: 9016465 - DNA, 22 bp, Homo sapiens
caggactgaagggcacagggaa

SEQ ID NO: 9016466 - DNA, 22 bp, Homo sapiens
caggactgaagggcacagggaa

SEQ ID NO: 9016467 - DNA, 22 bp, Homo sapiens
cagctggttgaagaggagctgg

SEQ ID NO: 9016468 - DNA, 22 bp, Homo sapiens
cagctggttatcagagaggcct

SEQ ID NO: 9016469 - DNA, 22 bp, Homo sapiens
cagctggttatcagagaggcct

SEQ ID NO: 9016470 - DNA, 22 bp, Homo sapiens
cagctggtactcagttcttgtc

SEQ ID NO: 9016471 - DNA, 22 bp, Homo sapiens
cagctgggtttagtggggtgtg

SEQ ID NO: 9016472 - DNA, 22 bp, Homo sapiens
cagctgggtttagtggggtgtg

SEQ ID NO: 9016473 - DNA, 22 bp, Homo sapiens
cagctgggtttagtggggtgtg

SEQ ID NO: 9016474 - DNA, 22 bp, Homo sapiens
cagctgggtttagtggggtgtg

SEQ ID NO: 9016475 - DNA, 22 bp, Homo sapiens
cagctgggtttagtggggtgtg

SEQ ID NO: 9016476 - DNA, 22 bp, Homo sapiens
cagctgttactctgagtaaatg

SEQ ID NO: 9016477 - DNA, 22 bp, Homo sapiens
cagctgttactgaagtaaaatg

SEQ ID NO: 9016478 - DNA, 22 bp, Homo sapiens
cagctgttatgaggtgtacatg

SEQ ID NO: 9016479 - DNA, 22 bp, Homo sapiens
cagctgttcacatttccaaaac

SEQ ID NO: 9016480 - DNA, 22 bp, Homo sapiens
cagctgttatgaggtgtacatg

SEQ ID NO: 9016481 - DNA, 22 bp, Homo sapiens
cagctgttcagcaactcgcaga

SEQ ID NO: 9016482 - DNA, 22 bp, Homo sapiens
cagctgttcattgttgccaccc

SEQ ID NO: 9016483 - DNA, 22 bp, Homo sapiens
cagctgttcagcaactcgcaga

SEQ ID NO: 9016484 - DNA, 22 bp, Homo sapiens
cagctgttcattgttgccaccc

SEQ ID NO: 9016485 - DNA, 22 bp, Homo sapiens
cagctgttcctggaaggagacc

SEQ ID NO: 9016486 - DNA, 22 bp, Homo sapiens
cagctgttcctggaaggagacc

SEQ ID NO: 9016487 - DNA, 22 bp, Homo sapiens
cagctgttcctggttggtggga

SEQ ID NO: 9016488 - DNA, 22 bp, Homo sapiens
cagctgtgtatgagagcatgct

SEQ ID NO: 9016489 - DNA, 22 bp, Homo sapiens
cagctgtgtctaattatggctg

SEQ ID NO: 9016490 - DNA, 22 bp, Homo sapiens
cagctgtgtatgagagcatgct

SEQ ID NO: 9016491 - DNA, 22 bp, Homo sapiens
cagctgtgtatgagagcatgct

SEQ ID NO: 9016492 - DNA, 22 bp, Homo sapiens
cagctgtgtctaattatggctg

SEQ ID NO: 9016493 - DNA, 22 bp, Homo sapiens
cagctgtgtctaattatggctg

SEQ ID NO: 9016494 - DNA, 22 bp, Homo sapiens
cagctgttaccaatcttagggc

SEQ ID NO: 9016495 - DNA, 22 bp, Homo sapiens
cagctgtgtctaattatggctg

SEQ ID NO: 9016496 - DNA, 22 bp, Homo sapiens
cagctgtccttcctggtgggcg

SEQ ID NO: 9016497 - DNA, 22 bp, Homo sapiens
cagctgtgtatgagagcatgct

SEQ ID NO: 9016498 - DNA, 21 bp, Homo sapiens
caggctctgctagaggagcct

SEQ ID NO: 9016499 - DNA, 21 bp, Homo sapiens
caggctctgctagaggagcct

SEQ ID NO: 9016500 - DNA, 21 bp, Homo sapiens
caggctctgctagaggagcct

SEQ ID NO: 9016501 - DNA, 22 bp, Homo sapiens
agcttccttggcgctgaggcct

SEQ ID NO: 9016502 - DNA, 22 bp, Homo sapiens
agcttccttggcgctgaggcct

SEQ ID NO: 9016503 - DNA, 22 bp, Homo sapiens
agcttctagcccatccagcagg

SEQ ID NO: 9016504 - DNA, 22 bp, Homo sapiens
agcttctagcccatccagcagg

SEQ ID NO: 9016505 - DNA, 22 bp, Homo sapiens
agcttctcaagtgtttgcgggg

SEQ ID NO: 9016506 - DNA, 22 bp, Homo sapiens
agcttctcagaagagtcctgta

SEQ ID NO: 9016507 - DNA, 22 bp, Homo sapiens
agcttctcagatggactgttag

SEQ ID NO: 9016508 - DNA, 22 bp, Homo sapiens
caggctcttccatcctgctgag

SEQ ID NO: 9016509 - DNA, 22 bp, Homo sapiens
caggctctgctgctacagctgt

SEQ ID NO: 9016510 - DNA, 22 bp, Homo sapiens
caggctctgctgctacagctgt

SEQ ID NO: 9016511 - DNA, 22 bp, Homo sapiens
caggctctgctgctacagctgt

SEQ ID NO: 9016512 - DNA, 22 bp, Homo sapiens
caggctctgctgctacagctgt

SEQ ID NO: 9016513 - DNA, 22 bp, Homo sapiens
caggctctgctgctacagctgt

SEQ ID NO: 9016514 - DNA, 22 bp, Homo sapiens
agcttcctgtcttctgcacaaa

SEQ ID NO: 9016515 - DNA, 21 bp, Homo sapiens
agcttcctgcagtgggaggtc

SEQ ID NO: 9016516 - DNA, 21 bp, Homo sapiens
agcttcctgcagtgggaggtc

SEQ ID NO: 9016517 - DNA, 22 bp, Homo sapiens
agcttcctcacctcagaggtct

SEQ ID NO: 9016518 - DNA, 22 bp, Homo sapiens
agcttcctgttgagagagggag

SEQ ID NO: 9016519 - DNA, 22 bp, Homo sapiens
agcttcctgtcttctgcacaaa

SEQ ID NO: 9016520 - DNA, 22 bp, Homo sapiens
agcttcccaggagaatcaggga

SEQ ID NO: 9016521 - DNA, 22 bp, Homo sapiens
agcttcctcacctcagaggtct

SEQ ID NO: 9016522 - DNA, 22 bp, Homo sapiens
agctgtctgtctcctgaggaga

SEQ ID NO: 9016523 - DNA, 22 bp, Homo sapiens
agctgtctgtgaacacagcatt

SEQ ID NO: 9016524 - DNA, 22 bp, Homo sapiens
agctgtctgtgaacacagcatt

SEQ ID NO: 9016525 - DNA, 22 bp, Homo sapiens
agctgtctggaagttcctcatg

SEQ ID NO: 9016526 - DNA, 22 bp, Homo sapiens
agctgtctgtctcctgaggaga

SEQ ID NO: 9016527 - DNA, 22 bp, Homo sapiens
agctgtctttcattacctcatt

SEQ ID NO: 9016528 - DNA, 22 bp, Homo sapiens
agctgtctttcattacctcatt

SEQ ID NO: 9016529 - DNA, 22 bp, Homo sapiens
agctgtctttctgcctcctgat

SEQ ID NO: 9016530 - DNA, 22 bp, Homo sapiens
agctgtctttctgcctcctgat

SEQ ID NO: 9016531 - DNA, 22 bp, Homo sapiens
caggcccagtgatcagggctct

SEQ ID NO: 9016532 - DNA, 22 bp, Homo sapiens
caggcccagtgatcagggctct

SEQ ID NO: 9016533 - DNA, 22 bp, Homo sapiens
caggcccaggtgtcgatgttcc

SEQ ID NO: 9016534 - DNA, 22 bp, Homo sapiens
caggcccagggttattgggaaa

SEQ ID NO: 9016535 - DNA, 22 bp, Homo sapiens
caggcccagtgatcagggctct

SEQ ID NO: 9016536 - DNA, 22 bp, Homo sapiens
caggcccataatgcaaatattt

SEQ ID NO: 9016537 - DNA, 22 bp, Homo sapiens
caggcccatctgctcccaggct

SEQ ID NO: 9016538 - DNA, 22 bp, Homo sapiens
agcttagaagtgtgctgagagg

SEQ ID NO: 9016539 - DNA, 22 bp, Homo sapiens
agcttactgtaattaaaagact

SEQ ID NO: 9016540 - DNA, 22 bp, Homo sapiens
agcttagaagtgtgctgagagg

SEQ ID NO: 9016541 - DNA, 22 bp, Homo sapiens
agcttactcttcaagaacaagc

SEQ ID NO: 9016542 - DNA, 21 bp, Homo sapiens
agcttacattaccattgttgc

SEQ ID NO: 9016543 - DNA, 22 bp, Homo sapiens
agcttactgggcagtaaagatt

SEQ ID NO: 9016544 - DNA, 22 bp, Homo sapiens
agcttagaagtgtgctgagagg

SEQ ID NO: 9016545 - DNA, 19 bp, Homo sapiens
agcttccatattctctagt

SEQ ID NO: 9016546 - DNA, 22 bp, Homo sapiens
agcttccattaactgctacact

SEQ ID NO: 9016547 - DNA, 22 bp, Homo sapiens
agcttccattaactgctacact

SEQ ID NO: 9016548 - DNA, 22 bp, Homo sapiens
agcttccattaactgctacact

SEQ ID NO: 9016549 - DNA, 22 bp, Homo sapiens
caggcccatttgtagccacttt

SEQ ID NO: 9016550 - DNA, 22 bp, Homo sapiens
caggcccatttgtagccacttt

SEQ ID NO: 9016551 - DNA, 22 bp, Homo sapiens
caggcccattctaggcttgcta

SEQ ID NO: 9016552 - DNA, 22 bp, Homo sapiens
caggcccatttgtagccacttt

SEQ ID NO: 9016553 - DNA, 22 bp, Homo sapiens
caggcccatttgtagccacttt

SEQ ID NO: 9016554 - DNA, 22 bp, Homo sapiens
caggcccatgagggcagccaca

SEQ ID NO: 9016555 - DNA, 22 bp, Homo sapiens
caggcccatgagggcagccaca

SEQ ID NO: 9016556 - DNA, 22 bp, Homo sapiens
caggcccatctgctcccaggct

SEQ ID NO: 9016557 - DNA, 22 bp, Homo sapiens
caggcccatctgctcccaggct

SEQ ID NO: 9016558 - DNA, 22 bp, Homo sapiens
caggcccatctgctcccaggct

SEQ ID NO: 9016559 - DNA, 22 bp, Homo sapiens
caggcccatgagggcagccaca

SEQ ID NO: 9016560 - DNA, 22 bp, Homo sapiens
caggcccattctaggcttgcta

SEQ ID NO: 9016561 - DNA, 22 bp, Homo sapiens
caggcccattctaggcttgcta

SEQ ID NO: 9016562 - DNA, 22 bp, Homo sapiens
caggcccatgagggcagccaca

SEQ ID NO: 9016563 - DNA, 22 bp, Homo sapiens
caggcagctagatttataacaa

SEQ ID NO: 9016564 - DNA, 22 bp, Homo sapiens
caggcagcgtcctgcttcctgt

SEQ ID NO: 9016565 - DNA, 22 bp, Homo sapiens
caggcagcgtcctgcttcctgt

SEQ ID NO: 9016566 - DNA, 22 bp, Homo sapiens
caggcagcgtcctgcttcctgt

SEQ ID NO: 9016567 - DNA, 22 bp, Homo sapiens
caggcagcgctcgtggcctggc

SEQ ID NO: 9016568 - DNA, 22 bp, Homo sapiens
caggcagcgctcgtggcctggc

SEQ ID NO: 9016569 - DNA, 22 bp, Homo sapiens
caggcagcgctcgtggcctggc

SEQ ID NO: 9016570 - DNA, 22 bp, Homo sapiens
caggcagccttctcgtctcaca

SEQ ID NO: 9016571 - DNA, 22 bp, Homo sapiens
caggcagccttctcgtctcaca

SEQ ID NO: 9016572 - DNA, 22 bp, Homo sapiens
caggcagcgctcgtggcctggc

SEQ ID NO: 9016573 - DNA, 22 bp, Homo sapiens
caggcagcgctcgtggcctggc

SEQ ID NO: 9016574 - DNA, 22 bp, Homo sapiens
caggcagcctgcggtctgcaca

SEQ ID NO: 9016575 - DNA, 22 bp, Homo sapiens
caggcagcctgcggtctgcaca

SEQ ID NO: 9016576 - DNA, 22 bp, Homo sapiens
caggcagcctgcggtctgcaca

SEQ ID NO: 9016577 - DNA, 22 bp, Homo sapiens
caggcagcctgcggtctgcaca

SEQ ID NO: 9016578 - DNA, 22 bp, Homo sapiens
caggcagggagctggaaaggat

SEQ ID NO: 9016579 - DNA, 22 bp, Homo sapiens
caggcagggagctggaaaggat

SEQ ID NO: 9016580 - DNA, 22 bp, Homo sapiens
caggcagggagctggaaaggat

SEQ ID NO: 9016581 - DNA, 22 bp, Homo sapiens
caggcagggagctggaaaggat

SEQ ID NO: 9016582 - DNA, 22 bp, Homo sapiens
caggcagctcgatgccttgttg

SEQ ID NO: 9016583 - DNA, 22 bp, Homo sapiens
caggcagggagctggaaaggat

SEQ ID NO: 9016584 - DNA, 22 bp, Homo sapiens
caggcagctcaaccttgggagc

SEQ ID NO: 9016585 - DNA, 22 bp, Homo sapiens
caggcagctcaaccttgggagc

SEQ ID NO: 9016586 - DNA, 22 bp, Homo sapiens
caggcagctcgatgccttgttg

SEQ ID NO: 9016587 - DNA, 22 bp, Homo sapiens
caggcagctcaaccttgggagc

SEQ ID NO: 9016588 - DNA, 22 bp, Homo sapiens
caggcagctagatttataacaa

SEQ ID NO: 9016589 - DNA, 22 bp, Homo sapiens
caggcagctcaaccttgggagc

SEQ ID NO: 9016590 - DNA, 22 bp, Homo sapiens
caggcaggtcagtgaagaagga

SEQ ID NO: 9016591 - DNA, 22 bp, Homo sapiens
caggcaggtcagtgaagaagga

SEQ ID NO: 9016592 - DNA, 22 bp, Homo sapiens
caggcaggtcagtgaagaagga

SEQ ID NO: 9016593 - DNA, 22 bp, Homo sapiens
caggcaggtcagtgaagaagga

SEQ ID NO: 9016594 - DNA, 22 bp, Homo sapiens
caggcaggtcagtgaagaagga

SEQ ID NO: 9016595 - DNA, 22 bp, Homo sapiens
caggcagggagctggaaaggat

SEQ ID NO: 9016596 - DNA, 22 bp, Homo sapiens
caggcagggagctggaaaggat

SEQ ID NO: 9016597 - DNA, 22 bp, Homo sapiens
caggcaggtcagtgaagaagga

SEQ ID NO: 9016598 - DNA, 22 bp, Homo sapiens
caggcagggagctggaaaggat

SEQ ID NO: 9016599 - DNA, 22 bp, Homo sapiens
caggcagggagctggaaaggat

SEQ ID NO: 9016600 - DNA, 22 bp, Homo sapiens
agctgtctacctgcagagtcct

SEQ ID NO: 9016601 - DNA, 22 bp, Homo sapiens
agctgtctccagatacaggatt

SEQ ID NO: 9016602 - DNA, 22 bp, Homo sapiens
agctgtctctggtattatgtga

SEQ ID NO: 9016603 - DNA, 22 bp, Homo sapiens
agctgtcagtgctgtgcctgta

SEQ ID NO: 9016604 - DNA, 22 bp, Homo sapiens
agctgtcctggctcaggctgtg

SEQ ID NO: 9016605 - DNA, 22 bp, Homo sapiens
agctgtctacagcaataaagga

SEQ ID NO: 9016606 - DNA, 22 bp, Homo sapiens
agctgtcctgtgggagggagtg

SEQ ID NO: 9016607 - DNA, 22 bp, Homo sapiens
agctgtcctggctcaggctgtg

SEQ ID NO: 9016608 - DNA, 22 bp, Homo sapiens
agctggttgtcattcagaattg

SEQ ID NO: 9016609 - DNA, 22 bp, Homo sapiens
agctggttgcttaacctctctg

SEQ ID NO: 9016610 - DNA, 22 bp, Homo sapiens
agctggttcattcattcatggt

SEQ ID NO: 9016611 - DNA, 22 bp, Homo sapiens
agctggttcccactgggcctgt

SEQ ID NO: 9016612 - DNA, 22 bp, Homo sapiens
agctggtttaggatggtctcca

SEQ ID NO: 9016613 - DNA, 22 bp, Homo sapiens
agctggtttaggaaaaggtagg

SEQ ID NO: 9016614 - DNA, 22 bp, Homo sapiens
agctggtttatttctcacaaca

SEQ ID NO: 9016615 - DNA, 22 bp, Homo sapiens
agctggtttgcaagtataatca

SEQ ID NO: 9016616 - DNA, 22 bp, Homo sapiens
agctgtatttgtgaatatttaa

SEQ ID NO: 9016617 - DNA, 22 bp, Homo sapiens
agctgtaatataagcaatgaaa

SEQ ID NO: 9016618 - DNA, 22 bp, Homo sapiens
agctggtttggggtagaggaca

SEQ ID NO: 9016619 - DNA, 22 bp, Homo sapiens
agctggtttggggtagaggaca

SEQ ID NO: 9016620 - DNA, 22 bp, Homo sapiens
agctggtgctgaagctcttgag

SEQ ID NO: 9016621 - DNA, 20 bp, Homo sapiens
caggcagtttgtggttaggg

SEQ ID NO: 9016622 - DNA, 22 bp, Homo sapiens
agctggtggaagggagcccaaa

SEQ ID NO: 9016623 - DNA, 22 bp, Homo sapiens
caggcagtggctcacagcaacc

SEQ ID NO: 9016624 - DNA, 22 bp, Homo sapiens
caggcagtgtcccaggaagcca

SEQ ID NO: 9016625 - DNA, 22 bp, Homo sapiens
caggcagtgtcccaggaagcca

SEQ ID NO: 9016626 - DNA, 22 bp, Homo sapiens
caggcaggtcagtgaagaagga

SEQ ID NO: 9016627 - DNA, 22 bp, Homo sapiens
caggcaggtgcagattcctctt

SEQ ID NO: 9016628 - DNA, 22 bp, Homo sapiens
caggcaggtgcagattcctctt

SEQ ID NO: 9016629 - DNA, 22 bp, Homo sapiens
caggcagtggctcacagcaacc

SEQ ID NO: 9016630 - DNA, 22 bp, Homo sapiens
caggcagtggctcacagcaacc

SEQ ID NO: 9016631 - DNA, 22 bp, Homo sapiens
caggcaggtgcagattcctctt

SEQ ID NO: 9016632 - DNA, 22 bp, Homo sapiens
caggcaggtgcagattcctctt

SEQ ID NO: 9016633 - DNA, 22 bp, Homo sapiens
cagtatttggaatatagctaag

SEQ ID NO: 9016634 - DNA, 22 bp, Homo sapiens
cagtatttggaatatagctaag

SEQ ID NO: 9016635 - DNA, 22 bp, Homo sapiens
cagtatttgttacagcattagc

SEQ ID NO: 9016636 - DNA, 22 bp, Homo sapiens
cagtatttgttacagcattagc

SEQ ID NO: 9016637 - DNA, 22 bp, Homo sapiens
cagtatttgttacagcattagc

SEQ ID NO: 9016638 - DNA, 22 bp, Homo sapiens
cagtatttgttacagcattagc

SEQ ID NO: 9016639 - DNA, 22 bp, Homo sapiens
cagtatttaggattaggagaga

SEQ ID NO: 9016640 - DNA, 22 bp, Homo sapiens
cagtatttatggcttgagtatt

SEQ ID NO: 9016641 - DNA, 22 bp, Homo sapiens
cagtatttatggcttgagtatt

SEQ ID NO: 9016642 - DNA, 22 bp, Homo sapiens
cagtatttatggcttgagtatt

SEQ ID NO: 9016643 - DNA, 22 bp, Homo sapiens
cagtatttcattcagaattgtt

SEQ ID NO: 9016644 - DNA, 22 bp, Homo sapiens
cagtatttcattcagaattgtt

SEQ ID NO: 9016645 - DNA, 22 bp, Homo sapiens
cagtatttcattcagaattgtt

SEQ ID NO: 9016646 - DNA, 22 bp, Homo sapiens
cagtatttcattcagaattgtt

SEQ ID NO: 9016647 - DNA, 22 bp, Homo sapiens
cagtatgtttgggagacatgac

SEQ ID NO: 9016648 - DNA, 20 bp, Homo sapiens
cagtattgatccattgtctg

SEQ ID NO: 9016649 - DNA, 22 bp, Homo sapiens
cagtatttaggattaggagaga

SEQ ID NO: 9016650 - DNA, 22 bp, Homo sapiens
cagtatgtttgggagacatgac

SEQ ID NO: 9016651 - DNA, 22 bp, Homo sapiens
cagtatgtttgggagacatgac

SEQ ID NO: 9016652 - DNA, 22 bp, Homo sapiens
cagtatgtctactggacaaagt

SEQ ID NO: 9016653 - DNA, 22 bp, Homo sapiens
cagtatgtttattagaactgca

SEQ ID NO: 9016654 - DNA, 22 bp, Homo sapiens
cagtatgattgccagttctatc

SEQ ID NO: 9016655 - DNA, 22 bp, Homo sapiens
cagtatgagagttgaatcaagg

SEQ ID NO: 9016656 - DNA, 22 bp, Homo sapiens
cagtatgtctactggacaaagt

SEQ ID NO: 9016657 - DNA, 22 bp, Homo sapiens
cagtatgttcttccaggacaga

SEQ ID NO: 9016658 - DNA, 22 bp, Homo sapiens
cagtatgtactcttatcatgta

SEQ ID NO: 9016659 - DNA, 22 bp, Homo sapiens
cagtatgtactcttatcatgta

SEQ ID NO: 9016660 - DNA, 22 bp, Homo sapiens
cagtatgtactcttatcatgta

SEQ ID NO: 9016661 - DNA, 22 bp, Homo sapiens
cagtatctgtcagtaatcaggt

SEQ ID NO: 9016662 - DNA, 20 bp, Homo sapiens
cagtatctgaagccacacaa

SEQ ID NO: 9016663 - DNA, 22 bp, Homo sapiens
cagtaataacacagaaagtttg

SEQ ID NO: 9016664 - DNA, 22 bp, Homo sapiens
cagtaaggatgcacataactag

SEQ ID NO: 9016665 - DNA, 22 bp, Homo sapiens
cagtaactgatgtgatcaaacg

SEQ ID NO: 9016666 - DNA, 22 bp, Homo sapiens
cagtaagaatatgaatcaggat

SEQ ID NO: 9016667 - DNA, 22 bp, Homo sapiens
cagtaactgatgtgatcaaacg

SEQ ID NO: 9016668 - DNA, 22 bp, Homo sapiens
cagtaagtattcgagtctccat

SEQ ID NO: 9016669 - DNA, 22 bp, Homo sapiens
cagtaagtattcgagtctccat

SEQ ID NO: 9016670 - DNA, 22 bp, Homo sapiens
aggacagagggaccagagccca

SEQ ID NO: 9016671 - DNA, 22 bp, Homo sapiens
aggacagagggaccagagccca

SEQ ID NO: 9016672 - DNA, 22 bp, Homo sapiens
aggacagagggaccagagccca

SEQ ID NO: 9016673 - DNA, 22 bp, Homo sapiens
aggacagagggaccagagccca

SEQ ID NO: 9016674 - DNA, 22 bp, Homo sapiens
aggacagagggaccagagccca

SEQ ID NO: 9016675 - DNA, 22 bp, Homo sapiens
aggacagagggaccagagccca

SEQ ID NO: 9016676 - DNA, 22 bp, Homo sapiens
aggacagagggaccagagccca

SEQ ID NO: 9016677 - DNA, 22 bp, Homo sapiens
aggacagagggaccagagccca

SEQ ID NO: 9016678 - DNA, 22 bp, Homo sapiens
aggacagagggaccagagccca

SEQ ID NO: 9016679 - DNA, 21 bp, Homo sapiens
aggacagatgtaggaataaag

SEQ ID NO: 9016680 - DNA, 21 bp, Homo sapiens
aggacagatgtaggaataaag

SEQ ID NO: 9016681 - DNA, 22 bp, Homo sapiens
aggacagatttttggccaccag

SEQ ID NO: 9016682 - DNA, 21 bp, Homo sapiens
aggacagatgtaggaataaag

SEQ ID NO: 9016683 - DNA, 22 bp, Homo sapiens
cagtaaacactagcattcttgg

SEQ ID NO: 9016684 - DNA, 22 bp, Homo sapiens
aggacagcaaccgttattcaca

SEQ ID NO: 9016685 - DNA, 22 bp, Homo sapiens
cagtaaacactagcattcttgg

SEQ ID NO: 9016686 - DNA, 22 bp, Homo sapiens
cagtaaacagttactaagaaga

SEQ ID NO: 9016687 - DNA, 22 bp, Homo sapiens
cagtaaaggttttatggggctt

SEQ ID NO: 9016688 - DNA, 22 bp, Homo sapiens
cagtaaaggttttatggggctt

SEQ ID NO: 9016689 - DNA, 22 bp, Homo sapiens
cagtaaagcatgtatgtcttca

SEQ ID NO: 9016690 - DNA, 22 bp, Homo sapiens
cagtaaacagttactaagaaga

SEQ ID NO: 9016691 - DNA, 22 bp, Homo sapiens
cagtaaagagccttcattaaat

SEQ ID NO: 9016692 - DNA, 22 bp, Homo sapiens
cagtaaacagttactaagaaga

SEQ ID NO: 9016693 - DNA, 22 bp, Homo sapiens
cagtaaagcatgtatgtcttca

SEQ ID NO: 9016694 - DNA, 22 bp, Homo sapiens
cagtaaagcatgtatgtcttca

SEQ ID NO: 9016695 - DNA, 22 bp, Homo sapiens
cagtaacatgaagagacatgga

SEQ ID NO: 9016696 - DNA, 22 bp, Homo sapiens
cagtaacatgaagagacatgga

SEQ ID NO: 9016697 - DNA, 22 bp, Homo sapiens
cagtaacatgaagagacatgga

SEQ ID NO: 9016698 - DNA, 22 bp, Homo sapiens
cagtaacagtgatcacctgtgg

SEQ ID NO: 9016699 - DNA, 22 bp, Homo sapiens
cagtaacatgaagagacatgga

SEQ ID NO: 9016700 - DNA, 22 bp, Homo sapiens
cagtaacagtgatcacctgtgg

SEQ ID NO: 9016701 - DNA, 22 bp, Homo sapiens
cagtaacagtgatcacctgtgg

SEQ ID NO: 9016702 - DNA, 22 bp, Homo sapiens
cagtaacaggctctgtggtata

SEQ ID NO: 9016703 - DNA, 22 bp, Homo sapiens
cagtaacaggctctgtggtata

SEQ ID NO: 9016704 - DNA, 22 bp, Homo sapiens
cagtaacaggctctgtggtata

SEQ ID NO: 9016705 - DNA, 22 bp, Homo sapiens
cagtaacaggctctgtggtata

SEQ ID NO: 9016706 - DNA, 22 bp, Homo sapiens
cagtaacatgtctgttaagaaa

SEQ ID NO: 9016707 - DNA, 22 bp, Homo sapiens
cagtaacatgtctgttaagaaa

SEQ ID NO: 9016708 - DNA, 22 bp, Homo sapiens
cagtaacatgtctgttaagaaa

SEQ ID NO: 9016709 - DNA, 22 bp, Homo sapiens
cagtaactaggacaaggaggaa

SEQ ID NO: 9016710 - DNA, 22 bp, Homo sapiens
cagtaacatttcaaggtagagg

SEQ ID NO: 9016711 - DNA, 22 bp, Homo sapiens
cagtaacatgtctgttaagaaa

SEQ ID NO: 9016712 - DNA, 22 bp, Homo sapiens
cagtaacatttcaaggtagagg

SEQ ID NO: 9016713 - DNA, 22 bp, Homo sapiens
cagtaaatgtgatttttcttgt

SEQ ID NO: 9016714 - DNA, 22 bp, Homo sapiens
cagtaaatgtgatttttcttgt

SEQ ID NO: 9016715 - DNA, 22 bp, Homo sapiens
cagtaaattatctcatctctgt

SEQ ID NO: 9016716 - DNA, 22 bp, Homo sapiens
cagtaaatgtgatttttcttgt

SEQ ID NO: 9016717 - DNA, 22 bp, Homo sapiens
cagtaacacaaccactccgtga

SEQ ID NO: 9016718 - DNA, 22 bp, Homo sapiens
cagtaacacaaccactccgtga

SEQ ID NO: 9016719 - DNA, 22 bp, Homo sapiens
cagtaaatgagaagctagtaat

SEQ ID NO: 9016720 - DNA, 22 bp, Homo sapiens
cagtaaatggtacgtatatttt

SEQ ID NO: 9016721 - DNA, 22 bp, Homo sapiens
aggaagttggcattttgtttca

SEQ ID NO: 9016722 - DNA, 22 bp, Homo sapiens
aggaatagaccacttcactgag

SEQ ID NO: 9016723 - DNA, 22 bp, Homo sapiens
aggaatatgagctgctgcagtg

SEQ ID NO: 9016724 - DNA, 22 bp, Homo sapiens
aggaagttagtaaattatgtgc

SEQ ID NO: 9016725 - DNA, 23 bp, Homo sapiens
aggaagttaaggcagacagacag

SEQ ID NO: 9016726 - DNA, 22 bp, Homo sapiens
aggaagtgggaagggtctgcca

SEQ ID NO: 9016727 - DNA, 22 bp, Homo sapiens
aggaatcaggagatgagcacgg

SEQ ID NO: 9016728 - DNA, 22 bp, Homo sapiens
aggaatctgtggttttaacagg

SEQ ID NO: 9016729 - DNA, 22 bp, Homo sapiens
aggacaagacaaggaccagaga

SEQ ID NO: 9016730 - DNA, 22 bp, Homo sapiens
aggacaagacaaggaccagaga

SEQ ID NO: 9016731 - DNA, 22 bp, Homo sapiens
aggacaagacaaggaccagaga

SEQ ID NO: 9016732 - DNA, 22 bp, Homo sapiens
aggacagacctaggactggagc

SEQ ID NO: 9016733 - DNA, 22 bp, Homo sapiens
aggacagacctaggactggagc

SEQ ID NO: 9016734 - DNA, 22 bp, Homo sapiens
aggacagacctaggactggagc

SEQ ID NO: 9016735 - DNA, 22 bp, Homo sapiens
aggacacttaggttattcaact

SEQ ID NO: 9016736 - DNA, 22 bp, Homo sapiens
aggacacatgcacaccctgcgt

SEQ ID NO: 9016737 - DNA, 22 bp, Homo sapiens
aggacacagtggtggggaaaag

SEQ ID NO: 9016738 - DNA, 22 bp, Homo sapiens
aggacagagccctagtttcata

SEQ ID NO: 9016739 - DNA, 22 bp, Homo sapiens
aggacagacctaggactggagc

SEQ ID NO: 9016740 - DNA, 22 bp, Homo sapiens
aggacagacctaggactggagc

SEQ ID NO: 9016741 - DNA, 22 bp, Homo sapiens
aggacagacctaggactggagc

SEQ ID NO: 9016742 - DNA, 22 bp, Homo sapiens
aggacagacctaggactggagc

SEQ ID NO: 9016743 - DNA, 22 bp, Homo sapiens
aggacagagcctgtgcagaccg

SEQ ID NO: 9016744 - DNA, 22 bp, Homo sapiens
aggacagagcctgtgcagaccg

SEQ ID NO: 9016745 - DNA, 22 bp, Homo sapiens
aggaagtgaaagggaaggagtt

SEQ ID NO: 9016746 - DNA, 20 bp, Homo sapiens
aggaagtgatgttttatctg

SEQ ID NO: 9016747 - DNA, 22 bp, Homo sapiens
aggaagtgcagggggaagtact

SEQ ID NO: 9016748 - DNA, 22 bp, Homo sapiens
caggtgtctaattctcaccccc

SEQ ID NO: 9016749 - DNA, 22 bp, Homo sapiens
aggaagtgaaagggaaggagtt

SEQ ID NO: 9016750 - DNA, 22 bp, Homo sapiens
aggaagtgctaagagaacatca

SEQ ID NO: 9016751 - DNA, 22 bp, Homo sapiens
aggaagtgctaagagaacatca

SEQ ID NO: 9016752 - DNA, 22 bp, Homo sapiens
aggaagtggataaaatagcttt

SEQ ID NO: 9016753 - DNA, 21 bp, Homo sapiens
aggaagtggccagattgggaa

SEQ ID NO: 9016754 - DNA, 21 bp, Homo sapiens
aggaagtggccagattgggaa

SEQ ID NO: 9016755 - DNA, 22 bp, Homo sapiens
caggtgtcaaaatactaagtgg

SEQ ID NO: 9016756 - DNA, 22 bp, Homo sapiens
caggtgggattttgctgcttga

SEQ ID NO: 9016757 - DNA, 22 bp, Homo sapiens
caggtgggccatgaaaaatgac

SEQ ID NO: 9016758 - DNA, 22 bp, Homo sapiens
caggtggtgcctcctcccttcc

SEQ ID NO: 9016759 - DNA, 22 bp, Homo sapiens
caggtggttatgaggaaggtga

SEQ ID NO: 9016760 - DNA, 22 bp, Homo sapiens
cagggcttactggaggctgctt

SEQ ID NO: 9016761 - DNA, 22 bp, Homo sapiens
cagggctgttagctgctgctct

SEQ ID NO: 9016762 - DNA, 22 bp, Homo sapiens
cagggctgttagctgctgctct

SEQ ID NO: 9016763 - DNA, 22 bp, Homo sapiens
cagggcttcgatggatggatgg

SEQ ID NO: 9016764 - DNA, 22 bp, Homo sapiens
cagggcttcgctcctggtgcac

SEQ ID NO: 9016765 - DNA, 22 bp, Homo sapiens
cagggctggcttccaagttgtt

SEQ ID NO: 9016766 - DNA, 23 bp, Homo sapiens
cagggctgggcttggtgttaggc

SEQ ID NO: 9016767 - DNA, 23 bp, Homo sapiens
cagggctgggcttggtgttaggc

SEQ ID NO: 9016768 - DNA, 23 bp, Homo sapiens
cagggctgggcttggtgttaggc

SEQ ID NO: 9016769 - DNA, 22 bp, Homo sapiens
cagggctgggttaaaagcaggg

SEQ ID NO: 9016770 - DNA, 22 bp, Homo sapiens
cagggctggctgtggcaatctc

SEQ ID NO: 9016771 - DNA, 22 bp, Homo sapiens
cagggctggctgtggcaatctc

SEQ ID NO: 9016772 - DNA, 22 bp, Homo sapiens
cagggctggcttccaagttgtt

SEQ ID NO: 9016773 - DNA, 22 bp, Homo sapiens
cagggctggcttccaagttgtt

SEQ ID NO: 9016774 - DNA, 23 bp, Homo sapiens
cagggctgggcttggtgttaggc

SEQ ID NO: 9016775 - DNA, 22 bp, Homo sapiens
cagggctgggttaaaagcaggg

SEQ ID NO: 9016776 - DNA, 22 bp, Homo sapiens
cagggctgggttaaaagcaggg

SEQ ID NO: 9016777 - DNA, 22 bp, Homo sapiens
cagggctgggttaaaagcaggg

SEQ ID NO: 9016778 - DNA, 22 bp, Homo sapiens
cagggctgggttaaaagcaggg

SEQ ID NO: 9016779 - DNA, 21 bp, Homo sapiens
aggaaaggaagtccccagggt

SEQ ID NO: 9016780 - DNA, 19 bp, Homo sapiens
aggaaaggatcaaaatagc

SEQ ID NO: 9016781 - DNA, 19 bp, Homo sapiens
aggaaaggatcaaaatagc

SEQ ID NO: 9016782 - DNA, 19 bp, Homo sapiens
aggaaaggatcaaaatagc

SEQ ID NO: 9016783 - DNA, 19 bp, Homo sapiens
aggaaaggatcaaaatagc

SEQ ID NO: 9016784 - DNA, 19 bp, Homo sapiens
aggaaaggatcaaaatagc

SEQ ID NO: 9016785 - DNA, 22 bp, Homo sapiens
aggaaaggattggcttctctgt

SEQ ID NO: 9016786 - DNA, 22 bp, Homo sapiens
aggaaaggattggcttctctgt

SEQ ID NO: 9016787 - DNA, 22 bp, Homo sapiens
aggaaaggcctcagcagaaacc

SEQ ID NO: 9016788 - DNA, 22 bp, Homo sapiens
aggaaaggcctcagcagaaacc

SEQ ID NO: 9016789 - DNA, 22 bp, Homo sapiens
aggaaaggcctcagcagaaacc

SEQ ID NO: 9016790 - DNA, 22 bp, Homo sapiens
aggaaaggcctcagcagaaacc

SEQ ID NO: 9016791 - DNA, 22 bp, Homo sapiens
aggaaaggcctcagcagaaacc

SEQ ID NO: 9016792 - DNA, 22 bp, Homo sapiens
aggaaaggcctcagcagaaacc

SEQ ID NO: 9016793 - DNA, 22 bp, Homo sapiens
aggaaaggattggcttctctgt

SEQ ID NO: 9016794 - DNA, 21 bp, Homo sapiens
aggaaaggccagcacgtaggg

SEQ ID NO: 9016795 - DNA, 21 bp, Homo sapiens
aggaaaggccagcacgtaggg

SEQ ID NO: 9016796 - DNA, 21 bp, Homo sapiens
aggaaaggccagcacgtaggg

SEQ ID NO: 9016797 - DNA, 21 bp, Homo sapiens
aggaaaggccagcacgtaggg

SEQ ID NO: 9016798 - DNA, 22 bp, Homo sapiens
aggaagaaaactaattagatgg

SEQ ID NO: 9016799 - DNA, 22 bp, Homo sapiens
aggaagaaaactaattagatgg

SEQ ID NO: 9016800 - DNA, 22 bp, Homo sapiens
aggaagaaacctactagagttt

SEQ ID NO: 9016801 - DNA, 22 bp, Homo sapiens
aggaagaaacctactagagttt

SEQ ID NO: 9016802 - DNA, 22 bp, Homo sapiens
aggaagaaaactaattagatgg

SEQ ID NO: 9016803 - DNA, 22 bp, Homo sapiens
aggaagaaaactaattagatgg

SEQ ID NO: 9016804 - DNA, 22 bp, Homo sapiens
aggaaaggcctttgcatttggt

SEQ ID NO: 9016805 - DNA, 22 bp, Homo sapiens
aggaaaggcctttgcatttggt

SEQ ID NO: 9016806 - DNA, 22 bp, Homo sapiens
aggaaaggcctcagcagaaacc

SEQ ID NO: 9016807 - DNA, 23 bp, Homo sapiens
aggaagaggcaatttctcttaga

SEQ ID NO: 9016808 - DNA, 23 bp, Homo sapiens
aggaagaggcaatttctcttaga

SEQ ID NO: 9016809 - DNA, 22 bp, Homo sapiens
aggaagagctggaccagaggac

SEQ ID NO: 9016810 - DNA, 22 bp, Homo sapiens
aggaagagctggaccagaggac

SEQ ID NO: 9016811 - DNA, 22 bp, Homo sapiens
aggaagagctggaccagaggac

SEQ ID NO: 9016812 - DNA, 22 bp, Homo sapiens
aggaagagctggaccagaggac

SEQ ID NO: 9016813 - DNA, 22 bp, Homo sapiens
aggaagagctggaccagaggac

SEQ ID NO: 9016814 - DNA, 22 bp, Homo sapiens
aggaagagctggaccagaggac

SEQ ID NO: 9016815 - DNA, 18 bp, Homo sapiens
cagggctgtggggtcact

SEQ ID NO: 9016816 - DNA, 18 bp, Homo sapiens
cagggctgtggggtcact

SEQ ID NO: 9016817 - DNA, 18 bp, Homo sapiens
cagggctgtggggtcact

SEQ ID NO: 9016818 - DNA, 23 bp, Homo sapiens
aggaagaggcaatttctcttaga

SEQ ID NO: 9016819 - DNA, 22 bp, Homo sapiens
aggaagagggtggcagataatc

SEQ ID NO: 9016820 - DNA, 18 bp, Homo sapiens
cagggctgtggggtcact

SEQ ID NO: 9016821 - DNA, 18 bp, Homo sapiens
cagggctgtggggtcact

SEQ ID NO: 9016822 - DNA, 18 bp, Homo sapiens
cagggctgtggggtcact

SEQ ID NO: 9016823 - DNA, 18 bp, Homo sapiens
cagggctgtggggtcact

SEQ ID NO: 9016824 - DNA, 18 bp, Homo sapiens
cagggctgtggggtcact

SEQ ID NO: 9016825 - DNA, 18 bp, Homo sapiens
cagggctgtggggtcact

SEQ ID NO: 9016826 - DNA, 22 bp, Homo sapiens
cagggctgttagctgctgctct

SEQ ID NO: 9016827 - DNA, 18 bp, Homo sapiens
cagggctgtggggtcact

SEQ ID NO: 9016828 - DNA, 22 bp, Homo sapiens
cagggctgttagctgctgctct

SEQ ID NO: 9016829 - DNA, 22 bp, Homo sapiens
cagggctgttagctgctgctct

SEQ ID NO: 9016830 - DNA, 22 bp, Homo sapiens
cagggctgttagctgctgctct

SEQ ID NO: 9016831 - DNA, 22 bp, Homo sapiens
cagggctgttagctgctgctct

SEQ ID NO: 9016832 - DNA, 22 bp, Homo sapiens
aggaagagcccgggtgacataa

SEQ ID NO: 9016833 - DNA, 22 bp, Homo sapiens
aggaagagcccgggtgacataa

SEQ ID NO: 9016834 - DNA, 22 bp, Homo sapiens
aggaagagcccgggtgacataa

SEQ ID NO: 9016835 - DNA, 22 bp, Homo sapiens
aggaagagcccgggtgacataa

SEQ ID NO: 9016836 - DNA, 22 bp, Homo sapiens
aggaagagcccgggtgacataa

SEQ ID NO: 9016837 - DNA, 22 bp, Homo sapiens
aggaagagcattcacatggtag

SEQ ID NO: 9016838 - DNA, 22 bp, Homo sapiens
aggaagagcccgggtgacataa

SEQ ID NO: 9016839 - DNA, 22 bp, Homo sapiens
aggaagagcccgggtgacataa

SEQ ID NO: 9016840 - DNA, 22 bp, Homo sapiens
aggaagagcccgggtgacataa

SEQ ID NO: 9016841 - DNA, 22 bp, Homo sapiens
aggaagagcccgggtgacataa

SEQ ID NO: 9016842 - DNA, 22 bp, Homo sapiens
aggaagagctggaccagaggac

SEQ ID NO: 9016843 - DNA, 22 bp, Homo sapiens
aggaagagctggaccagaggac

SEQ ID NO: 9016844 - DNA, 22 bp, Homo sapiens
aggaagagctggaccagaggac

SEQ ID NO: 9016845 - DNA, 22 bp, Homo sapiens
aggaagagctggaccagaggac

SEQ ID NO: 9016846 - DNA, 22 bp, Homo sapiens
aggaagagctggaccagaggac

SEQ ID NO: 9016847 - DNA, 22 bp, Homo sapiens
aggaagagctggaccagaggac

SEQ ID NO: 9016848 - DNA, 22 bp, Homo sapiens
aggaagagctggaccagaggac

SEQ ID NO: 9016849 - DNA, 22 bp, Homo sapiens
aggaagagctggaccagaggac

SEQ ID NO: 9016850 - DNA, 22 bp, Homo sapiens
aggaagagctggaccagaggac

SEQ ID NO: 9016851 - DNA, 22 bp, Homo sapiens
aggaagagctggaccagaggac

SEQ ID NO: 9016852 - DNA, 22 bp, Homo sapiens
aggaagagctggaccagaggac

SEQ ID NO: 9016853 - DNA, 22 bp, Homo sapiens
aggaagagctggaccagaggac

SEQ ID NO: 9016854 - DNA, 22 bp, Homo sapiens
aggaagagctggaccagaggac

SEQ ID NO: 9016855 - DNA, 22 bp, Homo sapiens
aggaagagctggaccagaggac

SEQ ID NO: 9016856 - DNA, 22 bp, Homo sapiens
agctttgcttcttttccatagc

SEQ ID NO: 9016857 - DNA, 19 bp, Homo sapiens
agctttgccaaaaacttag

SEQ ID NO: 9016858 - DNA, 22 bp, Homo sapiens
agctttgcaacctgaggccagt

SEQ ID NO: 9016859 - DNA, 19 bp, Homo sapiens
agctttgccaaaaacttag

SEQ ID NO: 9016860 - DNA, 23 bp, Homo sapiens
agctttgaggactttaaaagata

SEQ ID NO: 9016861 - DNA, 22 bp, Homo sapiens
agctttgaatgagtgcattgca

SEQ ID NO: 9016862 - DNA, 22 bp, Homo sapiens
agctttgaatgagtgcattgca

SEQ ID NO: 9016863 - DNA, 22 bp, Homo sapiens
agctttcttctagttgtacagt

SEQ ID NO: 9016864 - DNA, 22 bp, Homo sapiens
agctttcttctagttgtacagt

SEQ ID NO: 9016865 - DNA, 22 bp, Homo sapiens
cagggcagtaacgggaacatct

SEQ ID NO: 9016866 - DNA, 22 bp, Homo sapiens
cagggcagtaacgggaacatct

SEQ ID NO: 9016867 - DNA, 22 bp, Homo sapiens
cagggcagtaacgggaacatct

SEQ ID NO: 9016868 - DNA, 22 bp, Homo sapiens
agctttgaatctggtgtttgca

SEQ ID NO: 9016869 - DNA, 22 bp, Homo sapiens
agctttgaagtatttggtctcc

SEQ ID NO: 9016870 - DNA, 22 bp, Homo sapiens
agctttgaagtatttggtctcc

SEQ ID NO: 9016871 - DNA, 22 bp, Homo sapiens
agctttgaaaatccaaattaca

SEQ ID NO: 9016872 - DNA, 21 bp, Homo sapiens
agctttgaaagtgattcagtt

SEQ ID NO: 9016873 - DNA, 22 bp, Homo sapiens
agctttgaaattatgtttcaga

SEQ ID NO: 9016874 - DNA, 22 bp, Homo sapiens
agctttcttctagttgtacagt

SEQ ID NO: 9016875 - DNA, 22 bp, Homo sapiens
agctttgggattcaggcaggaa

SEQ ID NO: 9016876 - DNA, 22 bp, Homo sapiens
agctttggatgatctttgatac

SEQ ID NO: 9016877 - DNA, 22 bp, Homo sapiens
agctttggccctggaggttact

SEQ ID NO: 9016878 - DNA, 22 bp, Homo sapiens
agctttgggcagaagaggattc

SEQ ID NO: 9016879 - DNA, 20 bp, Homo sapiens
cagggctctgggcctggcct

SEQ ID NO: 9016880 - DNA, 22 bp, Homo sapiens
cagggctctgccttgagggatg

SEQ ID NO: 9016881 - DNA, 22 bp, Homo sapiens
cagggctctgccttgagggatg

SEQ ID NO: 9016882 - DNA, 22 bp, Homo sapiens
cagggctggctgtggcaatctc

SEQ ID NO: 9016883 - DNA, 22 bp, Homo sapiens
cagggctggctgtggcaatctc

SEQ ID NO: 9016884 - DNA, 22 bp, Homo sapiens
cagggctggctgtggcaatctc

SEQ ID NO: 9016885 - DNA, 22 bp, Homo sapiens
cagggctggctcatgaaaagtt

SEQ ID NO: 9016886 - DNA, 22 bp, Homo sapiens
cagggctggctgtggcaatctc

SEQ ID NO: 9016887 - DNA, 22 bp, Homo sapiens
cagggctggatttcatttctag

SEQ ID NO: 9016888 - DNA, 22 bp, Homo sapiens
cagggctggctcatgaaaagtt

SEQ ID NO: 9016889 - DNA, 22 bp, Homo sapiens
cagggctggctcatgaaaagtt

SEQ ID NO: 9016890 - DNA, 20 bp, Homo sapiens
cagggctctgggcctggcct

SEQ ID NO: 9016891 - DNA, 22 bp, Homo sapiens
cagggctggctcatgaaaagtt

SEQ ID NO: 9016892 - DNA, 22 bp, Homo sapiens
cagggcagggatgttgcggcag

SEQ ID NO: 9016893 - DNA, 22 bp, Homo sapiens
cagggcagggatgttgcggcag

SEQ ID NO: 9016894 - DNA, 22 bp, Homo sapiens
cagggcagggatgttgcggcag

SEQ ID NO: 9016895 - DNA, 22 bp, Homo sapiens
cagggcagggatgttgcggcag

SEQ ID NO: 9016896 - DNA, 22 bp, Homo sapiens
cagggcaggatgctgtgattat

SEQ ID NO: 9016897 - DNA, 22 bp, Homo sapiens
cagggcagggagcttagaatga

SEQ ID NO: 9016898 - DNA, 22 bp, Homo sapiens
cagggcagggagcttagaatga

SEQ ID NO: 9016899 - DNA, 22 bp, Homo sapiens
cagggcagggagcttagaatga

SEQ ID NO: 9016900 - DNA, 22 bp, Homo sapiens
cagggcagggccacaccccctg

SEQ ID NO: 9016901 - DNA, 22 bp, Homo sapiens
cagggcagggccacaccccctg

SEQ ID NO: 9016902 - DNA, 22 bp, Homo sapiens
cagggcagggccacaccccctg

SEQ ID NO: 9016903 - DNA, 22 bp, Homo sapiens
cagggcagggccacaccccctg

SEQ ID NO: 9016904 - DNA, 22 bp, Homo sapiens
cagggcagtaacgggaacatct

SEQ ID NO: 9016905 - DNA, 22 bp, Homo sapiens
cagggcagtaacgggaacatct

SEQ ID NO: 9016906 - DNA, 22 bp, Homo sapiens
cagggcagtaacgggaacatct

SEQ ID NO: 9016907 - DNA, 22 bp, Homo sapiens
cagggcagtaacgggaacatct

SEQ ID NO: 9016908 - DNA, 22 bp, Homo sapiens
caggctcttttggtggcaagga

SEQ ID NO: 9016909 - DNA, 22 bp, Homo sapiens
caggctcttccatcctgctgag

SEQ ID NO: 9016910 - DNA, 22 bp, Homo sapiens
caggctcttttggtggcaagga

SEQ ID NO: 9016911 - DNA, 22 bp, Homo sapiens
caggctcttccatcctgctgag

SEQ ID NO: 9016912 - DNA, 22 bp, Homo sapiens
caggctcttccatcctgctgag

SEQ ID NO: 9016913 - DNA, 22 bp, Homo sapiens
caggctcttccatcctgctgag

SEQ ID NO: 9016914 - DNA, 22 bp, Homo sapiens
caggctgaagtgcagtggtgtg

SEQ ID NO: 9016915 - DNA, 22 bp, Homo sapiens
caggctgaagtgcagtggtgtg

SEQ ID NO: 9016916 - DNA, 22 bp, Homo sapiens
cagggcaggatgctgtgattat

SEQ ID NO: 9016917 - DNA, 22 bp, Homo sapiens
cagggcaggatgctgtgattat

SEQ ID NO: 9016918 - DNA, 22 bp, Homo sapiens
cagggcaggatgctgtgattat

SEQ ID NO: 9016919 - DNA, 22 bp, Homo sapiens
cagggatgtgatgagctgagcc

SEQ ID NO: 9016920 - DNA, 22 bp, Homo sapiens
caggctgaagtgcagtggtgtg

SEQ ID NO: 9016921 - DNA, 22 bp, Homo sapiens
cagggatgtgatgagctgagcc

SEQ ID NO: 9016922 - DNA, 22 bp, Homo sapiens
cagggatgtgatgagctgagcc

SEQ ID NO: 9016923 - DNA, 22 bp, Homo sapiens
cagggatgtgatgagctgagcc

SEQ ID NO: 9016924 - DNA, 22 bp, Homo sapiens
cagggatgtgatgagctgagcc

SEQ ID NO: 9016925 - DNA, 22 bp, Homo sapiens
catctcttcattagcattattg

SEQ ID NO: 9016926 - DNA, 22 bp, Homo sapiens
catctcttcattagcattattg

SEQ ID NO: 9016927 - DNA, 22 bp, Homo sapiens
catctcttcattagcattattg

SEQ ID NO: 9016928 - DNA, 22 bp, Homo sapiens
catctctgtgtccccagagctt

SEQ ID NO: 9016929 - DNA, 21 bp, Homo sapiens
catcttaggttgtacatatat

SEQ ID NO: 9016930 - DNA, 21 bp, Homo sapiens
catcttaggttgtacatatat

SEQ ID NO: 9016931 - DNA, 22 bp, Homo sapiens
catcttaatttctaacaggcac

SEQ ID NO: 9016932 - DNA, 22 bp, Homo sapiens
catcttcaccagagacaagcaa

SEQ ID NO: 9016933 - DNA, 22 bp, Homo sapiens
catcttcacatatttccaatga

SEQ ID NO: 9016934 - DNA, 22 bp, Homo sapiens
catcttataggcagagttcagt

SEQ ID NO: 9016935 - DNA, 22 bp, Homo sapiens
catcttattttcttctagtgct

SEQ ID NO: 9016936 - DNA, 22 bp, Homo sapiens
catcttcaggggctacatctgt

SEQ ID NO: 9016937 - DNA, 22 bp, Homo sapiens
catcttcaggggctacatctgt

SEQ ID NO: 9016938 - DNA, 22 bp, Homo sapiens
catcttcaccagagacaagcaa

SEQ ID NO: 9016939 - DNA, 22 bp, Homo sapiens
catcttcaccagagacaagcaa

SEQ ID NO: 9016940 - DNA, 22 bp, Homo sapiens
catcttcaccagagacaagcaa

SEQ ID NO: 9016941 - DNA, 22 bp, Homo sapiens
catcttcaccagagacaagcaa

SEQ ID NO: 9016942 - DNA, 22 bp, Homo sapiens
catctctggttcagtctctgtg

SEQ ID NO: 9016943 - DNA, 19 bp, Homo sapiens
catctctgcaaggagctgc

SEQ ID NO: 9016944 - DNA, 22 bp, Homo sapiens
catctctgtgtccccagagctt

SEQ ID NO: 9016945 - DNA, 22 bp, Homo sapiens
catctctgtgtccccagagctt

SEQ ID NO: 9016946 - DNA, 22 bp, Homo sapiens
catctctggttcagtctctgtg

SEQ ID NO: 9016947 - DNA, 22 bp, Homo sapiens
catctctgagacctcagctggg

SEQ ID NO: 9016948 - DNA, 19 bp, Homo sapiens
catctctgcaaggagctgc

SEQ ID NO: 9016949 - DNA, 22 bp, Homo sapiens
catctctgagacctcagctggg

SEQ ID NO: 9016950 - DNA, 22 bp, Homo sapiens
catctctgagacctcagctggg

SEQ ID NO: 9016951 - DNA, 22 bp, Homo sapiens
catctcctggcagctgttagga

SEQ ID NO: 9016952 - DNA, 22 bp, Homo sapiens
catctctccacggcagctctcg

SEQ ID NO: 9016953 - DNA, 22 bp, Homo sapiens
catctctccacggcagctctcg

SEQ ID NO: 9016954 - DNA, 22 bp, Homo sapiens
catccaagaaaattttctctct

SEQ ID NO: 9016955 - DNA, 22 bp, Homo sapiens
catctcatagtgcagtgctgta

SEQ ID NO: 9016956 - DNA, 22 bp, Homo sapiens
catctcatagtgcagtgctgta

SEQ ID NO: 9016957 - DNA, 22 bp, Homo sapiens
catctcatcagtgagagtcagc

SEQ ID NO: 9016958 - DNA, 22 bp, Homo sapiens
catctcatcctgccctaaaaca

SEQ ID NO: 9016959 - DNA, 22 bp, Homo sapiens
catctcatcagtgagagtcagc

SEQ ID NO: 9016960 - DNA, 22 bp, Homo sapiens
catctcatcagtgagagtcagc

SEQ ID NO: 9016961 - DNA, 22 bp, Homo sapiens
catccaaagcaaatatcttaaa

SEQ ID NO: 9016962 - DNA, 22 bp, Homo sapiens
catccaaagcaaatatcttaaa

SEQ ID NO: 9016963 - DNA, 22 bp, Homo sapiens
catccaaactctcattatctgt

SEQ ID NO: 9016964 - DNA, 22 bp, Homo sapiens
catacatatgtggatgtcatat

SEQ ID NO: 9016965 - DNA, 22 bp, Homo sapiens
catacatatgtggatgtcatat

SEQ ID NO: 9016966 - DNA, 22 bp, Homo sapiens
catctccaggagttctactcat

SEQ ID NO: 9016967 - DNA, 22 bp, Homo sapiens
catctcatttattccaactcag

SEQ ID NO: 9016968 - DNA, 22 bp, Homo sapiens
catctcatgggcatgccaagct

SEQ ID NO: 9016969 - DNA, 22 bp, Homo sapiens
catctcatgggcatgccaagct

SEQ ID NO: 9016970 - DNA, 22 bp, Homo sapiens
catctcctggcagctgttagga

SEQ ID NO: 9016971 - DNA, 20 bp, Homo sapiens
catctcctgcctccatgttc

SEQ ID NO: 9016972 - DNA, 20 bp, Homo sapiens
catctcctgcctccatgttc

SEQ ID NO: 9016973 - DNA, 22 bp, Homo sapiens
catacagttttccctagatgtg

SEQ ID NO: 9016974 - DNA, 22 bp, Homo sapiens
catacagtgtggcatgtagtct

SEQ ID NO: 9016975 - DNA, 22 bp, Homo sapiens
catacagtgtggcatgtagtct

SEQ ID NO: 9016976 - DNA, 22 bp, Homo sapiens
catacagagaaggataataaag

SEQ ID NO: 9016977 - DNA, 22 bp, Homo sapiens
catacagagaaggataataaag

SEQ ID NO: 9016978 - DNA, 22 bp, Homo sapiens
catacatactgagtggactgat

SEQ ID NO: 9016979 - DNA, 22 bp, Homo sapiens
catacatactgagtggactgat

SEQ ID NO: 9016980 - DNA, 22 bp, Homo sapiens
catacagtgtggcatgtagtct

SEQ ID NO: 9016981 - DNA, 22 bp, Homo sapiens
catacagttttccctagatgtg

SEQ ID NO: 9016982 - DNA, 22 bp, Homo sapiens
catacataccactgctgtcttt

SEQ ID NO: 9016983 - DNA, 22 bp, Homo sapiens
catacagttttccctagatgtg

SEQ ID NO: 9016984 - DNA, 22 bp, Homo sapiens
catacagttttccctagatgtg

SEQ ID NO: 9016985 - DNA, 20 bp, Homo sapiens
catacactattctgtatagt

SEQ ID NO: 9016986 - DNA, 20 bp, Homo sapiens
catacactattctgtatagt

SEQ ID NO: 9016987 - DNA, 22 bp, Homo sapiens
catacaatcaagttctttatta

SEQ ID NO: 9016988 - DNA, 22 bp, Homo sapiens
catacaatcaagttctttatta

SEQ ID NO: 9016989 - DNA, 22 bp, Homo sapiens
catacaagcgttcaatagatgt

SEQ ID NO: 9016990 - DNA, 22 bp, Homo sapiens
catacaagcgttcaatagatgt

SEQ ID NO: 9016991 - DNA, 22 bp, Homo sapiens
catacaatcaagttctttatta

SEQ ID NO: 9016992 - DNA, 22 bp, Homo sapiens
catacaagcgttcaatagatgt

SEQ ID NO: 9016993 - DNA, 22 bp, Homo sapiens
catacaagcgttcaatagatgt

SEQ ID NO: 9016994 - DNA, 22 bp, Homo sapiens
catacaagcgtgcatgtgcttg

SEQ ID NO: 9016995 - DNA, 22 bp, Homo sapiens
catacaagcgtgcatgtgcttg

SEQ ID NO: 9016996 - DNA, 22 bp, Homo sapiens
catacaaatgtgtccaggctct

SEQ ID NO: 9016997 - DNA, 22 bp, Homo sapiens
catacaaatgtgtccaggctct

SEQ ID NO: 9016998 - DNA, 22 bp, Homo sapiens
catacaaatgtgtccaggctct

SEQ ID NO: 9016999 - DNA, 22 bp, Homo sapiens
cataatttttttaagtcagaac

SEQ ID NO: 9017000 - DNA, 22 bp, Homo sapiens
catacaaatgtgtccaggctct

SEQ ID NO: 9017001 - DNA, 22 bp, Homo sapiens
catacaaatgtgtccaggctct

SEQ ID NO: 9017002 - DNA, 22 bp, Homo sapiens
catacaaatgtgtccaggctct

SEQ ID NO: 9017003 - DNA, 22 bp, Homo sapiens
catacaaatgtgtccaggctct

SEQ ID NO: 9017004 - DNA, 22 bp, Homo sapiens
cataatttttttaagtcagaac

SEQ ID NO: 9017005 - DNA, 22 bp, Homo sapiens
catacaaatgtgtccaggctct

SEQ ID NO: 9017006 - DNA, 22 bp, Homo sapiens
cataatttttttaagtcagaac

SEQ ID NO: 9017007 - DNA, 22 bp, Homo sapiens
aggaggctgaactagggtctgg

SEQ ID NO: 9017008 - DNA, 22 bp, Homo sapiens
aggaggctgaactagggtctgg

SEQ ID NO: 9017009 - DNA, 22 bp, Homo sapiens
aggaggctctcaggtcctcccc

SEQ ID NO: 9017010 - DNA, 22 bp, Homo sapiens
aggaggctgaactagggtctgg

SEQ ID NO: 9017011 - DNA, 22 bp, Homo sapiens
aggaggctgaactagggtctgg

SEQ ID NO: 9017012 - DNA, 22 bp, Homo sapiens
aggaggctgaactagggtctgg

SEQ ID NO: 9017013 - DNA, 22 bp, Homo sapiens
aggaggctgaactagggtctgg

SEQ ID NO: 9017014 - DNA, 22 bp, Homo sapiens
aggaggctgaactagggtctgg

SEQ ID NO: 9017015 - DNA, 22 bp, Homo sapiens
aggaggcctgcagctgccattc

SEQ ID NO: 9017016 - DNA, 22 bp, Homo sapiens
aggaggcctgcagctgccattc

SEQ ID NO: 9017017 - DNA, 22 bp, Homo sapiens
aggaggcctgcagctgccattc

SEQ ID NO: 9017018 - DNA, 22 bp, Homo sapiens
aggaggcctgtgtttgtctgta

SEQ ID NO: 9017019 - DNA, 22 bp, Homo sapiens
aggaggcctgttttctcctgga

SEQ ID NO: 9017020 - DNA, 22 bp, Homo sapiens
aggaggctctcaggtcctcccc

SEQ ID NO: 9017021 - DNA, 22 bp, Homo sapiens
aggaggctctcaggtcctcccc

SEQ ID NO: 9017022 - DNA, 22 bp, Homo sapiens
aggaggctctcaggtcctcccc

SEQ ID NO: 9017023 - DNA, 22 bp, Homo sapiens
aggaggccttggggcttagagc

SEQ ID NO: 9017024 - DNA, 19 bp, Homo sapiens
catgaggcagctgcacccc

SEQ ID NO: 9017025 - DNA, 19 bp, Homo sapiens
catgaggcagctgcacccc

SEQ ID NO: 9017026 - DNA, 22 bp, Homo sapiens
catgaggtgataaagctgggat

SEQ ID NO: 9017027 - DNA, 22 bp, Homo sapiens
catgaggtcagggggagccggt

SEQ ID NO: 9017028 - DNA, 22 bp, Homo sapiens
catgagggttggggtggagctt

SEQ ID NO: 9017029 - DNA, 22 bp, Homo sapiens
aggatttgttgagttttagtgg

SEQ ID NO: 9017030 - DNA, 22 bp, Homo sapiens
catgaggatccaggtgacaggc

SEQ ID NO: 9017031 - DNA, 22 bp, Homo sapiens
catgaggatccaggtgacaggc

SEQ ID NO: 9017032 - DNA, 22 bp, Homo sapiens
catgagcattttggtctagttt

SEQ ID NO: 9017033 - DNA, 22 bp, Homo sapiens
catgagctgctgggagcctgtc

SEQ ID NO: 9017034 - DNA, 18 bp, Homo sapiens
catgagctgcccctagac

SEQ ID NO: 9017035 - DNA, 22 bp, Homo sapiens
catgagcattttggtctagttt

SEQ ID NO: 9017036 - DNA, 22 bp, Homo sapiens
catgagcataaatcagtcacga

SEQ ID NO: 9017037 - DNA, 22 bp, Homo sapiens
catgagataatttttctccagt

SEQ ID NO: 9017038 - DNA, 22 bp, Homo sapiens
catgagatttgggaggggccag

SEQ ID NO: 9017039 - DNA, 22 bp, Homo sapiens
aggatgtctctccagcctggag

SEQ ID NO: 9017040 - DNA, 23 bp, Homo sapiens
aggatgtaggatgtatggcagag

SEQ ID NO: 9017041 - DNA, 23 bp, Homo sapiens
aggatgtaggatgtatggcagag

SEQ ID NO: 9017042 - DNA, 23 bp, Homo sapiens
aggatgtaggatgtatggcagag

SEQ ID NO: 9017043 - DNA, 23 bp, Homo sapiens
aggatgtaggatgtatggcagag

SEQ ID NO: 9017044 - DNA, 22 bp, Homo sapiens
catgagaatgaagaagacttaa

SEQ ID NO: 9017045 - DNA, 22 bp, Homo sapiens
catgagatttgggaggggccag

SEQ ID NO: 9017046 - DNA, 22 bp, Homo sapiens
catgagataatttttctccagt

SEQ ID NO: 9017047 - DNA, 22 bp, Homo sapiens
catcttctgggacttctcagtt

SEQ ID NO: 9017048 - DNA, 22 bp, Homo sapiens
catcttctgggacttctcagtt

SEQ ID NO: 9017049 - DNA, 22 bp, Homo sapiens
catcttctgggacttctcagtt

SEQ ID NO: 9017050 - DNA, 22 bp, Homo sapiens
catcttcattttgtccagtact

SEQ ID NO: 9017051 - DNA, 22 bp, Homo sapiens
catcttcattttgtccagtact

SEQ ID NO: 9017052 - DNA, 22 bp, Homo sapiens
catcttctgggacttctcagtt

SEQ ID NO: 9017053 - DNA, 22 bp, Homo sapiens
catcttgactgggataagggat

SEQ ID NO: 9017054 - DNA, 22 bp, Homo sapiens
catcttcaggtgttttccatca

SEQ ID NO: 9017055 - DNA, 22 bp, Homo sapiens
catcttcaggttcatggtcata

SEQ ID NO: 9017056 - DNA, 22 bp, Homo sapiens
catcttcagtgattacctaaaa

SEQ ID NO: 9017057 - DNA, 22 bp, Homo sapiens
catcttcataaaggaactgcat

SEQ ID NO: 9017058 - DNA, 22 bp, Homo sapiens
catcttcattttgtccagtact

SEQ ID NO: 9017059 - DNA, 22 bp, Homo sapiens
catcttcagtgattacctaaaa

SEQ ID NO: 9017060 - DNA, 22 bp, Homo sapiens
catcttgatgctttgacaggtt

SEQ ID NO: 9017061 - DNA, 19 bp, Homo sapiens
catcttggagtactccttt

SEQ ID NO: 9017062 - DNA, 22 bp, Homo sapiens
catcttgcttcatctgctgtgt

SEQ ID NO: 9017063 - DNA, 17 bp, Homo sapiens
catctttaaaatcctga

SEQ ID NO: 9017064 - DNA, 22 bp, Homo sapiens
catcttgtgaatttctgattct

SEQ ID NO: 9017065 - DNA, 23 bp, Homo sapiens
aggatgggtggcaatagaaagac

SEQ ID NO: 9017066 - DNA, 23 bp, Homo sapiens
aggatgggtggcaatagaaagac

SEQ ID NO: 9017067 - DNA, 23 bp, Homo sapiens
aggatgggtggcaatagaaagac

SEQ ID NO: 9017068 - DNA, 22 bp, Homo sapiens
aggatggggtctgcagcctggt

SEQ ID NO: 9017069 - DNA, 22 bp, Homo sapiens
aggatggggtctgcagcctggt

SEQ ID NO: 9017070 - DNA, 22 bp, Homo sapiens
aggatgggtcagctagagtcca

SEQ ID NO: 9017071 - DNA, 22 bp, Homo sapiens
aggatgggtcagctagagtcca

SEQ ID NO: 9017072 - DNA, 22 bp, Homo sapiens
aggatgggtcagctagagtcca

SEQ ID NO: 9017073 - DNA, 22 bp, Homo sapiens
aggatggggtctgcagcctggt

SEQ ID NO: 9017074 - DNA, 22 bp, Homo sapiens
aggatggggtctgcagcctggt

SEQ ID NO: 9017075 - DNA, 22 bp, Homo sapiens
aggatggcttgcaggaggctgt

SEQ ID NO: 9017076 - DNA, 22 bp, Homo sapiens
aggatggcttgcaggaggctgt

SEQ ID NO: 9017077 - DNA, 22 bp, Homo sapiens
aggatgggcctgggatatgctt

SEQ ID NO: 9017078 - DNA, 22 bp, Homo sapiens
aggatgggcctgggatatgctt

SEQ ID NO: 9017079 - DNA, 22 bp, Homo sapiens
aggatgagagatacatggagca

SEQ ID NO: 9017080 - DNA, 22 bp, Homo sapiens
aggatgagagatacatggagca

SEQ ID NO: 9017081 - DNA, 22 bp, Homo sapiens
aggatggcttgcaggaggctgt

SEQ ID NO: 9017082 - DNA, 22 bp, Homo sapiens
aggatgagagatacatggagca

SEQ ID NO: 9017083 - DNA, 22 bp, Homo sapiens
aggatggcttgcaggaggctgt

SEQ ID NO: 9017084 - DNA, 22 bp, Homo sapiens
aggagccatccccatgagaggt

SEQ ID NO: 9017085 - DNA, 22 bp, Homo sapiens
aggagccatccccatgagaggt

SEQ ID NO: 9017086 - DNA, 22 bp, Homo sapiens
aggagccatccccatgagaggt

SEQ ID NO: 9017087 - DNA, 22 bp, Homo sapiens
aggagccagttccaccccagga

SEQ ID NO: 9017088 - DNA, 22 bp, Homo sapiens
aggagccagttccaccccagga

SEQ ID NO: 9017089 - DNA, 22 bp, Homo sapiens
aggagccagtggagttcctgcc

SEQ ID NO: 9017090 - DNA, 22 bp, Homo sapiens
aggagccagtggagttcctgcc

SEQ ID NO: 9017091 - DNA, 22 bp, Homo sapiens
cagttttatgtcgaatgtatac

SEQ ID NO: 9017092 - DNA, 22 bp, Homo sapiens
aggagccatccccatgagaggt

SEQ ID NO: 9017093 - DNA, 22 bp, Homo sapiens
aggagccatgagcaggaggcaa

SEQ ID NO: 9017094 - DNA, 22 bp, Homo sapiens
cagttttatgtcgaatgtatac

SEQ ID NO: 9017095 - DNA, 22 bp, Homo sapiens
cagttttatgtcgaatgtatac

SEQ ID NO: 9017096 - DNA, 22 bp, Homo sapiens
cagttttattggttgaaatctg

SEQ ID NO: 9017097 - DNA, 22 bp, Homo sapiens
cagttttattggttgaaatctg

SEQ ID NO: 9017098 - DNA, 22 bp, Homo sapiens
cagttttattggttgaaatctg

SEQ ID NO: 9017099 - DNA, 22 bp, Homo sapiens
cataacatccttgctactttga

SEQ ID NO: 9017100 - DNA, 22 bp, Homo sapiens
cataacatgtacatataaatgc

SEQ ID NO: 9017101 - DNA, 22 bp, Homo sapiens
cataacatgtacatataaatgc

SEQ ID NO: 9017102 - DNA, 22 bp, Homo sapiens
cataacatccttgctactttga

SEQ ID NO: 9017103 - DNA, 22 bp, Homo sapiens
cataacattaagcctctatttc

SEQ ID NO: 9017104 - DNA, 22 bp, Homo sapiens
cataacatgtacatataaatgc

SEQ ID NO: 9017105 - DNA, 22 bp, Homo sapiens
cataacatgtacatataaatgc

SEQ ID NO: 9017106 - DNA, 22 bp, Homo sapiens
cataacattaagcctctatttc

SEQ ID NO: 9017107 - DNA, 22 bp, Homo sapiens
cataacattaagcctctatttc

SEQ ID NO: 9017108 - DNA, 22 bp, Homo sapiens
cataacattattttctgaagat

SEQ ID NO: 9017109 - DNA, 22 bp, Homo sapiens
cataacattaagcctctatttc

SEQ ID NO: 9017110 - DNA, 17 bp, Homo sapiens
aggagctgggggtggtg

SEQ ID NO: 9017111 - DNA, 17 bp, Homo sapiens
aggagctgggggtggtg

SEQ ID NO: 9017112 - DNA, 22 bp, Homo sapiens
cataatatactacattgatgaa

SEQ ID NO: 9017113 - DNA, 22 bp, Homo sapiens
cataatatactacattgatgaa

SEQ ID NO: 9017114 - DNA, 22 bp, Homo sapiens
cataatatactacattgatgaa

SEQ ID NO: 9017115 - DNA, 22 bp, Homo sapiens
cataatatactacattgatgaa

SEQ ID NO: 9017116 - DNA, 22 bp, Homo sapiens
cataagaatatttagtggcagc

SEQ ID NO: 9017117 - DNA, 22 bp, Homo sapiens
cataagaaggtaacatccttaa

SEQ ID NO: 9017118 - DNA, 22 bp, Homo sapiens
cataagaatattccatcctttg

SEQ ID NO: 9017119 - DNA, 22 bp, Homo sapiens
cataagaatatttagtggcagc

SEQ ID NO: 9017120 - DNA, 22 bp, Homo sapiens
cataagaaataatgatgatgac

SEQ ID NO: 9017121 - DNA, 22 bp, Homo sapiens
cataactttaaagacagtgtgg

SEQ ID NO: 9017122 - DNA, 22 bp, Homo sapiens
cataagaaatttaacagaactt

SEQ ID NO: 9017123 - DNA, 22 bp, Homo sapiens
cataactggggacacttctcta

SEQ ID NO: 9017124 - DNA, 22 bp, Homo sapiens
cataactggggacacttctcta

SEQ ID NO: 9017125 - DNA, 22 bp, Homo sapiens
cataacattgagcagcattcct

SEQ ID NO: 9017126 - DNA, 22 bp, Homo sapiens
cataactagagtgaaatgttga

SEQ ID NO: 9017127 - DNA, 22 bp, Homo sapiens
cataactgggagatccaagggt

SEQ ID NO: 9017128 - DNA, 22 bp, Homo sapiens
aggagctggtagtctcattggg

SEQ ID NO: 9017129 - DNA, 22 bp, Homo sapiens
aggagctggtagtctcattggg

SEQ ID NO: 9017130 - DNA, 22 bp, Homo sapiens
aggagctgggttcctttggtgg

SEQ ID NO: 9017131 - DNA, 22 bp, Homo sapiens
aggagctgggttcctttggtgg

SEQ ID NO: 9017132 - DNA, 16 bp, Homo sapiens
aggagctgggtaggag

SEQ ID NO: 9017133 - DNA, 22 bp, Homo sapiens
aggagctggtagtctcattggg

SEQ ID NO: 9017134 - DNA, 16 bp, Homo sapiens
aggagctgggtaggag

SEQ ID NO: 9017135 - DNA, 17 bp, Homo sapiens
aggagctgggggtggtg

SEQ ID NO: 9017136 - DNA, 17 bp, Homo sapiens
aggagctgggggtggtg

SEQ ID NO: 9017137 - DNA, 16 bp, Homo sapiens
aggagctgggtaggag

SEQ ID NO: 9017138 - DNA, 22 bp, Homo sapiens
aggagctgggttcctttggtgg

SEQ ID NO: 9017139 - DNA, 22 bp, Homo sapiens
aggagctgggttcctttggtgg

SEQ ID NO: 9017140 - DNA, 22 bp, Homo sapiens
aggagctgtcagagtgccagag

SEQ ID NO: 9017141 - DNA, 22 bp, Homo sapiens
aggagctgtcagagtgccagag

SEQ ID NO: 9017142 - DNA, 22 bp, Homo sapiens
aggagctgtcagagtgccagag

SEQ ID NO: 9017143 - DNA, 22 bp, Homo sapiens
aggagctgtcagagtgccagag

SEQ ID NO: 9017144 - DNA, 22 bp, Homo sapiens
aggagctgtcatttgattcaca

SEQ ID NO: 9017145 - DNA, 22 bp, Homo sapiens
aggagctgtgaatgggaggggt

SEQ ID NO: 9017146 - DNA, 22 bp, Homo sapiens
aggagctgtcagagtgccagag

SEQ ID NO: 9017147 - DNA, 22 bp, Homo sapiens
aggagctgtcagagtgccagag

SEQ ID NO: 9017148 - DNA, 22 bp, Homo sapiens
aggagctgtcagagtgccagag

SEQ ID NO: 9017149 - DNA, 22 bp, Homo sapiens
aggagctgtcagagtgccagag

SEQ ID NO: 9017150 - DNA, 22 bp, Homo sapiens
aggagctgtcagagtgccagag

SEQ ID NO: 9017151 - DNA, 22 bp, Homo sapiens
aggaggcctacgcacatgtcta

SEQ ID NO: 9017152 - DNA, 22 bp, Homo sapiens
aggaggcctacgcacatgtcta

SEQ ID NO: 9017153 - DNA, 22 bp, Homo sapiens
aggaggcctacgcacatgtcta

SEQ ID NO: 9017154 - DNA, 22 bp, Homo sapiens
aggaggcctacgcacatgtcta

SEQ ID NO: 9017155 - DNA, 22 bp, Homo sapiens
aggaggccgggattctggagat

SEQ ID NO: 9017156 - DNA, 22 bp, Homo sapiens
aggaggcctctatccagagaga

SEQ ID NO: 9017157 - DNA, 22 bp, Homo sapiens
aggaggcctctatccagagaga

SEQ ID NO: 9017158 - DNA, 23 bp, Homo sapiens
aggaggcctgaaactgaggctga

SEQ ID NO: 9017159 - DNA, 23 bp, Homo sapiens
aggaggcctgaaactgaggctga

SEQ ID NO: 9017160 - DNA, 23 bp, Homo sapiens
aggaggcctgaaactgaggctga

SEQ ID NO: 9017161 - DNA, 22 bp, Homo sapiens
aggaggccgctgatgggctccc

SEQ ID NO: 9017162 - DNA, 22 bp, Homo sapiens
aggaggccgctgatgggctccc

SEQ ID NO: 9017163 - DNA, 22 bp, Homo sapiens
aggaggccgctgatgggctccc

SEQ ID NO: 9017164 - DNA, 22 bp, Homo sapiens
aggaggccgctgatgggctccc

SEQ ID NO: 9017165 - DNA, 22 bp, Homo sapiens
aggaggcagatgcttggctgta

SEQ ID NO: 9017166 - DNA, 22 bp, Homo sapiens
aggagctgtgaatgggaggggt

SEQ ID NO: 9017167 - DNA, 22 bp, Homo sapiens
aggagctgtgaatgggaggggt

SEQ ID NO: 9017168 - DNA, 22 bp, Homo sapiens
aggagctgtgaatgggaggggt

SEQ ID NO: 9017169 - DNA, 22 bp, Homo sapiens
aggagctgtgaatgggaggggt

SEQ ID NO: 9017170 - DNA, 22 bp, Homo sapiens
aggagctgtgaatgggaggggt

SEQ ID NO: 9017171 - DNA, 22 bp, Homo sapiens
aggagctgtgaatgggaggggt

SEQ ID NO: 9017172 - DNA, 22 bp, Homo sapiens
aggaggcagatgcttggctgta

SEQ ID NO: 9017173 - DNA, 22 bp, Homo sapiens
cagtgtggcttagggaataggc

SEQ ID NO: 9017174 - DNA, 22 bp, Homo sapiens
cagtgtgggtttgggaggagta

SEQ ID NO: 9017175 - DNA, 22 bp, Homo sapiens
cagtgtgggtttgggaggagta

SEQ ID NO: 9017176 - DNA, 22 bp, Homo sapiens
cagtgtgggtttgggaggagta

SEQ ID NO: 9017177 - DNA, 22 bp, Homo sapiens
cagtgtggctgagacagaggct

SEQ ID NO: 9017178 - DNA, 22 bp, Homo sapiens
cagtgtggctgagacagaggct

SEQ ID NO: 9017179 - DNA, 22 bp, Homo sapiens
cagtgtggagggagagagcctg

SEQ ID NO: 9017180 - DNA, 22 bp, Homo sapiens
cagtgtggagggagagagcctg

SEQ ID NO: 9017181 - DNA, 22 bp, Homo sapiens
cagtgtggagggagagagcctg

SEQ ID NO: 9017182 - DNA, 22 bp, Homo sapiens
cagtccaggttctttctctaaa

SEQ ID NO: 9017183 - DNA, 22 bp, Homo sapiens
cagtccaggttctttctctaaa

SEQ ID NO: 9017184 - DNA, 22 bp, Homo sapiens
cagtccagtccaatcctcaatg

SEQ ID NO: 9017185 - DNA, 22 bp, Homo sapiens
cagtccagtccaatcctcaatg

SEQ ID NO: 9017186 - DNA, 22 bp, Homo sapiens
cagtggttcctgttcttctggg

SEQ ID NO: 9017187 - DNA, 22 bp, Homo sapiens
cagtggttctcaatcaggaatg

SEQ ID NO: 9017188 - DNA, 22 bp, Homo sapiens
cagtggttcctgttcttctggg

SEQ ID NO: 9017189 - DNA, 22 bp, Homo sapiens
cagtgtgctgcagagaacattt

SEQ ID NO: 9017190 - DNA, 22 bp, Homo sapiens
cagtggttctcaatcaggaatg

SEQ ID NO: 9017191 - DNA, 22 bp, Homo sapiens
cagtccaggcctggaggagcca

SEQ ID NO: 9017192 - DNA, 22 bp, Homo sapiens
cagtccaggcctggaggagcca

SEQ ID NO: 9017193 - DNA, 22 bp, Homo sapiens
cagtccaggcctggaggagcca

SEQ ID NO: 9017194 - DNA, 22 bp, Homo sapiens
cagtccaggcctggaggagcca

SEQ ID NO: 9017195 - DNA, 22 bp, Homo sapiens
cagtccagctcatcagtggcac

SEQ ID NO: 9017196 - DNA, 22 bp, Homo sapiens
cagtccagctcatcagtggcac

SEQ ID NO: 9017197 - DNA, 22 bp, Homo sapiens
cagtccaggcctggaggagcca

SEQ ID NO: 9017198 - DNA, 22 bp, Homo sapiens
cagtccagctcatcagtggcac

SEQ ID NO: 9017199 - DNA, 22 bp, Homo sapiens
cagtccagctcatcagtggcac

SEQ ID NO: 9017200 - DNA, 22 bp, Homo sapiens
cagtccagagcccaccagagga

SEQ ID NO: 9017201 - DNA, 22 bp, Homo sapiens
cagtccagagcccaccagagga

SEQ ID NO: 9017202 - DNA, 22 bp, Homo sapiens
cagtccagagcccaccagagga

SEQ ID NO: 9017203 - DNA, 22 bp, Homo sapiens
cagtccagagtatatccgcttt

SEQ ID NO: 9017204 - DNA, 22 bp, Homo sapiens
cagtccagccagtagggtgtgg

SEQ ID NO: 9017205 - DNA, 22 bp, Homo sapiens
cagtccagccccctgctaaaag

SEQ ID NO: 9017206 - DNA, 22 bp, Homo sapiens
aggagccaggaaacctgctctg

SEQ ID NO: 9017207 - DNA, 22 bp, Homo sapiens
aggagccaggaaacctgctctg

SEQ ID NO: 9017208 - DNA, 22 bp, Homo sapiens
aggagccaggaaacctgctctg

SEQ ID NO: 9017209 - DNA, 23 bp, Homo sapiens
aggagccaggaaccagcttcccc

SEQ ID NO: 9017210 - DNA, 23 bp, Homo sapiens
aggagccaggaaccagcttcccc

SEQ ID NO: 9017211 - DNA, 22 bp, Homo sapiens
aggagccaggccccatggggct

SEQ ID NO: 9017212 - DNA, 22 bp, Homo sapiens
aggagccaggccccatggggct

SEQ ID NO: 9017213 - DNA, 22 bp, Homo sapiens
aggagccaggccccatggggct

SEQ ID NO: 9017214 - DNA, 22 bp, Homo sapiens
aggagccaggccccatggggct

SEQ ID NO: 9017215 - DNA, 22 bp, Homo sapiens
aggagccaggccccatggggct

SEQ ID NO: 9017216 - DNA, 22 bp, Homo sapiens
aggagccagggaagctgctttc

SEQ ID NO: 9017217 - DNA, 22 bp, Homo sapiens
aggagccagggaagctgctttc

SEQ ID NO: 9017218 - DNA, 22 bp, Homo sapiens
aggagccaggccccatggggct

SEQ ID NO: 9017219 - DNA, 23 bp, Homo sapiens
aggagccaggtgcagcccttgtg

SEQ ID NO: 9017220 - DNA, 23 bp, Homo sapiens
aggagccaggtgcagcccttgtg

SEQ ID NO: 9017221 - DNA, 23 bp, Homo sapiens
aggagccaggtgcagcccttgtg

SEQ ID NO: 9017222 - DNA, 23 bp, Homo sapiens
aggagccaggtgcagcccttgtg

SEQ ID NO: 9017223 - DNA, 22 bp, Homo sapiens
aggagccagggaagctgctttc

SEQ ID NO: 9017224 - DNA, 22 bp, Homo sapiens
aggagccagcgttcctcaggat

SEQ ID NO: 9017225 - DNA, 22 bp, Homo sapiens
aggagccagcgttcctcaggat

SEQ ID NO: 9017226 - DNA, 22 bp, Homo sapiens
aggagccagcgttcctcaggat

SEQ ID NO: 9017227 - DNA, 22 bp, Homo sapiens
aggagccagcgttcctcaggat

SEQ ID NO: 9017228 - DNA, 21 bp, Homo sapiens
aggagccagcctgtcagtcta

SEQ ID NO: 9017229 - DNA, 21 bp, Homo sapiens
aggagccagcctgtcagtcta

SEQ ID NO: 9017230 - DNA, 22 bp, Homo sapiens
aggagccagcgttcctcaggat

SEQ ID NO: 9017231 - DNA, 22 bp, Homo sapiens
aggagccagattctctcacttt

SEQ ID NO: 9017232 - DNA, 23 bp, Homo sapiens
aggagccagccctgttctcagta

SEQ ID NO: 9017233 - DNA, 22 bp, Homo sapiens
aggagccagaatccagactcgg

SEQ ID NO: 9017234 - DNA, 22 bp, Homo sapiens
aggagccagaatccagactcgg

SEQ ID NO: 9017235 - DNA, 22 bp, Homo sapiens
aggagccacttaggtgagataa

SEQ ID NO: 9017236 - DNA, 22 bp, Homo sapiens
aggagccagaatccagactcgg

SEQ ID NO: 9017237 - DNA, 22 bp, Homo sapiens
cagtgtggtgagattccaggtg

SEQ ID NO: 9017238 - DNA, 22 bp, Homo sapiens
cagtgtgtgactctgggggtac

SEQ ID NO: 9017239 - DNA, 22 bp, Homo sapiens
cagtgtgtggatcctcccagga

SEQ ID NO: 9017240 - DNA, 22 bp, Homo sapiens
cagtgtgtggatcctcccagga

SEQ ID NO: 9017241 - DNA, 21 bp, Homo sapiens
cagtgtggtgaccagggtctc

SEQ ID NO: 9017242 - DNA, 21 bp, Homo sapiens
cagtgtggtgaccagggtctc

SEQ ID NO: 9017243 - DNA, 21 bp, Homo sapiens
cagtgtggtgaccagggtctc

SEQ ID NO: 9017244 - DNA, 21 bp, Homo sapiens
cagtgtggtgaccagggtctc

SEQ ID NO: 9017245 - DNA, 22 bp, Homo sapiens
cagtgtggtgagattccaggtg

SEQ ID NO: 9017246 - DNA, 22 bp, Homo sapiens
cagtgtggtgagattccaggtg

SEQ ID NO: 9017247 - DNA, 22 bp, Homo sapiens
aggagccacttaggtgagataa

SEQ ID NO: 9017248 - DNA, 22 bp, Homo sapiens
aggagccacttaggtgagataa

SEQ ID NO: 9017249 - DNA, 22 bp, Homo sapiens
aggagccacttaggtgagataa

SEQ ID NO: 9017250 - DNA, 22 bp, Homo sapiens
aggagccacctaggagctgttt

SEQ ID NO: 9017251 - DNA, 22 bp, Homo sapiens
aggagccacctaggagctgttt

SEQ ID NO: 9017252 - DNA, 22 bp, Homo sapiens
cagtgtttaatcattgtgaatt

SEQ ID NO: 9017253 - DNA, 22 bp, Homo sapiens
cagtgtttagatcaagaaggcc

SEQ ID NO: 9017254 - DNA, 22 bp, Homo sapiens
cagtgtttagcacagtgcttgg

SEQ ID NO: 9017255 - DNA, 22 bp, Homo sapiens
cagtgtttagcacagtgcttgg

SEQ ID NO: 9017256 - DNA, 22 bp, Homo sapiens
cagtgttactgggcctgggtgt

SEQ ID NO: 9017257 - DNA, 22 bp, Homo sapiens
cagtgttccctgaacatatgtt

SEQ ID NO: 9017258 - DNA, 22 bp, Homo sapiens
cagtgttccctgaacatatgtt

SEQ ID NO: 9017259 - DNA, 22 bp, Homo sapiens
cagtgtttaatcattgtgaatt

SEQ ID NO: 9017260 - DNA, 22 bp, Homo sapiens
cagtgttgctaagttctgaact

SEQ ID NO: 9017261 - DNA, 22 bp, Homo sapiens
cagtgttgctaagttctgaact

SEQ ID NO: 9017262 - DNA, 21 bp, Homo sapiens
cagtgttgatatttaatacat

SEQ ID NO: 9017263 - DNA, 22 bp, Homo sapiens
cagtgttccctgaacatatgtt

SEQ ID NO: 9017264 - DNA, 22 bp, Homo sapiens
ccactattactgtgtggcagtc

SEQ ID NO: 9017265 - DNA, 22 bp, Homo sapiens
ccactcagaccaacgacccttc

SEQ ID NO: 9017266 - DNA, 22 bp, Homo sapiens
ccactcagcacagtggatgcag

SEQ ID NO: 9017267 - DNA, 22 bp, Homo sapiens
ccactcaggcctcctgctctcc

SEQ ID NO: 9017268 - DNA, 22 bp, Homo sapiens
ccacgctccctgatccctgctt

SEQ ID NO: 9017269 - DNA, 22 bp, Homo sapiens
ccacggccacccgctcatgggc

SEQ ID NO: 9017270 - DNA, 19 bp, Homo sapiens
ccacgaggttagcagccac

SEQ ID NO: 9017271 - DNA, 22 bp, Homo sapiens
ccacggccacccgctcatgggc

SEQ ID NO: 9017272 - DNA, 22 bp, Homo sapiens
ccacggccacccgctcatgggc

SEQ ID NO: 9017273 - DNA, 22 bp, Homo sapiens
ccacgggcagatgtggttggtt

SEQ ID NO: 9017274 - DNA, 23 bp, Homo sapiens
ccacgtctgcactgtagctgttg

SEQ ID NO: 9017275 - DNA, 22 bp, Homo sapiens
ccacgctcatcctctctgagag

SEQ ID NO: 9017276 - DNA, 22 bp, Homo sapiens
ccacgcatccctccacagagag

SEQ ID NO: 9017277 - DNA, 19 bp, Homo sapiens
ccacgaggttagcagccac

SEQ ID NO: 9017278 - DNA, 22 bp, Homo sapiens
ccacgagggaaccaggtggggt

SEQ ID NO: 9017279 - DNA, 22 bp, Homo sapiens
ccacgaggctatcctgctaggg

SEQ ID NO: 9017280 - DNA, 22 bp, Homo sapiens
ccacgaggctatcctgctaggg

SEQ ID NO: 9017281 - DNA, 22 bp, Homo sapiens
ccacgagggaaccaggtggggt

SEQ ID NO: 9017282 - DNA, 22 bp, Homo sapiens
ccacgagggaaccaggtggggt

SEQ ID NO: 9017283 - DNA, 22 bp, Homo sapiens
ccacccagaccagggatctggg

SEQ ID NO: 9017284 - DNA, 22 bp, Homo sapiens
ccacccagaccagggatctggg

SEQ ID NO: 9017285 - DNA, 22 bp, Homo sapiens
ccacccagaccagggatctggg

SEQ ID NO: 9017286 - DNA, 22 bp, Homo sapiens
ccacccagaccagggatctggg

SEQ ID NO: 9017287 - DNA, 22 bp, Homo sapiens
ccacccagaccagggatctggg

SEQ ID NO: 9017288 - DNA, 22 bp, Homo sapiens
ccacccagaccagggatctggg

SEQ ID NO: 9017289 - DNA, 22 bp, Homo sapiens
ccacccagaccagggatctggg

SEQ ID NO: 9017290 - DNA, 22 bp, Homo sapiens
ccacccagcagaggaggcaaga

SEQ ID NO: 9017291 - DNA, 22 bp, Homo sapiens
ccacccagcagaggaggcaaga

SEQ ID NO: 9017292 - DNA, 22 bp, Homo sapiens
ccacccagcagaggaggcaaga

SEQ ID NO: 9017293 - DNA, 22 bp, Homo sapiens
ccacgacgagtcatcagggcga

SEQ ID NO: 9017294 - DNA, 22 bp, Homo sapiens
ccacctggggctgtggcccctt

SEQ ID NO: 9017295 - DNA, 22 bp, Homo sapiens
ccacctggggcctctgagtctc

SEQ ID NO: 9017296 - DNA, 22 bp, Homo sapiens
ccacccagccagatgcaggaag

SEQ ID NO: 9017297 - DNA, 22 bp, Homo sapiens
ccacccagccagatgcaggaag

SEQ ID NO: 9017298 - DNA, 22 bp, Homo sapiens
ccacccagccagatgcaggaag

SEQ ID NO: 9017299 - DNA, 22 bp, Homo sapiens
ccacccagccagatgcaggaag

SEQ ID NO: 9017300 - DNA, 22 bp, Homo sapiens
ccacccagccagatgcaggaag

SEQ ID NO: 9017301 - DNA, 20 bp, Homo sapiens
ccacctggccaaggctgtgc

SEQ ID NO: 9017302 - DNA, 22 bp, Homo sapiens
ccacccacaaccagctggctgt

SEQ ID NO: 9017303 - DNA, 22 bp, Homo sapiens
ccacccagccagatgcaggaag

SEQ ID NO: 9017304 - DNA, 18 bp, Homo sapiens
ccacccagggggagagga

SEQ ID NO: 9017305 - DNA, 22 bp, Homo sapiens
ccacagtggttgtggcatgtgg

SEQ ID NO: 9017306 - DNA, 22 bp, Homo sapiens
ccacagtggttgtggcatgtgg

SEQ ID NO: 9017307 - DNA, 22 bp, Homo sapiens
ccacagtgttctttttaaaatt

SEQ ID NO: 9017308 - DNA, 22 bp, Homo sapiens
ccacagtgtggcataaactgta

SEQ ID NO: 9017309 - DNA, 22 bp, Homo sapiens
ccacagtgtggcataaactgta

SEQ ID NO: 9017310 - DNA, 22 bp, Homo sapiens
ccacagtggttctcaaccaggg

SEQ ID NO: 9017311 - DNA, 22 bp, Homo sapiens
ccacagtggttctcaaccaggg

SEQ ID NO: 9017312 - DNA, 22 bp, Homo sapiens
ccacagtgggcacagcaggact

SEQ ID NO: 9017313 - DNA, 22 bp, Homo sapiens
ccacagtgggcacagcaggact

SEQ ID NO: 9017314 - DNA, 20 bp, Homo sapiens
ccacagtggagactggagac

SEQ ID NO: 9017315 - DNA, 22 bp, Homo sapiens
ccacagtgggcacagcaggact

SEQ ID NO: 9017316 - DNA, 22 bp, Homo sapiens
ccacagtgttttgtcacattag

SEQ ID NO: 9017317 - DNA, 22 bp, Homo sapiens
ccacagtgttttgtcacattag

SEQ ID NO: 9017318 - DNA, 22 bp, Homo sapiens
ccacagtgttttgtcacattag

SEQ ID NO: 9017319 - DNA, 22 bp, Homo sapiens
ccacagttattcatttgtgaca

SEQ ID NO: 9017320 - DNA, 22 bp, Homo sapiens
ccacagttattcatttgtgaca

SEQ ID NO: 9017321 - DNA, 23 bp, Homo sapiens
ccacagttcatcgttcactcacc

SEQ ID NO: 9017322 - DNA, 22 bp, Homo sapiens
ccacagtttaggaagtcactct

SEQ ID NO: 9017323 - DNA, 22 bp, Homo sapiens
ccacagtttcttcatctataaa

SEQ ID NO: 9017324 - DNA, 22 bp, Homo sapiens
ccacagtttcttcatctataaa

SEQ ID NO: 9017325 - DNA, 21 bp, Homo sapiens
ccacagttctggcaagggctg

SEQ ID NO: 9017326 - DNA, 22 bp, Homo sapiens
ccacagtttgccagccaggaat

SEQ ID NO: 9017327 - DNA, 22 bp, Homo sapiens
ccacatctaagccttcatgata

SEQ ID NO: 9017328 - DNA, 22 bp, Homo sapiens
ccacatcagaaatgtttactca

SEQ ID NO: 9017329 - DNA, 22 bp, Homo sapiens
ccaccaggctctgtccgagcgg

SEQ ID NO: 9017330 - DNA, 21 bp, Homo sapiens
ccaccaggtcttctgctcggg

SEQ ID NO: 9017331 - DNA, 22 bp, Homo sapiens
ccaccaggcactcacagggaag

SEQ ID NO: 9017332 - DNA, 22 bp, Homo sapiens
ccaccaggcactcacagggaag

SEQ ID NO: 9017333 - DNA, 21 bp, Homo sapiens
ccaccaggtcttctgctcggg

SEQ ID NO: 9017334 - DNA, 22 bp, Homo sapiens
ccaccatgggaagagagactaa

SEQ ID NO: 9017335 - DNA, 21 bp, Homo sapiens
ccaccaggtcttctgctcggg

SEQ ID NO: 9017336 - DNA, 21 bp, Homo sapiens
ccaccaggtcttctgctcggg

SEQ ID NO: 9017337 - DNA, 21 bp, Homo sapiens
ccaccaggtcttctgctcggg

SEQ ID NO: 9017338 - DNA, 22 bp, Homo sapiens
ccaccattcaaggtcttcacag

SEQ ID NO: 9017339 - DNA, 22 bp, Homo sapiens
ccaccattatatctcccatgcc

SEQ ID NO: 9017340 - DNA, 22 bp, Homo sapiens
ccacccacaaccagctggctgt

SEQ ID NO: 9017341 - DNA, 20 bp, Homo sapiens
ccacccacgcgggctctgcc

SEQ ID NO: 9017342 - DNA, 22 bp, Homo sapiens
catttctgttctcttcctgtac

SEQ ID NO: 9017343 - DNA, 22 bp, Homo sapiens
catttgaaacctggaatctacc

SEQ ID NO: 9017344 - DNA, 22 bp, Homo sapiens
catttgaaacctggaatctacc

SEQ ID NO: 9017345 - DNA, 22 bp, Homo sapiens
ccaatgagacagaaagagcctc

SEQ ID NO: 9017346 - DNA, 22 bp, Homo sapiens
ccaatgaatatatttcatatga

SEQ ID NO: 9017347 - DNA, 22 bp, Homo sapiens
ccaatgagaggtatcagatcct

SEQ ID NO: 9017348 - DNA, 22 bp, Homo sapiens
ccaatgaaaggtcaattctata

SEQ ID NO: 9017349 - DNA, 22 bp, Homo sapiens
ccaatgaaaggtcaattctata

SEQ ID NO: 9017350 - DNA, 22 bp, Homo sapiens
ccaatgaaaggtcaattctata

SEQ ID NO: 9017351 - DNA, 22 bp, Homo sapiens
ccaatgaatatatttcatatga

SEQ ID NO: 9017352 - DNA, 22 bp, Homo sapiens
catttctgtcacgttcttttat

SEQ ID NO: 9017353 - DNA, 22 bp, Homo sapiens
catttctgtcacgttcttttat

SEQ ID NO: 9017354 - DNA, 22 bp, Homo sapiens
catttctgtcacgttcttttat

SEQ ID NO: 9017355 - DNA, 22 bp, Homo sapiens
catttctgtgacacttccatct

SEQ ID NO: 9017356 - DNA, 22 bp, Homo sapiens
catttctgttctcttcctgtac

SEQ ID NO: 9017357 - DNA, 22 bp, Homo sapiens
catttctgggagacatgctaga

SEQ ID NO: 9017358 - DNA, 23 bp, Homo sapiens
catttctgggagatttataaaat

SEQ ID NO: 9017359 - DNA, 22 bp, Homo sapiens
ccacagaattctgtctccagga

SEQ ID NO: 9017360 - DNA, 22 bp, Homo sapiens
ccacagaattctgtctccagga

SEQ ID NO: 9017361 - DNA, 22 bp, Homo sapiens
ccacagaatgatgacacttcag

SEQ ID NO: 9017362 - DNA, 22 bp, Homo sapiens
ccacagaatgatgacacttcag

SEQ ID NO: 9017363 - DNA, 22 bp, Homo sapiens
ccacagaccttggcttccacct

SEQ ID NO: 9017364 - DNA, 22 bp, Homo sapiens
ccacagaccttggcttccacct

SEQ ID NO: 9017365 - DNA, 22 bp, Homo sapiens
ccacagagacagagcccagggt

SEQ ID NO: 9017366 - DNA, 22 bp, Homo sapiens
ccacagagacagggtccttgct

SEQ ID NO: 9017367 - DNA, 22 bp, Homo sapiens
ccacagagacagggtccttgct

SEQ ID NO: 9017368 - DNA, 22 bp, Homo sapiens
ccacagagacagagcccagggt

SEQ ID NO: 9017369 - DNA, 22 bp, Homo sapiens
ccacagagacagagcccagggt

SEQ ID NO: 9017370 - DNA, 22 bp, Homo sapiens
ccacagagacagagcccagggt

SEQ ID NO: 9017371 - DNA, 22 bp, Homo sapiens
ccacagagactctgcaggactg

SEQ ID NO: 9017372 - DNA, 22 bp, Homo sapiens
ccacagagactctgcaggactg

SEQ ID NO: 9017373 - DNA, 22 bp, Homo sapiens
ccacagagactctgcaggactg

SEQ ID NO: 9017374 - DNA, 19 bp, Homo sapiens
ccacagagactagaagaca

SEQ ID NO: 9017375 - DNA, 19 bp, Homo sapiens
ccacagagactagaagaca

SEQ ID NO: 9017376 - DNA, 22 bp, Homo sapiens
ccacagagacagggtccttgct

SEQ ID NO: 9017377 - DNA, 19 bp, Homo sapiens
ccacagagcatgctgaggc

SEQ ID NO: 9017378 - DNA, 22 bp, Homo sapiens
ccacagagactctgcaggactg

SEQ ID NO: 9017379 - DNA, 22 bp, Homo sapiens
ccacagagactctgcaggactg

SEQ ID NO: 9017380 - DNA, 22 bp, Homo sapiens
ccacagagagtgtcagcctttg

SEQ ID NO: 9017381 - DNA, 20 bp, Homo sapiens
ccacagtggagactggagac

SEQ ID NO: 9017382 - DNA, 20 bp, Homo sapiens
ccacagtggagactggagac

SEQ ID NO: 9017383 - DNA, 22 bp, Homo sapiens
ccacagtgcctggaattctgca

SEQ ID NO: 9017384 - DNA, 22 bp, Homo sapiens
ccacagtgcctggaattctgca

SEQ ID NO: 9017385 - DNA, 22 bp, Homo sapiens
ccacaggcggagtggcgggcag

SEQ ID NO: 9017386 - DNA, 23 bp, Homo sapiens
ccacaggcacagaggcttgcatc

SEQ ID NO: 9017387 - DNA, 23 bp, Homo sapiens
ccacaggcacagaggcttgcatc

SEQ ID NO: 9017388 - DNA, 23 bp, Homo sapiens
ccacaggcacagaggcttgcatc

SEQ ID NO: 9017389 - DNA, 23 bp, Homo sapiens
ccacaggcacagaggcttgcatc

SEQ ID NO: 9017390 - DNA, 18 bp, Homo sapiens
aggcaggatcctggcctc

SEQ ID NO: 9017391 - DNA, 18 bp, Homo sapiens
aggcaggatcctggcctc

SEQ ID NO: 9017392 - DNA, 18 bp, Homo sapiens
aggcaggatcctggcctc

SEQ ID NO: 9017393 - DNA, 18 bp, Homo sapiens
aggcaggatcctggcctc

SEQ ID NO: 9017394 - DNA, 18 bp, Homo sapiens
aggcaggatcctggcctc

SEQ ID NO: 9017395 - DNA, 22 bp, Homo sapiens
aggcaggagtgaccctgacagg

SEQ ID NO: 9017396 - DNA, 22 bp, Homo sapiens
aggcaggagtgaccctgacagg

SEQ ID NO: 9017397 - DNA, 22 bp, Homo sapiens
aggcaggagtgaccctgacagg

SEQ ID NO: 9017398 - DNA, 22 bp, Homo sapiens
aggcaggagtgaccctgacagg

SEQ ID NO: 9017399 - DNA, 22 bp, Homo sapiens
aggcaggaggatcatggatgca

SEQ ID NO: 9017400 - DNA, 22 bp, Homo sapiens
aggcaggaggatcatggatgca

SEQ ID NO: 9017401 - DNA, 22 bp, Homo sapiens
aggcaggaggatcatggatgca

SEQ ID NO: 9017402 - DNA, 22 bp, Homo sapiens
aggcaggagcaagccctacaag

SEQ ID NO: 9017403 - DNA, 22 bp, Homo sapiens
aggcaggagcaagccctacaag

SEQ ID NO: 9017404 - DNA, 22 bp, Homo sapiens
aggcaggagcaagccctacaag

SEQ ID NO: 9017405 - DNA, 17 bp, Homo sapiens
aggcaggagattggaga

SEQ ID NO: 9017406 - DNA, 17 bp, Homo sapiens
aggcaggagattggaga

SEQ ID NO: 9017407 - DNA, 17 bp, Homo sapiens
aggcaggagattggaga

SEQ ID NO: 9017408 - DNA, 22 bp, Homo sapiens
aggcaggaaaatcgcttgaacc

SEQ ID NO: 9017409 - DNA, 22 bp, Homo sapiens
aggcaggaaccctgtgtgcgcc

SEQ ID NO: 9017410 - DNA, 23 bp, Homo sapiens
ccacagagctgccaattcctgtg

SEQ ID NO: 9017411 - DNA, 22 bp, Homo sapiens
ccacagagcattagatttcaga

SEQ ID NO: 9017412 - DNA, 19 bp, Homo sapiens
ccacagagcatgctgaggc

SEQ ID NO: 9017413 - DNA, 19 bp, Homo sapiens
ccacagagcatgctgaggc

SEQ ID NO: 9017414 - DNA, 22 bp, Homo sapiens
catttattggttaggccagcag

SEQ ID NO: 9017415 - DNA, 22 bp, Homo sapiens
catttattggttaggccagcag

SEQ ID NO: 9017416 - DNA, 22 bp, Homo sapiens
catttattggcatgtagtaggt

SEQ ID NO: 9017417 - DNA, 22 bp, Homo sapiens
catttcaaacagttacagctgc

SEQ ID NO: 9017418 - DNA, 22 bp, Homo sapiens
catttcaaacagttacagctgc

SEQ ID NO: 9017419 - DNA, 22 bp, Homo sapiens
catttcaaaagaattgccagaa

SEQ ID NO: 9017420 - DNA, 22 bp, Homo sapiens
catttcaaaagaattgccagaa

SEQ ID NO: 9017421 - DNA, 23 bp, Homo sapiens
catttcaacgaattttccttctg

SEQ ID NO: 9017422 - DNA, 22 bp, Homo sapiens
catttcaagcattgacttctat

SEQ ID NO: 9017423 - DNA, 23 bp, Homo sapiens
catttcaacgaattttccttctg

SEQ ID NO: 9017424 - DNA, 21 bp, Homo sapiens
catttcaaagagctggaaatc

SEQ ID NO: 9017425 - DNA, 21 bp, Homo sapiens
catttcaaagagctggaaatc

SEQ ID NO: 9017426 - DNA, 22 bp, Homo sapiens
catttcaagtaacagattgctt

SEQ ID NO: 9017427 - DNA, 22 bp, Homo sapiens
catttcaagtaacagattgctt

SEQ ID NO: 9017428 - DNA, 22 bp, Homo sapiens
catttcaagtaacagattgctt

SEQ ID NO: 9017429 - DNA, 22 bp, Homo sapiens
catttcaaggaccaccctggga

SEQ ID NO: 9017430 - DNA, 22 bp, Homo sapiens
catttcaagcattgacttctat

SEQ ID NO: 9017431 - DNA, 22 bp, Homo sapiens
catttcaagcattgacttctat

SEQ ID NO: 9017432 - DNA, 22 bp, Homo sapiens
catttcaatacagtttgtaaat

SEQ ID NO: 9017433 - DNA, 22 bp, Homo sapiens
catttcaatactatctgagaat

SEQ ID NO: 9017434 - DNA, 22 bp, Homo sapiens
catttcaatgccttcaacatag

SEQ ID NO: 9017435 - DNA, 22 bp, Homo sapiens
catttcaatgccttcaacatag

SEQ ID NO: 9017436 - DNA, 22 bp, Homo sapiens
catttcaatactatctgagaat

SEQ ID NO: 9017437 - DNA, 22 bp, Homo sapiens
catttcaattatttgctcttct

SEQ ID NO: 9017438 - DNA, 22 bp, Homo sapiens
catttcaatgccttcaacatag

SEQ ID NO: 9017439 - DNA, 22 bp, Homo sapiens
catttcaatgccttcaacatag

SEQ ID NO: 9017440 - DNA, 22 bp, Homo sapiens
catttcaatgccttcaacatag

SEQ ID NO: 9017441 - DNA, 22 bp, Homo sapiens
catttcaatgccttcaacatag

SEQ ID NO: 9017442 - DNA, 22 bp, Homo sapiens
catttcaatgccttcaacatag

SEQ ID NO: 9017443 - DNA, 22 bp, Homo sapiens
catttcacacataaacttgggt

SEQ ID NO: 9017444 - DNA, 22 bp, Homo sapiens
catttcaattatttgctcttct

SEQ ID NO: 9017445 - DNA, 22 bp, Homo sapiens
catttctcataatattagcact

SEQ ID NO: 9017446 - DNA, 22 bp, Homo sapiens
catttctcataatattagcact

SEQ ID NO: 9017447 - DNA, 22 bp, Homo sapiens
catttctcataatattagcact

SEQ ID NO: 9017448 - DNA, 22 bp, Homo sapiens
catttctccgccgagatcactg

SEQ ID NO: 9017449 - DNA, 22 bp, Homo sapiens
catttctgattacagaatacta

SEQ ID NO: 9017450 - DNA, 22 bp, Homo sapiens
catttctgattacagaatacta

SEQ ID NO: 9017451 - DNA, 22 bp, Homo sapiens
catttctccgccgagatcactg

SEQ ID NO: 9017452 - DNA, 22 bp, Homo sapiens
catttctcctgggtgataaatt

SEQ ID NO: 9017453 - DNA, 22 bp, Homo sapiens
aggcactgttcccagttatcct

SEQ ID NO: 9017454 - DNA, 22 bp, Homo sapiens
aggcactgttcccagttatcct

SEQ ID NO: 9017455 - DNA, 22 bp, Homo sapiens
aggcactgtgggtgtggccgga

SEQ ID NO: 9017456 - DNA, 22 bp, Homo sapiens
aggcactgtgggtgtggccgga

SEQ ID NO: 9017457 - DNA, 22 bp, Homo sapiens
aggcactgtgggtgtggccgga

SEQ ID NO: 9017458 - DNA, 20 bp, Homo sapiens
aggcactgttgtctgtatcc

SEQ ID NO: 9017459 - DNA, 20 bp, Homo sapiens
aggcactgttgtctgtatcc

SEQ ID NO: 9017460 - DNA, 20 bp, Homo sapiens
aggcactgttgtctgtatcc

SEQ ID NO: 9017461 - DNA, 21 bp, Homo sapiens
aggcactgtttgtggtttggg

SEQ ID NO: 9017462 - DNA, 21 bp, Homo sapiens
aggcacttaaccaatgttagc

SEQ ID NO: 9017463 - DNA, 21 bp, Homo sapiens
aggcactgtttgtggtttggg

SEQ ID NO: 9017464 - DNA, 21 bp, Homo sapiens
aggcactgtttgtggtttggg

SEQ ID NO: 9017465 - DNA, 20 bp, Homo sapiens
cattggacttggcttcatgg

SEQ ID NO: 9017466 - DNA, 22 bp, Homo sapiens
cattggaatgatcgttttgctg

SEQ ID NO: 9017467 - DNA, 22 bp, Homo sapiens
cattggcacaagtagcttcatc

SEQ ID NO: 9017468 - DNA, 22 bp, Homo sapiens
cattggaagacatatcatgcta

SEQ ID NO: 9017469 - DNA, 22 bp, Homo sapiens
cattggcacctcacaggataga

SEQ ID NO: 9017470 - DNA, 22 bp, Homo sapiens
cattggaatgcatttgaagaga

SEQ ID NO: 9017471 - DNA, 20 bp, Homo sapiens
cattggcattcacagaagct

SEQ ID NO: 9017472 - DNA, 22 bp, Homo sapiens
cattggccttttatcctagagg

SEQ ID NO: 9017473 - DNA, 22 bp, Homo sapiens
cattgtaagctgttgaatcctc

SEQ ID NO: 9017474 - DNA, 22 bp, Homo sapiens
cattggtttgatattgccatgg

SEQ ID NO: 9017475 - DNA, 22 bp, Homo sapiens
catttattggcatgtagtaggt

SEQ ID NO: 9017476 - DNA, 22 bp, Homo sapiens
aggcactttaggatcaggttga

SEQ ID NO: 9017477 - DNA, 22 bp, Homo sapiens
aggcactttacaatgtgtgaca

SEQ ID NO: 9017478 - DNA, 22 bp, Homo sapiens
aggcactttacaatgtgtgaca

SEQ ID NO: 9017479 - DNA, 22 bp, Homo sapiens
aggcacttgtaattgcagtcat

SEQ ID NO: 9017480 - DNA, 22 bp, Homo sapiens
aggcacttgtaattgcagtcat

SEQ ID NO: 9017481 - DNA, 22 bp, Homo sapiens
aggcacttggaggtctctgccc

SEQ ID NO: 9017482 - DNA, 22 bp, Homo sapiens
aggcacttgaattgatgatgtt

SEQ ID NO: 9017483 - DNA, 22 bp, Homo sapiens
aggcacttgattaatgtgaatt

SEQ ID NO: 9017484 - DNA, 22 bp, Homo sapiens
aggcacttgattaatgtgaatt

SEQ ID NO: 9017485 - DNA, 22 bp, Homo sapiens
aggcacttgcattgatgaggtc

SEQ ID NO: 9017486 - DNA, 22 bp, Homo sapiens
aggcacttgcattgatgaggtc

SEQ ID NO: 9017487 - DNA, 22 bp, Homo sapiens
aggcacttggaggtctctgccc

SEQ ID NO: 9017488 - DNA, 22 bp, Homo sapiens
aggcacttgcattgatgaggtc

SEQ ID NO: 9017489 - DNA, 22 bp, Homo sapiens
aggcacttgcattgatgaggtc

SEQ ID NO: 9017490 - DNA, 22 bp, Homo sapiens
aggcacttgcattgatgaggtc

SEQ ID NO: 9017491 - DNA, 22 bp, Homo sapiens
aggcacttaacctactaactga

SEQ ID NO: 9017492 - DNA, 22 bp, Homo sapiens
aggcacttaacctactaactga

SEQ ID NO: 9017493 - DNA, 22 bp, Homo sapiens
aggcacttaataaggattcaat

SEQ ID NO: 9017494 - DNA, 22 bp, Homo sapiens
aggcacttcatgggttcaagga

SEQ ID NO: 9017495 - DNA, 22 bp, Homo sapiens
aggcaactgagaggcccgtgtt

SEQ ID NO: 9017496 - DNA, 22 bp, Homo sapiens
aggcaactgtttgataatgttg

SEQ ID NO: 9017497 - DNA, 22 bp, Homo sapiens
aggcaagaaactttctgggaga

SEQ ID NO: 9017498 - DNA, 22 bp, Homo sapiens
aggcaacttttggggatgatgg

SEQ ID NO: 9017499 - DNA, 22 bp, Homo sapiens
aggcaacttgaccaggctttct

SEQ ID NO: 9017500 - DNA, 22 bp, Homo sapiens
aggcaactctgaccttatgaag

SEQ ID NO: 9017501 - DNA, 22 bp, Homo sapiens
aggcaactgacagtttctgctt

SEQ ID NO: 9017502 - DNA, 22 bp, Homo sapiens
aggcaactgacagcatatcctg

SEQ ID NO: 9017503 - DNA, 17 bp, Homo sapiens
aggcaactagttccctc

SEQ ID NO: 9017504 - DNA, 22 bp, Homo sapiens
aggcaactcatcatgaaagact

SEQ ID NO: 9017505 - DNA, 22 bp, Homo sapiens
aggcaactcatcatgaaagact

SEQ ID NO: 9017506 - DNA, 20 bp, Homo sapiens
aggcaactcaagtttttgcc

SEQ ID NO: 9017507 - DNA, 22 bp, Homo sapiens
aggcaagaacagacatgggagt

SEQ ID NO: 9017508 - DNA, 22 bp, Homo sapiens
aggcaagaacagacatgggagt

SEQ ID NO: 9017509 - DNA, 22 bp, Homo sapiens
aggcaagaacagacatgggagt

SEQ ID NO: 9017510 - DNA, 22 bp, Homo sapiens
aggcaagaacagacatgggagt

SEQ ID NO: 9017511 - DNA, 22 bp, Homo sapiens
aggcaagaacagacatgggagt

SEQ ID NO: 9017512 - DNA, 22 bp, Homo sapiens
aggcaagaacagacatgggagt

SEQ ID NO: 9017513 - DNA, 22 bp, Homo sapiens
aggcaagaaactttctgggaga

SEQ ID NO: 9017514 - DNA, 22 bp, Homo sapiens
aggcaagaaactttctgggaga

SEQ ID NO: 9017515 - DNA, 22 bp, Homo sapiens
aggcaagaaactttctgggaga

SEQ ID NO: 9017516 - DNA, 22 bp, Homo sapiens
aggcaagaacagacatgggagt

SEQ ID NO: 9017517 - DNA, 22 bp, Homo sapiens
aggcaagaccagaaagggctga

SEQ ID NO: 9017518 - DNA, 22 bp, Homo sapiens
aggcaagattaggaccagaaga

SEQ ID NO: 9017519 - DNA, 23 bp, Homo sapiens
aggcaagggtgtaaaggaaatga

SEQ ID NO: 9017520 - DNA, 22 bp, Homo sapiens
aggcaaggaagaattctcccct

SEQ ID NO: 9017521 - DNA, 22 bp, Homo sapiens
aggcaagcttgaaattggctct

SEQ ID NO: 9017522 - DNA, 22 bp, Homo sapiens
aggcaaggaagaattctcccct

SEQ ID NO: 9017523 - DNA, 22 bp, Homo sapiens
aggcaaggaagaattctcccct

SEQ ID NO: 9017524 - DNA, 22 bp, Homo sapiens
aggcaagggggcgccaccttcc

SEQ ID NO: 9017525 - DNA, 20 bp, Homo sapiens
aggcaaggtagatgtctgct

SEQ ID NO: 9017526 - DNA, 20 bp, Homo sapiens
aggcaaggtagatgtctgct

SEQ ID NO: 9017527 - DNA, 20 bp, Homo sapiens
aggcaaggtagatgtctgct

SEQ ID NO: 9017528 - DNA, 20 bp, Homo sapiens
aggcaaggtagatgtctgct

SEQ ID NO: 9017529 - DNA, 22 bp, Homo sapiens
aggcaaggtgctacagacagtg

SEQ ID NO: 9017530 - DNA, 23 bp, Homo sapiens
aggcaagggtgtaaaggaaatga

SEQ ID NO: 9017531 - DNA, 20 bp, Homo sapiens
aggcaaggtagatgtctgct

SEQ ID NO: 9017532 - DNA, 22 bp, Homo sapiens
aggcaagccgtgcctgtctcaa

SEQ ID NO: 9017533 - DNA, 22 bp, Homo sapiens
aggcaagcccccagtgaggctc

SEQ ID NO: 9017534 - DNA, 22 bp, Homo sapiens
aggcaagcccaggcacttggag

SEQ ID NO: 9017535 - DNA, 22 bp, Homo sapiens
aggcaagcattgggaacagggc

SEQ ID NO: 9017536 - DNA, 22 bp, Homo sapiens
aggcaagcaccgggggcctttt

SEQ ID NO: 9017537 - DNA, 22 bp, Homo sapiens
aggcaagcagtcagtctatgag

SEQ ID NO: 9017538 - DNA, 22 bp, Homo sapiens
aggcaagattaggaccagaaga

SEQ ID NO: 9017539 - DNA, 22 bp, Homo sapiens
aggcaagattaggaccagaaga

SEQ ID NO: 9017540 - DNA, 22 bp, Homo sapiens
aggcaagttattggctcagagc

SEQ ID NO: 9017541 - DNA, 22 bp, Homo sapiens
aggcaatcccctgaggatactt

SEQ ID NO: 9017542 - DNA, 22 bp, Homo sapiens
cattccttaacgtggggagtct

SEQ ID NO: 9017543 - DNA, 22 bp, Homo sapiens
cattccttaacgtggggagtct

SEQ ID NO: 9017544 - DNA, 17 bp, Homo sapiens
aggcaatgactgtggtt

SEQ ID NO: 9017545 - DNA, 22 bp, Homo sapiens
aggcaaggtgctcttgctctat

SEQ ID NO: 9017546 - DNA, 22 bp, Homo sapiens
aggcaagtgcattagaagagca

SEQ ID NO: 9017547 - DNA, 22 bp, Homo sapiens
aggcaaggtgctacagacagtg

SEQ ID NO: 9017548 - DNA, 22 bp, Homo sapiens
aggcaaggtgctcttgctctat

SEQ ID NO: 9017549 - DNA, 22 bp, Homo sapiens
aggcaaggtgctacagacagtg

SEQ ID NO: 9017550 - DNA, 22 bp, Homo sapiens
aggcaaggtgctacagacagtg

SEQ ID NO: 9017551 - DNA, 22 bp, Homo sapiens
aggcaaggtgctacagacagtg

SEQ ID NO: 9017552 - DNA, 22 bp, Homo sapiens
aggcaaggtgctacagacagtg

SEQ ID NO: 9017553 - DNA, 22 bp, Homo sapiens
aggcaaggtgctacagacagtg

SEQ ID NO: 9017554 - DNA, 22 bp, Homo sapiens
aggcaaggtgctacagacagtg

SEQ ID NO: 9017555 - DNA, 22 bp, Homo sapiens
cattgcttgatagctgaaaatt

SEQ ID NO: 9017556 - DNA, 22 bp, Homo sapiens
cattgcttgatagctgaaaatt

SEQ ID NO: 9017557 - DNA, 22 bp, Homo sapiens
cattgctttgtgcatatttaaa

SEQ ID NO: 9017558 - DNA, 22 bp, Homo sapiens
cattggaaaatgcatgcttttt

SEQ ID NO: 9017559 - DNA, 22 bp, Homo sapiens
cattgctgtagtccagatgagg

SEQ ID NO: 9017560 - DNA, 22 bp, Homo sapiens
cattgctgttaattgtctctag

SEQ ID NO: 9017561 - DNA, 22 bp, Homo sapiens
cattgctgcttccaggcacagg

SEQ ID NO: 9017562 - DNA, 22 bp, Homo sapiens
cattgcttatttcagctaaagt

SEQ ID NO: 9017563 - DNA, 22 bp, Homo sapiens
cattgcttatctagttcacata

SEQ ID NO: 9017564 - DNA, 20 bp, Homo sapiens
cattgcatatttcattgagg

SEQ ID NO: 9017565 - DNA, 22 bp, Homo sapiens
cattgcctcggagcctgttatg

SEQ ID NO: 9017566 - DNA, 20 bp, Homo sapiens
cattgcaggcagagtaagtg

SEQ ID NO: 9017567 - DNA, 22 bp, Homo sapiens
cattgcagtaatctggtgaaat

SEQ ID NO: 9017568 - DNA, 21 bp, Homo sapiens
cattgcagttttctctaagtt

SEQ ID NO: 9017569 - DNA, 22 bp, Homo sapiens
cattgcagtaatctggtgaaat

SEQ ID NO: 9017570 - DNA, 19 bp, Homo sapiens
cattcctttgtctgccaaa

SEQ ID NO: 9017571 - DNA, 19 bp, Homo sapiens
cattcctttgtctgccaaa

SEQ ID NO: 9017572 - DNA, 22 bp, Homo sapiens
cattccttaacgtggggagtct

SEQ ID NO: 9017573 - DNA, 22 bp, Homo sapiens
cattgcaggagagtaaataaaa

SEQ ID NO: 9017574 - DNA, 22 bp, Homo sapiens
cattgcaggagagtaaataaaa

SEQ ID NO: 9017575 - DNA, 22 bp, Homo sapiens
cattctgagtcactctttagca

SEQ ID NO: 9017576 - DNA, 22 bp, Homo sapiens
cattctgcgatcctcaagcaca

SEQ ID NO: 9017577 - DNA, 22 bp, Homo sapiens
cattctgggtctggctcaggga

SEQ ID NO: 9017578 - DNA, 22 bp, Homo sapiens
cattctgaccctatgatttaag

SEQ ID NO: 9017579 - DNA, 22 bp, Homo sapiens
cattctgaccctatgatttaag

SEQ ID NO: 9017580 - DNA, 22 bp, Homo sapiens
cattctctgatcttcacatacc

SEQ ID NO: 9017581 - DNA, 22 bp, Homo sapiens
cattctctgatcttcacatacc

SEQ ID NO: 9017582 - DNA, 22 bp, Homo sapiens
cattctctgatcttcacatacc

SEQ ID NO: 9017583 - DNA, 22 bp, Homo sapiens
cattctctgatcttcacatacc

SEQ ID NO: 9017584 - DNA, 22 bp, Homo sapiens
cattctcttgacaggacagccc

SEQ ID NO: 9017585 - DNA, 22 bp, Homo sapiens
cattcttacacaatattttaat

SEQ ID NO: 9017586 - DNA, 22 bp, Homo sapiens
cattcttacacaatattttaat

SEQ ID NO: 9017587 - DNA, 17 bp, Homo sapiens
cattctgtaatctttct

SEQ ID NO: 9017588 - DNA, 17 bp, Homo sapiens
cattctgtaatctttct

SEQ ID NO: 9017589 - DNA, 22 bp, Homo sapiens
cattctgacagctgaggtcgtg

SEQ ID NO: 9017590 - DNA, 22 bp, Homo sapiens
cattctgggtctggctcaggga

SEQ ID NO: 9017591 - DNA, 22 bp, Homo sapiens
cattcttctggatagttagttg

SEQ ID NO: 9017592 - DNA, 22 bp, Homo sapiens
cattcttatatttactcattca

SEQ ID NO: 9017593 - DNA, 22 bp, Homo sapiens
cattcttatatttactcattca

SEQ ID NO: 9017594 - DNA, 22 bp, Homo sapiens
tcccacccatcctgcatctctt

SEQ ID NO: 9017595 - DNA, 22 bp, Homo sapiens
tcccaccaggtgaccatttcat

SEQ ID NO: 9017596 - DNA, 22 bp, Homo sapiens
tcccaccaggtgaccatttcat

SEQ ID NO: 9017597 - DNA, 22 bp, Homo sapiens
tcccacccatcctgcatctctt

SEQ ID NO: 9017598 - DNA, 22 bp, Homo sapiens
tcccacccatcctgcatctctt

SEQ ID NO: 9017599 - DNA, 22 bp, Homo sapiens
tcccacccatcctgcatctctt

SEQ ID NO: 9017600 - DNA, 22 bp, Homo sapiens
tcccacccatcctgcatctctt

SEQ ID NO: 9017601 - DNA, 22 bp, Homo sapiens
tcccacccatcctgcatctctt

SEQ ID NO: 9017602 - DNA, 22 bp, Homo sapiens
cattcttgcaccgtgatggctt

SEQ ID NO: 9017603 - DNA, 22 bp, Homo sapiens
cattcttctcccttaccttcca

SEQ ID NO: 9017604 - DNA, 22 bp, Homo sapiens
cattcttctggatagttagttg

SEQ ID NO: 9017605 - DNA, 22 bp, Homo sapiens
tcccacattaccctgactgaca

SEQ ID NO: 9017606 - DNA, 22 bp, Homo sapiens
tcccaccaggtgaccatttcat

SEQ ID NO: 9017607 - DNA, 22 bp, Homo sapiens
tcccaccccggtcaagggctga

SEQ ID NO: 9017608 - DNA, 22 bp, Homo sapiens
tcccaccccggtcaagggctga

SEQ ID NO: 9017609 - DNA, 22 bp, Homo sapiens
tcccaccccttgactctttaag

SEQ ID NO: 9017610 - DNA, 22 bp, Homo sapiens
tcccaccccttgactctttaag

SEQ ID NO: 9017611 - DNA, 22 bp, Homo sapiens
tcccaccccttgactctttaag

SEQ ID NO: 9017612 - DNA, 22 bp, Homo sapiens
tcccaccccttgactctttaag

SEQ ID NO: 9017613 - DNA, 22 bp, Homo sapiens
tcccaccttccgtggaacccgt

SEQ ID NO: 9017614 - DNA, 22 bp, Homo sapiens
tcccaccccctccaaggaggaa

SEQ ID NO: 9017615 - DNA, 22 bp, Homo sapiens
tcccaccccctccaaggaggaa

SEQ ID NO: 9017616 - DNA, 22 bp, Homo sapiens
tcccaccccctccaaggaggaa

SEQ ID NO: 9017617 - DNA, 22 bp, Homo sapiens
tcccaccccctccaaggaggaa

SEQ ID NO: 9017618 - DNA, 22 bp, Homo sapiens
tcccaccccctccaaggaggaa

SEQ ID NO: 9017619 - DNA, 22 bp, Homo sapiens
tcccaccccggtcaagggctga

SEQ ID NO: 9017620 - DNA, 22 bp, Homo sapiens
tcccaccccggtcaagggctga

SEQ ID NO: 9017621 - DNA, 22 bp, Homo sapiens
tcccaccccggtcaagggctga

SEQ ID NO: 9017622 - DNA, 22 bp, Homo sapiens
cattacatttcaaaatgtttcc

SEQ ID NO: 9017623 - DNA, 22 bp, Homo sapiens
cattacttctcatgcttcatgc

SEQ ID NO: 9017624 - DNA, 22 bp, Homo sapiens
cattacatttcaaaatgtttcc

SEQ ID NO: 9017625 - DNA, 22 bp, Homo sapiens
cattacatggtccaggatatat

SEQ ID NO: 9017626 - DNA, 20 bp, Homo sapiens
tcccaaaattctactttatc

SEQ ID NO: 9017627 - DNA, 22 bp, Homo sapiens
cattagaacctataaaaagcat

SEQ ID NO: 9017628 - DNA, 22 bp, Homo sapiens
cattagaacctataaaaagcat

SEQ ID NO: 9017629 - DNA, 22 bp, Homo sapiens
cattagaacctataaaaagcat

SEQ ID NO: 9017630 - DNA, 22 bp, Homo sapiens
cattagaacctataaaaagcat

SEQ ID NO: 9017631 - DNA, 22 bp, Homo sapiens
cattagaactaagatgtccagg

SEQ ID NO: 9017632 - DNA, 22 bp, Homo sapiens
cattagaagaacagttatatta

SEQ ID NO: 9017633 - DNA, 22 bp, Homo sapiens
cattagaactaagatgtccagg

SEQ ID NO: 9017634 - DNA, 22 bp, Homo sapiens
cattagattggtgcaaaaataa

SEQ ID NO: 9017635 - DNA, 22 bp, Homo sapiens
cattagagcagataatatgtgt

SEQ ID NO: 9017636 - DNA, 22 bp, Homo sapiens
cattagaattaggttgtttacc

SEQ ID NO: 9017637 - DNA, 22 bp, Homo sapiens
cattagaaggttttaaaggaat

SEQ ID NO: 9017638 - DNA, 22 bp, Homo sapiens
cattagaaggttttaaaggaat

SEQ ID NO: 9017639 - DNA, 22 bp, Homo sapiens
cattagaagaacagttatatta

SEQ ID NO: 9017640 - DNA, 22 bp, Homo sapiens
cattagcattcagtgacttgta

SEQ ID NO: 9017641 - DNA, 22 bp, Homo sapiens
cattagcattacttcaaagagt

SEQ ID NO: 9017642 - DNA, 22 bp, Homo sapiens
cattagcattacttcaaagagt

SEQ ID NO: 9017643 - DNA, 22 bp, Homo sapiens
cattagctatctgtttacatta

SEQ ID NO: 9017644 - DNA, 22 bp, Homo sapiens
cattagctatctgtttacatta

SEQ ID NO: 9017645 - DNA, 22 bp, Homo sapiens
cattaggtatttaagcacacag

SEQ ID NO: 9017646 - DNA, 22 bp, Homo sapiens
cattagcattacttcaaagagt

SEQ ID NO: 9017647 - DNA, 22 bp, Homo sapiens
cattagcaggcactaagaaggt

SEQ ID NO: 9017648 - DNA, 22 bp, Homo sapiens
cattctaaagtgttttatacct

SEQ ID NO: 9017649 - DNA, 22 bp, Homo sapiens
cattcatttatgaaatatctat

SEQ ID NO: 9017650 - DNA, 22 bp, Homo sapiens
cattcatttgcccagtaagtca

SEQ ID NO: 9017651 - DNA, 22 bp, Homo sapiens
cattcatttatgaaatatctat

SEQ ID NO: 9017652 - DNA, 22 bp, Homo sapiens
cattctattgtagcaccctgta

SEQ ID NO: 9017653 - DNA, 22 bp, Homo sapiens
cattctcaatagtagatgagta

SEQ ID NO: 9017654 - DNA, 22 bp, Homo sapiens
cattctcaatagtagatgagta

SEQ ID NO: 9017655 - DNA, 22 bp, Homo sapiens
cattctcaatagtagatgagta

SEQ ID NO: 9017656 - DNA, 22 bp, Homo sapiens
cattctctacactcctgccctg

SEQ ID NO: 9017657 - DNA, 22 bp, Homo sapiens
cattctctacactcctgccctg

SEQ ID NO: 9017658 - DNA, 22 bp, Homo sapiens
tccattttcatctcatgtataa

SEQ ID NO: 9017659 - DNA, 22 bp, Homo sapiens
tccattttcatctcatgtataa

SEQ ID NO: 9017660 - DNA, 22 bp, Homo sapiens
tccattttcatctcatgtataa

SEQ ID NO: 9017661 - DNA, 22 bp, Homo sapiens
tccattttagagatgaagaaac

SEQ ID NO: 9017662 - DNA, 22 bp, Homo sapiens
tccattttagagatgaagaaac

SEQ ID NO: 9017663 - DNA, 22 bp, Homo sapiens
tccattttagagatgaagaaac

SEQ ID NO: 9017664 - DNA, 22 bp, Homo sapiens
tccattttagagatgaagaaac

SEQ ID NO: 9017665 - DNA, 22 bp, Homo sapiens
tccattttagagatgaagaaac

SEQ ID NO: 9017666 - DNA, 22 bp, Homo sapiens
tccattttctaagtatcactta

SEQ ID NO: 9017667 - DNA, 22 bp, Homo sapiens
tccattttcttgctctaggtaa

SEQ ID NO: 9017668 - DNA, 22 bp, Homo sapiens
tccattttgtaggtatgctaca

SEQ ID NO: 9017669 - DNA, 22 bp, Homo sapiens
tccattttgtaggtatgctaca

SEQ ID NO: 9017670 - DNA, 22 bp, Homo sapiens
tccatttttcatgactcctcaa

SEQ ID NO: 9017671 - DNA, 22 bp, Homo sapiens
tccatttttcatgactcctcaa

SEQ ID NO: 9017672 - DNA, 22 bp, Homo sapiens
tcccaaaatacttttctctcct

SEQ ID NO: 9017673 - DNA, 22 bp, Homo sapiens
tccatcaccacagaggacagag

SEQ ID NO: 9017674 - DNA, 22 bp, Homo sapiens
catgggctcaaccttgaccaca

SEQ ID NO: 9017675 - DNA, 22 bp, Homo sapiens
tccattttagaagaaaatccac

SEQ ID NO: 9017676 - DNA, 22 bp, Homo sapiens
tccattttagaagaaaatccac

SEQ ID NO: 9017677 - DNA, 22 bp, Homo sapiens
tccattttagaagaaaatccac

SEQ ID NO: 9017678 - DNA, 22 bp, Homo sapiens
tccatttggcctctgtattgta

SEQ ID NO: 9017679 - DNA, 22 bp, Homo sapiens
tccattttagaagaaaatccac

SEQ ID NO: 9017680 - DNA, 22 bp, Homo sapiens
tccatttgaaatgaaagtgata

SEQ ID NO: 9017681 - DNA, 22 bp, Homo sapiens
tccatttggcctctgtattgta

SEQ ID NO: 9017682 - DNA, 22 bp, Homo sapiens
tccatttggcactctatttcca

SEQ ID NO: 9017683 - DNA, 22 bp, Homo sapiens
catgggccatggtgaagccagg

SEQ ID NO: 9017684 - DNA, 22 bp, Homo sapiens
catgggcccgtgagaggcaggg

SEQ ID NO: 9017685 - DNA, 22 bp, Homo sapiens
catgggcccgtgagaggcaggg

SEQ ID NO: 9017686 - DNA, 22 bp, Homo sapiens
catgggctacagaagcatgctg

SEQ ID NO: 9017687 - DNA, 22 bp, Homo sapiens
catgggctacagaagcatgctg

SEQ ID NO: 9017688 - DNA, 22 bp, Homo sapiens
catgggctacagaagcatgctg

SEQ ID NO: 9017689 - DNA, 22 bp, Homo sapiens
catgggcagttggcagggctca

SEQ ID NO: 9017690 - DNA, 22 bp, Homo sapiens
catgggcagaagtggcatcatt

SEQ ID NO: 9017691 - DNA, 22 bp, Homo sapiens
catgggcagttggcagggctca

SEQ ID NO: 9017692 - DNA, 22 bp, Homo sapiens
catgggcagttggcagggctca

SEQ ID NO: 9017693 - DNA, 22 bp, Homo sapiens
tccaggagacacaaggtacata

SEQ ID NO: 9017694 - DNA, 22 bp, Homo sapiens
tccaggagacacccttgtgtgt

SEQ ID NO: 9017695 - DNA, 22 bp, Homo sapiens
tccaggagacacccttgtgtgt

SEQ ID NO: 9017696 - DNA, 22 bp, Homo sapiens
tccaggagacacaaggtacata

SEQ ID NO: 9017697 - DNA, 23 bp, Homo sapiens
tccaggagaattccagggcccgg

SEQ ID NO: 9017698 - DNA, 22 bp, Homo sapiens
tccaggagacacaaggtacata

SEQ ID NO: 9017699 - DNA, 22 bp, Homo sapiens
tccaggagaggcctgaccaggt

SEQ ID NO: 9017700 - DNA, 17 bp, Homo sapiens
tccaggagaggcaatgg

SEQ ID NO: 9017701 - DNA, 17 bp, Homo sapiens
tccaggagaggcaatgg

SEQ ID NO: 9017702 - DNA, 22 bp, Homo sapiens
tccaggagattcattaggtcat

SEQ ID NO: 9017703 - DNA, 22 bp, Homo sapiens
tccaggagatacactgcaccag

SEQ ID NO: 9017704 - DNA, 22 bp, Homo sapiens
tccaggagatacactgcaccag

SEQ ID NO: 9017705 - DNA, 22 bp, Homo sapiens
tccaggagatacactgcaccag

SEQ ID NO: 9017706 - DNA, 22 bp, Homo sapiens
tccaggagatacactgcaccag

SEQ ID NO: 9017707 - DNA, 22 bp, Homo sapiens
tccaggagaggtgtggggactg

SEQ ID NO: 9017708 - DNA, 22 bp, Homo sapiens
tccaggagaggtgtggggactg

SEQ ID NO: 9017709 - DNA, 22 bp, Homo sapiens
tccaggagaggtgtggggactg

SEQ ID NO: 9017710 - DNA, 22 bp, Homo sapiens
tccaggagaggcctgaccaggt

SEQ ID NO: 9017711 - DNA, 22 bp, Homo sapiens
tccaggagaggcctgaccaggt

SEQ ID NO: 9017712 - DNA, 22 bp, Homo sapiens
tccaggagaggcctgaccaggt

SEQ ID NO: 9017713 - DNA, 22 bp, Homo sapiens
tccaggagaggcctgaccaggt

SEQ ID NO: 9017714 - DNA, 22 bp, Homo sapiens
catgggaggtctgcaaggtgct

SEQ ID NO: 9017715 - DNA, 22 bp, Homo sapiens
catgggaggtctgcaaggtgct

SEQ ID NO: 9017716 - DNA, 22 bp, Homo sapiens
catgggaggcctgctgctggtg

SEQ ID NO: 9017717 - DNA, 22 bp, Homo sapiens
catgggaggtctgcaaggtgct

SEQ ID NO: 9017718 - DNA, 22 bp, Homo sapiens
catgggaggttggcttggcatg

SEQ ID NO: 9017719 - DNA, 23 bp, Homo sapiens
catgggagtgagaatgccagctc

SEQ ID NO: 9017720 - DNA, 22 bp, Homo sapiens
catgggaggttggcttggcatg

SEQ ID NO: 9017721 - DNA, 23 bp, Homo sapiens
catgggagtgagaatgccagctc

SEQ ID NO: 9017722 - DNA, 22 bp, Homo sapiens
catgggcaccttaaaatgaggc

SEQ ID NO: 9017723 - DNA, 22 bp, Homo sapiens
catgggcagaagtggcatcatt

SEQ ID NO: 9017724 - DNA, 23 bp, Homo sapiens
catgggagtgagaatgccagctc

SEQ ID NO: 9017725 - DNA, 22 bp, Homo sapiens
catgggcaccttaaaatgaggc

SEQ ID NO: 9017726 - DNA, 22 bp, Homo sapiens
catgggaggcctgctgctggtg

SEQ ID NO: 9017727 - DNA, 22 bp, Homo sapiens
catgggaggcctgctgctggtg

SEQ ID NO: 9017728 - DNA, 22 bp, Homo sapiens
catgggaggcctgctgctggtg

SEQ ID NO: 9017729 - DNA, 21 bp, Homo sapiens
tccaggagcacgggactagga

SEQ ID NO: 9017730 - DNA, 21 bp, Homo sapiens
tccaggagcacgggactagga

SEQ ID NO: 9017731 - DNA, 21 bp, Homo sapiens
tccaggagcacgggactagga

SEQ ID NO: 9017732 - DNA, 22 bp, Homo sapiens
tccaggagcatccaggtgaagc

SEQ ID NO: 9017733 - DNA, 22 bp, Homo sapiens
tccaggagcatccaggtgaagc

SEQ ID NO: 9017734 - DNA, 19 bp, Homo sapiens
tccaggagcaaagccagtt

SEQ ID NO: 9017735 - DNA, 19 bp, Homo sapiens
tccaggagcaaagccagtt

SEQ ID NO: 9017736 - DNA, 21 bp, Homo sapiens
tccaggagcacgggactagga

SEQ ID NO: 9017737 - DNA, 21 bp, Homo sapiens
tccaggagcacgggactagga

SEQ ID NO: 9017738 - DNA, 21 bp, Homo sapiens
tccaggagcacgggactagga

SEQ ID NO: 9017739 - DNA, 22 bp, Homo sapiens
cattgttgctgcttcaagatat

SEQ ID NO: 9017740 - DNA, 22 bp, Homo sapiens
cattgttcaacactgacttgca

SEQ ID NO: 9017741 - DNA, 22 bp, Homo sapiens
cattgttatagcattacacacc

SEQ ID NO: 9017742 - DNA, 22 bp, Homo sapiens
cattgttaccatcttttaccta

SEQ ID NO: 9017743 - DNA, 22 bp, Homo sapiens
cattgttaattggtatcttaca

SEQ ID NO: 9017744 - DNA, 22 bp, Homo sapiens
cattgttaattggtatcttaca

SEQ ID NO: 9017745 - DNA, 22 bp, Homo sapiens
cattgtgctttcattcaatata

SEQ ID NO: 9017746 - DNA, 22 bp, Homo sapiens
cattgtgtatttctgtagtact

SEQ ID NO: 9017747 - DNA, 22 bp, Homo sapiens
cattgtgctttcattcaatata

SEQ ID NO: 9017748 - DNA, 22 bp, Homo sapiens
cattgtgcagggataatgcagc

SEQ ID NO: 9017749 - DNA, 18 bp, Homo sapiens
cattgtttccagaagacc

SEQ ID NO: 9017750 - DNA, 22 bp, Homo sapiens
cattgtttctggagggatctgt

SEQ ID NO: 9017751 - DNA, 22 bp, Homo sapiens
cattgtttgagcatctgggatc

SEQ ID NO: 9017752 - DNA, 22 bp, Homo sapiens
cattgtttgagcatctgggatc

SEQ ID NO: 9017753 - DNA, 22 bp, Homo sapiens
cattgtttgtaaaattccagta

SEQ ID NO: 9017754 - DNA, 22 bp, Homo sapiens
cattgtttgtaaaattccagta

SEQ ID NO: 9017755 - DNA, 22 bp, Homo sapiens
cattgttgtgagatcaagcagt

SEQ ID NO: 9017756 - DNA, 18 bp, Homo sapiens
cattgtttccagaagacc

SEQ ID NO: 9017757 - DNA, 22 bp, Homo sapiens
cattgttgttaaacatagtaat

SEQ ID NO: 9017758 - DNA, 22 bp, Homo sapiens
catttaaaggttgtgggtaaaa

SEQ ID NO: 9017759 - DNA, 22 bp, Homo sapiens
catttaaaggttgtgggtaaaa

SEQ ID NO: 9017760 - DNA, 22 bp, Homo sapiens
catttaaaggttgtgggtaaaa

SEQ ID NO: 9017761 - DNA, 22 bp, Homo sapiens
catttaaaggttgtgggtaaaa

SEQ ID NO: 9017762 - DNA, 22 bp, Homo sapiens
cattgttttgagaacaacctga

SEQ ID NO: 9017763 - DNA, 22 bp, Homo sapiens
catttaaaggttgtgggtaaaa

SEQ ID NO: 9017764 - DNA, 22 bp, Homo sapiens
cattgttttgagaacaacctga

SEQ ID NO: 9017765 - DNA, 22 bp, Homo sapiens
cattgtcacccaaagctcatag

SEQ ID NO: 9017766 - DNA, 22 bp, Homo sapiens
cattgtcacccaaagctcatag

SEQ ID NO: 9017767 - DNA, 22 bp, Homo sapiens
cattgtattgaggatacttaag

SEQ ID NO: 9017768 - DNA, 22 bp, Homo sapiens
cattgtattgaggatacttaag

SEQ ID NO: 9017769 - DNA, 22 bp, Homo sapiens
cattgtattgaggatacttaag

SEQ ID NO: 9017770 - DNA, 22 bp, Homo sapiens
cattgtattgaggatacttaag

SEQ ID NO: 9017771 - DNA, 18 bp, Homo sapiens
cattgtacaatgctttat

SEQ ID NO: 9017772 - DNA, 22 bp, Homo sapiens
cattgtcattctatgctattca

SEQ ID NO: 9017773 - DNA, 22 bp, Homo sapiens
cattgtcctgtgggctccctgg

SEQ ID NO: 9017774 - DNA, 22 bp, Homo sapiens
cattgtctggtaggaagtgggc

SEQ ID NO: 9017775 - DNA, 22 bp, Homo sapiens
cattgtctcttgtcatttagta

SEQ ID NO: 9017776 - DNA, 22 bp, Homo sapiens
cattgtgcagggataatgcagc

SEQ ID NO: 9017777 - DNA, 22 bp, Homo sapiens
cattgtcacccaaagctcatag

SEQ ID NO: 9017778 - DNA, 22 bp, Homo sapiens
cattgtcattctatgctattca

SEQ ID NO: 9017779 - DNA, 22 bp, Homo sapiens
cattgtcacccaaagctcatag

SEQ ID NO: 9017780 - DNA, 22 bp, Homo sapiens
cattgtcacccaaagctcatag

SEQ ID NO: 9017781 - DNA, 22 bp, Homo sapiens
cattgtcacccaaagctcatag

SEQ ID NO: 9017782 - DNA, 22 bp, Homo sapiens
tcccactcccaggcaggcctct

SEQ ID NO: 9017783 - DNA, 22 bp, Homo sapiens
tcccactcccaggcaggcctct

SEQ ID NO: 9017784 - DNA, 22 bp, Homo sapiens
tcccactcccaggcaggcctct

SEQ ID NO: 9017785 - DNA, 22 bp, Homo sapiens
tcccaccttccgtggaacccgt

SEQ ID NO: 9017786 - DNA, 22 bp, Homo sapiens
cattgcactccagcctgggcaa

SEQ ID NO: 9017787 - DNA, 22 bp, Homo sapiens
cattgcactccagcctgggcca

SEQ ID NO: 9017788 - DNA, 22 bp, Homo sapiens
cattgcactcctgcctgggcaa

SEQ ID NO: 9017789 - DNA, 22 bp, Homo sapiens
catttaatctggctcatgagca

SEQ ID NO: 9017790 - DNA, 22 bp, Homo sapiens
catttaatctggctcatgagca

SEQ ID NO: 9017791 - DNA, 22 bp, Homo sapiens
catttaatcctcacaagcctat

SEQ ID NO: 9017792 - DNA, 22 bp, Homo sapiens
catttaatgcacggatgtagcc

SEQ ID NO: 9017793 - DNA, 22 bp, Homo sapiens
catttaatctggctcatgagca

SEQ ID NO: 9017794 - DNA, 22 bp, Homo sapiens
catttaatgcctttgccatcca

SEQ ID NO: 9017795 - DNA, 22 bp, Homo sapiens
catttaatgcctttgccatcca

SEQ ID NO: 9017796 - DNA, 22 bp, Homo sapiens
catttaatgcacggatgtagcc

SEQ ID NO: 9017797 - DNA, 22 bp, Homo sapiens
catttaatgcacggatgtagcc

SEQ ID NO: 9017798 - DNA, 22 bp, Homo sapiens
catttaatccatagaggaatgt

SEQ ID NO: 9017799 - DNA, 22 bp, Homo sapiens
catttaatagatgctgtttcag

SEQ ID NO: 9017800 - DNA, 22 bp, Homo sapiens
catttaatagatgctgtttcag

SEQ ID NO: 9017801 - DNA, 22 bp, Homo sapiens
catttaatagatgctgtttcag

SEQ ID NO: 9017802 - DNA, 22 bp, Homo sapiens
catttaatccatagaggaatgt

SEQ ID NO: 9017803 - DNA, 22 bp, Homo sapiens
catttaatcctcacaagcctat

SEQ ID NO: 9017804 - DNA, 22 bp, Homo sapiens
catttaatccatagaggaatgt

SEQ ID NO: 9017805 - DNA, 22 bp, Homo sapiens
catttaatagatgctgtttcag

SEQ ID NO: 9017806 - DNA, 22 bp, Homo sapiens
catttaatagatgctgtttcag

SEQ ID NO: 9017807 - DNA, 22 bp, Homo sapiens
catttaatagatgctgtttcag

SEQ ID NO: 9017808 - DNA, 22 bp, Homo sapiens
catttaagagaaatatttagtt

SEQ ID NO: 9017809 - DNA, 22 bp, Homo sapiens
catttacaatgtacaggttgtg

SEQ ID NO: 9017810 - DNA, 22 bp, Homo sapiens
catttacaatgtacaggttgtg

SEQ ID NO: 9017811 - DNA, 22 bp, Homo sapiens
catttaatgcctttgccatcca

SEQ ID NO: 9017812 - DNA, 22 bp, Homo sapiens
catttacacacagaggtgtgct

SEQ ID NO: 9017813 - DNA, 22 bp, Homo sapiens
catttacacacagaggtgtgct

SEQ ID NO: 9017814 - DNA, 22 bp, Homo sapiens
catttacacacagaggtgtgct

SEQ ID NO: 9017815 - DNA, 22 bp, Homo sapiens
tccctccttaataagaggtctg

SEQ ID NO: 9017816 - DNA, 22 bp, Homo sapiens
tccctccttaataagaggtctg

SEQ ID NO: 9017817 - DNA, 22 bp, Homo sapiens
tccctccttaataagaggtctg

SEQ ID NO: 9017818 - DNA, 22 bp, Homo sapiens
tccctccttaataagaggtctg

SEQ ID NO: 9017819 - DNA, 22 bp, Homo sapiens
tccctccttaataagaggtctg

SEQ ID NO: 9017820 - DNA, 22 bp, Homo sapiens
tccctcctggtgagcaggggct

SEQ ID NO: 9017821 - DNA, 22 bp, Homo sapiens
tccctcctgcatgaggctcggc

SEQ ID NO: 9017822 - DNA, 18 bp, Homo sapiens
tccctcctgcctgcttcc

SEQ ID NO: 9017823 - DNA, 18 bp, Homo sapiens
tccctcctgcctgcttcc

SEQ ID NO: 9017824 - DNA, 22 bp, Homo sapiens
tccctcctggccgtcaccgctg

SEQ ID NO: 9017825 - DNA, 22 bp, Homo sapiens
catttacacttctaaccacaag

SEQ ID NO: 9017826 - DNA, 22 bp, Homo sapiens
catttacacttctaaccacaag

SEQ ID NO: 9017827 - DNA, 22 bp, Homo sapiens
catttacacttctaaccacaag

SEQ ID NO: 9017828 - DNA, 22 bp, Homo sapiens
tccctcagaaattctctctgaa

SEQ ID NO: 9017829 - DNA, 22 bp, Homo sapiens
catttacacttctaaccacaag

SEQ ID NO: 9017830 - DNA, 22 bp, Homo sapiens
catttacacttctaaccacaag

SEQ ID NO: 9017831 - DNA, 20 bp, Homo sapiens
tccctcctgcagatagagaa

SEQ ID NO: 9017832 - DNA, 22 bp, Homo sapiens
tccctcctgcatgaggctcggc

SEQ ID NO: 9017833 - DNA, 22 bp, Homo sapiens
tccctcctgcatgaggctcggc

SEQ ID NO: 9017834 - DNA, 22 bp, Homo sapiens
tccctcagaaattctctctgaa

SEQ ID NO: 9017835 - DNA, 20 bp, Homo sapiens
tccctcctgcagatagagaa

SEQ ID NO: 9017836 - DNA, 20 bp, Homo sapiens
tccctcctgcagatagagaa

SEQ ID NO: 9017837 - DNA, 22 bp, Homo sapiens
tccctgggtcctgcttgctctc

SEQ ID NO: 9017838 - DNA, 22 bp, Homo sapiens
tccctgggtcctgcttgctctc

SEQ ID NO: 9017839 - DNA, 22 bp, Homo sapiens
tccctgggttacctttcaaggt

SEQ ID NO: 9017840 - DNA, 22 bp, Homo sapiens
tccctgggttacctttcaaggt

SEQ ID NO: 9017841 - DNA, 22 bp, Homo sapiens
tccctgggtcctgcttgctctc

SEQ ID NO: 9017842 - DNA, 22 bp, Homo sapiens
tccctgggtcctgcttgctctc

SEQ ID NO: 9017843 - DNA, 22 bp, Homo sapiens
tccctgggtcctgcttgctctc

SEQ ID NO: 9017844 - DNA, 22 bp, Homo sapiens
tccctgggtcattctctggcac

SEQ ID NO: 9017845 - DNA, 22 bp, Homo sapiens
tccctgggtcattctctggcac

SEQ ID NO: 9017846 - DNA, 22 bp, Homo sapiens
tccctgggtcattctctggcac

SEQ ID NO: 9017847 - DNA, 22 bp, Homo sapiens
tccctgggtcattctctggcac

SEQ ID NO: 9017848 - DNA, 23 bp, Homo sapiens
tcctaactcaattcaggggtgtc

SEQ ID NO: 9017849 - DNA, 22 bp, Homo sapiens
tcctaactaatttgtagcaaaa

SEQ ID NO: 9017850 - DNA, 20 bp, Homo sapiens
tcctaactataaagtggctc

SEQ ID NO: 9017851 - DNA, 22 bp, Homo sapiens
tccctgggttcccgtggaagtg

SEQ ID NO: 9017852 - DNA, 22 bp, Homo sapiens
tccctgggttcccgtggaagtg

SEQ ID NO: 9017853 - DNA, 23 bp, Homo sapiens
tcctaactgattctgcagtctct

SEQ ID NO: 9017854 - DNA, 23 bp, Homo sapiens
tcctaactgattctgcagtctct

SEQ ID NO: 9017855 - DNA, 22 bp, Homo sapiens
tcctaactccactagccttggg

SEQ ID NO: 9017856 - DNA, 23 bp, Homo sapiens
tcctaactcaattcaggggtgtc

SEQ ID NO: 9017857 - DNA, 23 bp, Homo sapiens
tcctaactcaattcaggggtgtc

SEQ ID NO: 9017858 - DNA, 16 bp, Homo sapiens
tcctaactggcagttc

SEQ ID NO: 9017859 - DNA, 18 bp, Homo sapiens
tcctaacttagatactcc

SEQ ID NO: 9017860 - DNA, 22 bp, Homo sapiens
tcctaactgccctgggcaaggt

SEQ ID NO: 9017861 - DNA, 22 bp, Homo sapiens
tcctaactccactagccttggg

SEQ ID NO: 9017862 - DNA, 23 bp, Homo sapiens
tcctaactgattctgcagtctct

SEQ ID NO: 9017863 - DNA, 22 bp, Homo sapiens
tccctggaacagagagacaacg

SEQ ID NO: 9017864 - DNA, 22 bp, Homo sapiens
tccctggaacagagagacaacg

SEQ ID NO: 9017865 - DNA, 22 bp, Homo sapiens
tccctgctttcttgtgagggga

SEQ ID NO: 9017866 - DNA, 22 bp, Homo sapiens
tccctgctttcttgtgagggga

SEQ ID NO: 9017867 - DNA, 22 bp, Homo sapiens
catttattgagtggccacagtg

SEQ ID NO: 9017868 - DNA, 22 bp, Homo sapiens
catttattgagtggccacagtg

SEQ ID NO: 9017869 - DNA, 18 bp, Homo sapiens
tccctggggctgccaccc

SEQ ID NO: 9017870 - DNA, 18 bp, Homo sapiens
tccctggggctgccaccc

SEQ ID NO: 9017871 - DNA, 18 bp, Homo sapiens
tccctggggctgccaccc

SEQ ID NO: 9017872 - DNA, 18 bp, Homo sapiens
tccctggggctgccaccc

SEQ ID NO: 9017873 - DNA, 22 bp, Homo sapiens
tccctggggtaacattagaggg

SEQ ID NO: 9017874 - DNA, 22 bp, Homo sapiens
tccctggggtatcgctgaggca

SEQ ID NO: 9017875 - DNA, 22 bp, Homo sapiens
tccctggggtatcgctgaggca

SEQ ID NO: 9017876 - DNA, 22 bp, Homo sapiens
tccctggggtatcgctgaggca

SEQ ID NO: 9017877 - DNA, 22 bp, Homo sapiens
tccctggggtatcgctgaggca

SEQ ID NO: 9017878 - DNA, 22 bp, Homo sapiens
tccctggggttcctccagccac

SEQ ID NO: 9017879 - DNA, 22 bp, Homo sapiens
tccctggggttcctccagccac

SEQ ID NO: 9017880 - DNA, 22 bp, Homo sapiens
tccctggggttcctccagccac

SEQ ID NO: 9017881 - DNA, 22 bp, Homo sapiens
tccctggggttcctccagccac

SEQ ID NO: 9017882 - DNA, 22 bp, Homo sapiens
tccctggggttcctccagccac

SEQ ID NO: 9017883 - DNA, 22 bp, Homo sapiens
tccctctctagcctgttcagta

SEQ ID NO: 9017884 - DNA, 22 bp, Homo sapiens
tccctctctagcctgttcagta

SEQ ID NO: 9017885 - DNA, 22 bp, Homo sapiens
tccctctctggctggggtgcgg

SEQ ID NO: 9017886 - DNA, 22 bp, Homo sapiens
catttattagttagttcgatgt

SEQ ID NO: 9017887 - DNA, 22 bp, Homo sapiens
tccctctcttgggcgtggctca

SEQ ID NO: 9017888 - DNA, 22 bp, Homo sapiens
tccctctctggctggggtgcgg

SEQ ID NO: 9017889 - DNA, 22 bp, Homo sapiens
catttattcagctcagtcggtt

SEQ ID NO: 9017890 - DNA, 22 bp, Homo sapiens
catttattagttagttcgatgt

SEQ ID NO: 9017891 - DNA, 22 bp, Homo sapiens
catttattcagctcagtcggtt

SEQ ID NO: 9017892 - DNA, 22 bp, Homo sapiens
tccctctccctattgcctggag

SEQ ID NO: 9017893 - DNA, 22 bp, Homo sapiens
tccctctctagcctgttcagta

SEQ ID NO: 9017894 - DNA, 22 bp, Homo sapiens
tccctctctagcctgttcagta

SEQ ID NO: 9017895 - DNA, 22 bp, Homo sapiens
tccctctccctattgcctggag

SEQ ID NO: 9017896 - DNA, 22 bp, Homo sapiens
tccctctccctattgcctggag

SEQ ID NO: 9017897 - DNA, 22 bp, Homo sapiens
tccctctccctattgcctggag

SEQ ID NO: 9017898 - DNA, 22 bp, Homo sapiens
tccctctccctattgcctggag

SEQ ID NO: 9017899 - DNA, 22 bp, Homo sapiens
tccctcctttatcaaaaagaga

SEQ ID NO: 9017900 - DNA, 22 bp, Homo sapiens
catttattctcagatccttgtc

SEQ ID NO: 9017901 - DNA, 22 bp, Homo sapiens
catttattcatttgctagggct

SEQ ID NO: 9017902 - DNA, 22 bp, Homo sapiens
catttattctcagatccttgtc

SEQ ID NO: 9017903 - DNA, 22 bp, Homo sapiens
catttattctcagatccttgtc

SEQ ID NO: 9017904 - DNA, 22 bp, Homo sapiens
catttattctcagatccttgtc

SEQ ID NO: 9017905 - DNA, 22 bp, Homo sapiens
catttattctcagatccttgtc

SEQ ID NO: 9017906 - DNA, 22 bp, Homo sapiens
catttattgagtggccacagtg

SEQ ID NO: 9017907 - DNA, 22 bp, Homo sapiens
catttattctcagatccttgtc

SEQ ID NO: 9017908 - DNA, 22 bp, Homo sapiens
catttattgagtggccacagtg

SEQ ID NO: 9017909 - DNA, 22 bp, Homo sapiens
catttattcatgatctgtagct

SEQ ID NO: 9017910 - DNA, 22 bp, Homo sapiens
catttattcatgatctgtagct

SEQ ID NO: 9017911 - DNA, 22 bp, Homo sapiens
catttattcatttgctagggct

SEQ ID NO: 9017912 - DNA, 22 bp, Homo sapiens
catttattcatgatctgtagct

SEQ ID NO: 9017913 - DNA, 22 bp, Homo sapiens
catttattcatgatctgtagct

SEQ ID NO: 9017914 - DNA, 22 bp, Homo sapiens
catttattcatgatctgtagct

SEQ ID NO: 9017915 - DNA, 22 bp, Homo sapiens
tcctgggctgtgtgccactctg

SEQ ID NO: 9017916 - DNA, 22 bp, Homo sapiens
tcctgggcttagtggctaggtc

SEQ ID NO: 9017917 - DNA, 22 bp, Homo sapiens
tcctgggctgtgtgccactctg

SEQ ID NO: 9017918 - DNA, 22 bp, Homo sapiens
tcctgggagcccttgctccacc

SEQ ID NO: 9017919 - DNA, 22 bp, Homo sapiens
tcctgggagcccttgctccacc

SEQ ID NO: 9017920 - DNA, 22 bp, Homo sapiens
tcctgggagcatgaagagggat

SEQ ID NO: 9017921 - DNA, 22 bp, Homo sapiens
tcctgggagcatgaagagggat

SEQ ID NO: 9017922 - DNA, 22 bp, Homo sapiens
tcctgggagcatggtgccgtga

SEQ ID NO: 9017923 - DNA, 22 bp, Homo sapiens
tcctgggagcccttgctccacc

SEQ ID NO: 9017924 - DNA, 22 bp, Homo sapiens
tcctgggagcatggtgccgtga

SEQ ID NO: 9017925 - DNA, 22 bp, Homo sapiens
tcctgggagcatggtgccgtga

SEQ ID NO: 9017926 - DNA, 22 bp, Homo sapiens
tcctgggagcacatggtcctgc

SEQ ID NO: 9017927 - DNA, 22 bp, Homo sapiens
tcctgggagcacatggtcctgc

SEQ ID NO: 9017928 - DNA, 22 bp, Homo sapiens
tcctgggagcacatggtcctgc

SEQ ID NO: 9017929 - DNA, 22 bp, Homo sapiens
tcctgggagcatgaagagggat

SEQ ID NO: 9017930 - DNA, 22 bp, Homo sapiens
ccacagaacctcagctttgagc

SEQ ID NO: 9017931 - DNA, 22 bp, Homo sapiens
ccacagaaagttgtctagagta

SEQ ID NO: 9017932 - DNA, 22 bp, Homo sapiens
ccacagaaagttgtctagagta

SEQ ID NO: 9017933 - DNA, 22 bp, Homo sapiens
tcctggctccagcagctcttcc

SEQ ID NO: 9017934 - DNA, 22 bp, Homo sapiens
tcctgggactttcaaggctagg

SEQ ID NO: 9017935 - DNA, 22 bp, Homo sapiens
tcctgggagacccagctgtgga

SEQ ID NO: 9017936 - DNA, 22 bp, Homo sapiens
tcctgggagacccagctgtgga

SEQ ID NO: 9017937 - DNA, 22 bp, Homo sapiens
tcctgggagagtgggactgtat

SEQ ID NO: 9017938 - DNA, 22 bp, Homo sapiens
tcctgggagagtgggactgtat

SEQ ID NO: 9017939 - DNA, 18 bp, Homo sapiens
tcctggcagtcagagagg

SEQ ID NO: 9017940 - DNA, 22 bp, Homo sapiens
tcctggcagtcaaataaccttg

SEQ ID NO: 9017941 - DNA, 22 bp, Homo sapiens
tcctggcaggtctgagaggtct

SEQ ID NO: 9017942 - DNA, 22 bp, Homo sapiens
tcctggcaggtgtattggctgt

SEQ ID NO: 9017943 - DNA, 22 bp, Homo sapiens
tcctggcagggtggcagcgggt

SEQ ID NO: 9017944 - DNA, 22 bp, Homo sapiens
tcctggcaggtcagcaggagca

SEQ ID NO: 9017945 - DNA, 22 bp, Homo sapiens
tcctggcaggtcagcaggagca

SEQ ID NO: 9017946 - DNA, 22 bp, Homo sapiens
tcctggcaggtcagcaggagca

SEQ ID NO: 9017947 - DNA, 22 bp, Homo sapiens
tcctggcaggtcagcaggagca

SEQ ID NO: 9017948 - DNA, 22 bp, Homo sapiens
tcctggcagggtggcagcgggt

SEQ ID NO: 9017949 - DNA, 22 bp, Homo sapiens
tcctggcagggtggcagcgggt

SEQ ID NO: 9017950 - DNA, 22 bp, Homo sapiens
tcctggcagggtggcagcgggt

SEQ ID NO: 9017951 - DNA, 22 bp, Homo sapiens
tcctggcagggtctaggtctag

SEQ ID NO: 9017952 - DNA, 22 bp, Homo sapiens
tcctggcagcccgcaggtgctg

SEQ ID NO: 9017953 - DNA, 21 bp, Homo sapiens
tcctggcaggcccaggaccct

SEQ ID NO: 9017954 - DNA, 22 bp, Homo sapiens
ccacagaaagcctgggaagtgg

SEQ ID NO: 9017955 - DNA, 22 bp, Homo sapiens
ccacagaaaataaagcacgatt

SEQ ID NO: 9017956 - DNA, 22 bp, Homo sapiens
ccacagaaaataaagcacgatt

SEQ ID NO: 9017957 - DNA, 22 bp, Homo sapiens
ccacactgaacctcagtgtctt

SEQ ID NO: 9017958 - DNA, 22 bp, Homo sapiens
ccacactccccgcaggcgtagg

SEQ ID NO: 9017959 - DNA, 17 bp, Homo sapiens
ccacaccctttccttcc

SEQ ID NO: 9017960 - DNA, 17 bp, Homo sapiens
ccacaccctttccttcc

SEQ ID NO: 9017961 - DNA, 19 bp, Homo sapiens
ccacacagtgtgcaattta

SEQ ID NO: 9017962 - DNA, 22 bp, Homo sapiens
ccacacagtcagtttccaagaa

SEQ ID NO: 9017963 - DNA, 22 bp, Homo sapiens
ccacacagtcagtttccaagaa

SEQ ID NO: 9017964 - DNA, 22 bp, Homo sapiens
ccacacagtcagtttccaagaa

SEQ ID NO: 9017965 - DNA, 22 bp, Homo sapiens
ccacacagtcagtttccaagaa

SEQ ID NO: 9017966 - DNA, 22 bp, Homo sapiens
ccaaggcccctgtggtctagcc

SEQ ID NO: 9017967 - DNA, 22 bp, Homo sapiens
ccaaggctcctcagctggtctt

SEQ ID NO: 9017968 - DNA, 17 bp, Homo sapiens
ccaaggctatttgtagt

SEQ ID NO: 9017969 - DNA, 22 bp, Homo sapiens
ccaaggctcctcagctggtctt

SEQ ID NO: 9017970 - DNA, 22 bp, Homo sapiens
ccaaggctcctcagctggtctt

SEQ ID NO: 9017971 - DNA, 22 bp, Homo sapiens
ccaaggccatcaggtaggtcct

SEQ ID NO: 9017972 - DNA, 18 bp, Homo sapiens
ccaaggcccctgctgggg

SEQ ID NO: 9017973 - DNA, 18 bp, Homo sapiens
ccaaggcccctgctgggg

SEQ ID NO: 9017974 - DNA, 18 bp, Homo sapiens
ccaaggcccctgctgggg

SEQ ID NO: 9017975 - DNA, 22 bp, Homo sapiens
ccaaggcccctgtggtctagcc

SEQ ID NO: 9017976 - DNA, 18 bp, Homo sapiens
ccaaggcccctgctgggg

SEQ ID NO: 9017977 - DNA, 22 bp, Homo sapiens
ccaaggcccctgtggtctagcc

SEQ ID NO: 9017978 - DNA, 22 bp, Homo sapiens
ccaaggctggagtgcagtggcg

SEQ ID NO: 9017979 - DNA, 22 bp, Homo sapiens
ccaaggctgtggggctgtgcag

SEQ ID NO: 9017980 - DNA, 22 bp, Homo sapiens
ccaaggctgtggggctgtgcag

SEQ ID NO: 9017981 - DNA, 22 bp, Homo sapiens
tcctggcagaaatggggctgtg

SEQ ID NO: 9017982 - DNA, 22 bp, Homo sapiens
tcctggcagagagcatgaggcc

SEQ ID NO: 9017983 - DNA, 22 bp, Homo sapiens
tcctggcagcccgcaggtgctg

SEQ ID NO: 9017984 - DNA, 22 bp, Homo sapiens
tcctggcacccttgggttggag

SEQ ID NO: 9017985 - DNA, 22 bp, Homo sapiens
tcctggcactttgggggctcgc

SEQ ID NO: 9017986 - DNA, 22 bp, Homo sapiens
tcctggcactttgggggctcgc

SEQ ID NO: 9017987 - DNA, 22 bp, Homo sapiens
tcctggaggacagaggcatctc

SEQ ID NO: 9017988 - DNA, 22 bp, Homo sapiens
tcctggaggacagaggcatctc

SEQ ID NO: 9017989 - DNA, 22 bp, Homo sapiens
ccaaggcttcccagagatgctc

SEQ ID NO: 9017990 - DNA, 22 bp, Homo sapiens
ccaaggcttcccagagatgctc

SEQ ID NO: 9017991 - DNA, 22 bp, Homo sapiens
ccaagggaaaccgagaggctgg

SEQ ID NO: 9017992 - DNA, 22 bp, Homo sapiens
ccaaggcaatgtgcagctggtg

SEQ ID NO: 9017993 - DNA, 22 bp, Homo sapiens
ccaaggcaatgtgcagctggtg

SEQ ID NO: 9017994 - DNA, 22 bp, Homo sapiens
ccaaggcaacgttggtgtcagg

SEQ ID NO: 9017995 - DNA, 22 bp, Homo sapiens
ccaaggcaacgttggtgtcagg

SEQ ID NO: 9017996 - DNA, 22 bp, Homo sapiens
ccaaggatgaggctcaaggagg

SEQ ID NO: 9017997 - DNA, 22 bp, Homo sapiens
ccaaggaggccccaggtcagct

SEQ ID NO: 9017998 - DNA, 22 bp, Homo sapiens
ccaaggaggccccaggtcagct

SEQ ID NO: 9017999 - DNA, 22 bp, Homo sapiens
ccaaggaggccccaggtcagct

SEQ ID NO: 9018000 - DNA, 22 bp, Homo sapiens
ccaaggagtagagcaggaagct

SEQ ID NO: 9018001 - DNA, 22 bp, Homo sapiens
ccaaggcagaagatggctcttg

SEQ ID NO: 9018002 - DNA, 22 bp, Homo sapiens
ccaaggcagaagatggctcttg

SEQ ID NO: 9018003 - DNA, 22 bp, Homo sapiens
ccaaggcagaagatggctcttg

SEQ ID NO: 9018004 - DNA, 22 bp, Homo sapiens
ccaaggcagaagatggctcttg

SEQ ID NO: 9018005 - DNA, 22 bp, Homo sapiens
ccaaggcacactctgcaaggtt

SEQ ID NO: 9018006 - DNA, 22 bp, Homo sapiens
ccaaggcacactctgcaaggtt

SEQ ID NO: 9018007 - DNA, 22 bp, Homo sapiens
ccaaggcacactctgcaaggtt

SEQ ID NO: 9018008 - DNA, 22 bp, Homo sapiens
ccaaggcacactctgcaaggtt

SEQ ID NO: 9018009 - DNA, 22 bp, Homo sapiens
ccaaggccacaaacagcctggc

SEQ ID NO: 9018010 - DNA, 22 bp, Homo sapiens
ccaaggccatcaggtaggtcct

SEQ ID NO: 9018011 - DNA, 22 bp, Homo sapiens
ccaaggccacaaacagcctggc

SEQ ID NO: 9018012 - DNA, 22 bp, Homo sapiens
ccaaggcatatggctgaaacca

SEQ ID NO: 9018013 - DNA, 22 bp, Homo sapiens
ccaaggcatatggctgaaacca

SEQ ID NO: 9018014 - DNA, 22 bp, Homo sapiens
ccaaggcagaagatggctcttg

SEQ ID NO: 9018015 - DNA, 22 bp, Homo sapiens
ccaaggagctgcaggcacttgt

SEQ ID NO: 9018016 - DNA, 22 bp, Homo sapiens
ccaaggagctgcaggcacttgt

SEQ ID NO: 9018017 - DNA, 22 bp, Homo sapiens
ccaaggagcaagtttacacctg

SEQ ID NO: 9018018 - DNA, 22 bp, Homo sapiens
ccaaggagcaaggctcaacaag

SEQ ID NO: 9018019 - DNA, 22 bp, Homo sapiens
ccaaggagaatgacaccatgga

SEQ ID NO: 9018020 - DNA, 22 bp, Homo sapiens
ccaaggagcaaggctcaacaag

SEQ ID NO: 9018021 - DNA, 22 bp, Homo sapiens
ccaaggagaatgacaccatgga

SEQ ID NO: 9018022 - DNA, 22 bp, Homo sapiens
ccaagaggttgaggctgcagtg

SEQ ID NO: 9018023 - DNA, 22 bp, Homo sapiens
ccaagaggttgtgaggcaggca

SEQ ID NO: 9018024 - DNA, 22 bp, Homo sapiens
ccaagagtaaattcatgatgcc

SEQ ID NO: 9018025 - DNA, 22 bp, Homo sapiens
ccaagaggttgtgaggcaggca

SEQ ID NO: 9018026 - DNA, 22 bp, Homo sapiens
ccaagaggttgtgaggcaggca

SEQ ID NO: 9018027 - DNA, 20 bp, Homo sapiens
tcctaagaggatggccacgt

SEQ ID NO: 9018028 - DNA, 20 bp, Homo sapiens
tcctaagaggatggccacgt

SEQ ID NO: 9018029 - DNA, 22 bp, Homo sapiens
tcctaagaagcatgggtcccaa

SEQ ID NO: 9018030 - DNA, 18 bp, Homo sapiens
tcctaacttagatactcc

SEQ ID NO: 9018031 - DNA, 18 bp, Homo sapiens
tcctaagatttgtgagaa

SEQ ID NO: 9018032 - DNA, 18 bp, Homo sapiens
tcctaagatttgtgagaa

SEQ ID NO: 9018033 - DNA, 22 bp, Homo sapiens
tcctaagatagaagatagtgaa

SEQ ID NO: 9018034 - DNA, 22 bp, Homo sapiens
tcctaagatagaagatagtgaa

SEQ ID NO: 9018035 - DNA, 22 bp, Homo sapiens
tcctaaggcaccagcttcctgt

SEQ ID NO: 9018036 - DNA, 20 bp, Homo sapiens
tcctaataacctgaagaaat

SEQ ID NO: 9018037 - DNA, 22 bp, Homo sapiens
tcctaattgcttcatgtgttgt

SEQ ID NO: 9018038 - DNA, 22 bp, Homo sapiens
tcctagaactccaggacagtcc

SEQ ID NO: 9018039 - DNA, 22 bp, Homo sapiens
tcctagaactccaggacagtcc

SEQ ID NO: 9018040 - DNA, 22 bp, Homo sapiens
tcctagaactccaggacagtcc

SEQ ID NO: 9018041 - DNA, 22 bp, Homo sapiens
tcctagaacagcccacctggaa

SEQ ID NO: 9018042 - DNA, 22 bp, Homo sapiens
tcctagaacagcccacctggaa

SEQ ID NO: 9018043 - DNA, 20 bp, Homo sapiens
tcctactcttttaatatgtg

SEQ ID NO: 9018044 - DNA, 22 bp, Homo sapiens
tcctacatcagctctcagtagc

SEQ ID NO: 9018045 - DNA, 19 bp, Homo sapiens
ccagagacattggcatctt

SEQ ID NO: 9018046 - DNA, 22 bp, Homo sapiens
ccagagaattttagacaaaaat

SEQ ID NO: 9018047 - DNA, 22 bp, Homo sapiens
ccagagaatccggagagtccat

SEQ ID NO: 9018048 - DNA, 22 bp, Homo sapiens
ccagagaagtcttgcctggatt

SEQ ID NO: 9018049 - DNA, 22 bp, Homo sapiens
ccagagaaggtggagcttgtgt

SEQ ID NO: 9018050 - DNA, 22 bp, Homo sapiens
ccagagaaccatctgcttgagg

SEQ ID NO: 9018051 - DNA, 22 bp, Homo sapiens
ccagagaaccatctgcttgagg

SEQ ID NO: 9018052 - DNA, 22 bp, Homo sapiens
ccagacaggggctgttcctgct

SEQ ID NO: 9018053 - DNA, 22 bp, Homo sapiens
ccagagaaccttgagctgtgag

SEQ ID NO: 9018054 - DNA, 22 bp, Homo sapiens
tctaaggagcgctccagaaaaa

SEQ ID NO: 9018055 - DNA, 22 bp, Homo sapiens
tctaaggagccaggactattag

SEQ ID NO: 9018056 - DNA, 22 bp, Homo sapiens
tctaaggccttcatgtcagtat

SEQ ID NO: 9018057 - DNA, 22 bp, Homo sapiens
tctaaggacattggctttggag

SEQ ID NO: 9018058 - DNA, 22 bp, Homo sapiens
tctaaggagccaggactattag

SEQ ID NO: 9018059 - DNA, 21 bp, Homo sapiens
tctaagccttgcagatgggtt

SEQ ID NO: 9018060 - DNA, 22 bp, Homo sapiens
tctaaggaaggacaccctggct

SEQ ID NO: 9018061 - DNA, 22 bp, Homo sapiens
tctaaggacattggctttggag

SEQ ID NO: 9018062 - DNA, 22 bp, Homo sapiens
tctaaggacagttattactggg

SEQ ID NO: 9018063 - DNA, 22 bp, Homo sapiens
tctaaggacaaggtcttggaga

SEQ ID NO: 9018064 - DNA, 22 bp, Homo sapiens
tctaaggacaaggtcttggaga

SEQ ID NO: 9018065 - DNA, 22 bp, Homo sapiens
tctaaggacagttattactggg

SEQ ID NO: 9018066 - DNA, 22 bp, Homo sapiens
ccagacaggggctgttcctgct

SEQ ID NO: 9018067 - DNA, 22 bp, Homo sapiens
ccagacaggggctgttcctgct

SEQ ID NO: 9018068 - DNA, 22 bp, Homo sapiens
ccagacaggggctgttcctgct

SEQ ID NO: 9018069 - DNA, 22 bp, Homo sapiens
ccagacaggggctgttcctgct

SEQ ID NO: 9018070 - DNA, 22 bp, Homo sapiens
tctaatcctatggtggggaggg

SEQ ID NO: 9018071 - DNA, 22 bp, Homo sapiens
tctaataaataaatgctctagg

SEQ ID NO: 9018072 - DNA, 22 bp, Homo sapiens
tctaataaataaatgctctagg

SEQ ID NO: 9018073 - DNA, 22 bp, Homo sapiens
ccactgtctgtgacatcagaaa

SEQ ID NO: 9018074 - DNA, 22 bp, Homo sapiens
ccactgtcttttccaggctgaa

SEQ ID NO: 9018075 - DNA, 22 bp, Homo sapiens
ccactgtctgtgacatcagaaa

SEQ ID NO: 9018076 - DNA, 22 bp, Homo sapiens
ccactgtcttttccaggctgaa

SEQ ID NO: 9018077 - DNA, 22 bp, Homo sapiens
ccactgtctgcaggcctcagca

SEQ ID NO: 9018078 - DNA, 22 bp, Homo sapiens
ccactgtcagaggggctgtgcc

SEQ ID NO: 9018079 - DNA, 22 bp, Homo sapiens
ccactgtattttggaagcagat

SEQ ID NO: 9018080 - DNA, 21 bp, Homo sapiens
ccactggtggggaacggtggc

SEQ ID NO: 9018081 - DNA, 22 bp, Homo sapiens
ccactgtaagtttgaaaataac

SEQ ID NO: 9018082 - DNA, 22 bp, Homo sapiens
ccactgctagagatgcatcccc

SEQ ID NO: 9018083 - DNA, 22 bp, Homo sapiens
ccactgctaacttgctgcagct

SEQ ID NO: 9018084 - DNA, 22 bp, Homo sapiens
ccactgggggctgctcccaggt

SEQ ID NO: 9018085 - DNA, 22 bp, Homo sapiens
ccactgggggctgctcccaggt

SEQ ID NO: 9018086 - DNA, 22 bp, Homo sapiens
ccactgctagagatgcatcccc

SEQ ID NO: 9018087 - DNA, 22 bp, Homo sapiens
ccactgtaagtttgaaaataac

SEQ ID NO: 9018088 - DNA, 22 bp, Homo sapiens
ccactgtaagtttgaaaataac

SEQ ID NO: 9018089 - DNA, 22 bp, Homo sapiens
ccactgtataagcaaaatgaaa

SEQ ID NO: 9018090 - DNA, 22 bp, Homo sapiens
ccactgtagttatgatgaagtt

SEQ ID NO: 9018091 - DNA, 22 bp, Homo sapiens
ccactgtataagcaaaatgaaa

SEQ ID NO: 9018092 - DNA, 22 bp, Homo sapiens
tctaagaattgaagtggctctt

SEQ ID NO: 9018093 - DNA, 22 bp, Homo sapiens
tctaagaatactcatatcttct

SEQ ID NO: 9018094 - DNA, 22 bp, Homo sapiens
tctaagaggcatcaagacaagc

SEQ ID NO: 9018095 - DNA, 22 bp, Homo sapiens
tctaagatctactatacatgtg

SEQ ID NO: 9018096 - DNA, 22 bp, Homo sapiens
tctaagatctactatacatgtg

SEQ ID NO: 9018097 - DNA, 22 bp, Homo sapiens
tctaagccaggactgagagacg

SEQ ID NO: 9018098 - DNA, 22 bp, Homo sapiens
tctaagaatactcatatcttct

SEQ ID NO: 9018099 - DNA, 22 bp, Homo sapiens
tctaagaagggttttaaatatt

SEQ ID NO: 9018100 - DNA, 22 bp, Homo sapiens
tctaagaatactcatatcttct

SEQ ID NO: 9018101 - DNA, 22 bp, Homo sapiens
tctaagaagggttttaaatatt

SEQ ID NO: 9018102 - DNA, 22 bp, Homo sapiens
tctaagaagggttttaaatatt

SEQ ID NO: 9018103 - DNA, 21 bp, Homo sapiens
tctaagaacatgattctccct

SEQ ID NO: 9018104 - DNA, 21 bp, Homo sapiens
tctaagaacatgattctccct

SEQ ID NO: 9018105 - DNA, 22 bp, Homo sapiens
tctaagaaatcagatgatgagg

SEQ ID NO: 9018106 - DNA, 22 bp, Homo sapiens
tctaagaaatcagatgatgagg

SEQ ID NO: 9018107 - DNA, 22 bp, Homo sapiens
ccacttcatcccagctcagata

SEQ ID NO: 9018108 - DNA, 22 bp, Homo sapiens
ccacttcatcccagctcagata

SEQ ID NO: 9018109 - DNA, 22 bp, Homo sapiens
ccactgtttcctttctgctggc

SEQ ID NO: 9018110 - DNA, 22 bp, Homo sapiens
ccactgttggcccgaaggggtc

SEQ ID NO: 9018111 - DNA, 22 bp, Homo sapiens
ccactgtgtccaccaggaatgc

SEQ ID NO: 9018112 - DNA, 22 bp, Homo sapiens
ccactgtgcccagcctcatggg

SEQ ID NO: 9018113 - DNA, 22 bp, Homo sapiens
tccttccaggtccagggatgtg

SEQ ID NO: 9018114 - DNA, 22 bp, Homo sapiens
tccttccaggtccagggatgtg

SEQ ID NO: 9018115 - DNA, 22 bp, Homo sapiens
tccttccaggtccagggatgtg

SEQ ID NO: 9018116 - DNA, 22 bp, Homo sapiens
tccttcccaggtgtcgccgcct

SEQ ID NO: 9018117 - DNA, 22 bp, Homo sapiens
tccttcccaggtgtcgccgcct

SEQ ID NO: 9018118 - DNA, 17 bp, Homo sapiens
tccttcagtgcctctgc

SEQ ID NO: 9018119 - DNA, 21 bp, Homo sapiens
tccttcagtctagatgattgt

SEQ ID NO: 9018120 - DNA, 22 bp, Homo sapiens
tccttaaaggactagaagtcaa

SEQ ID NO: 9018121 - DNA, 22 bp, Homo sapiens
tcctgggcttgctcctccagct

SEQ ID NO: 9018122 - DNA, 22 bp, Homo sapiens
tcctgggctgtgtgccactctg

SEQ ID NO: 9018123 - DNA, 22 bp, Homo sapiens
tcctgggcttcacagactctgt

SEQ ID NO: 9018124 - DNA, 22 bp, Homo sapiens
tcctgggcttgctcctccagct

SEQ ID NO: 9018125 - DNA, 22 bp, Homo sapiens
tcctgggcttgctcctccagct

SEQ ID NO: 9018126 - DNA, 22 bp, Homo sapiens
tcctgggcttgctcctccagct

SEQ ID NO: 9018127 - DNA, 22 bp, Homo sapiens
tcctgggcttgctcctccagct

SEQ ID NO: 9018128 - DNA, 22 bp, Homo sapiens
tcctgggcttcacagactctgt

SEQ ID NO: 9018129 - DNA, 22 bp, Homo sapiens
tcctgggcttcacagactctgt

SEQ ID NO: 9018130 - DNA, 22 bp, Homo sapiens
tcctgggcttagtggctaggtc

SEQ ID NO: 9018131 - DNA, 22 bp, Homo sapiens
tcctgggcttagtggctaggtc

SEQ ID NO: 9018132 - DNA, 22 bp, Homo sapiens
tcctgggcttagtggctaggtc

SEQ ID NO: 9018133 - DNA, 19 bp, Homo sapiens
tcctggggaggggcatggc

SEQ ID NO: 9018134 - DNA, 19 bp, Homo sapiens
tcctggggaggggcatggc

SEQ ID NO: 9018135 - DNA, 19 bp, Homo sapiens
tcctggggaggggcatggc

SEQ ID NO: 9018136 - DNA, 19 bp, Homo sapiens
tcctggggaggggcatggc

SEQ ID NO: 9018137 - DNA, 19 bp, Homo sapiens
tcctggggaggggcatggc

SEQ ID NO: 9018138 - DNA, 22 bp, Homo sapiens
tcctgtttttgtaatcgactct

SEQ ID NO: 9018139 - DNA, 19 bp, Homo sapiens
tccttaaaaaagcagttct

SEQ ID NO: 9018140 - DNA, 19 bp, Homo sapiens
tccttaaaaaagcagttct

SEQ ID NO: 9018141 - DNA, 22 bp, Homo sapiens
tccttaaacaacacactttgta

SEQ ID NO: 9018142 - DNA, 22 bp, Homo sapiens
tccttaaacaacacactttgta

SEQ ID NO: 9018143 - DNA, 22 bp, Homo sapiens
tcctgggcttgctcctccagct

SEQ ID NO: 9018144 - DNA, 22 bp, Homo sapiens
tcctgggctttgtttctctcct

SEQ ID NO: 9018145 - DNA, 22 bp, Homo sapiens
tcctgggctttgtttctctcct

SEQ ID NO: 9018146 - DNA, 22 bp, Homo sapiens
tcctgggctttgtttctctcct

SEQ ID NO: 9018147 - DNA, 21 bp, Homo sapiens
tccttcccccttggcctggga

SEQ ID NO: 9018148 - DNA, 22 bp, Homo sapiens
tccttcctccatggtcttggtt

SEQ ID NO: 9018149 - DNA, 22 bp, Homo sapiens
tccttcctccatggtcttggtt

SEQ ID NO: 9018150 - DNA, 22 bp, Homo sapiens
tccttcctcggggacccagatc

SEQ ID NO: 9018151 - DNA, 22 bp, Homo sapiens
tccttcctgcaggccaagtcct

SEQ ID NO: 9018152 - DNA, 22 bp, Homo sapiens
tccttcctcggggacccagatc

SEQ ID NO: 9018153 - DNA, 22 bp, Homo sapiens
tccttcctcggggacccagatc

SEQ ID NO: 9018154 - DNA, 22 bp, Homo sapiens
tccttccccctcaagagaactt

SEQ ID NO: 9018155 - DNA, 19 bp, Homo sapiens
tccttccccccagcacaga

SEQ ID NO: 9018156 - DNA, 19 bp, Homo sapiens
tccttccccccagcacaga

SEQ ID NO: 9018157 - DNA, 22 bp, Homo sapiens
tccttggggtaactccagcctg

SEQ ID NO: 9018158 - DNA, 22 bp, Homo sapiens
tccttggggtaactccagcctg

SEQ ID NO: 9018159 - DNA, 23 bp, Homo sapiens
tccttgggcctgcccagagtggt

SEQ ID NO: 9018160 - DNA, 22 bp, Homo sapiens
tccttcctgcaggccaagtcct

SEQ ID NO: 9018161 - DNA, 22 bp, Homo sapiens
tccttcctgcaggccaagtcct

SEQ ID NO: 9018162 - DNA, 23 bp, Homo sapiens
tccttgggcctgcccagagtggt

SEQ ID NO: 9018163 - DNA, 22 bp, Homo sapiens
tccttcctgctctaacattcag

SEQ ID NO: 9018164 - DNA, 20 bp, Homo sapiens
tcctttactgttggggttgg

SEQ ID NO: 9018165 - DNA, 22 bp, Homo sapiens
tcctttatgtgagttgtttccc

SEQ ID NO: 9018166 - DNA, 22 bp, Homo sapiens
tcctttatgtgagttgtttccc

SEQ ID NO: 9018167 - DNA, 22 bp, Homo sapiens
tcctttcaccaaaaagtgttgt

SEQ ID NO: 9018168 - DNA, 22 bp, Homo sapiens
ccactgctaacttgctgcagct

SEQ ID NO: 9018169 - DNA, 22 bp, Homo sapiens
ccactgctaacttgctgcagct

SEQ ID NO: 9018170 - DNA, 22 bp, Homo sapiens
tcctttaacttgattattttca

SEQ ID NO: 9018171 - DNA, 23 bp, Homo sapiens
tcctttaagatatcttattcctt

SEQ ID NO: 9018172 - DNA, 23 bp, Homo sapiens
tcctttaagatatcttattcctt

SEQ ID NO: 9018173 - DNA, 23 bp, Homo sapiens
tcctttaatgctggaatggctag

SEQ ID NO: 9018174 - DNA, 22 bp, Homo sapiens
tcctttatctgctcagaaagta

SEQ ID NO: 9018175 - DNA, 22 bp, Homo sapiens
tcctttatctgctcagaaagta

SEQ ID NO: 9018176 - DNA, 22 bp, Homo sapiens
tcctttatcaaggagccttaga

SEQ ID NO: 9018177 - DNA, 19 bp, Homo sapiens
tccttgtgactgtgtgaaa

SEQ ID NO: 9018178 - DNA, 22 bp, Homo sapiens
tcctttaaacaaccagctctca

SEQ ID NO: 9018179 - DNA, 22 bp, Homo sapiens
tccttgttgctgcagtcacctg

SEQ ID NO: 9018180 - DNA, 22 bp, Homo sapiens
tccttgtaacgttgggctgggg

SEQ ID NO: 9018181 - DNA, 22 bp, Homo sapiens
tccttggtgctggagctcagac

SEQ ID NO: 9018182 - DNA, 22 bp, Homo sapiens
tccttggtgcaaatgatttaat

SEQ ID NO: 9018183 - DNA, 22 bp, Homo sapiens
tccttggtgctggagctcagac

SEQ ID NO: 9018184 - DNA, 22 bp, Homo sapiens
tccttgggtcagtgagtgaggt

SEQ ID NO: 9018185 - DNA, 22 bp, Homo sapiens
tccttgggtcagtgagtgaggt

SEQ ID NO: 9018186 - DNA, 22 bp, Homo sapiens
tccttgggtcagtgagtgaggt

SEQ ID NO: 9018187 - DNA, 22 bp, Homo sapiens
tcctttaacttgattattttca

SEQ ID NO: 9018188 - DNA, 22 bp, Homo sapiens
tcctttaacttgattattttca

SEQ ID NO: 9018189 - DNA, 22 bp, Homo sapiens
tcctttaactagttaccatgtt

SEQ ID NO: 9018190 - DNA, 22 bp, Homo sapiens
tcctttaactagttaccatgtt

SEQ ID NO: 9018191 - DNA, 22 bp, Homo sapiens
tcctttaaagaactgtgctttt

SEQ ID NO: 9018192 - DNA, 22 bp, Homo sapiens
tcctttaaactcctttcaagtc

SEQ ID NO: 9018193 - DNA, 22 bp, Homo sapiens
tcctttaaactcctttcaagtc

SEQ ID NO: 9018194 - DNA, 22 bp, Homo sapiens
tcctttaaagaactgtgctttt

SEQ ID NO: 9018195 - DNA, 22 bp, Homo sapiens
tcctttaaagaactgtgctttt

SEQ ID NO: 9018196 - DNA, 22 bp, Homo sapiens
catgcatcagaatcacctagag

SEQ ID NO: 9018197 - DNA, 22 bp, Homo sapiens
catgcatattactagcacagca

SEQ ID NO: 9018198 - DNA, 22 bp, Homo sapiens
catgcatattactagcacagca

SEQ ID NO: 9018199 - DNA, 22 bp, Homo sapiens
catgcatgccgggctgacagag

SEQ ID NO: 9018200 - DNA, 22 bp, Homo sapiens
catgcatgccgggctgacagag

SEQ ID NO: 9018201 - DNA, 20 bp, Homo sapiens
catgcatgacactggaaagg

SEQ ID NO: 9018202 - DNA, 22 bp, Homo sapiens
catgcatctggtcttggaaata

SEQ ID NO: 9018203 - DNA, 22 bp, Homo sapiens
catgcatcgatgaatgcgtggg

SEQ ID NO: 9018204 - DNA, 22 bp, Homo sapiens
catgcatcgatgaatgcgtggg

SEQ ID NO: 9018205 - DNA, 22 bp, Homo sapiens
catgcatagctttggagctagg

SEQ ID NO: 9018206 - DNA, 22 bp, Homo sapiens
catgcatagtttttctagaagg

SEQ ID NO: 9018207 - DNA, 22 bp, Homo sapiens
catgcatatgtcaaaaaagcta

SEQ ID NO: 9018208 - DNA, 22 bp, Homo sapiens
catgcatatgtcaaaaaagcta

SEQ ID NO: 9018209 - DNA, 22 bp, Homo sapiens
catgcagtgtgtatctacttaa

SEQ ID NO: 9018210 - DNA, 22 bp, Homo sapiens
catgcagtgtgtatctacttaa

SEQ ID NO: 9018211 - DNA, 22 bp, Homo sapiens
catgcagtgcctctggattctt

SEQ ID NO: 9018212 - DNA, 22 bp, Homo sapiens
catgcagtgactcagacacagg

SEQ ID NO: 9018213 - DNA, 22 bp, Homo sapiens
catgcatacacaggtcaggcag

SEQ ID NO: 9018214 - DNA, 22 bp, Homo sapiens
catgcaggcgcaacttctacaa

SEQ ID NO: 9018215 - DNA, 22 bp, Homo sapiens
catgcagggactagagaacagg

SEQ ID NO: 9018216 - DNA, 22 bp, Homo sapiens
catgcagggactagagaacagg

SEQ ID NO: 9018217 - DNA, 22 bp, Homo sapiens
catgcagggacttgtgctccat

SEQ ID NO: 9018218 - DNA, 22 bp, Homo sapiens
catgcagggagcagaggagaca

SEQ ID NO: 9018219 - DNA, 22 bp, Homo sapiens
catgcagggacttgtgctccat

SEQ ID NO: 9018220 - DNA, 22 bp, Homo sapiens
catgcagggagtgctcctatta

SEQ ID NO: 9018221 - DNA, 22 bp, Homo sapiens
catgcaggtctggagcttgggg

SEQ ID NO: 9018222 - DNA, 22 bp, Homo sapiens
catgcagggagcagaggagaca

SEQ ID NO: 9018223 - DNA, 22 bp, Homo sapiens
catgcaggtctggagcttgggg

SEQ ID NO: 9018224 - DNA, 22 bp, Homo sapiens
catgcagtctggagccttctgt

SEQ ID NO: 9018225 - DNA, 22 bp, Homo sapiens
catgcagtctggagccttctgt

SEQ ID NO: 9018226 - DNA, 22 bp, Homo sapiens
catgcagtgaaattgatatcca

SEQ ID NO: 9018227 - DNA, 22 bp, Homo sapiens
catgcagtgactcagacacagg

SEQ ID NO: 9018228 - DNA, 22 bp, Homo sapiens
catgcagtcaataaacatgtgt

SEQ ID NO: 9018229 - DNA, 22 bp, Homo sapiens
catgcaggttatatgtgcttct

SEQ ID NO: 9018230 - DNA, 22 bp, Homo sapiens
catgcaggtgaccaggtgtggg

SEQ ID NO: 9018231 - DNA, 22 bp, Homo sapiens
catgacaaatcagaggggcttg

SEQ ID NO: 9018232 - DNA, 22 bp, Homo sapiens
catgaattatttttcacaagat

SEQ ID NO: 9018233 - DNA, 22 bp, Homo sapiens
catgaattatttttcacaagat

SEQ ID NO: 9018234 - DNA, 22 bp, Homo sapiens
catgaatttatattattagtga

SEQ ID NO: 9018235 - DNA, 22 bp, Homo sapiens
catgaattatttttcacaagat

SEQ ID NO: 9018236 - DNA, 22 bp, Homo sapiens
catgaattatttttcacaagat

SEQ ID NO: 9018237 - DNA, 22 bp, Homo sapiens
catgaatttttctgtgggttaa

SEQ ID NO: 9018238 - DNA, 22 bp, Homo sapiens
catgaattttaagactgttttt

SEQ ID NO: 9018239 - DNA, 22 bp, Homo sapiens
catgaatttatattattagtga

SEQ ID NO: 9018240 - DNA, 22 bp, Homo sapiens
catgaaggaattaaggtaagga

SEQ ID NO: 9018241 - DNA, 22 bp, Homo sapiens
catgaaggctgccagcaggcat

SEQ ID NO: 9018242 - DNA, 22 bp, Homo sapiens
catgaattagcaatggtgtgca

SEQ ID NO: 9018243 - DNA, 22 bp, Homo sapiens
catgaatcagaatcacctagag

SEQ ID NO: 9018244 - DNA, 22 bp, Homo sapiens
catgaagtcaggatttccatga

SEQ ID NO: 9018245 - DNA, 22 bp, Homo sapiens
catgaagtcaggatttccatga

SEQ ID NO: 9018246 - DNA, 22 bp, Homo sapiens
catgaatatacatcctgatggc

SEQ ID NO: 9018247 - DNA, 22 bp, Homo sapiens
catgaatatttagtatttactt

SEQ ID NO: 9018248 - DNA, 22 bp, Homo sapiens
catgagaaccaggtctgtgttt

SEQ ID NO: 9018249 - DNA, 22 bp, Homo sapiens
catgactgtgttagaagaatga

SEQ ID NO: 9018250 - DNA, 22 bp, Homo sapiens
catgactgtgttagaagaatga

SEQ ID NO: 9018251 - DNA, 22 bp, Homo sapiens
catgactctccctctgtttatt

SEQ ID NO: 9018252 - DNA, 22 bp, Homo sapiens
catgacattttaaaaagaacat

SEQ ID NO: 9018253 - DNA, 22 bp, Homo sapiens
catgacagtcctgaagagaacg

SEQ ID NO: 9018254 - DNA, 22 bp, Homo sapiens
catgacagtcctgaagagaacg

SEQ ID NO: 9018255 - DNA, 22 bp, Homo sapiens
catgacagtcctgaagagaacg

SEQ ID NO: 9018256 - DNA, 22 bp, Homo sapiens
catgacagtcctgaagagaacg

SEQ ID NO: 9018257 - DNA, 22 bp, Homo sapiens
catgacagtcctgaagagaacg

SEQ ID NO: 9018258 - DNA, 22 bp, Homo sapiens
catgacagatgcaaaggattgg

SEQ ID NO: 9018259 - DNA, 20 bp, Homo sapiens
catgacactgttcctctgcc

SEQ ID NO: 9018260 - DNA, 22 bp, Homo sapiens
catgacagatgcaaaggattgg

SEQ ID NO: 9018261 - DNA, 22 bp, Homo sapiens
catgcacacacagttctaatta

SEQ ID NO: 9018262 - DNA, 22 bp, Homo sapiens
catgcacacacagttctaatta

SEQ ID NO: 9018263 - DNA, 22 bp, Homo sapiens
catgcacacacgtgcatgtacg

SEQ ID NO: 9018264 - DNA, 22 bp, Homo sapiens
catgcacacacgtgcatgtacg

SEQ ID NO: 9018265 - DNA, 22 bp, Homo sapiens
catgcacacacgtgcatgtacg

SEQ ID NO: 9018266 - DNA, 22 bp, Homo sapiens
catgcacacacgtgcatgtacg

SEQ ID NO: 9018267 - DNA, 22 bp, Homo sapiens
catgcacacacgtgcatgtacg

SEQ ID NO: 9018268 - DNA, 22 bp, Homo sapiens
catgcaggcctatggagcagtg

SEQ ID NO: 9018269 - DNA, 22 bp, Homo sapiens
catgcaggcctatggagcagtg

SEQ ID NO: 9018270 - DNA, 23 bp, Homo sapiens
tccaggagaattccagggcccgg

SEQ ID NO: 9018271 - DNA, 23 bp, Homo sapiens
tccaggagaattccagggcccgg

SEQ ID NO: 9018272 - DNA, 22 bp, Homo sapiens
tccaggagaaggccatccagcg

SEQ ID NO: 9018273 - DNA, 22 bp, Homo sapiens
tccaggagaaggccatccagcg

SEQ ID NO: 9018274 - DNA, 22 bp, Homo sapiens
tccaggagaaggccatccagcg

SEQ ID NO: 9018275 - DNA, 22 bp, Homo sapiens
tccaggagaaggccatccagcg

SEQ ID NO: 9018276 - DNA, 20 bp, Homo sapiens
tccagctgggaacagctgat

SEQ ID NO: 9018277 - DNA, 22 bp, Homo sapiens
tccagctggggacatgggcttc

SEQ ID NO: 9018278 - DNA, 22 bp, Homo sapiens
tccaggagaaggccatccagcg

SEQ ID NO: 9018279 - DNA, 22 bp, Homo sapiens
tccaggagaaggccatccagcg

SEQ ID NO: 9018280 - DNA, 20 bp, Homo sapiens
tccagctgggaacagctgat

SEQ ID NO: 9018281 - DNA, 20 bp, Homo sapiens
tccagctgggaacagctgat

SEQ ID NO: 9018282 - DNA, 20 bp, Homo sapiens
tccagctgggaacagctgat

SEQ ID NO: 9018283 - DNA, 22 bp, Homo sapiens
catggccagcccccagttcctc

SEQ ID NO: 9018284 - DNA, 22 bp, Homo sapiens
catggccacatctagctgcaag

SEQ ID NO: 9018285 - DNA, 22 bp, Homo sapiens
catggccacatctagctgcaag

SEQ ID NO: 9018286 - DNA, 22 bp, Homo sapiens
catggccacatctagctgcaag

SEQ ID NO: 9018287 - DNA, 22 bp, Homo sapiens
catggccacatctagctgcaag

SEQ ID NO: 9018288 - DNA, 22 bp, Homo sapiens
catggccacatctagctgcaag

SEQ ID NO: 9018289 - DNA, 22 bp, Homo sapiens
catggccaaggatgctcaacca

SEQ ID NO: 9018290 - DNA, 22 bp, Homo sapiens
catggcattttttcatggagac

SEQ ID NO: 9018291 - DNA, 22 bp, Homo sapiens
catggcattttttcatggagac

SEQ ID NO: 9018292 - DNA, 22 bp, Homo sapiens
catggcaggaggctgctggcag

SEQ ID NO: 9018293 - DNA, 22 bp, Homo sapiens
catggcaggaggctgctggcag

SEQ ID NO: 9018294 - DNA, 22 bp, Homo sapiens
catggcaggaggctgctggcag

SEQ ID NO: 9018295 - DNA, 22 bp, Homo sapiens
catggcaggaggctgctggcag

SEQ ID NO: 9018296 - DNA, 22 bp, Homo sapiens
catggcaggatctgggcccaca

SEQ ID NO: 9018297 - DNA, 22 bp, Homo sapiens
catggcaggcttcttcagcctt

SEQ ID NO: 9018298 - DNA, 22 bp, Homo sapiens
catggcaggatctgggcccaca

SEQ ID NO: 9018299 - DNA, 22 bp, Homo sapiens
catggcaggaggctgctggcag

SEQ ID NO: 9018300 - DNA, 22 bp, Homo sapiens
catggcaggatctgggcccaca

SEQ ID NO: 9018301 - DNA, 22 bp, Homo sapiens
catggcagggctgtgggcaggt

SEQ ID NO: 9018302 - DNA, 22 bp, Homo sapiens
catggcagggctgtgggcaggt

SEQ ID NO: 9018303 - DNA, 22 bp, Homo sapiens
catggcagggctgtgggcaggt

SEQ ID NO: 9018304 - DNA, 22 bp, Homo sapiens
catggcagggctgtgggcaggt

SEQ ID NO: 9018305 - DNA, 22 bp, Homo sapiens
catggcagggctgtgggcaggt

SEQ ID NO: 9018306 - DNA, 22 bp, Homo sapiens
catggcaggtgcagattctgtg

SEQ ID NO: 9018307 - DNA, 22 bp, Homo sapiens
catggcaggtgcagattctgtg

SEQ ID NO: 9018308 - DNA, 22 bp, Homo sapiens
catggcattgcataacggggct

SEQ ID NO: 9018309 - DNA, 22 bp, Homo sapiens
catggcattgcataacggggct

SEQ ID NO: 9018310 - DNA, 22 bp, Homo sapiens
catggcagtgattcagcctttg

SEQ ID NO: 9018311 - DNA, 22 bp, Homo sapiens
catggcagtgattcagcctttg

SEQ ID NO: 9018312 - DNA, 22 bp, Homo sapiens
catggcagtgattcagcctttg

SEQ ID NO: 9018313 - DNA, 22 bp, Homo sapiens
catggcagtgattcagcctttg

SEQ ID NO: 9018314 - DNA, 22 bp, Homo sapiens
catggcagcctgccctgcttgc

SEQ ID NO: 9018315 - DNA, 22 bp, Homo sapiens
catggcagctcctccagtgtga

SEQ ID NO: 9018316 - DNA, 22 bp, Homo sapiens
catggcagctcctccagtgtga

SEQ ID NO: 9018317 - DNA, 22 bp, Homo sapiens
catggcagcctgccctgcttgc

SEQ ID NO: 9018318 - DNA, 22 bp, Homo sapiens
catggcagctcctccagtgtga

SEQ ID NO: 9018319 - DNA, 22 bp, Homo sapiens
catggcagagcctgcaggtggg

SEQ ID NO: 9018320 - DNA, 22 bp, Homo sapiens
catggcagagcctgcaggtggg

SEQ ID NO: 9018321 - DNA, 22 bp, Homo sapiens
catggcagagcctgcaggtggg

SEQ ID NO: 9018322 - DNA, 23 bp, Homo sapiens
catggcagcaagagctcatggcc

SEQ ID NO: 9018323 - DNA, 23 bp, Homo sapiens
catggcagcaagagctcatggcc

SEQ ID NO: 9018324 - DNA, 23 bp, Homo sapiens
catggcagcaagagctcatggcc

SEQ ID NO: 9018325 - DNA, 22 bp, Homo sapiens
catggcaggaaggacatgcact

SEQ ID NO: 9018326 - DNA, 22 bp, Homo sapiens
catggcaggaaggacatgcact

SEQ ID NO: 9018327 - DNA, 22 bp, Homo sapiens
catggcaggaaggacatgcact

SEQ ID NO: 9018328 - DNA, 22 bp, Homo sapiens
catggcaggaaggacatgcact

SEQ ID NO: 9018329 - DNA, 22 bp, Homo sapiens
catggcaggaaaatgaacaggc

SEQ ID NO: 9018330 - DNA, 22 bp, Homo sapiens
catggcaggaaaatgaacaggc

SEQ ID NO: 9018331 - DNA, 22 bp, Homo sapiens
catggcaggaaaatgaacaggc

SEQ ID NO: 9018332 - DNA, 22 bp, Homo sapiens
catggcagctttgggaggagga

SEQ ID NO: 9018333 - DNA, 22 bp, Homo sapiens
catggcagctttgggaggagga

SEQ ID NO: 9018334 - DNA, 22 bp, Homo sapiens
catggcagctttgggaggagga

SEQ ID NO: 9018335 - DNA, 22 bp, Homo sapiens
catggcagctttgggaggagga

SEQ ID NO: 9018336 - DNA, 22 bp, Homo sapiens
catggcagctttgggaggagga

SEQ ID NO: 9018337 - DNA, 22 bp, Homo sapiens
catggcagagcctgcaggtggg

SEQ ID NO: 9018338 - DNA, 22 bp, Homo sapiens
catggcagagcctgcaggtggg

SEQ ID NO: 9018339 - DNA, 22 bp, Homo sapiens
catggcagagaaggggaactgg

SEQ ID NO: 9018340 - DNA, 22 bp, Homo sapiens
catggaaggcaaaagacacaga

SEQ ID NO: 9018341 - DNA, 22 bp, Homo sapiens
catggaactgtataaaggcact

SEQ ID NO: 9018342 - DNA, 22 bp, Homo sapiens
catggaactgtgctgaaaagtg

SEQ ID NO: 9018343 - DNA, 22 bp, Homo sapiens
catggaacttcaagaagaaagc

SEQ ID NO: 9018344 - DNA, 22 bp, Homo sapiens
catggaaggcaaaagacacaga

SEQ ID NO: 9018345 - DNA, 22 bp, Homo sapiens
catggaactgtataaaggcact

SEQ ID NO: 9018346 - DNA, 22 bp, Homo sapiens
catgcattgtaatttttagtct

SEQ ID NO: 9018347 - DNA, 22 bp, Homo sapiens
catgcatttggagttttcaagt

SEQ ID NO: 9018348 - DNA, 22 bp, Homo sapiens
catgcattacaattgcatagta

SEQ ID NO: 9018349 - DNA, 22 bp, Homo sapiens
catgcattcagaatctctcaca

SEQ ID NO: 9018350 - DNA, 22 bp, Homo sapiens
catgcattcagaatctctcaca

SEQ ID NO: 9018351 - DNA, 22 bp, Homo sapiens
catgcattcctcctctgcctta

SEQ ID NO: 9018352 - DNA, 22 bp, Homo sapiens
catgcatgtgcagaaaggggtt

SEQ ID NO: 9018353 - DNA, 22 bp, Homo sapiens
catgcatgtcagggatcctgga

SEQ ID NO: 9018354 - DNA, 22 bp, Homo sapiens
catgcatgtttactacagtgac

SEQ ID NO: 9018355 - DNA, 22 bp, Homo sapiens
catgcatgtttactacagtgac

SEQ ID NO: 9018356 - DNA, 22 bp, Homo sapiens
catgcatggtcatgctgggact

SEQ ID NO: 9018357 - DNA, 22 bp, Homo sapiens
catgcatgcctggctcacagag

SEQ ID NO: 9018358 - DNA, 22 bp, Homo sapiens
catgcatgcctggctcacagag

SEQ ID NO: 9018359 - DNA, 22 bp, Homo sapiens
catgcatgccgggctgacagag

SEQ ID NO: 9018360 - DNA, 22 bp, Homo sapiens
tcagggagtgttggcaggatca

SEQ ID NO: 9018361 - DNA, 22 bp, Homo sapiens
tcagggagtgttggcaggatca

SEQ ID NO: 9018362 - DNA, 22 bp, Homo sapiens
tcagggagtgttggcaggatca

SEQ ID NO: 9018363 - DNA, 22 bp, Homo sapiens
tcagggagtgttggcaggatca

SEQ ID NO: 9018364 - DNA, 19 bp, Homo sapiens
tcagggagtttacagcatg

SEQ ID NO: 9018365 - DNA, 22 bp, Homo sapiens
tcagggaggtgtctgccagaga

SEQ ID NO: 9018366 - DNA, 22 bp, Homo sapiens
tcagggagtagtttgtgctatg

SEQ ID NO: 9018367 - DNA, 22 bp, Homo sapiens
tcagggaggtgtctgccagaga

SEQ ID NO: 9018368 - DNA, 22 bp, Homo sapiens
tcagggaggtgtctgccagaga

SEQ ID NO: 9018369 - DNA, 22 bp, Homo sapiens
tcagggaggtgtctgccagaga

SEQ ID NO: 9018370 - DNA, 22 bp, Homo sapiens
tcagggagggacctgaggctgg

SEQ ID NO: 9018371 - DNA, 22 bp, Homo sapiens
tcagggagggacctgaggctgg

SEQ ID NO: 9018372 - DNA, 22 bp, Homo sapiens
tcagggagggacctgaggctgg

SEQ ID NO: 9018373 - DNA, 22 bp, Homo sapiens
tcagggagggacctgaggctgg

SEQ ID NO: 9018374 - DNA, 22 bp, Homo sapiens
tcagggagggacctgaggctgg

SEQ ID NO: 9018375 - DNA, 22 bp, Homo sapiens
tcagggagatttggggactcaa

SEQ ID NO: 9018376 - DNA, 22 bp, Homo sapiens
tcagggagatttggggactcaa

SEQ ID NO: 9018377 - DNA, 22 bp, Homo sapiens
tcagggagatttggggactcaa

SEQ ID NO: 9018378 - DNA, 22 bp, Homo sapiens
tcagggagatttggggactcaa

SEQ ID NO: 9018379 - DNA, 22 bp, Homo sapiens
tcagggagatttggggactcaa

SEQ ID NO: 9018380 - DNA, 22 bp, Homo sapiens
tcaggtgtatcatggagttgaa

SEQ ID NO: 9018381 - DNA, 22 bp, Homo sapiens
tcagtattgctagagttcactg

SEQ ID NO: 9018382 - DNA, 22 bp, Homo sapiens
tcaggtgtaggttgttcagttt

SEQ ID NO: 9018383 - DNA, 19 bp, Homo sapiens
tcagggagtttacagcatg

SEQ ID NO: 9018384 - DNA, 22 bp, Homo sapiens
tcagggattaaggtcaaaggtg

SEQ ID NO: 9018385 - DNA, 22 bp, Homo sapiens
tcagggattgcaaaattcatcc

SEQ ID NO: 9018386 - DNA, 22 bp, Homo sapiens
tcagtcacactcactgaggtag

SEQ ID NO: 9018387 - DNA, 22 bp, Homo sapiens
tcagtcaccttgactatagctg

SEQ ID NO: 9018388 - DNA, 22 bp, Homo sapiens
tcagtcaccttgactatagctg

SEQ ID NO: 9018389 - DNA, 22 bp, Homo sapiens
tcagtcaccaatgggaggagga

SEQ ID NO: 9018390 - DNA, 22 bp, Homo sapiens
tcagtcaacataaatccaaggt

SEQ ID NO: 9018391 - DNA, 22 bp, Homo sapiens
tcagtatttctaaacattggct

SEQ ID NO: 9018392 - DNA, 22 bp, Homo sapiens
tcagtcaatgtgtcagctctcc

SEQ ID NO: 9018393 - DNA, 22 bp, Homo sapiens
tcagtcaatgccttcctgggca

SEQ ID NO: 9018394 - DNA, 20 bp, Homo sapiens
tcagtccaagcgaatgcccc

SEQ ID NO: 9018395 - DNA, 22 bp, Homo sapiens
tcagtccaatgattgtaggaca

SEQ ID NO: 9018396 - DNA, 22 bp, Homo sapiens
tcagtccaatgattgtaggaca

SEQ ID NO: 9018397 - DNA, 22 bp, Homo sapiens
tcagtccactaagacccttgtt

SEQ ID NO: 9018398 - DNA, 22 bp, Homo sapiens
tcagtccactaagacccttgtt

SEQ ID NO: 9018399 - DNA, 22 bp, Homo sapiens
tcagtccagccatcatttattc

SEQ ID NO: 9018400 - DNA, 22 bp, Homo sapiens
tcagtcagaatcaccagacttt

SEQ ID NO: 9018401 - DNA, 22 bp, Homo sapiens
tcagtcatgaccatggggtgga

SEQ ID NO: 9018402 - DNA, 22 bp, Homo sapiens
tcagtcaggagatgccagagat

SEQ ID NO: 9018403 - DNA, 22 bp, Homo sapiens
tcagtcacttttgcctgctaca

SEQ ID NO: 9018404 - DNA, 22 bp, Homo sapiens
tcagtcacttttgcctgctaca

SEQ ID NO: 9018405 - DNA, 22 bp, Homo sapiens
tcagtcaccaatgggaggagga

SEQ ID NO: 9018406 - DNA, 19 bp, Homo sapiens
tcagtcatatatctgcacc

SEQ ID NO: 9018407 - DNA, 22 bp, Homo sapiens
tcagtcagtgcgcaagtggtta

SEQ ID NO: 9018408 - DNA, 22 bp, Homo sapiens
tcagtcagggctgtgaactgcc

SEQ ID NO: 9018409 - DNA, 22 bp, Homo sapiens
tcagtgctcctaaagtgaatgc

SEQ ID NO: 9018410 - DNA, 22 bp, Homo sapiens
tcagtgctcctaaagtgaatgc

SEQ ID NO: 9018411 - DNA, 22 bp, Homo sapiens
tcagtgctcctaaagtgaatgc

SEQ ID NO: 9018412 - DNA, 22 bp, Homo sapiens
tcagtgctcaggggagccgagg

SEQ ID NO: 9018413 - DNA, 22 bp, Homo sapiens
tcagtgctcaggggagccgagg

SEQ ID NO: 9018414 - DNA, 19 bp, Homo sapiens
tcagtgctcctatgtcctt

SEQ ID NO: 9018415 - DNA, 22 bp, Homo sapiens
tcagtgctcctaaagtgaatgc

SEQ ID NO: 9018416 - DNA, 22 bp, Homo sapiens
tcagtgctcctaaagtgaatgc

SEQ ID NO: 9018417 - DNA, 20 bp, Homo sapiens
tcagtgctcaggcaccaggt

SEQ ID NO: 9018418 - DNA, 20 bp, Homo sapiens
tcagtgctcaggcaccaggt

SEQ ID NO: 9018419 - DNA, 20 bp, Homo sapiens
tcagtgctcaggcaccaggt

SEQ ID NO: 9018420 - DNA, 22 bp, Homo sapiens
tcagtgctaaaagagctggtgt

SEQ ID NO: 9018421 - DNA, 22 bp, Homo sapiens
tcagtgctaaaagagctggtgt

SEQ ID NO: 9018422 - DNA, 22 bp, Homo sapiens
tcagtgcctactttgatcaatt

SEQ ID NO: 9018423 - DNA, 22 bp, Homo sapiens
tcagtgcctactttgatcaatt

SEQ ID NO: 9018424 - DNA, 22 bp, Homo sapiens
tcagtgctgccatggcagggcc

SEQ ID NO: 9018425 - DNA, 22 bp, Homo sapiens
tcagtgctgagtagcgtgcacc

SEQ ID NO: 9018426 - DNA, 22 bp, Homo sapiens
tcagtgctgccatggcagggcc

SEQ ID NO: 9018427 - DNA, 22 bp, Homo sapiens
tcagtgctgagtagcgtgcacc

SEQ ID NO: 9018428 - DNA, 19 bp, Homo sapiens
tcagtgctcctatgtcctt

SEQ ID NO: 9018429 - DNA, 22 bp, Homo sapiens
tcagtgctctgaggtccagggt

SEQ ID NO: 9018430 - DNA, 22 bp, Homo sapiens
tcagtgctctgaggtccagggt

SEQ ID NO: 9018431 - DNA, 22 bp, Homo sapiens
catctattttctgtgaggtatc

SEQ ID NO: 9018432 - DNA, 22 bp, Homo sapiens
tcagtgctgctttatgacagtt

SEQ ID NO: 9018433 - DNA, 21 bp, Homo sapiens
catctcagtgggttggtggat

SEQ ID NO: 9018434 - DNA, 22 bp, Homo sapiens
catctcagtgtacagggagtct

SEQ ID NO: 9018435 - DNA, 22 bp, Homo sapiens
tcagtgccaattctgccatggg

SEQ ID NO: 9018436 - DNA, 22 bp, Homo sapiens
tcagtgcattctaccaaaaggc

SEQ ID NO: 9018437 - DNA, 22 bp, Homo sapiens
tcagtgccatgggcagacaggc

SEQ ID NO: 9018438 - DNA, 22 bp, Homo sapiens
tcagtgccatgggcagacaggc

SEQ ID NO: 9018439 - DNA, 22 bp, Homo sapiens
tcagtgccaattctgccatggg

SEQ ID NO: 9018440 - DNA, 22 bp, Homo sapiens
tcagtgccaattctgccatggg

SEQ ID NO: 9018441 - DNA, 22 bp, Homo sapiens
tcagtcccttaaaggtggcagc

SEQ ID NO: 9018442 - DNA, 22 bp, Homo sapiens
tcagtcccttctccaggtcagc

SEQ ID NO: 9018443 - DNA, 22 bp, Homo sapiens
tcagtgcattcatgggtggctg

SEQ ID NO: 9018444 - DNA, 22 bp, Homo sapiens
tcagtccctaaggatatgggct

SEQ ID NO: 9018445 - DNA, 22 bp, Homo sapiens
tcagtccctcgcaccctgccat

SEQ ID NO: 9018446 - DNA, 21 bp, Homo sapiens
tcagtccctgggtgtgtccca

SEQ ID NO: 9018447 - DNA, 21 bp, Homo sapiens
tcagtccctgggtgtgtccca

SEQ ID NO: 9018448 - DNA, 21 bp, Homo sapiens
tcagtccctgggtgtgtccca

SEQ ID NO: 9018449 - DNA, 22 bp, Homo sapiens
tcagtccagctcctcatttccc

SEQ ID NO: 9018450 - DNA, 19 bp, Homo sapiens
tcagtccagctgtgaagac

SEQ ID NO: 9018451 - DNA, 22 bp, Homo sapiens
tcagtccaggggctgtgatgtc

SEQ ID NO: 9018452 - DNA, 22 bp, Homo sapiens
tcagtccaggattgggagtgac

SEQ ID NO: 9018453 - DNA, 22 bp, Homo sapiens
tcagtccaggattgggagtgac

SEQ ID NO: 9018454 - DNA, 22 bp, Homo sapiens
tcagtccaggggctgtgatgtc

SEQ ID NO: 9018455 - DNA, 22 bp, Homo sapiens
tcagtccaggggctgtgatgtc

SEQ ID NO: 9018456 - DNA, 22 bp, Homo sapiens
tcagtccataggtgggcctgag

SEQ ID NO: 9018457 - DNA, 22 bp, Homo sapiens
tcagtccataggtgggcctgag

SEQ ID NO: 9018458 - DNA, 22 bp, Homo sapiens
tcagtccataggtgggcctgag

SEQ ID NO: 9018459 - DNA, 23 bp, Homo sapiens
tcagtcccaacagcttctcctgg

SEQ ID NO: 9018460 - DNA, 22 bp, Homo sapiens
tcagtccataggtgggcctgag

SEQ ID NO: 9018461 - DNA, 22 bp, Homo sapiens
tcagtcccaaggtcctgaggtg

SEQ ID NO: 9018462 - DNA, 22 bp, Homo sapiens
tcagtccccagatgtgtgctgt

SEQ ID NO: 9018463 - DNA, 22 bp, Homo sapiens
catgaacaaattctgtttgagg

SEQ ID NO: 9018464 - DNA, 22 bp, Homo sapiens
catgaacaaattctgtttgagg

SEQ ID NO: 9018465 - DNA, 22 bp, Homo sapiens
catgaacaaattctgtttgagg

SEQ ID NO: 9018466 - DNA, 22 bp, Homo sapiens
catgaacaatttgctcactgat

SEQ ID NO: 9018467 - DNA, 22 bp, Homo sapiens
catgaacaatttgctcactgat

SEQ ID NO: 9018468 - DNA, 22 bp, Homo sapiens
catgaacaatttgctcactgat

SEQ ID NO: 9018469 - DNA, 22 bp, Homo sapiens
catgaacaccaggcatgaacaa

SEQ ID NO: 9018470 - DNA, 22 bp, Homo sapiens
catgaacaccaggcatgaacaa

SEQ ID NO: 9018471 - DNA, 22 bp, Homo sapiens
catgaacaccaggcatgaacaa

SEQ ID NO: 9018472 - DNA, 22 bp, Homo sapiens
catgaacagctaacattttggg

SEQ ID NO: 9018473 - DNA, 21 bp, Homo sapiens
catgaacatgcttatcctcag

SEQ ID NO: 9018474 - DNA, 22 bp, Homo sapiens
catgaacattcagaaatacagc

SEQ ID NO: 9018475 - DNA, 22 bp, Homo sapiens
catgaacattcagaaatacagc

SEQ ID NO: 9018476 - DNA, 21 bp, Homo sapiens
catgaacatgcttatcctcag

SEQ ID NO: 9018477 - DNA, 21 bp, Homo sapiens
catgaacatgcttatcctcag

SEQ ID NO: 9018478 - DNA, 22 bp, Homo sapiens
catgaacagattcttcatttct

SEQ ID NO: 9018479 - DNA, 22 bp, Homo sapiens
catgaacagctaacattttggg

SEQ ID NO: 9018480 - DNA, 22 bp, Homo sapiens
catgaacagctaacattttggg

SEQ ID NO: 9018481 - DNA, 22 bp, Homo sapiens
catgaacatttgtttacatctg

SEQ ID NO: 9018482 - DNA, 22 bp, Homo sapiens
catgaacatttgtttacatctg

SEQ ID NO: 9018483 - DNA, 21 bp, Homo sapiens
catgaagaatcaagacccttg

SEQ ID NO: 9018484 - DNA, 21 bp, Homo sapiens
catgaagaatcaagacccttg

SEQ ID NO: 9018485 - DNA, 22 bp, Homo sapiens
catgaacattcagaaatacagc

SEQ ID NO: 9018486 - DNA, 22 bp, Homo sapiens
catgaacattcagaaatacagc

SEQ ID NO: 9018487 - DNA, 22 bp, Homo sapiens
catgaacattcagaaatacagc

SEQ ID NO: 9018488 - DNA, 22 bp, Homo sapiens
catgaacattcagaaatacagc

SEQ ID NO: 9018489 - DNA, 22 bp, Homo sapiens
catgaacattgcagggatgtga

SEQ ID NO: 9018490 - DNA, 22 bp, Homo sapiens
catgaagccctcatcagtctga

SEQ ID NO: 9018491 - DNA, 22 bp, Homo sapiens
catgaagcatgttttgtcatga

SEQ ID NO: 9018492 - DNA, 22 bp, Homo sapiens
catgaagcatgttttgtcatga

SEQ ID NO: 9018493 - DNA, 22 bp, Homo sapiens
catgaagatcctgtatgttttt

SEQ ID NO: 9018494 - DNA, 22 bp, Homo sapiens
catctgttaaagtctaatgaaa

SEQ ID NO: 9018495 - DNA, 22 bp, Homo sapiens
catctgtgccgggtgtttgtca

SEQ ID NO: 9018496 - DNA, 22 bp, Homo sapiens
catctgttctatccacgttgct

SEQ ID NO: 9018497 - DNA, 22 bp, Homo sapiens
catctgttctatccacgttgct

SEQ ID NO: 9018498 - DNA, 22 bp, Homo sapiens
catctgtgtatctgtgcttaga

SEQ ID NO: 9018499 - DNA, 22 bp, Homo sapiens
catctgtcatcaaccctggcta

SEQ ID NO: 9018500 - DNA, 22 bp, Homo sapiens
catctgtctgcatgctctgggt

SEQ ID NO: 9018501 - DNA, 22 bp, Homo sapiens
catctgtcatcaaccctggcta

SEQ ID NO: 9018502 - DNA, 22 bp, Homo sapiens
catctgtcatcaaccctggcta

SEQ ID NO: 9018503 - DNA, 22 bp, Homo sapiens
catctgtctgcatgctctgggt

SEQ ID NO: 9018504 - DNA, 22 bp, Homo sapiens
catctgtttcctaatctgtagc

SEQ ID NO: 9018505 - DNA, 22 bp, Homo sapiens
catctgttgagttctccgtgct

SEQ ID NO: 9018506 - DNA, 22 bp, Homo sapiens
catcttaaattaaagcttaagg

SEQ ID NO: 9018507 - DNA, 22 bp, Homo sapiens
catgaaaataacattgttgtga

SEQ ID NO: 9018508 - DNA, 22 bp, Homo sapiens
catgaaaataacattgttgtga

SEQ ID NO: 9018509 - DNA, 22 bp, Homo sapiens
catgaaaataacattgttgtga

SEQ ID NO: 9018510 - DNA, 22 bp, Homo sapiens
catgaaaataacattgttgtga

SEQ ID NO: 9018511 - DNA, 22 bp, Homo sapiens
catgaaaataacattgttgtga

SEQ ID NO: 9018512 - DNA, 22 bp, Homo sapiens
catgaaaataacattgttgtga

SEQ ID NO: 9018513 - DNA, 22 bp, Homo sapiens
catgaaaataacattgttgtga

SEQ ID NO: 9018514 - DNA, 22 bp, Homo sapiens
catgaacaaatcctgcgagtat

SEQ ID NO: 9018515 - DNA, 22 bp, Homo sapiens
catgaaattgctcctttggtgc

SEQ ID NO: 9018516 - DNA, 19 bp, Homo sapiens
catctggatgattctcctg

SEQ ID NO: 9018517 - DNA, 19 bp, Homo sapiens
catctggatgattctcctg

SEQ ID NO: 9018518 - DNA, 22 bp, Homo sapiens
catctggcagaccctgcctccg

SEQ ID NO: 9018519 - DNA, 19 bp, Homo sapiens
catctggatgattctcctg

SEQ ID NO: 9018520 - DNA, 22 bp, Homo sapiens
catctggcagaccctgcctccg

SEQ ID NO: 9018521 - DNA, 22 bp, Homo sapiens
catctggcagaccctgcctccg

SEQ ID NO: 9018522 - DNA, 22 bp, Homo sapiens
catctgctgttccttggactca

SEQ ID NO: 9018523 - DNA, 22 bp, Homo sapiens
catctgctgttccttggactca

SEQ ID NO: 9018524 - DNA, 22 bp, Homo sapiens
catctgctgttccttggactca

SEQ ID NO: 9018525 - DNA, 22 bp, Homo sapiens
catctggacaaaactctgaagg

SEQ ID NO: 9018526 - DNA, 22 bp, Homo sapiens
catctgctgttccttggactca

SEQ ID NO: 9018527 - DNA, 22 bp, Homo sapiens
catctgtaaagtaggaatattg

SEQ ID NO: 9018528 - DNA, 22 bp, Homo sapiens
catctgtaaggaagaggatcaa

SEQ ID NO: 9018529 - DNA, 19 bp, Homo sapiens
catctgtaaggacagaaac

SEQ ID NO: 9018530 - DNA, 19 bp, Homo sapiens
catctgtaaggacagaaac

SEQ ID NO: 9018531 - DNA, 22 bp, Homo sapiens
catctgtagctccatgacaatt

SEQ ID NO: 9018532 - DNA, 22 bp, Homo sapiens
catctgtaggtgacacatgagt

SEQ ID NO: 9018533 - DNA, 22 bp, Homo sapiens
catctgtagctccatgacaatt

SEQ ID NO: 9018534 - DNA, 22 bp, Homo sapiens
catctgtagctccatgacaatt

SEQ ID NO: 9018535 - DNA, 22 bp, Homo sapiens
catctgtaggtgacacatgagt

SEQ ID NO: 9018536 - DNA, 22 bp, Homo sapiens
catctgtcaacagagacggtca

SEQ ID NO: 9018537 - DNA, 22 bp, Homo sapiens
catctggctagctatcattgtg

SEQ ID NO: 9018538 - DNA, 22 bp, Homo sapiens
catctggttagttgatgaaact

SEQ ID NO: 9018539 - DNA, 22 bp, Homo sapiens
catctgtaaagtaggaatattg

SEQ ID NO: 9018540 - DNA, 22 bp, Homo sapiens
catctggtttaaaagaagaaag

SEQ ID NO: 9018541 - DNA, 22 bp, Homo sapiens
catctgaagtgaattgcttttt

SEQ ID NO: 9018542 - DNA, 22 bp, Homo sapiens
catctgaataaagacttgcaga

SEQ ID NO: 9018543 - DNA, 22 bp, Homo sapiens
catctgaatttgccttagtttc

SEQ ID NO: 9018544 - DNA, 22 bp, Homo sapiens
catctgaatatcccaggcatat

SEQ ID NO: 9018545 - DNA, 22 bp, Homo sapiens
catctgaatatcccaggcatat

SEQ ID NO: 9018546 - DNA, 22 bp, Homo sapiens
catctgaaatctgcctacaagc

SEQ ID NO: 9018547 - DNA, 22 bp, Homo sapiens
catctgaaatctgcctacaagc

SEQ ID NO: 9018548 - DNA, 22 bp, Homo sapiens
catctgaagtgaattgcttttt

SEQ ID NO: 9018549 - DNA, 22 bp, Homo sapiens
catctgcaggggaagccagttt

SEQ ID NO: 9018550 - DNA, 22 bp, Homo sapiens
catctgccactctctcccacca

SEQ ID NO: 9018551 - DNA, 20 bp, Homo sapiens
catctgagcccacagaagtc

SEQ ID NO: 9018552 - DNA, 20 bp, Homo sapiens
catctgagcccacagaagtc

SEQ ID NO: 9018553 - DNA, 22 bp, Homo sapiens
catctgaatttgccttagtttc

SEQ ID NO: 9018554 - DNA, 22 bp, Homo sapiens
catctgctgttccttggactca

SEQ ID NO: 9018555 - DNA, 22 bp, Homo sapiens
catctgctgttccttggactca

SEQ ID NO: 9018556 - DNA, 22 bp, Homo sapiens
catctgctgtaattaacaagcc

SEQ ID NO: 9018557 - DNA, 22 bp, Homo sapiens
catctgctgctgaagccagcat

SEQ ID NO: 9018558 - DNA, 22 bp, Homo sapiens
catctgctgacttgacaagtac

SEQ ID NO: 9018559 - DNA, 22 bp, Homo sapiens
catctgctctgtctgccatgtt

SEQ ID NO: 9018560 - DNA, 22 bp, Homo sapiens
catctgcctaagtggccctgtt

SEQ ID NO: 9018561 - DNA, 22 bp, Homo sapiens
catctgcctaagtggccctgtt

SEQ ID NO: 9018562 - DNA, 22 bp, Homo sapiens
catctgcctaagtggccctgtt

SEQ ID NO: 9018563 - DNA, 22 bp, Homo sapiens
tcaggccaggagatcagattga

SEQ ID NO: 9018564 - DNA, 22 bp, Homo sapiens
tcaggcagagtggaagctgcaa

SEQ ID NO: 9018565 - DNA, 22 bp, Homo sapiens
tcaggcagagttaatttgctcc

SEQ ID NO: 9018566 - DNA, 22 bp, Homo sapiens
tcaggcccagagtcacggatcc

SEQ ID NO: 9018567 - DNA, 22 bp, Homo sapiens
tcaggcccagagtcacggatcc

SEQ ID NO: 9018568 - DNA, 18 bp, Homo sapiens
cataattttctttcttta

SEQ ID NO: 9018569 - DNA, 22 bp, Homo sapiens
tcaggcagagtggaagctgcaa

SEQ ID NO: 9018570 - DNA, 18 bp, Homo sapiens
cataattttctttcttta

SEQ ID NO: 9018571 - DNA, 18 bp, Homo sapiens
cataattttctttcttta

SEQ ID NO: 9018572 - DNA, 22 bp, Homo sapiens
cataattttccatggtttgcta

SEQ ID NO: 9018573 - DNA, 18 bp, Homo sapiens
cataattttctttcttta

SEQ ID NO: 9018574 - DNA, 22 bp, Homo sapiens
cataatttctgtatcagcacca

SEQ ID NO: 9018575 - DNA, 22 bp, Homo sapiens
cataatttctgtatcagcacca

SEQ ID NO: 9018576 - DNA, 22 bp, Homo sapiens
cataatttctgtatcagcacca

SEQ ID NO: 9018577 - DNA, 22 bp, Homo sapiens
cataatttctaccagggccata

SEQ ID NO: 9018578 - DNA, 22 bp, Homo sapiens
cataatttgatatgcttgatgg

SEQ ID NO: 9018579 - DNA, 22 bp, Homo sapiens
cataatttgatatgcttgatgg

SEQ ID NO: 9018580 - DNA, 18 bp, Homo sapiens
cataattttctttcttta

SEQ ID NO: 9018581 - DNA, 22 bp, Homo sapiens
cataattttccatggtttgcta

SEQ ID NO: 9018582 - DNA, 22 bp, Homo sapiens
cataattttccatggtttgcta

SEQ ID NO: 9018583 - DNA, 22 bp, Homo sapiens
cataatttcccaagagattgaa

SEQ ID NO: 9018584 - DNA, 22 bp, Homo sapiens
cataatttcccaagagattgaa

SEQ ID NO: 9018585 - DNA, 22 bp, Homo sapiens
cataatttcactgtcgtatggc

SEQ ID NO: 9018586 - DNA, 22 bp, Homo sapiens
cataatttcactgtcgtatggc

SEQ ID NO: 9018587 - DNA, 22 bp, Homo sapiens
cataatttcactgtcgtatggc

SEQ ID NO: 9018588 - DNA, 22 bp, Homo sapiens
cataattataaacgcaagttca

SEQ ID NO: 9018589 - DNA, 22 bp, Homo sapiens
cataattataaacgcaagttca

SEQ ID NO: 9018590 - DNA, 22 bp, Homo sapiens
cataattagtcatgttatgcat

SEQ ID NO: 9018591 - DNA, 22 bp, Homo sapiens
cataattataaacgcaagttca

SEQ ID NO: 9018592 - DNA, 22 bp, Homo sapiens
cataattaggcagttgatcatt

SEQ ID NO: 9018593 - DNA, 22 bp, Homo sapiens
cataattaggcagttgatcatt

SEQ ID NO: 9018594 - DNA, 22 bp, Homo sapiens
cataattagtcatgttatgcat

SEQ ID NO: 9018595 - DNA, 22 bp, Homo sapiens
cataatgttgtaacacatagag

SEQ ID NO: 9018596 - DNA, 22 bp, Homo sapiens
cataattaaattctgggcaaga

SEQ ID NO: 9018597 - DNA, 22 bp, Homo sapiens
cataattaaattctgggcaaga

SEQ ID NO: 9018598 - DNA, 22 bp, Homo sapiens
cataattaaattctgggcaaga

SEQ ID NO: 9018599 - DNA, 22 bp, Homo sapiens
cataatgtgtgtcatacagact

SEQ ID NO: 9018600 - DNA, 22 bp, Homo sapiens
cataatgtgtgtcatacagact

SEQ ID NO: 9018601 - DNA, 22 bp, Homo sapiens
cataattactgatatgctgatt

SEQ ID NO: 9018602 - DNA, 22 bp, Homo sapiens
cataattactgatatgctgatt

SEQ ID NO: 9018603 - DNA, 22 bp, Homo sapiens
cataattagagaattcatgtta

SEQ ID NO: 9018604 - DNA, 22 bp, Homo sapiens
cataattaggcagttgatcatt

SEQ ID NO: 9018605 - DNA, 22 bp, Homo sapiens
cataattaggcagttgatcatt

SEQ ID NO: 9018606 - DNA, 22 bp, Homo sapiens
tcagcaggtgaacatcatgcca

SEQ ID NO: 9018607 - DNA, 22 bp, Homo sapiens
tcagcaggtgaacatcatgcca

SEQ ID NO: 9018608 - DNA, 22 bp, Homo sapiens
tcagcaggtgcctcagattctt

SEQ ID NO: 9018609 - DNA, 22 bp, Homo sapiens
tcagcaggtgcctcagattctt

SEQ ID NO: 9018610 - DNA, 22 bp, Homo sapiens
tcagcaggtctgaggcggggcc

SEQ ID NO: 9018611 - DNA, 22 bp, Homo sapiens
tcagcaggtctgaggcggggcc

SEQ ID NO: 9018612 - DNA, 22 bp, Homo sapiens
tcagcaggtctgaggcggggcc

SEQ ID NO: 9018613 - DNA, 22 bp, Homo sapiens
tcagcaggtgaacatcatgcca

SEQ ID NO: 9018614 - DNA, 22 bp, Homo sapiens
tcagcagggtttgacttctaat

SEQ ID NO: 9018615 - DNA, 22 bp, Homo sapiens
tcagcagggtttgacttctaat

SEQ ID NO: 9018616 - DNA, 22 bp, Homo sapiens
tcagcagggtttgacttctaat

SEQ ID NO: 9018617 - DNA, 22 bp, Homo sapiens
tcagcaggtctgaggcggggcc

SEQ ID NO: 9018618 - DNA, 22 bp, Homo sapiens
tcagcaggtgctttgtttactc

SEQ ID NO: 9018619 - DNA, 22 bp, Homo sapiens
tcagcaggtgctttgtttactc

SEQ ID NO: 9018620 - DNA, 22 bp, Homo sapiens
tcagcaggtgcctcagattctt

SEQ ID NO: 9018621 - DNA, 22 bp, Homo sapiens
tcagcaggtgctttgtttactc

SEQ ID NO: 9018622 - DNA, 22 bp, Homo sapiens
tcagcaggtggtgggcaggtga

SEQ ID NO: 9018623 - DNA, 17 bp, Homo sapiens
tcagcagtaatggtggg

SEQ ID NO: 9018624 - DNA, 22 bp, Homo sapiens
tcagcagtagagggggcacagt

SEQ ID NO: 9018625 - DNA, 22 bp, Homo sapiens
tcagcagtagagggggcacagt

SEQ ID NO: 9018626 - DNA, 22 bp, Homo sapiens
tcagcaggtggtgggcaggtga

SEQ ID NO: 9018627 - DNA, 22 bp, Homo sapiens
tcagcaggtggtgggcaggtga

SEQ ID NO: 9018628 - DNA, 22 bp, Homo sapiens
cataatcagatgtgtacataag

SEQ ID NO: 9018629 - DNA, 22 bp, Homo sapiens
cataatcagatgtgtacataag

SEQ ID NO: 9018630 - DNA, 22 bp, Homo sapiens
cataatatctccgattacttgc

SEQ ID NO: 9018631 - DNA, 22 bp, Homo sapiens
cataatcctggtgtagccctct

SEQ ID NO: 9018632 - DNA, 22 bp, Homo sapiens
cataatcccaggcttgcattca

SEQ ID NO: 9018633 - DNA, 22 bp, Homo sapiens
cataatgtctgacacagtaaga

SEQ ID NO: 9018634 - DNA, 22 bp, Homo sapiens
cataatgtctgacacagtaaga

SEQ ID NO: 9018635 - DNA, 22 bp, Homo sapiens
cataatgtgtgtcatacagact

SEQ ID NO: 9018636 - DNA, 22 bp, Homo sapiens
cataatgtctgacacagtaaga

SEQ ID NO: 9018637 - DNA, 22 bp, Homo sapiens
cataatgtctgacacagtaaga

SEQ ID NO: 9018638 - DNA, 22 bp, Homo sapiens
cataatgtatgcattttccagc

SEQ ID NO: 9018639 - DNA, 22 bp, Homo sapiens
cataatccttgattcaaataat

SEQ ID NO: 9018640 - DNA, 22 bp, Homo sapiens
tcagcagtcctccaggatcaag

SEQ ID NO: 9018641 - DNA, 22 bp, Homo sapiens
tcagcagtcacatgttgtccca

SEQ ID NO: 9018642 - DNA, 22 bp, Homo sapiens
tcagcagtcaaagagaatctct

SEQ ID NO: 9018643 - DNA, 22 bp, Homo sapiens
tcagcagtagagggggcacagt

SEQ ID NO: 9018644 - DNA, 22 bp, Homo sapiens
tcagcagtcaaagagaatctct

SEQ ID NO: 9018645 - DNA, 17 bp, Homo sapiens
tcagcagtaatggtggg

SEQ ID NO: 9018646 - DNA, 22 bp, Homo sapiens
tcagcagtcctccaggatcaag

SEQ ID NO: 9018647 - DNA, 22 bp, Homo sapiens
tcagcagtcctccaggatcaag

SEQ ID NO: 9018648 - DNA, 22 bp, Homo sapiens
cataacatccttgctactttga

SEQ ID NO: 9018649 - DNA, 22 bp, Homo sapiens
cataatatctccgattacttgc

SEQ ID NO: 9018650 - DNA, 22 bp, Homo sapiens
cataatatctccgattacttgc

SEQ ID NO: 9018651 - DNA, 22 bp, Homo sapiens
cataatatctccgattacttgc

SEQ ID NO: 9018652 - DNA, 22 bp, Homo sapiens
cataacatccttgctactttga

SEQ ID NO: 9018653 - DNA, 22 bp, Homo sapiens
cataatatctccgattacttgc

SEQ ID NO: 9018654 - DNA, 22 bp, Homo sapiens
catagaaatcaggtgagaatct

SEQ ID NO: 9018655 - DNA, 22 bp, Homo sapiens
catagaaatcaggtgagaatct

SEQ ID NO: 9018656 - DNA, 22 bp, Homo sapiens
catagaaatcaggtgagaatct

SEQ ID NO: 9018657 - DNA, 22 bp, Homo sapiens
catagaaatcaggtgagaatct

SEQ ID NO: 9018658 - DNA, 22 bp, Homo sapiens
catagaaatcaggtgagaatct

SEQ ID NO: 9018659 - DNA, 22 bp, Homo sapiens
catagaaatcaggtgagaatct

SEQ ID NO: 9018660 - DNA, 22 bp, Homo sapiens
catagaaatcaggtgagaatct

SEQ ID NO: 9018661 - DNA, 22 bp, Homo sapiens
catagaaagtattatggaattt

SEQ ID NO: 9018662 - DNA, 22 bp, Homo sapiens
catagaaagtattatggaattt

SEQ ID NO: 9018663 - DNA, 22 bp, Homo sapiens
catagaaagtattatggaattt

SEQ ID NO: 9018664 - DNA, 22 bp, Homo sapiens
catagaaagtattatggaattt

SEQ ID NO: 9018665 - DNA, 22 bp, Homo sapiens
catagaaacttgcagcaagcac

SEQ ID NO: 9018666 - DNA, 22 bp, Homo sapiens
catagaaactgagacaaggatt

SEQ ID NO: 9018667 - DNA, 22 bp, Homo sapiens
catagaaactgagacaaggatt

SEQ ID NO: 9018668 - DNA, 22 bp, Homo sapiens
catagaaactgagacaaggatt

SEQ ID NO: 9018669 - DNA, 22 bp, Homo sapiens
catagaaactgagacaaggatt

SEQ ID NO: 9018670 - DNA, 22 bp, Homo sapiens
catagaaactgagacaaggatt

SEQ ID NO: 9018671 - DNA, 22 bp, Homo sapiens
catagaaactgagacaaggatt

SEQ ID NO: 9018672 - DNA, 22 bp, Homo sapiens
catagaaaagagtaggtaatgt

SEQ ID NO: 9018673 - DNA, 22 bp, Homo sapiens
catagaaaagagtaggtaatgt

SEQ ID NO: 9018674 - DNA, 22 bp, Homo sapiens
tcaggcctgagaaaaatccttt

SEQ ID NO: 9018675 - DNA, 22 bp, Homo sapiens
catagaaactgagacaaggatt

SEQ ID NO: 9018676 - DNA, 22 bp, Homo sapiens
tcaggcctagaacacagcagat

SEQ ID NO: 9018677 - DNA, 22 bp, Homo sapiens
tcaggccctttgctgctgcccc

SEQ ID NO: 9018678 - DNA, 22 bp, Homo sapiens
tcaggcctagggagaaaattca

SEQ ID NO: 9018679 - DNA, 22 bp, Homo sapiens
tcaggcctagggagccacacca

SEQ ID NO: 9018680 - DNA, 22 bp, Homo sapiens
tcaggcctagggagccacacca

SEQ ID NO: 9018681 - DNA, 22 bp, Homo sapiens
tcaggcctagggagccacacca

SEQ ID NO: 9018682 - DNA, 22 bp, Homo sapiens
tcaggcctccaggttaccattt

SEQ ID NO: 9018683 - DNA, 22 bp, Homo sapiens
tcaggcctcagcagcccacagg

SEQ ID NO: 9018684 - DNA, 22 bp, Homo sapiens
tcaggcctcagcagcccacagg

SEQ ID NO: 9018685 - DNA, 22 bp, Homo sapiens
tcaggcctcaagctgctttaag

SEQ ID NO: 9018686 - DNA, 22 bp, Homo sapiens
tcaggcccttctcccaggactc

SEQ ID NO: 9018687 - DNA, 22 bp, Homo sapiens
tcaggcccttctcccaggactc

SEQ ID NO: 9018688 - DNA, 22 bp, Homo sapiens
tcaggccctttgctgctgcccc

SEQ ID NO: 9018689 - DNA, 22 bp, Homo sapiens
tcaggccccatcccagacttat

SEQ ID NO: 9018690 - DNA, 22 bp, Homo sapiens
tcaggcccagagtcacggatcc

SEQ ID NO: 9018691 - DNA, 22 bp, Homo sapiens
tcaggccccatcccagacttat

SEQ ID NO: 9018692 - DNA, 22 bp, Homo sapiens
tcaggccccttgtcagctctgt

SEQ ID NO: 9018693 - DNA, 22 bp, Homo sapiens
tcaggccccttgtcagctctgt

SEQ ID NO: 9018694 - DNA, 22 bp, Homo sapiens
catagaatcatagcacatttga

SEQ ID NO: 9018695 - DNA, 22 bp, Homo sapiens
catagaatcatagcacatttga

SEQ ID NO: 9018696 - DNA, 22 bp, Homo sapiens
catagaatcatagcacatttga

SEQ ID NO: 9018697 - DNA, 22 bp, Homo sapiens
catagaacagctcctagcacat

SEQ ID NO: 9018698 - DNA, 22 bp, Homo sapiens
catagaatatgtgtgattgtta

SEQ ID NO: 9018699 - DNA, 22 bp, Homo sapiens
catagaatatgtgtgattgtta

SEQ ID NO: 9018700 - DNA, 22 bp, Homo sapiens
tcaggctgtatatcttgcactc

SEQ ID NO: 9018701 - DNA, 22 bp, Homo sapiens
tcaggctgcctatcagactgtg

SEQ ID NO: 9018702 - DNA, 22 bp, Homo sapiens
tcaggctgcctatcagactgtg

SEQ ID NO: 9018703 - DNA, 22 bp, Homo sapiens
tcaggctgcctatcagactgtg

SEQ ID NO: 9018704 - DNA, 22 bp, Homo sapiens
catagaatcatagcacatttga

SEQ ID NO: 9018705 - DNA, 17 bp, Homo sapiens
tcaggctgtgcctggta

SEQ ID NO: 9018706 - DNA, 21 bp, Homo sapiens
tcaggctgtctgctggttcca

SEQ ID NO: 9018707 - DNA, 17 bp, Homo sapiens
tcaggctgtgcctggta

SEQ ID NO: 9018708 - DNA, 17 bp, Homo sapiens
tcaggctgtgcctggta

SEQ ID NO: 9018709 - DNA, 17 bp, Homo sapiens
tcaggctgtgcctggta

SEQ ID NO: 9018710 - DNA, 22 bp, Homo sapiens
tcaggctgtgggcactggccat

SEQ ID NO: 9018711 - DNA, 22 bp, Homo sapiens
tcaggctgtggctttgaccgca

SEQ ID NO: 9018712 - DNA, 22 bp, Homo sapiens
tcaggctgtgggcactggccat

SEQ ID NO: 9018713 - DNA, 22 bp, Homo sapiens
tcaggctgtgggcactggccat

SEQ ID NO: 9018714 - DNA, 22 bp, Homo sapiens
tcaggctgtggcttcagttctt

SEQ ID NO: 9018715 - DNA, 17 bp, Homo sapiens
tcaggctgtgcctggta

SEQ ID NO: 9018716 - DNA, 22 bp, Homo sapiens
tcaggctgtgtctttaaacaat

SEQ ID NO: 9018717 - DNA, 22 bp, Homo sapiens
tcaggctgttagccacctcctc

SEQ ID NO: 9018718 - DNA, 22 bp, Homo sapiens
tcaggctgttagccacctcctc

SEQ ID NO: 9018719 - DNA, 22 bp, Homo sapiens
tcaggctgtgtctttaaacaat

SEQ ID NO: 9018720 - DNA, 22 bp, Homo sapiens
tcagggagaggtgagagcctgt

SEQ ID NO: 9018721 - DNA, 22 bp, Homo sapiens
tcagggagaggtgagagcctgt

SEQ ID NO: 9018722 - DNA, 22 bp, Homo sapiens
tcagggagaggtgagagcctgt

SEQ ID NO: 9018723 - DNA, 22 bp, Homo sapiens
tcagggagaggtgagagcctgt

SEQ ID NO: 9018724 - DNA, 22 bp, Homo sapiens
tcagggagagtgacccatccac

SEQ ID NO: 9018725 - DNA, 22 bp, Homo sapiens
tcagggagagtgacccatccac

SEQ ID NO: 9018726 - DNA, 22 bp, Homo sapiens
tcagaggatagaaatacttatt

SEQ ID NO: 9018727 - DNA, 23 bp, Homo sapiens
tcagaggatcatcaaacgttttc

SEQ ID NO: 9018728 - DNA, 22 bp, Homo sapiens
tcagaggatcatgtccctactc

SEQ ID NO: 9018729 - DNA, 22 bp, Homo sapiens
tcagaggagggactcagaccca

SEQ ID NO: 9018730 - DNA, 22 bp, Homo sapiens
tcagaggaggcatttaaacaga

SEQ ID NO: 9018731 - DNA, 22 bp, Homo sapiens
tcagaggaggcatttaaacaga

SEQ ID NO: 9018732 - DNA, 23 bp, Homo sapiens
tcagagcaagatgatgtatgagc

SEQ ID NO: 9018733 - DNA, 22 bp, Homo sapiens
tcagaggagcaaaagaggggat

SEQ ID NO: 9018734 - DNA, 22 bp, Homo sapiens
tcagaggagcaaaagaggggat

SEQ ID NO: 9018735 - DNA, 22 bp, Homo sapiens
tcagaggagatggttaccaggg

SEQ ID NO: 9018736 - DNA, 22 bp, Homo sapiens
tcagaggagccaaagttctgag

SEQ ID NO: 9018737 - DNA, 22 bp, Homo sapiens
tcagaggagcaaaagaggggat

SEQ ID NO: 9018738 - DNA, 21 bp, Homo sapiens
tcagataccagactcaagggg

SEQ ID NO: 9018739 - DNA, 22 bp, Homo sapiens
tcagatagtgataatagcatgt

SEQ ID NO: 9018740 - DNA, 22 bp, Homo sapiens
tcagatactagctctcagcctc

SEQ ID NO: 9018741 - DNA, 22 bp, Homo sapiens
tcagataccattgaatttgttg

SEQ ID NO: 9018742 - DNA, 22 bp, Homo sapiens
tcagatactgtggcttatgggc

SEQ ID NO: 9018743 - DNA, 22 bp, Homo sapiens
tcagatatagtcatttaaataa

SEQ ID NO: 9018744 - DNA, 22 bp, Homo sapiens
tcagatatgaattcatatctct

SEQ ID NO: 9018745 - DNA, 22 bp, Homo sapiens
tcagatatgaattcatatctct

SEQ ID NO: 9018746 - DNA, 22 bp, Homo sapiens
tcagatattcaattaagttaaa

SEQ ID NO: 9018747 - DNA, 22 bp, Homo sapiens
tcagatattcaattaagttaaa

SEQ ID NO: 9018748 - DNA, 22 bp, Homo sapiens
tcagagtttctagtcaaatcca

SEQ ID NO: 9018749 - DNA, 22 bp, Homo sapiens
tcagagtttctgatttagtagg

SEQ ID NO: 9018750 - DNA, 22 bp, Homo sapiens
tcagagtttcaggatacaaata

SEQ ID NO: 9018751 - DNA, 22 bp, Homo sapiens
tcagagtttctagtcaaatcca

SEQ ID NO: 9018752 - DNA, 22 bp, Homo sapiens
tcagagtttcaggatacaaata

SEQ ID NO: 9018753 - DNA, 22 bp, Homo sapiens
tcagagtttgaaataattttta

SEQ ID NO: 9018754 - DNA, 22 bp, Homo sapiens
tcagagtttgtactgacaggag

SEQ ID NO: 9018755 - DNA, 22 bp, Homo sapiens
tcagagtttgtactgacaggag

SEQ ID NO: 9018756 - DNA, 22 bp, Homo sapiens
tcagagttggcctttctgtatt

SEQ ID NO: 9018757 - DNA, 22 bp, Homo sapiens
tcagagttggcagtaaaacaca

SEQ ID NO: 9018758 - DNA, 22 bp, Homo sapiens
tcagagttggcagtaaaacaca

SEQ ID NO: 9018759 - DNA, 22 bp, Homo sapiens
tcagagttggcagtaaaacaca

SEQ ID NO: 9018760 - DNA, 22 bp, Homo sapiens
tcagaggatgctgttctttaat

SEQ ID NO: 9018761 - DNA, 22 bp, Homo sapiens
cagttttcttgttatatttggg

SEQ ID NO: 9018762 - DNA, 22 bp, Homo sapiens
cagttttcttgttatatttggg

SEQ ID NO: 9018763 - DNA, 22 bp, Homo sapiens
cagttttggtcctttctaggta

SEQ ID NO: 9018764 - DNA, 22 bp, Homo sapiens
cagtttttagattagttggtgg

SEQ ID NO: 9018765 - DNA, 22 bp, Homo sapiens
cagttttccatgactcagagag

SEQ ID NO: 9018766 - DNA, 22 bp, Homo sapiens
cagttttccatgactcagagag

SEQ ID NO: 9018767 - DNA, 22 bp, Homo sapiens
cagtttgtgctaggcactattt

SEQ ID NO: 9018768 - DNA, 22 bp, Homo sapiens
cagttttctaaagtctctttaa

SEQ ID NO: 9018769 - DNA, 22 bp, Homo sapiens
cagttttctatggtagaagcat

SEQ ID NO: 9018770 - DNA, 22 bp, Homo sapiens
tcagatcatcagctgctttata

SEQ ID NO: 9018771 - DNA, 22 bp, Homo sapiens
tcagatcatttgtggattcact

SEQ ID NO: 9018772 - DNA, 22 bp, Homo sapiens
tcagatattcaattaagttaaa

SEQ ID NO: 9018773 - DNA, 22 bp, Homo sapiens
tcagatattctctaagaacaat

SEQ ID NO: 9018774 - DNA, 22 bp, Homo sapiens
tcagatattctctaagaacaat

SEQ ID NO: 9018775 - DNA, 22 bp, Homo sapiens
cagtttgtcttgattcagaaca

SEQ ID NO: 9018776 - DNA, 22 bp, Homo sapiens
cagtttgtcttgattcagaaca

SEQ ID NO: 9018777 - DNA, 22 bp, Homo sapiens
cagtttgtcttgattcagaaca

SEQ ID NO: 9018778 - DNA, 22 bp, Homo sapiens
tcagatctaattggattattat

SEQ ID NO: 9018779 - DNA, 23 bp, Homo sapiens
tcagatgaggaatgcatactaat

SEQ ID NO: 9018780 - DNA, 22 bp, Homo sapiens
cagtttttgccattaagagtaa

SEQ ID NO: 9018781 - DNA, 22 bp, Homo sapiens
cagtttttgccattaagagtaa

SEQ ID NO: 9018782 - DNA, 22 bp, Homo sapiens
cagtttttgccattaagagtaa

SEQ ID NO: 9018783 - DNA, 17 bp, Homo sapiens
cataaaacagttctatt

SEQ ID NO: 9018784 - DNA, 17 bp, Homo sapiens
cataaaacagttctatt

SEQ ID NO: 9018785 - DNA, 22 bp, Homo sapiens
cataaaagccacctatttaaag

SEQ ID NO: 9018786 - DNA, 18 bp, Homo sapiens
cagtttttatatctggca

SEQ ID NO: 9018787 - DNA, 22 bp, Homo sapiens
cagtttttcaaaattacatgat

SEQ ID NO: 9018788 - DNA, 22 bp, Homo sapiens
cagtttttcaaaattacatgat

SEQ ID NO: 9018789 - DNA, 22 bp, Homo sapiens
cagtttttcaaaattacatgat

SEQ ID NO: 9018790 - DNA, 22 bp, Homo sapiens
cagtttttcaaaattacatgat

SEQ ID NO: 9018791 - DNA, 22 bp, Homo sapiens
cagtttttcaaaattacatgat

SEQ ID NO: 9018792 - DNA, 22 bp, Homo sapiens
cagtttttcaaaattacatgat

SEQ ID NO: 9018793 - DNA, 22 bp, Homo sapiens
cagtttttgccattaagagtaa

SEQ ID NO: 9018794 - DNA, 22 bp, Homo sapiens
cataaaatggcttgttctttaa

SEQ ID NO: 9018795 - DNA, 23 bp, Homo sapiens
cataaaatattagtatggtagca

SEQ ID NO: 9018796 - DNA, 23 bp, Homo sapiens
cataaaatattagtatggtagca

SEQ ID NO: 9018797 - DNA, 22 bp, Homo sapiens
cataaaaggtagcagtttgaaa

SEQ ID NO: 9018798 - DNA, 22 bp, Homo sapiens
cataaaagccacctatttaaag

SEQ ID NO: 9018799 - DNA, 22 bp, Homo sapiens
tcagagattcacgtcagtccca

SEQ ID NO: 9018800 - DNA, 22 bp, Homo sapiens
tcagagattgaaaacatatcca

SEQ ID NO: 9018801 - DNA, 18 bp, Homo sapiens
tcagagcaaacagaagcc

SEQ ID NO: 9018802 - DNA, 22 bp, Homo sapiens
tcagagcaaattcctgtgagcc

SEQ ID NO: 9018803 - DNA, 22 bp, Homo sapiens
tcagagcaaattcctgtgagcc

SEQ ID NO: 9018804 - DNA, 22 bp, Homo sapiens
tcagagatggagttagcagtga

SEQ ID NO: 9018805 - DNA, 23 bp, Homo sapiens
tcagagatggaaagcagaccacg

SEQ ID NO: 9018806 - DNA, 22 bp, Homo sapiens
tcagagattcacgtcagtccca

SEQ ID NO: 9018807 - DNA, 22 bp, Homo sapiens
tcagagatgcagtgccacctac

SEQ ID NO: 9018808 - DNA, 22 bp, Homo sapiens
tcagagatgcagtgccacctac

SEQ ID NO: 9018809 - DNA, 22 bp, Homo sapiens
tcagagatcttcaggatgggac

SEQ ID NO: 9018810 - DNA, 22 bp, Homo sapiens
tcagagatctggagtacaactg

SEQ ID NO: 9018811 - DNA, 22 bp, Homo sapiens
tcagagagttacacaaattgtt

SEQ ID NO: 9018812 - DNA, 22 bp, Homo sapiens
tcagagagtgcaaaatatagct

SEQ ID NO: 9018813 - DNA, 22 bp, Homo sapiens
tcagagagtgcaaaatatagct

SEQ ID NO: 9018814 - DNA, 22 bp, Homo sapiens
tcagagagttagtgtcttagct

SEQ ID NO: 9018815 - DNA, 22 bp, Homo sapiens
tcagagagttagtgtcttagct

SEQ ID NO: 9018816 - DNA, 22 bp, Homo sapiens
tcagagagttggaaagaattaa

SEQ ID NO: 9018817 - DNA, 22 bp, Homo sapiens
tcagagagttttcactagggtg

SEQ ID NO: 9018818 - DNA, 22 bp, Homo sapiens
tcagagagttttcactagggtg

SEQ ID NO: 9018819 - DNA, 22 bp, Homo sapiens
tcagagagttttcactagggtg

SEQ ID NO: 9018820 - DNA, 22 bp, Homo sapiens
tcagagatctggagtacaactg

SEQ ID NO: 9018821 - DNA, 22 bp, Homo sapiens
tcagagatcttcaggatgggac

SEQ ID NO: 9018822 - DNA, 23 bp, Homo sapiens
cagttggaggtacagagacactg

SEQ ID NO: 9018823 - DNA, 22 bp, Homo sapiens
cagttgctggatgtgcagctct

SEQ ID NO: 9018824 - DNA, 17 bp, Homo sapiens
cagttggagacaagtcc

SEQ ID NO: 9018825 - DNA, 22 bp, Homo sapiens
cagttggaggaatgaggctgta

SEQ ID NO: 9018826 - DNA, 22 bp, Homo sapiens
cagttgctacagttcaagtgtg

SEQ ID NO: 9018827 - DNA, 22 bp, Homo sapiens
cagttgcagctgtgacattgcg

SEQ ID NO: 9018828 - DNA, 22 bp, Homo sapiens
cagttgatttttatggtgtgaa

SEQ ID NO: 9018829 - DNA, 22 bp, Homo sapiens
cagttgcagaggcagagtgcta

SEQ ID NO: 9018830 - DNA, 21 bp, Homo sapiens
tcagagagtcacagtgaactg

SEQ ID NO: 9018831 - DNA, 21 bp, Homo sapiens
tcagagagtcacagtgaactg

SEQ ID NO: 9018832 - DNA, 21 bp, Homo sapiens
tcagagagtcacagtgaactg

SEQ ID NO: 9018833 - DNA, 22 bp, Homo sapiens
tcagagagtgcaaaatatagct

SEQ ID NO: 9018834 - DNA, 22 bp, Homo sapiens
tcagagagtcctggtcatttgc

SEQ ID NO: 9018835 - DNA, 21 bp, Homo sapiens
tcagagagtcacagtgaactg

SEQ ID NO: 9018836 - DNA, 22 bp, Homo sapiens
cagttgtcctttgtaccaagtt

SEQ ID NO: 9018837 - DNA, 22 bp, Homo sapiens
tcagagaggttggtgataagaa

SEQ ID NO: 9018838 - DNA, 17 bp, Homo sapiens
cagttgaaatgtttgga

SEQ ID NO: 9018839 - DNA, 22 bp, Homo sapiens
cagttgaatggtcagacaaggc

SEQ ID NO: 9018840 - DNA, 20 bp, Homo sapiens
cagttgaaataatttgtttg

SEQ ID NO: 9018841 - DNA, 22 bp, Homo sapiens
cagttcttaataccatgtggtt

SEQ ID NO: 9018842 - DNA, 22 bp, Homo sapiens
cagttgaaaagattttattctg

SEQ ID NO: 9018843 - DNA, 22 bp, Homo sapiens
cagttgatgggactcatgtggg

SEQ ID NO: 9018844 - DNA, 22 bp, Homo sapiens
cagttgatcactataggcttca

SEQ ID NO: 9018845 - DNA, 23 bp, Homo sapiens
cagttgatgttaccttccttaga

SEQ ID NO: 9018846 - DNA, 22 bp, Homo sapiens
cagttgattgacttaagtacct

SEQ ID NO: 9018847 - DNA, 23 bp, Homo sapiens
cagttgatgttaccttccttaga

SEQ ID NO: 9018848 - DNA, 22 bp, Homo sapiens
cagttgatgtttagactctgca

SEQ ID NO: 9018849 - DNA, 21 bp, Homo sapiens
cagttgatagagatcttgagc

SEQ ID NO: 9018850 - DNA, 22 bp, Homo sapiens
cagttgataataccagagagag

SEQ ID NO: 9018851 - DNA, 22 bp, Homo sapiens
cagttgatatagaaaaaagtga

SEQ ID NO: 9018852 - DNA, 22 bp, Homo sapiens
cagttgatattgcagacaagca

SEQ ID NO: 9018853 - DNA, 22 bp, Homo sapiens
cagttgatcactataggcttca

SEQ ID NO: 9018854 - DNA, 22 bp, Homo sapiens
cagttctggagtttcattcttt

SEQ ID NO: 9018855 - DNA, 22 bp, Homo sapiens
cagttctggaggctccacatct

SEQ ID NO: 9018856 - DNA, 22 bp, Homo sapiens
cagttctggaggctccacatct

SEQ ID NO: 9018857 - DNA, 22 bp, Homo sapiens
cagttctggtttgcagatatat

SEQ ID NO: 9018858 - DNA, 22 bp, Homo sapiens
tcaatgaagagatttaaatcat

SEQ ID NO: 9018859 - DNA, 22 bp, Homo sapiens
tcaatgaagagatttaaatcat

SEQ ID NO: 9018860 - DNA, 22 bp, Homo sapiens
cagttactgtatgtcaaagact

SEQ ID NO: 9018861 - DNA, 22 bp, Homo sapiens
cagttataagactaagctattc

SEQ ID NO: 9018862 - DNA, 22 bp, Homo sapiens
tcaatcaatggtttccaaattt

SEQ ID NO: 9018863 - DNA, 22 bp, Homo sapiens
tcaatcaaagcactgggctttg

SEQ ID NO: 9018864 - DNA, 22 bp, Homo sapiens
tcaatcaaagccagatgtcctt

SEQ ID NO: 9018865 - DNA, 22 bp, Homo sapiens
tcaatcaatgtgtcagttccca

SEQ ID NO: 9018866 - DNA, 22 bp, Homo sapiens
tcaatcacgtgttccatgttct

SEQ ID NO: 9018867 - DNA, 22 bp, Homo sapiens
tcaatctagagattaaaatagg

SEQ ID NO: 9018868 - DNA, 22 bp, Homo sapiens
tcaatctgttccattagaacat

SEQ ID NO: 9018869 - DNA, 22 bp, Homo sapiens
tcaatgaaagagcatgcatttt

SEQ ID NO: 9018870 - DNA, 22 bp, Homo sapiens
tcaatgaaagagcatgcatttt

SEQ ID NO: 9018871 - DNA, 22 bp, Homo sapiens
tcaatcataatgaagtgaagaa

SEQ ID NO: 9018872 - DNA, 22 bp, Homo sapiens
tcaatattcttctttagtagga

SEQ ID NO: 9018873 - DNA, 22 bp, Homo sapiens
tcaatatattccatgttttctc

SEQ ID NO: 9018874 - DNA, 22 bp, Homo sapiens
tcaatattcttctttagtagga

SEQ ID NO: 9018875 - DNA, 22 bp, Homo sapiens
tcaatatattccatgttttctc

SEQ ID NO: 9018876 - DNA, 22 bp, Homo sapiens
tcaatatattccatgttttctc

SEQ ID NO: 9018877 - DNA, 22 bp, Homo sapiens
tcaatagattaggtattagatt

SEQ ID NO: 9018878 - DNA, 22 bp, Homo sapiens
tcaatagattaggtattagatt

SEQ ID NO: 9018879 - DNA, 22 bp, Homo sapiens
tcaatagcatagcaattaatgt

SEQ ID NO: 9018880 - DNA, 22 bp, Homo sapiens
tcaatatagcagtgtacttgag

SEQ ID NO: 9018881 - DNA, 22 bp, Homo sapiens
tcaatagcatagcaattaatgt

SEQ ID NO: 9018882 - DNA, 22 bp, Homo sapiens
tcaatatagcagtgtacttgag

SEQ ID NO: 9018883 - DNA, 22 bp, Homo sapiens
caggggcttaagtgacagaagg

SEQ ID NO: 9018884 - DNA, 22 bp, Homo sapiens
caggggcttaagtgacagaagg

SEQ ID NO: 9018885 - DNA, 22 bp, Homo sapiens
caggggcttttcctctataagg

SEQ ID NO: 9018886 - DNA, 22 bp, Homo sapiens
caggggcttaagtgacagaagg

SEQ ID NO: 9018887 - DNA, 22 bp, Homo sapiens
caggggcttaagtgacagaagg

SEQ ID NO: 9018888 - DNA, 22 bp, Homo sapiens
caggggcctgtcctggcttctg

SEQ ID NO: 9018889 - DNA, 22 bp, Homo sapiens
caggggcgggtaaaaggcctcc

SEQ ID NO: 9018890 - DNA, 22 bp, Homo sapiens
caggggctgtttgcctcaggcc

SEQ ID NO: 9018891 - DNA, 22 bp, Homo sapiens
caggggctgtttgcctcaggcc

SEQ ID NO: 9018892 - DNA, 22 bp, Homo sapiens
caggggcttttcctctataagg

SEQ ID NO: 9018893 - DNA, 22 bp, Homo sapiens
cagggggcagcgtagaaaatga

SEQ ID NO: 9018894 - DNA, 22 bp, Homo sapiens
cagggggctcaaaggagagtgc

SEQ ID NO: 9018895 - DNA, 22 bp, Homo sapiens
cagggggcagcgtagaaaatga

SEQ ID NO: 9018896 - DNA, 22 bp, Homo sapiens
cagggggcagcgtagaaaatga

SEQ ID NO: 9018897 - DNA, 22 bp, Homo sapiens
cagggggctcaaaggagagtgc

SEQ ID NO: 9018898 - DNA, 22 bp, Homo sapiens
cagggggctcaaaggagagtgc

SEQ ID NO: 9018899 - DNA, 22 bp, Homo sapiens
cagggggctcaaaggagagtgc

SEQ ID NO: 9018900 - DNA, 22 bp, Homo sapiens
cagggggctgtggctgtccagt

SEQ ID NO: 9018901 - DNA, 22 bp, Homo sapiens
cagggggctgtggctgtccagt

SEQ ID NO: 9018902 - DNA, 22 bp, Homo sapiens
caggggggcaggagtcattgat

SEQ ID NO: 9018903 - DNA, 22 bp, Homo sapiens
cagggggctgtggctgtccagt

SEQ ID NO: 9018904 - DNA, 22 bp, Homo sapiens
cagggggctgtggctgtccagt

SEQ ID NO: 9018905 - DNA, 22 bp, Homo sapiens
cagggggctgtggctgtccagt

SEQ ID NO: 9018906 - DNA, 22 bp, Homo sapiens
cagggctgtgcccatcttcccc

SEQ ID NO: 9018907 - DNA, 22 bp, Homo sapiens
cagggctgtgcccatcttcccc

SEQ ID NO: 9018908 - DNA, 17 bp, Homo sapiens
cagggctgtctgcctag

SEQ ID NO: 9018909 - DNA, 17 bp, Homo sapiens
cagggctgtctgcctag

SEQ ID NO: 9018910 - DNA, 17 bp, Homo sapiens
cagggctgtctgcctag

SEQ ID NO: 9018911 - DNA, 22 bp, Homo sapiens
cagggctgtctccaaaggcccc

SEQ ID NO: 9018912 - DNA, 17 bp, Homo sapiens
cagggctgtctgcctag

SEQ ID NO: 9018913 - DNA, 22 bp, Homo sapiens
cagggctgtctccaaaggcccc

SEQ ID NO: 9018914 - DNA, 22 bp, Homo sapiens
cagggctgtctccaaaggcccc

SEQ ID NO: 9018915 - DNA, 17 bp, Homo sapiens
cagggctgtctgcctag

SEQ ID NO: 9018916 - DNA, 17 bp, Homo sapiens
cagggctgtctgcctag

SEQ ID NO: 9018917 - DNA, 17 bp, Homo sapiens
cagggctgtctgcctag

SEQ ID NO: 9018918 - DNA, 22 bp, Homo sapiens
cagggctgtggctttgtgctgt

SEQ ID NO: 9018919 - DNA, 22 bp, Homo sapiens
caggggcctgtcctggcttctg

SEQ ID NO: 9018920 - DNA, 22 bp, Homo sapiens
caggggcctgtcctggcttctg

SEQ ID NO: 9018921 - DNA, 22 bp, Homo sapiens
cagggctgtggctttgtgctgt

SEQ ID NO: 9018922 - DNA, 22 bp, Homo sapiens
cagggctgtggaaaactggtgc

SEQ ID NO: 9018923 - DNA, 22 bp, Homo sapiens
cagggctgtggctttgtgctgt

SEQ ID NO: 9018924 - DNA, 22 bp, Homo sapiens
cagggctgtggaaaactggtgc

SEQ ID NO: 9018925 - DNA, 22 bp, Homo sapiens
cagggctgtgcccatcttcccc

SEQ ID NO: 9018926 - DNA, 22 bp, Homo sapiens
cagggctgtggaaaactggtgc

SEQ ID NO: 9018927 - DNA, 22 bp, Homo sapiens
cagggctgtgcccatcttcccc

SEQ ID NO: 9018928 - DNA, 22 bp, Homo sapiens
cagggctgtggaaaactggtgc

SEQ ID NO: 9018929 - DNA, 22 bp, Homo sapiens
caggggtggctgcagcagaggt

SEQ ID NO: 9018930 - DNA, 22 bp, Homo sapiens
caggggtggctgcagcagaggt

SEQ ID NO: 9018931 - DNA, 22 bp, Homo sapiens
caggggtggctgcagcagaggt

SEQ ID NO: 9018932 - DNA, 22 bp, Homo sapiens
caggggtggctgcagcagaggt

SEQ ID NO: 9018933 - DNA, 22 bp, Homo sapiens
caggggtgtttttggccaggag

SEQ ID NO: 9018934 - DNA, 22 bp, Homo sapiens
cagggggtggtccaggctgcgc

SEQ ID NO: 9018935 - DNA, 22 bp, Homo sapiens
cagggggtggtccaggctgcgc

SEQ ID NO: 9018936 - DNA, 22 bp, Homo sapiens
cagggggtggtccaggctgcgc

SEQ ID NO: 9018937 - DNA, 22 bp, Homo sapiens
cagggggtggtccaggctgcgc

SEQ ID NO: 9018938 - DNA, 22 bp, Homo sapiens
caggggtggctgcagcagaggt

SEQ ID NO: 9018939 - DNA, 22 bp, Homo sapiens
cagggtagggcaagggaacctg

SEQ ID NO: 9018940 - DNA, 22 bp, Homo sapiens
cagggtagacagtaggtgtctg

SEQ ID NO: 9018941 - DNA, 22 bp, Homo sapiens
cagggtagggcaagggaacctg

SEQ ID NO: 9018942 - DNA, 22 bp, Homo sapiens
cagggtagggcaagggaacctg

SEQ ID NO: 9018943 - DNA, 22 bp, Homo sapiens
cagggtagggcaagggaacctg

SEQ ID NO: 9018944 - DNA, 22 bp, Homo sapiens
cagggtagacagtaggtgtctg

SEQ ID NO: 9018945 - DNA, 22 bp, Homo sapiens
cagggtagacagtaggtgtctg

SEQ ID NO: 9018946 - DNA, 22 bp, Homo sapiens
cagggtacagagttttctaaac

SEQ ID NO: 9018947 - DNA, 22 bp, Homo sapiens
caggggtgtttttggccaggag

SEQ ID NO: 9018948 - DNA, 22 bp, Homo sapiens
cagggtccatctttcatcactg

SEQ ID NO: 9018949 - DNA, 22 bp, Homo sapiens
cagggtcaggctgctagaagct

SEQ ID NO: 9018950 - DNA, 22 bp, Homo sapiens
cagggtcatggcacctgcacgg

SEQ ID NO: 9018951 - DNA, 22 bp, Homo sapiens
cagggtcatggcacctgcacgg

SEQ ID NO: 9018952 - DNA, 22 bp, Homo sapiens
cagggtcatggcacctgcacgg

SEQ ID NO: 9018953 - DNA, 22 bp, Homo sapiens
cagggtcaggctgctagaagct

SEQ ID NO: 9018954 - DNA, 22 bp, Homo sapiens
cagggtcaagagactccagcag

SEQ ID NO: 9018955 - DNA, 22 bp, Homo sapiens
cagggtcaagagactccagcag

SEQ ID NO: 9018956 - DNA, 22 bp, Homo sapiens
cagggtcaagagactccagcag

SEQ ID NO: 9018957 - DNA, 22 bp, Homo sapiens
cagggtagtaatttaatacaag

SEQ ID NO: 9018958 - DNA, 22 bp, Homo sapiens
cagggtccggctgcctggctgt

SEQ ID NO: 9018959 - DNA, 22 bp, Homo sapiens
cagggtctgatggtcctcactt

SEQ ID NO: 9018960 - DNA, 22 bp, Homo sapiens
cagggtctgatggtcctcactt

SEQ ID NO: 9018961 - DNA, 22 bp, Homo sapiens
cagggtggggctggctatcaaa

SEQ ID NO: 9018962 - DNA, 22 bp, Homo sapiens
cagggtggggctggctatcaaa

SEQ ID NO: 9018963 - DNA, 22 bp, Homo sapiens
cagggtccggctgcctggctgt

SEQ ID NO: 9018964 - DNA, 22 bp, Homo sapiens
cagggtcccaggagctgctttc

SEQ ID NO: 9018965 - DNA, 22 bp, Homo sapiens
cagggctggatttcatttctag

SEQ ID NO: 9018966 - DNA, 22 bp, Homo sapiens
cagggctgggttaaaagcaggg

SEQ ID NO: 9018967 - DNA, 22 bp, Homo sapiens
cagggctgggttaaaagcaggg

SEQ ID NO: 9018968 - DNA, 22 bp, Homo sapiens
cagggctgggttaaaagcaggg

SEQ ID NO: 9018969 - DNA, 23 bp, Homo sapiens
cagggctggtagggaagagcgtg

SEQ ID NO: 9018970 - DNA, 22 bp, Homo sapiens
cagggctgggttaaaagcaggg

SEQ ID NO: 9018971 - DNA, 23 bp, Homo sapiens
cagggctggtagggaagagcgtg

SEQ ID NO: 9018972 - DNA, 22 bp, Homo sapiens
tagggaaatatagatttagggc

SEQ ID NO: 9018973 - DNA, 22 bp, Homo sapiens
tagggaaaagacttcactgttt

SEQ ID NO: 9018974 - DNA, 22 bp, Homo sapiens
tagggaaatatagatttagggc

SEQ ID NO: 9018975 - DNA, 22 bp, Homo sapiens
taggcttgcaattaggatggaa

SEQ ID NO: 9018976 - DNA, 22 bp, Homo sapiens
taggcttgcaattaggatggaa

SEQ ID NO: 9018977 - DNA, 22 bp, Homo sapiens
taggcttgttacaaaacagtca

SEQ ID NO: 9018978 - DNA, 22 bp, Homo sapiens
taggcttcccgctcacatgccc

SEQ ID NO: 9018979 - DNA, 22 bp, Homo sapiens
taggcttccgagtcttggtatc

SEQ ID NO: 9018980 - DNA, 23 bp, Homo sapiens
taggcttctgctgtccccgacgc

SEQ ID NO: 9018981 - DNA, 22 bp, Homo sapiens
tagggaaaagacttcactgttt

SEQ ID NO: 9018982 - DNA, 22 bp, Homo sapiens
taggctttgtgcaggatacagg

SEQ ID NO: 9018983 - DNA, 22 bp, Homo sapiens
taggctttgtgttttgggaaca

SEQ ID NO: 9018984 - DNA, 23 bp, Homo sapiens
cagggctggtagggaagagcgtg

SEQ ID NO: 9018985 - DNA, 23 bp, Homo sapiens
cagggctggtagggaagagcgtg

SEQ ID NO: 9018986 - DNA, 23 bp, Homo sapiens
cagggctggtagggaagagcgtg

SEQ ID NO: 9018987 - DNA, 23 bp, Homo sapiens
cagggctggtagggaagagcgtg

SEQ ID NO: 9018988 - DNA, 23 bp, Homo sapiens
cagggctggtagggaagagcgtg

SEQ ID NO: 9018989 - DNA, 22 bp, Homo sapiens
cagggctgggttaaaagcaggg

SEQ ID NO: 9018990 - DNA, 22 bp, Homo sapiens
cagggctggtttgtcgaagaaa

SEQ ID NO: 9018991 - DNA, 22 bp, Homo sapiens
cagggctggtttgtcgaagaaa

SEQ ID NO: 9018992 - DNA, 22 bp, Homo sapiens
cagggctggtttgtcgaagaaa

SEQ ID NO: 9018993 - DNA, 22 bp, Homo sapiens
cagggctggtttgtcgaagaaa

SEQ ID NO: 9018994 - DNA, 22 bp, Homo sapiens
cagggctggtttgtcgaagaaa

SEQ ID NO: 9018995 - DNA, 22 bp, Homo sapiens
cagggctggtttgtcgaagaaa

SEQ ID NO: 9018996 - DNA, 22 bp, Homo sapiens
cagggctgtctccaaaggcccc

SEQ ID NO: 9018997 - DNA, 22 bp, Homo sapiens
cagggctgtaaattagtgctga

SEQ ID NO: 9018998 - DNA, 22 bp, Homo sapiens
cagggctgtaaattagtgctga

SEQ ID NO: 9018999 - DNA, 22 bp, Homo sapiens
cagggctgtctccaaaggcccc

SEQ ID NO: 9019000 - DNA, 22 bp, Homo sapiens
cagggctgtctccaaaggcccc

SEQ ID NO: 9019001 - DNA, 22 bp, Homo sapiens
cagggctgtctccaaaggcccc

SEQ ID NO: 9019002 - DNA, 22 bp, Homo sapiens
cagggctgtaaattagtgctga

SEQ ID NO: 9019003 - DNA, 22 bp, Homo sapiens
cagggctgtaaattagtgctga

SEQ ID NO: 9019004 - DNA, 22 bp, Homo sapiens
cagggctgtaaattagtgctga

SEQ ID NO: 9019005 - DNA, 22 bp, Homo sapiens
cagggctgtaaattagtgctga

SEQ ID NO: 9019006 - DNA, 22 bp, Homo sapiens
cagggctgtaaattagtgctga

SEQ ID NO: 9019007 - DNA, 22 bp, Homo sapiens
cagggctgaactgagcttgtga

SEQ ID NO: 9019008 - DNA, 22 bp, Homo sapiens
cagggctgaactgagcttgtga

SEQ ID NO: 9019009 - DNA, 22 bp, Homo sapiens
cagggctgaagaaattcaaaag

SEQ ID NO: 9019010 - DNA, 22 bp, Homo sapiens
cagggctgaagaaattcaaaag

SEQ ID NO: 9019011 - DNA, 22 bp, Homo sapiens
cagggctgagaatttagagaca

SEQ ID NO: 9019012 - DNA, 22 bp, Homo sapiens
cagggctgaagaaattcaaaag

SEQ ID NO: 9019013 - DNA, 22 bp, Homo sapiens
cagggctgaagaaattcaaaag

SEQ ID NO: 9019014 - DNA, 22 bp, Homo sapiens
taggctgggcctgccttccagg

SEQ ID NO: 9019015 - DNA, 22 bp, Homo sapiens
cagggctgaagaaattcaaaag

SEQ ID NO: 9019016 - DNA, 22 bp, Homo sapiens
taggctgggctgagctggacgg

SEQ ID NO: 9019017 - DNA, 22 bp, Homo sapiens
taggctgggcctgccttccagg

SEQ ID NO: 9019018 - DNA, 22 bp, Homo sapiens
taggctgggcctgccttccagg

SEQ ID NO: 9019019 - DNA, 22 bp, Homo sapiens
taggctgggctgagctggacgg

SEQ ID NO: 9019020 - DNA, 22 bp, Homo sapiens
taggctgggctgagctggacgg

SEQ ID NO: 9019021 - DNA, 22 bp, Homo sapiens
taggctgggctgagctggacgg

SEQ ID NO: 9019022 - DNA, 18 bp, Homo sapiens
taggctgggggctgtagt

SEQ ID NO: 9019023 - DNA, 22 bp, Homo sapiens
taggctgggctgagctggacgg

SEQ ID NO: 9019024 - DNA, 22 bp, Homo sapiens
taggctgggctgagctggacgg

SEQ ID NO: 9019025 - DNA, 22 bp, Homo sapiens
taggctgggctgagctggacgg

SEQ ID NO: 9019026 - DNA, 22 bp, Homo sapiens
taggctgtaagagagggcagag

SEQ ID NO: 9019027 - DNA, 22 bp, Homo sapiens
taggctgtaagagagggcagag

SEQ ID NO: 9019028 - DNA, 22 bp, Homo sapiens
taggctgggggtaggaattgag

SEQ ID NO: 9019029 - DNA, 18 bp, Homo sapiens
taggctgggggctgtagt

SEQ ID NO: 9019030 - DNA, 22 bp, Homo sapiens
taggctgggggtaggaattgag

SEQ ID NO: 9019031 - DNA, 22 bp, Homo sapiens
taggctgggggtaggaattgag

SEQ ID NO: 9019032 - DNA, 18 bp, Homo sapiens
taggctgggggctgtagt

SEQ ID NO: 9019033 - DNA, 18 bp, Homo sapiens
taggctgggggctgtagt

SEQ ID NO: 9019034 - DNA, 18 bp, Homo sapiens
taggctgggggctgtagt

SEQ ID NO: 9019035 - DNA, 18 bp, Homo sapiens
taggctgggggctgtagt

SEQ ID NO: 9019036 - DNA, 22 bp, Homo sapiens
cagggctgaaatcaaggtgtag

SEQ ID NO: 9019037 - DNA, 22 bp, Homo sapiens
cagggctgaactgagcttgtga

SEQ ID NO: 9019038 - DNA, 22 bp, Homo sapiens
cagggctgaaatcaaggtgtag

SEQ ID NO: 9019039 - DNA, 22 bp, Homo sapiens
cagggctcttccggagcaggga

SEQ ID NO: 9019040 - DNA, 22 bp, Homo sapiens
cagggctcttccggagcaggga

SEQ ID NO: 9019041 - DNA, 22 bp, Homo sapiens
cagggctgaaatcaaggtgtag

SEQ ID NO: 9019042 - DNA, 22 bp, Homo sapiens
cagggctgaaatcaaggtgtag

SEQ ID NO: 9019043 - DNA, 22 bp, Homo sapiens
cagggctgaaatcaaggtgtag

SEQ ID NO: 9019044 - DNA, 20 bp, Homo sapiens
cagggctctgggcctggcct

SEQ ID NO: 9019045 - DNA, 20 bp, Homo sapiens
cagggctctgggcctggcct

SEQ ID NO: 9019046 - DNA, 20 bp, Homo sapiens
cagggctctgggcctggcct

SEQ ID NO: 9019047 - DNA, 22 bp, Homo sapiens
cagggctcttcatcacacagta

SEQ ID NO: 9019048 - DNA, 22 bp, Homo sapiens
cagggctcttcatcacacagta

SEQ ID NO: 9019049 - DNA, 22 bp, Homo sapiens
cagggctcttcatcacacagta

SEQ ID NO: 9019050 - DNA, 22 bp, Homo sapiens
cagggctcttccggagcaggga

SEQ ID NO: 9019051 - DNA, 22 bp, Homo sapiens
cagggctcttccggagcaggga

SEQ ID NO: 9019052 - DNA, 22 bp, Homo sapiens
cagggcccatggctcaggtagg

SEQ ID NO: 9019053 - DNA, 22 bp, Homo sapiens
cagggccccagggatgtctgct

SEQ ID NO: 9019054 - DNA, 20 bp, Homo sapiens
cagggcctaagagctgaaaa

SEQ ID NO: 9019055 - DNA, 20 bp, Homo sapiens
cagggcctaagagctgaaaa

SEQ ID NO: 9019056 - DNA, 20 bp, Homo sapiens
cagggcctaagagctgaaaa

SEQ ID NO: 9019057 - DNA, 20 bp, Homo sapiens
cagggcctatgattgagctt

SEQ ID NO: 9019058 - DNA, 20 bp, Homo sapiens
cagggcctatgattgagctt

SEQ ID NO: 9019059 - DNA, 20 bp, Homo sapiens
cagggcctaagagctgaaaa

SEQ ID NO: 9019060 - DNA, 22 bp, Homo sapiens
cagggccctaagatacacatca

SEQ ID NO: 9019061 - DNA, 23 bp, Homo sapiens
cagggccctgctcaatttctcca

SEQ ID NO: 9019062 - DNA, 22 bp, Homo sapiens
cagggcctcatcctcagagatt

SEQ ID NO: 9019063 - DNA, 22 bp, Homo sapiens
cagggcctcatcctcagagatt

SEQ ID NO: 9019064 - DNA, 22 bp, Homo sapiens
cagggcctcatcctcagagatt

SEQ ID NO: 9019065 - DNA, 22 bp, Homo sapiens
cagggcctcatcctcagagatt

SEQ ID NO: 9019066 - DNA, 22 bp, Homo sapiens
cagggcctcatcctcagagatt

SEQ ID NO: 9019067 - DNA, 20 bp, Homo sapiens
cagggcctatgattgagctt

SEQ ID NO: 9019068 - DNA, 22 bp, Homo sapiens
cagggcctcatcctcagagatt

SEQ ID NO: 9019069 - DNA, 22 bp, Homo sapiens
cagggcctcattgtcagtcctg

SEQ ID NO: 9019070 - DNA, 22 bp, Homo sapiens
cagggctccatgcagggactcc

SEQ ID NO: 9019071 - DNA, 22 bp, Homo sapiens
cagggctccatgcagggactcc

SEQ ID NO: 9019072 - DNA, 22 bp, Homo sapiens
cagggctccatgcagggactcc

SEQ ID NO: 9019073 - DNA, 22 bp, Homo sapiens
cagggctccatgcagggactcc

SEQ ID NO: 9019074 - DNA, 22 bp, Homo sapiens
cagggctccatgcagggactcc

SEQ ID NO: 9019075 - DNA, 22 bp, Homo sapiens
cagggctccatgcagggactcc

SEQ ID NO: 9019076 - DNA, 22 bp, Homo sapiens
taggccacagatgagacataag

SEQ ID NO: 9019077 - DNA, 21 bp, Homo sapiens
taggccacatgggttggagat

SEQ ID NO: 9019078 - DNA, 22 bp, Homo sapiens
taggccaccagggttccattta

SEQ ID NO: 9019079 - DNA, 22 bp, Homo sapiens
taggccaagttgatcagacatc

SEQ ID NO: 9019080 - DNA, 22 bp, Homo sapiens
taggccacaaataagatcctgt

SEQ ID NO: 9019081 - DNA, 22 bp, Homo sapiens
taggccacagagaggagatttc

SEQ ID NO: 9019082 - DNA, 22 bp, Homo sapiens
taggccagaggagcagctttgg

SEQ ID NO: 9019083 - DNA, 22 bp, Homo sapiens
taggccactctcctttgtctca

SEQ ID NO: 9019084 - DNA, 22 bp, Homo sapiens
taggccacgaaggagatgatag

SEQ ID NO: 9019085 - DNA, 22 bp, Homo sapiens
taggccacggaaagcaggttgc

SEQ ID NO: 9019086 - DNA, 22 bp, Homo sapiens
cagggcccagtccctgctgtca

SEQ ID NO: 9019087 - DNA, 22 bp, Homo sapiens
cagggcccaggccactgggttg

SEQ ID NO: 9019088 - DNA, 22 bp, Homo sapiens
cagggcccaggccactgggttg

SEQ ID NO: 9019089 - DNA, 22 bp, Homo sapiens
cagggcccagtccctgctgtca

SEQ ID NO: 9019090 - DNA, 22 bp, Homo sapiens
cagggcccagtccctgctgtca

SEQ ID NO: 9019091 - DNA, 22 bp, Homo sapiens
cagggccattggcgtggctgtc

SEQ ID NO: 9019092 - DNA, 22 bp, Homo sapiens
cagggccattggcgtggctgtc

SEQ ID NO: 9019093 - DNA, 22 bp, Homo sapiens
cagggccattggcgtggctgtc

SEQ ID NO: 9019094 - DNA, 22 bp, Homo sapiens
cagggcccaagacacaatgagg

SEQ ID NO: 9019095 - DNA, 22 bp, Homo sapiens
cagggcccaagacacaatgagg

SEQ ID NO: 9019096 - DNA, 22 bp, Homo sapiens
taggcagggattagggttgatt

SEQ ID NO: 9019097 - DNA, 22 bp, Homo sapiens
taggcagggattagggttgatt

SEQ ID NO: 9019098 - DNA, 22 bp, Homo sapiens
taggcaggtgtgcactgcccac

SEQ ID NO: 9019099 - DNA, 22 bp, Homo sapiens
taggcaggtgtgcactgcccac

SEQ ID NO: 9019100 - DNA, 22 bp, Homo sapiens
taggcaggtgtgcactgcccac

SEQ ID NO: 9019101 - DNA, 18 bp, Homo sapiens
taggaggctcctgggggc

SEQ ID NO: 9019102 - DNA, 22 bp, Homo sapiens
taggaggccatccagcctgcct

SEQ ID NO: 9019103 - DNA, 22 bp, Homo sapiens
taggcagggattagggttgatt

SEQ ID NO: 9019104 - DNA, 22 bp, Homo sapiens
taggagggccctgaaaatggca

SEQ ID NO: 9019105 - DNA, 22 bp, Homo sapiens
taggccaaggacagtaaggaca

SEQ ID NO: 9019106 - DNA, 22 bp, Homo sapiens
taggccaaatgacttgatgttt

SEQ ID NO: 9019107 - DNA, 22 bp, Homo sapiens
taggccaacgtggaagggtcca

SEQ ID NO: 9019108 - DNA, 22 bp, Homo sapiens
taggcattttcagtgttgttgt

SEQ ID NO: 9019109 - DNA, 22 bp, Homo sapiens
taggcatttaagatggataagg

SEQ ID NO: 9019110 - DNA, 22 bp, Homo sapiens
taggcattttattgaacgtaac

SEQ ID NO: 9019111 - DNA, 22 bp, Homo sapiens
taggcattacctaacattacct

SEQ ID NO: 9019112 - DNA, 22 bp, Homo sapiens
taggcattacctaacattacct

SEQ ID NO: 9019113 - DNA, 22 bp, Homo sapiens
taggcatgcaaataaatgtgca

SEQ ID NO: 9019114 - DNA, 22 bp, Homo sapiens
taggcatgcaaataaatgtgca

SEQ ID NO: 9019115 - DNA, 22 bp, Homo sapiens
tagcttgagtgtttcataaata

SEQ ID NO: 9019116 - DNA, 20 bp, Homo sapiens
tagcttgaagaactccagag

SEQ ID NO: 9019117 - DNA, 22 bp, Homo sapiens
tagcttgactattctatgatgt

SEQ ID NO: 9019118 - DNA, 22 bp, Homo sapiens
tagcttctgggagtgtttacta

SEQ ID NO: 9019119 - DNA, 22 bp, Homo sapiens
tagcttctggagtgtttgaaaa

SEQ ID NO: 9019120 - DNA, 22 bp, Homo sapiens
tagcttctcttttcaacatctt

SEQ ID NO: 9019121 - DNA, 22 bp, Homo sapiens
tagctttaaaaatcatcaaagc

SEQ ID NO: 9019122 - DNA, 22 bp, Homo sapiens
tagctttaaaaatcatcaaagc

SEQ ID NO: 9019123 - DNA, 22 bp, Homo sapiens
tagctttaagacatggtgaatg

SEQ ID NO: 9019124 - DNA, 22 bp, Homo sapiens
tagctttaaaaatcatcaaagc

SEQ ID NO: 9019125 - DNA, 22 bp, Homo sapiens
tagcttcagggaaaccactgct

SEQ ID NO: 9019126 - DNA, 22 bp, Homo sapiens
tagcttatctatacagactttt

SEQ ID NO: 9019127 - DNA, 22 bp, Homo sapiens
tagcttatcccacagtgcccag

SEQ ID NO: 9019128 - DNA, 22 bp, Homo sapiens
tagcttctaatacttaccaatt

SEQ ID NO: 9019129 - DNA, 22 bp, Homo sapiens
tagcttctatacaacttcagca

SEQ ID NO: 9019130 - DNA, 22 bp, Homo sapiens
tagcttctcataatttatgctg

SEQ ID NO: 9019131 - DNA, 22 bp, Homo sapiens
tagcttctaatacttaccaatt

SEQ ID NO: 9019132 - DNA, 22 bp, Homo sapiens
cagggccactgcatgaggttca

SEQ ID NO: 9019133 - DNA, 22 bp, Homo sapiens
cagggccactgcatgaggttca

SEQ ID NO: 9019134 - DNA, 22 bp, Homo sapiens
cagggccactgcatgaggttca

SEQ ID NO: 9019135 - DNA, 22 bp, Homo sapiens
cagggagcctccaaagctttca

SEQ ID NO: 9019136 - DNA, 22 bp, Homo sapiens
cagggccactgcatgaggttca

SEQ ID NO: 9019137 - DNA, 22 bp, Homo sapiens
cagggccaggctgatggcctgg

SEQ ID NO: 9019138 - DNA, 22 bp, Homo sapiens
cagggagccccaattccatgcc

SEQ ID NO: 9019139 - DNA, 22 bp, Homo sapiens
cagggagccccaattccatgcc

SEQ ID NO: 9019140 - DNA, 22 bp, Homo sapiens
cagggagccccaattccatgcc

SEQ ID NO: 9019141 - DNA, 22 bp, Homo sapiens
cagggagccccaattccatgcc

SEQ ID NO: 9019142 - DNA, 22 bp, Homo sapiens
cagggagccccaattccatgcc

SEQ ID NO: 9019143 - DNA, 22 bp, Homo sapiens
cagggagcctccaaagctttca

SEQ ID NO: 9019144 - DNA, 22 bp, Homo sapiens
cagggagcaggctctgtccatc

SEQ ID NO: 9019145 - DNA, 22 bp, Homo sapiens
cagggagccaccagataattac

SEQ ID NO: 9019146 - DNA, 22 bp, Homo sapiens
cagggagcaggctctgtccatc

SEQ ID NO: 9019147 - DNA, 22 bp, Homo sapiens
cagggccaggctgatggcctgg

SEQ ID NO: 9019148 - DNA, 22 bp, Homo sapiens
cagggccagggctatggtgaag

SEQ ID NO: 9019149 - DNA, 22 bp, Homo sapiens
cagggccagggacacgctgtca

SEQ ID NO: 9019150 - DNA, 22 bp, Homo sapiens
cagggccagggacacgctgtca

SEQ ID NO: 9019151 - DNA, 22 bp, Homo sapiens
cagggccaggctgatggcctgg

SEQ ID NO: 9019152 - DNA, 22 bp, Homo sapiens
cagggccagggctatggtgaag

SEQ ID NO: 9019153 - DNA, 22 bp, Homo sapiens
cagggccagggctatggtgaag

SEQ ID NO: 9019154 - DNA, 22 bp, Homo sapiens
cagggccagggctatggtgaag

SEQ ID NO: 9019155 - DNA, 22 bp, Homo sapiens
cagggccagttctcgcagcagt

SEQ ID NO: 9019156 - DNA, 22 bp, Homo sapiens
cagggccagttctcgcagcagt

SEQ ID NO: 9019157 - DNA, 22 bp, Homo sapiens
cagggccagggctccatttcct

SEQ ID NO: 9019158 - DNA, 22 bp, Homo sapiens
cagggccagttctcgcagcagt

SEQ ID NO: 9019159 - DNA, 22 bp, Homo sapiens
cagggccatgaggcacagggtc

SEQ ID NO: 9019160 - DNA, 22 bp, Homo sapiens
cagggccatgaggcacagggtc

SEQ ID NO: 9019161 - DNA, 22 bp, Homo sapiens
cagggccatgaggcacagggtc

SEQ ID NO: 9019162 - DNA, 22 bp, Homo sapiens
cagggccatgaggcacagggtc

SEQ ID NO: 9019163 - DNA, 22 bp, Homo sapiens
cagggccattggaacaaagagg

SEQ ID NO: 9019164 - DNA, 22 bp, Homo sapiens
cagggccattggaacaaagagg

SEQ ID NO: 9019165 - DNA, 22 bp, Homo sapiens
cagggccattggaacaaagagg

SEQ ID NO: 9019166 - DNA, 22 bp, Homo sapiens
cagggccattggaacaaagagg

SEQ ID NO: 9019167 - DNA, 22 bp, Homo sapiens
cagggccattggcgtggctgtc

SEQ ID NO: 9019168 - DNA, 22 bp, Homo sapiens
tagcttaaggagtaccagatca

SEQ ID NO: 9019169 - DNA, 22 bp, Homo sapiens
tagcttaacagcaaaactgttg

SEQ ID NO: 9019170 - DNA, 22 bp, Homo sapiens
tagcttaatatgaaacacataa

SEQ ID NO: 9019171 - DNA, 22 bp, Homo sapiens
tagcttaatatgaaacacataa

SEQ ID NO: 9019172 - DNA, 22 bp, Homo sapiens
cagggccagttctcgcagcagt

SEQ ID NO: 9019173 - DNA, 22 bp, Homo sapiens
cagggccagttctcgcagcagt

SEQ ID NO: 9019174 - DNA, 22 bp, Homo sapiens
cagggccagttctcgcagcagt

SEQ ID NO: 9019175 - DNA, 22 bp, Homo sapiens
cagggccagttctcgcagcagt

SEQ ID NO: 9019176 - DNA, 22 bp, Homo sapiens
cagggccatatcttgtgcacca

SEQ ID NO: 9019177 - DNA, 22 bp, Homo sapiens
cagggccatatcttgtgcacca

SEQ ID NO: 9019178 - DNA, 22 bp, Homo sapiens
cagggccatatcttgtgcacca

SEQ ID NO: 9019179 - DNA, 22 bp, Homo sapiens
cagggccatatcttgtgcacca

SEQ ID NO: 9019180 - DNA, 22 bp, Homo sapiens
cagggccatgaggcacagggtc

SEQ ID NO: 9019181 - DNA, 22 bp, Homo sapiens
cagggccatgaggcacagggtc

SEQ ID NO: 9019182 - DNA, 22 bp, Homo sapiens
cagggccatgaggcacagggtc

SEQ ID NO: 9019183 - DNA, 22 bp, Homo sapiens
cagggagcaggctctgtccatc

SEQ ID NO: 9019184 - DNA, 22 bp, Homo sapiens
cagggagcaggctctgtccatc

SEQ ID NO: 9019185 - DNA, 22 bp, Homo sapiens
cagggagcaggctctgtccatc

SEQ ID NO: 9019186 - DNA, 22 bp, Homo sapiens
cagggagcagcgctggggcctc

SEQ ID NO: 9019187 - DNA, 22 bp, Homo sapiens
cagggagcagcgctggggcctc

SEQ ID NO: 9019188 - DNA, 22 bp, Homo sapiens
cagggagcaggctctgtccatc

SEQ ID NO: 9019189 - DNA, 22 bp, Homo sapiens
cagggagcagcgctggggcctc

SEQ ID NO: 9019190 - DNA, 22 bp, Homo sapiens
cagggagcagcccctagaagta

SEQ ID NO: 9019191 - DNA, 22 bp, Homo sapiens
cagggagcagcccctagaagta

SEQ ID NO: 9019192 - DNA, 22 bp, Homo sapiens
cagggagcagcccctagaagta

SEQ ID NO: 9019193 - DNA, 22 bp, Homo sapiens
cagggagcagcgctggggcctc

SEQ ID NO: 9019194 - DNA, 22 bp, Homo sapiens
cagggagcagcgctggggcctc

SEQ ID NO: 9019195 - DNA, 22 bp, Homo sapiens
cagggagatcttggctcctggt

SEQ ID NO: 9019196 - DNA, 22 bp, Homo sapiens
cagggagcactgcgagcggcag

SEQ ID NO: 9019197 - DNA, 22 bp, Homo sapiens
cagggagatcttggctcctggt

SEQ ID NO: 9019198 - DNA, 22 bp, Homo sapiens
cagggagcactgcgagcggcag

SEQ ID NO: 9019199 - DNA, 22 bp, Homo sapiens
cagggagcactgcgagcggcag

SEQ ID NO: 9019200 - DNA, 22 bp, Homo sapiens
cagggagcactgcgagcggcag

SEQ ID NO: 9019201 - DNA, 22 bp, Homo sapiens
cagggagcactgcgagcggcag

SEQ ID NO: 9019202 - DNA, 22 bp, Homo sapiens
cagggagcagcatgggcaaagg

SEQ ID NO: 9019203 - DNA, 22 bp, Homo sapiens
cagggagcagcatgggcaaagg

SEQ ID NO: 9019204 - DNA, 22 bp, Homo sapiens
cagggagcagcccctagaagta

SEQ ID NO: 9019205 - DNA, 22 bp, Homo sapiens
cagggagcagcccctagaagta

SEQ ID NO: 9019206 - DNA, 22 bp, Homo sapiens
cagggagatcttggctcctggt

SEQ ID NO: 9019207 - DNA, 22 bp, Homo sapiens
cagggagatcttggctcctggt

SEQ ID NO: 9019208 - DNA, 22 bp, Homo sapiens
cagggagatcttggctcctggt

SEQ ID NO: 9019209 - DNA, 22 bp, Homo sapiens
tagatttgtttccttctctcca

SEQ ID NO: 9019210 - DNA, 22 bp, Homo sapiens
tagatttgtgcaagaagggatt

SEQ ID NO: 9019211 - DNA, 22 bp, Homo sapiens
tagatttgtgcaagaagggatt

SEQ ID NO: 9019212 - DNA, 22 bp, Homo sapiens
tagatttgtgtttgggatgaga

SEQ ID NO: 9019213 - DNA, 22 bp, Homo sapiens
tagatttgcctgggaaagctca

SEQ ID NO: 9019214 - DNA, 22 bp, Homo sapiens
tagatttgcctgggaaagctca

SEQ ID NO: 9019215 - DNA, 22 bp, Homo sapiens
tagatttgctccaatgagttaa

SEQ ID NO: 9019216 - DNA, 22 bp, Homo sapiens
tagatttgcctgggaaagctca

SEQ ID NO: 9019217 - DNA, 19 bp, Homo sapiens
tagatttgatcatctggat

SEQ ID NO: 9019218 - DNA, 22 bp, Homo sapiens
tagatttgaatgatgtaaagag

SEQ ID NO: 9019219 - DNA, 22 bp, Homo sapiens
tagatttgatgcaattggattg

SEQ ID NO: 9019220 - DNA, 22 bp, Homo sapiens
tagatttgatgtaagcatagtc

SEQ ID NO: 9019221 - DNA, 22 bp, Homo sapiens
tagatttgatgtaagcatagtc

SEQ ID NO: 9019222 - DNA, 22 bp, Homo sapiens
tagatttctcattcatagattg

SEQ ID NO: 9019223 - DNA, 22 bp, Homo sapiens
tagatttgatgtaagcatagtc

SEQ ID NO: 9019224 - DNA, 22 bp, Homo sapiens
tagatttctaacagtgtgcttg

SEQ ID NO: 9019225 - DNA, 22 bp, Homo sapiens
tagatttctcattcatagattg

SEQ ID NO: 9019226 - DNA, 22 bp, Homo sapiens
tagatttgaatgatgtaaagag

SEQ ID NO: 9019227 - DNA, 22 bp, Homo sapiens
tagattgtaagctccttgaggg

SEQ ID NO: 9019228 - DNA, 22 bp, Homo sapiens
tagattgtagatcatgagactt

SEQ ID NO: 9019229 - DNA, 22 bp, Homo sapiens
tagatttaagaccctgaatttg

SEQ ID NO: 9019230 - DNA, 22 bp, Homo sapiens
tagattctttgctagatcattg

SEQ ID NO: 9019231 - DNA, 22 bp, Homo sapiens
tagattctttgctagatcattg

SEQ ID NO: 9019232 - DNA, 22 bp, Homo sapiens
tagatttaagaccctgaatttg

SEQ ID NO: 9019233 - DNA, 22 bp, Homo sapiens
tagatttcaggagacaaaatgg

SEQ ID NO: 9019234 - DNA, 22 bp, Homo sapiens
tagatttcaggagacaaaatgg

SEQ ID NO: 9019235 - DNA, 22 bp, Homo sapiens
tagatttcctcttcctcattcc

SEQ ID NO: 9019236 - DNA, 22 bp, Homo sapiens
tagatttcgctgcatctcaatc

SEQ ID NO: 9019237 - DNA, 22 bp, Homo sapiens
caggtggcattgtcccgccagc

SEQ ID NO: 9019238 - DNA, 22 bp, Homo sapiens
caggtggcatgactgcctacaa

SEQ ID NO: 9019239 - DNA, 22 bp, Homo sapiens
caggtggcatgactgcctacaa

SEQ ID NO: 9019240 - DNA, 22 bp, Homo sapiens
caggtggcatgactgcctacaa

SEQ ID NO: 9019241 - DNA, 22 bp, Homo sapiens
caggtggccttgccatctcctg

SEQ ID NO: 9019242 - DNA, 22 bp, Homo sapiens
caggtggccttgccatctcctg

SEQ ID NO: 9019243 - DNA, 22 bp, Homo sapiens
caggtggccagtactcaaggat

SEQ ID NO: 9019244 - DNA, 22 bp, Homo sapiens
caggtggccagtactcaaggat

SEQ ID NO: 9019245 - DNA, 22 bp, Homo sapiens
caggtggccagtactcaaggat

SEQ ID NO: 9019246 - DNA, 22 bp, Homo sapiens
caggtggccagtactcaaggat

SEQ ID NO: 9019247 - DNA, 22 bp, Homo sapiens
caggtggcagaggtctctggaa

SEQ ID NO: 9019248 - DNA, 22 bp, Homo sapiens
caggtggcagtgcctgcattct

SEQ ID NO: 9019249 - DNA, 22 bp, Homo sapiens
caggtggcagaggtctctggaa

SEQ ID NO: 9019250 - DNA, 22 bp, Homo sapiens
caggtggcagaggtctctggaa

SEQ ID NO: 9019251 - DNA, 22 bp, Homo sapiens
caggtggcagaggtctctggaa

SEQ ID NO: 9019252 - DNA, 22 bp, Homo sapiens
caggtggatctctaaggactga

SEQ ID NO: 9019253 - DNA, 22 bp, Homo sapiens
caggtggatctctaaggactga

SEQ ID NO: 9019254 - DNA, 22 bp, Homo sapiens
caggtggagctgactgagggca

SEQ ID NO: 9019255 - DNA, 22 bp, Homo sapiens
caggtggcaaatgagtagcatt

SEQ ID NO: 9019256 - DNA, 23 bp, Homo sapiens
caggtggctccacgaggggtggg

SEQ ID NO: 9019257 - DNA, 23 bp, Homo sapiens
caggtggctccacgaggggtggg

SEQ ID NO: 9019258 - DNA, 22 bp, Homo sapiens
caggtggctaacggcctcatag

SEQ ID NO: 9019259 - DNA, 23 bp, Homo sapiens
caggtggctccacgaggggtggg

SEQ ID NO: 9019260 - DNA, 23 bp, Homo sapiens
caggtggctccacgaggggtggg

SEQ ID NO: 9019261 - DNA, 22 bp, Homo sapiens
caggtggctaacggcctcatag

SEQ ID NO: 9019262 - DNA, 19 bp, Homo sapiens
caggtggcgctctacaggg

SEQ ID NO: 9019263 - DNA, 22 bp, Homo sapiens
caggtggccttgccatctcctg

SEQ ID NO: 9019264 - DNA, 19 bp, Homo sapiens
caggtggcgctctacaggg

SEQ ID NO: 9019265 - DNA, 19 bp, Homo sapiens
caggtggcgctctacaggg

SEQ ID NO: 9019266 - DNA, 19 bp, Homo sapiens
caggtggcgctctacaggg

SEQ ID NO: 9019267 - DNA, 22 bp, Homo sapiens
tattaggtgtgtttataagacc

SEQ ID NO: 9019268 - DNA, 22 bp, Homo sapiens
tattaggttggtgcaaaattaa

SEQ ID NO: 9019269 - DNA, 22 bp, Homo sapiens
tattaaatatatctgttagttg

SEQ ID NO: 9019270 - DNA, 22 bp, Homo sapiens
tattaaatgttatttgggttgt

SEQ ID NO: 9019271 - DNA, 22 bp, Homo sapiens
tattaggtagattttactgatt

SEQ ID NO: 9019272 - DNA, 22 bp, Homo sapiens
tattaaatgttatttgggttgt

SEQ ID NO: 9019273 - DNA, 22 bp, Homo sapiens
caggtggctgagctgacctttg

SEQ ID NO: 9019274 - DNA, 22 bp, Homo sapiens
tattaaatgttatttgggttgt

SEQ ID NO: 9019275 - DNA, 18 bp, Homo sapiens
caggtgggtctcctgccc

SEQ ID NO: 9019276 - DNA, 18 bp, Homo sapiens
caggtgggtctcctgccc

SEQ ID NO: 9019277 - DNA, 18 bp, Homo sapiens
caggtgggtctcctgccc

SEQ ID NO: 9019278 - DNA, 18 bp, Homo sapiens
caggtgggtctcctgccc

SEQ ID NO: 9019279 - DNA, 18 bp, Homo sapiens
caggtgggtctcctgccc

SEQ ID NO: 9019280 - DNA, 18 bp, Homo sapiens
caggtgggtctcctgccc

SEQ ID NO: 9019281 - DNA, 22 bp, Homo sapiens
caggtgggtacatcacagagac

SEQ ID NO: 9019282 - DNA, 22 bp, Homo sapiens
caggtgggtacatcacagagac

SEQ ID NO: 9019283 - DNA, 22 bp, Homo sapiens
caggtgggtacatcacagagac

SEQ ID NO: 9019284 - DNA, 22 bp, Homo sapiens
caggtgggtacatcacagagac

SEQ ID NO: 9019285 - DNA, 22 bp, Homo sapiens
tattattaaatggcagaatttt

SEQ ID NO: 9019286 - DNA, 22 bp, Homo sapiens
tattattaaatggcagaatttt

SEQ ID NO: 9019287 - DNA, 22 bp, Homo sapiens
tattattaaatggcagaatttt

SEQ ID NO: 9019288 - DNA, 22 bp, Homo sapiens
tattatgtagagtaagggttaa

SEQ ID NO: 9019289 - DNA, 22 bp, Homo sapiens
tattattaaatggcagaatttt

SEQ ID NO: 9019290 - DNA, 22 bp, Homo sapiens
tattatggggggaacatcactc

SEQ ID NO: 9019291 - DNA, 22 bp, Homo sapiens
tattatggttgtaggttaacaa

SEQ ID NO: 9019292 - DNA, 22 bp, Homo sapiens
tattatggcagcattcagtatg

SEQ ID NO: 9019293 - DNA, 22 bp, Homo sapiens
tattatgaggactggtgtaagg

SEQ ID NO: 9019294 - DNA, 22 bp, Homo sapiens
tattatgaggggcagagggcat

SEQ ID NO: 9019295 - DNA, 22 bp, Homo sapiens
tattatgaggcttagggatgac

SEQ ID NO: 9019296 - DNA, 22 bp, Homo sapiens
tattatccaaagagctgggagc

SEQ ID NO: 9019297 - DNA, 20 bp, Homo sapiens
tattatgacctgtgttctgg

SEQ ID NO: 9019298 - DNA, 22 bp, Homo sapiens
tattatgagccaggtgctgtct

SEQ ID NO: 9019299 - DNA, 20 bp, Homo sapiens
tattatgacctgtgttctgg

SEQ ID NO: 9019300 - DNA, 22 bp, Homo sapiens
tattatgaggtatttggacttt

SEQ ID NO: 9019301 - DNA, 22 bp, Homo sapiens
tattatgatcgtgactcaagga

SEQ ID NO: 9019302 - DNA, 22 bp, Homo sapiens
tattatgatcccagccctggag

SEQ ID NO: 9019303 - DNA, 22 bp, Homo sapiens
tattatgattcggacgtggcag

SEQ ID NO: 9019304 - DNA, 22 bp, Homo sapiens
tattatgatcgtgactcaagga

SEQ ID NO: 9019305 - DNA, 22 bp, Homo sapiens
tattataatttagggcttggat

SEQ ID NO: 9019306 - DNA, 22 bp, Homo sapiens
tattatcagagctatttggaat

SEQ ID NO: 9019307 - DNA, 22 bp, Homo sapiens
tattatatttagtaatgtggag

SEQ ID NO: 9019308 - DNA, 22 bp, Homo sapiens
tattagtagcttgaaattggtg

SEQ ID NO: 9019309 - DNA, 22 bp, Homo sapiens
tattagttgcaaaacattgact

SEQ ID NO: 9019310 - DNA, 22 bp, Homo sapiens
tattataaaattactggcaggg

SEQ ID NO: 9019311 - DNA, 22 bp, Homo sapiens
tattatcagagctatttggaat

SEQ ID NO: 9019312 - DNA, 22 bp, Homo sapiens
tattatcattaactgttgaatt

SEQ ID NO: 9019313 - DNA, 22 bp, Homo sapiens
tattatcatgttaattagtggg

SEQ ID NO: 9019314 - DNA, 22 bp, Homo sapiens
tattatcattggtaatatggtc

SEQ ID NO: 9019315 - DNA, 22 bp, Homo sapiens
tattatcattggtaatatggtc

SEQ ID NO: 9019316 - DNA, 22 bp, Homo sapiens
caggtacaaagctactgcctga

SEQ ID NO: 9019317 - DNA, 22 bp, Homo sapiens
caggtaaggtcacattctgaag

SEQ ID NO: 9019318 - DNA, 22 bp, Homo sapiens
caggtaaggtcacattctgaag

SEQ ID NO: 9019319 - DNA, 22 bp, Homo sapiens
cagggtttctgttgagaagtcc

SEQ ID NO: 9019320 - DNA, 22 bp, Homo sapiens
cagggtggggctggctatcaaa

SEQ ID NO: 9019321 - DNA, 22 bp, Homo sapiens
cagggtttcaccatgttagcag

SEQ ID NO: 9019322 - DNA, 22 bp, Homo sapiens
cagggtttctgttgagaagtcc

SEQ ID NO: 9019323 - DNA, 22 bp, Homo sapiens
caggtagaggctgccatcagct

SEQ ID NO: 9019324 - DNA, 22 bp, Homo sapiens
caggtaggaaaagggtgtcagg

SEQ ID NO: 9019325 - DNA, 22 bp, Homo sapiens
caggtaggaggctccctagtcc

SEQ ID NO: 9019326 - DNA, 22 bp, Homo sapiens
caggtagctgctggccatgtac

SEQ ID NO: 9019327 - DNA, 22 bp, Homo sapiens
caggtagcttttgatattaggg

SEQ ID NO: 9019328 - DNA, 22 bp, Homo sapiens
caggtagctgcagagactattt

SEQ ID NO: 9019329 - DNA, 22 bp, Homo sapiens
caggtagctgctggccatgtac

SEQ ID NO: 9019330 - DNA, 17 bp, Homo sapiens
caggtacattgctactg

SEQ ID NO: 9019331 - DNA, 22 bp, Homo sapiens
caggtacattcgtagacccatt

SEQ ID NO: 9019332 - DNA, 22 bp, Homo sapiens
caggtacccaggctctttccaa

SEQ ID NO: 9019333 - DNA, 22 bp, Homo sapiens
caggtagaggctgccatcagct

SEQ ID NO: 9019334 - DNA, 22 bp, Homo sapiens
caggtaggcagccggtctctgg

SEQ ID NO: 9019335 - DNA, 22 bp, Homo sapiens
caggtagggatatgatggtgat

SEQ ID NO: 9019336 - DNA, 22 bp, Homo sapiens
caggtattaataaatggagagt

SEQ ID NO: 9019337 - DNA, 22 bp, Homo sapiens
caggtattaataaatggagagt

SEQ ID NO: 9019338 - DNA, 22 bp, Homo sapiens
caggtataacgtgcatgttgta

SEQ ID NO: 9019339 - DNA, 22 bp, Homo sapiens
caggtatatgtgcatccataga

SEQ ID NO: 9019340 - DNA, 22 bp, Homo sapiens
caggtaggtatggtgcagtctt

SEQ ID NO: 9019341 - DNA, 22 bp, Homo sapiens
caggtaggttttaggctaaaca

SEQ ID NO: 9019342 - DNA, 20 bp, Homo sapiens
caggtattacttcctttatg

SEQ ID NO: 9019343 - DNA, 20 bp, Homo sapiens
caggtattacatctgcacct

SEQ ID NO: 9019344 - DNA, 20 bp, Homo sapiens
caggtattacttcctttatg

SEQ ID NO: 9019345 - DNA, 22 bp, Homo sapiens
caggtattcatagaattcagag

SEQ ID NO: 9019346 - DNA, 17 bp, Homo sapiens
caggtatttaggcattg

SEQ ID NO: 9019347 - DNA, 22 bp, Homo sapiens
caggtattcatagaattcagag

SEQ ID NO: 9019348 - DNA, 23 bp, Homo sapiens
caggtattgatttttcttctagg

SEQ ID NO: 9019349 - DNA, 17 bp, Homo sapiens
caggtatttaggcattg

SEQ ID NO: 9019350 - DNA, 22 bp, Homo sapiens
caggtattttcaaggcttgtgt

SEQ ID NO: 9019351 - DNA, 22 bp, Homo sapiens
caggtcagaggcgcagccccca

SEQ ID NO: 9019352 - DNA, 22 bp, Homo sapiens
caggtcagaggtagatgagatg

SEQ ID NO: 9019353 - DNA, 22 bp, Homo sapiens
caggtcagaggtagatgagatg

SEQ ID NO: 9019354 - DNA, 22 bp, Homo sapiens
caggtcagaggtagatgagatg

SEQ ID NO: 9019355 - DNA, 22 bp, Homo sapiens
caggtcagaggtagatgagatg

SEQ ID NO: 9019356 - DNA, 22 bp, Homo sapiens
caggtgctgtcctgcacatgtc

SEQ ID NO: 9019357 - DNA, 22 bp, Homo sapiens
caggtgctgtcctgcacatgtc

SEQ ID NO: 9019358 - DNA, 22 bp, Homo sapiens
caggtgctgtgaatcttcataa

SEQ ID NO: 9019359 - DNA, 22 bp, Homo sapiens
caggtgctgcgtggcggagctg

SEQ ID NO: 9019360 - DNA, 22 bp, Homo sapiens
caggtgctgcgtggcggagctg

SEQ ID NO: 9019361 - DNA, 22 bp, Homo sapiens
caggtgctgtcctgcacatgtc

SEQ ID NO: 9019362 - DNA, 22 bp, Homo sapiens
caggtgctctgctgcaggtaag

SEQ ID NO: 9019363 - DNA, 22 bp, Homo sapiens
caggtgctgcagggctggcgtc

SEQ ID NO: 9019364 - DNA, 22 bp, Homo sapiens
caggtgctgcgtggcggagctg

SEQ ID NO: 9019365 - DNA, 22 bp, Homo sapiens
caggtgctgcagggctggcgtc

SEQ ID NO: 9019366 - DNA, 22 bp, Homo sapiens
caggtgctgcagggctggcgtc

SEQ ID NO: 9019367 - DNA, 22 bp, Homo sapiens
caggtgcctcaggatgagacaa

SEQ ID NO: 9019368 - DNA, 22 bp, Homo sapiens
caggtgcctcaggatgagacaa

SEQ ID NO: 9019369 - DNA, 22 bp, Homo sapiens
caggtgcctcaggatgagacaa

SEQ ID NO: 9019370 - DNA, 22 bp, Homo sapiens
caggtgcctcaggatgagacaa

SEQ ID NO: 9019371 - DNA, 22 bp, Homo sapiens
caggtgctcccagagaagtgct

SEQ ID NO: 9019372 - DNA, 22 bp, Homo sapiens
caggtgctcccagagaagtgct

SEQ ID NO: 9019373 - DNA, 22 bp, Homo sapiens
caggtgccgggaatgcagcaat

SEQ ID NO: 9019374 - DNA, 22 bp, Homo sapiens
caggtgccgggaatgcagcaat

SEQ ID NO: 9019375 - DNA, 22 bp, Homo sapiens
caggtgcccagctcctgctgtg

SEQ ID NO: 9019376 - DNA, 22 bp, Homo sapiens
caggtgcccagctcctgctgtg

SEQ ID NO: 9019377 - DNA, 22 bp, Homo sapiens
caggtcagcacttggaggtgca

SEQ ID NO: 9019378 - DNA, 22 bp, Homo sapiens
caggtcagcacttggaggtgca

SEQ ID NO: 9019379 - DNA, 22 bp, Homo sapiens
caggtcagcacttggaggtgca

SEQ ID NO: 9019380 - DNA, 22 bp, Homo sapiens
caggtcagctggtgccccaggt

SEQ ID NO: 9019381 - DNA, 22 bp, Homo sapiens
caggtccaactatttatctgtg

SEQ ID NO: 9019382 - DNA, 22 bp, Homo sapiens
caggtccaagagatcctcctac

SEQ ID NO: 9019383 - DNA, 22 bp, Homo sapiens
caggtccacagcccatcactgc

SEQ ID NO: 9019384 - DNA, 22 bp, Homo sapiens
caggtccacagcccatcactgc

SEQ ID NO: 9019385 - DNA, 22 bp, Homo sapiens
caggtccacagcccatcactgc

SEQ ID NO: 9019386 - DNA, 22 bp, Homo sapiens
caggtccaattgcgctaaaatc

SEQ ID NO: 9019387 - DNA, 22 bp, Homo sapiens
caggtgcccagctcctgctgtg

SEQ ID NO: 9019388 - DNA, 22 bp, Homo sapiens
caggtgacaagacaggtaatat

SEQ ID NO: 9019389 - DNA, 22 bp, Homo sapiens
caggtgaagaggataaaaagtt

SEQ ID NO: 9019390 - DNA, 22 bp, Homo sapiens
caggtccaccatgcctcaagcc

SEQ ID NO: 9019391 - DNA, 22 bp, Homo sapiens
caggtgaatcacttgagtccag

SEQ ID NO: 9019392 - DNA, 22 bp, Homo sapiens
caggtgaagaggataaaaagtt

SEQ ID NO: 9019393 - DNA, 22 bp, Homo sapiens
caggtgggtgtatgaatgcaaa

SEQ ID NO: 9019394 - DNA, 22 bp, Homo sapiens
caggtgggtgtatgaatgcaaa

SEQ ID NO: 9019395 - DNA, 22 bp, Homo sapiens
caggtgggtgtatgaatgcaaa

SEQ ID NO: 9019396 - DNA, 22 bp, Homo sapiens
caggtgggtgtatgaatgcaaa

SEQ ID NO: 9019397 - DNA, 22 bp, Homo sapiens
cagtatatgctctttcatcaaa

SEQ ID NO: 9019398 - DNA, 22 bp, Homo sapiens
cagtattttcaggatttggaag

SEQ ID NO: 9019399 - DNA, 22 bp, Homo sapiens
cagtattttcaggatttggaag

SEQ ID NO: 9019400 - DNA, 21 bp, Homo sapiens
cagtattttaagcagtgagtt

SEQ ID NO: 9019401 - DNA, 19 bp, Homo sapiens
cagtatcattgcacatagt

SEQ ID NO: 9019402 - DNA, 21 bp, Homo sapiens
cagtattttaagcagtgagtt

SEQ ID NO: 9019403 - DNA, 21 bp, Homo sapiens
cagtattttaagcagtgagtt

SEQ ID NO: 9019404 - DNA, 21 bp, Homo sapiens
cagtattttaagcagtgagtt

SEQ ID NO: 9019405 - DNA, 22 bp, Homo sapiens
cagtatattctgcagagcctta

SEQ ID NO: 9019406 - DNA, 22 bp, Homo sapiens
cagtatattttagagaagtccc

SEQ ID NO: 9019407 - DNA, 22 bp, Homo sapiens
cagtatctccacatgtaaagtg

SEQ ID NO: 9019408 - DNA, 22 bp, Homo sapiens
cagtatattctgcagagcctta

SEQ ID NO: 9019409 - DNA, 19 bp, Homo sapiens
cagtatcattgcacatagt

SEQ ID NO: 9019410 - DNA, 22 bp, Homo sapiens
cagtcacataggtatacacata

SEQ ID NO: 9019411 - DNA, 22 bp, Homo sapiens
cagtcacataggtatacacata

SEQ ID NO: 9019412 - DNA, 22 bp, Homo sapiens
cagtcacaggtggagaaccgag

SEQ ID NO: 9019413 - DNA, 22 bp, Homo sapiens
cagtcacaggtggagaaccgag

SEQ ID NO: 9019414 - DNA, 22 bp, Homo sapiens
cagtcacagtgacaggatgtgg

SEQ ID NO: 9019415 - DNA, 22 bp, Homo sapiens
cagtcacagtgacaggatgtgg

SEQ ID NO: 9019416 - DNA, 22 bp, Homo sapiens
cagtcacagtgacaggatgtgg

SEQ ID NO: 9019417 - DNA, 22 bp, Homo sapiens
cagtcaaacttataggcacatt

SEQ ID NO: 9019418 - DNA, 22 bp, Homo sapiens
cagtcacaagcgtacctaattt

SEQ ID NO: 9019419 - DNA, 22 bp, Homo sapiens
cagtcacaagcgtacctaattt

SEQ ID NO: 9019420 - DNA, 22 bp, Homo sapiens
cagtcacaagcgtacctaattt

SEQ ID NO: 9019421 - DNA, 22 bp, Homo sapiens
cagtcacacaagtggacttggg

SEQ ID NO: 9019422 - DNA, 17 bp, Homo sapiens
cagtcacaggtcttttc

SEQ ID NO: 9019423 - DNA, 22 bp, Homo sapiens
cagtcacacaagtggacttggg

SEQ ID NO: 9019424 - DNA, 22 bp, Homo sapiens
cagtcacatggatgatggatag

SEQ ID NO: 9019425 - DNA, 22 bp, Homo sapiens
cagtcacattgccctgcattta

SEQ ID NO: 9019426 - DNA, 22 bp, Homo sapiens
cagtcacatggatgatggatag

SEQ ID NO: 9019427 - DNA, 22 bp, Homo sapiens
cagtcaccaccaggtggcagta

SEQ ID NO: 9019428 - DNA, 22 bp, Homo sapiens
cagtcaccaccaggtggcagta

SEQ ID NO: 9019429 - DNA, 22 bp, Homo sapiens
cagtcaccaccaggtggcagta

SEQ ID NO: 9019430 - DNA, 22 bp, Homo sapiens
cagtcacatttcgacataacta

SEQ ID NO: 9019431 - DNA, 22 bp, Homo sapiens
cagtcacatttcgacataacta

SEQ ID NO: 9019432 - DNA, 22 bp, Homo sapiens
cagtcacatttcgacataacta

SEQ ID NO: 9019433 - DNA, 22 bp, Homo sapiens
cagtcacctgaagacttgacca

SEQ ID NO: 9019434 - DNA, 22 bp, Homo sapiens
cagtcacctgaagacttgacca

SEQ ID NO: 9019435 - DNA, 22 bp, Homo sapiens
cagtcacctagacagaacttac

SEQ ID NO: 9019436 - DNA, 22 bp, Homo sapiens
cagtcaccatagaataaaacat

SEQ ID NO: 9019437 - DNA, 22 bp, Homo sapiens
cagtcaccatagaataaaacat

SEQ ID NO: 9019438 - DNA, 22 bp, Homo sapiens
cagtcactccagcctgcctcag

SEQ ID NO: 9019439 - DNA, 22 bp, Homo sapiens
cagtcactccagcctgcctcag

SEQ ID NO: 9019440 - DNA, 22 bp, Homo sapiens
cagtcactggaatagctgagga

SEQ ID NO: 9019441 - DNA, 22 bp, Homo sapiens
cagtcaccttgaggactcagac

SEQ ID NO: 9019442 - DNA, 22 bp, Homo sapiens
cagtcaccttgaggactcagac

SEQ ID NO: 9019443 - DNA, 22 bp, Homo sapiens
tattttaaagactgccagccta

SEQ ID NO: 9019444 - DNA, 22 bp, Homo sapiens
tattttaaagactgccagccta

SEQ ID NO: 9019445 - DNA, 22 bp, Homo sapiens
tattttaaagactgccagccta

SEQ ID NO: 9019446 - DNA, 22 bp, Homo sapiens
tattttaaagactgccagccta

SEQ ID NO: 9019447 - DNA, 22 bp, Homo sapiens
tatttgaagattcttctgatgt

SEQ ID NO: 9019448 - DNA, 22 bp, Homo sapiens
tatttgtttctagtggcagcaa

SEQ ID NO: 9019449 - DNA, 22 bp, Homo sapiens
tatttgaaagtgtacaaaaact

SEQ ID NO: 9019450 - DNA, 20 bp, Homo sapiens
tatttgaaatggccaagtgt

SEQ ID NO: 9019451 - DNA, 20 bp, Homo sapiens
tatttgaaatggccaagtgt

SEQ ID NO: 9019452 - DNA, 22 bp, Homo sapiens
tatttgaagattcttctgatgt

SEQ ID NO: 9019453 - DNA, 22 bp, Homo sapiens
tattttaaagtgaagggtcttg

SEQ ID NO: 9019454 - DNA, 22 bp, Homo sapiens
tattttaaagtgaagggtcttg

SEQ ID NO: 9019455 - DNA, 22 bp, Homo sapiens
tattttaaagtgaagggtcttg

SEQ ID NO: 9019456 - DNA, 22 bp, Homo sapiens
tattttaaagactgccagccta

SEQ ID NO: 9019457 - DNA, 22 bp, Homo sapiens
tattttacagactactttagat

SEQ ID NO: 9019458 - DNA, 22 bp, Homo sapiens
cagtcaggctgcgcttctctga

SEQ ID NO: 9019459 - DNA, 22 bp, Homo sapiens
cagtcagggacaccagctagga

SEQ ID NO: 9019460 - DNA, 22 bp, Homo sapiens
cagtcagggacaccagctagga

SEQ ID NO: 9019461 - DNA, 22 bp, Homo sapiens
cagtcaggggtgggatcaaggc

SEQ ID NO: 9019462 - DNA, 22 bp, Homo sapiens
cagtcattggctaaagctccct

SEQ ID NO: 9019463 - DNA, 22 bp, Homo sapiens
cagtcattcctaaccaagaaca

SEQ ID NO: 9019464 - DNA, 22 bp, Homo sapiens
cagtccaacctgccccttgggc

SEQ ID NO: 9019465 - DNA, 22 bp, Homo sapiens
cagtccaacctgccccttgggc

SEQ ID NO: 9019466 - DNA, 22 bp, Homo sapiens
cagtcaggggtgggatcaaggc

SEQ ID NO: 9019467 - DNA, 22 bp, Homo sapiens
cagtcactccagcctgcctcag

SEQ ID NO: 9019468 - DNA, 22 bp, Homo sapiens
cagtcactggaatagctgagga

SEQ ID NO: 9019469 - DNA, 22 bp, Homo sapiens
cagtcacttacaaaaatataat

SEQ ID NO: 9019470 - DNA, 22 bp, Homo sapiens
cagtcagaaggaagatgcttaa

SEQ ID NO: 9019471 - DNA, 22 bp, Homo sapiens
cagtcaggctgcgcttctctga

SEQ ID NO: 9019472 - DNA, 22 bp, Homo sapiens
cagtcaggaatgcctccttcct

SEQ ID NO: 9019473 - DNA, 22 bp, Homo sapiens
cagtcaggctgcgcttctctga

SEQ ID NO: 9019474 - DNA, 22 bp, Homo sapiens
cagtcaggaatgcctccttcct

SEQ ID NO: 9019475 - DNA, 22 bp, Homo sapiens
cagtcaggaatgcctccttcct

SEQ ID NO: 9019476 - DNA, 22 bp, Homo sapiens
cagtcagagtcacagtaatttg

SEQ ID NO: 9019477 - DNA, 22 bp, Homo sapiens
cagtcagaggtcttctaaaaca

SEQ ID NO: 9019478 - DNA, 22 bp, Homo sapiens
tcaaaacaacactcaggtgtaa

SEQ ID NO: 9019479 - DNA, 22 bp, Homo sapiens
tcaaaacaacactcaggtgtaa

SEQ ID NO: 9019480 - DNA, 22 bp, Homo sapiens
tcaaaacaacactcaggtgtaa

SEQ ID NO: 9019481 - DNA, 22 bp, Homo sapiens
tcaaaacaacactcaggtgtaa

SEQ ID NO: 9019482 - DNA, 22 bp, Homo sapiens
tcaaaacaacactcaggtgtaa

SEQ ID NO: 9019483 - DNA, 22 bp, Homo sapiens
tcaaaacaacactcaggtgtaa

SEQ ID NO: 9019484 - DNA, 22 bp, Homo sapiens
tcaaaaattttctgaggatgag

SEQ ID NO: 9019485 - DNA, 22 bp, Homo sapiens
tcaaaaattttctgaggatgag

SEQ ID NO: 9019486 - DNA, 22 bp, Homo sapiens
tcaaaaattttctgaggatgag

SEQ ID NO: 9019487 - DNA, 22 bp, Homo sapiens
tcaaaacaatcattggatgtgc

SEQ ID NO: 9019488 - DNA, 22 bp, Homo sapiens
tcaaaacaatcattggatgtgc

SEQ ID NO: 9019489 - DNA, 22 bp, Homo sapiens
tcaaaacaatcattggatgtgc

SEQ ID NO: 9019490 - DNA, 22 bp, Homo sapiens
tcaaaacaatcattggatgtgc

SEQ ID NO: 9019491 - DNA, 22 bp, Homo sapiens
tcaaaacaacactcaggtgtaa

SEQ ID NO: 9019492 - DNA, 22 bp, Homo sapiens
tcaaaacaatcattggatgtgc

SEQ ID NO: 9019493 - DNA, 22 bp, Homo sapiens
tcaaaacaacactcaggtgtaa

SEQ ID NO: 9019494 - DNA, 22 bp, Homo sapiens
tcaaaacaatcattggatgtgc

SEQ ID NO: 9019495 - DNA, 22 bp, Homo sapiens
tcaaaacaacactcaggtgtaa

SEQ ID NO: 9019496 - DNA, 22 bp, Homo sapiens
tcaaaacaatcattggatgtgc

SEQ ID NO: 9019497 - DNA, 19 bp, Homo sapiens
tcaaaacacaaatggttga

SEQ ID NO: 9019498 - DNA, 19 bp, Homo sapiens
tcaaaacacaaatggttga

SEQ ID NO: 9019499 - DNA, 19 bp, Homo sapiens
tcaaaacacaaatggttga

SEQ ID NO: 9019500 - DNA, 19 bp, Homo sapiens
tcaaaacacaaatggttga

SEQ ID NO: 9019501 - DNA, 19 bp, Homo sapiens
tcaaaacacaaatggttga

SEQ ID NO: 9019502 - DNA, 19 bp, Homo sapiens
tcaaaacacaaatggttga

SEQ ID NO: 9019503 - DNA, 19 bp, Homo sapiens
tcaaaacacaaatggttga

SEQ ID NO: 9019504 - DNA, 19 bp, Homo sapiens
tcaaaacacaaatggttga

SEQ ID NO: 9019505 - DNA, 19 bp, Homo sapiens
tcaaaacacaaatggttga

SEQ ID NO: 9019506 - DNA, 22 bp, Homo sapiens
tcaaaacactattacctttaat

SEQ ID NO: 9019507 - DNA, 22 bp, Homo sapiens
tcaaaacactattacctttaat

SEQ ID NO: 9019508 - DNA, 22 bp, Homo sapiens
tcaaaacactattacctttaat

SEQ ID NO: 9019509 - DNA, 22 bp, Homo sapiens
tcaaaacactattacctttaat

SEQ ID NO: 9019510 - DNA, 19 bp, Homo sapiens
tcaaaacacaaatggttga

SEQ ID NO: 9019511 - DNA, 19 bp, Homo sapiens
tcaaaacacaaatggttga

SEQ ID NO: 9019512 - DNA, 22 bp, Homo sapiens
tattttaggtaatatccattgt

SEQ ID NO: 9019513 - DNA, 22 bp, Homo sapiens
tattttactttaaagcgagaga

SEQ ID NO: 9019514 - DNA, 22 bp, Homo sapiens
tattttactttaaagcgagaga

SEQ ID NO: 9019515 - DNA, 22 bp, Homo sapiens
tattttacatgacaggtgttta

SEQ ID NO: 9019516 - DNA, 22 bp, Homo sapiens
tattttacatgacaggtgttta

SEQ ID NO: 9019517 - DNA, 22 bp, Homo sapiens
tattttatctgccagagtggag

SEQ ID NO: 9019518 - DNA, 22 bp, Homo sapiens
tattttatctgccagagtggag

SEQ ID NO: 9019519 - DNA, 22 bp, Homo sapiens
tattttatctgccagagtggag

SEQ ID NO: 9019520 - DNA, 22 bp, Homo sapiens
tattttatctgccagagtggag

SEQ ID NO: 9019521 - DNA, 22 bp, Homo sapiens
tattttcaccatgtatccctgt

SEQ ID NO: 9019522 - DNA, 22 bp, Homo sapiens
tcaaaaatgttttatattggta

SEQ ID NO: 9019523 - DNA, 22 bp, Homo sapiens
tcaaaaatgttttatattggta

SEQ ID NO: 9019524 - DNA, 22 bp, Homo sapiens
tcaaaaatgttttatattggta

SEQ ID NO: 9019525 - DNA, 22 bp, Homo sapiens
tattttcaccatgtatccctgt

SEQ ID NO: 9019526 - DNA, 22 bp, Homo sapiens
tcaaaaatgttttatattggta

SEQ ID NO: 9019527 - DNA, 22 bp, Homo sapiens
tcaacaaatacttaaagcagag

SEQ ID NO: 9019528 - DNA, 22 bp, Homo sapiens
tcaacaaatacttaaagcagag

SEQ ID NO: 9019529 - DNA, 22 bp, Homo sapiens
tcaaaacactattacctttaat

SEQ ID NO: 9019530 - DNA, 22 bp, Homo sapiens
tcaaaacactattacctttaat

SEQ ID NO: 9019531 - DNA, 22 bp, Homo sapiens
tcaaaacactattacctttaat

SEQ ID NO: 9019532 - DNA, 22 bp, Homo sapiens
tcaacaaatacttaaagcagag

SEQ ID NO: 9019533 - DNA, 22 bp, Homo sapiens
tcaaaacactattacctttaat

SEQ ID NO: 9019534 - DNA, 22 bp, Homo sapiens
tcaacaaatacttaaagcagag

SEQ ID NO: 9019535 - DNA, 22 bp, Homo sapiens
tcaacaaatacttaaagcagag

SEQ ID NO: 9019536 - DNA, 22 bp, Homo sapiens
tcaagatgaaccaggacattca

SEQ ID NO: 9019537 - DNA, 22 bp, Homo sapiens
tcaagatgaaagatgtagccat

SEQ ID NO: 9019538 - DNA, 20 bp, Homo sapiens
tcaagatgaggtcatactgg

SEQ ID NO: 9019539 - DNA, 22 bp, Homo sapiens
tcaagatgcatgggtggcataa

SEQ ID NO: 9019540 - DNA, 19 bp, Homo sapiens
tcaagatggatggctccca

SEQ ID NO: 9019541 - DNA, 22 bp, Homo sapiens
tcaagatgtccagtgcctataa

SEQ ID NO: 9019542 - DNA, 22 bp, Homo sapiens
tcaagcaaactctgagaaataa

SEQ ID NO: 9019543 - DNA, 22 bp, Homo sapiens
tcaagcaaatgtccttttgttc

SEQ ID NO: 9019544 - DNA, 22 bp, Homo sapiens
tcaagcaaagtttagctggtta

SEQ ID NO: 9019545 - DNA, 22 bp, Homo sapiens
tcaagcaaagatacaaatggaa

SEQ ID NO: 9019546 - DNA, 22 bp, Homo sapiens
tcaagcaaagatacaaatggaa

SEQ ID NO: 9019547 - DNA, 22 bp, Homo sapiens
tcaagcaacagaactgtgagac

SEQ ID NO: 9019548 - DNA, 22 bp, Homo sapiens
tcaagcaactgaattctaaaag

SEQ ID NO: 9019549 - DNA, 22 bp, Homo sapiens
tcaagcaactgaattctaaaag

SEQ ID NO: 9019550 - DNA, 22 bp, Homo sapiens
tcaagcaagtgtttggtgtaaa

SEQ ID NO: 9019551 - DNA, 22 bp, Homo sapiens
tcaagcaagttgcatattgcta

SEQ ID NO: 9019552 - DNA, 22 bp, Homo sapiens
tcaagcaactgaattctaaaag

SEQ ID NO: 9019553 - DNA, 23 bp, Homo sapiens
tcaagcaattctcctgcctcggc

SEQ ID NO: 9019554 - DNA, 22 bp, Homo sapiens
tcaagcagagtcaaaagtacca

SEQ ID NO: 9019555 - DNA, 22 bp, Homo sapiens
tcaagcagagtcaaaagtacca

SEQ ID NO: 9019556 - DNA, 23 bp, Homo sapiens
tcaagcaataattggtaatagtg

SEQ ID NO: 9019557 - DNA, 22 bp, Homo sapiens
tcaagcaattctcctgcctcag

SEQ ID NO: 9019558 - DNA, 22 bp, Homo sapiens
tcaagcaatctctgtgtccctg

SEQ ID NO: 9019559 - DNA, 23 bp, Homo sapiens
tcaagcaataattggtaatagtg

SEQ ID NO: 9019560 - DNA, 22 bp, Homo sapiens
tcaagcagggtagcaagctggt

SEQ ID NO: 9019561 - DNA, 19 bp, Homo sapiens
tcaagcagtctgatttagg

SEQ ID NO: 9019562 - DNA, 19 bp, Homo sapiens
tcaagcagtctgatttagg

SEQ ID NO: 9019563 - DNA, 22 bp, Homo sapiens
tcaagcagcagatcaagagcta

SEQ ID NO: 9019564 - DNA, 22 bp, Homo sapiens
tcaagcagcagatcaagagcta

SEQ ID NO: 9019565 - DNA, 22 bp, Homo sapiens
tcaagcagcttttacagaagag

SEQ ID NO: 9019566 - DNA, 22 bp, Homo sapiens
tcaagcagcttttacagaagag

SEQ ID NO: 9019567 - DNA, 22 bp, Homo sapiens
tcaatagagccttctttcaggt

SEQ ID NO: 9019568 - DNA, 22 bp, Homo sapiens
tcaatagagccttctttcaggt

SEQ ID NO: 9019569 - DNA, 22 bp, Homo sapiens
tcaatagagccttctttcaggt

SEQ ID NO: 9019570 - DNA, 22 bp, Homo sapiens
tcaatagataaagctacataaa

SEQ ID NO: 9019571 - DNA, 22 bp, Homo sapiens
tcaatagataaagctacataaa

SEQ ID NO: 9019572 - DNA, 22 bp, Homo sapiens
tcaatagattaggtattagatt

SEQ ID NO: 9019573 - DNA, 22 bp, Homo sapiens
tcaagccactggcagaagatta

SEQ ID NO: 9019574 - DNA, 22 bp, Homo sapiens
tcaagccactggcagaagatta

SEQ ID NO: 9019575 - DNA, 22 bp, Homo sapiens
tcaagccatcaggcagcgggtt

SEQ ID NO: 9019576 - DNA, 22 bp, Homo sapiens
tcaagccatcaggcagcgggtt

SEQ ID NO: 9019577 - DNA, 18 bp, Homo sapiens
tcaagccattctcctgcc

SEQ ID NO: 9019578 - DNA, 22 bp, Homo sapiens
tcaagccactggcagaagatta

SEQ ID NO: 9019579 - DNA, 22 bp, Homo sapiens
taatccagcgggtgattgcaca

SEQ ID NO: 9019580 - DNA, 18 bp, Homo sapiens
taatccagggcaggtgat

SEQ ID NO: 9019581 - DNA, 22 bp, Homo sapiens
taatccagcgggtgattgcaca

SEQ ID NO: 9019582 - DNA, 22 bp, Homo sapiens
taatgtacctccagatgttgta

SEQ ID NO: 9019583 - DNA, 22 bp, Homo sapiens
taatgtataacaaatactcatc

SEQ ID NO: 9019584 - DNA, 22 bp, Homo sapiens
taatgtataacaaatactcatc

SEQ ID NO: 9019585 - DNA, 22 bp, Homo sapiens
taatgtatttgttcagaagagt

SEQ ID NO: 9019586 - DNA, 22 bp, Homo sapiens
taatgtatttgttcagaagagt

SEQ ID NO: 9019587 - DNA, 22 bp, Homo sapiens
taatgtataacaaatactcatc

SEQ ID NO: 9019588 - DNA, 22 bp, Homo sapiens
taatgtataacaaatactcatc

SEQ ID NO: 9019589 - DNA, 22 bp, Homo sapiens
taatgtatttgttcagaagagt

SEQ ID NO: 9019590 - DNA, 22 bp, Homo sapiens
taatgtcaaggtcattctagag

SEQ ID NO: 9019591 - DNA, 22 bp, Homo sapiens
taatcatatgggtaatccaatg

SEQ ID NO: 9019592 - DNA, 22 bp, Homo sapiens
taatccaaaactgaatctgtgg

SEQ ID NO: 9019593 - DNA, 20 bp, Homo sapiens
taatcacttataagacaatg

SEQ ID NO: 9019594 - DNA, 22 bp, Homo sapiens
taatcactgtcaacctttgttc

SEQ ID NO: 9019595 - DNA, 22 bp, Homo sapiens
taatcactgtgagtctgttttc

SEQ ID NO: 9019596 - DNA, 22 bp, Homo sapiens
taatcactgggcgtttggtact

SEQ ID NO: 9019597 - DNA, 22 bp, Homo sapiens
taatcactgggcgtttggtact

SEQ ID NO: 9019598 - DNA, 22 bp, Homo sapiens
taatcatatgggtaatccaatg

SEQ ID NO: 9019599 - DNA, 22 bp, Homo sapiens
taatcatatgggtaatccaatg

SEQ ID NO: 9019600 - DNA, 20 bp, Homo sapiens
taatcacttataagacaatg

SEQ ID NO: 9019601 - DNA, 22 bp, Homo sapiens
taatcacttttcattagtacct

SEQ ID NO: 9019602 - DNA, 22 bp, Homo sapiens
taatcacttttcattagtacct

SEQ ID NO: 9019603 - DNA, 22 bp, Homo sapiens
taatatgtgttactgacttttt

SEQ ID NO: 9019604 - DNA, 22 bp, Homo sapiens
taatatttctaccctgctgcct

SEQ ID NO: 9019605 - DNA, 22 bp, Homo sapiens
taatatctggcattcaaacatg

SEQ ID NO: 9019606 - DNA, 22 bp, Homo sapiens
taatatctggcattcaaacatg

SEQ ID NO: 9019607 - DNA, 22 bp, Homo sapiens
taatatctggcattcaaacatg

SEQ ID NO: 9019608 - DNA, 22 bp, Homo sapiens
taatatctggcattcaaacatg

SEQ ID NO: 9019609 - DNA, 22 bp, Homo sapiens
taatatctggcattcaaacatg

SEQ ID NO: 9019610 - DNA, 22 bp, Homo sapiens
taatacagatacaaaggaggac

SEQ ID NO: 9019611 - DNA, 22 bp, Homo sapiens
taatatctacttcatagagttt

SEQ ID NO: 9019612 - DNA, 22 bp, Homo sapiens
taatcacagaaacagactgttt

SEQ ID NO: 9019613 - DNA, 22 bp, Homo sapiens
taatcacagaaacagactgttt

SEQ ID NO: 9019614 - DNA, 22 bp, Homo sapiens
taatcacagaaacagactgttt

SEQ ID NO: 9019615 - DNA, 22 bp, Homo sapiens
taatcacatcagggtaaatggg

SEQ ID NO: 9019616 - DNA, 22 bp, Homo sapiens
taatcacagaaacagactgttt

SEQ ID NO: 9019617 - DNA, 22 bp, Homo sapiens
taatatttctaccctgctgcct

SEQ ID NO: 9019618 - DNA, 22 bp, Homo sapiens
taatatttctaccctgctgcct

SEQ ID NO: 9019619 - DNA, 22 bp, Homo sapiens
taatatttctaccctgctgcct

SEQ ID NO: 9019620 - DNA, 22 bp, Homo sapiens
taatcacaattcagatgtctta

SEQ ID NO: 9019621 - DNA, 22 bp, Homo sapiens
taatcacaattcagatgtctta

SEQ ID NO: 9019622 - DNA, 22 bp, Homo sapiens
taatcacaattcagatgtctta

SEQ ID NO: 9019623 - DNA, 22 bp, Homo sapiens
caggcagggagctggaaaggat

SEQ ID NO: 9019624 - DNA, 22 bp, Homo sapiens
taatgttacactgcatggttca

SEQ ID NO: 9019625 - DNA, 22 bp, Homo sapiens
taatgtgtgtcatcagtagagt

SEQ ID NO: 9019626 - DNA, 22 bp, Homo sapiens
taatgtgttgaatatttgtaca

SEQ ID NO: 9019627 - DNA, 22 bp, Homo sapiens
taatgtgttgaatatttgtaca

SEQ ID NO: 9019628 - DNA, 22 bp, Homo sapiens
taatgttacactgcatggttca

SEQ ID NO: 9019629 - DNA, 22 bp, Homo sapiens
taatgtgtgtcatcagtagagt

SEQ ID NO: 9019630 - DNA, 22 bp, Homo sapiens
taatgtgtgtcatcagtagagt

SEQ ID NO: 9019631 - DNA, 22 bp, Homo sapiens
taatgtgtgtcatcagtagagt

SEQ ID NO: 9019632 - DNA, 22 bp, Homo sapiens
taatgtgtcctgaaagcttctg

SEQ ID NO: 9019633 - DNA, 22 bp, Homo sapiens
taatgtctttaagagcattggg

SEQ ID NO: 9019634 - DNA, 22 bp, Homo sapiens
taatgtctttaagagcattggg

SEQ ID NO: 9019635 - DNA, 22 bp, Homo sapiens
taatgtcttgtgagagctggag

SEQ ID NO: 9019636 - DNA, 22 bp, Homo sapiens
taatgtcttagtaccttaattt

SEQ ID NO: 9019637 - DNA, 22 bp, Homo sapiens
taatgtctgtgtttcagtgcag

SEQ ID NO: 9019638 - DNA, 22 bp, Homo sapiens
taatgtctgatagtgatggctc

SEQ ID NO: 9019639 - DNA, 22 bp, Homo sapiens
taatgtctatgggccagataat

SEQ ID NO: 9019640 - DNA, 22 bp, Homo sapiens
taatgtctatgggccagataat

SEQ ID NO: 9019641 - DNA, 22 bp, Homo sapiens
taatgtctagatcagacctcga

SEQ ID NO: 9019642 - DNA, 22 bp, Homo sapiens
taatgtcagcatagtttatttt

SEQ ID NO: 9019643 - DNA, 22 bp, Homo sapiens
caggcatgcttctgtctgggca

SEQ ID NO: 9019644 - DNA, 22 bp, Homo sapiens
caggcatgcttctgtctgggca

SEQ ID NO: 9019645 - DNA, 22 bp, Homo sapiens
caggcatgagccaggcccctcc

SEQ ID NO: 9019646 - DNA, 22 bp, Homo sapiens
caggcatggagaggcagagact

SEQ ID NO: 9019647 - DNA, 22 bp, Homo sapiens
caggcatggagaggcagagact

SEQ ID NO: 9019648 - DNA, 22 bp, Homo sapiens
caggcatggagaggcagagact

SEQ ID NO: 9019649 - DNA, 22 bp, Homo sapiens
caggcatggagaggcagagact

SEQ ID NO: 9019650 - DNA, 22 bp, Homo sapiens
caggcatggaaaagcccagagg

SEQ ID NO: 9019651 - DNA, 22 bp, Homo sapiens
caggcatggaaaagcccagagg

SEQ ID NO: 9019652 - DNA, 22 bp, Homo sapiens
caggcatggatctggaatcatt

SEQ ID NO: 9019653 - DNA, 22 bp, Homo sapiens
caggcatggatctggaatcatt

SEQ ID NO: 9019654 - DNA, 22 bp, Homo sapiens
caggcatgggccatgggaagtg

SEQ ID NO: 9019655 - DNA, 22 bp, Homo sapiens
caggcatggagaggcagagact

SEQ ID NO: 9019656 - DNA, 22 bp, Homo sapiens
caggcatggagaggcagagact

SEQ ID NO: 9019657 - DNA, 22 bp, Homo sapiens
caggccagtgggaaatagggat

SEQ ID NO: 9019658 - DNA, 19 bp, Homo sapiens
caggccagtgtcagggggc

SEQ ID NO: 9019659 - DNA, 19 bp, Homo sapiens
caggccagtgtcagggggc

SEQ ID NO: 9019660 - DNA, 19 bp, Homo sapiens
caggccagtgtcagggggc

SEQ ID NO: 9019661 - DNA, 22 bp, Homo sapiens
caggccaggtggcaggcaaaac

SEQ ID NO: 9019662 - DNA, 22 bp, Homo sapiens
caggccagtgggaaatagggat

SEQ ID NO: 9019663 - DNA, 22 bp, Homo sapiens
caggccagtgggaaatagggat

SEQ ID NO: 9019664 - DNA, 22 bp, Homo sapiens
caggccagggttgagaagagaa

SEQ ID NO: 9019665 - DNA, 22 bp, Homo sapiens
caggccagggttgagaagagaa

SEQ ID NO: 9019666 - DNA, 22 bp, Homo sapiens
caggccagggttgagaagagaa

SEQ ID NO: 9019667 - DNA, 22 bp, Homo sapiens
caggccagggttgagaagagaa

SEQ ID NO: 9019668 - DNA, 22 bp, Homo sapiens
caggccagggttgagaagagaa

SEQ ID NO: 9019669 - DNA, 22 bp, Homo sapiens
caggccaggtgctctagaatca

SEQ ID NO: 9019670 - DNA, 22 bp, Homo sapiens
caggccaggtgctctagaatca

SEQ ID NO: 9019671 - DNA, 22 bp, Homo sapiens
caggccaggtgctctagaatca

SEQ ID NO: 9019672 - DNA, 22 bp, Homo sapiens
caggccagtgtgcttcccaggc

SEQ ID NO: 9019673 - DNA, 22 bp, Homo sapiens
caggccagtgtgcttcccaggc

SEQ ID NO: 9019674 - DNA, 22 bp, Homo sapiens
caggccagtgtgcttcccaggc

SEQ ID NO: 9019675 - DNA, 22 bp, Homo sapiens
caggccattaccgctgagaccc

SEQ ID NO: 9019676 - DNA, 22 bp, Homo sapiens
caggcccaaatgcaaccttctt

SEQ ID NO: 9019677 - DNA, 19 bp, Homo sapiens
caggccagtgtcagggggc

SEQ ID NO: 9019678 - DNA, 22 bp, Homo sapiens
caggccagtgtgcttcccaggc

SEQ ID NO: 9019679 - DNA, 19 bp, Homo sapiens
caggccagtgtcagggggc

SEQ ID NO: 9019680 - DNA, 22 bp, Homo sapiens
caggccagtgtgcttcccaggc

SEQ ID NO: 9019681 - DNA, 22 bp, Homo sapiens
caggccagtgtgcttcccaggc

SEQ ID NO: 9019682 - DNA, 22 bp, Homo sapiens
caggcccacgaggcacacagag

SEQ ID NO: 9019683 - DNA, 22 bp, Homo sapiens
caggcccaaatgcaaccttctt

SEQ ID NO: 9019684 - DNA, 22 bp, Homo sapiens
caggcccaagactgatgagtct

SEQ ID NO: 9019685 - DNA, 22 bp, Homo sapiens
caggcccagaggcctcttccca

SEQ ID NO: 9019686 - DNA, 22 bp, Homo sapiens
caggcccactgcttgtctagtc

SEQ ID NO: 9019687 - DNA, 22 bp, Homo sapiens
caggcccactgcttgtctagtc

SEQ ID NO: 9019688 - DNA, 22 bp, Homo sapiens
caggcccacgaggcacacagag

SEQ ID NO: 9019689 - DNA, 22 bp, Homo sapiens
caggccagagcgcgtggttggg

SEQ ID NO: 9019690 - DNA, 22 bp, Homo sapiens
caggccagggttgagaagagaa

SEQ ID NO: 9019691 - DNA, 22 bp, Homo sapiens
caggccagagcgcgtggttggg

SEQ ID NO: 9019692 - DNA, 22 bp, Homo sapiens
caggccagagcgcgtggttggg

SEQ ID NO: 9019693 - DNA, 22 bp, Homo sapiens
caggccagagcgcgtggttggg

SEQ ID NO: 9019694 - DNA, 20 bp, Homo sapiens
tacaaacctccacactggtg

SEQ ID NO: 9019695 - DNA, 22 bp, Homo sapiens
tacaaaagtaattacggttttt

SEQ ID NO: 9019696 - DNA, 22 bp, Homo sapiens
tacaaaagtaattacggttttt

SEQ ID NO: 9019697 - DNA, 22 bp, Homo sapiens
tacaaaagtaattacggttttt

SEQ ID NO: 9019698 - DNA, 22 bp, Homo sapiens
tacaaaagtaattacggttttt

SEQ ID NO: 9019699 - DNA, 22 bp, Homo sapiens
tacaaaagtaattacggttttt

SEQ ID NO: 9019700 - DNA, 22 bp, Homo sapiens
tacaaaacagtgctctggtcct

SEQ ID NO: 9019701 - DNA, 22 bp, Homo sapiens
tacaaaacagtgctctggtcct

SEQ ID NO: 9019702 - DNA, 22 bp, Homo sapiens
tacaaaacagtgctctggtcct

SEQ ID NO: 9019703 - DNA, 22 bp, Homo sapiens
tacaaaacagtgctctggtcct

SEQ ID NO: 9019704 - DNA, 22 bp, Homo sapiens
tacaaaacagtgctctggtcct

SEQ ID NO: 9019705 - DNA, 22 bp, Homo sapiens
tacaaaaaattgatactgacga

SEQ ID NO: 9019706 - DNA, 22 bp, Homo sapiens
tacaaaaaattgatactgacga

SEQ ID NO: 9019707 - DNA, 22 bp, Homo sapiens
tacaaaaggaagagggatctta

SEQ ID NO: 9019708 - DNA, 22 bp, Homo sapiens
tacaaaacagtgctctggtcct

SEQ ID NO: 9019709 - DNA, 22 bp, Homo sapiens
tacaaaacagtgctctggtcct

SEQ ID NO: 9019710 - DNA, 22 bp, Homo sapiens
tacaaaaggaagagggatctta

SEQ ID NO: 9019711 - DNA, 22 bp, Homo sapiens
tacaaaaggaagagggatctta

SEQ ID NO: 9019712 - DNA, 22 bp, Homo sapiens
tacaaaaggaagagggatctta

SEQ ID NO: 9019713 - DNA, 22 bp, Homo sapiens
tacaaaagtaattacggttttt

SEQ ID NO: 9019714 - DNA, 22 bp, Homo sapiens
tacaaaagtaattacggttttt

SEQ ID NO: 9019715 - DNA, 22 bp, Homo sapiens
tacaaaaggaagagggatctta

SEQ ID NO: 9019716 - DNA, 22 bp, Homo sapiens
tacaaaaggaagagggatctta

SEQ ID NO: 9019717 - DNA, 22 bp, Homo sapiens
caggcatgggccatgggaagtg

SEQ ID NO: 9019718 - DNA, 22 bp, Homo sapiens
caggcatgggccatgggaagtg

SEQ ID NO: 9019719 - DNA, 22 bp, Homo sapiens
caggcatggatctggaatcatt

SEQ ID NO: 9019720 - DNA, 22 bp, Homo sapiens
caggcatgggccatgggaagtg

SEQ ID NO: 9019721 - DNA, 22 bp, Homo sapiens
caggcatgtggcccaggggtga

SEQ ID NO: 9019722 - DNA, 22 bp, Homo sapiens
caggcatgtggcccaggggtga

SEQ ID NO: 9019723 - DNA, 22 bp, Homo sapiens
caggcattcctctatgaatatt

SEQ ID NO: 9019724 - DNA, 22 bp, Homo sapiens
caggcattgccattcctccaga

SEQ ID NO: 9019725 - DNA, 22 bp, Homo sapiens
caggcatttaactctctaatgg

SEQ ID NO: 9019726 - DNA, 22 bp, Homo sapiens
caggcatttcgcaaaggctgag

SEQ ID NO: 9019727 - DNA, 22 bp, Homo sapiens
tacaaaaaattgatactgacga

SEQ ID NO: 9019728 - DNA, 22 bp, Homo sapiens
tacaaaaaattgatactgacga

SEQ ID NO: 9019729 - DNA, 22 bp, Homo sapiens
tacaaaaaattgatactgacga

SEQ ID NO: 9019730 - DNA, 22 bp, Homo sapiens
caggcatttaactctctaatgg

SEQ ID NO: 9019731 - DNA, 21 bp, Homo sapiens
caggccaaaaggttcaacatt

SEQ ID NO: 9019732 - DNA, 22 bp, Homo sapiens
tacaaaaaattgatactgacga

SEQ ID NO: 9019733 - DNA, 22 bp, Homo sapiens
tacaaaaaattgatactgacga

SEQ ID NO: 9019734 - DNA, 22 bp, Homo sapiens
tacaaaaaattgatactgacga

SEQ ID NO: 9019735 - DNA, 22 bp, Homo sapiens
tacaaaaaattgatactgacga

SEQ ID NO: 9019736 - DNA, 22 bp, Homo sapiens
tacaaaaaattgatactgacga

SEQ ID NO: 9019737 - DNA, 22 bp, Homo sapiens
tacaaaaaattgatactgacga

SEQ ID NO: 9019738 - DNA, 22 bp, Homo sapiens
taagtgaaataagtcagataca

SEQ ID NO: 9019739 - DNA, 22 bp, Homo sapiens
taagtgaaatggtgcatcaaat

SEQ ID NO: 9019740 - DNA, 22 bp, Homo sapiens
taagtgaaaatggtttcccagc

SEQ ID NO: 9019741 - DNA, 22 bp, Homo sapiens
taagtgaaataagtcagataca

SEQ ID NO: 9019742 - DNA, 22 bp, Homo sapiens
taagtcttcatagtctaatgtc

SEQ ID NO: 9019743 - DNA, 22 bp, Homo sapiens
taagtcttgaaatatttcctat

SEQ ID NO: 9019744 - DNA, 22 bp, Homo sapiens
taagtctctcgtttgattcatt

SEQ ID NO: 9019745 - DNA, 22 bp, Homo sapiens
taagtcgtggatgattcttcgg

SEQ ID NO: 9019746 - DNA, 22 bp, Homo sapiens
taagtcgtggatgattcttcgg

SEQ ID NO: 9019747 - DNA, 22 bp, Homo sapiens
taagtcctattccaggtctctc

SEQ ID NO: 9019748 - DNA, 22 bp, Homo sapiens
taagtccacaggctgacagcgg

SEQ ID NO: 9019749 - DNA, 22 bp, Homo sapiens
taagtccacaggctgacagcgg

SEQ ID NO: 9019750 - DNA, 22 bp, Homo sapiens
taagtccacaggagttgtgttc

SEQ ID NO: 9019751 - DNA, 22 bp, Homo sapiens
taagtccaagggtatgagttgg

SEQ ID NO: 9019752 - DNA, 22 bp, Homo sapiens
taagtccagtgttctctctgtg

SEQ ID NO: 9019753 - DNA, 22 bp, Homo sapiens
taagtccagtgttctctctgtg

SEQ ID NO: 9019754 - DNA, 22 bp, Homo sapiens
taagtccactatatccttctct

SEQ ID NO: 9019755 - DNA, 22 bp, Homo sapiens
taagtccactatatccttctct

SEQ ID NO: 9019756 - DNA, 22 bp, Homo sapiens
taagtccacctcattcttcagc

SEQ ID NO: 9019757 - DNA, 22 bp, Homo sapiens
taagtccacctcattcttcagc

SEQ ID NO: 9019758 - DNA, 22 bp, Homo sapiens
taagtccacctcattcttcagc

SEQ ID NO: 9019759 - DNA, 22 bp, Homo sapiens
taagtccataatggcagtaaat

SEQ ID NO: 9019760 - DNA, 22 bp, Homo sapiens
taaggcagcctcagggtagggt

SEQ ID NO: 9019761 - DNA, 22 bp, Homo sapiens
taaggcaggaactggctgtttt

SEQ ID NO: 9019762 - DNA, 19 bp, Homo sapiens
taagtagtcaaatagtaac

SEQ ID NO: 9019763 - DNA, 19 bp, Homo sapiens
taagtagtcaaatagtaac

SEQ ID NO: 9019764 - DNA, 22 bp, Homo sapiens
taagtattggcctatagctaga

SEQ ID NO: 9019765 - DNA, 22 bp, Homo sapiens
taagtatgttagaaaatcaagt

SEQ ID NO: 9019766 - DNA, 22 bp, Homo sapiens
taaggcagcctcagggtagggt

SEQ ID NO: 9019767 - DNA, 22 bp, Homo sapiens
taaggcagctgagcttctaaca

SEQ ID NO: 9019768 - DNA, 22 bp, Homo sapiens
taaggcagcctcagggtagggt

SEQ ID NO: 9019769 - DNA, 23 bp, Homo sapiens
cagctcagcacataggaggtact

SEQ ID NO: 9019770 - DNA, 23 bp, Homo sapiens
cagctcagcacataggaggtact

SEQ ID NO: 9019771 - DNA, 22 bp, Homo sapiens
taagtcatcccataacagtgct

SEQ ID NO: 9019772 - DNA, 22 bp, Homo sapiens
taagtcaaggtggcatttgaga

SEQ ID NO: 9019773 - DNA, 22 bp, Homo sapiens
taagtattggcctatagctaga

SEQ ID NO: 9019774 - DNA, 22 bp, Homo sapiens
taagtattggcctatagctaga

SEQ ID NO: 9019775 - DNA, 22 bp, Homo sapiens
taagtcacttattccacaagat

SEQ ID NO: 9019776 - DNA, 22 bp, Homo sapiens
taagtcacttaagtttgcatgt

SEQ ID NO: 9019777 - DNA, 22 bp, Homo sapiens
gtgcttaaggcagtctgtcaaa

SEQ ID NO: 9019778 - DNA, 22 bp, Homo sapiens
gtgcttaaggcagtctgtcaaa

SEQ ID NO: 9019779 - DNA, 22 bp, Homo sapiens
gtgcttaatacatgtcaataac

SEQ ID NO: 9019780 - DNA, 22 bp, Homo sapiens
gtgcttaaaacagaaaacattg

SEQ ID NO: 9019781 - DNA, 22 bp, Homo sapiens
gtgcttaacctagtttctagta

SEQ ID NO: 9019782 - DNA, 22 bp, Homo sapiens
gtgcttatgtgggagggagagg

SEQ ID NO: 9019783 - DNA, 20 bp, Homo sapiens
gtgcttcagaagccattgct

SEQ ID NO: 9019784 - DNA, 22 bp, Homo sapiens
gtgcttatccccattctggagg

SEQ ID NO: 9019785 - DNA, 22 bp, Homo sapiens
gtgcttatccccattctggagg

SEQ ID NO: 9019786 - DNA, 22 bp, Homo sapiens
gtgcttcactgacctgttttca

SEQ ID NO: 9019787 - DNA, 22 bp, Homo sapiens
gtgcttctcttcacacccaact

SEQ ID NO: 9019788 - DNA, 22 bp, Homo sapiens
gtgcttctctgctctacccggc

SEQ ID NO: 9019789 - DNA, 22 bp, Homo sapiens
gtgcttctctgctctacccggc

SEQ ID NO: 9019790 - DNA, 22 bp, Homo sapiens
gtgcttctccgttctgcagcac

SEQ ID NO: 9019791 - DNA, 22 bp, Homo sapiens
gtgcttctccgttctgcagcac

SEQ ID NO: 9019792 - DNA, 22 bp, Homo sapiens
cagctcagacgcaggtcgagca

SEQ ID NO: 9019793 - DNA, 22 bp, Homo sapiens
cagctcagacgcaggtcgagca

SEQ ID NO: 9019794 - DNA, 22 bp, Homo sapiens
cagctcacttgtttcatcttct

SEQ ID NO: 9019795 - DNA, 22 bp, Homo sapiens
cagctcagacgcaggtcgagca

SEQ ID NO: 9019796 - DNA, 22 bp, Homo sapiens
cagctcagacgcaggtcgagca

SEQ ID NO: 9019797 - DNA, 22 bp, Homo sapiens
cagctcaatagcctaccttaat

SEQ ID NO: 9019798 - DNA, 22 bp, Homo sapiens
cagctcacccatcacgtctgct

SEQ ID NO: 9019799 - DNA, 22 bp, Homo sapiens
cagctcacccatcacgtctgct

SEQ ID NO: 9019800 - DNA, 22 bp, Homo sapiens
cagctcacagccacgccattcc

SEQ ID NO: 9019801 - DNA, 22 bp, Homo sapiens
cagctcaagtttcccaggtcag

SEQ ID NO: 9019802 - DNA, 22 bp, Homo sapiens
cagctcaagtttcccaggtcag

SEQ ID NO: 9019803 - DNA, 22 bp, Homo sapiens
cagctattttgcctatcatggt

SEQ ID NO: 9019804 - DNA, 22 bp, Homo sapiens
gtgcttctgccaactaattaac

SEQ ID NO: 9019805 - DNA, 22 bp, Homo sapiens
cagctattggcaagaagtggtg

SEQ ID NO: 9019806 - DNA, 22 bp, Homo sapiens
cagctattgataaatgttgggg

SEQ ID NO: 9019807 - DNA, 22 bp, Homo sapiens
cagctattggtccacaggtatg

SEQ ID NO: 9019808 - DNA, 22 bp, Homo sapiens
cagctattggtccacaggtatg

SEQ ID NO: 9019809 - DNA, 22 bp, Homo sapiens
cagctatttatctttcatgata

SEQ ID NO: 9019810 - DNA, 22 bp, Homo sapiens
cagctatttgtaggaaaactgt

SEQ ID NO: 9019811 - DNA, 22 bp, Homo sapiens
cagctattttctcattaaggat

SEQ ID NO: 9019812 - DNA, 22 bp, Homo sapiens
caggcaccagtgagaagggcct

SEQ ID NO: 9019813 - DNA, 22 bp, Homo sapiens
caggcaccagtgagaagggcct

SEQ ID NO: 9019814 - DNA, 22 bp, Homo sapiens
caggcaccacactaggggctga

SEQ ID NO: 9019815 - DNA, 22 bp, Homo sapiens
caggcaccacactaggggctga

SEQ ID NO: 9019816 - DNA, 22 bp, Homo sapiens
caggcaccacactaggggctga

SEQ ID NO: 9019817 - DNA, 22 bp, Homo sapiens
caggcaccacactaggggctga

SEQ ID NO: 9019818 - DNA, 22 bp, Homo sapiens
caggcaccaatagggatcgtgg

SEQ ID NO: 9019819 - DNA, 22 bp, Homo sapiens
caggcaccaatagggatcgtgg

SEQ ID NO: 9019820 - DNA, 22 bp, Homo sapiens
caggcaccccaggtgagcactg

SEQ ID NO: 9019821 - DNA, 22 bp, Homo sapiens
caggcaccccaggtgagcactg

SEQ ID NO: 9019822 - DNA, 22 bp, Homo sapiens
caggcaccccaggtgagcactg

SEQ ID NO: 9019823 - DNA, 22 bp, Homo sapiens
caggcaccccaggtgagcactg

SEQ ID NO: 9019824 - DNA, 22 bp, Homo sapiens
caggcacccagcccagtcgcac

SEQ ID NO: 9019825 - DNA, 22 bp, Homo sapiens
caggcacccagcccagtcgcac

SEQ ID NO: 9019826 - DNA, 22 bp, Homo sapiens
caggcacccagcccagtcgcac

SEQ ID NO: 9019827 - DNA, 22 bp, Homo sapiens
caggcacctgtgtgtctcaggg

SEQ ID NO: 9019828 - DNA, 22 bp, Homo sapiens
caggcacctgtgtgtctcaggg

SEQ ID NO: 9019829 - DNA, 22 bp, Homo sapiens
caggcacctttgtgcatgggca

SEQ ID NO: 9019830 - DNA, 22 bp, Homo sapiens
caggcacctttgtgcatgggca

SEQ ID NO: 9019831 - DNA, 22 bp, Homo sapiens
caggcacctgtgtgtctcaggg

SEQ ID NO: 9019832 - DNA, 22 bp, Homo sapiens
caggcacctgtgtgtctcaggg

SEQ ID NO: 9019833 - DNA, 22 bp, Homo sapiens
caggcaccctctgaggggaagc

SEQ ID NO: 9019834 - DNA, 22 bp, Homo sapiens
caggcaccctctgaggggaagc

SEQ ID NO: 9019835 - DNA, 22 bp, Homo sapiens
caggcaccctctgaggggaagc

SEQ ID NO: 9019836 - DNA, 22 bp, Homo sapiens
caggcaccctctgaggggaagc

SEQ ID NO: 9019837 - DNA, 22 bp, Homo sapiens
caggcacctcacgtgggtccca

SEQ ID NO: 9019838 - DNA, 22 bp, Homo sapiens
caggcacctcacgtgggtccca

SEQ ID NO: 9019839 - DNA, 22 bp, Homo sapiens
caggcagatgctgacaagagtt

SEQ ID NO: 9019840 - DNA, 22 bp, Homo sapiens
caggcagatgctgacaagagtt

SEQ ID NO: 9019841 - DNA, 22 bp, Homo sapiens
caggcagatgctgacaagagtt

SEQ ID NO: 9019842 - DNA, 22 bp, Homo sapiens
caggcagagttagagcaactgg

SEQ ID NO: 9019843 - DNA, 22 bp, Homo sapiens
caggcagagttagtgatttagg

SEQ ID NO: 9019844 - DNA, 22 bp, Homo sapiens
caggcagagttagtgatttagg

SEQ ID NO: 9019845 - DNA, 22 bp, Homo sapiens
caggcagagttagtgatttagg

SEQ ID NO: 9019846 - DNA, 22 bp, Homo sapiens
caggcagatatgttcgctttaa

SEQ ID NO: 9019847 - DNA, 22 bp, Homo sapiens
caggcagatatgttcgctttaa

SEQ ID NO: 9019848 - DNA, 22 bp, Homo sapiens
caggcagagctgaagatagatg

SEQ ID NO: 9019849 - DNA, 22 bp, Homo sapiens
caggcagagttagagcaactgg

SEQ ID NO: 9019850 - DNA, 22 bp, Homo sapiens
caggcagagttagagcaactgg

SEQ ID NO: 9019851 - DNA, 22 bp, Homo sapiens
caggcagagttagagcaactgg

SEQ ID NO: 9019852 - DNA, 22 bp, Homo sapiens
caggcagagttagagcaactgg

SEQ ID NO: 9019853 - DNA, 22 bp, Homo sapiens
caggcagagccaatcgtggggt

SEQ ID NO: 9019854 - DNA, 22 bp, Homo sapiens
caggcagagctgaagatagatg

SEQ ID NO: 9019855 - DNA, 22 bp, Homo sapiens
caggcagagccaatcgtggggt

SEQ ID NO: 9019856 - DNA, 22 bp, Homo sapiens
caggcagagccaatcgtggggt

SEQ ID NO: 9019857 - DNA, 21 bp, Homo sapiens
taataattccactacagagta

SEQ ID NO: 9019858 - DNA, 21 bp, Homo sapiens
taataattccactacagagta

SEQ ID NO: 9019859 - DNA, 21 bp, Homo sapiens
taataattccactacagagta

SEQ ID NO: 9019860 - DNA, 21 bp, Homo sapiens
taataattccactacagagta

SEQ ID NO: 9019861 - DNA, 22 bp, Homo sapiens
taataattagttattgatcgtg

SEQ ID NO: 9019862 - DNA, 22 bp, Homo sapiens
caggcagcagaggagtgtggga

SEQ ID NO: 9019863 - DNA, 22 bp, Homo sapiens
caggcagcagaggagtgtggga

SEQ ID NO: 9019864 - DNA, 22 bp, Homo sapiens
caggcagcagccactctggtat

SEQ ID NO: 9019865 - DNA, 22 bp, Homo sapiens
taataattaacagtgatgggtc

SEQ ID NO: 9019866 - DNA, 22 bp, Homo sapiens
taataattagttattgatcgtg

SEQ ID NO: 9019867 - DNA, 22 bp, Homo sapiens
caggcagatttgctgccctcca

SEQ ID NO: 9019868 - DNA, 22 bp, Homo sapiens
caggcagatttgctgccctcca

SEQ ID NO: 9019869 - DNA, 22 bp, Homo sapiens
caggcagatttgctgccctcca

SEQ ID NO: 9019870 - DNA, 22 bp, Homo sapiens
caggcagatgctgacaagagtt

SEQ ID NO: 9019871 - DNA, 22 bp, Homo sapiens
caggcagatgctgacaagagtt

SEQ ID NO: 9019872 - DNA, 22 bp, Homo sapiens
caggcagatgctgacaagagtt

SEQ ID NO: 9019873 - DNA, 22 bp, Homo sapiens
caggcagatttgctgccctcca

SEQ ID NO: 9019874 - DNA, 22 bp, Homo sapiens
caggcagatttgctgccctcca

SEQ ID NO: 9019875 - DNA, 22 bp, Homo sapiens
caggcagatttgctgccctcca

SEQ ID NO: 9019876 - DNA, 22 bp, Homo sapiens
taatacaatggagttgggcccc

SEQ ID NO: 9019877 - DNA, 22 bp, Homo sapiens
taatacaatggagttgggcccc

SEQ ID NO: 9019878 - DNA, 22 bp, Homo sapiens
taatacaatggagttgggcccc

SEQ ID NO: 9019879 - DNA, 22 bp, Homo sapiens
taataattttaaagaaggctag

SEQ ID NO: 9019880 - DNA, 22 bp, Homo sapiens
taatacaaggcaggaagcagta

SEQ ID NO: 9019881 - DNA, 22 bp, Homo sapiens
taatacaaggcaggaagcagta

SEQ ID NO: 9019882 - DNA, 22 bp, Homo sapiens
taatacaaggcaggaagcagta

SEQ ID NO: 9019883 - DNA, 22 bp, Homo sapiens
taataattggcaatgttgagca

SEQ ID NO: 9019884 - DNA, 22 bp, Homo sapiens
taataattggcaatgttgagca

SEQ ID NO: 9019885 - DNA, 22 bp, Homo sapiens
taataattggcaatgttgagca

SEQ ID NO: 9019886 - DNA, 21 bp, Homo sapiens
taataattccactacagagta

SEQ ID NO: 9019887 - DNA, 22 bp, Homo sapiens
taataattggctaaccctggga

SEQ ID NO: 9019888 - DNA, 22 bp, Homo sapiens
taataattggcaatgttgagca

SEQ ID NO: 9019889 - DNA, 22 bp, Homo sapiens
taataattttaaagaaggctag

SEQ ID NO: 9019890 - DNA, 22 bp, Homo sapiens
taataattggctaaccctggga

SEQ ID NO: 9019891 - DNA, 22 bp, Homo sapiens
tagattatccctgatttgtcca

SEQ ID NO: 9019892 - DNA, 22 bp, Homo sapiens
tagatacaggctctctgagcct

SEQ ID NO: 9019893 - DNA, 22 bp, Homo sapiens
tagatacaggcaagattatgaa

SEQ ID NO: 9019894 - DNA, 22 bp, Homo sapiens
tagatacaggcaagattatgaa

SEQ ID NO: 9019895 - DNA, 22 bp, Homo sapiens
tagatacacacacagtcatgtg

SEQ ID NO: 9019896 - DNA, 22 bp, Homo sapiens
tagattcatgcagtatgctagt

SEQ ID NO: 9019897 - DNA, 22 bp, Homo sapiens
tagattcagatatttaggacaa

SEQ ID NO: 9019898 - DNA, 22 bp, Homo sapiens
tagattctccacatgtagcaat

SEQ ID NO: 9019899 - DNA, 22 bp, Homo sapiens
tagattctactgtcacttagtt

SEQ ID NO: 9019900 - DNA, 22 bp, Homo sapiens
tagattctacagctcagctgtc

SEQ ID NO: 9019901 - DNA, 22 bp, Homo sapiens
tagattctgtaaataatcaagg

SEQ ID NO: 9019902 - DNA, 22 bp, Homo sapiens
tagattctggagagacagcagt

SEQ ID NO: 9019903 - DNA, 22 bp, Homo sapiens
tagattctcccatcatgagatg

SEQ ID NO: 9019904 - DNA, 22 bp, Homo sapiens
tagattctcccatcatgagatg

SEQ ID NO: 9019905 - DNA, 22 bp, Homo sapiens
tagattcttagtttcatagaat

SEQ ID NO: 9019906 - DNA, 22 bp, Homo sapiens
tagattctgtgagagtcaaagt

SEQ ID NO: 9019907 - DNA, 22 bp, Homo sapiens
cagggaaggctgcaaatgttaa

SEQ ID NO: 9019908 - DNA, 22 bp, Homo sapiens
cagggaaggctgcaaatgttaa

SEQ ID NO: 9019909 - DNA, 22 bp, Homo sapiens
cagggacaaacaaggttgggga

SEQ ID NO: 9019910 - DNA, 22 bp, Homo sapiens
cagggaatccatggtcataagg

SEQ ID NO: 9019911 - DNA, 22 bp, Homo sapiens
cagggacaaagtgagaaaggaa

SEQ ID NO: 9019912 - DNA, 22 bp, Homo sapiens
cagggacaaagtgagaaaggaa

SEQ ID NO: 9019913 - DNA, 22 bp, Homo sapiens
cagggacaaagtgagaaaggaa

SEQ ID NO: 9019914 - DNA, 22 bp, Homo sapiens
cagggacaatggcagagcctga

SEQ ID NO: 9019915 - DNA, 22 bp, Homo sapiens
cagggacaatggcagagcctga

SEQ ID NO: 9019916 - DNA, 22 bp, Homo sapiens
cagggacaatggcagagcctga

SEQ ID NO: 9019917 - DNA, 22 bp, Homo sapiens
cagggacaatggcagagcctga

SEQ ID NO: 9019918 - DNA, 22 bp, Homo sapiens
cagggacagagactgcaccttg

SEQ ID NO: 9019919 - DNA, 22 bp, Homo sapiens
cagggacagagactgcaccttg

SEQ ID NO: 9019920 - DNA, 22 bp, Homo sapiens
cagggacagagactgcaccttg

SEQ ID NO: 9019921 - DNA, 22 bp, Homo sapiens
cagggacagcactaaactcttg

SEQ ID NO: 9019922 - DNA, 20 bp, Homo sapiens
cagggacagcagtgggtttt

SEQ ID NO: 9019923 - DNA, 20 bp, Homo sapiens
cagggacagcagtgggtttt

SEQ ID NO: 9019924 - DNA, 22 bp, Homo sapiens
caggcttggcagggaggctggt

SEQ ID NO: 9019925 - DNA, 22 bp, Homo sapiens
caggcttggcagggaggctggt

SEQ ID NO: 9019926 - DNA, 22 bp, Homo sapiens
caggcttggcagggaggctggt

SEQ ID NO: 9019927 - DNA, 22 bp, Homo sapiens
caggcttgggttctctgagtta

SEQ ID NO: 9019928 - DNA, 22 bp, Homo sapiens
caggcttgtgtctcagctgcag

SEQ ID NO: 9019929 - DNA, 22 bp, Homo sapiens
caggctttactttctctctgaa

SEQ ID NO: 9019930 - DNA, 22 bp, Homo sapiens
caggcttggttggggcgaggga

SEQ ID NO: 9019931 - DNA, 22 bp, Homo sapiens
caggcttggttggggcgaggga

SEQ ID NO: 9019932 - DNA, 22 bp, Homo sapiens
caggctgtctgaatggaggccc

SEQ ID NO: 9019933 - DNA, 22 bp, Homo sapiens
caggcttggagggcagtggcat

SEQ ID NO: 9019934 - DNA, 22 bp, Homo sapiens
caggcttggagggcagtggcat

SEQ ID NO: 9019935 - DNA, 22 bp, Homo sapiens
caggcttggagggcagtggcat

SEQ ID NO: 9019936 - DNA, 22 bp, Homo sapiens
caggcttggagggcagtggcat

SEQ ID NO: 9019937 - DNA, 22 bp, Homo sapiens
caggcttggcagggaggctggt

SEQ ID NO: 9019938 - DNA, 22 bp, Homo sapiens
caggcttggcagggaggctggt

SEQ ID NO: 9019939 - DNA, 22 bp, Homo sapiens
tagaaacaagggagaggattct

SEQ ID NO: 9019940 - DNA, 22 bp, Homo sapiens
caggctgtctgaatggaggccc

SEQ ID NO: 9019941 - DNA, 22 bp, Homo sapiens
caggctgtctgaatggaggccc

SEQ ID NO: 9019942 - DNA, 22 bp, Homo sapiens
cagggaacaagatgagaatgga

SEQ ID NO: 9019943 - DNA, 22 bp, Homo sapiens
cagggaagaatagttagcaaag

SEQ ID NO: 9019944 - DNA, 22 bp, Homo sapiens
cagggaaagttcttgtccactc

SEQ ID NO: 9019945 - DNA, 22 bp, Homo sapiens
cagggaaagttcttgtccactc

SEQ ID NO: 9019946 - DNA, 22 bp, Homo sapiens
cagggaaattaagtgacgatga

SEQ ID NO: 9019947 - DNA, 22 bp, Homo sapiens
cagggaagagccgatgctgcag

SEQ ID NO: 9019948 - DNA, 22 bp, Homo sapiens
cagggaagagccgatgctgcag

SEQ ID NO: 9019949 - DNA, 22 bp, Homo sapiens
cagggaagagccgatgctgcag

SEQ ID NO: 9019950 - DNA, 22 bp, Homo sapiens
cagggaagagccgatgctgcag

SEQ ID NO: 9019951 - DNA, 22 bp, Homo sapiens
cagggaagagccgatgctgcag

SEQ ID NO: 9019952 - DNA, 22 bp, Homo sapiens
caggcttttatgaatttcagtg

SEQ ID NO: 9019953 - DNA, 22 bp, Homo sapiens
caggctttactttctctctgaa

SEQ ID NO: 9019954 - DNA, 22 bp, Homo sapiens
cagggaaactaggaaataagct

SEQ ID NO: 9019955 - DNA, 22 bp, Homo sapiens
cagggaaagtcccaccccacac

SEQ ID NO: 9019956 - DNA, 22 bp, Homo sapiens
cagggaaagtcccaccccacac

SEQ ID NO: 9019957 - DNA, 22 bp, Homo sapiens
caggctttttctgctgtcctct

SEQ ID NO: 9019958 - DNA, 22 bp, Homo sapiens
caggctttttctgctgtcctct

SEQ ID NO: 9019959 - DNA, 22 bp, Homo sapiens
caggctttttctgctgtcctct

SEQ ID NO: 9019960 - DNA, 22 bp, Homo sapiens
tagaaaatggccaagcaggact

SEQ ID NO: 9019961 - DNA, 22 bp, Homo sapiens
tagaaaatggccaagcaggact

SEQ ID NO: 9019962 - DNA, 22 bp, Homo sapiens
tagaaaatggccaagcaggact

SEQ ID NO: 9019963 - DNA, 22 bp, Homo sapiens
tagaaaatggccaagcaggact

SEQ ID NO: 9019964 - DNA, 22 bp, Homo sapiens
tagaaaatggccaagcaggact

SEQ ID NO: 9019965 - DNA, 22 bp, Homo sapiens
tagaaaagtatgggactgacat

SEQ ID NO: 9019966 - DNA, 22 bp, Homo sapiens
tagaaaatagggcctgtggagc

SEQ ID NO: 9019967 - DNA, 22 bp, Homo sapiens
tagaaaatagggcctgtggagc

SEQ ID NO: 9019968 - DNA, 22 bp, Homo sapiens
tagaaaatagggcctgtggagc

SEQ ID NO: 9019969 - DNA, 22 bp, Homo sapiens
tagaaaatccagtgtggggaga

SEQ ID NO: 9019970 - DNA, 22 bp, Homo sapiens
tagaaaatgttccactgccatt

SEQ ID NO: 9019971 - DNA, 22 bp, Homo sapiens
tagaaaatgttccactgccatt

SEQ ID NO: 9019972 - DNA, 22 bp, Homo sapiens
tagaaaatgttccactgccatt

SEQ ID NO: 9019973 - DNA, 22 bp, Homo sapiens
tagaaaatgttccactgccatt

SEQ ID NO: 9019974 - DNA, 22 bp, Homo sapiens
tagaaaatgttccactgccatt

SEQ ID NO: 9019975 - DNA, 22 bp, Homo sapiens
tagaaacaaaatctgatgactc

SEQ ID NO: 9019976 - DNA, 22 bp, Homo sapiens
tagaaacaaagacctgggtgct

SEQ ID NO: 9019977 - DNA, 22 bp, Homo sapiens
tagaaacaaaatctgatgactc

SEQ ID NO: 9019978 - DNA, 22 bp, Homo sapiens
tagaaacaaaatctgatgactc

SEQ ID NO: 9019979 - DNA, 22 bp, Homo sapiens
caggctgggaacgccacccgct

SEQ ID NO: 9019980 - DNA, 22 bp, Homo sapiens
caggctgggaacgccacccgct

SEQ ID NO: 9019981 - DNA, 22 bp, Homo sapiens
caggctgggaacgccacccgct

SEQ ID NO: 9019982 - DNA, 22 bp, Homo sapiens
caggctgggaacgccacccgct

SEQ ID NO: 9019983 - DNA, 22 bp, Homo sapiens
caggctgggactgacccctgct

SEQ ID NO: 9019984 - DNA, 22 bp, Homo sapiens
caggctggcaatgcgtcaagca

SEQ ID NO: 9019985 - DNA, 22 bp, Homo sapiens
caggctgggaacgccacccgct

SEQ ID NO: 9019986 - DNA, 22 bp, Homo sapiens
caggctggcaatgcgtcaagca

SEQ ID NO: 9019987 - DNA, 22 bp, Homo sapiens
caggctggcaatgcgtcaagca

SEQ ID NO: 9019988 - DNA, 22 bp, Homo sapiens
caggctgggactgacccctgct

SEQ ID NO: 9019989 - DNA, 22 bp, Homo sapiens
caggctgggactgacccctgct

SEQ ID NO: 9019990 - DNA, 22 bp, Homo sapiens
caggctgggactgacccctgct

SEQ ID NO: 9019991 - DNA, 22 bp, Homo sapiens
caggctgggactgacccctgct

SEQ ID NO: 9019992 - DNA, 22 bp, Homo sapiens
caggctgggactgacccctgct

SEQ ID NO: 9019993 - DNA, 22 bp, Homo sapiens
caggctgggactgacccctgct

SEQ ID NO: 9019994 - DNA, 22 bp, Homo sapiens
caggctgggcagcctccccggc

SEQ ID NO: 9019995 - DNA, 22 bp, Homo sapiens
tagaaaagccccagctggaggg

SEQ ID NO: 9019996 - DNA, 22 bp, Homo sapiens
tagaaaagctctaaggcctctc

SEQ ID NO: 9019997 - DNA, 22 bp, Homo sapiens
tagaaaagtatgggactgacat

SEQ ID NO: 9019998 - DNA, 22 bp, Homo sapiens
caggctggagttcagtggtgtg

SEQ ID NO: 9019999 - DNA, 22 bp, Homo sapiens
caggctggagttcagtggtgtg

SEQ ID NO: 9020000 - DNA, 22 bp, Homo sapiens
caggctggagttcagtggtgtg

SEQ ID NO: 9020001 - DNA, 22 bp, Homo sapiens
caggctggagttcagtggtgtg

SEQ ID NO: 9020002 - DNA, 22 bp, Homo sapiens
caggctggcaatgcgtcaagca

SEQ ID NO: 9020003 - DNA, 22 bp, Homo sapiens
caggctggagttcagtggtgtg

SEQ ID NO: 9020004 - DNA, 22 bp, Homo sapiens
caggctggagttcagtggtgtg

SEQ ID NO: 9020005 - DNA, 22 bp, Homo sapiens
caggctggagttcagtggtgtg

SEQ ID NO: 9020006 - DNA, 22 bp, Homo sapiens
caggctggagttcagtggtgtg

SEQ ID NO: 9020007 - DNA, 22 bp, Homo sapiens
caggctggagttcagtggtgtg

SEQ ID NO: 9020008 - DNA, 22 bp, Homo sapiens
caggctggagttcagtggtgtg

SEQ ID NO: 9020009 - DNA, 22 bp, Homo sapiens
caggctggagttcagtggtgtg

SEQ ID NO: 9020010 - DNA, 22 bp, Homo sapiens
caggctgccgtgaagcaggcct

SEQ ID NO: 9020011 - DNA, 22 bp, Homo sapiens
caggctgccgtgaagcaggcct

SEQ ID NO: 9020012 - DNA, 22 bp, Homo sapiens
caggctgccgtggggtccaggc

SEQ ID NO: 9020013 - DNA, 22 bp, Homo sapiens
caggctgccgtggggtccaggc

SEQ ID NO: 9020014 - DNA, 22 bp, Homo sapiens
caggctggagtgcagtggtgcc

SEQ ID NO: 9020015 - DNA, 22 bp, Homo sapiens
caggctggagtgcagtggtgcc

SEQ ID NO: 9020016 - DNA, 22 bp, Homo sapiens
caggctggagttcagtggtgtg

SEQ ID NO: 9020017 - DNA, 22 bp, Homo sapiens
caggctggagttcagtggtgtg

SEQ ID NO: 9020018 - DNA, 22 bp, Homo sapiens
caggctggagtgcagtggtgcc

SEQ ID NO: 9020019 - DNA, 22 bp, Homo sapiens
caggctggagtgcagtggtgcc

SEQ ID NO: 9020020 - DNA, 22 bp, Homo sapiens
caggctgcatggaggggtacag

SEQ ID NO: 9020021 - DNA, 22 bp, Homo sapiens
caggctgccaaggctggggagg

SEQ ID NO: 9020022 - DNA, 22 bp, Homo sapiens
caggctgccaaggctggggagg

SEQ ID NO: 9020023 - DNA, 22 bp, Homo sapiens
caggctgcccggcaagttgcgc

SEQ ID NO: 9020024 - DNA, 22 bp, Homo sapiens
caggctgccaaggctggggagg

SEQ ID NO: 9020025 - DNA, 22 bp, Homo sapiens
caggctgccaaggctggggagg

SEQ ID NO: 9020026 - DNA, 22 bp, Homo sapiens
caggctgccaaggctggggagg

SEQ ID NO: 9020027 - DNA, 22 bp, Homo sapiens
caggctgcagtgcagtggctat

SEQ ID NO: 9020028 - DNA, 22 bp, Homo sapiens
caggctgcagtgcagtggctat

SEQ ID NO: 9020029 - DNA, 22 bp, Homo sapiens
caggctgcatggaggggtacag

SEQ ID NO: 9020030 - DNA, 22 bp, Homo sapiens
caggctgccctagcttggacat

SEQ ID NO: 9020031 - DNA, 22 bp, Homo sapiens
caggctgccctagcttggacat

SEQ ID NO: 9020032 - DNA, 22 bp, Homo sapiens
caggctgccctagcttggacat

SEQ ID NO: 9020033 - DNA, 22 bp, Homo sapiens
caggctgccgaggctgcagaat

SEQ ID NO: 9020034 - DNA, 22 bp, Homo sapiens
caggctgccgaggctgcagaat

SEQ ID NO: 9020035 - DNA, 22 bp, Homo sapiens
caggctgccgaggctgcagaat

SEQ ID NO: 9020036 - DNA, 22 bp, Homo sapiens
caggctgccctagcttggacat

SEQ ID NO: 9020037 - DNA, 22 bp, Homo sapiens
caggctgccgtgaagcaggcct

SEQ ID NO: 9020038 - DNA, 22 bp, Homo sapiens
caggctgccgaggctgcagaat

SEQ ID NO: 9020039 - DNA, 22 bp, Homo sapiens
caggctgccgtgaagcaggcct

SEQ ID NO: 9020040 - DNA, 22 bp, Homo sapiens
caggctgccgtgaagcaggcct

SEQ ID NO: 9020041 - DNA, 22 bp, Homo sapiens
caggcgagtgaacagactctca

SEQ ID NO: 9020042 - DNA, 22 bp, Homo sapiens
caggccttttttcctgcagtgt

SEQ ID NO: 9020043 - DNA, 22 bp, Homo sapiens
caggccttttttcctgcagtgt

SEQ ID NO: 9020044 - DNA, 22 bp, Homo sapiens
caggcggccatgatctggcagg

SEQ ID NO: 9020045 - DNA, 22 bp, Homo sapiens
caggcctttgcagggagagaga

SEQ ID NO: 9020046 - DNA, 18 bp, Homo sapiens
caggcctttgagacagaa

SEQ ID NO: 9020047 - DNA, 18 bp, Homo sapiens
caggcctttgagacagaa

SEQ ID NO: 9020048 - DNA, 22 bp, Homo sapiens
tacatttcctgtcagagatata

SEQ ID NO: 9020049 - DNA, 22 bp, Homo sapiens
tacatttcctgtcagagatata

SEQ ID NO: 9020050 - DNA, 22 bp, Homo sapiens
tacatttcctgtcagagatata

SEQ ID NO: 9020051 - DNA, 22 bp, Homo sapiens
tacatttcctgtcagagatata

SEQ ID NO: 9020052 - DNA, 22 bp, Homo sapiens
tacatttcctgtcagagatata

SEQ ID NO: 9020053 - DNA, 22 bp, Homo sapiens
caggcctttctggggaagtgag

SEQ ID NO: 9020054 - DNA, 22 bp, Homo sapiens
caggcctttctggggaagtgag

SEQ ID NO: 9020055 - DNA, 22 bp, Homo sapiens
caggcctttcttggggcttaga

SEQ ID NO: 9020056 - DNA, 22 bp, Homo sapiens
tacattgttcatgcatgagaaa

SEQ ID NO: 9020057 - DNA, 22 bp, Homo sapiens
tacattgttcatgcatgagaaa

SEQ ID NO: 9020058 - DNA, 22 bp, Homo sapiens
tacattgtgttaaaacagaaga

SEQ ID NO: 9020059 - DNA, 22 bp, Homo sapiens
tacattgttcatgcatgagaaa

SEQ ID NO: 9020060 - DNA, 22 bp, Homo sapiens
tacattgtgttaaaacagaaga

SEQ ID NO: 9020061 - DNA, 22 bp, Homo sapiens
tacattgtgttaaaacagaaga

SEQ ID NO: 9020062 - DNA, 22 bp, Homo sapiens
tacattgtgttaaaacagaaga

SEQ ID NO: 9020063 - DNA, 22 bp, Homo sapiens
tacattgtgtctctatctagtc

SEQ ID NO: 9020064 - DNA, 23 bp, Homo sapiens
tacattgtggatggagtcctggg

SEQ ID NO: 9020065 - DNA, 22 bp, Homo sapiens
tacattgtgatgtttcaataca

SEQ ID NO: 9020066 - DNA, 22 bp, Homo sapiens
tacattgtattatccgtgattg

SEQ ID NO: 9020067 - DNA, 22 bp, Homo sapiens
tacattgtatcaaccctcaact

SEQ ID NO: 9020068 - DNA, 22 bp, Homo sapiens
tacattgtctgcaattttctct

SEQ ID NO: 9020069 - DNA, 22 bp, Homo sapiens
tacattgtgatgtttcaataca

SEQ ID NO: 9020070 - DNA, 22 bp, Homo sapiens
tacattgtgataggaagtcacc

SEQ ID NO: 9020071 - DNA, 22 bp, Homo sapiens
tacattgtgatgtttcaataca

SEQ ID NO: 9020072 - DNA, 22 bp, Homo sapiens
tacatttataaggcttctctgt

SEQ ID NO: 9020073 - DNA, 22 bp, Homo sapiens
tacatttataaggcttctctgt

SEQ ID NO: 9020074 - DNA, 22 bp, Homo sapiens
tacatttataaggcttctctgt

SEQ ID NO: 9020075 - DNA, 22 bp, Homo sapiens
tacatttataaggcttctctgt

SEQ ID NO: 9020076 - DNA, 22 bp, Homo sapiens
tacatttataaggcttctctgt

SEQ ID NO: 9020077 - DNA, 22 bp, Homo sapiens
tacatttacagagccttctctg

SEQ ID NO: 9020078 - DNA, 22 bp, Homo sapiens
tacattgttttttcttgccatc

SEQ ID NO: 9020079 - DNA, 22 bp, Homo sapiens
tacattgttttttcttgccatc

SEQ ID NO: 9020080 - DNA, 22 bp, Homo sapiens
tacattgttttttcttgccatc

SEQ ID NO: 9020081 - DNA, 22 bp, Homo sapiens
tacattgtttgagatagtttgt

SEQ ID NO: 9020082 - DNA, 22 bp, Homo sapiens
tactttattgtaaatgctgatg

SEQ ID NO: 9020083 - DNA, 22 bp, Homo sapiens
tactttattgtaaatgctgatg

SEQ ID NO: 9020084 - DNA, 22 bp, Homo sapiens
tactttattgtaaatgctgatg

SEQ ID NO: 9020085 - DNA, 22 bp, Homo sapiens
tactttacagtattagataatt

SEQ ID NO: 9020086 - DNA, 22 bp, Homo sapiens
tactttatcagcgtcaaaggta

SEQ ID NO: 9020087 - DNA, 22 bp, Homo sapiens
tactttaaaaactgataattca

SEQ ID NO: 9020088 - DNA, 22 bp, Homo sapiens
tactttaaagaggtgtaatgag

SEQ ID NO: 9020089 - DNA, 22 bp, Homo sapiens
caggctactggggcttggatgg

SEQ ID NO: 9020090 - DNA, 22 bp, Homo sapiens
caggctacatttgctctgagaa

SEQ ID NO: 9020091 - DNA, 22 bp, Homo sapiens
caggctacatttgctctgagaa

SEQ ID NO: 9020092 - DNA, 22 bp, Homo sapiens
caggctacatttgctctgagaa

SEQ ID NO: 9020093 - DNA, 22 bp, Homo sapiens
caggctagattggggccagtag

SEQ ID NO: 9020094 - DNA, 22 bp, Homo sapiens
caggctcaagccctgcttatat

SEQ ID NO: 9020095 - DNA, 16 bp, Homo sapiens
tactgtggagcaaggc

SEQ ID NO: 9020096 - DNA, 22 bp, Homo sapiens
caggctcaaggctgacttccat

SEQ ID NO: 9020097 - DNA, 22 bp, Homo sapiens
tacttgttatcatcttttcctt

SEQ ID NO: 9020098 - DNA, 18 bp, Homo sapiens
tactgtggatcaggggtt

SEQ ID NO: 9020099 - DNA, 22 bp, Homo sapiens
tactgtgggatgttgtgattag

SEQ ID NO: 9020100 - DNA, 22 bp, Homo sapiens
tactgtggggatattgattgta

SEQ ID NO: 9020101 - DNA, 22 bp, Homo sapiens
tactgtggtaacattttaaatt

SEQ ID NO: 9020102 - DNA, 22 bp, Homo sapiens
tacttgttttgtgttcctaaac

SEQ ID NO: 9020103 - DNA, 22 bp, Homo sapiens
tactttaaaaactgataattca

SEQ ID NO: 9020104 - DNA, 22 bp, Homo sapiens
tactttaaaaactgataattca

SEQ ID NO: 9020105 - DNA, 22 bp, Homo sapiens
tactttaaaaactgataattca

SEQ ID NO: 9020106 - DNA, 22 bp, Homo sapiens
tactgtggttactgctattaga

SEQ ID NO: 9020107 - DNA, 20 bp, Homo sapiens
caggcctctgggggccctgg

SEQ ID NO: 9020108 - DNA, 20 bp, Homo sapiens
caggcctctgggggccctgg

SEQ ID NO: 9020109 - DNA, 22 bp, Homo sapiens
caggcctctccttagtctggca

SEQ ID NO: 9020110 - DNA, 22 bp, Homo sapiens
caggcctctccttagtctggca

SEQ ID NO: 9020111 - DNA, 19 bp, Homo sapiens
caggcctctggtctgctgt

SEQ ID NO: 9020112 - DNA, 20 bp, Homo sapiens
caggcctctgggggccctgg

SEQ ID NO: 9020113 - DNA, 20 bp, Homo sapiens
caggcctctgggggccctgg

SEQ ID NO: 9020114 - DNA, 19 bp, Homo sapiens
caggcctcttaccctctct

SEQ ID NO: 9020115 - DNA, 19 bp, Homo sapiens
caggcctctggtctgctgt

SEQ ID NO: 9020116 - DNA, 19 bp, Homo sapiens
caggcctctggtctgctgt

SEQ ID NO: 9020117 - DNA, 22 bp, Homo sapiens
caggcctctatggtcagctgag

SEQ ID NO: 9020118 - DNA, 22 bp, Homo sapiens
caggcctctatggtcagctgag

SEQ ID NO: 9020119 - DNA, 22 bp, Homo sapiens
caggcctctatggtcagctgag

SEQ ID NO: 9020120 - DNA, 22 bp, Homo sapiens
caggcctctccttagtctggca

SEQ ID NO: 9020121 - DNA, 22 bp, Homo sapiens
caggcctctatggtcagctgag

SEQ ID NO: 9020122 - DNA, 22 bp, Homo sapiens
caggcctctatggtcagctgag

SEQ ID NO: 9020123 - DNA, 22 bp, Homo sapiens
caggcctcgaggagacagctac

SEQ ID NO: 9020124 - DNA, 22 bp, Homo sapiens
caggcctcgaggagacagctac

SEQ ID NO: 9020125 - DNA, 22 bp, Homo sapiens
caggcctcgaggagacagctac

SEQ ID NO: 9020126 - DNA, 22 bp, Homo sapiens
caggcctcgaggagacagctac

SEQ ID NO: 9020127 - DNA, 22 bp, Homo sapiens
caggcctctatggtcagctgag

SEQ ID NO: 9020128 - DNA, 22 bp, Homo sapiens
caggcctctatggtcagctgag

SEQ ID NO: 9020129 - DNA, 22 bp, Homo sapiens
caggcccagggagggagaccaa

SEQ ID NO: 9020130 - DNA, 22 bp, Homo sapiens
caggcccagggagggagaccaa

SEQ ID NO: 9020131 - DNA, 22 bp, Homo sapiens
caggcccagggagggagaccaa

SEQ ID NO: 9020132 - DNA, 22 bp, Homo sapiens
caggccgggcactgcgctaggt

SEQ ID NO: 9020133 - DNA, 22 bp, Homo sapiens
caggccggggcggcgccatctt

SEQ ID NO: 9020134 - DNA, 22 bp, Homo sapiens
caggccgggcactgcgctaggt

SEQ ID NO: 9020135 - DNA, 22 bp, Homo sapiens
caggcctcctatgagcactagc

SEQ ID NO: 9020136 - DNA, 21 bp, Homo sapiens
caggccgggtgagcaggcagc

SEQ ID NO: 9020137 - DNA, 22 bp, Homo sapiens
caggcctcctatgagcactagc

SEQ ID NO: 9020138 - DNA, 22 bp, Homo sapiens
caggcctcctatgagcactagc

SEQ ID NO: 9020139 - DNA, 22 bp, Homo sapiens
caggcctcgaggagacagctac

SEQ ID NO: 9020140 - DNA, 22 bp, Homo sapiens
caggcctcgaggagacagctac

SEQ ID NO: 9020141 - DNA, 22 bp, Homo sapiens
caggcccagcccagcccttcga

SEQ ID NO: 9020142 - DNA, 22 bp, Homo sapiens
caggcccagaggcctcttccca

SEQ ID NO: 9020143 - DNA, 22 bp, Homo sapiens
caggcccagcccagcccttcga

SEQ ID NO: 9020144 - DNA, 22 bp, Homo sapiens
caggcccagcccttagccaggt

SEQ ID NO: 9020145 - DNA, 22 bp, Homo sapiens
caggcccagcccttagccaggt

SEQ ID NO: 9020146 - DNA, 22 bp, Homo sapiens
caggcccaggccagtggttccc

SEQ ID NO: 9020147 - DNA, 22 bp, Homo sapiens
caggcccagcccttagccaggt

SEQ ID NO: 9020148 - DNA, 22 bp, Homo sapiens
caggcccagcccttagccaggt

SEQ ID NO: 9020149 - DNA, 22 bp, Homo sapiens
caggcctcttccatgcagcagc

SEQ ID NO: 9020150 - DNA, 22 bp, Homo sapiens
caggcctcttccatgcagcagc

SEQ ID NO: 9020151 - DNA, 19 bp, Homo sapiens
caggcctcttaccctctct

SEQ ID NO: 9020152 - DNA, 18 bp, Homo sapiens
caggcctcttgatcttcc

SEQ ID NO: 9020153 - DNA, 22 bp, Homo sapiens
caggcctcttccatgcagcagc

SEQ ID NO: 9020154 - DNA, 18 bp, Homo sapiens
caggcctcttgatcttcc

SEQ ID NO: 9020155 - DNA, 18 bp, Homo sapiens
caggcctcttgatcttcc

SEQ ID NO: 9020156 - DNA, 22 bp, Homo sapiens
caggcctgaccctgagcttcac

SEQ ID NO: 9020157 - DNA, 22 bp, Homo sapiens
caggcctgaccctgagcttcac

SEQ ID NO: 9020158 - DNA, 22 bp, Homo sapiens
caggcctgaccctgagcttcac

SEQ ID NO: 9020159 - DNA, 22 bp, Homo sapiens
caggcctgagacatctgagata

SEQ ID NO: 9020160 - DNA, 22 bp, Homo sapiens
caggcctgaccctgagcttcac

SEQ ID NO: 9020161 - DNA, 22 bp, Homo sapiens
caggcctgaccctgagcttcac

SEQ ID NO: 9020162 - DNA, 22 bp, Homo sapiens
caggcctgagacatctgagata

SEQ ID NO: 9020163 - DNA, 22 bp, Homo sapiens
caggcctgagacatctgagata

SEQ ID NO: 9020164 - DNA, 22 bp, Homo sapiens
caggcctgagtgtggaagtctt

SEQ ID NO: 9020165 - DNA, 22 bp, Homo sapiens
caggcctgagacatctgagata

SEQ ID NO: 9020166 - DNA, 22 bp, Homo sapiens
caggcctgagacatctgagata

SEQ ID NO: 9020167 - DNA, 22 bp, Homo sapiens
caggcctgagacatctgagata

SEQ ID NO: 9020168 - DNA, 22 bp, Homo sapiens
tacatgtttactccaagtcagg

SEQ ID NO: 9020169 - DNA, 22 bp, Homo sapiens
tacatgtttactccaagtcagg

SEQ ID NO: 9020170 - DNA, 22 bp, Homo sapiens
tacatgtttggtaaatgatggc

SEQ ID NO: 9020171 - DNA, 22 bp, Homo sapiens
tacattgctagaaatgtatttt

SEQ ID NO: 9020172 - DNA, 22 bp, Homo sapiens
tacattgctcattatattgctt

SEQ ID NO: 9020173 - DNA, 22 bp, Homo sapiens
tacattgattcaggatataggc

SEQ ID NO: 9020174 - DNA, 22 bp, Homo sapiens
tacattgattcaggatataggc

SEQ ID NO: 9020175 - DNA, 22 bp, Homo sapiens
tacattgctttctaatacatct

SEQ ID NO: 9020176 - DNA, 22 bp, Homo sapiens
tacattgctttctaatacatct

SEQ ID NO: 9020177 - DNA, 22 bp, Homo sapiens
caggcctgcaggaaaggctccc

SEQ ID NO: 9020178 - DNA, 22 bp, Homo sapiens
caggcctgagtgtggaagtctt

SEQ ID NO: 9020179 - DNA, 22 bp, Homo sapiens
caggcctgagtgtggaagtctt

SEQ ID NO: 9020180 - DNA, 22 bp, Homo sapiens
caggcctgcaggaaaggctccc

SEQ ID NO: 9020181 - DNA, 22 bp, Homo sapiens
caggcctgcttcttacccttca

SEQ ID NO: 9020182 - DNA, 22 bp, Homo sapiens
caggcctgcaggaaaggctccc

SEQ ID NO: 9020183 - DNA, 22 bp, Homo sapiens
tacatgttcaaatttgtctttc

SEQ ID NO: 9020184 - DNA, 22 bp, Homo sapiens
tacatgttcaaatttgtctttc

SEQ ID NO: 9020185 - DNA, 22 bp, Homo sapiens
cctctggaggctctaagagaga

SEQ ID NO: 9020186 - DNA, 22 bp, Homo sapiens
cctctggagtcagaccagcttg

SEQ ID NO: 9020187 - DNA, 22 bp, Homo sapiens
cctctggacttgggacagtgag

SEQ ID NO: 9020188 - DNA, 22 bp, Homo sapiens
tgggaagctgcattttaacaag

SEQ ID NO: 9020189 - DNA, 22 bp, Homo sapiens
tgggaagctgcattttaacaag

SEQ ID NO: 9020190 - DNA, 22 bp, Homo sapiens
tgggaagctactcatgcaggca

SEQ ID NO: 9020191 - DNA, 22 bp, Homo sapiens
tgggaaggaactgcctttagct

SEQ ID NO: 9020192 - DNA, 22 bp, Homo sapiens
tgggaaggaactgcctttagct

SEQ ID NO: 9020193 - DNA, 22 bp, Homo sapiens
tgggaaggaactgcctttagct

SEQ ID NO: 9020194 - DNA, 22 bp, Homo sapiens
tgggaaggacagaacataattg

SEQ ID NO: 9020195 - DNA, 22 bp, Homo sapiens
tgggaaggaatggtgattaata

SEQ ID NO: 9020196 - DNA, 22 bp, Homo sapiens
tgggaaggacgtgtcagtggca

SEQ ID NO: 9020197 - DNA, 22 bp, Homo sapiens
tgggaaggataccttggaacat

SEQ ID NO: 9020198 - DNA, 22 bp, Homo sapiens
tgggaaggacgtgtcagtggca

SEQ ID NO: 9020199 - DNA, 22 bp, Homo sapiens
tgggaaggacgtgtcagtggca

SEQ ID NO: 9020200 - DNA, 22 bp, Homo sapiens
tgggaaggataccttggaacat

SEQ ID NO: 9020201 - DNA, 22 bp, Homo sapiens
tgggaaggatacgttacaagat

SEQ ID NO: 9020202 - DNA, 22 bp, Homo sapiens
tgggaaggatacgttacaagat

SEQ ID NO: 9020203 - DNA, 22 bp, Homo sapiens
tgggaaggcagtcactgtccta

SEQ ID NO: 9020204 - DNA, 22 bp, Homo sapiens
tgggaaggcagtcactgtccta

SEQ ID NO: 9020205 - DNA, 22 bp, Homo sapiens
tgggaaggcagtcactgtccta

SEQ ID NO: 9020206 - DNA, 22 bp, Homo sapiens
tgggaaggcagtcactgtccta

SEQ ID NO: 9020207 - DNA, 22 bp, Homo sapiens
tgggaaggatacgttacaagat

SEQ ID NO: 9020208 - DNA, 22 bp, Homo sapiens
cctctgtggccttggaccagct

SEQ ID NO: 9020209 - DNA, 22 bp, Homo sapiens
cctctgtggccttggaccagct

SEQ ID NO: 9020210 - DNA, 19 bp, Homo sapiens
cctctgtgggagtcagtga

SEQ ID NO: 9020211 - DNA, 22 bp, Homo sapiens
cctcttccagctgttgcttcca

SEQ ID NO: 9020212 - DNA, 22 bp, Homo sapiens
cctcttccagctgttgcttcca

SEQ ID NO: 9020213 - DNA, 22 bp, Homo sapiens
cctctgagtagactggacatga

SEQ ID NO: 9020214 - DNA, 22 bp, Homo sapiens
cctctgagtcatgcgcatagga

SEQ ID NO: 9020215 - DNA, 22 bp, Homo sapiens
cctctgagtacagtgatggatt

SEQ ID NO: 9020216 - DNA, 22 bp, Homo sapiens
tggcttccagtaatcaggattt

SEQ ID NO: 9020217 - DNA, 22 bp, Homo sapiens
tggcttccagagctgctccacc

SEQ ID NO: 9020218 - DNA, 22 bp, Homo sapiens
tggcttccagagctgctccacc

SEQ ID NO: 9020219 - DNA, 22 bp, Homo sapiens
cctctgcctgcacatcatcctg

SEQ ID NO: 9020220 - DNA, 22 bp, Homo sapiens
cctctgcctgcacatcatcctg

SEQ ID NO: 9020221 - DNA, 22 bp, Homo sapiens
cctctgcccttttcctgtatca

SEQ ID NO: 9020222 - DNA, 22 bp, Homo sapiens
cctctgcccttttcctgtatca

SEQ ID NO: 9020223 - DNA, 22 bp, Homo sapiens
cctctgcccttttcctgtatca

SEQ ID NO: 9020224 - DNA, 20 bp, Homo sapiens
cctctgccccggggctgcta

SEQ ID NO: 9020225 - DNA, 20 bp, Homo sapiens
cctctgccccggggctgcta

SEQ ID NO: 9020226 - DNA, 20 bp, Homo sapiens
cctctgccccggggctgcta

SEQ ID NO: 9020227 - DNA, 20 bp, Homo sapiens
cctctgccccggggctgcta

SEQ ID NO: 9020228 - DNA, 18 bp, Homo sapiens
cctctgccatagccagca

SEQ ID NO: 9020229 - DNA, 22 bp, Homo sapiens
cctctgagtcatgcgcatagga

SEQ ID NO: 9020230 - DNA, 22 bp, Homo sapiens
cctctgagtcctccctggttgc

SEQ ID NO: 9020231 - DNA, 22 bp, Homo sapiens
cctctgagtcctccctggttgc

SEQ ID NO: 9020232 - DNA, 18 bp, Homo sapiens
cctctgccatagccagca

SEQ ID NO: 9020233 - DNA, 20 bp, Homo sapiens
cctctgcctttctagtctga

SEQ ID NO: 9020234 - DNA, 20 bp, Homo sapiens
cctctgcctttctagtctga

SEQ ID NO: 9020235 - DNA, 22 bp, Homo sapiens
cctctgcgcccttgatcagcca

SEQ ID NO: 9020236 - DNA, 18 bp, Homo sapiens
cctctgcctttgtagagc

SEQ ID NO: 9020237 - DNA, 18 bp, Homo sapiens
cctctgcctttgtagagc

SEQ ID NO: 9020238 - DNA, 18 bp, Homo sapiens
cctctgcctttgtagagc

SEQ ID NO: 9020239 - DNA, 20 bp, Homo sapiens
cctctgcctttctagtctga

SEQ ID NO: 9020240 - DNA, 20 bp, Homo sapiens
cctctgcctttctagtctga

SEQ ID NO: 9020241 - DNA, 20 bp, Homo sapiens
cctctgcctttctagtctga

SEQ ID NO: 9020242 - DNA, 22 bp, Homo sapiens
cctctgcctttagtgaaagttg

SEQ ID NO: 9020243 - DNA, 22 bp, Homo sapiens
cctctgcctttagtgaaagttg

SEQ ID NO: 9020244 - DNA, 22 bp, Homo sapiens
cctctgcctgcacatcatcctg

SEQ ID NO: 9020245 - DNA, 22 bp, Homo sapiens
cctctgcctttagtgaaagttg

SEQ ID NO: 9020246 - DNA, 21 bp, Homo sapiens
cctctgctcgggcatgcgttt

SEQ ID NO: 9020247 - DNA, 19 bp, Homo sapiens
cctctgctccagtttcctt

SEQ ID NO: 9020248 - DNA, 19 bp, Homo sapiens
cctctgctccagtttcctt

SEQ ID NO: 9020249 - DNA, 22 bp, Homo sapiens
cctctgctgctgttgagcaccg

SEQ ID NO: 9020250 - DNA, 22 bp, Homo sapiens
cctctgctctggtccatgtgct

SEQ ID NO: 9020251 - DNA, 22 bp, Homo sapiens
cctctgctctggtccatgtgct

SEQ ID NO: 9020252 - DNA, 22 bp, Homo sapiens
cctctgctctggtccatgtgct

SEQ ID NO: 9020253 - DNA, 22 bp, Homo sapiens
tggctggctggaccacacctgc

SEQ ID NO: 9020254 - DNA, 22 bp, Homo sapiens
tggctggctggaccacacctgc

SEQ ID NO: 9020255 - DNA, 18 bp, Homo sapiens
tggctggctctgtcatct

SEQ ID NO: 9020256 - DNA, 22 bp, Homo sapiens
tggctggctagtgggcaggatt

SEQ ID NO: 9020257 - DNA, 22 bp, Homo sapiens
tggctggctagtgggcaggatt

SEQ ID NO: 9020258 - DNA, 22 bp, Homo sapiens
tggctggctagtgggcaggatt

SEQ ID NO: 9020259 - DNA, 18 bp, Homo sapiens
tggctggctctgtcatct

SEQ ID NO: 9020260 - DNA, 18 bp, Homo sapiens
tggctggctctgtcatct

SEQ ID NO: 9020261 - DNA, 18 bp, Homo sapiens
tggctggctctgtcatct

SEQ ID NO: 9020262 - DNA, 22 bp, Homo sapiens
tggctgctcaagggaggaggct

SEQ ID NO: 9020263 - DNA, 22 bp, Homo sapiens
tggctgctagccagagcttcag

SEQ ID NO: 9020264 - DNA, 22 bp, Homo sapiens
tggctgctcaagggaggaggct

SEQ ID NO: 9020265 - DNA, 22 bp, Homo sapiens
tggctggctagtgggcaggatt

SEQ ID NO: 9020266 - DNA, 16 bp, Homo sapiens
tggctgagagagggtt

SEQ ID NO: 9020267 - DNA, 16 bp, Homo sapiens
tggctgagagagggtt

SEQ ID NO: 9020268 - DNA, 22 bp, Homo sapiens
tggctgctagccagagcttcag

SEQ ID NO: 9020269 - DNA, 22 bp, Homo sapiens
tggctgagagaagacggggaag

SEQ ID NO: 9020270 - DNA, 22 bp, Homo sapiens
tggctgagagaagacggggaag

SEQ ID NO: 9020271 - DNA, 22 bp, Homo sapiens
tggctgagaccttcccaaattc

SEQ ID NO: 9020272 - DNA, 22 bp, Homo sapiens
tggctgagaccatcagggtgta

SEQ ID NO: 9020273 - DNA, 22 bp, Homo sapiens
tggctgagaccatcagggtgta

SEQ ID NO: 9020274 - DNA, 22 bp, Homo sapiens
tggctgagaccatcagggtgta

SEQ ID NO: 9020275 - DNA, 22 bp, Homo sapiens
tggctgagaccatcagggtgta

SEQ ID NO: 9020276 - DNA, 22 bp, Homo sapiens
tggctgagaatgggatgatgcc

SEQ ID NO: 9020277 - DNA, 22 bp, Homo sapiens
tggctgagaatgggatgatgcc

SEQ ID NO: 9020278 - DNA, 22 bp, Homo sapiens
tggctgagaagttctggtggga

SEQ ID NO: 9020279 - DNA, 22 bp, Homo sapiens
tggctgagaatgggatgatgcc

SEQ ID NO: 9020280 - DNA, 22 bp, Homo sapiens
tggctgagaagttctggtggga

SEQ ID NO: 9020281 - DNA, 19 bp, Homo sapiens
tggctctgtcgaaggcaca

SEQ ID NO: 9020282 - DNA, 17 bp, Homo sapiens
tggctctgtcctcagct

SEQ ID NO: 9020283 - DNA, 22 bp, Homo sapiens
tggctctgtcactgtgagctat

SEQ ID NO: 9020284 - DNA, 17 bp, Homo sapiens
tggctctgtcctcagct

SEQ ID NO: 9020285 - DNA, 17 bp, Homo sapiens
tggctctgtcctcagct

SEQ ID NO: 9020286 - DNA, 17 bp, Homo sapiens
tggctctgtcctcagct

SEQ ID NO: 9020287 - DNA, 17 bp, Homo sapiens
tggctctgtcctcagct

SEQ ID NO: 9020288 - DNA, 19 bp, Homo sapiens
tggctctgtcgaaggcaca

SEQ ID NO: 9020289 - DNA, 22 bp, Homo sapiens
tggcttcatctgcagcactgcc

SEQ ID NO: 9020290 - DNA, 22 bp, Homo sapiens
tggcttcatctgcagcactgcc

SEQ ID NO: 9020291 - DNA, 22 bp, Homo sapiens
tggcttcatggcaagtcttagt

SEQ ID NO: 9020292 - DNA, 22 bp, Homo sapiens
tggcttcaggcagaatttagac

SEQ ID NO: 9020293 - DNA, 22 bp, Homo sapiens
tggcttcagtctcatcttggaa

SEQ ID NO: 9020294 - DNA, 22 bp, Homo sapiens
tggcttcagttcctgtgttgtt

SEQ ID NO: 9020295 - DNA, 22 bp, Homo sapiens
tggcttcattcagcatgacagt

SEQ ID NO: 9020296 - DNA, 22 bp, Homo sapiens
tggcttcattcagcatgacagt

SEQ ID NO: 9020297 - DNA, 22 bp, Homo sapiens
tggcttcattctgtagttaaaa

SEQ ID NO: 9020298 - DNA, 22 bp, Homo sapiens
tggcttcattctgtagttaaaa

SEQ ID NO: 9020299 - DNA, 22 bp, Homo sapiens
tggcttcattattgtttttcct

SEQ ID NO: 9020300 - DNA, 22 bp, Homo sapiens
tggcttcattattgtttttcct

SEQ ID NO: 9020301 - DNA, 22 bp, Homo sapiens
tggcttcattcagcatgacagt

SEQ ID NO: 9020302 - DNA, 22 bp, Homo sapiens
tggcttcatgtagtttgagttg

SEQ ID NO: 9020303 - DNA, 20 bp, Homo sapiens
tggctggcttgtatttcctt

SEQ ID NO: 9020304 - DNA, 22 bp, Homo sapiens
tggctggcttgttcactgactg

SEQ ID NO: 9020305 - DNA, 20 bp, Homo sapiens
tggctggcttgtatttcctt

SEQ ID NO: 9020306 - DNA, 22 bp, Homo sapiens
tggctggcttgttcactgactg

SEQ ID NO: 9020307 - DNA, 22 bp, Homo sapiens
tggctggcttgttcactgactg

SEQ ID NO: 9020308 - DNA, 22 bp, Homo sapiens
tggctggcttgttcactgactg

SEQ ID NO: 9020309 - DNA, 22 bp, Homo sapiens
tggctgggagctggaactgggc

SEQ ID NO: 9020310 - DNA, 22 bp, Homo sapiens
tggctgggagctggaactgggc

SEQ ID NO: 9020311 - DNA, 22 bp, Homo sapiens
tggctgggagctggaactgggc

SEQ ID NO: 9020312 - DNA, 22 bp, Homo sapiens
tggctggctttcttgtatttac

SEQ ID NO: 9020313 - DNA, 22 bp, Homo sapiens
tggctggctgtcaaggaaagcc

SEQ ID NO: 9020314 - DNA, 22 bp, Homo sapiens
tggctggctgtcaaggaaagcc

SEQ ID NO: 9020315 - DNA, 22 bp, Homo sapiens
tggctggctggaccacacctgc

SEQ ID NO: 9020316 - DNA, 22 bp, Homo sapiens
tggctggctgtcagtaggctgt

SEQ ID NO: 9020317 - DNA, 22 bp, Homo sapiens
tggctggctgtcagtaggctgt

SEQ ID NO: 9020318 - DNA, 22 bp, Homo sapiens
tggctggctgtcaaggaaagcc

SEQ ID NO: 9020319 - DNA, 22 bp, Homo sapiens
tggctggctgtcaaggaaagcc

SEQ ID NO: 9020320 - DNA, 22 bp, Homo sapiens
tggctggctgtccagctgggca

SEQ ID NO: 9020321 - DNA, 22 bp, Homo sapiens
tggctggctgtcagtaggctgt

SEQ ID NO: 9020322 - DNA, 22 bp, Homo sapiens
tggctggctgtccagctgggca

SEQ ID NO: 9020323 - DNA, 22 bp, Homo sapiens
tggctggctgtccagctgggca

SEQ ID NO: 9020324 - DNA, 22 bp, Homo sapiens
tggctggctgtccagctgggca

SEQ ID NO: 9020325 - DNA, 22 bp, Homo sapiens
tggctggctgtccagctgggca

SEQ ID NO: 9020326 - DNA, 22 bp, Homo sapiens
cctgagctagggaaggaagacc

SEQ ID NO: 9020327 - DNA, 21 bp, Homo sapiens
cctgagcctgtttatccagaa

SEQ ID NO: 9020328 - DNA, 22 bp, Homo sapiens
cctgagcctggctcatgcactc

SEQ ID NO: 9020329 - DNA, 21 bp, Homo sapiens
cctgagcctgtttatccagaa

SEQ ID NO: 9020330 - DNA, 22 bp, Homo sapiens
cctgagcctggctcatgcactc

SEQ ID NO: 9020331 - DNA, 22 bp, Homo sapiens
cctgagcctggctcatgcactc

SEQ ID NO: 9020332 - DNA, 22 bp, Homo sapiens
tgggctggcccaccacacctcg

SEQ ID NO: 9020333 - DNA, 22 bp, Homo sapiens
tgggctggcccaccacacctcg

SEQ ID NO: 9020334 - DNA, 22 bp, Homo sapiens
tgggctggagcttgttgcttcc

SEQ ID NO: 9020335 - DNA, 22 bp, Homo sapiens
tgggctggcccaccacacctcg

SEQ ID NO: 9020336 - DNA, 22 bp, Homo sapiens
cctgagcctggctcatgcactc

SEQ ID NO: 9020337 - DNA, 22 bp, Homo sapiens
tgggctggcccaccacacctcg

SEQ ID NO: 9020338 - DNA, 22 bp, Homo sapiens
tgggctggcccaccacacctcg

SEQ ID NO: 9020339 - DNA, 22 bp, Homo sapiens
tgggctggcccaccacacctcg

SEQ ID NO: 9020340 - DNA, 22 bp, Homo sapiens
tgggctggcccaccacacctcg

SEQ ID NO: 9020341 - DNA, 22 bp, Homo sapiens
tgggctgcttcctcagctgaga

SEQ ID NO: 9020342 - DNA, 22 bp, Homo sapiens
tgggctgcttcctcagctgaga

SEQ ID NO: 9020343 - DNA, 22 bp, Homo sapiens
tgggctgcttcctcagctgaga

SEQ ID NO: 9020344 - DNA, 22 bp, Homo sapiens
tgggctggagcttgttgcttcc

SEQ ID NO: 9020345 - DNA, 22 bp, Homo sapiens
tgggctggagcttgttgcttcc

SEQ ID NO: 9020346 - DNA, 22 bp, Homo sapiens
tgggctggagcttgttgcttcc

SEQ ID NO: 9020347 - DNA, 22 bp, Homo sapiens
tgggctggagcttgttgcttcc

SEQ ID NO: 9020348 - DNA, 22 bp, Homo sapiens
tgggctggagcttgttgcttcc

SEQ ID NO: 9020349 - DNA, 22 bp, Homo sapiens
cctgagctggagacattacata

SEQ ID NO: 9020350 - DNA, 22 bp, Homo sapiens
tggggagcccactcacctcccc

SEQ ID NO: 9020351 - DNA, 22 bp, Homo sapiens
tggggaggaagtcagatttcag

SEQ ID NO: 9020352 - DNA, 22 bp, Homo sapiens
cctgagctggaagagcttgtgc

SEQ ID NO: 9020353 - DNA, 22 bp, Homo sapiens
cctgagctggaagagcttgtgc

SEQ ID NO: 9020354 - DNA, 22 bp, Homo sapiens
cctgagctgactctcctttcag

SEQ ID NO: 9020355 - DNA, 22 bp, Homo sapiens
cctgagctgactctcctttcag

SEQ ID NO: 9020356 - DNA, 22 bp, Homo sapiens
cctgagctgactctcctttcag

SEQ ID NO: 9020357 - DNA, 22 bp, Homo sapiens
cctgagctgcggggcagtgctc

SEQ ID NO: 9020358 - DNA, 22 bp, Homo sapiens
cctgagctgcggggcagtgctc

SEQ ID NO: 9020359 - DNA, 22 bp, Homo sapiens
cctgagctccagtagcagccag

SEQ ID NO: 9020360 - DNA, 22 bp, Homo sapiens
cctgagctccagtagcagccag

SEQ ID NO: 9020361 - DNA, 22 bp, Homo sapiens
cctgagctccagtagcagccag

SEQ ID NO: 9020362 - DNA, 22 bp, Homo sapiens
cctgagctctgcactttttaga

SEQ ID NO: 9020363 - DNA, 22 bp, Homo sapiens
cctgagctgaactaagcagttt

SEQ ID NO: 9020364 - DNA, 22 bp, Homo sapiens
cctgagctgaactaagcagttt

SEQ ID NO: 9020365 - DNA, 22 bp, Homo sapiens
cctgagctctgcactttttaga

SEQ ID NO: 9020366 - DNA, 22 bp, Homo sapiens
cctgagctccagtagcagccag

SEQ ID NO: 9020367 - DNA, 22 bp, Homo sapiens
cctgagctctgcactttttaga

SEQ ID NO: 9020368 - DNA, 22 bp, Homo sapiens
cctgagctcaagaaggtgacca

SEQ ID NO: 9020369 - DNA, 22 bp, Homo sapiens
cctgagctcaagaaggtgacca

SEQ ID NO: 9020370 - DNA, 22 bp, Homo sapiens
cctgagctcaagaaggtgacca

SEQ ID NO: 9020371 - DNA, 22 bp, Homo sapiens
cctgagctagggaaggaagacc

SEQ ID NO: 9020372 - DNA, 22 bp, Homo sapiens
cctgagctagggaaggaagacc

SEQ ID NO: 9020373 - DNA, 22 bp, Homo sapiens
cctgagctcaaagggtgcctgg

SEQ ID NO: 9020374 - DNA, 22 bp, Homo sapiens
cctgagctcaaagggtgcctgg

SEQ ID NO: 9020375 - DNA, 21 bp, Homo sapiens
tgggcccagctctgtctgttt

SEQ ID NO: 9020376 - DNA, 22 bp, Homo sapiens
tgggcccacatgcctttctgcc

SEQ ID NO: 9020377 - DNA, 22 bp, Homo sapiens
tgggccagtttctcattgaaat

SEQ ID NO: 9020378 - DNA, 22 bp, Homo sapiens
tgggcccaagtgcaatgcagtg

SEQ ID NO: 9020379 - DNA, 22 bp, Homo sapiens
tgggcccaagagagtctccaac

SEQ ID NO: 9020380 - DNA, 22 bp, Homo sapiens
tgggcccaagagagtctccaac

SEQ ID NO: 9020381 - DNA, 22 bp, Homo sapiens
tgggcccaagtgcaatgcagtg

SEQ ID NO: 9020382 - DNA, 21 bp, Homo sapiens
tgggcccagttcccgctgggc

SEQ ID NO: 9020383 - DNA, 22 bp, Homo sapiens
tgggcccatcattgctgtgggc

SEQ ID NO: 9020384 - DNA, 21 bp, Homo sapiens
tgggcccagttcccgctgggc

SEQ ID NO: 9020385 - DNA, 22 bp, Homo sapiens
tgggcccaggtcctgggagaag

SEQ ID NO: 9020386 - DNA, 21 bp, Homo sapiens
tgggcccagttcccgctgggc

SEQ ID NO: 9020387 - DNA, 22 bp, Homo sapiens
tgggcccatcattgctgtgggc

SEQ ID NO: 9020388 - DNA, 22 bp, Homo sapiens
tgggccccagcacgtctgggga

SEQ ID NO: 9020389 - DNA, 22 bp, Homo sapiens
tgggccctgacttcaagcatcc

SEQ ID NO: 9020390 - DNA, 22 bp, Homo sapiens
tgggccccttggtttcctgagc

SEQ ID NO: 9020391 - DNA, 22 bp, Homo sapiens
tgggccctgacttcaagcatcc

SEQ ID NO: 9020392 - DNA, 23 bp, Homo sapiens
tgggccctggagtcgccagtctg

SEQ ID NO: 9020393 - DNA, 22 bp, Homo sapiens
tgggccctgacttcaagcatcc

SEQ ID NO: 9020394 - DNA, 22 bp, Homo sapiens
tgggccctgcccttgtctgtcc

SEQ ID NO: 9020395 - DNA, 22 bp, Homo sapiens
tgggccctggtggccatgcctc

SEQ ID NO: 9020396 - DNA, 22 bp, Homo sapiens
tgggccctggtggccatgcctc

SEQ ID NO: 9020397 - DNA, 22 bp, Homo sapiens
tgggccctggtggccatgcctc

SEQ ID NO: 9020398 - DNA, 23 bp, Homo sapiens
tgggccctggagtcgccagtctg

SEQ ID NO: 9020399 - DNA, 22 bp, Homo sapiens
tgggctgctgagaatgagagag

SEQ ID NO: 9020400 - DNA, 22 bp, Homo sapiens
tgggctgctgcggtgctcttgg

SEQ ID NO: 9020401 - DNA, 22 bp, Homo sapiens
tgggctgctgtctgcacatgct

SEQ ID NO: 9020402 - DNA, 22 bp, Homo sapiens
tgggctgctgttacaggggctg

SEQ ID NO: 9020403 - DNA, 22 bp, Homo sapiens
tgggctgctgttacaggggctg

SEQ ID NO: 9020404 - DNA, 22 bp, Homo sapiens
tgggctgctgtctgcacatgct

SEQ ID NO: 9020405 - DNA, 22 bp, Homo sapiens
tgggctgctgtctgcacatgct

SEQ ID NO: 9020406 - DNA, 22 bp, Homo sapiens
tgggctgctgtctgcacatgct

SEQ ID NO: 9020407 - DNA, 22 bp, Homo sapiens
tgggctgctgtctgcacatgct

SEQ ID NO: 9020408 - DNA, 22 bp, Homo sapiens
tgggctgctgtctgcacatgct

SEQ ID NO: 9020409 - DNA, 22 bp, Homo sapiens
tgggctgcggataggcctcgga

SEQ ID NO: 9020410 - DNA, 22 bp, Homo sapiens
tgggctgcggataggcctcgga

SEQ ID NO: 9020411 - DNA, 18 bp, Homo sapiens
tgggctgcctggcctctg

SEQ ID NO: 9020412 - DNA, 18 bp, Homo sapiens
tgggctgcctggcctctg

SEQ ID NO: 9020413 - DNA, 22 bp, Homo sapiens
tgggctcctcgtcactcgctgt

SEQ ID NO: 9020414 - DNA, 22 bp, Homo sapiens
tgggcccttatgaagctcaaga

SEQ ID NO: 9020415 - DNA, 22 bp, Homo sapiens
tgggccctggtggccatgcctc

SEQ ID NO: 9020416 - DNA, 22 bp, Homo sapiens
tgggctccttgggagcaagtga

SEQ ID NO: 9020417 - DNA, 22 bp, Homo sapiens
cctgagcctgcagccgagcaga

SEQ ID NO: 9020418 - DNA, 22 bp, Homo sapiens
cctgagcctgcagccgagcaga

SEQ ID NO: 9020419 - DNA, 22 bp, Homo sapiens
tgggccagtttctcattgaaat

SEQ ID NO: 9020420 - DNA, 22 bp, Homo sapiens
tgggccagtttctcattgaaat

SEQ ID NO: 9020421 - DNA, 22 bp, Homo sapiens
cctgagcctggctcatgcactc

SEQ ID NO: 9020422 - DNA, 22 bp, Homo sapiens
tgggccatttttggaagactgg

SEQ ID NO: 9020423 - DNA, 22 bp, Homo sapiens
tgggcccaagagagtctccaac

SEQ ID NO: 9020424 - DNA, 22 bp, Homo sapiens
cctgagcctgagtggtgcaggg

SEQ ID NO: 9020425 - DNA, 22 bp, Homo sapiens
cctgagcctgcagccgagcaga

SEQ ID NO: 9020426 - DNA, 22 bp, Homo sapiens
cctgagcctgagtggtgcaggg

SEQ ID NO: 9020427 - DNA, 22 bp, Homo sapiens
cctgagcctgagtggtgcaggg

SEQ ID NO: 9020428 - DNA, 22 bp, Homo sapiens
cctgagcctgagtggtgcaggg

SEQ ID NO: 9020429 - DNA, 22 bp, Homo sapiens
cctgagcctcttgcacgctcag

SEQ ID NO: 9020430 - DNA, 22 bp, Homo sapiens
cctgagcctgagtggtgcaggg

SEQ ID NO: 9020431 - DNA, 22 bp, Homo sapiens
cctgagcatcagcgcctcctta

SEQ ID NO: 9020432 - DNA, 22 bp, Homo sapiens
cctgagcattagacatccatca

SEQ ID NO: 9020433 - DNA, 22 bp, Homo sapiens
cctgagcatcagcgcctcctta

SEQ ID NO: 9020434 - DNA, 22 bp, Homo sapiens
cctgagcagctctgaggggcga

SEQ ID NO: 9020435 - DNA, 22 bp, Homo sapiens
cctgagcagggctctgcagggc

SEQ ID NO: 9020436 - DNA, 22 bp, Homo sapiens
cctgagcagggctctgcagggc

SEQ ID NO: 9020437 - DNA, 22 bp, Homo sapiens
cctgagccaagagtcagaatct

SEQ ID NO: 9020438 - DNA, 18 bp, Homo sapiens
cctgagccctgcttactt

SEQ ID NO: 9020439 - DNA, 22 bp, Homo sapiens
cctgagccgagcgctctttctc

SEQ ID NO: 9020440 - DNA, 22 bp, Homo sapiens
cctgagcctcttgcacgctcag

SEQ ID NO: 9020441 - DNA, 22 bp, Homo sapiens
cctgagccgagcgctctttctc

SEQ ID NO: 9020442 - DNA, 22 bp, Homo sapiens
cctgagccgagcgctctttctc

SEQ ID NO: 9020443 - DNA, 22 bp, Homo sapiens
cctgagcacacatcagaatcac

SEQ ID NO: 9020444 - DNA, 22 bp, Homo sapiens
cctgagcacaagggagctttga

SEQ ID NO: 9020445 - DNA, 22 bp, Homo sapiens
cctgagcaaaggaaggatgact

SEQ ID NO: 9020446 - DNA, 22 bp, Homo sapiens
cctgagcaaaggcccagaggga

SEQ ID NO: 9020447 - DNA, 22 bp, Homo sapiens
cctgagatttgtaatttttgta

SEQ ID NO: 9020448 - DNA, 22 bp, Homo sapiens
cctgagatgtgtaacagatggt

SEQ ID NO: 9020449 - DNA, 22 bp, Homo sapiens
cctgagatggggattattccaa

SEQ ID NO: 9020450 - DNA, 23 bp, Homo sapiens
cctgagatctgtaagggaccttg

SEQ ID NO: 9020451 - DNA, 22 bp, Homo sapiens
cctgagatggccagtgctggga

SEQ ID NO: 9020452 - DNA, 22 bp, Homo sapiens
cctgagaccaagttgcagccat

SEQ ID NO: 9020453 - DNA, 22 bp, Homo sapiens
cctgagaccaagttgcagccat

SEQ ID NO: 9020454 - DNA, 22 bp, Homo sapiens
tgggagtttgttagaaatgcag

SEQ ID NO: 9020455 - DNA, 22 bp, Homo sapiens
cctgagagagaagcgacctggt

SEQ ID NO: 9020456 - DNA, 22 bp, Homo sapiens
cctgagagagaagcgacctggt

SEQ ID NO: 9020457 - DNA, 22 bp, Homo sapiens
cctgagatcagtgcatttggtg

SEQ ID NO: 9020458 - DNA, 22 bp, Homo sapiens
tgggagtgttcttggcttgctt

SEQ ID NO: 9020459 - DNA, 22 bp, Homo sapiens
tgggagtgttcttggcttgctt

SEQ ID NO: 9020460 - DNA, 23 bp, Homo sapiens
tgggagtgttgggatctctgctc

SEQ ID NO: 9020461 - DNA, 22 bp, Homo sapiens
tgggagttagttatactgtgac

SEQ ID NO: 9020462 - DNA, 23 bp, Homo sapiens
tgggagttgagtgaggttgcttt

SEQ ID NO: 9020463 - DNA, 22 bp, Homo sapiens
tgggagttaacattggtctctg

SEQ ID NO: 9020464 - DNA, 22 bp, Homo sapiens
cctcttctaggacgtccttgtg

SEQ ID NO: 9020465 - DNA, 22 bp, Homo sapiens
cctcttctaggacgtccttgtg

SEQ ID NO: 9020466 - DNA, 22 bp, Homo sapiens
cctcttctaggtttcagcctgc

SEQ ID NO: 9020467 - DNA, 22 bp, Homo sapiens
cctcttctaggtttcagcctgc

SEQ ID NO: 9020468 - DNA, 22 bp, Homo sapiens
cctcttctaggtttcagcctgc

SEQ ID NO: 9020469 - DNA, 19 bp, Homo sapiens
cctcttcctctgacactat

SEQ ID NO: 9020470 - DNA, 19 bp, Homo sapiens
cctcttcctctgacactat

SEQ ID NO: 9020471 - DNA, 19 bp, Homo sapiens
cctcttcctctgacactat

SEQ ID NO: 9020472 - DNA, 22 bp, Homo sapiens
cctcttcctgcactgacatttt

SEQ ID NO: 9020473 - DNA, 22 bp, Homo sapiens
cctcttccttctcactgtggaa

SEQ ID NO: 9020474 - DNA, 22 bp, Homo sapiens
cctcttccttctcactgtggaa

SEQ ID NO: 9020475 - DNA, 22 bp, Homo sapiens
cctcttcctcaccatctacaac

SEQ ID NO: 9020476 - DNA, 17 bp, Homo sapiens
cctcttcctctcagctg

SEQ ID NO: 9020477 - DNA, 17 bp, Homo sapiens
cctcttcctctcagctg

SEQ ID NO: 9020478 - DNA, 17 bp, Homo sapiens
cctcttcctctcagctg

SEQ ID NO: 9020479 - DNA, 17 bp, Homo sapiens
cctcttcctctcagctg

SEQ ID NO: 9020480 - DNA, 18 bp, Homo sapiens
tgggagtgggagtggata

SEQ ID NO: 9020481 - DNA, 19 bp, Homo sapiens
cctcttctctggcagcaga

SEQ ID NO: 9020482 - DNA, 22 bp, Homo sapiens
cctcttctcaactccagccaga

SEQ ID NO: 9020483 - DNA, 19 bp, Homo sapiens
tgggagtggggaaggtcct

SEQ ID NO: 9020484 - DNA, 18 bp, Homo sapiens
tgggagtgggagtggata

SEQ ID NO: 9020485 - DNA, 18 bp, Homo sapiens
tgggagtgggagtggata

SEQ ID NO: 9020486 - DNA, 18 bp, Homo sapiens
tgggagtgggagtggata

SEQ ID NO: 9020487 - DNA, 18 bp, Homo sapiens
tgggagtgggagtggata

SEQ ID NO: 9020488 - DNA, 18 bp, Homo sapiens
tgggagtgggagtggata

SEQ ID NO: 9020489 - DNA, 22 bp, Homo sapiens
tgggagtggggcatagaaggta

SEQ ID NO: 9020490 - DNA, 22 bp, Homo sapiens
tgggagtggggcatagaaggta

SEQ ID NO: 9020491 - DNA, 22 bp, Homo sapiens
tgggagtggggcatagaaggta

SEQ ID NO: 9020492 - DNA, 19 bp, Homo sapiens
tgggagtggggaaggtcct

SEQ ID NO: 9020493 - DNA, 19 bp, Homo sapiens
tgggagtggggaaggtcct

SEQ ID NO: 9020494 - DNA, 19 bp, Homo sapiens
tgggagtggggaaggtcct

SEQ ID NO: 9020495 - DNA, 22 bp, Homo sapiens
tgggagtggggcatagaaggta

SEQ ID NO: 9020496 - DNA, 22 bp, Homo sapiens
tgggagtgttcttggcttgctt

SEQ ID NO: 9020497 - DNA, 22 bp, Homo sapiens
tggcctggggaagaccatgggc

SEQ ID NO: 9020498 - DNA, 22 bp, Homo sapiens
tggcctggggaagaccatgggc

SEQ ID NO: 9020499 - DNA, 22 bp, Homo sapiens
tggcctggggaagaccatgggc

SEQ ID NO: 9020500 - DNA, 22 bp, Homo sapiens
tggcctgggcctgccggtgcaa

SEQ ID NO: 9020501 - DNA, 22 bp, Homo sapiens
tggcctgggcctgccggtgcaa

SEQ ID NO: 9020502 - DNA, 22 bp, Homo sapiens
tggcctgggcctgccggtgcaa

SEQ ID NO: 9020503 - DNA, 22 bp, Homo sapiens
tggcctggggaagaccatgggc

SEQ ID NO: 9020504 - DNA, 22 bp, Homo sapiens
tggcctggggaagaccatgggc

SEQ ID NO: 9020505 - DNA, 22 bp, Homo sapiens
tggcctggggacctgtgagacc

SEQ ID NO: 9020506 - DNA, 22 bp, Homo sapiens
tggcctggggacctgtgagacc

SEQ ID NO: 9020507 - DNA, 22 bp, Homo sapiens
tggcctggggacctgtgagacc

SEQ ID NO: 9020508 - DNA, 22 bp, Homo sapiens
tggcctgggcatgaagcatcgt

SEQ ID NO: 9020509 - DNA, 22 bp, Homo sapiens
tggcctggctgccctgtctgga

SEQ ID NO: 9020510 - DNA, 22 bp, Homo sapiens
tggcctggctgccctgtctgga

SEQ ID NO: 9020511 - DNA, 22 bp, Homo sapiens
tggcctgggccggcagatatac

SEQ ID NO: 9020512 - DNA, 22 bp, Homo sapiens
tggcctgggcctgccggtgcaa

SEQ ID NO: 9020513 - DNA, 22 bp, Homo sapiens
tggcctgggcatgaagcatcgt

SEQ ID NO: 9020514 - DNA, 22 bp, Homo sapiens
tggcctgggcctgccggtgcaa

SEQ ID NO: 9020515 - DNA, 22 bp, Homo sapiens
tggcctgggccggcagatatac

SEQ ID NO: 9020516 - DNA, 22 bp, Homo sapiens
tggcctgggccggcagatatac

SEQ ID NO: 9020517 - DNA, 22 bp, Homo sapiens
tggcctgggccggcagatatac

SEQ ID NO: 9020518 - DNA, 22 bp, Homo sapiens
tggctctgagacacaggctctc

SEQ ID NO: 9020519 - DNA, 21 bp, Homo sapiens
tggctctgggtaggagagtgc

SEQ ID NO: 9020520 - DNA, 22 bp, Homo sapiens
tggctctgagacacaggctctc

SEQ ID NO: 9020521 - DNA, 21 bp, Homo sapiens
tggctctgggtaggagagtgc

SEQ ID NO: 9020522 - DNA, 21 bp, Homo sapiens
tggctctgggtaggagagtgc

SEQ ID NO: 9020523 - DNA, 21 bp, Homo sapiens
tggctctgggtaggagagtgc

SEQ ID NO: 9020524 - DNA, 22 bp, Homo sapiens
tggctctggtgcgggctcctgc

SEQ ID NO: 9020525 - DNA, 22 bp, Homo sapiens
tggctctggtgcgggctcctgc

SEQ ID NO: 9020526 - DNA, 22 bp, Homo sapiens
tggctctgtcaaactgcacaca

SEQ ID NO: 9020527 - DNA, 22 bp, Homo sapiens
tggctctgtcactgtgagctat

SEQ ID NO: 9020528 - DNA, 22 bp, Homo sapiens
tggctctgtcactgtgagctat

SEQ ID NO: 9020529 - DNA, 22 bp, Homo sapiens
cctcagtttatcctctgtaaca

SEQ ID NO: 9020530 - DNA, 22 bp, Homo sapiens
cctcatcgtttccagaatgtgg

SEQ ID NO: 9020531 - DNA, 20 bp, Homo sapiens
cctcatctcaagggcagtcc

SEQ ID NO: 9020532 - DNA, 20 bp, Homo sapiens
cctcatctcaagggcagtcc

SEQ ID NO: 9020533 - DNA, 22 bp, Homo sapiens
cctcatctgtcatcctagggaa

SEQ ID NO: 9020534 - DNA, 22 bp, Homo sapiens
cctcagtgtgtggatgttagag

SEQ ID NO: 9020535 - DNA, 20 bp, Homo sapiens
cctcagtgtcctggactggg

SEQ ID NO: 9020536 - DNA, 22 bp, Homo sapiens
cctcagtgtgtggatgttagag

SEQ ID NO: 9020537 - DNA, 22 bp, Homo sapiens
cctcagtgtgcagcagcatctg

SEQ ID NO: 9020538 - DNA, 22 bp, Homo sapiens
cctcagggactccatgctgcag

SEQ ID NO: 9020539 - DNA, 22 bp, Homo sapiens
cctcagggactccatgctgcag

SEQ ID NO: 9020540 - DNA, 18 bp, Homo sapiens
cctcagggagagagacgc

SEQ ID NO: 9020541 - DNA, 22 bp, Homo sapiens
cctcagtgcgtactgaacagtg

SEQ ID NO: 9020542 - DNA, 20 bp, Homo sapiens
cctcagtgtcctggactggg

SEQ ID NO: 9020543 - DNA, 22 bp, Homo sapiens
cctcagtgagtgtttccttctt

SEQ ID NO: 9020544 - DNA, 18 bp, Homo sapiens
cctcagggagagagacgc

SEQ ID NO: 9020545 - DNA, 18 bp, Homo sapiens
cctcagggagagagacgc

SEQ ID NO: 9020546 - DNA, 22 bp, Homo sapiens
tggcctggctcacagtgagatt

SEQ ID NO: 9020547 - DNA, 22 bp, Homo sapiens
tggcctggctcacagtgagatt

SEQ ID NO: 9020548 - DNA, 22 bp, Homo sapiens
tggcctggctgccctgtctgga

SEQ ID NO: 9020549 - DNA, 22 bp, Homo sapiens
tggcctggctgccctgtctgga

SEQ ID NO: 9020550 - DNA, 22 bp, Homo sapiens
tggcctggctgccctgtctgga

SEQ ID NO: 9020551 - DNA, 22 bp, Homo sapiens
cctccaaggtgagagaggatgg

SEQ ID NO: 9020552 - DNA, 22 bp, Homo sapiens
cctcatggtacttactgtagct

SEQ ID NO: 9020553 - DNA, 22 bp, Homo sapiens
cctcatggccttgagctgaggg

SEQ ID NO: 9020554 - DNA, 22 bp, Homo sapiens
cctcatggtacttactgtagct

SEQ ID NO: 9020555 - DNA, 22 bp, Homo sapiens
cctcatggccttgagctgaggg

SEQ ID NO: 9020556 - DNA, 19 bp, Homo sapiens
cctcatcttggtgtgtgca

SEQ ID NO: 9020557 - DNA, 22 bp, Homo sapiens
cctcatggacctcagactgtcc

SEQ ID NO: 9020558 - DNA, 22 bp, Homo sapiens
cctcatggccttgagctgaggg

SEQ ID NO: 9020559 - DNA, 22 bp, Homo sapiens
cctcaggcttgtgagccttcag

SEQ ID NO: 9020560 - DNA, 22 bp, Homo sapiens
cctcaggcttgtgagccttcag

SEQ ID NO: 9020561 - DNA, 22 bp, Homo sapiens
cctcaggcttgtgagccttcag

SEQ ID NO: 9020562 - DNA, 22 bp, Homo sapiens
cctcaggcttctagttcagtga

SEQ ID NO: 9020563 - DNA, 22 bp, Homo sapiens
cctcaggcttctagttcagtga

SEQ ID NO: 9020564 - DNA, 22 bp, Homo sapiens
cctcaggcttctagttcagtga

SEQ ID NO: 9020565 - DNA, 22 bp, Homo sapiens
cctcaggcttctagttcagtga

SEQ ID NO: 9020566 - DNA, 22 bp, Homo sapiens
cctcagggaatgggaggctggg

SEQ ID NO: 9020567 - DNA, 22 bp, Homo sapiens
cctcagggaatgggaggctggg

SEQ ID NO: 9020568 - DNA, 22 bp, Homo sapiens
cctcaggcttgtgagccttcag

SEQ ID NO: 9020569 - DNA, 22 bp, Homo sapiens
cctcagggaatgggaggctggg

SEQ ID NO: 9020570 - DNA, 22 bp, Homo sapiens
cctcagggaatgggaggctggg

SEQ ID NO: 9020571 - DNA, 22 bp, Homo sapiens
cctcagggaatgggaggctggg

SEQ ID NO: 9020572 - DNA, 22 bp, Homo sapiens
cctcaggcttacgggcaatgga

SEQ ID NO: 9020573 - DNA, 22 bp, Homo sapiens
cctcaggcttacgggcaatgga

SEQ ID NO: 9020574 - DNA, 22 bp, Homo sapiens
cctcaggcttcgtcttccaccc

SEQ ID NO: 9020575 - DNA, 22 bp, Homo sapiens
cctcaggcttacgggcaatgga

SEQ ID NO: 9020576 - DNA, 22 bp, Homo sapiens
cctcaggcttcgtcttccaccc

SEQ ID NO: 9020577 - DNA, 22 bp, Homo sapiens
cctcaggcttcgtcttccaccc

SEQ ID NO: 9020578 - DNA, 22 bp, Homo sapiens
cctcaggcttcgtcttccaccc

SEQ ID NO: 9020579 - DNA, 22 bp, Homo sapiens
cctcaggcttaacttgtcttga

SEQ ID NO: 9020580 - DNA, 22 bp, Homo sapiens
cctcaggctgtcttccttctgg

SEQ ID NO: 9020581 - DNA, 22 bp, Homo sapiens
cctcaggcttacgggcaatgga

SEQ ID NO: 9020582 - DNA, 22 bp, Homo sapiens
cctcaggcttacgggcaatgga

SEQ ID NO: 9020583 - DNA, 22 bp, Homo sapiens
cctcaggcttaacttgtcttga

SEQ ID NO: 9020584 - DNA, 22 bp, Homo sapiens
cctcaggctgtcttccttctgg

SEQ ID NO: 9020585 - DNA, 22 bp, Homo sapiens
cctcaggctctgggtgcctacc

SEQ ID NO: 9020586 - DNA, 22 bp, Homo sapiens
cctcaggctctgggtgcctacc

SEQ ID NO: 9020587 - DNA, 22 bp, Homo sapiens
cctcaggctgctcacacttgtc

SEQ ID NO: 9020588 - DNA, 22 bp, Homo sapiens
cctcaggctgctcacacttgtc

SEQ ID NO: 9020589 - DNA, 22 bp, Homo sapiens
cctcaggctgctcacacttgtc

SEQ ID NO: 9020590 - DNA, 22 bp, Homo sapiens
cctcaggctctgggtgcctacc

SEQ ID NO: 9020591 - DNA, 22 bp, Homo sapiens
cctcaggctgctcacacttgtc

SEQ ID NO: 9020592 - DNA, 22 bp, Homo sapiens
cctcaggctgggctgcccctgg

SEQ ID NO: 9020593 - DNA, 22 bp, Homo sapiens
cctcaggctgctcacacttgtc

SEQ ID NO: 9020594 - DNA, 22 bp, Homo sapiens
cctcaggctgggctgcccctgg

SEQ ID NO: 9020595 - DNA, 22 bp, Homo sapiens
cctcaggctgggctgcccctgg

SEQ ID NO: 9020596 - DNA, 22 bp, Homo sapiens
cctcaggctagctactgtccct

SEQ ID NO: 9020597 - DNA, 22 bp, Homo sapiens
cctcaggctagctactgtccct

SEQ ID NO: 9020598 - DNA, 22 bp, Homo sapiens
cctcaggctagctactgtccct

SEQ ID NO: 9020599 - DNA, 22 bp, Homo sapiens
cctcaggctagctactgtccct

SEQ ID NO: 9020600 - DNA, 22 bp, Homo sapiens
cctcaggctagctactgtccct

SEQ ID NO: 9020601 - DNA, 22 bp, Homo sapiens
cctcaggctctgggtgcctacc

SEQ ID NO: 9020602 - DNA, 22 bp, Homo sapiens
cctcaggcctgccagagcccca

SEQ ID NO: 9020603 - DNA, 22 bp, Homo sapiens
cctcaggcctgccagagcccca

SEQ ID NO: 9020604 - DNA, 22 bp, Homo sapiens
cctcaggcctgccagagcccca

SEQ ID NO: 9020605 - DNA, 22 bp, Homo sapiens
cctcaggcctgccagagcccca

SEQ ID NO: 9020606 - DNA, 22 bp, Homo sapiens
cctcaggcctctgcctcattgg

SEQ ID NO: 9020607 - DNA, 22 bp, Homo sapiens
cctcaggcctctgcctcattgg

SEQ ID NO: 9020608 - DNA, 22 bp, Homo sapiens
cctcagcttgatttctgcagag

SEQ ID NO: 9020609 - DNA, 22 bp, Homo sapiens
cctcaggcctctgcctcattgg

SEQ ID NO: 9020610 - DNA, 20 bp, Homo sapiens
tggcccagcacgacgaggac

SEQ ID NO: 9020611 - DNA, 20 bp, Homo sapiens
tggcccagcacgacgaggac

SEQ ID NO: 9020612 - DNA, 20 bp, Homo sapiens
tggcccagcacgacgaggac

SEQ ID NO: 9020613 - DNA, 22 bp, Homo sapiens
tggcccagcactccaagtaggg

SEQ ID NO: 9020614 - DNA, 22 bp, Homo sapiens
tggcccagcactccaagtaggg

SEQ ID NO: 9020615 - DNA, 22 bp, Homo sapiens
tggcccagcactccaagtaggg

SEQ ID NO: 9020616 - DNA, 20 bp, Homo sapiens
tggcccagcacgacgaggac

SEQ ID NO: 9020617 - DNA, 22 bp, Homo sapiens
tggcccagcactccaagtaggg

SEQ ID NO: 9020618 - DNA, 22 bp, Homo sapiens
tggcccagcagttctgccccag

SEQ ID NO: 9020619 - DNA, 22 bp, Homo sapiens
tggcccagcagttctgccccag

SEQ ID NO: 9020620 - DNA, 22 bp, Homo sapiens
tggcccagcagttctgccccag

SEQ ID NO: 9020621 - DNA, 17 bp, Homo sapiens
cctcagcttctttcctc

SEQ ID NO: 9020622 - DNA, 19 bp, Homo sapiens
tggcccagatggtcctggg

SEQ ID NO: 9020623 - DNA, 19 bp, Homo sapiens
tggcccagatggtcctggg

SEQ ID NO: 9020624 - DNA, 19 bp, Homo sapiens
tggcccagatggtcctggg

SEQ ID NO: 9020625 - DNA, 19 bp, Homo sapiens
tggcccagatggtcctggg

SEQ ID NO: 9020626 - DNA, 19 bp, Homo sapiens
tggcccagatggtcctggg

SEQ ID NO: 9020627 - DNA, 19 bp, Homo sapiens
tggcccagatggtcctggg

SEQ ID NO: 9020628 - DNA, 19 bp, Homo sapiens
tggcccagatggtcctggg

SEQ ID NO: 9020629 - DNA, 22 bp, Homo sapiens
tggcccagatctctgaccttga

SEQ ID NO: 9020630 - DNA, 22 bp, Homo sapiens
tggcccagatctctgaccttga

SEQ ID NO: 9020631 - DNA, 22 bp, Homo sapiens
tggcccagatctctgaccttga

SEQ ID NO: 9020632 - DNA, 22 bp, Homo sapiens
tggcccagatctctgaccttga

SEQ ID NO: 9020633 - DNA, 22 bp, Homo sapiens
tggcccagagcactgctgggca

SEQ ID NO: 9020634 - DNA, 22 bp, Homo sapiens
tggcccagagcactgctgggca

SEQ ID NO: 9020635 - DNA, 22 bp, Homo sapiens
cctcagagtctagtaaataata

SEQ ID NO: 9020636 - DNA, 22 bp, Homo sapiens
cctcagagttatttgaagtgaa

SEQ ID NO: 9020637 - DNA, 22 bp, Homo sapiens
cctcagagttatttgaagtgaa

SEQ ID NO: 9020638 - DNA, 22 bp, Homo sapiens
cctcagagttatttgaagtgaa

SEQ ID NO: 9020639 - DNA, 22 bp, Homo sapiens
cctcagagttatttgaagtgaa

SEQ ID NO: 9020640 - DNA, 22 bp, Homo sapiens
cctcagagttggaatcacattt

SEQ ID NO: 9020641 - DNA, 22 bp, Homo sapiens
cctcagagttggaatcacattt

SEQ ID NO: 9020642 - DNA, 22 bp, Homo sapiens
cctcagagttggaatcacattt

SEQ ID NO: 9020643 - DNA, 22 bp, Homo sapiens
cctcagaggttttcattctgta

SEQ ID NO: 9020644 - DNA, 22 bp, Homo sapiens
cctcagaggttctgtgtgggaa

SEQ ID NO: 9020645 - DNA, 22 bp, Homo sapiens
cctcagaggttttcattctgta

SEQ ID NO: 9020646 - DNA, 22 bp, Homo sapiens
cctcagaggttttcattctgta

SEQ ID NO: 9020647 - DNA, 22 bp, Homo sapiens
cctcagagtaggtctcagctgt

SEQ ID NO: 9020648 - DNA, 22 bp, Homo sapiens
cctcagagtaggtctcagctgt

SEQ ID NO: 9020649 - DNA, 22 bp, Homo sapiens
cctcagagtaggtctcagctgt

SEQ ID NO: 9020650 - DNA, 22 bp, Homo sapiens
cctcagcatcctcctgctcagt

SEQ ID NO: 9020651 - DNA, 22 bp, Homo sapiens
tggcccagagcactgctgggca

SEQ ID NO: 9020652 - DNA, 22 bp, Homo sapiens
tggcccagagcactgctgggca

SEQ ID NO: 9020653 - DNA, 22 bp, Homo sapiens
tggcccagagcactgctgggca

SEQ ID NO: 9020654 - DNA, 22 bp, Homo sapiens
tggcccagagcactgctgggca

SEQ ID NO: 9020655 - DNA, 22 bp, Homo sapiens
cctcagcatcctcatgctcagt

SEQ ID NO: 9020656 - DNA, 22 bp, Homo sapiens
cctcagagtttaagatgtcaga

SEQ ID NO: 9020657 - DNA, 22 bp, Homo sapiens
cctcagagtttaagatgtcaga

SEQ ID NO: 9020658 - DNA, 22 bp, Homo sapiens
cctcagagtttaagatgtcaga

SEQ ID NO: 9020659 - DNA, 22 bp, Homo sapiens
cctcagagttggccacgagagc

SEQ ID NO: 9020660 - DNA, 22 bp, Homo sapiens
cctcagagtttaagatgtcaga

SEQ ID NO: 9020661 - DNA, 22 bp, Homo sapiens
cctcagagtttaagatgtcaga

SEQ ID NO: 9020662 - DNA, 22 bp, Homo sapiens
cctcagcagacacgcttctcac

SEQ ID NO: 9020663 - DNA, 22 bp, Homo sapiens
cctcagatgtcttaaggcactg

SEQ ID NO: 9020664 - DNA, 22 bp, Homo sapiens
tggagcagggcatcactgtgcg

SEQ ID NO: 9020665 - DNA, 22 bp, Homo sapiens
tggagcagggcatcactgtgcg

SEQ ID NO: 9020666 - DNA, 22 bp, Homo sapiens
tggagcagggcatcactgtgcg

SEQ ID NO: 9020667 - DNA, 22 bp, Homo sapiens
tggagcagggcatcactgtgcg

SEQ ID NO: 9020668 - DNA, 22 bp, Homo sapiens
tggagcaggccggaagtggctt

SEQ ID NO: 9020669 - DNA, 22 bp, Homo sapiens
tggagcaggccggaagtggctt

SEQ ID NO: 9020670 - DNA, 22 bp, Homo sapiens
tggagcagggcatcactgtgcg

SEQ ID NO: 9020671 - DNA, 22 bp, Homo sapiens
tggagcaggccggaagtggctt

SEQ ID NO: 9020672 - DNA, 22 bp, Homo sapiens
tggagcaggccggaagtggctt

SEQ ID NO: 9020673 - DNA, 22 bp, Homo sapiens
tggagcaggccggaagtggctt

SEQ ID NO: 9020674 - DNA, 22 bp, Homo sapiens
tggagcaggccggaagtggctt

SEQ ID NO: 9020675 - DNA, 22 bp, Homo sapiens
tggagcaggccggaagtggctt

SEQ ID NO: 9020676 - DNA, 22 bp, Homo sapiens
tggagcaggcatctttctctct

SEQ ID NO: 9020677 - DNA, 22 bp, Homo sapiens
tggagcaggccggaagtggctt

SEQ ID NO: 9020678 - DNA, 22 bp, Homo sapiens
tggagcaggcatctttctctct

SEQ ID NO: 9020679 - DNA, 22 bp, Homo sapiens
tggagcaggcatctttctctct

SEQ ID NO: 9020680 - DNA, 18 bp, Homo sapiens
tggagcaggtaggcatga

SEQ ID NO: 9020681 - DNA, 22 bp, Homo sapiens
ccctgcagccttgcatgccttc

SEQ ID NO: 9020682 - DNA, 18 bp, Homo sapiens
tggagcaggtaggcatga

SEQ ID NO: 9020683 - DNA, 22 bp, Homo sapiens
ccctgcagccttgcatgccttc

SEQ ID NO: 9020684 - DNA, 22 bp, Homo sapiens
ccctgcagccttgcatgccttc

SEQ ID NO: 9020685 - DNA, 18 bp, Homo sapiens
tggagcaggtaggcatga

SEQ ID NO: 9020686 - DNA, 18 bp, Homo sapiens
tggagcaggtaggcatga

SEQ ID NO: 9020687 - DNA, 19 bp, Homo sapiens
tggagcagggcccttgttt

SEQ ID NO: 9020688 - DNA, 19 bp, Homo sapiens
tggagcagggcccttgttt

SEQ ID NO: 9020689 - DNA, 19 bp, Homo sapiens
tggagcagggcccttgttt

SEQ ID NO: 9020690 - DNA, 22 bp, Homo sapiens
ccctgcaggggacctgcagcct

SEQ ID NO: 9020691 - DNA, 23 bp, Homo sapiens
ccctgcagtcagggtgagatggt

SEQ ID NO: 9020692 - DNA, 23 bp, Homo sapiens
ccctgcagtcagggtgagatggt

SEQ ID NO: 9020693 - DNA, 22 bp, Homo sapiens
ccctgtgggaactcctgagttg

SEQ ID NO: 9020694 - DNA, 22 bp, Homo sapiens
ccctgtgggccatgtgtctaca

SEQ ID NO: 9020695 - DNA, 23 bp, Homo sapiens
ccctgcagtcagggtgagatggt

SEQ ID NO: 9020696 - DNA, 22 bp, Homo sapiens
ccctgcaggggacctgcagcct

SEQ ID NO: 9020697 - DNA, 22 bp, Homo sapiens
ccctgcaggggacctgcagcct

SEQ ID NO: 9020698 - DNA, 22 bp, Homo sapiens
ccctgcaggggacctgcagcct

SEQ ID NO: 9020699 - DNA, 22 bp, Homo sapiens
ccctgcaggctcagactggagt

SEQ ID NO: 9020700 - DNA, 21 bp, Homo sapiens
ccctgcaggccagggctgagc

SEQ ID NO: 9020701 - DNA, 21 bp, Homo sapiens
ccctgcaggccagggctgagc

SEQ ID NO: 9020702 - DNA, 22 bp, Homo sapiens
ccctgcaggctcagactggagt

SEQ ID NO: 9020703 - DNA, 22 bp, Homo sapiens
ccctgcaggctcagactggagt

SEQ ID NO: 9020704 - DNA, 22 bp, Homo sapiens
ccctgcaggctcagactggagt

SEQ ID NO: 9020705 - DNA, 22 bp, Homo sapiens
ccctgcaggctcagactggagt

SEQ ID NO: 9020706 - DNA, 22 bp, Homo sapiens
ccctgcagccttgcatgccttc

SEQ ID NO: 9020707 - DNA, 22 bp, Homo sapiens
ccctgcagcttttgcatagtca

SEQ ID NO: 9020708 - DNA, 22 bp, Homo sapiens
ccctgcagccttgcatgccttc

SEQ ID NO: 9020709 - DNA, 21 bp, Homo sapiens
ccctgcaggccagggctgagc

SEQ ID NO: 9020710 - DNA, 22 bp, Homo sapiens
ccctgcagcttttgcatagtca

SEQ ID NO: 9020711 - DNA, 22 bp, Homo sapiens
ccctgcagcttttgcatagtca

SEQ ID NO: 9020712 - DNA, 22 bp, Homo sapiens
cccttcctggagtaccctctgt

SEQ ID NO: 9020713 - DNA, 22 bp, Homo sapiens
cccttccttgattttaactgga

SEQ ID NO: 9020714 - DNA, 22 bp, Homo sapiens
cccttccttgattttaactgga

SEQ ID NO: 9020715 - DNA, 22 bp, Homo sapiens
cccttcctgggtgtcccggagt

SEQ ID NO: 9020716 - DNA, 22 bp, Homo sapiens
cccttcctgggtgtcccggagt

SEQ ID NO: 9020717 - DNA, 22 bp, Homo sapiens
ccctgtggggtccgcctgtccg

SEQ ID NO: 9020718 - DNA, 22 bp, Homo sapiens
ccctgtggtgacaggcctgtct

SEQ ID NO: 9020719 - DNA, 22 bp, Homo sapiens
cccttcctcaaggagctgtgtt

SEQ ID NO: 9020720 - DNA, 22 bp, Homo sapiens
cccttcctcaaggagctgtgtt

SEQ ID NO: 9020721 - DNA, 22 bp, Homo sapiens
cccttcccttctgggagatcca

SEQ ID NO: 9020722 - DNA, 22 bp, Homo sapiens
cccttcctcccaggcttctgtg

SEQ ID NO: 9020723 - DNA, 22 bp, Homo sapiens
cccttcctcccaggcttctgtg

SEQ ID NO: 9020724 - DNA, 19 bp, Homo sapiens
tggcagaggacaaggactt

SEQ ID NO: 9020725 - DNA, 19 bp, Homo sapiens
tggcagaggacaaggactt

SEQ ID NO: 9020726 - DNA, 22 bp, Homo sapiens
tggcagaggagaattaagatta

SEQ ID NO: 9020727 - DNA, 22 bp, Homo sapiens
tggcagaggagaattaagatta

SEQ ID NO: 9020728 - DNA, 19 bp, Homo sapiens
tggcagaggacaaggactt

SEQ ID NO: 9020729 - DNA, 22 bp, Homo sapiens
cccttctttgtaataaagatta

SEQ ID NO: 9020730 - DNA, 22 bp, Homo sapiens
tggcagaggaaaaagtcactgg

SEQ ID NO: 9020731 - DNA, 19 bp, Homo sapiens
tggcagaggacaaggactt

SEQ ID NO: 9020732 - DNA, 22 bp, Homo sapiens
cccttccttgtgactggtgggg

SEQ ID NO: 9020733 - DNA, 22 bp, Homo sapiens
cccttccttgtgactggtgggg

SEQ ID NO: 9020734 - DNA, 22 bp, Homo sapiens
cccttctctttcactcactatt

SEQ ID NO: 9020735 - DNA, 22 bp, Homo sapiens
cccttctctttcactcactatt

SEQ ID NO: 9020736 - DNA, 22 bp, Homo sapiens
cccttctctttcactcactatt

SEQ ID NO: 9020737 - DNA, 22 bp, Homo sapiens
cccttctctttcactcactatt

SEQ ID NO: 9020738 - DNA, 22 bp, Homo sapiens
cccttctagtccattcttcaca

SEQ ID NO: 9020739 - DNA, 22 bp, Homo sapiens
cccttctgtaaatgctgactgg

SEQ ID NO: 9020740 - DNA, 21 bp, Homo sapiens
cccttctgctccagctttgcc

SEQ ID NO: 9020741 - DNA, 21 bp, Homo sapiens
cccttcttactcaagctcatt

SEQ ID NO: 9020742 - DNA, 22 bp, Homo sapiens
cccttctctttcactcactatt

SEQ ID NO: 9020743 - DNA, 22 bp, Homo sapiens
cccttctctttcactcactatt

SEQ ID NO: 9020744 - DNA, 21 bp, Homo sapiens
cccttctgctccagctttgcc

SEQ ID NO: 9020745 - DNA, 22 bp, Homo sapiens
tggcagggtggcaacttttggt

SEQ ID NO: 9020746 - DNA, 22 bp, Homo sapiens
tggcagggtggcaacttttggt

SEQ ID NO: 9020747 - DNA, 22 bp, Homo sapiens
tggcagggtggcaacttttggt

SEQ ID NO: 9020748 - DNA, 19 bp, Homo sapiens
cctaggcattgtccaaggg

SEQ ID NO: 9020749 - DNA, 22 bp, Homo sapiens
cctaggcacccgagttatgttc

SEQ ID NO: 9020750 - DNA, 22 bp, Homo sapiens
cctaggcaagagttggtgtgga

SEQ ID NO: 9020751 - DNA, 22 bp, Homo sapiens
cctaggagttgaggtggccaga

SEQ ID NO: 9020752 - DNA, 22 bp, Homo sapiens
cctaggagttcgaagctgcagt

SEQ ID NO: 9020753 - DNA, 22 bp, Homo sapiens
cctaggcaagagttggtgtgga

SEQ ID NO: 9020754 - DNA, 22 bp, Homo sapiens
cctaggaagctgagattgcagt

SEQ ID NO: 9020755 - DNA, 22 bp, Homo sapiens
cctaggaacccccaggcttctg

SEQ ID NO: 9020756 - DNA, 22 bp, Homo sapiens
cctaggaaggagtatagtaaat

SEQ ID NO: 9020757 - DNA, 22 bp, Homo sapiens
cctaggaaggagtatagtaaat

SEQ ID NO: 9020758 - DNA, 22 bp, Homo sapiens
cctaggagaggtaatgaagttc

SEQ ID NO: 9020759 - DNA, 22 bp, Homo sapiens
cctaggagttcgaagctgcagt

SEQ ID NO: 9020760 - DNA, 22 bp, Homo sapiens
cctaggagttgaggtggccaga

SEQ ID NO: 9020761 - DNA, 22 bp, Homo sapiens
cctaggagttcgaagctgcagt

SEQ ID NO: 9020762 - DNA, 22 bp, Homo sapiens
cctaggagttcgaagctgcagt

SEQ ID NO: 9020763 - DNA, 22 bp, Homo sapiens
cctaggagaggtaatgaagttc

SEQ ID NO: 9020764 - DNA, 22 bp, Homo sapiens
cctaggagaggtaatgaagttc

SEQ ID NO: 9020765 - DNA, 22 bp, Homo sapiens
tggcagggtgggcttcagcccc

SEQ ID NO: 9020766 - DNA, 22 bp, Homo sapiens
tggcagggtgggcttcagcccc

SEQ ID NO: 9020767 - DNA, 22 bp, Homo sapiens
tggcagggtgggcttcagcccc

SEQ ID NO: 9020768 - DNA, 22 bp, Homo sapiens
tggcagggtgggcttcagcccc

SEQ ID NO: 9020769 - DNA, 22 bp, Homo sapiens
tggcagggttggccaccttacc

SEQ ID NO: 9020770 - DNA, 22 bp, Homo sapiens
tggcagggttggccaccttacc

SEQ ID NO: 9020771 - DNA, 22 bp, Homo sapiens
tggcagggttggccaccttacc

SEQ ID NO: 9020772 - DNA, 22 bp, Homo sapiens
cctcagaagctcaaggacattg

SEQ ID NO: 9020773 - DNA, 22 bp, Homo sapiens
cctcagaaggacaagagacaaa

SEQ ID NO: 9020774 - DNA, 22 bp, Homo sapiens
tggcaggtacccattggctgta

SEQ ID NO: 9020775 - DNA, 22 bp, Homo sapiens
tggcagggttggccaccttacc

SEQ ID NO: 9020776 - DNA, 18 bp, Homo sapiens
cctcagaggcaaattgtt

SEQ ID NO: 9020777 - DNA, 18 bp, Homo sapiens
cctcagaggcaaattgtt

SEQ ID NO: 9020778 - DNA, 22 bp, Homo sapiens
cctcagaaggacaagagacaaa

SEQ ID NO: 9020779 - DNA, 22 bp, Homo sapiens
cctcagaaggacaagagacaaa

SEQ ID NO: 9020780 - DNA, 22 bp, Homo sapiens
cctcagaggcagatggtaagaa

SEQ ID NO: 9020781 - DNA, 22 bp, Homo sapiens
cctcagaggcagatggtaagaa

SEQ ID NO: 9020782 - DNA, 22 bp, Homo sapiens
cctcagaggcatggttagaata

SEQ ID NO: 9020783 - DNA, 23 bp, Homo sapiens
cctcagaggcctcatagtctggc

SEQ ID NO: 9020784 - DNA, 22 bp, Homo sapiens
cctcagaggttctgtgtgggaa

SEQ ID NO: 9020785 - DNA, 22 bp, Homo sapiens
cctcagaggtgtggcatctctg

SEQ ID NO: 9020786 - DNA, 22 bp, Homo sapiens
cctcagaggtgtggcatctctg

SEQ ID NO: 9020787 - DNA, 22 bp, Homo sapiens
cctcagaggtgaacatcagtgc

SEQ ID NO: 9020788 - DNA, 22 bp, Homo sapiens
cctagccttcggcctacccatc

SEQ ID NO: 9020789 - DNA, 18 bp, Homo sapiens
cctaggaaagggaggcaa

SEQ ID NO: 9020790 - DNA, 21 bp, Homo sapiens
cctagcctcttacccagcttt

SEQ ID NO: 9020791 - DNA, 18 bp, Homo sapiens
cctagcctccaagctcat

SEQ ID NO: 9020792 - DNA, 22 bp, Homo sapiens
cctagccccagatatctcacac

SEQ ID NO: 9020793 - DNA, 22 bp, Homo sapiens
cctagagtgattgagagcatca

SEQ ID NO: 9020794 - DNA, 19 bp, Homo sapiens
cctagagggaaggcaggac

SEQ ID NO: 9020795 - DNA, 22 bp, Homo sapiens
cctagatgggatggcggccggg

SEQ ID NO: 9020796 - DNA, 22 bp, Homo sapiens
cctagcaataaagatatcattt

SEQ ID NO: 9020797 - DNA, 22 bp, Homo sapiens
cctagcagaagctgcaatgcct

SEQ ID NO: 9020798 - DNA, 22 bp, Homo sapiens
cctagcagggaagcagtgagga

SEQ ID NO: 9020799 - DNA, 22 bp, Homo sapiens
cctagcagggaagcagtgagga

SEQ ID NO: 9020800 - DNA, 22 bp, Homo sapiens
cctagcagggagaggatacctg

SEQ ID NO: 9020801 - DNA, 22 bp, Homo sapiens
cctagcagggagaggatacctg

SEQ ID NO: 9020802 - DNA, 22 bp, Homo sapiens
cctagactagaggcagggagcc

SEQ ID NO: 9020803 - DNA, 22 bp, Homo sapiens
cctagactagaggcagggagcc

SEQ ID NO: 9020804 - DNA, 18 bp, Homo sapiens
cctagagcagatggaagt

SEQ ID NO: 9020805 - DNA, 22 bp, Homo sapiens
cctagactagaggcagggagcc

SEQ ID NO: 9020806 - DNA, 18 bp, Homo sapiens
cctaagctccagccccag

SEQ ID NO: 9020807 - DNA, 22 bp, Homo sapiens
cctagagccgcacctcctccac

SEQ ID NO: 9020808 - DNA, 18 bp, Homo sapiens
cctagagcagatgggagt

SEQ ID NO: 9020809 - DNA, 18 bp, Homo sapiens
cctagagcagatgggagt

SEQ ID NO: 9020810 - DNA, 22 bp, Homo sapiens
cctagagctctgctttatctaa

SEQ ID NO: 9020811 - DNA, 22 bp, Homo sapiens
cctagaggctgcaaggagaggc

SEQ ID NO: 9020812 - DNA, 22 bp, Homo sapiens
cctagaggctgcaaggagaggc

SEQ ID NO: 9020813 - DNA, 22 bp, Homo sapiens
cctagagctctgctttatctaa

SEQ ID NO: 9020814 - DNA, 19 bp, Homo sapiens
cctagagcagtacctggta

SEQ ID NO: 9020815 - DNA, 22 bp, Homo sapiens
tggcagaggagaattaagatta

SEQ ID NO: 9020816 - DNA, 22 bp, Homo sapiens
tggcagaggagaattaagatta

SEQ ID NO: 9020817 - DNA, 22 bp, Homo sapiens
tggcagaggagaattaagatta

SEQ ID NO: 9020818 - DNA, 22 bp, Homo sapiens
tggcagaggaggctcagattga

SEQ ID NO: 9020819 - DNA, 22 bp, Homo sapiens
tggcagaggaggctcagattga

SEQ ID NO: 9020820 - DNA, 19 bp, Homo sapiens
tggcagaggcagtttgtac

SEQ ID NO: 9020821 - DNA, 19 bp, Homo sapiens
tggcagaggcagtttgtac

SEQ ID NO: 9020822 - DNA, 19 bp, Homo sapiens
tggcagaggcagtttgtac

SEQ ID NO: 9020823 - DNA, 22 bp, Homo sapiens
tggcagaggctctgtgatgttg

SEQ ID NO: 9020824 - DNA, 22 bp, Homo sapiens
tggcagaggctctgtgatgttg

SEQ ID NO: 9020825 - DNA, 22 bp, Homo sapiens
tggcagaggtaattcaaatccc

SEQ ID NO: 9020826 - DNA, 22 bp, Homo sapiens
tggcagaggctctgtgatgttg

SEQ ID NO: 9020827 - DNA, 22 bp, Homo sapiens
tggcagaggctctgtgatgttg

SEQ ID NO: 9020828 - DNA, 22 bp, Homo sapiens
cctaagaattaatgaatacacc

SEQ ID NO: 9020829 - DNA, 22 bp, Homo sapiens
cctaagaattaatgaatacacc

SEQ ID NO: 9020830 - DNA, 22 bp, Homo sapiens
cctaagagattattgctcctgc

SEQ ID NO: 9020831 - DNA, 22 bp, Homo sapiens
tggcagaggtaattcaaatccc

SEQ ID NO: 9020832 - DNA, 22 bp, Homo sapiens
tggcagaggtaattcaaatccc

SEQ ID NO: 9020833 - DNA, 22 bp, Homo sapiens
tgccttagggtacctggtgctt

SEQ ID NO: 9020834 - DNA, 23 bp, Homo sapiens
tgccttagttagcacatttctaa

SEQ ID NO: 9020835 - DNA, 20 bp, Homo sapiens
tgccttagagataaaggctt

SEQ ID NO: 9020836 - DNA, 22 bp, Homo sapiens
tgccttagagcactcaagagtg

SEQ ID NO: 9020837 - DNA, 22 bp, Homo sapiens
tgccttagaggatagtgaagcc

SEQ ID NO: 9020838 - DNA, 22 bp, Homo sapiens
tgccttcaatcaggatggtctc

SEQ ID NO: 9020839 - DNA, 22 bp, Homo sapiens
tgccttcaagacccatcctcca

SEQ ID NO: 9020840 - DNA, 22 bp, Homo sapiens
tgccttcaccaggccttcagcc

SEQ ID NO: 9020841 - DNA, 22 bp, Homo sapiens
tgccttcaatcaggatggtctc

SEQ ID NO: 9020842 - DNA, 22 bp, Homo sapiens
tgcctgttgcccacctgataaa

SEQ ID NO: 9020843 - DNA, 22 bp, Homo sapiens
tgcctgttgcccacctgataaa

SEQ ID NO: 9020844 - DNA, 22 bp, Homo sapiens
tgcctgttgcccacctgataaa

SEQ ID NO: 9020845 - DNA, 22 bp, Homo sapiens
tgcctgttgcccacctgataaa

SEQ ID NO: 9020846 - DNA, 22 bp, Homo sapiens
tgccttcctggagctgaaggct

SEQ ID NO: 9020847 - DNA, 22 bp, Homo sapiens
tgccttcctggagctgaaggct

SEQ ID NO: 9020848 - DNA, 22 bp, Homo sapiens
tgccttcatccatgttatagtg

SEQ ID NO: 9020849 - DNA, 22 bp, Homo sapiens
tgccttcctaatggtggggttt

SEQ ID NO: 9020850 - DNA, 22 bp, Homo sapiens
tgccttcactgagcttatggga

SEQ ID NO: 9020851 - DNA, 22 bp, Homo sapiens
tgccttcatccatgttatagtg

SEQ ID NO: 9020852 - DNA, 22 bp, Homo sapiens
tgccttcactgagcttatggga

SEQ ID NO: 9020853 - DNA, 22 bp, Homo sapiens
tgcctgtgttgattactttgtc

SEQ ID NO: 9020854 - DNA, 22 bp, Homo sapiens
tgcctgtgtggtctgcgcatta

SEQ ID NO: 9020855 - DNA, 22 bp, Homo sapiens
tgcctgtgtggtctgcgcatta

SEQ ID NO: 9020856 - DNA, 22 bp, Homo sapiens
tgcctgtgtggggtctgccgcc

SEQ ID NO: 9020857 - DNA, 17 bp, Homo sapiens
cccagggaccactgctt

SEQ ID NO: 9020858 - DNA, 17 bp, Homo sapiens
cccagggaccactgctt

SEQ ID NO: 9020859 - DNA, 22 bp, Homo sapiens
tgcctgtgtgaccacgggcaag

SEQ ID NO: 9020860 - DNA, 17 bp, Homo sapiens
cccagggaccactgctt

SEQ ID NO: 9020861 - DNA, 22 bp, Homo sapiens
tgcctgtgtggggtctgccgcc

SEQ ID NO: 9020862 - DNA, 22 bp, Homo sapiens
tgcctgtgtgaccacgggcaag

SEQ ID NO: 9020863 - DNA, 22 bp, Homo sapiens
cccagggacagatgggcagcta

SEQ ID NO: 9020864 - DNA, 22 bp, Homo sapiens
cccagggacagatgggcagcta

SEQ ID NO: 9020865 - DNA, 22 bp, Homo sapiens
cccagggacagatgggcagcta

SEQ ID NO: 9020866 - DNA, 22 bp, Homo sapiens
cccagggacagatgggcagcta

SEQ ID NO: 9020867 - DNA, 17 bp, Homo sapiens
cccagggaccactgctt

SEQ ID NO: 9020868 - DNA, 22 bp, Homo sapiens
cccagggacagatgggcagcta

SEQ ID NO: 9020869 - DNA, 22 bp, Homo sapiens
cccaggggttcaaggctgcagt

SEQ ID NO: 9020870 - DNA, 22 bp, Homo sapiens
cccaggggttcaaggctgcagt

SEQ ID NO: 9020871 - DNA, 22 bp, Homo sapiens
cccaggggttcaaggctgcagt

SEQ ID NO: 9020872 - DNA, 22 bp, Homo sapiens
cccaggggttcaaggctgcagt

SEQ ID NO: 9020873 - DNA, 22 bp, Homo sapiens
cccaggggttcaaggctgcagt

SEQ ID NO: 9020874 - DNA, 22 bp, Homo sapiens
cccaggggttcaaggctgcagt

SEQ ID NO: 9020875 - DNA, 22 bp, Homo sapiens
cccaggggttctagaccagctt

SEQ ID NO: 9020876 - DNA, 22 bp, Homo sapiens
cccaggggttctagaccagctt

SEQ ID NO: 9020877 - DNA, 22 bp, Homo sapiens
cccaggggttctagaccagctt

SEQ ID NO: 9020878 - DNA, 22 bp, Homo sapiens
cccaggggttctagaccagctt

SEQ ID NO: 9020879 - DNA, 22 bp, Homo sapiens
cccaggggttctagaccagctt

SEQ ID NO: 9020880 - DNA, 22 bp, Homo sapiens
cccaggggttcaaggctgcagt

SEQ ID NO: 9020881 - DNA, 20 bp, Homo sapiens
cccaggggttgtggtgagga

SEQ ID NO: 9020882 - DNA, 20 bp, Homo sapiens
cccaggggttgtggtgagga

SEQ ID NO: 9020883 - DNA, 20 bp, Homo sapiens
cccaggggttgtggtgagga

SEQ ID NO: 9020884 - DNA, 22 bp, Homo sapiens
cccaggggttctgagcagcagc

SEQ ID NO: 9020885 - DNA, 22 bp, Homo sapiens
cccaggggttctgagcagcagc

SEQ ID NO: 9020886 - DNA, 22 bp, Homo sapiens
cccaggggttctgagcagcagc

SEQ ID NO: 9020887 - DNA, 22 bp, Homo sapiens
cccaggggttctgagcagcagc

SEQ ID NO: 9020888 - DNA, 20 bp, Homo sapiens
cccaggggttgtggtgagga

SEQ ID NO: 9020889 - DNA, 20 bp, Homo sapiens
cccaggggttgtggtgagga

SEQ ID NO: 9020890 - DNA, 20 bp, Homo sapiens
cccaggggttgtggtgagga

SEQ ID NO: 9020891 - DNA, 22 bp, Homo sapiens
cccagggtagctgagctggcag

SEQ ID NO: 9020892 - DNA, 22 bp, Homo sapiens
cccagggtaatcatgtgaagcc

SEQ ID NO: 9020893 - DNA, 20 bp, Homo sapiens
cccaggggttgtggtgagga

SEQ ID NO: 9020894 - DNA, 23 bp, Homo sapiens
cccaggtagccctctagagcctg

SEQ ID NO: 9020895 - DNA, 22 bp, Homo sapiens
cccagggtggatgcaagcagca

SEQ ID NO: 9020896 - DNA, 22 bp, Homo sapiens
cccagggtggatgcaagcagca

SEQ ID NO: 9020897 - DNA, 22 bp, Homo sapiens
cccagggtccctgctctctgtg

SEQ ID NO: 9020898 - DNA, 22 bp, Homo sapiens
cccagggtgcggccctggctgg

SEQ ID NO: 9020899 - DNA, 22 bp, Homo sapiens
cccagggtgcggccctggctgg

SEQ ID NO: 9020900 - DNA, 22 bp, Homo sapiens
cccagggtgctaattaaatatg

SEQ ID NO: 9020901 - DNA, 22 bp, Homo sapiens
cccagggtccctgctctctgtg

SEQ ID NO: 9020902 - DNA, 22 bp, Homo sapiens
cccagggtagctgagctggcag

SEQ ID NO: 9020903 - DNA, 23 bp, Homo sapiens
cccagggacacgatgacacctcc

SEQ ID NO: 9020904 - DNA, 23 bp, Homo sapiens
cccagggacacgatgacacctcc

SEQ ID NO: 9020905 - DNA, 22 bp, Homo sapiens
cccagggaatgactctggcctt

SEQ ID NO: 9020906 - DNA, 22 bp, Homo sapiens
cccagggaatgactctggcctt

SEQ ID NO: 9020907 - DNA, 22 bp, Homo sapiens
cccagggaagggctacctgagg

SEQ ID NO: 9020908 - DNA, 22 bp, Homo sapiens
cccagggaaggcagatggagga

SEQ ID NO: 9020909 - DNA, 22 bp, Homo sapiens
cccaggctggtcctgaactcct

SEQ ID NO: 9020910 - DNA, 22 bp, Homo sapiens
cccaggctggtcctgaactcct

SEQ ID NO: 9020911 - DNA, 22 bp, Homo sapiens
cccaggctggtcctgaactcct

SEQ ID NO: 9020912 - DNA, 22 bp, Homo sapiens
cccaggctggtcctgaactcct

SEQ ID NO: 9020913 - DNA, 22 bp, Homo sapiens
cccaggctggtcctgaactcct

SEQ ID NO: 9020914 - DNA, 21 bp, Homo sapiens
cccagggaagccgcagtcacc

SEQ ID NO: 9020915 - DNA, 22 bp, Homo sapiens
cccaggctggggctcctccagc

SEQ ID NO: 9020916 - DNA, 22 bp, Homo sapiens
cccaggctggggctcctccagc

SEQ ID NO: 9020917 - DNA, 22 bp, Homo sapiens
cccaggctggggctcctccagc

SEQ ID NO: 9020918 - DNA, 22 bp, Homo sapiens
cccaggctgggaacgattctag

SEQ ID NO: 9020919 - DNA, 22 bp, Homo sapiens
cccaggctgggaacgattctag

SEQ ID NO: 9020920 - DNA, 22 bp, Homo sapiens
cccaggctgggaacgattctag

SEQ ID NO: 9020921 - DNA, 22 bp, Homo sapiens
cccaggctggcctccgcagtgc

SEQ ID NO: 9020922 - DNA, 22 bp, Homo sapiens
cccaggctggcctccgcagtgc

SEQ ID NO: 9020923 - DNA, 22 bp, Homo sapiens
cccaggctggcactgctgaagt

SEQ ID NO: 9020924 - DNA, 22 bp, Homo sapiens
cccaggctggcactgctgaagt

SEQ ID NO: 9020925 - DNA, 22 bp, Homo sapiens
cccaggctggcactgctgaagt

SEQ ID NO: 9020926 - DNA, 22 bp, Homo sapiens
cccaggctggatttcggtggca

SEQ ID NO: 9020927 - DNA, 22 bp, Homo sapiens
cccaggctggatttcggtggca

SEQ ID NO: 9020928 - DNA, 22 bp, Homo sapiens
cccaggctggatttcggtggca

SEQ ID NO: 9020929 - DNA, 22 bp, Homo sapiens
cccaggctggatttcggtggca

SEQ ID NO: 9020930 - DNA, 22 bp, Homo sapiens
cccaggctggatttcggtggca

SEQ ID NO: 9020931 - DNA, 22 bp, Homo sapiens
cccaggctggagtgtaatggtg

SEQ ID NO: 9020932 - DNA, 22 bp, Homo sapiens
cccaggctggagtgtaatggtg

SEQ ID NO: 9020933 - DNA, 22 bp, Homo sapiens
tgccctggtatcatgtggaatt

SEQ ID NO: 9020934 - DNA, 22 bp, Homo sapiens
tgccctggtatcatgtggaatt

SEQ ID NO: 9020935 - DNA, 22 bp, Homo sapiens
tgccctggtagacacagactgt

SEQ ID NO: 9020936 - DNA, 22 bp, Homo sapiens
tgccctggtatcatgtggaatt

SEQ ID NO: 9020937 - DNA, 22 bp, Homo sapiens
tgccctggtgaagtgctctcct

SEQ ID NO: 9020938 - DNA, 22 bp, Homo sapiens
tgccctggtagacacagactgt

SEQ ID NO: 9020939 - DNA, 22 bp, Homo sapiens
tgccctggttacactggagtcc

SEQ ID NO: 9020940 - DNA, 22 bp, Homo sapiens
tgccctggttacactggagtcc

SEQ ID NO: 9020941 - DNA, 22 bp, Homo sapiens
tgccctggttacactggagtcc

SEQ ID NO: 9020942 - DNA, 22 bp, Homo sapiens
tgccctggtgaagtgctctcct

SEQ ID NO: 9020943 - DNA, 22 bp, Homo sapiens
tgccctggtgaagtgctctcct

SEQ ID NO: 9020944 - DNA, 22 bp, Homo sapiens
cccaggctggagggcagtgtca

SEQ ID NO: 9020945 - DNA, 22 bp, Homo sapiens
cccaggctggagggcagtgtca

SEQ ID NO: 9020946 - DNA, 22 bp, Homo sapiens
cccaggctggaattccaggcct

SEQ ID NO: 9020947 - DNA, 22 bp, Homo sapiens
tgccctggttacactggagtcc

SEQ ID NO: 9020948 - DNA, 22 bp, Homo sapiens
cccaggctgagttagaggtgtc

SEQ ID NO: 9020949 - DNA, 22 bp, Homo sapiens
cccaggctgagttagaggtgtc

SEQ ID NO: 9020950 - DNA, 22 bp, Homo sapiens
cccaggctgagttagaggtgtc

SEQ ID NO: 9020951 - DNA, 22 bp, Homo sapiens
cccaggctgagttagaggtgtc

SEQ ID NO: 9020952 - DNA, 22 bp, Homo sapiens
cccaggctggaattccaggcct

SEQ ID NO: 9020953 - DNA, 22 bp, Homo sapiens
cccaggctggagtgcaatggca

SEQ ID NO: 9020954 - DNA, 22 bp, Homo sapiens
cccaggctggagtgcaatggca

SEQ ID NO: 9020955 - DNA, 22 bp, Homo sapiens
cccaggctggagggcagtgtca

SEQ ID NO: 9020956 - DNA, 22 bp, Homo sapiens
cccaggctggagggcagtgtca

SEQ ID NO: 9020957 - DNA, 22 bp, Homo sapiens
cccaggctggagtgcaatggtg

SEQ ID NO: 9020958 - DNA, 22 bp, Homo sapiens
cccaggctggagtgcaatggca

SEQ ID NO: 9020959 - DNA, 22 bp, Homo sapiens
cccaggctggagtgcagtggcg

SEQ ID NO: 9020960 - DNA, 22 bp, Homo sapiens
cccaggctggagtgcagtggcg

SEQ ID NO: 9020961 - DNA, 22 bp, Homo sapiens
cccaggctggagtgcagtggcg

SEQ ID NO: 9020962 - DNA, 22 bp, Homo sapiens
cccaggctggagtgcagtggcg

SEQ ID NO: 9020963 - DNA, 22 bp, Homo sapiens
cccaggctggagtgcagtggcg

SEQ ID NO: 9020964 - DNA, 22 bp, Homo sapiens
cccaggctggagtgcagtggcg

SEQ ID NO: 9020965 - DNA, 22 bp, Homo sapiens
cccaggctggagtgcagtggcg

SEQ ID NO: 9020966 - DNA, 22 bp, Homo sapiens
cccaggctggagtgcaatggtg

SEQ ID NO: 9020967 - DNA, 22 bp, Homo sapiens
cccaggctggagtgcaatggtg

SEQ ID NO: 9020968 - DNA, 22 bp, Homo sapiens
tgccagtctcaccctgggtcct

SEQ ID NO: 9020969 - DNA, 22 bp, Homo sapiens
tgccagtctcaccctgggtcct

SEQ ID NO: 9020970 - DNA, 22 bp, Homo sapiens
tgccagtctcaccctgggtcct

SEQ ID NO: 9020971 - DNA, 22 bp, Homo sapiens
tgccaggctaagtggaggactt

SEQ ID NO: 9020972 - DNA, 22 bp, Homo sapiens
cccaggagataacgttcccaag

SEQ ID NO: 9020973 - DNA, 22 bp, Homo sapiens
cccaggagataacgttcccaag

SEQ ID NO: 9020974 - DNA, 22 bp, Homo sapiens
cccaggagataacgttcccaag

SEQ ID NO: 9020975 - DNA, 22 bp, Homo sapiens
tgccagtgggtgtgcagagact

SEQ ID NO: 9020976 - DNA, 22 bp, Homo sapiens
tgccagtgcttgtgtctgagca

SEQ ID NO: 9020977 - DNA, 22 bp, Homo sapiens
tgccagtgagccctgggatgtg

SEQ ID NO: 9020978 - DNA, 22 bp, Homo sapiens
tgccagtgagccctgggatgtg

SEQ ID NO: 9020979 - DNA, 22 bp, Homo sapiens
tgccagtgcctgctgcccaata

SEQ ID NO: 9020980 - DNA, 22 bp, Homo sapiens
tgccagtgaaacgtggtctcat

SEQ ID NO: 9020981 - DNA, 22 bp, Homo sapiens
tgccagtgaaacatggaagaat

SEQ ID NO: 9020982 - DNA, 22 bp, Homo sapiens
tgccagtgaaacatggaagaat

SEQ ID NO: 9020983 - DNA, 22 bp, Homo sapiens
cccaggagagaggccagttggc

SEQ ID NO: 9020984 - DNA, 22 bp, Homo sapiens
cccaggagagaggccagttggc

SEQ ID NO: 9020985 - DNA, 22 bp, Homo sapiens
cccaggagagaggccagttggc

SEQ ID NO: 9020986 - DNA, 22 bp, Homo sapiens
cccaggagagagacttgaatct

SEQ ID NO: 9020987 - DNA, 22 bp, Homo sapiens
cccaggagagaggccagttggc

SEQ ID NO: 9020988 - DNA, 22 bp, Homo sapiens
cccaggagagaggccagttggc

SEQ ID NO: 9020989 - DNA, 22 bp, Homo sapiens
cccaggagagaggccagttggc

SEQ ID NO: 9020990 - DNA, 22 bp, Homo sapiens
cccaggagagaggggataaagc

SEQ ID NO: 9020991 - DNA, 22 bp, Homo sapiens
cccaggagagaggggataaagc

SEQ ID NO: 9020992 - DNA, 22 bp, Homo sapiens
cccaggagagaggggataaagc

SEQ ID NO: 9020993 - DNA, 22 bp, Homo sapiens
cccaggagagggaaccaaatgt

SEQ ID NO: 9020994 - DNA, 22 bp, Homo sapiens
cccaggagagggaaccaaatgt

SEQ ID NO: 9020995 - DNA, 22 bp, Homo sapiens
cccaggagactgagctgtaacc

SEQ ID NO: 9020996 - DNA, 22 bp, Homo sapiens
cccaggagacctgtgaaaggac

SEQ ID NO: 9020997 - DNA, 22 bp, Homo sapiens
cccaggagactgagctgtaacc

SEQ ID NO: 9020998 - DNA, 22 bp, Homo sapiens
cccaggagagagacttgaatct

SEQ ID NO: 9020999 - DNA, 22 bp, Homo sapiens
cccaggagagagacttgaatct

SEQ ID NO: 9021000 - DNA, 22 bp, Homo sapiens
cccaggagagagacttgaatct

SEQ ID NO: 9021001 - DNA, 22 bp, Homo sapiens
cccaggagagagacttgaatct

SEQ ID NO: 9021002 - DNA, 22 bp, Homo sapiens
cccaggagacctagatctgttt

SEQ ID NO: 9021003 - DNA, 22 bp, Homo sapiens
cccaggagacctagatctgttt

SEQ ID NO: 9021004 - DNA, 22 bp, Homo sapiens
cccaggagacctagatctgttt

SEQ ID NO: 9021005 - DNA, 22 bp, Homo sapiens
cccaggagacctgtgaaaggac

SEQ ID NO: 9021006 - DNA, 22 bp, Homo sapiens
cccaggagacctgtgaaaggac

SEQ ID NO: 9021007 - DNA, 22 bp, Homo sapiens
cccaggagacctgtgaaaggac

SEQ ID NO: 9021008 - DNA, 22 bp, Homo sapiens
cccaggagacctgtgaaaggac

SEQ ID NO: 9021009 - DNA, 22 bp, Homo sapiens
tgccaggatataagagtgcgat

SEQ ID NO: 9021010 - DNA, 22 bp, Homo sapiens
tgccaggatataagagtgcgat

SEQ ID NO: 9021011 - DNA, 22 bp, Homo sapiens
tgccaggatataagagtgcgat

SEQ ID NO: 9021012 - DNA, 22 bp, Homo sapiens
tgccaggagtgtagagtggttt

SEQ ID NO: 9021013 - DNA, 22 bp, Homo sapiens
tgccaggagtgtagagtggttt

SEQ ID NO: 9021014 - DNA, 22 bp, Homo sapiens
tgccaggagtcaggccaggcag

SEQ ID NO: 9021015 - DNA, 22 bp, Homo sapiens
tgccaggagtcaggccaggcag

SEQ ID NO: 9021016 - DNA, 22 bp, Homo sapiens
tgccaggaggggacacctcctc

SEQ ID NO: 9021017 - DNA, 22 bp, Homo sapiens
cccaggagacatatagaaggac

SEQ ID NO: 9021018 - DNA, 22 bp, Homo sapiens
cccaggagacctagatctgttt

SEQ ID NO: 9021019 - DNA, 22 bp, Homo sapiens
cccaggagacctagatctgttt

SEQ ID NO: 9021020 - DNA, 22 bp, Homo sapiens
cccaggagacctagatctgttt

SEQ ID NO: 9021021 - DNA, 22 bp, Homo sapiens
cccaggagacatatagaaggac

SEQ ID NO: 9021022 - DNA, 22 bp, Homo sapiens
cccaggagacatatagaaggac

SEQ ID NO: 9021023 - DNA, 22 bp, Homo sapiens
cccaggagacatatagaaggac

SEQ ID NO: 9021024 - DNA, 22 bp, Homo sapiens
tgccagctcctgcagctcctgt

SEQ ID NO: 9021025 - DNA, 22 bp, Homo sapiens
tgccagctccgaggagctgcag

SEQ ID NO: 9021026 - DNA, 22 bp, Homo sapiens
tgccagctcctgcagctcctgt

SEQ ID NO: 9021027 - DNA, 22 bp, Homo sapiens
tgccagctccgaggagctgcag

SEQ ID NO: 9021028 - DNA, 22 bp, Homo sapiens
tgccagctcccttttctcctcc

SEQ ID NO: 9021029 - DNA, 22 bp, Homo sapiens
tgccagctccgaggagctgcag

SEQ ID NO: 9021030 - DNA, 22 bp, Homo sapiens
tgccagctcccttttctcctcc

SEQ ID NO: 9021031 - DNA, 19 bp, Homo sapiens
tgccacagataaaaactga

SEQ ID NO: 9021032 - DNA, 22 bp, Homo sapiens
tgcacagatctggtggcaagga

SEQ ID NO: 9021033 - DNA, 22 bp, Homo sapiens
tgccacagaggtgaagcccact

SEQ ID NO: 9021034 - DNA, 22 bp, Homo sapiens
tgccacagaggtgaagcccact

SEQ ID NO: 9021035 - DNA, 22 bp, Homo sapiens
tgcacagagggaggcataaaat

SEQ ID NO: 9021036 - DNA, 22 bp, Homo sapiens
tgcacagagggaggcataaaat

SEQ ID NO: 9021037 - DNA, 22 bp, Homo sapiens
tgcacagatagtgatagatagc

SEQ ID NO: 9021038 - DNA, 22 bp, Homo sapiens
tgcacagatagtgatagatagc

SEQ ID NO: 9021039 - DNA, 22 bp, Homo sapiens
tgcacagacatacacatatatg

SEQ ID NO: 9021040 - DNA, 22 bp, Homo sapiens
tgcacagacatacacatatatg

SEQ ID NO: 9021041 - DNA, 22 bp, Homo sapiens
tgcacagagagatgagacacgt

SEQ ID NO: 9021042 - DNA, 22 bp, Homo sapiens
tgcacagagagatgagacacgt

SEQ ID NO: 9021043 - DNA, 22 bp, Homo sapiens
tgccaggaggaggtgggacaga

SEQ ID NO: 9021044 - DNA, 22 bp, Homo sapiens
tgccaggaggaggtgggacaga

SEQ ID NO: 9021045 - DNA, 22 bp, Homo sapiens
tgccaggaggcggcttgggaaa

SEQ ID NO: 9021046 - DNA, 22 bp, Homo sapiens
tgccaggacaaggaccacatgg

SEQ ID NO: 9021047 - DNA, 22 bp, Homo sapiens
tgccaggagagtgcatgcaggg

SEQ ID NO: 9021048 - DNA, 22 bp, Homo sapiens
tgccaggagagtgcatgcaggg

SEQ ID NO: 9021049 - DNA, 22 bp, Homo sapiens
tgccaggaacctgttcttgttc

SEQ ID NO: 9021050 - DNA, 22 bp, Homo sapiens
tgccaggaaactgtatatcttg

SEQ ID NO: 9021051 - DNA, 22 bp, Homo sapiens
tgccaggaagtgtgtgggcctg

SEQ ID NO: 9021052 - DNA, 22 bp, Homo sapiens
tgccaggaagtgtgtgggcctg

SEQ ID NO: 9021053 - DNA, 22 bp, Homo sapiens
tgccaggaagtgtgtgggcctg

SEQ ID NO: 9021054 - DNA, 19 bp, Homo sapiens
tgccaggaatactccagaa

SEQ ID NO: 9021055 - DNA, 19 bp, Homo sapiens
tgccaggaatactccagaa

SEQ ID NO: 9021056 - DNA, 19 bp, Homo sapiens
tgccaggaatactccagaa

SEQ ID NO: 9021057 - DNA, 22 bp, Homo sapiens
tgccaggacaaggaccacatgg

SEQ ID NO: 9021058 - DNA, 22 bp, Homo sapiens
tgccaggacaaggaccacatgg

SEQ ID NO: 9021059 - DNA, 22 bp, Homo sapiens
tgccaggacaaggaccacatgg

SEQ ID NO: 9021060 - DNA, 21 bp, Homo sapiens
tgccagctgctgcatctgtct

SEQ ID NO: 9021061 - DNA, 22 bp, Homo sapiens
tgccagctgcttgtcccccaca

SEQ ID NO: 9021062 - DNA, 22 bp, Homo sapiens
tgccagctgcttgtcccccaca

SEQ ID NO: 9021063 - DNA, 22 bp, Homo sapiens
tgccagctgttcccacccaaaa

SEQ ID NO: 9021064 - DNA, 22 bp, Homo sapiens
tgccagcttctaaggacccagg

SEQ ID NO: 9021065 - DNA, 22 bp, Homo sapiens
tgccagctgttcccacccaaaa

SEQ ID NO: 9021066 - DNA, 22 bp, Homo sapiens
tgccagctgacagcagagacaa

SEQ ID NO: 9021067 - DNA, 21 bp, Homo sapiens
tgccagctgctgcatctgtct

SEQ ID NO: 9021068 - DNA, 22 bp, Homo sapiens
tgccagctgacagcagagacaa

SEQ ID NO: 9021069 - DNA, 22 bp, Homo sapiens
tgccagcttttgactatcttag

SEQ ID NO: 9021070 - DNA, 22 bp, Homo sapiens
tgccagcttgtggtcagaggct

SEQ ID NO: 9021071 - DNA, 22 bp, Homo sapiens
tgccagcttgtggtcagaggct

SEQ ID NO: 9021072 - DNA, 22 bp, Homo sapiens
tgccagcttcttacggctgcct

SEQ ID NO: 9021073 - DNA, 22 bp, Homo sapiens
tgccagcttcttacggctgcct

SEQ ID NO: 9021074 - DNA, 22 bp, Homo sapiens
tgccagcttctaaggacccagg

SEQ ID NO: 9021075 - DNA, 22 bp, Homo sapiens
tgccctggggtctggagcagca

SEQ ID NO: 9021076 - DNA, 22 bp, Homo sapiens
tgccctggggtctggagcagca

SEQ ID NO: 9021077 - DNA, 22 bp, Homo sapiens
tgccctggggtctggagcagca

SEQ ID NO: 9021078 - DNA, 22 bp, Homo sapiens
tgccctggggtctggagcagca

SEQ ID NO: 9021079 - DNA, 22 bp, Homo sapiens
tgccctggggtctggagcagca

SEQ ID NO: 9021080 - DNA, 21 bp, Homo sapiens
tgccctggggctcttccctca

SEQ ID NO: 9021081 - DNA, 22 bp, Homo sapiens
tgccctggggagcccagccagg

SEQ ID NO: 9021082 - DNA, 22 bp, Homo sapiens
tgccctgggctttgctatgact

SEQ ID NO: 9021083 - DNA, 21 bp, Homo sapiens
tgccctggggctcttccctca

SEQ ID NO: 9021084 - DNA, 22 bp, Homo sapiens
tgccctggggagcccagccagg

SEQ ID NO: 9021085 - DNA, 22 bp, Homo sapiens
tgccctggggagcccagccagg

SEQ ID NO: 9021086 - DNA, 22 bp, Homo sapiens
tgccctgggctttgctatgact

SEQ ID NO: 9021087 - DNA, 22 bp, Homo sapiens
tgccctgggagttggagctgct

SEQ ID NO: 9021088 - DNA, 22 bp, Homo sapiens
cccaggctcccaggtgggacaa

SEQ ID NO: 9021089 - DNA, 22 bp, Homo sapiens
cccaggctcccaggtgggacaa

SEQ ID NO: 9021090 - DNA, 22 bp, Homo sapiens
cccaggctcccaggtgggacaa

SEQ ID NO: 9021091 - DNA, 22 bp, Homo sapiens
cccaggctcccaggtgggacaa

SEQ ID NO: 9021092 - DNA, 22 bp, Homo sapiens
tgccctgggagttggagctgct

SEQ ID NO: 9021093 - DNA, 22 bp, Homo sapiens
cccaggctcactgtccgcttcc

SEQ ID NO: 9021094 - DNA, 22 bp, Homo sapiens
cccaggctcactgtccgcttcc

SEQ ID NO: 9021095 - DNA, 22 bp, Homo sapiens
cccaggctcagactggcttgtt

SEQ ID NO: 9021096 - DNA, 22 bp, Homo sapiens
cccaggctcagactggcttgtt

SEQ ID NO: 9021097 - DNA, 22 bp, Homo sapiens
cccaggctcagactggcttgtt

SEQ ID NO: 9021098 - DNA, 22 bp, Homo sapiens
cccaggctcagactggcttgtt

SEQ ID NO: 9021099 - DNA, 22 bp, Homo sapiens
cccaggctcagactggcttgtt

SEQ ID NO: 9021100 - DNA, 22 bp, Homo sapiens
cccaggctcccaggtgggacaa

SEQ ID NO: 9021101 - DNA, 22 bp, Homo sapiens
cccaggctcccaggtgggacaa

SEQ ID NO: 9021102 - DNA, 22 bp, Homo sapiens
cccaggctagtatgatatcagt

SEQ ID NO: 9021103 - DNA, 22 bp, Homo sapiens
cccaggctagtatgatatcagt

SEQ ID NO: 9021104 - DNA, 22 bp, Homo sapiens
cccaggctagtatgatatcagt

SEQ ID NO: 9021105 - DNA, 19 bp, Homo sapiens
cccaggctacatggagagg

SEQ ID NO: 9021106 - DNA, 19 bp, Homo sapiens
cccaggctacatggagagg

SEQ ID NO: 9021107 - DNA, 19 bp, Homo sapiens
cccaggctacatggagagg

SEQ ID NO: 9021108 - DNA, 22 bp, Homo sapiens
cccaggctagaaaggccaacaa

SEQ ID NO: 9021109 - DNA, 22 bp, Homo sapiens
cccaggctagaaaggccaacaa

SEQ ID NO: 9021110 - DNA, 22 bp, Homo sapiens
cccaggctagaaaggccaacaa

SEQ ID NO: 9021111 - DNA, 22 bp, Homo sapiens
tgccagtgtagtagctggttta

SEQ ID NO: 9021112 - DNA, 22 bp, Homo sapiens
tgccagtgtggaactaggaaga

SEQ ID NO: 9021113 - DNA, 22 bp, Homo sapiens
tgccagtgtggaactaggaaga

SEQ ID NO: 9021114 - DNA, 22 bp, Homo sapiens
tgccagtgggtgtgcagagact

SEQ ID NO: 9021115 - DNA, 22 bp, Homo sapiens
tgccagtgcttgtgtctgagca

SEQ ID NO: 9021116 - DNA, 22 bp, Homo sapiens
tgccagtgggtgtgcagagact

SEQ ID NO: 9021117 - DNA, 22 bp, Homo sapiens
tgccagtgtggaactaggaaga

SEQ ID NO: 9021118 - DNA, 22 bp, Homo sapiens
tgccagtgtgagtggagttctt

SEQ ID NO: 9021119 - DNA, 22 bp, Homo sapiens
tgccagtgtgtgccttaagctc

SEQ ID NO: 9021120 - DNA, 22 bp, Homo sapiens
tgccagttgggaaaacagacat

SEQ ID NO: 9021121 - DNA, 22 bp, Homo sapiens
tgccatagcaatggtaagctga

SEQ ID NO: 9021122 - DNA, 22 bp, Homo sapiens
tgccatattattgagcatatta

SEQ ID NO: 9021123 - DNA, 22 bp, Homo sapiens
tgccatattgcaaagtgtctgc

SEQ ID NO: 9021124 - DNA, 22 bp, Homo sapiens
tgcccagccaatttgttatgtt

SEQ ID NO: 9021125 - DNA, 22 bp, Homo sapiens
tgccatattgatgtgctgtacc

SEQ ID NO: 9021126 - DNA, 22 bp, Homo sapiens
tgcccagccagtttatggtaat

SEQ ID NO: 9021127 - DNA, 22 bp, Homo sapiens
tgcccagccaatttgttatgtt

SEQ ID NO: 9021128 - DNA, 22 bp, Homo sapiens
tgcccagccagtttatggtaat

SEQ ID NO: 9021129 - DNA, 22 bp, Homo sapiens
tgcccagcccctatccctggga

SEQ ID NO: 9021130 - DNA, 22 bp, Homo sapiens
tgcccagccagtttatggtaat

SEQ ID NO: 9021131 - DNA, 22 bp, Homo sapiens
tgcccagcctaaacttggcaag

SEQ ID NO: 9021132 - DNA, 22 bp, Homo sapiens
tgcccagcctaaacttggcaag

SEQ ID NO: 9021133 - DNA, 22 bp, Homo sapiens
tgcccagcctaaacttggcaag

SEQ ID NO: 9021134 - DNA, 22 bp, Homo sapiens
tgcccagcctaaacttggcaag

SEQ ID NO: 9021135 - DNA, 22 bp, Homo sapiens
tgcccagcccctatccctggga

SEQ ID NO: 9021136 - DNA, 22 bp, Homo sapiens
tgcccagcctaaacttggcaag

SEQ ID NO: 9021137 - DNA, 22 bp, Homo sapiens
tgcccagcccctatccctggga

SEQ ID NO: 9021138 - DNA, 22 bp, Homo sapiens
tgcccagcccctatccctggga

SEQ ID NO: 9021139 - DNA, 22 bp, Homo sapiens
tgcccagcccctatccctggga

SEQ ID NO: 9021140 - DNA, 22 bp, Homo sapiens
tgcccagcgcccacattctgtc

SEQ ID NO: 9021141 - DNA, 22 bp, Homo sapiens
tgcccagcgcccacattctgtc

SEQ ID NO: 9021142 - DNA, 22 bp, Homo sapiens
tgcccagcgcccacattctgtc

SEQ ID NO: 9021143 - DNA, 22 bp, Homo sapiens
tgcccagcgcccacattctgtc

SEQ ID NO: 9021144 - DNA, 22 bp, Homo sapiens
tgcccagctattcctttcttag

SEQ ID NO: 9021145 - DNA, 22 bp, Homo sapiens
tgcccagctattcctttcttag

SEQ ID NO: 9021146 - DNA, 22 bp, Homo sapiens
tgcccagctattcctttcttag

SEQ ID NO: 9021147 - DNA, 22 bp, Homo sapiens
cccaggcagtgtgtgcatgcgt

SEQ ID NO: 9021148 - DNA, 22 bp, Homo sapiens
cccaggcagtgtgtgcatgcgt

SEQ ID NO: 9021149 - DNA, 22 bp, Homo sapiens
tgcccagctgtcaaagtagata

SEQ ID NO: 9021150 - DNA, 22 bp, Homo sapiens
tgcccagctgtcaaagtagata

SEQ ID NO: 9021151 - DNA, 22 bp, Homo sapiens
tgcccagctgtcaaagtagata

SEQ ID NO: 9021152 - DNA, 22 bp, Homo sapiens
cccaggcagtgtgtgcatgcgt

SEQ ID NO: 9021153 - DNA, 23 bp, Homo sapiens
cccaggctacaaattatgctctg

SEQ ID NO: 9021154 - DNA, 22 bp, Homo sapiens
cccaggcatcccattaaggagc

SEQ ID NO: 9021155 - DNA, 19 bp, Homo sapiens
cccaggctacatggagagg

SEQ ID NO: 9021156 - DNA, 19 bp, Homo sapiens
cccaggctacatggagagg

SEQ ID NO: 9021157 - DNA, 22 bp, Homo sapiens
tgctggcctgggctgcaccttg

SEQ ID NO: 9021158 - DNA, 22 bp, Homo sapiens
tgctggcctgggctgcaccttg

SEQ ID NO: 9021159 - DNA, 22 bp, Homo sapiens
tgctggcctgggctgcaccttg

SEQ ID NO: 9021160 - DNA, 22 bp, Homo sapiens
tgctggcctgggctgcaccttg

SEQ ID NO: 9021161 - DNA, 22 bp, Homo sapiens
tgctggcctggttagaaagggg

SEQ ID NO: 9021162 - DNA, 22 bp, Homo sapiens
tgctggcctgtccacgggctgt

SEQ ID NO: 9021163 - DNA, 22 bp, Homo sapiens
tgctggcctggttagaaagggg

SEQ ID NO: 9021164 - DNA, 22 bp, Homo sapiens
tgctggccctggctcagggaac

SEQ ID NO: 9021165 - DNA, 22 bp, Homo sapiens
tgctggccgtgagctctcggga

SEQ ID NO: 9021166 - DNA, 21 bp, Homo sapiens
tgctggcctcaagggtgactt

SEQ ID NO: 9021167 - DNA, 21 bp, Homo sapiens
tgctggcctcaagggtgactt

SEQ ID NO: 9021168 - DNA, 22 bp, Homo sapiens
tgctggcctcggcgctgggcct

SEQ ID NO: 9021169 - DNA, 22 bp, Homo sapiens
tgctggcctcggcgctgggcct

SEQ ID NO: 9021170 - DNA, 22 bp, Homo sapiens
tgctggcctcggcgctgggcct

SEQ ID NO: 9021171 - DNA, 22 bp, Homo sapiens
tgctggcctcggcgctgggcct

SEQ ID NO: 9021172 - DNA, 22 bp, Homo sapiens
tgctggccctggctcagggaac

SEQ ID NO: 9021173 - DNA, 22 bp, Homo sapiens
tgctggcccatgaagacgcagt

SEQ ID NO: 9021174 - DNA, 22 bp, Homo sapiens
tgctggccctggctcagggaac

SEQ ID NO: 9021175 - DNA, 22 bp, Homo sapiens
tgctggccggccaggtgctgag

SEQ ID NO: 9021176 - DNA, 22 bp, Homo sapiens
tgctggccggccaggtgctgag

SEQ ID NO: 9021177 - DNA, 22 bp, Homo sapiens
tgctggccggccaggtgctgag

SEQ ID NO: 9021178 - DNA, 22 bp, Homo sapiens
tgctggccggccaggtgctgag

SEQ ID NO: 9021179 - DNA, 21 bp, Homo sapiens
tgctggccatgtgctgggcat

SEQ ID NO: 9021180 - DNA, 22 bp, Homo sapiens
tgctggcccagtatggactgca

SEQ ID NO: 9021181 - DNA, 22 bp, Homo sapiens
tgctggcccagtatggactgca

SEQ ID NO: 9021182 - DNA, 22 bp, Homo sapiens
tgctggcccagtatggactgca

SEQ ID NO: 9021183 - DNA, 22 bp, Homo sapiens
tgctggcccagtatggactgca

SEQ ID NO: 9021184 - DNA, 22 bp, Homo sapiens
tgctggcccatgaagacgcagt

SEQ ID NO: 9021185 - DNA, 22 bp, Homo sapiens
tgctggcccatgaagacgcagt

SEQ ID NO: 9021186 - DNA, 22 bp, Homo sapiens
tgctggcttggaaggaaagcgc

SEQ ID NO: 9021187 - DNA, 22 bp, Homo sapiens
tgctggctttaaggttaaagtg

SEQ ID NO: 9021188 - DNA, 22 bp, Homo sapiens
tgctggctttagtgattggggt

SEQ ID NO: 9021189 - DNA, 22 bp, Homo sapiens
tgctggctttagtgattggggt

SEQ ID NO: 9021190 - DNA, 22 bp, Homo sapiens
tgctggctaatggaaaccagat

SEQ ID NO: 9021191 - DNA, 22 bp, Homo sapiens
tgctggctacattattgctgtc

SEQ ID NO: 9021192 - DNA, 22 bp, Homo sapiens
tgctggcctgtccacgggctgt

SEQ ID NO: 9021193 - DNA, 22 bp, Homo sapiens
tgctggcctgtccacgggctgt

SEQ ID NO: 9021194 - DNA, 23 bp, Homo sapiens
tgctggctaagaatctgcatttt

SEQ ID NO: 9021195 - DNA, 23 bp, Homo sapiens
tgctggctaagaatctgcatttt

SEQ ID NO: 9021196 - DNA, 22 bp, Homo sapiens
tgctggcctgtccacgggctgt

SEQ ID NO: 9021197 - DNA, 22 bp, Homo sapiens
tgctggctttgcgagatgcatt

SEQ ID NO: 9021198 - DNA, 22 bp, Homo sapiens
tgctggctttctgtccctggca

SEQ ID NO: 9021199 - DNA, 22 bp, Homo sapiens
tgctggctttctgtccctggca

SEQ ID NO: 9021200 - DNA, 22 bp, Homo sapiens
tgctggctttctgtccctggca

SEQ ID NO: 9021201 - DNA, 22 bp, Homo sapiens
tgctggcttttccttcaggcag

SEQ ID NO: 9021202 - DNA, 23 bp, Homo sapiens
tgctggcttttatctggtcccta

SEQ ID NO: 9021203 - DNA, 22 bp, Homo sapiens
tgctggcttttccttcaggcag

SEQ ID NO: 9021204 - DNA, 22 bp, Homo sapiens
tgctggctttgcgagatgcatt

SEQ ID NO: 9021205 - DNA, 22 bp, Homo sapiens
tgctggctttgcgagatgcatt

SEQ ID NO: 9021206 - DNA, 23 bp, Homo sapiens
tgctggcttttatctggtcccta

SEQ ID NO: 9021207 - DNA, 23 bp, Homo sapiens
tgctggcttttatctggtcccta

SEQ ID NO: 9021208 - DNA, 22 bp, Homo sapiens
cccgagggccgaaagctgcttt

SEQ ID NO: 9021209 - DNA, 22 bp, Homo sapiens
cccgagggccgaaagctgcttt

SEQ ID NO: 9021210 - DNA, 22 bp, Homo sapiens
cccgagtgtctactcactccca

SEQ ID NO: 9021211 - DNA, 18 bp, Homo sapiens
cccggctaatttttggta

SEQ ID NO: 9021212 - DNA, 22 bp, Homo sapiens
cccgctccttacctgtccaacc

SEQ ID NO: 9021213 - DNA, 22 bp, Homo sapiens
cccgctccttacctgtccaacc

SEQ ID NO: 9021214 - DNA, 21 bp, Homo sapiens
cccgcacagcggtaggccgcc

SEQ ID NO: 9021215 - DNA, 21 bp, Homo sapiens
cccgcacagcggtaggccgcc

SEQ ID NO: 9021216 - DNA, 22 bp, Homo sapiens
ccccttctggtcttcaatggtg

SEQ ID NO: 9021217 - DNA, 22 bp, Homo sapiens
ccccttctctgcaagcctgctc

SEQ ID NO: 9021218 - DNA, 22 bp, Homo sapiens
ccccttctctgcaagcctgctc

SEQ ID NO: 9021219 - DNA, 22 bp, Homo sapiens
ccccttctgtgtcctgtcagcc

SEQ ID NO: 9021220 - DNA, 22 bp, Homo sapiens
ccccttctgtgtcctgtcagcc

SEQ ID NO: 9021221 - DNA, 22 bp, Homo sapiens
ccccttctgtgtcctgtcagcc

SEQ ID NO: 9021222 - DNA, 22 bp, Homo sapiens
ccccttctgtgtcctgtcagcc

SEQ ID NO: 9021223 - DNA, 22 bp, Homo sapiens
ccccttctgtgtcctgtcagcc

SEQ ID NO: 9021224 - DNA, 22 bp, Homo sapiens
ccccttgaggggaatggctgga

SEQ ID NO: 9021225 - DNA, 22 bp, Homo sapiens
ccccttgacctgtgatagcttc

SEQ ID NO: 9021226 - DNA, 19 bp, Homo sapiens
ccccttgtgtaactagcct

SEQ ID NO: 9021227 - DNA, 22 bp, Homo sapiens
cccctcttgtactagacagttt

SEQ ID NO: 9021228 - DNA, 22 bp, Homo sapiens
cccctcttgtactagacagttt

SEQ ID NO: 9021229 - DNA, 22 bp, Homo sapiens
ccccttccaggaagcagaatcg

SEQ ID NO: 9021230 - DNA, 22 bp, Homo sapiens
cccctcttggcattgagtgcca

SEQ ID NO: 9021231 - DNA, 22 bp, Homo sapiens
ccccttccttcctcagacagcc

SEQ ID NO: 9021232 - DNA, 22 bp, Homo sapiens
cccctcttgtgggctcaggtca

SEQ ID NO: 9021233 - DNA, 22 bp, Homo sapiens
ccccttccttcctcagacagcc

SEQ ID NO: 9021234 - DNA, 22 bp, Homo sapiens
ccccttccttcctcagacagcc

SEQ ID NO: 9021235 - DNA, 22 bp, Homo sapiens
tgctgggatatagcttctaggg

SEQ ID NO: 9021236 - DNA, 22 bp, Homo sapiens
tgctgggatatagcttctaggg

SEQ ID NO: 9021237 - DNA, 22 bp, Homo sapiens
tgctgggcacacagtaggtgct

SEQ ID NO: 9021238 - DNA, 22 bp, Homo sapiens
tgctggctttttgtgtcaaaga

SEQ ID NO: 9021239 - DNA, 22 bp, Homo sapiens
tgctgggatatagcttctaggg

SEQ ID NO: 9021240 - DNA, 22 bp, Homo sapiens
tgctgggatatagcttctaggg

SEQ ID NO: 9021241 - DNA, 22 bp, Homo sapiens
tgctgggatatagcttctaggg

SEQ ID NO: 9021242 - DNA, 22 bp, Homo sapiens
tgctggctttttgtgtcaaaga

SEQ ID NO: 9021243 - DNA, 22 bp, Homo sapiens
tgctggctttttgtgtcaaaga

SEQ ID NO: 9021244 - DNA, 22 bp, Homo sapiens
tgctggctttttggtccttgct

SEQ ID NO: 9021245 - DNA, 22 bp, Homo sapiens
tgctggctttttggtccttgct

SEQ ID NO: 9021246 - DNA, 22 bp, Homo sapiens
cccagttgttgccggctctgga

SEQ ID NO: 9021247 - DNA, 22 bp, Homo sapiens
cccaggtctatgccagctctga

SEQ ID NO: 9021248 - DNA, 22 bp, Homo sapiens
cccaggtctatgccagctctga

SEQ ID NO: 9021249 - DNA, 22 bp, Homo sapiens
cccaggtctatgccagctctga

SEQ ID NO: 9021250 - DNA, 22 bp, Homo sapiens
cccagtttcaactttccagtgg

SEQ ID NO: 9021251 - DNA, 21 bp, Homo sapiens
cccaggtcgtggtcttcccag

SEQ ID NO: 9021252 - DNA, 22 bp, Homo sapiens
cccaggtcgtcagcagtgtggt

SEQ ID NO: 9021253 - DNA, 22 bp, Homo sapiens
cccaggtcccggggccagctgc

SEQ ID NO: 9021254 - DNA, 22 bp, Homo sapiens
cccaggtcgtcagcagtgtggt

SEQ ID NO: 9021255 - DNA, 22 bp, Homo sapiens
cccaggtcccgccccagctcta

SEQ ID NO: 9021256 - DNA, 22 bp, Homo sapiens
cccaggtccccacctgtctgct

SEQ ID NO: 9021257 - DNA, 22 bp, Homo sapiens
ccccaaagcctcagcctgcctg

SEQ ID NO: 9021258 - DNA, 18 bp, Homo sapiens
ccccaaaagtcaccctgg

SEQ ID NO: 9021259 - DNA, 22 bp, Homo sapiens
ccccaaaattcttaagttgaat

SEQ ID NO: 9021260 - DNA, 22 bp, Homo sapiens
ccccaaagctgagttcccgcct

SEQ ID NO: 9021261 - DNA, 22 bp, Homo sapiens
cccatttttgtgtgagtaatga

SEQ ID NO: 9021262 - DNA, 22 bp, Homo sapiens
cccattttgcttatgctgctgt

SEQ ID NO: 9021263 - DNA, 22 bp, Homo sapiens
cccattttggaacgagtagcca

SEQ ID NO: 9021264 - DNA, 22 bp, Homo sapiens
cccatttttgtgtgagtaatga

SEQ ID NO: 9021265 - DNA, 22 bp, Homo sapiens
ccccaaaacttagtgacttaaa

SEQ ID NO: 9021266 - DNA, 22 bp, Homo sapiens
ccccaaaacttggtgacttcca

SEQ ID NO: 9021267 - DNA, 22 bp, Homo sapiens
cccattgtggttgttgaggata

SEQ ID NO: 9021268 - DNA, 22 bp, Homo sapiens
cccattcttcatacaagtctaa

SEQ ID NO: 9021269 - DNA, 22 bp, Homo sapiens
cccatttcttgagttcagctct

SEQ ID NO: 9021270 - DNA, 22 bp, Homo sapiens
cccattttagcaaggggtggcg

SEQ ID NO: 9021271 - DNA, 23 bp, Homo sapiens
cccattttcatgttaactcctgg

SEQ ID NO: 9021272 - DNA, 23 bp, Homo sapiens
cccattttcatgttaactcctgg

SEQ ID NO: 9021273 - DNA, 22 bp, Homo sapiens
ccccacccacctaagagaaact

SEQ ID NO: 9021274 - DNA, 22 bp, Homo sapiens
ccccacccacctaagagaaact

SEQ ID NO: 9021275 - DNA, 22 bp, Homo sapiens
ccccacccacctaagagaaact

SEQ ID NO: 9021276 - DNA, 22 bp, Homo sapiens
ccccaccctcgctccatttcgg

SEQ ID NO: 9021277 - DNA, 22 bp, Homo sapiens
ccccaccctcgctccatttcgg

SEQ ID NO: 9021278 - DNA, 22 bp, Homo sapiens
ccccaccctcgctccatttcgg

SEQ ID NO: 9021279 - DNA, 22 bp, Homo sapiens
ccccaccctcgctccatttcgg

SEQ ID NO: 9021280 - DNA, 22 bp, Homo sapiens
ccccaccagcaccctctctatc

SEQ ID NO: 9021281 - DNA, 22 bp, Homo sapiens
ccccaccaccaaggctcagttt

SEQ ID NO: 9021282 - DNA, 22 bp, Homo sapiens
ccccaccaccaaggctcagttt

SEQ ID NO: 9021283 - DNA, 22 bp, Homo sapiens
ccccacccacctaagagaaact

SEQ ID NO: 9021284 - DNA, 22 bp, Homo sapiens
ccccaccagcaccctctctatc

SEQ ID NO: 9021285 - DNA, 22 bp, Homo sapiens
tgctggccaagcagaggtcaat

SEQ ID NO: 9021286 - DNA, 22 bp, Homo sapiens
tgctggccaatggcagaggcgg

SEQ ID NO: 9021287 - DNA, 22 bp, Homo sapiens
tgctggccaatggcagaggcgg

SEQ ID NO: 9021288 - DNA, 22 bp, Homo sapiens
tgctggccaatggcagaggcgg

SEQ ID NO: 9021289 - DNA, 22 bp, Homo sapiens
tgctggccaatggcagaggcgg

SEQ ID NO: 9021290 - DNA, 21 bp, Homo sapiens
tgctggccatgtgctgggcat

SEQ ID NO: 9021291 - DNA, 21 bp, Homo sapiens
tgctggccatgtgctgggcat

SEQ ID NO: 9021292 - DNA, 21 bp, Homo sapiens
tgctggccatgtgctgggcat

SEQ ID NO: 9021293 - DNA, 22 bp, Homo sapiens
tgctggagcccaggcggccttt

SEQ ID NO: 9021294 - DNA, 22 bp, Homo sapiens
tgctggagcccaggcggccttt

SEQ ID NO: 9021295 - DNA, 22 bp, Homo sapiens
ccccaccctcgctccatttcgg

SEQ ID NO: 9021296 - DNA, 22 bp, Homo sapiens
ccccaccctcgctccatttcgg

SEQ ID NO: 9021297 - DNA, 22 bp, Homo sapiens
tgctggagcccaggcggccttt

SEQ ID NO: 9021298 - DNA, 22 bp, Homo sapiens
ccccacaactcatgttgaaact

SEQ ID NO: 9021299 - DNA, 22 bp, Homo sapiens
ccccacaactcatgttgaaact

SEQ ID NO: 9021300 - DNA, 22 bp, Homo sapiens
ccccacaactcatgttgaaact

SEQ ID NO: 9021301 - DNA, 22 bp, Homo sapiens
ccccacacctgccgggcagcag

SEQ ID NO: 9021302 - DNA, 22 bp, Homo sapiens
ccccacaactcatgttgaaact

SEQ ID NO: 9021303 - DNA, 22 bp, Homo sapiens
ccccacactctttacattcata

SEQ ID NO: 9021304 - DNA, 22 bp, Homo sapiens
ccccacagccgccagcagggag

SEQ ID NO: 9021305 - DNA, 20 bp, Homo sapiens
ccccacactattgagcactt

SEQ ID NO: 9021306 - DNA, 22 bp, Homo sapiens
ccccacagccgccagcagggag

SEQ ID NO: 9021307 - DNA, 22 bp, Homo sapiens
ccccacagccgccagcagggag

SEQ ID NO: 9021308 - DNA, 22 bp, Homo sapiens
ccccacagcttgtggagagaat

SEQ ID NO: 9021309 - DNA, 22 bp, Homo sapiens
ccccacagcttgtggagagaat

SEQ ID NO: 9021310 - DNA, 22 bp, Homo sapiens
ccccacaggtgtctgaggcagg

SEQ ID NO: 9021311 - DNA, 22 bp, Homo sapiens
ccccacaggtgtctgaggcagg

SEQ ID NO: 9021312 - DNA, 22 bp, Homo sapiens
ccccacaggtgtctgaggcagg

SEQ ID NO: 9021313 - DNA, 22 bp, Homo sapiens
ccccacagtccgtgaggagcca

SEQ ID NO: 9021314 - DNA, 22 bp, Homo sapiens
ccccacagtccgtgaggagcca

SEQ ID NO: 9021315 - DNA, 22 bp, Homo sapiens
ccccacagtccgtgaggagcca

SEQ ID NO: 9021316 - DNA, 22 bp, Homo sapiens
ccccacagtccgtgaggagcca

SEQ ID NO: 9021317 - DNA, 22 bp, Homo sapiens
ccccacagtccgtgaggagcca

SEQ ID NO: 9021318 - DNA, 22 bp, Homo sapiens
tggaatgtgaacatacaaggta

SEQ ID NO: 9021319 - DNA, 22 bp, Homo sapiens
tggaatgtgctactgttgattt

SEQ ID NO: 9021320 - DNA, 22 bp, Homo sapiens
tggaatgtgctactgttgattt

SEQ ID NO: 9021321 - DNA, 22 bp, Homo sapiens
tggaatgtcataccataaaaga

SEQ ID NO: 9021322 - DNA, 22 bp, Homo sapiens
tggaatgtcttgatatagaggt

SEQ ID NO: 9021323 - DNA, 22 bp, Homo sapiens
tggaatgtgagaataccgtttt

SEQ ID NO: 9021324 - DNA, 22 bp, Homo sapiens
tggaatgtgctagggctgtggc

SEQ ID NO: 9021325 - DNA, 22 bp, Homo sapiens
tggaatgtgctagggctgtggc

SEQ ID NO: 9021326 - DNA, 22 bp, Homo sapiens
tggaatgtggataagggtgtct

SEQ ID NO: 9021327 - DNA, 22 bp, Homo sapiens
tggaatgtggtatcagtagaaa

SEQ ID NO: 9021328 - DNA, 23 bp, Homo sapiens
tggaatgtctgattctgctctag

SEQ ID NO: 9021329 - DNA, 23 bp, Homo sapiens
tggaatgtctgattctgctctag

SEQ ID NO: 9021330 - DNA, 22 bp, Homo sapiens
tggaatgtcagctacaagaggg

SEQ ID NO: 9021331 - DNA, 22 bp, Homo sapiens
tggaatgtattaagtattgagt

SEQ ID NO: 9021332 - DNA, 22 bp, Homo sapiens
tggaatgtcaagaagcagtaag

SEQ ID NO: 9021333 - DNA, 22 bp, Homo sapiens
tggaatgtcaaaagtctgctat

SEQ ID NO: 9021334 - DNA, 22 bp, Homo sapiens
tggaatgtcaaaagtctgctat

SEQ ID NO: 9021335 - DNA, 22 bp, Homo sapiens
tggaatgtatagatgttatgta

SEQ ID NO: 9021336 - DNA, 22 bp, Homo sapiens
tggaatgtagtgtccatggaat

SEQ ID NO: 9021337 - DNA, 22 bp, Homo sapiens
tggaatgtagtgtccatggaat

SEQ ID NO: 9021338 - DNA, 22 bp, Homo sapiens
tggaatgtaaactctgtgaggg

SEQ ID NO: 9021339 - DNA, 22 bp, Homo sapiens
tggaatgtaaactctgtgaggg

SEQ ID NO: 9021340 - DNA, 22 bp, Homo sapiens
tggaatgtaaagcgtgtgataa

SEQ ID NO: 9021341 - DNA, 22 bp, Homo sapiens
tggaatgtaaagcgtgtgataa

SEQ ID NO: 9021342 - DNA, 22 bp, Homo sapiens
tggaatgtaaagggtatgggat

SEQ ID NO: 9021343 - DNA, 22 bp, Homo sapiens
tggaatgtagcaagtgttgtca

SEQ ID NO: 9021344 - DNA, 20 bp, Homo sapiens
tggaatgtagtcggtgagag

SEQ ID NO: 9021345 - DNA, 20 bp, Homo sapiens
tggaatgtagtcggtgagag

SEQ ID NO: 9021346 - DNA, 21 bp, Homo sapiens
tggaatgtacctccctctctt

SEQ ID NO: 9021347 - DNA, 21 bp, Homo sapiens
tggaatgtacctccctctctt

SEQ ID NO: 9021348 - DNA, 22 bp, Homo sapiens
tggaatgtaatcagaatatgaa

SEQ ID NO: 9021349 - DNA, 22 bp, Homo sapiens
tggaatgtaatcatgtggtggt

SEQ ID NO: 9021350 - DNA, 22 bp, Homo sapiens
tggaatgtaaacctcaggtggg

SEQ ID NO: 9021351 - DNA, 22 bp, Homo sapiens
tggaatgtaaacctcaggtggg

SEQ ID NO: 9021352 - DNA, 20 bp, Homo sapiens
tggaatgggtccttgaaaaa

SEQ ID NO: 9021353 - DNA, 22 bp, Homo sapiens
tggaatggaaacaaactgagga

SEQ ID NO: 9021354 - DNA, 22 bp, Homo sapiens
tggaatggaaacaaactgagga

SEQ ID NO: 9021355 - DNA, 22 bp, Homo sapiens
tggaatggaaacaaactgagga

SEQ ID NO: 9021356 - DNA, 22 bp, Homo sapiens
ccctcgggtcgcggactgcgct

SEQ ID NO: 9021357 - DNA, 22 bp, Homo sapiens
ccctctacagggaagcgctttc

SEQ ID NO: 9021358 - DNA, 22 bp, Homo sapiens
ccctcgtgcatccatcatttag

SEQ ID NO: 9021359 - DNA, 22 bp, Homo sapiens
ccctcgctctaggcagccctgt

SEQ ID NO: 9021360 - DNA, 22 bp, Homo sapiens
ccctcgctctaggcagccctgt

SEQ ID NO: 9021361 - DNA, 22 bp, Homo sapiens
ccctcctgtgcctgaggccagc

SEQ ID NO: 9021362 - DNA, 22 bp, Homo sapiens
ccctcctgtgcctgaggccagc

SEQ ID NO: 9021363 - DNA, 22 bp, Homo sapiens
ccctccttaccaccacagctcc

SEQ ID NO: 9021364 - DNA, 22 bp, Homo sapiens
ccctccttaccaccacagctcc

SEQ ID NO: 9021365 - DNA, 22 bp, Homo sapiens
ccctcctctccctaagagtcac

SEQ ID NO: 9021366 - DNA, 22 bp, Homo sapiens
ccctcctctccctaagagtcac

SEQ ID NO: 9021367 - DNA, 22 bp, Homo sapiens
tggaatgttaaacctcaatgat

SEQ ID NO: 9021368 - DNA, 22 bp, Homo sapiens
tggaatgtgttctattttacag

SEQ ID NO: 9021369 - DNA, 22 bp, Homo sapiens
ccctcctggaggcggatgccca

SEQ ID NO: 9021370 - DNA, 22 bp, Homo sapiens
ccctcctggaggcggatgccca

SEQ ID NO: 9021371 - DNA, 22 bp, Homo sapiens
ccctcctggaggcggatgccca

SEQ ID NO: 9021372 - DNA, 22 bp, Homo sapiens
ccctcctgtgcctgaggccagc

SEQ ID NO: 9021373 - DNA, 22 bp, Homo sapiens
ccctcctctccctaagagtcac

SEQ ID NO: 9021374 - DNA, 20 bp, Homo sapiens
tgctgtgtggcccagcatga

SEQ ID NO: 9021375 - DNA, 20 bp, Homo sapiens
tgctgtgtggcccagcatga

SEQ ID NO: 9021376 - DNA, 22 bp, Homo sapiens
tgctgtgttaaatacaagcatg

SEQ ID NO: 9021377 - DNA, 22 bp, Homo sapiens
tgctgtgtctttctgtgaaaag

SEQ ID NO: 9021378 - DNA, 22 bp, Homo sapiens
tgctgtgtggatgtgaagaatc

SEQ ID NO: 9021379 - DNA, 22 bp, Homo sapiens
tgctgtgtctttctgtgaaaag

SEQ ID NO: 9021380 - DNA, 22 bp, Homo sapiens
tgctgtgtggatgtgaagaatc

SEQ ID NO: 9021381 - DNA, 22 bp, Homo sapiens
tgctgtgtctttctgtgaaaag

SEQ ID NO: 9021382 - DNA, 22 bp, Homo sapiens
tgctgtgttactgagatccggc

SEQ ID NO: 9021383 - DNA, 22 bp, Homo sapiens
tgctgtgttaaatacaagcatg

SEQ ID NO: 9021384 - DNA, 22 bp, Homo sapiens
tgctgtgttaaatacaagcatg

SEQ ID NO: 9021385 - DNA, 22 bp, Homo sapiens
tgctgtgttctcctgactcacc

SEQ ID NO: 9021386 - DNA, 22 bp, Homo sapiens
tgctgtgttcaccaatatgtgt

SEQ ID NO: 9021387 - DNA, 22 bp, Homo sapiens
tgctgtgttcctcagtttcatg

SEQ ID NO: 9021388 - DNA, 22 bp, Homo sapiens
tggaatggaaacaaactgagga

SEQ ID NO: 9021389 - DNA, 22 bp, Homo sapiens
tggaatggaaacaaactgagga

SEQ ID NO: 9021390 - DNA, 22 bp, Homo sapiens
tggaatggaaacaaactgagga

SEQ ID NO: 9021391 - DNA, 22 bp, Homo sapiens
tggaagggagctggaatttgga

SEQ ID NO: 9021392 - DNA, 22 bp, Homo sapiens
tggaagggagctggaatttgga

SEQ ID NO: 9021393 - DNA, 22 bp, Homo sapiens
tgctgtgttctcctgactcacc

SEQ ID NO: 9021394 - DNA, 22 bp, Homo sapiens
tgctgttagtaaggaacatgac

SEQ ID NO: 9021395 - DNA, 22 bp, Homo sapiens
tggaagggagctggaatttgga

SEQ ID NO: 9021396 - DNA, 22 bp, Homo sapiens
tggaagggagctggaatttgga

SEQ ID NO: 9021397 - DNA, 22 bp, Homo sapiens
tggaagggagctggaatttgga

SEQ ID NO: 9021398 - DNA, 22 bp, Homo sapiens
tggaagggagctggaatttgga

SEQ ID NO: 9021399 - DNA, 22 bp, Homo sapiens
tggaagggagctggaatttgga

SEQ ID NO: 9021400 - DNA, 22 bp, Homo sapiens
tgctgtgctctttaaggtgctg

SEQ ID NO: 9021401 - DNA, 22 bp, Homo sapiens
tgctgtgctccattgtcttcac

SEQ ID NO: 9021402 - DNA, 18 bp, Homo sapiens
cccggctaatttttggta

SEQ ID NO: 9021403 - DNA, 18 bp, Homo sapiens
cccggctaatttttggta

SEQ ID NO: 9021404 - DNA, 22 bp, Homo sapiens
tgctgtggattcagagatgaaa

SEQ ID NO: 9021405 - DNA, 23 bp, Homo sapiens
tgctgtggatggcaggtccttgc

SEQ ID NO: 9021406 - DNA, 22 bp, Homo sapiens
tgctgtgctggcggcagaggcc

SEQ ID NO: 9021407 - DNA, 22 bp, Homo sapiens
tgctgtgctggcggcagaggcc

SEQ ID NO: 9021408 - DNA, 22 bp, Homo sapiens
tgctgtgctctttaaggtgctg

SEQ ID NO: 9021409 - DNA, 22 bp, Homo sapiens
tgctgtgctggcggcagaggcc

SEQ ID NO: 9021410 - DNA, 22 bp, Homo sapiens
tgctgtggttcccagagtggat

SEQ ID NO: 9021411 - DNA, 22 bp, Homo sapiens
tgctgtggttcccagagtggat

SEQ ID NO: 9021412 - DNA, 22 bp, Homo sapiens
tgctgtgtaaaaggtgattgaa

SEQ ID NO: 9021413 - DNA, 22 bp, Homo sapiens
tgctgtgtaaaaggtgattgaa

SEQ ID NO: 9021414 - DNA, 22 bp, Homo sapiens
tgctgtgtctttctgtgaaaag

SEQ ID NO: 9021415 - DNA, 22 bp, Homo sapiens
tgctgtgtaaaaggtgattgaa

SEQ ID NO: 9021416 - DNA, 22 bp, Homo sapiens
tgctgtgtaaaaggtgattgaa

SEQ ID NO: 9021417 - DNA, 22 bp, Homo sapiens
ccctctctcaggctgacagcct

SEQ ID NO: 9021418 - DNA, 22 bp, Homo sapiens
ccctctctcaggctgacagcct

SEQ ID NO: 9021419 - DNA, 22 bp, Homo sapiens
ccctctctcaggctgacagcct

SEQ ID NO: 9021420 - DNA, 19 bp, Homo sapiens
ccctcttgcacaaagcaaa

SEQ ID NO: 9021421 - DNA, 22 bp, Homo sapiens
ccctgaaatcctgtgctctgtg

SEQ ID NO: 9021422 - DNA, 19 bp, Homo sapiens
ccctcttgcacaaagcaaa

SEQ ID NO: 9021423 - DNA, 19 bp, Homo sapiens
ccctcttgcacaaagcaaa

SEQ ID NO: 9021424 - DNA, 18 bp, Homo sapiens
ccctctcctgctagtggg

SEQ ID NO: 9021425 - DNA, 18 bp, Homo sapiens
ccctctcctgctagtggg

SEQ ID NO: 9021426 - DNA, 22 bp, Homo sapiens
ccctctcagtcagagccagata

SEQ ID NO: 9021427 - DNA, 22 bp, Homo sapiens
ccctctccctgcagaatgtggc

SEQ ID NO: 9021428 - DNA, 22 bp, Homo sapiens
ccctctacagggaagcgctttc

SEQ ID NO: 9021429 - DNA, 18 bp, Homo sapiens
ccctctcctgctagtggg

SEQ ID NO: 9021430 - DNA, 18 bp, Homo sapiens
ccctctcctgctagtggg

SEQ ID NO: 9021431 - DNA, 18 bp, Homo sapiens
ccctctcctgctagtggg

SEQ ID NO: 9021432 - DNA, 22 bp, Homo sapiens
ccctctcctggctgcatggagc

SEQ ID NO: 9021433 - DNA, 22 bp, Homo sapiens
ccctctcctggctgcatggagc

SEQ ID NO: 9021434 - DNA, 22 bp, Homo sapiens
ccctctcctggctgcatggagc

SEQ ID NO: 9021435 - DNA, 22 bp, Homo sapiens
ccctctcctggctgcatggagc

SEQ ID NO: 9021436 - DNA, 22 bp, Homo sapiens
ccctctcctggctgcatggagc

SEQ ID NO: 9021437 - DNA, 20 bp, Homo sapiens
ccctgagaccagagagcagc

SEQ ID NO: 9021438 - DNA, 20 bp, Homo sapiens
ccctgagaccagagagcagc

SEQ ID NO: 9021439 - DNA, 20 bp, Homo sapiens
ccctgagaccagagagcagc

SEQ ID NO: 9021440 - DNA, 20 bp, Homo sapiens
ccctgagacaaaggaggggc

SEQ ID NO: 9021441 - DNA, 20 bp, Homo sapiens
ccctgagacaaaggaggggc

SEQ ID NO: 9021442 - DNA, 20 bp, Homo sapiens
ccctgagacaaaggaggggc

SEQ ID NO: 9021443 - DNA, 20 bp, Homo sapiens
ccctgagacgactgagctcc

SEQ ID NO: 9021444 - DNA, 20 bp, Homo sapiens
ccctgagacgactgagctcc

SEQ ID NO: 9021445 - DNA, 20 bp, Homo sapiens
ccctgagacgactgagctcc

SEQ ID NO: 9021446 - DNA, 20 bp, Homo sapiens
ccctgagacgactgagctcc

SEQ ID NO: 9021447 - DNA, 22 bp, Homo sapiens
ccctgagagcagggtctttctc

SEQ ID NO: 9021448 - DNA, 22 bp, Homo sapiens
ccctgagaggttgagtgtctgc

SEQ ID NO: 9021449 - DNA, 22 bp, Homo sapiens
ccctgagaggttgagtgtctgc

SEQ ID NO: 9021450 - DNA, 20 bp, Homo sapiens
ccctgagacaaaggaggggc

SEQ ID NO: 9021451 - DNA, 20 bp, Homo sapiens
ccctgagacaaaggaggggc

SEQ ID NO: 9021452 - DNA, 22 bp, Homo sapiens
ccctgagaacaacttaggggtc

SEQ ID NO: 9021453 - DNA, 22 bp, Homo sapiens
ccctgagaagatcattgccacg

SEQ ID NO: 9021454 - DNA, 22 bp, Homo sapiens
ccctgacttgatctttgacttg

SEQ ID NO: 9021455 - DNA, 22 bp, Homo sapiens
ccctgaccctatcagagggcca

SEQ ID NO: 9021456 - DNA, 22 bp, Homo sapiens
ccctgaccctatcagagggcca

SEQ ID NO: 9021457 - DNA, 22 bp, Homo sapiens
ccctgaccccacggctggagaa

SEQ ID NO: 9021458 - DNA, 18 bp, Homo sapiens
ccctgaagggcaagataa

SEQ ID NO: 9021459 - DNA, 22 bp, Homo sapiens
ccctgacccaaaactgtcagaa

SEQ ID NO: 9021460 - DNA, 22 bp, Homo sapiens
ccctgacccaaaactgtcagaa

SEQ ID NO: 9021461 - DNA, 22 bp, Homo sapiens
ccctgaccaccagctccatttg

SEQ ID NO: 9021462 - DNA, 22 bp, Homo sapiens
ccctgaccagcagtacttggta

SEQ ID NO: 9021463 - DNA, 22 bp, Homo sapiens
ccctgaccatcccgcactgact

SEQ ID NO: 9021464 - DNA, 22 bp, Homo sapiens
ccctgaggaccaggaaggaggg

SEQ ID NO: 9021465 - DNA, 22 bp, Homo sapiens
ccctgaggaccaggaaggaggg

SEQ ID NO: 9021466 - DNA, 22 bp, Homo sapiens
ccctgaggaccaggaaggaggg

SEQ ID NO: 9021467 - DNA, 22 bp, Homo sapiens
tggagcaaattcaagctcatct

SEQ ID NO: 9021468 - DNA, 22 bp, Homo sapiens
tggagcagaaatggcctcttgt

SEQ ID NO: 9021469 - DNA, 22 bp, Homo sapiens
tggagcagaaatggcctcttgt

SEQ ID NO: 9021470 - DNA, 23 bp, Homo sapiens
ccctgagctggtccaggctcaac

SEQ ID NO: 9021471 - DNA, 23 bp, Homo sapiens
ccctgagctggtccaggctcaac

SEQ ID NO: 9021472 - DNA, 23 bp, Homo sapiens
ccctgagctggtccaggctcaac

SEQ ID NO: 9021473 - DNA, 22 bp, Homo sapiens
ccctgaggaaagggtggagggc

SEQ ID NO: 9021474 - DNA, 22 bp, Homo sapiens
ccctgaggaaagggtggagggc

SEQ ID NO: 9021475 - DNA, 22 bp, Homo sapiens
ccctgaggaaagggtggagggc

SEQ ID NO: 9021476 - DNA, 22 bp, Homo sapiens
ccctgaggaaagggtggagggc

SEQ ID NO: 9021477 - DNA, 22 bp, Homo sapiens
ccctgaggaaagggtggagggc

SEQ ID NO: 9021478 - DNA, 22 bp, Homo sapiens
ccctgaggaaagggtggagggc

SEQ ID NO: 9021479 - DNA, 22 bp, Homo sapiens
tggagcaggactgctgccctca

SEQ ID NO: 9021480 - DNA, 22 bp, Homo sapiens
tggagcaggactgctgccctca

SEQ ID NO: 9021481 - DNA, 16 bp, Homo sapiens
tggagcaggcaggatg

SEQ ID NO: 9021482 - DNA, 16 bp, Homo sapiens
tggagcaggcaggatg

SEQ ID NO: 9021483 - DNA, 16 bp, Homo sapiens
tggagcaggcaggatg

SEQ ID NO: 9021484 - DNA, 22 bp, Homo sapiens
tggagcaggcatctttctctct

SEQ ID NO: 9021485 - DNA, 22 bp, Homo sapiens
tggagcaggcatctttctctct

SEQ ID NO: 9021486 - DNA, 22 bp, Homo sapiens
tggagcaggacggggagtggta

SEQ ID NO: 9021487 - DNA, 22 bp, Homo sapiens
tggagcaggactgctgccctca

SEQ ID NO: 9021488 - DNA, 22 bp, Homo sapiens
tggagcaggactgctgccctca

SEQ ID NO: 9021489 - DNA, 22 bp, Homo sapiens
tggagcaggacggggagtggta

SEQ ID NO: 9021490 - DNA, 22 bp, Homo sapiens
tggagcaggacggggagtggta

SEQ ID NO: 9021491 - DNA, 22 bp, Homo sapiens
tggagcagaaatggcctcttgt

SEQ ID NO: 9021492 - DNA, 22 bp, Homo sapiens
tggagcaggacggggagtggta

SEQ ID NO: 9021493 - DNA, 22 bp, Homo sapiens
tggagcagaaatggcctcttgt

SEQ ID NO: 9021494 - DNA, 22 bp, Homo sapiens
tggagcagaaatggcctcttgt

SEQ ID NO: 9021495 - DNA, 22 bp, Homo sapiens
ccctgagcattcatgtgagctt

SEQ ID NO: 9021496 - DNA, 22 bp, Homo sapiens
ccctgagcattcatgtgagctt

SEQ ID NO: 9021497 - DNA, 22 bp, Homo sapiens
ccctgagcattcatgtgagctt

SEQ ID NO: 9021498 - DNA, 22 bp, Homo sapiens
ccctgagccacacagagcaggt

SEQ ID NO: 9021499 - DNA, 22 bp, Homo sapiens
ccctgagcattcatgtgagctt

SEQ ID NO: 9021500 - DNA, 22 bp, Homo sapiens
ccctgagccacacagagcaggt

SEQ ID NO: 9021501 - DNA, 22 bp, Homo sapiens
ccctgagccacacagagcaggt

SEQ ID NO: 9021502 - DNA, 22 bp, Homo sapiens
ccctgagccacacagagcaggt

SEQ ID NO: 9021503 - DNA, 22 bp, Homo sapiens
ccctgagcccatagttgacatt

SEQ ID NO: 9021504 - DNA, 22 bp, Homo sapiens
ccctgagcgtgaggaggaagta

SEQ ID NO: 9021505 - DNA, 22 bp, Homo sapiens
ccctgagcgtgaggaggaagta

SEQ ID NO: 9021506 - DNA, 22 bp, Homo sapiens
ccctgagcgtgaggaggaagta

SEQ ID NO: 9021507 - DNA, 22 bp, Homo sapiens
ccctgagcgtgaggaggaagta

SEQ ID NO: 9021508 - DNA, 22 bp, Homo sapiens
ccctgagccgctgctccaacct

SEQ ID NO: 9021509 - DNA, 22 bp, Homo sapiens
ccctgagccgctgctccaacct

SEQ ID NO: 9021510 - DNA, 22 bp, Homo sapiens
ccctgagccgcctgccgtgtcc

SEQ ID NO: 9021511 - DNA, 22 bp, Homo sapiens
ccctgagcccatagttgacatt

SEQ ID NO: 9021512 - DNA, 22 bp, Homo sapiens
ccctgagccgcctgccgtgtcc

SEQ ID NO: 9021513 - DNA, 22 bp, Homo sapiens
ccctgagcagtctgcagagagc

SEQ ID NO: 9021514 - DNA, 22 bp, Homo sapiens
ccctgagcagtctgcagagagc

SEQ ID NO: 9021515 - DNA, 22 bp, Homo sapiens
ccctgagcagtctgcagagagc

SEQ ID NO: 9021516 - DNA, 22 bp, Homo sapiens
ccctgagcacacctggcagaca

SEQ ID NO: 9021517 - DNA, 22 bp, Homo sapiens
ccctgagcacacctggcagaca

SEQ ID NO: 9021518 - DNA, 22 bp, Homo sapiens
ccctgagcacacctggcagaca

SEQ ID NO: 9021519 - DNA, 22 bp, Homo sapiens
ccctgagatgcctcaccctagt

SEQ ID NO: 9021520 - DNA, 22 bp, Homo sapiens
ccctgagcacacctggcagaca

SEQ ID NO: 9021521 - DNA, 18 bp, Homo sapiens
ccctgagatgatgctgtg

SEQ ID NO: 9021522 - DNA, 22 bp, Homo sapiens
ccctgagagtgagtgccacctt

SEQ ID NO: 9021523 - DNA, 18 bp, Homo sapiens
ccctgagatgatgctgtg

SEQ ID NO: 9021524 - DNA, 22 bp, Homo sapiens
ccctgagatgcctcaccctagt

SEQ ID NO: 9021525 - DNA, 22 bp, Homo sapiens
ccaggctctgtgtgggctagag

SEQ ID NO: 9021526 - DNA, 22 bp, Homo sapiens
ccaggctctgtgtgggctagag

SEQ ID NO: 9021527 - DNA, 22 bp, Homo sapiens
ccaggctctgtgtgggctagag

SEQ ID NO: 9021528 - DNA, 22 bp, Homo sapiens
ccaggctctgtgtgggctagag

SEQ ID NO: 9021529 - DNA, 22 bp, Homo sapiens
ccaggctctgtgtgggctagag

SEQ ID NO: 9021530 - DNA, 22 bp, Homo sapiens
ccaggctctgtgtgggctagag

SEQ ID NO: 9021531 - DNA, 22 bp, Homo sapiens
ccaggctctgttccccgaggag

SEQ ID NO: 9021532 - DNA, 22 bp, Homo sapiens
ccaggctctgttccccgaggag

SEQ ID NO: 9021533 - DNA, 22 bp, Homo sapiens
ccaggctctgttccccgaggag

SEQ ID NO: 9021534 - DNA, 22 bp, Homo sapiens
ccaggctctgttccccgaggag

SEQ ID NO: 9021535 - DNA, 22 bp, Homo sapiens
ccaggctctgttccccgaggag

SEQ ID NO: 9021536 - DNA, 22 bp, Homo sapiens
ccaggctctgttccccgaggag

SEQ ID NO: 9021537 - DNA, 22 bp, Homo sapiens
ccaggctgaatatgttccaggg

SEQ ID NO: 9021538 - DNA, 22 bp, Homo sapiens
ccaggctgaatatgttccaggg

SEQ ID NO: 9021539 - DNA, 22 bp, Homo sapiens
ccaggctgaatatgttccaggg

SEQ ID NO: 9021540 - DNA, 23 bp, Homo sapiens
ccaggctctttcacctgctattc

SEQ ID NO: 9021541 - DNA, 23 bp, Homo sapiens
ccaggctctttcacctgctattc

SEQ ID NO: 9021542 - DNA, 23 bp, Homo sapiens
ccaggctctttcacctgctattc

SEQ ID NO: 9021543 - DNA, 23 bp, Homo sapiens
ccaggctctttcacctgctattc

SEQ ID NO: 9021544 - DNA, 22 bp, Homo sapiens
ccaggctgaatatgttccaggg

SEQ ID NO: 9021545 - DNA, 22 bp, Homo sapiens
ccaggcctggaccatgccaggg

SEQ ID NO: 9021546 - DNA, 22 bp, Homo sapiens
ccaggcctggaccatgccaggg

SEQ ID NO: 9021547 - DNA, 22 bp, Homo sapiens
ccaggcctggacgggtggcctg

SEQ ID NO: 9021548 - DNA, 22 bp, Homo sapiens
ccaggcctggacgggtggcctg

SEQ ID NO: 9021549 - DNA, 22 bp, Homo sapiens
ccaggcctggaccatgccaggg

SEQ ID NO: 9021550 - DNA, 22 bp, Homo sapiens
ccaggcctggacgggtggcctg

SEQ ID NO: 9021551 - DNA, 22 bp, Homo sapiens
ccaggcctggacgggtggcctg

SEQ ID NO: 9021552 - DNA, 22 bp, Homo sapiens
ccaggcctggacgggtggcctg

SEQ ID NO: 9021553 - DNA, 22 bp, Homo sapiens
ccaggcctggacgggtggcctg

SEQ ID NO: 9021554 - DNA, 22 bp, Homo sapiens
ccaggcctggccaggggatgcc

SEQ ID NO: 9021555 - DNA, 22 bp, Homo sapiens
ccaggcctggccaggggatgcc

SEQ ID NO: 9021556 - DNA, 21 bp, Homo sapiens
ccaggctcctgaggctggtca

SEQ ID NO: 9021557 - DNA, 21 bp, Homo sapiens
ccaggctcctgaggctggtca

SEQ ID NO: 9021558 - DNA, 21 bp, Homo sapiens
ccaggctcctgaggctggtca

SEQ ID NO: 9021559 - DNA, 22 bp, Homo sapiens
ccaggcctggccaggggatgcc

SEQ ID NO: 9021560 - DNA, 22 bp, Homo sapiens
ccaggcctggccaggggatgcc

SEQ ID NO: 9021561 - DNA, 22 bp, Homo sapiens
ccaggcctggccaggggatgcc

SEQ ID NO: 9021562 - DNA, 22 bp, Homo sapiens
ccaggcctggccaggggatgcc

SEQ ID NO: 9021563 - DNA, 22 bp, Homo sapiens
ccaggctctgtgtgggctagag

SEQ ID NO: 9021564 - DNA, 22 bp, Homo sapiens
ccaggctctgtctggtcagaag

SEQ ID NO: 9021565 - DNA, 22 bp, Homo sapiens
ccaggctctgtctggtcagaag

SEQ ID NO: 9021566 - DNA, 22 bp, Homo sapiens
ccaggctctgtctggtcagaag

SEQ ID NO: 9021567 - DNA, 22 bp, Homo sapiens
ccaggctctgtctggtcagaag

SEQ ID NO: 9021568 - DNA, 22 bp, Homo sapiens
ccaggctctgtctggtcagaag

SEQ ID NO: 9021569 - DNA, 22 bp, Homo sapiens
ccaggctgagcatgattggagc

SEQ ID NO: 9021570 - DNA, 22 bp, Homo sapiens
tctttggcatttaggagcagga

SEQ ID NO: 9021571 - DNA, 22 bp, Homo sapiens
tctttggccttaggagcccttg

SEQ ID NO: 9021572 - DNA, 22 bp, Homo sapiens
tctttggctatgatttactgtt

SEQ ID NO: 9021573 - DNA, 22 bp, Homo sapiens
tctttggccttaggagcccttg

SEQ ID NO: 9021574 - DNA, 22 bp, Homo sapiens
tctttggcatttaggagcagga

SEQ ID NO: 9021575 - DNA, 22 bp, Homo sapiens
tctttggcttgtctcctcagtt

SEQ ID NO: 9021576 - DNA, 22 bp, Homo sapiens
tctttggcttgtctcctcagtt

SEQ ID NO: 9021577 - DNA, 22 bp, Homo sapiens
tctttggctttgccacacccaa

SEQ ID NO: 9021578 - DNA, 22 bp, Homo sapiens
tctttggctttgccacacccaa

SEQ ID NO: 9021579 - DNA, 19 bp, Homo sapiens
tctttggcttctggatcag

SEQ ID NO: 9021580 - DNA, 22 bp, Homo sapiens
tctttggctgcctgaagcccaa

SEQ ID NO: 9021581 - DNA, 19 bp, Homo sapiens
tctttggcttctggatcag

SEQ ID NO: 9021582 - DNA, 22 bp, Homo sapiens
tctttggctgcctgaagcccaa

SEQ ID NO: 9021583 - DNA, 19 bp, Homo sapiens
tctttggctaaattgggtg

SEQ ID NO: 9021584 - DNA, 22 bp, Homo sapiens
tctttggctatgatttactgtt

SEQ ID NO: 9021585 - DNA, 22 bp, Homo sapiens
tctttgggctaggagtttggat

SEQ ID NO: 9021586 - DNA, 22 bp, Homo sapiens
tctttgggctaggagtttggat

SEQ ID NO: 9021587 - DNA, 22 bp, Homo sapiens
tctttgggccgacactcgtcaa

SEQ ID NO: 9021588 - DNA, 22 bp, Homo sapiens
tctttgggagatgttatttata

SEQ ID NO: 9021589 - DNA, 22 bp, Homo sapiens
tctttgggagaaggggtcccag

SEQ ID NO: 9021590 - DNA, 22 bp, Homo sapiens
tctttgggagaaggggtcccag

SEQ ID NO: 9021591 - DNA, 22 bp, Homo sapiens
tctttgggagatgttatttata

SEQ ID NO: 9021592 - DNA, 22 bp, Homo sapiens
tctttggcttgtctcctcagtt

SEQ ID NO: 9021593 - DNA, 22 bp, Homo sapiens
tctttggctttgccacacccaa

SEQ ID NO: 9021594 - DNA, 22 bp, Homo sapiens
tctttggggcatctgggagatt

SEQ ID NO: 9021595 - DNA, 22 bp, Homo sapiens
tctttggggcatctgggagatt

SEQ ID NO: 9021596 - DNA, 22 bp, Homo sapiens
tctttggtcagaaagattacac

SEQ ID NO: 9021597 - DNA, 22 bp, Homo sapiens
tctttggtcatcatgggaagca

SEQ ID NO: 9021598 - DNA, 22 bp, Homo sapiens
tctttggtattcacttgtgaag

SEQ ID NO: 9021599 - DNA, 22 bp, Homo sapiens
tctttggtattcacttgtgaag

SEQ ID NO: 9021600 - DNA, 23 bp, Homo sapiens
tctttggtaaataaagtggggat

SEQ ID NO: 9021601 - DNA, 22 bp, Homo sapiens
ccaggctgctgttggtgtccgc

SEQ ID NO: 9021602 - DNA, 22 bp, Homo sapiens
ccaggctgctgttggtgtccgc

SEQ ID NO: 9021603 - DNA, 22 bp, Homo sapiens
tctttggtgatatctctttggt

SEQ ID NO: 9021604 - DNA, 22 bp, Homo sapiens
tctttggtgaatggtcatccag

SEQ ID NO: 9021605 - DNA, 22 bp, Homo sapiens
tctttggtcatcatgggaagca

SEQ ID NO: 9021606 - DNA, 22 bp, Homo sapiens
ccaggctggagtgcaatggcat

SEQ ID NO: 9021607 - DNA, 22 bp, Homo sapiens
ccaggctgctgttggtgtccgc

SEQ ID NO: 9021608 - DNA, 22 bp, Homo sapiens
ccaggctggagtgcaatggcat

SEQ ID NO: 9021609 - DNA, 22 bp, Homo sapiens
ccaggctggagtgcaatggcat

SEQ ID NO: 9021610 - DNA, 22 bp, Homo sapiens
ccaggctggagtgcaatggcat

SEQ ID NO: 9021611 - DNA, 22 bp, Homo sapiens
ccaggctggagtgcaatggcgt

SEQ ID NO: 9021612 - DNA, 22 bp, Homo sapiens
ccaggctggagtgcaatggcgt

SEQ ID NO: 9021613 - DNA, 22 bp, Homo sapiens
ccaggctggagtgcaatggcgt

SEQ ID NO: 9021614 - DNA, 22 bp, Homo sapiens
ccaggctggagtgcaatggtgc

SEQ ID NO: 9021615 - DNA, 22 bp, Homo sapiens
ccaggctggagtgcaatggtgc

SEQ ID NO: 9021616 - DNA, 22 bp, Homo sapiens
ccaggctggagtgcaatggcgt

SEQ ID NO: 9021617 - DNA, 22 bp, Homo sapiens
ccaggctggagtgcaatggcgt

SEQ ID NO: 9021618 - DNA, 22 bp, Homo sapiens
ccaggctggagtgcaatggcat

SEQ ID NO: 9021619 - DNA, 22 bp, Homo sapiens
ccaggctggagtgcaatggcgt

SEQ ID NO: 9021620 - DNA, 22 bp, Homo sapiens
tctttcttgcaaggatgcagga

SEQ ID NO: 9021621 - DNA, 22 bp, Homo sapiens
tctttcttctttcatagtgtga

SEQ ID NO: 9021622 - DNA, 22 bp, Homo sapiens
tctttcttcagccctgtaagat

SEQ ID NO: 9021623 - DNA, 22 bp, Homo sapiens
tctttcttcctggagcccaaca

SEQ ID NO: 9021624 - DNA, 22 bp, Homo sapiens
tctttcttcctggagcccaaca

SEQ ID NO: 9021625 - DNA, 22 bp, Homo sapiens
tctttcttcagccctgtaagat

SEQ ID NO: 9021626 - DNA, 22 bp, Homo sapiens
tctttcttcagccctgtaagat

SEQ ID NO: 9021627 - DNA, 22 bp, Homo sapiens
tctttcttcagccctgtaagat

SEQ ID NO: 9021628 - DNA, 22 bp, Homo sapiens
tctttcttattatgctcaatgt

SEQ ID NO: 9021629 - DNA, 22 bp, Homo sapiens
tctttcttattatgctcaatgt

SEQ ID NO: 9021630 - DNA, 22 bp, Homo sapiens
tctttcttattatgctcaatgt

SEQ ID NO: 9021631 - DNA, 22 bp, Homo sapiens
tctttcttggtattctgagcta

SEQ ID NO: 9021632 - DNA, 22 bp, Homo sapiens
tctttcttggtataaagcaggg

SEQ ID NO: 9021633 - DNA, 22 bp, Homo sapiens
tctttcttctttcatagtgtga

SEQ ID NO: 9021634 - DNA, 22 bp, Homo sapiens
tctttcttggtataaagcaggg

SEQ ID NO: 9021635 - DNA, 22 bp, Homo sapiens
tctttcttggtataaagcaggg

SEQ ID NO: 9021636 - DNA, 22 bp, Homo sapiens
tctttcttgtgggtgccctttt

SEQ ID NO: 9021637 - DNA, 22 bp, Homo sapiens
tctttcttgtgggtgccctttt

SEQ ID NO: 9021638 - DNA, 22 bp, Homo sapiens
tctttcttgtgggtgccctttt

SEQ ID NO: 9021639 - DNA, 22 bp, Homo sapiens
tctttctttatcacctgatatg

SEQ ID NO: 9021640 - DNA, 22 bp, Homo sapiens
ccaggcctggaccatgccaggg

SEQ ID NO: 9021641 - DNA, 19 bp, Homo sapiens
ccaggcctgcgggcgttgg

SEQ ID NO: 9021642 - DNA, 19 bp, Homo sapiens
ccaggcctgcgggcgttgg

SEQ ID NO: 9021643 - DNA, 19 bp, Homo sapiens
ccaggcctgcgggcgttgg

SEQ ID NO: 9021644 - DNA, 22 bp, Homo sapiens
ccaggcctgcatctgctgcgca

SEQ ID NO: 9021645 - DNA, 22 bp, Homo sapiens
ccaggcctgcattccctctcag

SEQ ID NO: 9021646 - DNA, 22 bp, Homo sapiens
ccaggcctgcattccctctcag

SEQ ID NO: 9021647 - DNA, 22 bp, Homo sapiens
ccaggcctgcatctgctgcgca

SEQ ID NO: 9021648 - DNA, 22 bp, Homo sapiens
tctttgaaagctgttctagagt

SEQ ID NO: 9021649 - DNA, 22 bp, Homo sapiens
tctttgaaaagggagatagaaa

SEQ ID NO: 9021650 - DNA, 22 bp, Homo sapiens
tctttgaaacaccctaaccttt

SEQ ID NO: 9021651 - DNA, 22 bp, Homo sapiens
tctttgaaaagggagatagaaa

SEQ ID NO: 9021652 - DNA, 22 bp, Homo sapiens
tctttctttatcacctgatatg

SEQ ID NO: 9021653 - DNA, 22 bp, Homo sapiens
tctttgaaaagatattcctcct

SEQ ID NO: 9021654 - DNA, 22 bp, Homo sapiens
ccaggccagtgtttggtccagg

SEQ ID NO: 9021655 - DNA, 22 bp, Homo sapiens
ccaggccagtgtttggtccagg

SEQ ID NO: 9021656 - DNA, 22 bp, Homo sapiens
ccaggccagggctgcagcgagc

SEQ ID NO: 9021657 - DNA, 22 bp, Homo sapiens
ccaggccagggctgcagcgagc

SEQ ID NO: 9021658 - DNA, 22 bp, Homo sapiens
ccaggccagggctgcagcgagc

SEQ ID NO: 9021659 - DNA, 22 bp, Homo sapiens
ccaggccagggctgcagcgagc

SEQ ID NO: 9021660 - DNA, 22 bp, Homo sapiens
ccaggccagggctgcagcgagc

SEQ ID NO: 9021661 - DNA, 21 bp, Homo sapiens
ccaggccaggcctacggggat

SEQ ID NO: 9021662 - DNA, 22 bp, Homo sapiens
ccaggccagtgtttggtccagg

SEQ ID NO: 9021663 - DNA, 22 bp, Homo sapiens
ccaggccagtgtttggtccagg

SEQ ID NO: 9021664 - DNA, 22 bp, Homo sapiens
ccaggccagtgtttggtccagg

SEQ ID NO: 9021665 - DNA, 19 bp, Homo sapiens
ccaggccatcccagttccc

SEQ ID NO: 9021666 - DNA, 19 bp, Homo sapiens
ccaggccatcccagttccc

SEQ ID NO: 9021667 - DNA, 19 bp, Homo sapiens
ccaggccatcccagttccc

SEQ ID NO: 9021668 - DNA, 22 bp, Homo sapiens
ccaggccattcccagagttgct

SEQ ID NO: 9021669 - DNA, 18 bp, Homo sapiens
ccaggccatgaacctctg

SEQ ID NO: 9021670 - DNA, 18 bp, Homo sapiens
ccaggccatgaacctctg

SEQ ID NO: 9021671 - DNA, 22 bp, Homo sapiens
ccaggccattcccagagttgct

SEQ ID NO: 9021672 - DNA, 22 bp, Homo sapiens
ccaggccattcccagagttgct

SEQ ID NO: 9021673 - DNA, 22 bp, Homo sapiens
ccaggcccagggtactgaccaa

SEQ ID NO: 9021674 - DNA, 22 bp, Homo sapiens
ccaggccccagggctggctttc

SEQ ID NO: 9021675 - DNA, 22 bp, Homo sapiens
ccaggcccaccttggccactta

SEQ ID NO: 9021676 - DNA, 22 bp, Homo sapiens
ccaggcccagggtactgaccaa

SEQ ID NO: 9021677 - DNA, 22 bp, Homo sapiens
ccaggcccagggtactgaccaa

SEQ ID NO: 9021678 - DNA, 22 bp, Homo sapiens
ccaggcccaccttggccactta

SEQ ID NO: 9021679 - DNA, 22 bp, Homo sapiens
ccaggcccaccttggccactta

SEQ ID NO: 9021680 - DNA, 22 bp, Homo sapiens
ccaggcccaccttggccactta

SEQ ID NO: 9021681 - DNA, 22 bp, Homo sapiens
tctttcaaatgcttgaattgga

SEQ ID NO: 9021682 - DNA, 22 bp, Homo sapiens
ccaggcccccgagcagaagaca

SEQ ID NO: 9021683 - DNA, 22 bp, Homo sapiens
ccaggccccagggctggctttc

SEQ ID NO: 9021684 - DNA, 22 bp, Homo sapiens
ccaggccccagggctggctttc

SEQ ID NO: 9021685 - DNA, 22 bp, Homo sapiens
ccaggccccagggctggctttc

SEQ ID NO: 9021686 - DNA, 22 bp, Homo sapiens
tctttcaatccattcatatgtc

SEQ ID NO: 9021687 - DNA, 22 bp, Homo sapiens
tctttcttattagccattgttc

SEQ ID NO: 9021688 - DNA, 22 bp, Homo sapiens
tctttcttattagccattgttc

SEQ ID NO: 9021689 - DNA, 22 bp, Homo sapiens
ccaggagacaaagatgactgct

SEQ ID NO: 9021690 - DNA, 22 bp, Homo sapiens
ccaggagacaaagatgactgct

SEQ ID NO: 9021691 - DNA, 22 bp, Homo sapiens
ccaggagacccagggaaggagc

SEQ ID NO: 9021692 - DNA, 22 bp, Homo sapiens
ccaggagacaaagatgactgct

SEQ ID NO: 9021693 - DNA, 22 bp, Homo sapiens
ccaggagacaaagatgactgct

SEQ ID NO: 9021694 - DNA, 22 bp, Homo sapiens
ccaggagacaaagatgactgct

SEQ ID NO: 9021695 - DNA, 22 bp, Homo sapiens
ccaggagaatgggattacccta

SEQ ID NO: 9021696 - DNA, 22 bp, Homo sapiens
ccaggagaatgggattacccta

SEQ ID NO: 9021697 - DNA, 22 bp, Homo sapiens
ccaggagaatgggattacccta

SEQ ID NO: 9021698 - DNA, 22 bp, Homo sapiens
ccaggagactgtactgatattt

SEQ ID NO: 9021699 - DNA, 22 bp, Homo sapiens
ccaggagactgtactgatattt

SEQ ID NO: 9021700 - DNA, 22 bp, Homo sapiens
ccaggagacccagggaaggagc

SEQ ID NO: 9021701 - DNA, 22 bp, Homo sapiens
ccaggagggaggagttcctgag

SEQ ID NO: 9021702 - DNA, 22 bp, Homo sapiens
ccaggaggttgaggctgcagtg

SEQ ID NO: 9021703 - DNA, 22 bp, Homo sapiens
ccaggaggttgaggctgcagtg

SEQ ID NO: 9021704 - DNA, 22 bp, Homo sapiens
ccaggaggttgaggctgcagtg

SEQ ID NO: 9021705 - DNA, 22 bp, Homo sapiens
ccaggaggttgaggctgcagtg

SEQ ID NO: 9021706 - DNA, 22 bp, Homo sapiens
ccaggaggttgaggctgcagtg

SEQ ID NO: 9021707 - DNA, 22 bp, Homo sapiens
ccaggaggttgaggctgcagtg

SEQ ID NO: 9021708 - DNA, 22 bp, Homo sapiens
ccaggagggaccgcggcatccc

SEQ ID NO: 9021709 - DNA, 22 bp, Homo sapiens
ccaggagggaccgcggcatccc

SEQ ID NO: 9021710 - DNA, 17 bp, Homo sapiens
ccaggagagatgcttgt

SEQ ID NO: 9021711 - DNA, 22 bp, Homo sapiens
ccaggagtcaataaaggaagct

SEQ ID NO: 9021712 - DNA, 22 bp, Homo sapiens
ccaggagtcaataaaggaagct

SEQ ID NO: 9021713 - DNA, 22 bp, Homo sapiens
ccaggagtctggatgaggtgtc

SEQ ID NO: 9021714 - DNA, 22 bp, Homo sapiens
ccaggagtgcagggatggtatc

SEQ ID NO: 9021715 - DNA, 22 bp, Homo sapiens
ccaggagtctggatgaggtgtc

SEQ ID NO: 9021716 - DNA, 19 bp, Homo sapiens
ccaggagtggtggggtgag

SEQ ID NO: 9021717 - DNA, 22 bp, Homo sapiens
ccaggagttggaagctgccatg

SEQ ID NO: 9021718 - DNA, 19 bp, Homo sapiens
ccaggagtggtggggtgag

SEQ ID NO: 9021719 - DNA, 19 bp, Homo sapiens
ccaggagtggtggggtgag

SEQ ID NO: 9021720 - DNA, 22 bp, Homo sapiens
ccaggagtggctggtgaccttc

SEQ ID NO: 9021721 - DNA, 22 bp, Homo sapiens
ccaggagtggctggtgaccttc

SEQ ID NO: 9021722 - DNA, 22 bp, Homo sapiens
ccaggagtctggatgaggtgtc

SEQ ID NO: 9021723 - DNA, 22 bp, Homo sapiens
ccaggagtgcagggatggtatc

SEQ ID NO: 9021724 - DNA, 22 bp, Homo sapiens
ccaggagtctggatgaggtgtc

SEQ ID NO: 9021725 - DNA, 22 bp, Homo sapiens
ccaggagtggctggtgaccttc

SEQ ID NO: 9021726 - DNA, 22 bp, Homo sapiens
ccaggaggttgaggctgcagtg

SEQ ID NO: 9021727 - DNA, 22 bp, Homo sapiens
ccaggaggttgaggctgcagtg

SEQ ID NO: 9021728 - DNA, 22 bp, Homo sapiens
ccaggaggttgaggctgcagtg

SEQ ID NO: 9021729 - DNA, 22 bp, Homo sapiens
ccaggaggttgaggctgcagtg

SEQ ID NO: 9021730 - DNA, 22 bp, Homo sapiens
ccaggaggttgaggctgcagtg

SEQ ID NO: 9021731 - DNA, 22 bp, Homo sapiens
ccaggaggttgaggctgcagtg

SEQ ID NO: 9021732 - DNA, 22 bp, Homo sapiens
ccaggaggttgaggctgcagtg

SEQ ID NO: 9021733 - DNA, 22 bp, Homo sapiens
ccaggaggttgaggctgcagtg

SEQ ID NO: 9021734 - DNA, 22 bp, Homo sapiens
ccaggaggttgaggctgcagtg

SEQ ID NO: 9021735 - DNA, 22 bp, Homo sapiens
ccaggaggttgaggctgcagtg

SEQ ID NO: 9021736 - DNA, 22 bp, Homo sapiens
ccaggatgacccccactttcct

SEQ ID NO: 9021737 - DNA, 22 bp, Homo sapiens
ccaggatgacccccactttcct

SEQ ID NO: 9021738 - DNA, 22 bp, Homo sapiens
ccaggagtttgaggctgcagtg

SEQ ID NO: 9021739 - DNA, 22 bp, Homo sapiens
ccaggatggggagcagatagaa

SEQ ID NO: 9021740 - DNA, 22 bp, Homo sapiens
ccaggatggggagcagatagaa

SEQ ID NO: 9021741 - DNA, 22 bp, Homo sapiens
ccaggatggggagcagatagaa

SEQ ID NO: 9021742 - DNA, 22 bp, Homo sapiens
ccaggcaaaacagatttgtatg

SEQ ID NO: 9021743 - DNA, 22 bp, Homo sapiens
ccaggatggggagcagatagaa

SEQ ID NO: 9021744 - DNA, 22 bp, Homo sapiens
ccaggcaaagcccatgcaagag

SEQ ID NO: 9021745 - DNA, 22 bp, Homo sapiens
ccaggcaaagcccatgcaagag

SEQ ID NO: 9021746 - DNA, 22 bp, Homo sapiens
ccaggcaaatccctctggcaga

SEQ ID NO: 9021747 - DNA, 22 bp, Homo sapiens
ccaggcaaatccctctggcaga

SEQ ID NO: 9021748 - DNA, 22 bp, Homo sapiens
ccaggcaaatccctctggcaga

SEQ ID NO: 9021749 - DNA, 22 bp, Homo sapiens
ccaggagttggaggctgcagtg

SEQ ID NO: 9021750 - DNA, 22 bp, Homo sapiens
ccaggagttggaggctgcagtg

SEQ ID NO: 9021751 - DNA, 22 bp, Homo sapiens
ccaggagttggaggctgcagtg

SEQ ID NO: 9021752 - DNA, 22 bp, Homo sapiens
ccaggagttggaggctgcagtg

SEQ ID NO: 9021753 - DNA, 22 bp, Homo sapiens
ccaggagttggaagctgccatg

SEQ ID NO: 9021754 - DNA, 22 bp, Homo sapiens
ccaggagttggaggctgcagtg

SEQ ID NO: 9021755 - DNA, 22 bp, Homo sapiens
ccaggagttggaagctgccatg

SEQ ID NO: 9021756 - DNA, 22 bp, Homo sapiens
ccaggagttggaggttgcagtg

SEQ ID NO: 9021757 - DNA, 22 bp, Homo sapiens
ccaggagttggaggttgcagtg

SEQ ID NO: 9021758 - DNA, 22 bp, Homo sapiens
ccaggagttggaggctgcagtg

SEQ ID NO: 9021759 - DNA, 22 bp, Homo sapiens
ccaggagtttgaggctgcagtg

SEQ ID NO: 9021760 - DNA, 22 bp, Homo sapiens
ccaggagtttgaggctgcagtg

SEQ ID NO: 9021761 - DNA, 22 bp, Homo sapiens
ccaggagtttgaggctgcagtg

SEQ ID NO: 9021762 - DNA, 22 bp, Homo sapiens
ccaggagtttgaggctgcagtg

SEQ ID NO: 9021763 - DNA, 22 bp, Homo sapiens
ccaggagtttgaggctgcagtg

SEQ ID NO: 9021764 - DNA, 22 bp, Homo sapiens
tcttcacattttaagaagttct

SEQ ID NO: 9021765 - DNA, 22 bp, Homo sapiens
tcttcacattttaagaagttct

SEQ ID NO: 9021766 - DNA, 22 bp, Homo sapiens
tcttcacattttaagaagttct

SEQ ID NO: 9021767 - DNA, 22 bp, Homo sapiens
tcttcacattttagtggtttgt

SEQ ID NO: 9021768 - DNA, 22 bp, Homo sapiens
tcttcacattttaagaagttct

SEQ ID NO: 9021769 - DNA, 22 bp, Homo sapiens
tcttcactgatgtctctcaaat

SEQ ID NO: 9021770 - DNA, 22 bp, Homo sapiens
tcttcaccatcaacagaatgaa

SEQ ID NO: 9021771 - DNA, 22 bp, Homo sapiens
tcttcacattcacgtaacatag

SEQ ID NO: 9021772 - DNA, 22 bp, Homo sapiens
tcttcacattcacgtaacatag

SEQ ID NO: 9021773 - DNA, 22 bp, Homo sapiens
tcttcacattcacgtaacatag

SEQ ID NO: 9021774 - DNA, 22 bp, Homo sapiens
tcttcacatggagaagcaactc

SEQ ID NO: 9021775 - DNA, 22 bp, Homo sapiens
ccaggcaagagaggctctggca

SEQ ID NO: 9021776 - DNA, 22 bp, Homo sapiens
ccaggcaagagaggctctggca

SEQ ID NO: 9021777 - DNA, 22 bp, Homo sapiens
ccaggcaagagaggctctggca

SEQ ID NO: 9021778 - DNA, 20 bp, Homo sapiens
ccaggcaactatcctgtctc

SEQ ID NO: 9021779 - DNA, 20 bp, Homo sapiens
ccaggcaactatcctgtctc

SEQ ID NO: 9021780 - DNA, 20 bp, Homo sapiens
ccaggcaactatcctgtctc

SEQ ID NO: 9021781 - DNA, 20 bp, Homo sapiens
ccaggcaactatcctgtctc

SEQ ID NO: 9021782 - DNA, 22 bp, Homo sapiens
ccaggcaacggagcccactgcc

SEQ ID NO: 9021783 - DNA, 22 bp, Homo sapiens
ccaggcaagctctgctgtgccc

SEQ ID NO: 9021784 - DNA, 22 bp, Homo sapiens
ccaggcaagctctgctgtgccc

SEQ ID NO: 9021785 - DNA, 15 bp, Homo sapiens
ccaggcaagcaggaa

SEQ ID NO: 9021786 - DNA, 22 bp, Homo sapiens
ccaggcaaggacatgaaactga

SEQ ID NO: 9021787 - DNA, 22 bp, Homo sapiens
tcttagaatgtcaactgatgtt

SEQ ID NO: 9021788 - DNA, 22 bp, Homo sapiens
tcttagaatgtcaactgatgtt

SEQ ID NO: 9021789 - DNA, 22 bp, Homo sapiens
ccaggcaaggtctcctagagag

SEQ ID NO: 9021790 - DNA, 22 bp, Homo sapiens
ccaggcaaggtctcctagagag

SEQ ID NO: 9021791 - DNA, 22 bp, Homo sapiens
tcttcagagtgagcagtgtcat

SEQ ID NO: 9021792 - DNA, 22 bp, Homo sapiens
tcttcagagtgaaagtctgtga

SEQ ID NO: 9021793 - DNA, 20 bp, Homo sapiens
tcttccaggtacagtctgca

SEQ ID NO: 9021794 - DNA, 22 bp, Homo sapiens
tcttcagataaagggagagtat

SEQ ID NO: 9021795 - DNA, 22 bp, Homo sapiens
tcttccagtctgtaggactagg

SEQ ID NO: 9021796 - DNA, 22 bp, Homo sapiens
tcttccagtctgtaggactagg

SEQ ID NO: 9021797 - DNA, 22 bp, Homo sapiens
tcttccagtgctgtgtagagct

SEQ ID NO: 9021798 - DNA, 22 bp, Homo sapiens
tcttccagtgctgtgtagagct

SEQ ID NO: 9021799 - DNA, 22 bp, Homo sapiens
tcttccagtctgtaggactagg

SEQ ID NO: 9021800 - DNA, 22 bp, Homo sapiens
tcttccaggtatgtttctagtt

SEQ ID NO: 9021801 - DNA, 22 bp, Homo sapiens
tcttccaggtatgtttctagtt

SEQ ID NO: 9021802 - DNA, 22 bp, Homo sapiens
tcttccaggtatgtttctagtt

SEQ ID NO: 9021803 - DNA, 19 bp, Homo sapiens
tcttccagtcacataacaa

SEQ ID NO: 9021804 - DNA, 19 bp, Homo sapiens
tcttccagtcacataacaa

SEQ ID NO: 9021805 - DNA, 22 bp, Homo sapiens
tcttcccagtgagacttatggg

SEQ ID NO: 9021806 - DNA, 22 bp, Homo sapiens
tcttcccagtgagacttatggg

SEQ ID NO: 9021807 - DNA, 22 bp, Homo sapiens
tcttcccagctgctgcgatgcc

SEQ ID NO: 9021808 - DNA, 22 bp, Homo sapiens
tcttcccagaggaggtgccagc

SEQ ID NO: 9021809 - DNA, 22 bp, Homo sapiens
tcttcccagaggaggtgccagc

SEQ ID NO: 9021810 - DNA, 22 bp, Homo sapiens
tcttcccactgcccatgggcag

SEQ ID NO: 9021811 - DNA, 22 bp, Homo sapiens
tcttcccagaccttacatgtga

SEQ ID NO: 9021812 - DNA, 22 bp, Homo sapiens
tcttccagtgctgtgtagagct

SEQ ID NO: 9021813 - DNA, 22 bp, Homo sapiens
tcttccagtgtagacatctgcc

SEQ ID NO: 9021814 - DNA, 22 bp, Homo sapiens
tcttccagtgtagacatctgcc

SEQ ID NO: 9021815 - DNA, 22 bp, Homo sapiens
tcttccagtgtagacatctgcc

SEQ ID NO: 9021816 - DNA, 22 bp, Homo sapiens
tcttccagtgtagacatctgcc

SEQ ID NO: 9021817 - DNA, 22 bp, Homo sapiens
tcttcccaatgcaaagtaggac

SEQ ID NO: 9021818 - DNA, 22 bp, Homo sapiens
tcttcccagaccttacatgtga

SEQ ID NO: 9021819 - DNA, 22 bp, Homo sapiens
tcttcagaggagctgaatatat

SEQ ID NO: 9021820 - DNA, 22 bp, Homo sapiens
tcttcagaggagctgaatatat

SEQ ID NO: 9021821 - DNA, 22 bp, Homo sapiens
tcttcagagcatttctgaggta

SEQ ID NO: 9021822 - DNA, 22 bp, Homo sapiens
tcttcagagcatttctgaggta

SEQ ID NO: 9021823 - DNA, 22 bp, Homo sapiens
tcttcagaggaagtcagtcttt

SEQ ID NO: 9021824 - DNA, 22 bp, Homo sapiens
tcttcagagcatttctgaggta

SEQ ID NO: 9021825 - DNA, 22 bp, Homo sapiens
tcttcagagcatttctgaggta

SEQ ID NO: 9021826 - DNA, 22 bp, Homo sapiens
tcttcagagatgtaacatatgg

SEQ ID NO: 9021827 - DNA, 22 bp, Homo sapiens
tcttcagagatgtaacatatgg

SEQ ID NO: 9021828 - DNA, 22 bp, Homo sapiens
tcttcagagatgtaacatatgg

SEQ ID NO: 9021829 - DNA, 22 bp, Homo sapiens
tcttcagagatgtaacatatgg

SEQ ID NO: 9021830 - DNA, 22 bp, Homo sapiens
tcttcagagactctgagcccct

SEQ ID NO: 9021831 - DNA, 22 bp, Homo sapiens
tcttcagagactctgagcccct

SEQ ID NO: 9021832 - DNA, 22 bp, Homo sapiens
tcttcagagactctgagcccct

SEQ ID NO: 9021833 - DNA, 22 bp, Homo sapiens
tcttcagactccaaatgtttta

SEQ ID NO: 9021834 - DNA, 22 bp, Homo sapiens
tcttcagactccaaatgtttta

SEQ ID NO: 9021835 - DNA, 22 bp, Homo sapiens
tcttcagactccaaatgtttta

SEQ ID NO: 9021836 - DNA, 22 bp, Homo sapiens
tcttcagactccaaatgtttta

SEQ ID NO: 9021837 - DNA, 22 bp, Homo sapiens
tcttcagactgttgttcttttg

SEQ ID NO: 9021838 - DNA, 22 bp, Homo sapiens
tcttcagactgttgttcttttg

SEQ ID NO: 9021839 - DNA, 22 bp, Homo sapiens
tcttcagacccttagctgtgat

SEQ ID NO: 9021840 - DNA, 22 bp, Homo sapiens
tcttcagacccttagctgtgat

SEQ ID NO: 9021841 - DNA, 22 bp, Homo sapiens
tcttcagaaaattatcacttgt

SEQ ID NO: 9021842 - DNA, 22 bp, Homo sapiens
tcttcagaaaattatcacttgt

SEQ ID NO: 9021843 - DNA, 22 bp, Homo sapiens
tcttcactgatgtctctcaaat

SEQ ID NO: 9021844 - DNA, 22 bp, Homo sapiens
tcttcagaagatcacatcagtg

SEQ ID NO: 9021845 - DNA, 22 bp, Homo sapiens
tcttcagaagatcacatcagtg

SEQ ID NO: 9021846 - DNA, 22 bp, Homo sapiens
tcttcagacccttagctgtgat

SEQ ID NO: 9021847 - DNA, 22 bp, Homo sapiens
tcttcagaagatcacatcagtg

SEQ ID NO: 9021848 - DNA, 22 bp, Homo sapiens
ccaggccagagtgcagtggcac

SEQ ID NO: 9021849 - DNA, 22 bp, Homo sapiens
ccaggccagagtgcagtggcac

SEQ ID NO: 9021850 - DNA, 22 bp, Homo sapiens
ccaggccagagtgcagtggcac

SEQ ID NO: 9021851 - DNA, 22 bp, Homo sapiens
ccaggccagagtgcagtggcac

SEQ ID NO: 9021852 - DNA, 22 bp, Homo sapiens
ccaggccagcctggagcatggc

SEQ ID NO: 9021853 - DNA, 22 bp, Homo sapiens
ccaggccagcaggcacacctgc

SEQ ID NO: 9021854 - DNA, 22 bp, Homo sapiens
ccaggccagcaggcacacctgc

SEQ ID NO: 9021855 - DNA, 22 bp, Homo sapiens
ccaggccagcaggcacacctgc

SEQ ID NO: 9021856 - DNA, 22 bp, Homo sapiens
ccaggccagcaggcacacctgc

SEQ ID NO: 9021857 - DNA, 22 bp, Homo sapiens
ccaggccagcaggcacacctgc

SEQ ID NO: 9021858 - DNA, 22 bp, Homo sapiens
ccaggccagcgctggctggagg

SEQ ID NO: 9021859 - DNA, 22 bp, Homo sapiens
ccaggccagcgctggctggagg

SEQ ID NO: 9021860 - DNA, 22 bp, Homo sapiens
ccaggccaggagagcgaggttt

SEQ ID NO: 9021861 - DNA, 22 bp, Homo sapiens
ccaggccagcgctggctggagg

SEQ ID NO: 9021862 - DNA, 22 bp, Homo sapiens
ccaggccagcgctggctggagg

SEQ ID NO: 9021863 - DNA, 22 bp, Homo sapiens
ccaggccagcctggagcatggc

SEQ ID NO: 9021864 - DNA, 22 bp, Homo sapiens
ccaggccagcctggagcatggc

SEQ ID NO: 9021865 - DNA, 22 bp, Homo sapiens
ccaggccagcctggagcatggc

SEQ ID NO: 9021866 - DNA, 22 bp, Homo sapiens
ccaggccagcgctggctggagg

SEQ ID NO: 9021867 - DNA, 22 bp, Homo sapiens
ccaggccagcgctggctggagg

SEQ ID NO: 9021868 - DNA, 22 bp, Homo sapiens
ccaggccagcgctggctggagg

SEQ ID NO: 9021869 - DNA, 22 bp, Homo sapiens
ccaggccagagtgcagtggcac

SEQ ID NO: 9021870 - DNA, 22 bp, Homo sapiens
ccaggcaggctagaatgtaaat

SEQ ID NO: 9021871 - DNA, 19 bp, Homo sapiens
tcttccctggctgtcagtc

SEQ ID NO: 9021872 - DNA, 22 bp, Homo sapiens
tcttccctcttctgccaaatac

SEQ ID NO: 9021873 - DNA, 22 bp, Homo sapiens
tcttcctatgccaacattctgt

SEQ ID NO: 9021874 - DNA, 22 bp, Homo sapiens
tcttcctatggggctgcaggaa

SEQ ID NO: 9021875 - DNA, 22 bp, Homo sapiens
tcttcccattagtaatgaagtg

SEQ ID NO: 9021876 - DNA, 21 bp, Homo sapiens
tcttcccattatgttccaatt

SEQ ID NO: 9021877 - DNA, 22 bp, Homo sapiens
tcttcccattagtaatgaagtg

SEQ ID NO: 9021878 - DNA, 22 bp, Homo sapiens
tcttcccccgtgctccagtgca

SEQ ID NO: 9021879 - DNA, 22 bp, Homo sapiens
tcttcccccgtgctccagtgca

SEQ ID NO: 9021880 - DNA, 22 bp, Homo sapiens
tcttcccccgtgctccagtgca

SEQ ID NO: 9021881 - DNA, 21 bp, Homo sapiens
tcttccctcaggatgtcctgc

SEQ ID NO: 9021882 - DNA, 22 bp, Homo sapiens
tcttccctaatcaccatcttca

SEQ ID NO: 9021883 - DNA, 21 bp, Homo sapiens
tcttccctcaggatgtcctgc

SEQ ID NO: 9021884 - DNA, 22 bp, Homo sapiens
ccaggagaagcatctgagtgta

SEQ ID NO: 9021885 - DNA, 22 bp, Homo sapiens
ccaggagaagcatctgagtgta

SEQ ID NO: 9021886 - DNA, 22 bp, Homo sapiens
ccaggagaagcatctgagtgta

SEQ ID NO: 9021887 - DNA, 22 bp, Homo sapiens
ccaggagaagcatctgagtgta

SEQ ID NO: 9021888 - DNA, 22 bp, Homo sapiens
ccaggagaagcatctgagtgta

SEQ ID NO: 9021889 - DNA, 22 bp, Homo sapiens
ccaggagaagcatctgagtgta

SEQ ID NO: 9021890 - DNA, 22 bp, Homo sapiens
ccaggagaataatggcagatta

SEQ ID NO: 9021891 - DNA, 22 bp, Homo sapiens
ccaggagaataatggcagatta

SEQ ID NO: 9021892 - DNA, 22 bp, Homo sapiens
ccaggagaataatggcagatta

SEQ ID NO: 9021893 - DNA, 22 bp, Homo sapiens
ccaggacttattacagtataac

SEQ ID NO: 9021894 - DNA, 20 bp, Homo sapiens
ccaggactgctggggactct

SEQ ID NO: 9021895 - DNA, 20 bp, Homo sapiens
ccaggactgctggggactct

SEQ ID NO: 9021896 - DNA, 22 bp, Homo sapiens
ccaggactgcagggggcgagga

SEQ ID NO: 9021897 - DNA, 22 bp, Homo sapiens
tctggtttcaatgggtacgatt

SEQ ID NO: 9021898 - DNA, 22 bp, Homo sapiens
ccaggactgcagggggcgagga

SEQ ID NO: 9021899 - DNA, 22 bp, Homo sapiens
ccaggactttaagtccagcact

SEQ ID NO: 9021900 - DNA, 19 bp, Homo sapiens
ccaggactttgcagacact

SEQ ID NO: 9021901 - DNA, 22 bp, Homo sapiens
ccaggactttaagtccagcact

SEQ ID NO: 9021902 - DNA, 22 bp, Homo sapiens
ccaggacttcgaggctacagtg

SEQ ID NO: 9021903 - DNA, 22 bp, Homo sapiens
ccaggacttcgaggctacagtg

SEQ ID NO: 9021904 - DNA, 22 bp, Homo sapiens
tctggtgtcagtattctttgaa

SEQ ID NO: 9021905 - DNA, 22 bp, Homo sapiens
tctggtggtgggccacaagcat

SEQ ID NO: 9021906 - DNA, 22 bp, Homo sapiens
tctggtggtatacatctaggag

SEQ ID NO: 9021907 - DNA, 21 bp, Homo sapiens
tctggtctgctgtggacctgg

SEQ ID NO: 9021908 - DNA, 22 bp, Homo sapiens
tctggtcccttttcctgcagtc

SEQ ID NO: 9021909 - DNA, 20 bp, Homo sapiens
tctggtgccccttcctgaga

SEQ ID NO: 9021910 - DNA, 22 bp, Homo sapiens
tctggtggtatacatctaggag

SEQ ID NO: 9021911 - DNA, 20 bp, Homo sapiens
tctggtgccccttcctgaga

SEQ ID NO: 9021912 - DNA, 22 bp, Homo sapiens
tctggtcctgaagtcaacttca

SEQ ID NO: 9021913 - DNA, 22 bp, Homo sapiens
tctggtcctgaagtcaacttca

SEQ ID NO: 9021914 - DNA, 22 bp, Homo sapiens
tctggtcctctctgtgatgcta

SEQ ID NO: 9021915 - DNA, 22 bp, Homo sapiens
tctggtcctctctgtgatgcta

SEQ ID NO: 9021916 - DNA, 22 bp, Homo sapiens
tctggtcctctctgtgatgcta

SEQ ID NO: 9021917 - DNA, 22 bp, Homo sapiens
tctggtcccttttcctgcagtc

SEQ ID NO: 9021918 - DNA, 22 bp, Homo sapiens
tctggtcccttttcctgcagtc

SEQ ID NO: 9021919 - DNA, 22 bp, Homo sapiens
tctggtccctgctcacttcttg

SEQ ID NO: 9021920 - DNA, 22 bp, Homo sapiens
tctggtccctgtgtcacctctc

SEQ ID NO: 9021921 - DNA, 22 bp, Homo sapiens
tctggtccctgtgtcacctctc

SEQ ID NO: 9021922 - DNA, 22 bp, Homo sapiens
tctggtcccttttcctgcagtc

SEQ ID NO: 9021923 - DNA, 22 bp, Homo sapiens
tctggtcccttttcctgcagtc

SEQ ID NO: 9021924 - DNA, 22 bp, Homo sapiens
tctggtccccattccaggtggg

SEQ ID NO: 9021925 - DNA, 22 bp, Homo sapiens
tctggtccccattccaggtggg

SEQ ID NO: 9021926 - DNA, 22 bp, Homo sapiens
tctggtcatcggaaagatcaaa

SEQ ID NO: 9021927 - DNA, 22 bp, Homo sapiens
tctggtccccattccaggtggg

SEQ ID NO: 9021928 - DNA, 22 bp, Homo sapiens
tctgggagccatgccttggagt

SEQ ID NO: 9021929 - DNA, 22 bp, Homo sapiens
tctgggagccatgccttggagt

SEQ ID NO: 9021930 - DNA, 22 bp, Homo sapiens
tctgggagcagctcagcagatt

SEQ ID NO: 9021931 - DNA, 22 bp, Homo sapiens
tctgggagcagctcagcagatt

SEQ ID NO: 9021932 - DNA, 22 bp, Homo sapiens
tctgggagcagctcagcagatt

SEQ ID NO: 9021933 - DNA, 22 bp, Homo sapiens
tctgggagccatgccttggagt

SEQ ID NO: 9021934 - DNA, 22 bp, Homo sapiens
tctgggagccatgccttggagt

SEQ ID NO: 9021935 - DNA, 22 bp, Homo sapiens
tctgggagccatgccttggagt

SEQ ID NO: 9021936 - DNA, 22 bp, Homo sapiens
tctgggagccatgccttggagt

SEQ ID NO: 9021937 - DNA, 22 bp, Homo sapiens
tctgggagcctgaaagtgaatg

SEQ ID NO: 9021938 - DNA, 20 bp, Homo sapiens
tctggggatgaggtctagga

SEQ ID NO: 9021939 - DNA, 22 bp, Homo sapiens
tctgggagcgctgtttttccca

SEQ ID NO: 9021940 - DNA, 22 bp, Homo sapiens
tctggtaacctttatccctcct

SEQ ID NO: 9021941 - DNA, 22 bp, Homo sapiens
tctggtagaagaagtgaagctg

SEQ ID NO: 9021942 - DNA, 22 bp, Homo sapiens
tctggtaataggcaatagcttg

SEQ ID NO: 9021943 - DNA, 22 bp, Homo sapiens
ccaggactcaatgaccacaggg

SEQ ID NO: 9021944 - DNA, 22 bp, Homo sapiens
ccaggactcagtggggaaaggg

SEQ ID NO: 9021945 - DNA, 22 bp, Homo sapiens
ccaggactcagtggggaaaggg

SEQ ID NO: 9021946 - DNA, 19 bp, Homo sapiens
tctgggagagtgaatctga

SEQ ID NO: 9021947 - DNA, 19 bp, Homo sapiens
tctgggagagtgaatctga

SEQ ID NO: 9021948 - DNA, 19 bp, Homo sapiens
tctgggagagtgaatctga

SEQ ID NO: 9021949 - DNA, 22 bp, Homo sapiens
tctgggagatccaagcagaact

SEQ ID NO: 9021950 - DNA, 19 bp, Homo sapiens
tctgggagagtgaatctga

SEQ ID NO: 9021951 - DNA, 19 bp, Homo sapiens
tctgggagagtgaatctga

SEQ ID NO: 9021952 - DNA, 21 bp, Homo sapiens
ccaggactccatggggtctct

SEQ ID NO: 9021953 - DNA, 22 bp, Homo sapiens
tctgggagatccaagcagaact

SEQ ID NO: 9021954 - DNA, 22 bp, Homo sapiens
tctgggagcacacgcagtgatc

SEQ ID NO: 9021955 - DNA, 22 bp, Homo sapiens
tctgggagcacacgcagtgatc

SEQ ID NO: 9021956 - DNA, 22 bp, Homo sapiens
tctgggagcacacgcagtgatc

SEQ ID NO: 9021957 - DNA, 22 bp, Homo sapiens
tctgggagcacacgcagtgatc

SEQ ID NO: 9021958 - DNA, 22 bp, Homo sapiens
tctgggagcacacgcagtgatc

SEQ ID NO: 9021959 - DNA, 22 bp, Homo sapiens
tctgggagcagatgatggtata

SEQ ID NO: 9021960 - DNA, 22 bp, Homo sapiens
tctgggagcagatgatggtata

SEQ ID NO: 9021961 - DNA, 22 bp, Homo sapiens
tctgggagcagatgatggtata

SEQ ID NO: 9021962 - DNA, 22 bp, Homo sapiens
tctgggagcagatgatggtata

SEQ ID NO: 9021963 - DNA, 22 bp, Homo sapiens
tctggccttatctgtccaagcc

SEQ ID NO: 9021964 - DNA, 22 bp, Homo sapiens
tctggcctgtgttggtggcccc

SEQ ID NO: 9021965 - DNA, 22 bp, Homo sapiens
tctggcctgaaagtccatgctt

SEQ ID NO: 9021966 - DNA, 22 bp, Homo sapiens
tctggcctgggcctgccggtgc

SEQ ID NO: 9021967 - DNA, 22 bp, Homo sapiens
tctggcctgtgttggtggcccc

SEQ ID NO: 9021968 - DNA, 22 bp, Homo sapiens
tctggcctcctccaccagggaa

SEQ ID NO: 9021969 - DNA, 22 bp, Homo sapiens
tctggcctcctccaccagggaa

SEQ ID NO: 9021970 - DNA, 22 bp, Homo sapiens
tctggcctactggagtccatga

SEQ ID NO: 9021971 - DNA, 22 bp, Homo sapiens
tctggcctatttctgtcagatc

SEQ ID NO: 9021972 - DNA, 22 bp, Homo sapiens
tctggcctatttctgtcagatc

SEQ ID NO: 9021973 - DNA, 22 bp, Homo sapiens
tctggccctgctgctgtgagca

SEQ ID NO: 9021974 - DNA, 22 bp, Homo sapiens
tctggccctgctgctgtgagca

SEQ ID NO: 9021975 - DNA, 22 bp, Homo sapiens
tctggcctactggagtccatga

SEQ ID NO: 9021976 - DNA, 22 bp, Homo sapiens
tctggccctgctgctgtgagca

SEQ ID NO: 9021977 - DNA, 22 bp, Homo sapiens
tctggcaggccttgtcaatctg

SEQ ID NO: 9021978 - DNA, 22 bp, Homo sapiens
tctggcaggggttctgcacttg

SEQ ID NO: 9021979 - DNA, 22 bp, Homo sapiens
tctggcaggcaatcggctctgg

SEQ ID NO: 9021980 - DNA, 22 bp, Homo sapiens
tctggcaggccttgtcaatctg

SEQ ID NO: 9021981 - DNA, 21 bp, Homo sapiens
tctggcaggcacgggcccagc

SEQ ID NO: 9021982 - DNA, 22 bp, Homo sapiens
tctggcaggcaatcggctctgg

SEQ ID NO: 9021983 - DNA, 22 bp, Homo sapiens
tctggcaggatatcgaagtgaa

SEQ ID NO: 9021984 - DNA, 22 bp, Homo sapiens
tctggcaggaccatgaagcgta

SEQ ID NO: 9021985 - DNA, 22 bp, Homo sapiens
tctggcagctctcctcggcgga

SEQ ID NO: 9021986 - DNA, 22 bp, Homo sapiens
tctggcagctcagttcaggtct

SEQ ID NO: 9021987 - DNA, 22 bp, Homo sapiens
tctggcaggacatgctgaccat

SEQ ID NO: 9021988 - DNA, 22 bp, Homo sapiens
tctggcagctctcctcggcgga

SEQ ID NO: 9021989 - DNA, 21 bp, Homo sapiens
tctggcaggaagacggatggg

SEQ ID NO: 9021990 - DNA, 21 bp, Homo sapiens
tctggcagcagtttgttgagt

SEQ ID NO: 9021991 - DNA, 22 bp, Homo sapiens
tctggcagcgaagcgtgtactt

SEQ ID NO: 9021992 - DNA, 22 bp, Homo sapiens
tctggcagctatcctctggcca

SEQ ID NO: 9021993 - DNA, 22 bp, Homo sapiens
tctggcagctatcctctggcca

SEQ ID NO: 9021994 - DNA, 22 bp, Homo sapiens
ccaggacagtgaacatgtaaga

SEQ ID NO: 9021995 - DNA, 22 bp, Homo sapiens
ccaggacagtgaacatgtaaga

SEQ ID NO: 9021996 - DNA, 22 bp, Homo sapiens
ccaggacagtgaacatgtaaga

SEQ ID NO: 9021997 - DNA, 22 bp, Homo sapiens
ccaggaccacacgacaggagag

SEQ ID NO: 9021998 - DNA, 22 bp, Homo sapiens
ccaggaccctgcaaaccctgtt

SEQ ID NO: 9021999 - DNA, 19 bp, Homo sapiens
ccaggacctttccagggtc

SEQ ID NO: 9022000 - DNA, 19 bp, Homo sapiens
ccaggacctttccagggtc

SEQ ID NO: 9022001 - DNA, 22 bp, Homo sapiens
ccaggacctggagctctatgaa

SEQ ID NO: 9022002 - DNA, 22 bp, Homo sapiens
ccaggacctggagctctatgaa

SEQ ID NO: 9022003 - DNA, 22 bp, Homo sapiens
ccaggacactgcttcacagcag

SEQ ID NO: 9022004 - DNA, 22 bp, Homo sapiens
ccaggacactgcttcacagcag

SEQ ID NO: 9022005 - DNA, 22 bp, Homo sapiens
ccaggacactgcttcacagcag

SEQ ID NO: 9022006 - DNA, 22 bp, Homo sapiens
ccaggacaggagttggcttcgc

SEQ ID NO: 9022007 - DNA, 22 bp, Homo sapiens
ccaggacaggagttggcttcgc

SEQ ID NO: 9022008 - DNA, 22 bp, Homo sapiens
ccaggacaggagttggcttcgc

SEQ ID NO: 9022009 - DNA, 18 bp, Homo sapiens
ccaggacaggcaaaaggt

SEQ ID NO: 9022010 - DNA, 22 bp, Homo sapiens
ccaggacagggagacgggagcc

SEQ ID NO: 9022011 - DNA, 22 bp, Homo sapiens
ccaggacagggagacgggagcc

SEQ ID NO: 9022012 - DNA, 22 bp, Homo sapiens
ccaggacagggagacgggagcc

SEQ ID NO: 9022013 - DNA, 22 bp, Homo sapiens
tctggctcacttcaggcttcac

SEQ ID NO: 9022014 - DNA, 22 bp, Homo sapiens
tctggctaacattttgtggaga

SEQ ID NO: 9022015 - DNA, 17 bp, Homo sapiens
tctggccttcctgaact

SEQ ID NO: 9022016 - DNA, 22 bp, Homo sapiens
ccaggaaggatcgtttgggagt

SEQ ID NO: 9022017 - DNA, 22 bp, Homo sapiens
ccaggacactgcttcacagcag

SEQ ID NO: 9022018 - DNA, 22 bp, Homo sapiens
tctggctcaggtcagacaggga

SEQ ID NO: 9022019 - DNA, 21 bp, Homo sapiens
ccaggaaggactgagctccct

SEQ ID NO: 9022020 - DNA, 22 bp, Homo sapiens
ccagctctgattttgacctcca

SEQ ID NO: 9022021 - DNA, 22 bp, Homo sapiens
ccagctctgcagggcctggggt

SEQ ID NO: 9022022 - DNA, 22 bp, Homo sapiens
ccagctctgcagggcctggggt

SEQ ID NO: 9022023 - DNA, 22 bp, Homo sapiens
ccagctctgccaagcgtcagct

SEQ ID NO: 9022024 - DNA, 22 bp, Homo sapiens
ccagctctgccaagcgtcagct

SEQ ID NO: 9022025 - DNA, 22 bp, Homo sapiens
ccagctctgccaagcgtcagct

SEQ ID NO: 9022026 - DNA, 22 bp, Homo sapiens
ccagctctgattttgacctcca

SEQ ID NO: 9022027 - DNA, 22 bp, Homo sapiens
ccagctctctgtcctccccaca

SEQ ID NO: 9022028 - DNA, 22 bp, Homo sapiens
ccagctctctgtcctccccaca

SEQ ID NO: 9022029 - DNA, 22 bp, Homo sapiens
ccagctctctgtcctccccaca

SEQ ID NO: 9022030 - DNA, 22 bp, Homo sapiens
ccagctctctttgaagcataaa

SEQ ID NO: 9022031 - DNA, 22 bp, Homo sapiens
ccagctctctttgaagcataaa

SEQ ID NO: 9022032 - DNA, 22 bp, Homo sapiens
ccagctctcttcaagcccactc

SEQ ID NO: 9022033 - DNA, 22 bp, Homo sapiens
ccagctctcttcaagcccactc

SEQ ID NO: 9022034 - DNA, 22 bp, Homo sapiens
ccagctgcaggtgttccagatg

SEQ ID NO: 9022035 - DNA, 22 bp, Homo sapiens
ccagctgcaggtgttccagatg

SEQ ID NO: 9022036 - DNA, 22 bp, Homo sapiens
ccagctgcaggtgttccagatg

SEQ ID NO: 9022037 - DNA, 22 bp, Homo sapiens
ccagctgcaggggagcagtgga

SEQ ID NO: 9022038 - DNA, 22 bp, Homo sapiens
ccagctgcaggggagcagtgga

SEQ ID NO: 9022039 - DNA, 22 bp, Homo sapiens
ccagctgcatgacattaggtga

SEQ ID NO: 9022040 - DNA, 22 bp, Homo sapiens
ccagctgcccaagaggcatcct

SEQ ID NO: 9022041 - DNA, 22 bp, Homo sapiens
ccagctgcatcctattcactgc

SEQ ID NO: 9022042 - DNA, 22 bp, Homo sapiens
ccagctgcatcctattcactgc

SEQ ID NO: 9022043 - DNA, 22 bp, Homo sapiens
ccagctgcatcctattcactgc

SEQ ID NO: 9022044 - DNA, 20 bp, Homo sapiens
ccagctgcagttcttaatga

SEQ ID NO: 9022045 - DNA, 20 bp, Homo sapiens
ccagctgcagttcttaatga

SEQ ID NO: 9022046 - DNA, 22 bp, Homo sapiens
ccagctgaggcagccacacagg

SEQ ID NO: 9022047 - DNA, 20 bp, Homo sapiens
ccagctgagccaaggggaga

SEQ ID NO: 9022048 - DNA, 22 bp, Homo sapiens
ccagctctgccaagcgtcagct

SEQ ID NO: 9022049 - DNA, 22 bp, Homo sapiens
ccagctgaggttgaagaaagag

SEQ ID NO: 9022050 - DNA, 22 bp, Homo sapiens
ccagctgaggttgaagaaagag

SEQ ID NO: 9022051 - DNA, 22 bp, Homo sapiens
ccagctgcaggggagcagtgga

SEQ ID NO: 9022052 - DNA, 22 bp, Homo sapiens
ccagctgcaggggagcagtgga

SEQ ID NO: 9022053 - DNA, 22 bp, Homo sapiens
ccagctgcagaatgttggggaa

SEQ ID NO: 9022054 - DNA, 22 bp, Homo sapiens
ccagctgcaggggagcagtgga

SEQ ID NO: 9022055 - DNA, 22 bp, Homo sapiens
ccagctgcaggggagcagtgga

SEQ ID NO: 9022056 - DNA, 22 bp, Homo sapiens
ccagctgctgacatgggcaggt

SEQ ID NO: 9022057 - DNA, 22 bp, Homo sapiens
ccagctgctgacatgggcaggt

SEQ ID NO: 9022058 - DNA, 22 bp, Homo sapiens
ccagctgctgacatgggcaggt

SEQ ID NO: 9022059 - DNA, 22 bp, Homo sapiens
ccagctgctgacatgggcaggt

SEQ ID NO: 9022060 - DNA, 22 bp, Homo sapiens
ccagctgctctcttctccgcca

SEQ ID NO: 9022061 - DNA, 22 bp, Homo sapiens
ccagctgctctcttctccgcca

SEQ ID NO: 9022062 - DNA, 22 bp, Homo sapiens
ccagctgctgcaccgtgcatgg

SEQ ID NO: 9022063 - DNA, 22 bp, Homo sapiens
ccagctgctgtgaggaccacag

SEQ ID NO: 9022064 - DNA, 22 bp, Homo sapiens
ccagctgctgtgaggaccacag

SEQ ID NO: 9022065 - DNA, 22 bp, Homo sapiens
ccagctgctgtgaggaccacag

SEQ ID NO: 9022066 - DNA, 22 bp, Homo sapiens
ccagctgctgtgaggaccacag

SEQ ID NO: 9022067 - DNA, 22 bp, Homo sapiens
ccagctgcttgggaaaatgtct

SEQ ID NO: 9022068 - DNA, 22 bp, Homo sapiens
tctggaggccatagggaaggat

SEQ ID NO: 9022069 - DNA, 22 bp, Homo sapiens
ccagctgctgtgcagggaggct

SEQ ID NO: 9022070 - DNA, 22 bp, Homo sapiens
ccagctgctgtgcagggaggct

SEQ ID NO: 9022071 - DNA, 22 bp, Homo sapiens
tctggcagcaagtctgtttctc

SEQ ID NO: 9022072 - DNA, 22 bp, Homo sapiens
tctggcagcagcatcagtggct

SEQ ID NO: 9022073 - DNA, 22 bp, Homo sapiens
tctggcagcaagtctgtttctc

SEQ ID NO: 9022074 - DNA, 21 bp, Homo sapiens
ccagctgcctgcactttggac

SEQ ID NO: 9022075 - DNA, 21 bp, Homo sapiens
ccagctgcctgcactttggac

SEQ ID NO: 9022076 - DNA, 18 bp, Homo sapiens
ccagctgcgctgaaccga

SEQ ID NO: 9022077 - DNA, 22 bp, Homo sapiens
ccagctgcgggcatcgagagtt

SEQ ID NO: 9022078 - DNA, 22 bp, Homo sapiens
ccagctgcgggcatcgagagtt

SEQ ID NO: 9022079 - DNA, 22 bp, Homo sapiens
ccagctgcgggcatcgagagtt

SEQ ID NO: 9022080 - DNA, 18 bp, Homo sapiens
ccagctgcgctgaaccga

SEQ ID NO: 9022081 - DNA, 22 bp, Homo sapiens
ccagctgcccactatgtgttct

SEQ ID NO: 9022082 - DNA, 22 bp, Homo sapiens
ccagctgcctaagcaatccata

SEQ ID NO: 9022083 - DNA, 22 bp, Homo sapiens
ccagctgcccactatgtgttct

SEQ ID NO: 9022084 - DNA, 22 bp, Homo sapiens
ccagctgcccaagaggcatcct

SEQ ID NO: 9022085 - DNA, 22 bp, Homo sapiens
ccagctgcccaagaggcatcct

SEQ ID NO: 9022086 - DNA, 22 bp, Homo sapiens
ccagctgcccaagaggcatcct

SEQ ID NO: 9022087 - DNA, 22 bp, Homo sapiens
ccagctgcccaagaggcatcct

SEQ ID NO: 9022088 - DNA, 22 bp, Homo sapiens
ccagctgctatcatgccatttc

SEQ ID NO: 9022089 - DNA, 17 bp, Homo sapiens
ccagctgctccctcaga

SEQ ID NO: 9022090 - DNA, 17 bp, Homo sapiens
ccagctgctccctcaga

SEQ ID NO: 9022091 - DNA, 17 bp, Homo sapiens
ccagctgctccctcaga

SEQ ID NO: 9022092 - DNA, 21 bp, Homo sapiens
ccagctgctccttgaggttcc

SEQ ID NO: 9022093 - DNA, 21 bp, Homo sapiens
ccagctgctccttgaggttcc

SEQ ID NO: 9022094 - DNA, 22 bp, Homo sapiens
ccagctgcggtctcccaaagtt

SEQ ID NO: 9022095 - DNA, 22 bp, Homo sapiens
ccagctgcggtctcccaaagtt

SEQ ID NO: 9022096 - DNA, 22 bp, Homo sapiens
ccagctgcgggcatcgagagtt

SEQ ID NO: 9022097 - DNA, 22 bp, Homo sapiens
ccagctgctaacacaaaggagt

SEQ ID NO: 9022098 - DNA, 22 bp, Homo sapiens
ccagctgctatcatgccatttc

SEQ ID NO: 9022099 - DNA, 22 bp, Homo sapiens
tctgcttctcctacttcatggg

SEQ ID NO: 9022100 - DNA, 22 bp, Homo sapiens
tctgctgtttactgtgtgatat

SEQ ID NO: 9022101 - DNA, 22 bp, Homo sapiens
tctgcttgcgttctgctccctc

SEQ ID NO: 9022102 - DNA, 22 bp, Homo sapiens
tctgcttctgtgaaggcagtct

SEQ ID NO: 9022103 - DNA, 22 bp, Homo sapiens
tctgcttgcgttctgctccctc

SEQ ID NO: 9022104 - DNA, 22 bp, Homo sapiens
tctgcttgtgtctgtccagcct

SEQ ID NO: 9022105 - DNA, 22 bp, Homo sapiens
tctgcttgtgtctgtccagcct

SEQ ID NO: 9022106 - DNA, 22 bp, Homo sapiens
tctgctttagacataaaaggta

SEQ ID NO: 9022107 - DNA, 22 bp, Homo sapiens
tctgctttagtgcaaagtctta

SEQ ID NO: 9022108 - DNA, 22 bp, Homo sapiens
tctgctttagacataaaaggta

SEQ ID NO: 9022109 - DNA, 22 bp, Homo sapiens
tctgctttatggctcagagact

SEQ ID NO: 9022110 - DNA, 22 bp, Homo sapiens
tctgctttcttactaaaaatga

SEQ ID NO: 9022111 - DNA, 22 bp, Homo sapiens
tctgctttcttactaaaaatga

SEQ ID NO: 9022112 - DNA, 22 bp, Homo sapiens
tctgctttcttactaaaaatga

SEQ ID NO: 9022113 - DNA, 22 bp, Homo sapiens
tctgctttcttactaaaaatga

SEQ ID NO: 9022114 - DNA, 22 bp, Homo sapiens
tctgctttcaaattcacttagt

SEQ ID NO: 9022115 - DNA, 22 bp, Homo sapiens
tctgctttcaaattcacttagt

SEQ ID NO: 9022116 - DNA, 18 bp, Homo sapiens
tctggaacaacttcatgt

SEQ ID NO: 9022117 - DNA, 18 bp, Homo sapiens
tctggaacaacttcatgt

SEQ ID NO: 9022118 - DNA, 18 bp, Homo sapiens
tctggaacaacttcatgt

SEQ ID NO: 9022119 - DNA, 22 bp, Homo sapiens
tctggaaatttcagttttagag

SEQ ID NO: 9022120 - DNA, 22 bp, Homo sapiens
tctggaaatttcagttttagag

SEQ ID NO: 9022121 - DNA, 22 bp, Homo sapiens
ccagctctcagcgggagactca

SEQ ID NO: 9022122 - DNA, 22 bp, Homo sapiens
ccagctctcagcgggagactca

SEQ ID NO: 9022123 - DNA, 22 bp, Homo sapiens
tctgctttgctgcctcctgatc

SEQ ID NO: 9022124 - DNA, 22 bp, Homo sapiens
tctgctttgctgcctcctgatc

SEQ ID NO: 9022125 - DNA, 22 bp, Homo sapiens
tctgctttcttgcgcagatgtg

SEQ ID NO: 9022126 - DNA, 22 bp, Homo sapiens
tctgctttcttgcgcagatgtg

SEQ ID NO: 9022127 - DNA, 22 bp, Homo sapiens
tctgctttgaccttcttgatgc

SEQ ID NO: 9022128 - DNA, 22 bp, Homo sapiens
tctggaaaagcgataaaccatt

SEQ ID NO: 9022129 - DNA, 22 bp, Homo sapiens
tctggaaaagcgataaaccatt

SEQ ID NO: 9022130 - DNA, 22 bp, Homo sapiens
tctggaaaagcgataaaccatt

SEQ ID NO: 9022131 - DNA, 22 bp, Homo sapiens
tctgctttttcattgactgaaa

SEQ ID NO: 9022132 - DNA, 22 bp, Homo sapiens
tctggaaagatcattaaatcca

SEQ ID NO: 9022133 - DNA, 22 bp, Homo sapiens
tctggaaagatcattaaatcca

SEQ ID NO: 9022134 - DNA, 22 bp, Homo sapiens
tctggaaataaaattatagttg

SEQ ID NO: 9022135 - DNA, 22 bp, Homo sapiens
tctcagagaacagttggtgctt

SEQ ID NO: 9022136 - DNA, 22 bp, Homo sapiens
tctcagagaaatgtgtcaccat

SEQ ID NO: 9022137 - DNA, 22 bp, Homo sapiens
tctgctattttctatctgtgtg

SEQ ID NO: 9022138 - DNA, 22 bp, Homo sapiens
tctgctattttctatctgtgtg

SEQ ID NO: 9022139 - DNA, 22 bp, Homo sapiens
tctgctaatgtggttatttcta

SEQ ID NO: 9022140 - DNA, 22 bp, Homo sapiens
tctcagactatagtagagattc

SEQ ID NO: 9022141 - DNA, 22 bp, Homo sapiens
tctcagactatagtagagattc

SEQ ID NO: 9022142 - DNA, 22 bp, Homo sapiens
tctcagactatagtagagattc

SEQ ID NO: 9022143 - DNA, 23 bp, Homo sapiens
tctcagacccgaagccagaggaa

SEQ ID NO: 9022144 - DNA, 19 bp, Homo sapiens
tctcagactgtgcttctgt

SEQ ID NO: 9022145 - DNA, 22 bp, Homo sapiens
tctcagactctttagtgaaggt

SEQ ID NO: 9022146 - DNA, 19 bp, Homo sapiens
tctcagactgtgcttctgt

SEQ ID NO: 9022147 - DNA, 19 bp, Homo sapiens
tctcagactgtgcttctgt

SEQ ID NO: 9022148 - DNA, 22 bp, Homo sapiens
tctcagaataaattcctaactt

SEQ ID NO: 9022149 - DNA, 22 bp, Homo sapiens
tctcagaatccttgcccaggtg

SEQ ID NO: 9022150 - DNA, 22 bp, Homo sapiens
tctcagaatccttgcccaggtg

SEQ ID NO: 9022151 - DNA, 19 bp, Homo sapiens
tctcagaattaagagtgct

SEQ ID NO: 9022152 - DNA, 22 bp, Homo sapiens
tctcagaatccttgcccaggtg

SEQ ID NO: 9022153 - DNA, 19 bp, Homo sapiens
tctcagaattggcaatcat

SEQ ID NO: 9022154 - DNA, 22 bp, Homo sapiens
tctcagacatgtaatctctacc

SEQ ID NO: 9022155 - DNA, 22 bp, Homo sapiens
tctcagacatgtaatctctacc

SEQ ID NO: 9022156 - DNA, 22 bp, Homo sapiens
tctcagaattgtgtccactggg

SEQ ID NO: 9022157 - DNA, 22 bp, Homo sapiens
tctcagaagggtggtgctggag

SEQ ID NO: 9022158 - DNA, 22 bp, Homo sapiens
tctcagaagtgatcaggatgtt

SEQ ID NO: 9022159 - DNA, 22 bp, Homo sapiens
ccagagagagaggtcaatggca

SEQ ID NO: 9022160 - DNA, 22 bp, Homo sapiens
ccagagagagaggtcaatggca

SEQ ID NO: 9022161 - DNA, 22 bp, Homo sapiens
ccagagagaaatggatttgagt

SEQ ID NO: 9022162 - DNA, 22 bp, Homo sapiens
ccagagagaaatggatttgagt

SEQ ID NO: 9022163 - DNA, 22 bp, Homo sapiens
ccagagagaaatggatttgagt

SEQ ID NO: 9022164 - DNA, 22 bp, Homo sapiens
ccagagagaaaatggagggcca

SEQ ID NO: 9022165 - DNA, 22 bp, Homo sapiens
ccagagagaaaatggagggcca

SEQ ID NO: 9022166 - DNA, 22 bp, Homo sapiens
ccagagagaaaatggagggcca

SEQ ID NO: 9022167 - DNA, 22 bp, Homo sapiens
ccagagagaaaatggagggcca

SEQ ID NO: 9022168 - DNA, 22 bp, Homo sapiens
ccagagagaaaatggagggcca

SEQ ID NO: 9022169 - DNA, 22 bp, Homo sapiens
ccagagagaaaatggagggcca

SEQ ID NO: 9022170 - DNA, 22 bp, Homo sapiens
ccagagagaaaatggagggcca

SEQ ID NO: 9022171 - DNA, 22 bp, Homo sapiens
ccagagacgtcggtcagggcgc

SEQ ID NO: 9022172 - DNA, 22 bp, Homo sapiens
cccagactcatccctgggagct

SEQ ID NO: 9022173 - DNA, 22 bp, Homo sapiens
tgcacacatatgagcatgtgtg

SEQ ID NO: 9022174 - DNA, 22 bp, Homo sapiens
tgcacacatgtatgtatatgtg

SEQ ID NO: 9022175 - DNA, 22 bp, Homo sapiens
tgcacacatgtttacaagcatc

SEQ ID NO: 9022176 - DNA, 22 bp, Homo sapiens
tgcacacatgtttacaagcatc

SEQ ID NO: 9022177 - DNA, 22 bp, Homo sapiens
tgcacacgcatgcaagtgcagg

SEQ ID NO: 9022178 - DNA, 22 bp, Homo sapiens
tgcacacctctccaccactctc

SEQ ID NO: 9022179 - DNA, 22 bp, Homo sapiens
tgcacacattaaggatacacag

SEQ ID NO: 9022180 - DNA, 22 bp, Homo sapiens
tgcacacattaaggatacacag

SEQ ID NO: 9022181 - DNA, 22 bp, Homo sapiens
tgcacacattctatggggctga

SEQ ID NO: 9022182 - DNA, 22 bp, Homo sapiens
tgcacacattctatggggctga

SEQ ID NO: 9022183 - DNA, 22 bp, Homo sapiens
cccagaaggctaagcgtggatt

SEQ ID NO: 9022184 - DNA, 22 bp, Homo sapiens
cccagaaggctaagcgtggatt

SEQ ID NO: 9022185 - DNA, 22 bp, Homo sapiens
cccagaaggctaagcgtggatt

SEQ ID NO: 9022186 - DNA, 22 bp, Homo sapiens
cccagaaggcttgccaggaagc

SEQ ID NO: 9022187 - DNA, 22 bp, Homo sapiens
cccagaaggcttgccaggaagc

SEQ ID NO: 9022188 - DNA, 22 bp, Homo sapiens
cccagaaggtcgaggctgcagt

SEQ ID NO: 9022189 - DNA, 22 bp, Homo sapiens
cccagaaggtcgaggctgcagt

SEQ ID NO: 9022190 - DNA, 22 bp, Homo sapiens
cccagaaggtcgaggctgcagt

SEQ ID NO: 9022191 - DNA, 22 bp, Homo sapiens
cccagaaggtcgaggctgcagt

SEQ ID NO: 9022192 - DNA, 22 bp, Homo sapiens
cccagaatgattcagcgacagt

SEQ ID NO: 9022193 - DNA, 22 bp, Homo sapiens
cccagaataggtaagcccaggg

SEQ ID NO: 9022194 - DNA, 22 bp, Homo sapiens
cccagacataacagcagagagg

SEQ ID NO: 9022195 - DNA, 22 bp, Homo sapiens
cccagacataacagcagagagg

SEQ ID NO: 9022196 - DNA, 22 bp, Homo sapiens
cccagacataacagcagagagg

SEQ ID NO: 9022197 - DNA, 22 bp, Homo sapiens
cccagacattgcagggactggt

SEQ ID NO: 9022198 - DNA, 22 bp, Homo sapiens
cccagacccagagggaggcagg

SEQ ID NO: 9022199 - DNA, 22 bp, Homo sapiens
cccagacagtcaagaggcctgc

SEQ ID NO: 9022200 - DNA, 22 bp, Homo sapiens
cccagacagtcaagaggcctgc

SEQ ID NO: 9022201 - DNA, 22 bp, Homo sapiens
cccagaattattctcttctcct

SEQ ID NO: 9022202 - DNA, 22 bp, Homo sapiens
cccagaatgattcagcgacagt

SEQ ID NO: 9022203 - DNA, 22 bp, Homo sapiens
cccagaatgttatagtgcccct

SEQ ID NO: 9022204 - DNA, 22 bp, Homo sapiens
cccagacagtcaagaggcctgc

SEQ ID NO: 9022205 - DNA, 22 bp, Homo sapiens
cccagacagtcaagaggcctgc

SEQ ID NO: 9022206 - DNA, 22 bp, Homo sapiens
cccactgtgttgcagtctagtg

SEQ ID NO: 9022207 - DNA, 22 bp, Homo sapiens
cccactgtgttgcagtctagtg

SEQ ID NO: 9022208 - DNA, 22 bp, Homo sapiens
cccacttcatgggcaggaagga

SEQ ID NO: 9022209 - DNA, 20 bp, Homo sapiens
cccagaagcttaacagagca

SEQ ID NO: 9022210 - DNA, 20 bp, Homo sapiens
cccagaagcttaacagagca

SEQ ID NO: 9022211 - DNA, 22 bp, Homo sapiens
cccactttggttgcactctgcc

SEQ ID NO: 9022212 - DNA, 22 bp, Homo sapiens
tgcaaataggggacaactcttt

SEQ ID NO: 9022213 - DNA, 22 bp, Homo sapiens
tgcaaataggggacaactcttt

SEQ ID NO: 9022214 - DNA, 22 bp, Homo sapiens
tgcaaatagcctgatgaaagaa

SEQ ID NO: 9022215 - DNA, 22 bp, Homo sapiens
tgcaaatagcctgatgaaagaa

SEQ ID NO: 9022216 - DNA, 22 bp, Homo sapiens
tgcaaatagcctgatgaaagaa

SEQ ID NO: 9022217 - DNA, 22 bp, Homo sapiens
tgcaaatagcctgatgaaagaa

SEQ ID NO: 9022218 - DNA, 22 bp, Homo sapiens
tgcaaatagcctatatttatag

SEQ ID NO: 9022219 - DNA, 22 bp, Homo sapiens
cccacccctggacaggtgagtg

SEQ ID NO: 9022220 - DNA, 22 bp, Homo sapiens
cccacccctggacaggtgagtg

SEQ ID NO: 9022221 - DNA, 22 bp, Homo sapiens
cccacccctggacaggtgagtg

SEQ ID NO: 9022222 - DNA, 22 bp, Homo sapiens
tgcaaataggggacaactcttt

SEQ ID NO: 9022223 - DNA, 22 bp, Homo sapiens
tgcaaatattccatgctgttca

SEQ ID NO: 9022224 - DNA, 22 bp, Homo sapiens
tgcaaatattagcattcgatat

SEQ ID NO: 9022225 - DNA, 22 bp, Homo sapiens
tgcaaatattagcattcgatat

SEQ ID NO: 9022226 - DNA, 22 bp, Homo sapiens
tgcaaatattccatgctgttca

SEQ ID NO: 9022227 - DNA, 22 bp, Homo sapiens
tgcaaatattagcattcgatat

SEQ ID NO: 9022228 - DNA, 22 bp, Homo sapiens
tgcaaataggggacaactcttt

SEQ ID NO: 9022229 - DNA, 22 bp, Homo sapiens
tgcaaagttgcatcaaaaccca

SEQ ID NO: 9022230 - DNA, 22 bp, Homo sapiens
tgcaaagttgcatcaaaaccca

SEQ ID NO: 9022231 - DNA, 22 bp, Homo sapiens
tgcaaagttgaggaaggcatgg

SEQ ID NO: 9022232 - DNA, 22 bp, Homo sapiens
tgcaaataaatttctgttcatt

SEQ ID NO: 9022233 - DNA, 23 bp, Homo sapiens
tgcaaataacaaggagtttaagg

SEQ ID NO: 9022234 - DNA, 23 bp, Homo sapiens
tgcaaataacaaggagtttaagg

SEQ ID NO: 9022235 - DNA, 23 bp, Homo sapiens
tgcaaataacaaggagtttaagg

SEQ ID NO: 9022236 - DNA, 23 bp, Homo sapiens
tgcaaataacaaggagtttaagg

SEQ ID NO: 9022237 - DNA, 22 bp, Homo sapiens
tgcaaataagctattatggaat

SEQ ID NO: 9022238 - DNA, 22 bp, Homo sapiens
tgcaaataagctattatggaat

SEQ ID NO: 9022239 - DNA, 22 bp, Homo sapiens
tgcaaatagcctatatttatag

SEQ ID NO: 9022240 - DNA, 22 bp, Homo sapiens
tgcaaatagcctatatttatag

SEQ ID NO: 9022241 - DNA, 22 bp, Homo sapiens
tgcaaatacaaaatggtacagc

SEQ ID NO: 9022242 - DNA, 23 bp, Homo sapiens
tgcaaataccatgctgtcctgtc

SEQ ID NO: 9022243 - DNA, 18 bp, Homo sapiens
tgcaaaggacactgagat

SEQ ID NO: 9022244 - DNA, 21 bp, Homo sapiens
tgcaaaggacctgaggtagga

SEQ ID NO: 9022245 - DNA, 22 bp, Homo sapiens
tgcaaagccacaatgaaatcag

SEQ ID NO: 9022246 - DNA, 23 bp, Homo sapiens
tgcaaagcacttaagaggccctg

SEQ ID NO: 9022247 - DNA, 22 bp, Homo sapiens
tgcaaagggctttgcatacaga

SEQ ID NO: 9022248 - DNA, 22 bp, Homo sapiens
tgcaaagggctttgcatacaga

SEQ ID NO: 9022249 - DNA, 22 bp, Homo sapiens
tgcaaagtgctagcccacacca

SEQ ID NO: 9022250 - DNA, 22 bp, Homo sapiens
tgcaaagtcgcaaaattcttct

SEQ ID NO: 9022251 - DNA, 22 bp, Homo sapiens
tgcaaagtcgcaaaattcttct

SEQ ID NO: 9022252 - DNA, 22 bp, Homo sapiens
tgcaaaggaggatgggaaagaa

SEQ ID NO: 9022253 - DNA, 22 bp, Homo sapiens
tgcaaaggaggccaaaccaagt

SEQ ID NO: 9022254 - DNA, 22 bp, Homo sapiens
tgcaaaggcatctgggaaggtt

SEQ ID NO: 9022255 - DNA, 22 bp, Homo sapiens
ccattccatgtgctacacataa

SEQ ID NO: 9022256 - DNA, 22 bp, Homo sapiens
ccattctgaagtgcaggctaag

SEQ ID NO: 9022257 - DNA, 22 bp, Homo sapiens
ccattctgaacaattcttgtct

SEQ ID NO: 9022258 - DNA, 22 bp, Homo sapiens
ccattccttcatcaaaaggcct

SEQ ID NO: 9022259 - DNA, 19 bp, Homo sapiens
ccattcctctagaatttgg

SEQ ID NO: 9022260 - DNA, 20 bp, Homo sapiens
ccattctgggtgcagtctgg

SEQ ID NO: 9022261 - DNA, 22 bp, Homo sapiens
ccattctgccatgcttcatcta

SEQ ID NO: 9022262 - DNA, 22 bp, Homo sapiens
ccattctgagtcttatgtcttt

SEQ ID NO: 9022263 - DNA, 20 bp, Homo sapiens
ccattctgggtgcagtctgg

SEQ ID NO: 9022264 - DNA, 22 bp, Homo sapiens
ccattctgagtcttatgtcttt

SEQ ID NO: 9022265 - DNA, 22 bp, Homo sapiens
ccattctgacacctaattctgt

SEQ ID NO: 9022266 - DNA, 22 bp, Homo sapiens
ccattctgacttcattgcctca

SEQ ID NO: 9022267 - DNA, 22 bp, Homo sapiens
ccattggagccaagagttttac

SEQ ID NO: 9022268 - DNA, 19 bp, Homo sapiens
ccattgtaaagaaaaatgt

SEQ ID NO: 9022269 - DNA, 22 bp, Homo sapiens
ccattggagagttttaagaagg

SEQ ID NO: 9022270 - DNA, 22 bp, Homo sapiens
ccattgaattagaaggggaagg

SEQ ID NO: 9022271 - DNA, 22 bp, Homo sapiens
ccattgaatcctcagctgctag

SEQ ID NO: 9022272 - DNA, 22 bp, Homo sapiens
ccattgaaggcacttgagcaga

SEQ ID NO: 9022273 - DNA, 22 bp, Homo sapiens
ccattgaacccctctaggccac

SEQ ID NO: 9022274 - DNA, 22 bp, Homo sapiens
ccattctttcagtgtctcatgt

SEQ ID NO: 9022275 - DNA, 22 bp, Homo sapiens
ccattctgtgtctctccacagc

SEQ ID NO: 9022276 - DNA, 22 bp, Homo sapiens
ccattctgtttaatgaatgaaa

SEQ ID NO: 9022277 - DNA, 19 bp, Homo sapiens
ccattctgtctctgccaca

SEQ ID NO: 9022278 - DNA, 22 bp, Homo sapiens
ccattaaacttgtggacccagt

SEQ ID NO: 9022279 - DNA, 22 bp, Homo sapiens
ccattaaaatggaatgtagtga

SEQ ID NO: 9022280 - DNA, 22 bp, Homo sapiens
ccattaaaattgtgacatagga

SEQ ID NO: 9022281 - DNA, 22 bp, Homo sapiens
ccattaaaatggaatgtagtga

SEQ ID NO: 9022282 - DNA, 22 bp, Homo sapiens
ccattaaaatggaatgtagtga

SEQ ID NO: 9022283 - DNA, 22 bp, Homo sapiens
ccatgttgtatctcttatcggc

SEQ ID NO: 9022284 - DNA, 22 bp, Homo sapiens
ccatgtgggattttggtgtctg

SEQ ID NO: 9022285 - DNA, 22 bp, Homo sapiens
ccatgtgttgagattccagcct

SEQ ID NO: 9022286 - DNA, 22 bp, Homo sapiens
ccattcactgaacaaggctaaa

SEQ ID NO: 9022287 - DNA, 22 bp, Homo sapiens
ccattcacctcttcacgtgctc

SEQ ID NO: 9022288 - DNA, 22 bp, Homo sapiens
ccattcatagcaagctacatct

SEQ ID NO: 9022289 - DNA, 22 bp, Homo sapiens
ccattcacttttgccctgtcct

SEQ ID NO: 9022290 - DNA, 22 bp, Homo sapiens
ccattattataggaggctcatt

SEQ ID NO: 9022291 - DNA, 22 bp, Homo sapiens
ccattattataggaggctcatt

SEQ ID NO: 9022292 - DNA, 22 bp, Homo sapiens
ccattatccattttgagtctta

SEQ ID NO: 9022293 - DNA, 22 bp, Homo sapiens
ccattatccacgggcttcctga

SEQ ID NO: 9022294 - DNA, 22 bp, Homo sapiens
ccattagataatgcacaccctc

SEQ ID NO: 9022295 - DNA, 22 bp, Homo sapiens
ccattagaagatgtaatagaga

SEQ ID NO: 9022296 - DNA, 22 bp, Homo sapiens
ccattacttagaaaggaactga

SEQ ID NO: 9022297 - DNA, 22 bp, Homo sapiens
ccattactttccaatatatcag

SEQ ID NO: 9022298 - DNA, 22 bp, Homo sapiens
ccattagtacctctggaaaatt

SEQ ID NO: 9022299 - DNA, 22 bp, Homo sapiens
ccattactgaaataaagagaat

SEQ ID NO: 9022300 - DNA, 22 bp, Homo sapiens
ccattaaagcaccactgtaata

SEQ ID NO: 9022301 - DNA, 22 bp, Homo sapiens
tgattcaagccaccacatactg

SEQ ID NO: 9022302 - DNA, 22 bp, Homo sapiens
tgatttcctgtgcgcccttagg

SEQ ID NO: 9022303 - DNA, 22 bp, Homo sapiens
tgatttctcatattgttcaaaa

SEQ ID NO: 9022304 - DNA, 22 bp, Homo sapiens
tgattcaagattggttagctgt

SEQ ID NO: 9022305 - DNA, 20 bp, Homo sapiens
tgatttctcttctattcctt

SEQ ID NO: 9022306 - DNA, 22 bp, Homo sapiens
tgatttctctccgttatttcag

SEQ ID NO: 9022307 - DNA, 21 bp, Homo sapiens
tgatttctgccaagttcacta

SEQ ID NO: 9022308 - DNA, 22 bp, Homo sapiens
tgatttctcttggcaatatgtt

SEQ ID NO: 9022309 - DNA, 21 bp, Homo sapiens
tgatttctgccaagttcacta

SEQ ID NO: 9022310 - DNA, 22 bp, Homo sapiens
tgatttcttccttgtcattaga

SEQ ID NO: 9022311 - DNA, 22 bp, Homo sapiens
tgatttgaaacctttggcaaga

SEQ ID NO: 9022312 - DNA, 22 bp, Homo sapiens
tgatttcttctaatttccatca

SEQ ID NO: 9022313 - DNA, 22 bp, Homo sapiens
tgatttgaggtacataaatcca

SEQ ID NO: 9022314 - DNA, 22 bp, Homo sapiens
tgatttgattcttcttggagta

SEQ ID NO: 9022315 - DNA, 22 bp, Homo sapiens
tgatttgattcttcttggagta

SEQ ID NO: 9022316 - DNA, 23 bp, Homo sapiens
tgattttaaaaagtaagttatca

SEQ ID NO: 9022317 - DNA, 22 bp, Homo sapiens
tgatttgcgtctcatttgaaat

SEQ ID NO: 9022318 - DNA, 22 bp, Homo sapiens
tgatttgtttagtgccaagttt

SEQ ID NO: 9022319 - DNA, 22 bp, Homo sapiens
tgatttgttacacaggtgtgtg

SEQ ID NO: 9022320 - DNA, 22 bp, Homo sapiens
tgattttattgaaacttcactt

SEQ ID NO: 9022321 - DNA, 22 bp, Homo sapiens
tgattttacttagcatgatgtt

SEQ ID NO: 9022322 - DNA, 22 bp, Homo sapiens
tgattttacttagcatgatgtt

SEQ ID NO: 9022323 - DNA, 22 bp, Homo sapiens
tgattttattggtgaggaaatt

SEQ ID NO: 9022324 - DNA, 22 bp, Homo sapiens
tgattttattgaaacttcactt

SEQ ID NO: 9022325 - DNA, 23 bp, Homo sapiens
tgattttaaaaagtaagttatca

SEQ ID NO: 9022326 - DNA, 23 bp, Homo sapiens
tgattttaaaaagtaagttatca

SEQ ID NO: 9022327 - DNA, 23 bp, Homo sapiens
tgattttaaaaagtaagttatca

SEQ ID NO: 9022328 - DNA, 23 bp, Homo sapiens
tgattttaaaaagtaagttatca

SEQ ID NO: 9022329 - DNA, 22 bp, Homo sapiens
tgaggtagtttgttgtacagta

SEQ ID NO: 9022330 - DNA, 22 bp, Homo sapiens
tgaggtagttctaatattaaag

SEQ ID NO: 9022331 - DNA, 21 bp, Homo sapiens
tgaggtagtgtttgtcaagtt

SEQ ID NO: 9022332 - DNA, 21 bp, Homo sapiens
tgaggtagtgtttgtcaagtt

SEQ ID NO: 9022333 - DNA, 21 bp, Homo sapiens
tgaggtagtgtttgtcaagtt

SEQ ID NO: 9022334 - DNA, 22 bp, Homo sapiens
tgaggtagtttgttgtacagta

SEQ ID NO: 9022335 - DNA, 22 bp, Homo sapiens
tgaggtagtttgttgtacagta

SEQ ID NO: 9022336 - DNA, 22 bp, Homo sapiens
tgaggtagtttttcaagtattt

SEQ ID NO: 9022337 - DNA, 20 bp, Homo sapiens
tgaggtatcaattcaaggca

SEQ ID NO: 9022338 - DNA, 20 bp, Homo sapiens
tgaggtatcaattcaaggca

SEQ ID NO: 9022339 - DNA, 22 bp, Homo sapiens
tgaggtatacgttggttcagtc

SEQ ID NO: 9022340 - DNA, 22 bp, Homo sapiens
tgaggtagtaaaggtgttagtt

SEQ ID NO: 9022341 - DNA, 22 bp, Homo sapiens
tgaggtagtagatttttgtcca

SEQ ID NO: 9022342 - DNA, 22 bp, Homo sapiens
tgaggtagtagatttttgtcca

SEQ ID NO: 9022343 - DNA, 22 bp, Homo sapiens
tgaggtagtgattgtagaagtg

SEQ ID NO: 9022344 - DNA, 22 bp, Homo sapiens
tgaggtagtaaaggtgttagtt

SEQ ID NO: 9022345 - DNA, 22 bp, Homo sapiens
tgaggtagtgcttgtcatgttt

SEQ ID NO: 9022346 - DNA, 22 bp, Homo sapiens
tgaggtagtgtttagtccagtc

SEQ ID NO: 9022347 - DNA, 22 bp, Homo sapiens
tgaggtagtgcttgtcatgttt

SEQ ID NO: 9022348 - DNA, 22 bp, Homo sapiens
tgaggtagggaaggctggtatt

SEQ ID NO: 9022349 - DNA, 22 bp, Homo sapiens
tgaggtaggcttgagatgggag

SEQ ID NO: 9022350 - DNA, 22 bp, Homo sapiens
tgaggtaggcttgagatgggag

SEQ ID NO: 9022351 - DNA, 22 bp, Homo sapiens
tgaggtaggcttgagatgggag

SEQ ID NO: 9022352 - DNA, 22 bp, Homo sapiens
tgaggtagggaaggctggtatt

SEQ ID NO: 9022353 - DNA, 22 bp, Homo sapiens
tgaggtagggaaggctggtatt

SEQ ID NO: 9022354 - DNA, 22 bp, Homo sapiens
tgaggtagggagtttgttgttg

SEQ ID NO: 9022355 - DNA, 22 bp, Homo sapiens
tgaggtagggagtttgttgttg

SEQ ID NO: 9022356 - DNA, 22 bp, Homo sapiens
tgaggtagggacttaaaactgt

SEQ ID NO: 9022357 - DNA, 22 bp, Homo sapiens
tgaggtaggtaccattatcact

SEQ ID NO: 9022358 - DNA, 22 bp, Homo sapiens
tgaggtaggtggtaagagatac

SEQ ID NO: 9022359 - DNA, 22 bp, Homo sapiens
tgaggtaggtggtgaaaaatga

SEQ ID NO: 9022360 - DNA, 22 bp, Homo sapiens
tgaggtaggtggtggcagccat

SEQ ID NO: 9022361 - DNA, 22 bp, Homo sapiens
tgaggtaggttgaaagatagat

SEQ ID NO: 9022362 - DNA, 22 bp, Homo sapiens
tgaggtaggtgtcgagagaggt

SEQ ID NO: 9022363 - DNA, 22 bp, Homo sapiens
tgaggtaggtgtcgagagaggt

SEQ ID NO: 9022364 - DNA, 22 bp, Homo sapiens
tgaggtcaagcccagagcagca

SEQ ID NO: 9022365 - DNA, 22 bp, Homo sapiens
tgaggtcacagctggggatgga

SEQ ID NO: 9022366 - DNA, 22 bp, Homo sapiens
tgaggtcacctggaggcagcct

SEQ ID NO: 9022367 - DNA, 22 bp, Homo sapiens
tgaggtcaagcccagagcagca

SEQ ID NO: 9022368 - DNA, 22 bp, Homo sapiens
tgaggtcacctggaggcagcct

SEQ ID NO: 9022369 - DNA, 22 bp, Homo sapiens
tgaggtcacctggaggcagcct

SEQ ID NO: 9022370 - DNA, 22 bp, Homo sapiens
tgaggtattttttaaagcacaa

SEQ ID NO: 9022371 - DNA, 22 bp, Homo sapiens
tgaggtatgtgatgtcttttag

SEQ ID NO: 9022372 - DNA, 22 bp, Homo sapiens
tgaggtatggtaaggtaaaatc

SEQ ID NO: 9022373 - DNA, 22 bp, Homo sapiens
tgaggtatgctgaactctgttt

SEQ ID NO: 9022374 - DNA, 22 bp, Homo sapiens
tgaggtatggtaaggtaaaatc

SEQ ID NO: 9022375 - DNA, 22 bp, Homo sapiens
tgaggtatgaggttctatgatc

SEQ ID NO: 9022376 - DNA, 22 bp, Homo sapiens
tgaggtatccagtgaagcagcc

SEQ ID NO: 9022377 - DNA, 22 bp, Homo sapiens
tgaggtatgagtgtgccaggtg

SEQ ID NO: 9022378 - DNA, 22 bp, Homo sapiens
tgaggtatgctgaactctgttt

SEQ ID NO: 9022379 - DNA, 22 bp, Homo sapiens
tgaggtatgatttacatgcagt

SEQ ID NO: 9022380 - DNA, 22 bp, Homo sapiens
ccatgtgtctcccctggaagta

SEQ ID NO: 9022381 - DNA, 22 bp, Homo sapiens
ccatgtggtgggaaggagaatg

SEQ ID NO: 9022382 - DNA, 22 bp, Homo sapiens
ccatggctaagtatctgtagaa

SEQ ID NO: 9022383 - DNA, 22 bp, Homo sapiens
ccatggcctgaaggagtgcatc

SEQ ID NO: 9022384 - DNA, 22 bp, Homo sapiens
ccatggcctgaaggagtgcatc

SEQ ID NO: 9022385 - DNA, 22 bp, Homo sapiens
ccatgccttcctttccctggaa

SEQ ID NO: 9022386 - DNA, 22 bp, Homo sapiens
ccatgctgaccctgtgcaggca

SEQ ID NO: 9022387 - DNA, 22 bp, Homo sapiens
ccatgctggagtccctagctgt

SEQ ID NO: 9022388 - DNA, 22 bp, Homo sapiens
ccatgctgaccctgtgcaggca

SEQ ID NO: 9022389 - DNA, 22 bp, Homo sapiens
ccatgctgaccctgtgcaggca

SEQ ID NO: 9022390 - DNA, 22 bp, Homo sapiens
ccatgcttaaataagaggcagc

SEQ ID NO: 9022391 - DNA, 22 bp, Homo sapiens
ccatgctgtgacacagtagtta

SEQ ID NO: 9022392 - DNA, 22 bp, Homo sapiens
ccatgctgtgacacagtagtta

SEQ ID NO: 9022393 - DNA, 22 bp, Homo sapiens
ccatgctggagtccctagctgt

SEQ ID NO: 9022394 - DNA, 22 bp, Homo sapiens
ccatgctggagtccctagctgt

SEQ ID NO: 9022395 - DNA, 22 bp, Homo sapiens
ccatgctgggatgctccaagtg

SEQ ID NO: 9022396 - DNA, 22 bp, Homo sapiens
ccatgcctcgggaagagtctgt

SEQ ID NO: 9022397 - DNA, 22 bp, Homo sapiens
ccatgcccttgtcatctccagg

SEQ ID NO: 9022398 - DNA, 22 bp, Homo sapiens
ccatgcccttgtcatctccagg

SEQ ID NO: 9022399 - DNA, 22 bp, Homo sapiens
ccatgccccaatacaggacacc

SEQ ID NO: 9022400 - DNA, 22 bp, Homo sapiens
ccatgccccaccaggacgctgc

SEQ ID NO: 9022401 - DNA, 22 bp, Homo sapiens
ccatgccctaaaggactggcag

SEQ ID NO: 9022402 - DNA, 22 bp, Homo sapiens
ccatgccctaaaggactggcag

SEQ ID NO: 9022403 - DNA, 22 bp, Homo sapiens
ccatgcctcgggaagagtctgt

SEQ ID NO: 9022404 - DNA, 22 bp, Homo sapiens
ccatgccttcctttccctggaa

SEQ ID NO: 9022405 - DNA, 22 bp, Homo sapiens
ccatgccatactggccacccgg

SEQ ID NO: 9022406 - DNA, 19 bp, Homo sapiens
ccatgccatcattttaaag

SEQ ID NO: 9022407 - DNA, 22 bp, Homo sapiens
ccatgcccacgttgtggctcag

SEQ ID NO: 9022408 - DNA, 22 bp, Homo sapiens
ccatgcccacgttgtggctcag

SEQ ID NO: 9022409 - DNA, 22 bp, Homo sapiens
ccatgcccacgttgtggctcag

SEQ ID NO: 9022410 - DNA, 22 bp, Homo sapiens
ccatgccccaccaggacgctgc

SEQ ID NO: 9022411 - DNA, 22 bp, Homo sapiens
ccatgccccaccaggacgctgc

SEQ ID NO: 9022412 - DNA, 22 bp, Homo sapiens
ccatgcccacgttgtggctcag

SEQ ID NO: 9022413 - DNA, 22 bp, Homo sapiens
ccatgccagctgctaggtcaca

SEQ ID NO: 9022414 - DNA, 22 bp, Homo sapiens
ccatgcatggcactggactggg

SEQ ID NO: 9022415 - DNA, 22 bp, Homo sapiens
ccatgcagtgctggagctgatt

SEQ ID NO: 9022416 - DNA, 22 bp, Homo sapiens
ccatgcagtgctggagctgatt

SEQ ID NO: 9022417 - DNA, 22 bp, Homo sapiens
ccatgcatgcctgaaattgctg

SEQ ID NO: 9022418 - DNA, 22 bp, Homo sapiens
ccatgcagtgctggagctgatt

SEQ ID NO: 9022419 - DNA, 22 bp, Homo sapiens
ccatcctgcattgctattcaga

SEQ ID NO: 9022420 - DNA, 22 bp, Homo sapiens
ccagtgtttgatgggattttca

SEQ ID NO: 9022421 - DNA, 22 bp, Homo sapiens
ccatcctgcattgctattcaga

SEQ ID NO: 9022422 - DNA, 22 bp, Homo sapiens
ccagtgtttccccagaagagag

SEQ ID NO: 9022423 - DNA, 22 bp, Homo sapiens
ccagtgtttccgtcagtacacg

SEQ ID NO: 9022424 - DNA, 22 bp, Homo sapiens
ccagtcctgggagcttgcactg

SEQ ID NO: 9022425 - DNA, 22 bp, Homo sapiens
ccagtcctgtgtgaccctgcac

SEQ ID NO: 9022426 - DNA, 22 bp, Homo sapiens
ccagtcctcagatggtctgtgc

SEQ ID NO: 9022427 - DNA, 22 bp, Homo sapiens
ccagtcctcagatggtctgtgc

SEQ ID NO: 9022428 - DNA, 22 bp, Homo sapiens
ccagtcctcagatggtctgtgc

SEQ ID NO: 9022429 - DNA, 19 bp, Homo sapiens
ccagtcctctttgggcctg

SEQ ID NO: 9022430 - DNA, 22 bp, Homo sapiens
ccagtcctgccaccctgtctat

SEQ ID NO: 9022431 - DNA, 22 bp, Homo sapiens
ccagtcctgccaccctgtctat

SEQ ID NO: 9022432 - DNA, 22 bp, Homo sapiens
ccagtctcgttgaggcgcttgt

SEQ ID NO: 9022433 - DNA, 20 bp, Homo sapiens
ccagtctctatcagaaataa

SEQ ID NO: 9022434 - DNA, 20 bp, Homo sapiens
ccagtctctatcagaaataa

SEQ ID NO: 9022435 - DNA, 20 bp, Homo sapiens
ccagtctctatcagaaataa

SEQ ID NO: 9022436 - DNA, 20 bp, Homo sapiens
ccagtctctggccagcatca

SEQ ID NO: 9022437 - DNA, 20 bp, Homo sapiens
ccagtctctggccagcatca

SEQ ID NO: 9022438 - DNA, 22 bp, Homo sapiens
ccagtctcttccctcctgccag

SEQ ID NO: 9022439 - DNA, 22 bp, Homo sapiens
ccagtctcttccctcctgccag

SEQ ID NO: 9022440 - DNA, 22 bp, Homo sapiens
ccagtctcttccctcctgccag

SEQ ID NO: 9022441 - DNA, 23 bp, Homo sapiens
ccagtctctttccaaaatcacat

SEQ ID NO: 9022442 - DNA, 19 bp, Homo sapiens
ccagtctccttgcagcatc

SEQ ID NO: 9022443 - DNA, 22 bp, Homo sapiens
ccagtctcgttgaggcgcttgt

SEQ ID NO: 9022444 - DNA, 22 bp, Homo sapiens
ccagtctcctaagagcccctga

SEQ ID NO: 9022445 - DNA, 22 bp, Homo sapiens
ccagtctcctaagagcccctga

SEQ ID NO: 9022446 - DNA, 22 bp, Homo sapiens
ccagtctcctaagagcccctga

SEQ ID NO: 9022447 - DNA, 22 bp, Homo sapiens
ccagtctcctaagagcccctga

SEQ ID NO: 9022448 - DNA, 23 bp, Homo sapiens
ccagtctcacgtatacaggattt

SEQ ID NO: 9022449 - DNA, 23 bp, Homo sapiens
ccagtctcacgtatacaggattt

SEQ ID NO: 9022450 - DNA, 23 bp, Homo sapiens
ccagtctcacgtatacaggattt

SEQ ID NO: 9022451 - DNA, 22 bp, Homo sapiens
ccagtctcagttcacgttggta

SEQ ID NO: 9022452 - DNA, 22 bp, Homo sapiens
ccagtctcagttcacgttggta

SEQ ID NO: 9022453 - DNA, 20 bp, Homo sapiens
ccagtccctgagcaccaggg

SEQ ID NO: 9022454 - DNA, 22 bp, Homo sapiens
ccagtcctagaagaggagtcga

SEQ ID NO: 9022455 - DNA, 20 bp, Homo sapiens
ccagtccctgagcaccaggg

SEQ ID NO: 9022456 - DNA, 22 bp, Homo sapiens
ccagtcctcagatggtctgtgc

SEQ ID NO: 9022457 - DNA, 22 bp, Homo sapiens
ccagtcccgcatggtccagaat

SEQ ID NO: 9022458 - DNA, 22 bp, Homo sapiens
ccagtcccgcatggtccagaat

SEQ ID NO: 9022459 - DNA, 20 bp, Homo sapiens
ccagtccctgagcaccaggg

SEQ ID NO: 9022460 - DNA, 22 bp, Homo sapiens
tgaggcagcctgcattaaagag

SEQ ID NO: 9022461 - DNA, 22 bp, Homo sapiens
tgaggcagcctgcattaaagag

SEQ ID NO: 9022462 - DNA, 22 bp, Homo sapiens
ccagtcccgcatggtccagaat

SEQ ID NO: 9022463 - DNA, 22 bp, Homo sapiens
ccagtcccgcatggtccagaat

SEQ ID NO: 9022464 - DNA, 22 bp, Homo sapiens
tgaggcagcaattgtattgtat

SEQ ID NO: 9022465 - DNA, 22 bp, Homo sapiens
tgaggcagcaattgtattgtat

SEQ ID NO: 9022466 - DNA, 22 bp, Homo sapiens
tgaggcagcattcttcaagaca

SEQ ID NO: 9022467 - DNA, 22 bp, Homo sapiens
tgaggcagcattcttcaagaca

SEQ ID NO: 9022468 - DNA, 22 bp, Homo sapiens
tgaggcagcccactttccttag

SEQ ID NO: 9022469 - DNA, 22 bp, Homo sapiens
tgaggcagcccactttccttag

SEQ ID NO: 9022470 - DNA, 22 bp, Homo sapiens
tgaggcagcattcttcaagaca

SEQ ID NO: 9022471 - DNA, 23 bp, Homo sapiens
tgaggctgattgatttttgctca

SEQ ID NO: 9022472 - DNA, 23 bp, Homo sapiens
tgaggctgattgatttttgctca

SEQ ID NO: 9022473 - DNA, 22 bp, Homo sapiens
tgagggatccagaggcagtggt

SEQ ID NO: 9022474 - DNA, 23 bp, Homo sapiens
ccagtctctttccaaaatcacat

SEQ ID NO: 9022475 - DNA, 23 bp, Homo sapiens
tgaggctgattgatttttgctca

SEQ ID NO: 9022476 - DNA, 23 bp, Homo sapiens
tgaggctgattgatttttgctca

SEQ ID NO: 9022477 - DNA, 23 bp, Homo sapiens
ccagtctctttccaaaatcacat

SEQ ID NO: 9022478 - DNA, 23 bp, Homo sapiens
ccagtctctttccaaaatcacat

SEQ ID NO: 9022479 - DNA, 22 bp, Homo sapiens
tgagggcaaagtggtgctgagg

SEQ ID NO: 9022480 - DNA, 22 bp, Homo sapiens
tgagggcaaagtggtgctgagg

SEQ ID NO: 9022481 - DNA, 22 bp, Homo sapiens
tgagggcaaagtggtgctgagg

SEQ ID NO: 9022482 - DNA, 22 bp, Homo sapiens
tgagggctaaattgtggcaggt

SEQ ID NO: 9022483 - DNA, 22 bp, Homo sapiens
tgagggctaaattgtggcaggt

SEQ ID NO: 9022484 - DNA, 22 bp, Homo sapiens
tgagggctaaattgtggcaggt

SEQ ID NO: 9022485 - DNA, 22 bp, Homo sapiens
tgagggctaaattgtggcaggt

SEQ ID NO: 9022486 - DNA, 22 bp, Homo sapiens
tgagggctaaattgtggcaggt

SEQ ID NO: 9022487 - DNA, 22 bp, Homo sapiens
tgagggctaaattgtggcaggt

SEQ ID NO: 9022488 - DNA, 20 bp, Homo sapiens
tgagggctaaccagactctg

SEQ ID NO: 9022489 - DNA, 20 bp, Homo sapiens
tgagggctaaccagactctg

SEQ ID NO: 9022490 - DNA, 22 bp, Homo sapiens
tgagggcagagcactggggagc

SEQ ID NO: 9022491 - DNA, 22 bp, Homo sapiens
tgagggcagagcactggggagc

SEQ ID NO: 9022492 - DNA, 22 bp, Homo sapiens
tgagggcagagcactggggagc

SEQ ID NO: 9022493 - DNA, 22 bp, Homo sapiens
tgagggcagagcactggggagc

SEQ ID NO: 9022494 - DNA, 22 bp, Homo sapiens
tgagggcagagcactggggagc

SEQ ID NO: 9022495 - DNA, 22 bp, Homo sapiens
tgagggccgaggagctgtgggt

SEQ ID NO: 9022496 - DNA, 22 bp, Homo sapiens
tgagggccgaggagctgtgggt

SEQ ID NO: 9022497 - DNA, 22 bp, Homo sapiens
tgagggctgacaggaggacagc

SEQ ID NO: 9022498 - DNA, 22 bp, Homo sapiens
tgagggctgcttccagagctag

SEQ ID NO: 9022499 - DNA, 22 bp, Homo sapiens
tgagggctgtctgaagcttggg

SEQ ID NO: 9022500 - DNA, 22 bp, Homo sapiens
tgagggctgcttccagagctag

SEQ ID NO: 9022501 - DNA, 22 bp, Homo sapiens
ccagtgttctggtgttcatttc

SEQ ID NO: 9022502 - DNA, 22 bp, Homo sapiens
ccagtgttccctcgggttcatg

SEQ ID NO: 9022503 - DNA, 22 bp, Homo sapiens
ccagtgttccagagagctgatg

SEQ ID NO: 9022504 - DNA, 22 bp, Homo sapiens
tgaggggaactgatgcccattg

SEQ ID NO: 9022505 - DNA, 22 bp, Homo sapiens
ccagtgtttacagttgaacaaa

SEQ ID NO: 9022506 - DNA, 22 bp, Homo sapiens
ccagtgtttacagttgaacaaa

SEQ ID NO: 9022507 - DNA, 22 bp, Homo sapiens
ccagtgttggaggatggcttgc

SEQ ID NO: 9022508 - DNA, 22 bp, Homo sapiens
ccagtgtttaggaataaaatgt

SEQ ID NO: 9022509 - DNA, 22 bp, Homo sapiens
ccagtgttgcataggatgggga

SEQ ID NO: 9022510 - DNA, 22 bp, Homo sapiens
ccagtgttccatggagtgatta

SEQ ID NO: 9022511 - DNA, 22 bp, Homo sapiens
ccagtgttgaacagtatttgga

SEQ ID NO: 9022512 - DNA, 22 bp, Homo sapiens
tgacaatgacatggacagtgat

SEQ ID NO: 9022513 - DNA, 22 bp, Homo sapiens
tgacaatgacatggacagtgat

SEQ ID NO: 9022514 - DNA, 22 bp, Homo sapiens
tgacaatgattaggtagcttct

SEQ ID NO: 9022515 - DNA, 22 bp, Homo sapiens
tgacaatggatattagttgtgg

SEQ ID NO: 9022516 - DNA, 22 bp, Homo sapiens
tgacaatggatattagttgtgg

SEQ ID NO: 9022517 - DNA, 22 bp, Homo sapiens
ccagggctgctgtgggactcca

SEQ ID NO: 9022518 - DNA, 22 bp, Homo sapiens
ccagggctgctgtgggactcca

SEQ ID NO: 9022519 - DNA, 22 bp, Homo sapiens
tgacaatggggcacatggaaag

SEQ ID NO: 9022520 - DNA, 22 bp, Homo sapiens
ccagggctgctgtgggactcca

SEQ ID NO: 9022521 - DNA, 22 bp, Homo sapiens
ccagggctgctgtgggactcca

SEQ ID NO: 9022522 - DNA, 22 bp, Homo sapiens
ccagggcttcagaggttttggc

SEQ ID NO: 9022523 - DNA, 22 bp, Homo sapiens
ccagggcttcagaggttttggc

SEQ ID NO: 9022524 - DNA, 22 bp, Homo sapiens
tgacaagttctaataagaaatg

SEQ ID NO: 9022525 - DNA, 22 bp, Homo sapiens
tgacaagttggaaagcagtgca

SEQ ID NO: 9022526 - DNA, 22 bp, Homo sapiens
tgacaagtttcctggtgatttt

SEQ ID NO: 9022527 - DNA, 22 bp, Homo sapiens
tgacaagtcactgttcttcaat

SEQ ID NO: 9022528 - DNA, 23 bp, Homo sapiens
tgacaagtctcagccaatgcaga

SEQ ID NO: 9022529 - DNA, 22 bp, Homo sapiens
tgacaagtcactgttcttcaat

SEQ ID NO: 9022530 - DNA, 22 bp, Homo sapiens
tgacaagtagggtgggatttgt

SEQ ID NO: 9022531 - DNA, 22 bp, Homo sapiens
tgacaagtacataatttcatgt

SEQ ID NO: 9022532 - DNA, 22 bp, Homo sapiens
tgacaagctttacagaattgaa

SEQ ID NO: 9022533 - DNA, 22 bp, Homo sapiens
tgacaagtacataatttcatgt

SEQ ID NO: 9022534 - DNA, 22 bp, Homo sapiens
tgacaagctttacagaattgaa

SEQ ID NO: 9022535 - DNA, 22 bp, Homo sapiens
tgacaagaggcagaatcagctg

SEQ ID NO: 9022536 - DNA, 19 bp, Homo sapiens
tgacaagataatagccttg

SEQ ID NO: 9022537 - DNA, 19 bp, Homo sapiens
ccagggctttaagttgagg

SEQ ID NO: 9022538 - DNA, 19 bp, Homo sapiens
ccagggctttaagttgagg

SEQ ID NO: 9022539 - DNA, 19 bp, Homo sapiens
ccagggctttaagttgagg

SEQ ID NO: 9022540 - DNA, 22 bp, Homo sapiens
ccagggcttggtggcttgtatc

SEQ ID NO: 9022541 - DNA, 22 bp, Homo sapiens
ccagggcttcagttagtggtga

SEQ ID NO: 9022542 - DNA, 22 bp, Homo sapiens
ccagggcttcagttagtggtga

SEQ ID NO: 9022543 - DNA, 22 bp, Homo sapiens
ccagggcttcagttagtggtga

SEQ ID NO: 9022544 - DNA, 22 bp, Homo sapiens
ccagggcttcccacgtgccctg

SEQ ID NO: 9022545 - DNA, 22 bp, Homo sapiens
ccagggcttcccacgtgccctg

SEQ ID NO: 9022546 - DNA, 22 bp, Homo sapiens
ccagggcttcagttagtggtga

SEQ ID NO: 9022547 - DNA, 22 bp, Homo sapiens
ccagggcttcccacgtgccctg

SEQ ID NO: 9022548 - DNA, 22 bp, Homo sapiens
ccagggctttgccaaagtccag

SEQ ID NO: 9022549 - DNA, 22 bp, Homo sapiens
ccagggctttgccaaagtccag

SEQ ID NO: 9022550 - DNA, 22 bp, Homo sapiens
ccagggctttatctgcctttga

SEQ ID NO: 9022551 - DNA, 22 bp, Homo sapiens
ccagggctttatctgcctttga

SEQ ID NO: 9022552 - DNA, 22 bp, Homo sapiens
ccaggggaaacagggagcactc

SEQ ID NO: 9022553 - DNA, 22 bp, Homo sapiens
ccaggggaaacagggagcactc

SEQ ID NO: 9022554 - DNA, 22 bp, Homo sapiens
ccaggggaaacagggagcactc

SEQ ID NO: 9022555 - DNA, 21 bp, Homo sapiens
ccaggggcaaattgtcgtttc

SEQ ID NO: 9022556 - DNA, 22 bp, Homo sapiens
ccaggggaaacagggagcactc

SEQ ID NO: 9022557 - DNA, 22 bp, Homo sapiens
ccaggggaaacagggagcactc

SEQ ID NO: 9022558 - DNA, 22 bp, Homo sapiens
ccaggggaaacagggagcactc

SEQ ID NO: 9022559 - DNA, 20 bp, Homo sapiens
tgacagtttcatatggttca

SEQ ID NO: 9022560 - DNA, 20 bp, Homo sapiens
tgacagtttcatatggttca

SEQ ID NO: 9022561 - DNA, 22 bp, Homo sapiens
tgacataaaccagtgagcaaaa

SEQ ID NO: 9022562 - DNA, 22 bp, Homo sapiens
tgacagtttattttgcagaatg

SEQ ID NO: 9022563 - DNA, 22 bp, Homo sapiens
tgacataaaccagtgagcaaaa

SEQ ID NO: 9022564 - DNA, 22 bp, Homo sapiens
tgacagttcaggtcagatttat

SEQ ID NO: 9022565 - DNA, 22 bp, Homo sapiens
tgacagttcaggtcagatttat

SEQ ID NO: 9022566 - DNA, 22 bp, Homo sapiens
tgacagttaaggtatacattca

SEQ ID NO: 9022567 - DNA, 22 bp, Homo sapiens
tgacagttaaggtatacattca

SEQ ID NO: 9022568 - DNA, 22 bp, Homo sapiens
tgacagttgagcatgtaagaga

SEQ ID NO: 9022569 - DNA, 22 bp, Homo sapiens
tgacagttgtattacatgggaa

SEQ ID NO: 9022570 - DNA, 22 bp, Homo sapiens
tgacagttgtattacatgggaa

SEQ ID NO: 9022571 - DNA, 22 bp, Homo sapiens
tgacagtttattttgcagaatg

SEQ ID NO: 9022572 - DNA, 22 bp, Homo sapiens
tgacagtttagtgtaatagtta

SEQ ID NO: 9022573 - DNA, 22 bp, Homo sapiens
tgacagtgtcagtttcctaata

SEQ ID NO: 9022574 - DNA, 23 bp, Homo sapiens
tgacagtgtatttgactatatgg

SEQ ID NO: 9022575 - DNA, 22 bp, Homo sapiens
tgacagtgtttgcacttcaggt

SEQ ID NO: 9022576 - DNA, 22 bp, Homo sapiens
tgacagtgtttgcacttcaggt

SEQ ID NO: 9022577 - DNA, 22 bp, Homo sapiens
tgacagtgcgggtacatcatag

SEQ ID NO: 9022578 - DNA, 22 bp, Homo sapiens
ccaggggcctgtgaaggtgccc

SEQ ID NO: 9022579 - DNA, 22 bp, Homo sapiens
ccaggggcctgtgaaggtgccc

SEQ ID NO: 9022580 - DNA, 22 bp, Homo sapiens
ccaggggcctgtgaaggtgccc

SEQ ID NO: 9022581 - DNA, 22 bp, Homo sapiens
ccaggggcctgtgaaggtgccc

SEQ ID NO: 9022582 - DNA, 20 bp, Homo sapiens
tgacatagctcttggggtgc

SEQ ID NO: 9022583 - DNA, 22 bp, Homo sapiens
tgacatacttttagatagatgg

SEQ ID NO: 9022584 - DNA, 22 bp, Homo sapiens
tgacataatgctttgaagttgc

SEQ ID NO: 9022585 - DNA, 22 bp, Homo sapiens
tgacataatgctttgaagttgc

SEQ ID NO: 9022586 - DNA, 22 bp, Homo sapiens
tgacataataatccaaacatac

SEQ ID NO: 9022587 - DNA, 22 bp, Homo sapiens
tgagaaaagtacatggagaagc

SEQ ID NO: 9022588 - DNA, 22 bp, Homo sapiens
tgagaaaagtacatggagaagc

SEQ ID NO: 9022589 - DNA, 22 bp, Homo sapiens
tgagaaggaaacaatggctttt

SEQ ID NO: 9022590 - DNA, 22 bp, Homo sapiens
tgagaaggaaacaatggctttt

SEQ ID NO: 9022591 - DNA, 22 bp, Homo sapiens
tgagaaaagtacatggagaagc

SEQ ID NO: 9022592 - DNA, 22 bp, Homo sapiens
tgagaaaaggttgagatgataa

SEQ ID NO: 9022593 - DNA, 22 bp, Homo sapiens
tgagaaaaggttgagatgataa

SEQ ID NO: 9022594 - DNA, 22 bp, Homo sapiens
tgagaaaaggttgagatgataa

SEQ ID NO: 9022595 - DNA, 22 bp, Homo sapiens
tgagaaaaggttgagatgataa

SEQ ID NO: 9022596 - DNA, 22 bp, Homo sapiens
tgacatctagtaggtagagacc

SEQ ID NO: 9022597 - DNA, 22 bp, Homo sapiens
tgacatcctgagtacataagag

SEQ ID NO: 9022598 - DNA, 22 bp, Homo sapiens
tgacatccggccactagactcc

SEQ ID NO: 9022599 - DNA, 22 bp, Homo sapiens
ccaggctggagtgcagtggcac

SEQ ID NO: 9022600 - DNA, 22 bp, Homo sapiens
ccaggctggagtgcagtggcac

SEQ ID NO: 9022601 - DNA, 22 bp, Homo sapiens
ccaggctggagtgcagtggcac

SEQ ID NO: 9022602 - DNA, 22 bp, Homo sapiens
ccaggctggagtgcagtggcac

SEQ ID NO: 9022603 - DNA, 22 bp, Homo sapiens
ccaggctggagtgcagtggcac

SEQ ID NO: 9022604 - DNA, 22 bp, Homo sapiens
ccaggctggagtgcagtggcac

SEQ ID NO: 9022605 - DNA, 22 bp, Homo sapiens
ccaggctggagtgcagtggcac

SEQ ID NO: 9022606 - DNA, 22 bp, Homo sapiens
ccaggctggagtgcagtggcac

SEQ ID NO: 9022607 - DNA, 22 bp, Homo sapiens
ccaggctggagtgcagtggcac

SEQ ID NO: 9022608 - DNA, 22 bp, Homo sapiens
ccaggctggagtgcagtagtgt

SEQ ID NO: 9022609 - DNA, 22 bp, Homo sapiens
ccaggctggagtgcagtagtgt

SEQ ID NO: 9022610 - DNA, 22 bp, Homo sapiens
ccaggctggagtgcagtagtgt

SEQ ID NO: 9022611 - DNA, 22 bp, Homo sapiens
ccaggctggagtgcagtagtgt

SEQ ID NO: 9022612 - DNA, 22 bp, Homo sapiens
ccaggctggagtgcaatggtgc

SEQ ID NO: 9022613 - DNA, 22 bp, Homo sapiens
ccaggctggagtgcaatggtgc

SEQ ID NO: 9022614 - DNA, 22 bp, Homo sapiens
ccaggctggagtgcaatggtgc

SEQ ID NO: 9022615 - DNA, 22 bp, Homo sapiens
ccaggctggagtgcagtagtgt

SEQ ID NO: 9022616 - DNA, 22 bp, Homo sapiens
ccaggctggagtgcagtagtgt

SEQ ID NO: 9022617 - DNA, 22 bp, Homo sapiens
ccaggctggagtgtagtcgcat

SEQ ID NO: 9022618 - DNA, 22 bp, Homo sapiens
ccaggctggagtgtagtcgcat

SEQ ID NO: 9022619 - DNA, 22 bp, Homo sapiens
ccaggctggagtgtagtcgcat

SEQ ID NO: 9022620 - DNA, 22 bp, Homo sapiens
ccaggctggattttgcagttca

SEQ ID NO: 9022621 - DNA, 22 bp, Homo sapiens
ccaggctggattttgcagttca

SEQ ID NO: 9022622 - DNA, 22 bp, Homo sapiens
ccaggctggattttgcagttca

SEQ ID NO: 9022623 - DNA, 20 bp, Homo sapiens
ccaggctggcaaatgggggc

SEQ ID NO: 9022624 - DNA, 22 bp, Homo sapiens
ccaggctggattttgcagttca

SEQ ID NO: 9022625 - DNA, 20 bp, Homo sapiens
ccaggctggcaaatgggggc

SEQ ID NO: 9022626 - DNA, 20 bp, Homo sapiens
ccaggctggcaaatgggggc

SEQ ID NO: 9022627 - DNA, 21 bp, Homo sapiens
ccaggctggccatggtattga

SEQ ID NO: 9022628 - DNA, 20 bp, Homo sapiens
ccaggctggcaaatgggggc

SEQ ID NO: 9022629 - DNA, 22 bp, Homo sapiens
tgaagttcactgagagttcacc

SEQ ID NO: 9022630 - DNA, 23 bp, Homo sapiens
tgaagttcattctcactgatgta

SEQ ID NO: 9022631 - DNA, 22 bp, Homo sapiens
tgaagttcaagggctacatttg

SEQ ID NO: 9022632 - DNA, 20 bp, Homo sapiens
ccaggctggcaaatgggggc

SEQ ID NO: 9022633 - DNA, 21 bp, Homo sapiens
ccaggctggccatggtattga

SEQ ID NO: 9022634 - DNA, 20 bp, Homo sapiens
ccaggctggcaaatgggggc

SEQ ID NO: 9022635 - DNA, 22 bp, Homo sapiens
tgaatgagtttggctgctgttc

SEQ ID NO: 9022636 - DNA, 22 bp, Homo sapiens
tgaatgatacagaattatgtag

SEQ ID NO: 9022637 - DNA, 22 bp, Homo sapiens
tgaatgatctagttttgtagac

SEQ ID NO: 9022638 - DNA, 22 bp, Homo sapiens
tgaagttgttaaggttgccatt

SEQ ID NO: 9022639 - DNA, 22 bp, Homo sapiens
tgaagttgttaaggttgccatt

SEQ ID NO: 9022640 - DNA, 22 bp, Homo sapiens
tgaagttgttaaggttgccatt

SEQ ID NO: 9022641 - DNA, 22 bp, Homo sapiens
tgaagttgttaaggttgccatt

SEQ ID NO: 9022642 - DNA, 21 bp, Homo sapiens
tgaagttcgcgggcaagatta

SEQ ID NO: 9022643 - DNA, 22 bp, Homo sapiens
tgaatgagtggattctgagtag

SEQ ID NO: 9022644 - DNA, 22 bp, Homo sapiens
tgaatgagtggattctgagtag

SEQ ID NO: 9022645 - DNA, 22 bp, Homo sapiens
tgaatgagtgagttcagacctc

SEQ ID NO: 9022646 - DNA, 22 bp, Homo sapiens
tgaatgatgaggggagaataat

SEQ ID NO: 9022647 - DNA, 22 bp, Homo sapiens
tgaatgatgtataatattgaga

SEQ ID NO: 9022648 - DNA, 22 bp, Homo sapiens
tgaatgatggtgtgttcttgcc

SEQ ID NO: 9022649 - DNA, 22 bp, Homo sapiens
tgaatgcatggcttagatctac

SEQ ID NO: 9022650 - DNA, 22 bp, Homo sapiens
tgaatgcagagactgtgggaaa

SEQ ID NO: 9022651 - DNA, 22 bp, Homo sapiens
tgacaacaaggatcctgcctgg

SEQ ID NO: 9022652 - DNA, 20 bp, Homo sapiens
tgacaacaaaatggtaattt

SEQ ID NO: 9022653 - DNA, 22 bp, Homo sapiens
tgacaaattcatatttcagagg

SEQ ID NO: 9022654 - DNA, 22 bp, Homo sapiens
tgaatgcaaatcatgattgtaa

SEQ ID NO: 9022655 - DNA, 22 bp, Homo sapiens
tgaatgcaagtcacacatttct

SEQ ID NO: 9022656 - DNA, 22 bp, Homo sapiens
tgacaagaatttgggactgtta

SEQ ID NO: 9022657 - DNA, 22 bp, Homo sapiens
tgacaagaagacctggtaatga

SEQ ID NO: 9022658 - DNA, 20 bp, Homo sapiens
tgacaactctgagaacgttc

SEQ ID NO: 9022659 - DNA, 23 bp, Homo sapiens
tgacaacagctctcagccatgtc

SEQ ID NO: 9022660 - DNA, 23 bp, Homo sapiens
tgacaacagctctcagccatgtc

SEQ ID NO: 9022661 - DNA, 22 bp, Homo sapiens
tgacaacatcatttttgtgtgg

SEQ ID NO: 9022662 - DNA, 20 bp, Homo sapiens
tgacaacatgccttttgctt

SEQ ID NO: 9022663 - DNA, 22 bp, Homo sapiens
tgacaacattgagttatgtgca

SEQ ID NO: 9022664 - DNA, 21 bp, Homo sapiens
tgacaacagaactgggcaagc

SEQ ID NO: 9022665 - DNA, 22 bp, Homo sapiens
tgacaacagccatcacttttag

SEQ ID NO: 9022666 - DNA, 23 bp, Homo sapiens
tgacaacagctctcagccatgtc

SEQ ID NO: 9022667 - DNA, 22 bp, Homo sapiens
ccaggtgctcttgccagggctg

SEQ ID NO: 9022668 - DNA, 22 bp, Homo sapiens
ccaggtgctcttgccagggctg

SEQ ID NO: 9022669 - DNA, 22 bp, Homo sapiens
ccaggtgctgaccggtcagatt

SEQ ID NO: 9022670 - DNA, 22 bp, Homo sapiens
ccaggtgctgaccggtcagatt

SEQ ID NO: 9022671 - DNA, 19 bp, Homo sapiens
ccaggtggaactgaggtag

SEQ ID NO: 9022672 - DNA, 22 bp, Homo sapiens
ccaggtgctagcaatcactgtc

SEQ ID NO: 9022673 - DNA, 22 bp, Homo sapiens
ccaggtgctcttgccagggctg

SEQ ID NO: 9022674 - DNA, 22 bp, Homo sapiens
ccaggtgctcttgccagggctg

SEQ ID NO: 9022675 - DNA, 19 bp, Homo sapiens
ccaggtggaactgaggtag

SEQ ID NO: 9022676 - DNA, 22 bp, Homo sapiens
ccaggtggaaggtctgtgctct

SEQ ID NO: 9022677 - DNA, 22 bp, Homo sapiens
ccaggtggaaggtctgtgctct

SEQ ID NO: 9022678 - DNA, 22 bp, Homo sapiens
ccaggtggaaggtctgtgctct

SEQ ID NO: 9022679 - DNA, 22 bp, Homo sapiens
ccaggtggaaggtctgtgctct

SEQ ID NO: 9022680 - DNA, 22 bp, Homo sapiens
ccaggggttggaggttgcagtg

SEQ ID NO: 9022681 - DNA, 22 bp, Homo sapiens
ccagggtaccccaagggcaggt

SEQ ID NO: 9022682 - DNA, 22 bp, Homo sapiens
ccaggggttggaggttgcagtg

SEQ ID NO: 9022683 - DNA, 22 bp, Homo sapiens
ccaggggggcgtagatgctggg

SEQ ID NO: 9022684 - DNA, 22 bp, Homo sapiens
ccaggggggcgtagatgctggg

SEQ ID NO: 9022685 - DNA, 22 bp, Homo sapiens
ccaggggggcgtagatgctggg

SEQ ID NO: 9022686 - DNA, 22 bp, Homo sapiens
ccaggggggcgtagatgctggg

SEQ ID NO: 9022687 - DNA, 22 bp, Homo sapiens
ccaggggggcgtagatgctggg

SEQ ID NO: 9022688 - DNA, 22 bp, Homo sapiens
ccaggggctggtgctgagctgg

SEQ ID NO: 9022689 - DNA, 22 bp, Homo sapiens
ccaggggctggtgctgagctgg

SEQ ID NO: 9022690 - DNA, 22 bp, Homo sapiens
ccagggggcttggtgaggccat

SEQ ID NO: 9022691 - DNA, 22 bp, Homo sapiens
ccaggtgctagcaatcactgtc

SEQ ID NO: 9022692 - DNA, 22 bp, Homo sapiens
ccaggtctcgggtctgctcgtg

SEQ ID NO: 9022693 - DNA, 22 bp, Homo sapiens
ccaggtctcgggtctgctcgtg

SEQ ID NO: 9022694 - DNA, 21 bp, Homo sapiens
ccagggtccagctgccatggt

SEQ ID NO: 9022695 - DNA, 17 bp, Homo sapiens
ccaggtctccttgcttt

SEQ ID NO: 9022696 - DNA, 22 bp, Homo sapiens
ccagggtcacaaataactgcag

SEQ ID NO: 9022697 - DNA, 22 bp, Homo sapiens
tgagaatcatccagaggcttct

SEQ ID NO: 9022698 - DNA, 22 bp, Homo sapiens
tgagaatcagctgcacagaggt

SEQ ID NO: 9022699 - DNA, 22 bp, Homo sapiens
tgagaatatttgaagatgttag

SEQ ID NO: 9022700 - DNA, 22 bp, Homo sapiens
tgagaatagtaataatttctgg

SEQ ID NO: 9022701 - DNA, 22 bp, Homo sapiens
tgagaatattgttttagtgagg

SEQ ID NO: 9022702 - DNA, 22 bp, Homo sapiens
tgagaatagcagactggtaact

SEQ ID NO: 9022703 - DNA, 22 bp, Homo sapiens
tgagaatagcaaaagctgtcag

SEQ ID NO: 9022704 - DNA, 22 bp, Homo sapiens
tgagaatagaaagagctgtcat

SEQ ID NO: 9022705 - DNA, 22 bp, Homo sapiens
tgagaatagcaaaagctgtcag

SEQ ID NO: 9022706 - DNA, 22 bp, Homo sapiens
tgagaatagcaaaagctgtcag

SEQ ID NO: 9022707 - DNA, 22 bp, Homo sapiens
tgagaatactgcattgttagga

SEQ ID NO: 9022708 - DNA, 22 bp, Homo sapiens
tgagaatagaaagagctgtcat

SEQ ID NO: 9022709 - DNA, 22 bp, Homo sapiens
tgagaatagaaagagctgtcat

SEQ ID NO: 9022710 - DNA, 22 bp, Homo sapiens
ccaggggctctcagggtgtgtg

SEQ ID NO: 9022711 - DNA, 22 bp, Homo sapiens
ccaggggctctcagggtgtgtg

SEQ ID NO: 9022712 - DNA, 22 bp, Homo sapiens
ccaggggctctcagggtgtgtg

SEQ ID NO: 9022713 - DNA, 22 bp, Homo sapiens
ccaggggctctcagggtgtgtg

SEQ ID NO: 9022714 - DNA, 22 bp, Homo sapiens
ccaggggctggtgctgagctgg

SEQ ID NO: 9022715 - DNA, 22 bp, Homo sapiens
ccaggggctggtgctgagctgg

SEQ ID NO: 9022716 - DNA, 22 bp, Homo sapiens
ccaggggctgcagatccatggt

SEQ ID NO: 9022717 - DNA, 22 bp, Homo sapiens
tgagaaggtgaaagtgtggaga

SEQ ID NO: 9022718 - DNA, 19 bp, Homo sapiens
tgagaaggtttccgtgggt

SEQ ID NO: 9022719 - DNA, 22 bp, Homo sapiens
tgagaaggtgaaagtgtggaga

SEQ ID NO: 9022720 - DNA, 22 bp, Homo sapiens
tgagaaggtgaaagtgtggaga

SEQ ID NO: 9022721 - DNA, 22 bp, Homo sapiens
tgagaagtactacaagagaggg

SEQ ID NO: 9022722 - DNA, 22 bp, Homo sapiens
tgagaagtactacaagagaggg

SEQ ID NO: 9022723 - DNA, 21 bp, Homo sapiens
tgagaagtatgtcttcagcca

SEQ ID NO: 9022724 - DNA, 17 bp, Homo sapiens
tgagaagtaggcatcat

SEQ ID NO: 9022725 - DNA, 22 bp, Homo sapiens
tgagaagtgacattattgaatg

SEQ ID NO: 9022726 - DNA, 22 bp, Homo sapiens
tgagaagtgacattattgaatg

SEQ ID NO: 9022727 - DNA, 22 bp, Homo sapiens
tgagaataacagcctgtgttcc

SEQ ID NO: 9022728 - DNA, 22 bp, Homo sapiens
tgagaataacagcctgtgttcc

SEQ ID NO: 9022729 - DNA, 22 bp, Homo sapiens
tgagaataactgatttaaatgc

SEQ ID NO: 9022730 - DNA, 22 bp, Homo sapiens
tgagaataactgatttaaatgc

SEQ ID NO: 9022731 - DNA, 22 bp, Homo sapiens
tgagaataagagatagtttatt

SEQ ID NO: 9022732 - DNA, 22 bp, Homo sapiens
tgagaataagagatagtttatt

SEQ ID NO: 9022733 - DNA, 22 bp, Homo sapiens
tgagaatactgcattgttagga

SEQ ID NO: 9022734 - DNA, 22 bp, Homo sapiens
tgagaataagagatagtttatt

SEQ ID NO: 9022735 - DNA, 22 bp, Homo sapiens
tgagaaggcctgtgtgacaggg

SEQ ID NO: 9022736 - DNA, 22 bp, Homo sapiens
tgagaaggcctgtgtgacaggg

SEQ ID NO: 9022737 - DNA, 22 bp, Homo sapiens
tgagaaggcctgtgtgacaggg

SEQ ID NO: 9022738 - DNA, 19 bp, Homo sapiens
tgagaaggcagtggggagc

SEQ ID NO: 9022739 - DNA, 19 bp, Homo sapiens
tgagaaggcagtggggagc

SEQ ID NO: 9022740 - DNA, 20 bp, Homo sapiens
tgagaaggggtcagctgtac

SEQ ID NO: 9022741 - DNA, 22 bp, Homo sapiens
tgagaagggttggagaaataat

SEQ ID NO: 9022742 - DNA, 20 bp, Homo sapiens
tgagaaggggtcagctgtac

SEQ ID NO: 9022743 - DNA, 22 bp, Homo sapiens
tgagaaggctcaggcttagaga

SEQ ID NO: 9022744 - DNA, 23 bp, Homo sapiens
tgaggacctctcaggggccaggc

SEQ ID NO: 9022745 - DNA, 22 bp, Homo sapiens
ccaggtgtgctctgcagtggat

SEQ ID NO: 9022746 - DNA, 22 bp, Homo sapiens
ccaggtgtggggaggactcaca

SEQ ID NO: 9022747 - DNA, 22 bp, Homo sapiens
ccaggtgtgccagcagggactg

SEQ ID NO: 9022748 - DNA, 22 bp, Homo sapiens
ccaggtgtgctctgcagtggat

SEQ ID NO: 9022749 - DNA, 22 bp, Homo sapiens
ccaggtgtgctctgcagtggat

SEQ ID NO: 9022750 - DNA, 22 bp, Homo sapiens
ccaggtgtgatttggcagtgtc

SEQ ID NO: 9022751 - DNA, 22 bp, Homo sapiens
ccaggtgtgatttggcagtgtc

SEQ ID NO: 9022752 - DNA, 22 bp, Homo sapiens
tgaggcagatatttattgggtt

SEQ ID NO: 9022753 - DNA, 22 bp, Homo sapiens
tgaggcagatatttattgggtt

SEQ ID NO: 9022754 - DNA, 22 bp, Homo sapiens
tgaggcagagtaagatacatga

SEQ ID NO: 9022755 - DNA, 22 bp, Homo sapiens
tgaggcagagtaagatacatga

SEQ ID NO: 9022756 - DNA, 22 bp, Homo sapiens
tgaggcagcaattgtattgtat

SEQ ID NO: 9022757 - DNA, 22 bp, Homo sapiens
tgaggcagcaattgattattca

SEQ ID NO: 9022758 - DNA, 22 bp, Homo sapiens
tgaggcagcaattgattattca

SEQ ID NO: 9022759 - DNA, 22 bp, Homo sapiens
tgaggcagaaattcctgttttc

SEQ ID NO: 9022760 - DNA, 22 bp, Homo sapiens
tgaggcagaaattcctgttttc

SEQ ID NO: 9022761 - DNA, 22 bp, Homo sapiens
tgaggcagaaattcctgttttc

SEQ ID NO: 9022762 - DNA, 22 bp, Homo sapiens
tgaggcagaaaatagcagttca

SEQ ID NO: 9022763 - DNA, 22 bp, Homo sapiens
tgaggcagaaaatagcagttca

SEQ ID NO: 9022764 - DNA, 22 bp, Homo sapiens
tgaggactttccatgttaatgt

SEQ ID NO: 9022765 - DNA, 22 bp, Homo sapiens
tgaggcagaaaatagcagttca

SEQ ID NO: 9022766 - DNA, 22 bp, Homo sapiens
ccaggtgtctgtggccagccct

SEQ ID NO: 9022767 - DNA, 22 bp, Homo sapiens
ccaggtgtcatgcgtgtgaccc

SEQ ID NO: 9022768 - DNA, 22 bp, Homo sapiens
ccaggtgtcatgcgtgtgaccc

SEQ ID NO: 9022769 - DNA, 22 bp, Homo sapiens
ccaggtgtaggacaccaaggga

SEQ ID NO: 9022770 - DNA, 22 bp, Homo sapiens
ccaggtgtagcactgctcacag

SEQ ID NO: 9022771 - DNA, 22 bp, Homo sapiens
tgagacgaagtcttgctctgtt

SEQ ID NO: 9022772 - DNA, 22 bp, Homo sapiens
tgagacgaagtcttgctctgtt

SEQ ID NO: 9022773 - DNA, 22 bp, Homo sapiens
tgagacgaagtcttgctctgtt

SEQ ID NO: 9022774 - DNA, 22 bp, Homo sapiens
tgagaccttggggagccctgtt

SEQ ID NO: 9022775 - DNA, 22 bp, Homo sapiens
tgagacgaagtcttgctctgtt

SEQ ID NO: 9022776 - DNA, 22 bp, Homo sapiens
tgagacagttctgcagctgggt

SEQ ID NO: 9022777 - DNA, 22 bp, Homo sapiens
tgagacagttctgcagctgggt

SEQ ID NO: 9022778 - DNA, 22 bp, Homo sapiens
tgagacagttctgcagctgggt

SEQ ID NO: 9022779 - DNA, 22 bp, Homo sapiens
tgagacagttggtgaaatctaa

SEQ ID NO: 9022780 - DNA, 22 bp, Homo sapiens
tgagacagttctgcagctgggt

SEQ ID NO: 9022781 - DNA, 22 bp, Homo sapiens
tgagacagttggtgaaatctaa

SEQ ID NO: 9022782 - DNA, 22 bp, Homo sapiens
tgagaccatttgacatacagtg

SEQ ID NO: 9022783 - DNA, 22 bp, Homo sapiens
tgagacatgtgaatatttgtac

SEQ ID NO: 9022784 - DNA, 22 bp, Homo sapiens
tgagacatcacaaaatcctcaa

SEQ ID NO: 9022785 - DNA, 22 bp, Homo sapiens
tgagacatcatggctgaaagta

SEQ ID NO: 9022786 - DNA, 22 bp, Homo sapiens
tgagacatcatggctgaaagta

SEQ ID NO: 9022787 - DNA, 22 bp, Homo sapiens
tgagacatcacaaaatcctcaa

SEQ ID NO: 9022788 - DNA, 22 bp, Homo sapiens
tgagacagtttttctatttcca

SEQ ID NO: 9022789 - DNA, 22 bp, Homo sapiens
tgagacatgctgtccaagaagt

SEQ ID NO: 9022790 - DNA, 22 bp, Homo sapiens
tgagacatgctgtccaagaagt

SEQ ID NO: 9022791 - DNA, 22 bp, Homo sapiens
tgagacatcatggctgaaagta

SEQ ID NO: 9022792 - DNA, 22 bp, Homo sapiens
tgagacatcatggctgaaagta

SEQ ID NO: 9022793 - DNA, 20 bp, Homo sapiens
tgagacccgctgacaagttc

SEQ ID NO: 9022794 - DNA, 23 bp, Homo sapiens
tgagaccctaatttagcaagtgt

SEQ ID NO: 9022795 - DNA, 22 bp, Homo sapiens
tgagacctgcctctgcactagg

SEQ ID NO: 9022796 - DNA, 22 bp, Homo sapiens
tgagacctgcccaacgcagacc

SEQ ID NO: 9022797 - DNA, 23 bp, Homo sapiens
tgagaccctaatttagcaagtgt

SEQ ID NO: 9022798 - DNA, 22 bp, Homo sapiens
tgagacctctgggttctgagct

SEQ ID NO: 9022799 - DNA, 22 bp, Homo sapiens
tgagaccttaaaaggtatgtca

SEQ ID NO: 9022800 - DNA, 22 bp, Homo sapiens
tgagacgaagtcttgctctgtt

SEQ ID NO: 9022801 - DNA, 22 bp, Homo sapiens
tgagacctgtagcttcacagag

SEQ ID NO: 9022802 - DNA, 22 bp, Homo sapiens
tgagacctgtagcttcacagag

SEQ ID NO: 9022803 - DNA, 22 bp, Homo sapiens
tgagacctgtaatgagaaattg

SEQ ID NO: 9022804 - DNA, 18 bp, Homo sapiens
ctcctccacagcccctgc

SEQ ID NO: 9022805 - DNA, 18 bp, Homo sapiens
ctcctccacagcccctgc

SEQ ID NO: 9022806 - DNA, 18 bp, Homo sapiens
ctcctccacagcccctgc

SEQ ID NO: 9022807 - DNA, 22 bp, Homo sapiens
ctcctccacagagtccttgcca

SEQ ID NO: 9022808 - DNA, 22 bp, Homo sapiens
ctcctccacagagtccttgcca

SEQ ID NO: 9022809 - DNA, 22 bp, Homo sapiens
tttagtgcctggtttccttctt

SEQ ID NO: 9022810 - DNA, 22 bp, Homo sapiens
ctcctcagttgtcccatggaga

SEQ ID NO: 9022811 - DNA, 22 bp, Homo sapiens
ctcctccacagacctactgaat

SEQ ID NO: 9022812 - DNA, 22 bp, Homo sapiens
tttagtcatttggatttgatct

SEQ ID NO: 9022813 - DNA, 22 bp, Homo sapiens
tttagtctaataaaagtggagt

SEQ ID NO: 9022814 - DNA, 23 bp, Homo sapiens
tttagtcagttgacagccatata

SEQ ID NO: 9022815 - DNA, 22 bp, Homo sapiens
tttagtgataagaattatgaaa

SEQ ID NO: 9022816 - DNA, 22 bp, Homo sapiens
tttagtgattcatttagaaaaa

SEQ ID NO: 9022817 - DNA, 22 bp, Homo sapiens
tttagtgattcatttagaaaaa

SEQ ID NO: 9022818 - DNA, 23 bp, Homo sapiens
tttagtgatctcgtgtttttagc

SEQ ID NO: 9022819 - DNA, 22 bp, Homo sapiens
tttagtgagtgtgaatcaaatg

SEQ ID NO: 9022820 - DNA, 22 bp, Homo sapiens
tttagtgagtgtgaatcaaatg

SEQ ID NO: 9022821 - DNA, 22 bp, Homo sapiens
tttaggcatgcagttctattta

SEQ ID NO: 9022822 - DNA, 22 bp, Homo sapiens
tttaggccagatttatttgaca

SEQ ID NO: 9022823 - DNA, 22 bp, Homo sapiens
tttaggctgcagcagggatgga

SEQ ID NO: 9022824 - DNA, 22 bp, Homo sapiens
tttaggttaatcaacaaacatt

SEQ ID NO: 9022825 - DNA, 22 bp, Homo sapiens
tttaggtaagctgaatatgaag

SEQ ID NO: 9022826 - DNA, 22 bp, Homo sapiens
tttaggttttttcacgtggcta

SEQ ID NO: 9022827 - DNA, 22 bp, Homo sapiens
tttaggttttttcacgtggcta

SEQ ID NO: 9022828 - DNA, 22 bp, Homo sapiens
tttagtaagttcactgcaaagc

SEQ ID NO: 9022829 - DNA, 22 bp, Homo sapiens
tttagtaagttcactgcaaagc

SEQ ID NO: 9022830 - DNA, 22 bp, Homo sapiens
tttagtaagttcactgcaaagc

SEQ ID NO: 9022831 - DNA, 22 bp, Homo sapiens
tttagtactcaggggagaagtt

SEQ ID NO: 9022832 - DNA, 22 bp, Homo sapiens
tttagtagaatagtatatcaaa

SEQ ID NO: 9022833 - DNA, 22 bp, Homo sapiens
tttagtactgtttaaaaatgga

SEQ ID NO: 9022834 - DNA, 22 bp, Homo sapiens
tttagtatataaaaagagaagt

SEQ ID NO: 9022835 - DNA, 22 bp, Homo sapiens
tttaatcaggcaaagcataata

SEQ ID NO: 9022836 - DNA, 22 bp, Homo sapiens
tttaatcaggcaaagcataata

SEQ ID NO: 9022837 - DNA, 22 bp, Homo sapiens
tttaatcaggcaaagcataata

SEQ ID NO: 9022838 - DNA, 22 bp, Homo sapiens
tttaatcataagaaggaaaata

SEQ ID NO: 9022839 - DNA, 22 bp, Homo sapiens
tttaatcaggcaaagcataata

SEQ ID NO: 9022840 - DNA, 22 bp, Homo sapiens
tttaatcataagaaggaaaata

SEQ ID NO: 9022841 - DNA, 23 bp, Homo sapiens
ctccccagtgtcctcatgcatct

SEQ ID NO: 9022842 - DNA, 23 bp, Homo sapiens
ctccccagtgtcctcatgcatct

SEQ ID NO: 9022843 - DNA, 22 bp, Homo sapiens
tttaatctattccctaaacacc

SEQ ID NO: 9022844 - DNA, 23 bp, Homo sapiens
ctccccagtgtcctcatgcatct

SEQ ID NO: 9022845 - DNA, 23 bp, Homo sapiens
ctccccagtgtcctcatgcatct

SEQ ID NO: 9022846 - DNA, 22 bp, Homo sapiens
ctccccattgtgacctcatcca

SEQ ID NO: 9022847 - DNA, 22 bp, Homo sapiens
ctccccattgtgacctcatcca

SEQ ID NO: 9022848 - DNA, 22 bp, Homo sapiens
ctccccatggcaacagttatgg

SEQ ID NO: 9022849 - DNA, 22 bp, Homo sapiens
ctcccccttagctcttgtcttt

SEQ ID NO: 9022850 - DNA, 22 bp, Homo sapiens
ctcccccttagctcttgtcttt

SEQ ID NO: 9022851 - DNA, 22 bp, Homo sapiens
ctcccctccttaggtcttctag

SEQ ID NO: 9022852 - DNA, 22 bp, Homo sapiens
ctcccctccttaggtcttctag

SEQ ID NO: 9022853 - DNA, 22 bp, Homo sapiens
ctcccctccttaggtcttctag

SEQ ID NO: 9022854 - DNA, 22 bp, Homo sapiens
ctcccctccttaggtcttctag

SEQ ID NO: 9022855 - DNA, 17 bp, Homo sapiens
ctcccccccacgtgtcc

SEQ ID NO: 9022856 - DNA, 22 bp, Homo sapiens
ctcccccttagctcttgtcttt

SEQ ID NO: 9022857 - DNA, 20 bp, Homo sapiens
ctcccctctacagagggctg

SEQ ID NO: 9022858 - DNA, 18 bp, Homo sapiens
ctcccctgttttccctgc

SEQ ID NO: 9022859 - DNA, 20 bp, Homo sapiens
ctcccctctacagagggctg

SEQ ID NO: 9022860 - DNA, 20 bp, Homo sapiens
ctcccctctacagagggctg

SEQ ID NO: 9022861 - DNA, 22 bp, Homo sapiens
ctcccggcacttggcatgtcat

SEQ ID NO: 9022862 - DNA, 22 bp, Homo sapiens
ctcccgtgatcctggaggagag

SEQ ID NO: 9022863 - DNA, 22 bp, Homo sapiens
ctcccgagttcaagctattttc

SEQ ID NO: 9022864 - DNA, 22 bp, Homo sapiens
ctccccttcttgccagatcctt

SEQ ID NO: 9022865 - DNA, 22 bp, Homo sapiens
ctccccttccgccagctcttga

SEQ ID NO: 9022866 - DNA, 22 bp, Homo sapiens
ctcccggctgctccggctcccg

SEQ ID NO: 9022867 - DNA, 22 bp, Homo sapiens
ctcccgtgatcctggaggagag

SEQ ID NO: 9022868 - DNA, 22 bp, Homo sapiens
ctcccgtggatgttcttcagtc

SEQ ID NO: 9022869 - DNA, 22 bp, Homo sapiens
ctccctcacaaagcattctctt

SEQ ID NO: 9022870 - DNA, 22 bp, Homo sapiens
tttagacatggcttgctcactt

SEQ ID NO: 9022871 - DNA, 21 bp, Homo sapiens
tttagagaagacaatgggcat

SEQ ID NO: 9022872 - DNA, 17 bp, Homo sapiens
ctcctggcagcctcagg

SEQ ID NO: 9022873 - DNA, 17 bp, Homo sapiens
ctcctggcagcctcagg

SEQ ID NO: 9022874 - DNA, 22 bp, Homo sapiens
ctcctggcactgtcttgaccca

SEQ ID NO: 9022875 - DNA, 17 bp, Homo sapiens
ctcctggcagcctcagg

SEQ ID NO: 9022876 - DNA, 22 bp, Homo sapiens
ctcctggcagttccccttgtca

SEQ ID NO: 9022877 - DNA, 17 bp, Homo sapiens
ctcctggccacccctct

SEQ ID NO: 9022878 - DNA, 22 bp, Homo sapiens
ctcctggccacgttcttgctgg

SEQ ID NO: 9022879 - DNA, 16 bp, Homo sapiens
tttatttactagtgtt

SEQ ID NO: 9022880 - DNA, 22 bp, Homo sapiens
tttatttaccttatgtcctcca

SEQ ID NO: 9022881 - DNA, 22 bp, Homo sapiens
ctcctggcactcagtgtggaag

SEQ ID NO: 9022882 - DNA, 22 bp, Homo sapiens
ctcctggatgcaggctgtctgc

SEQ ID NO: 9022883 - DNA, 22 bp, Homo sapiens
tttatttaaagtcgtgtgttaa

SEQ ID NO: 9022884 - DNA, 22 bp, Homo sapiens
tttatttaaagtcgtgtgttaa

SEQ ID NO: 9022885 - DNA, 22 bp, Homo sapiens
tttatttaaagtcgtgtgttaa

SEQ ID NO: 9022886 - DNA, 22 bp, Homo sapiens
tttatttaccttatgtcctcca

SEQ ID NO: 9022887 - DNA, 22 bp, Homo sapiens
ctcctccagcttccagtggctc

SEQ ID NO: 9022888 - DNA, 18 bp, Homo sapiens
ctcctccacagcccctgc

SEQ ID NO: 9022889 - DNA, 22 bp, Homo sapiens
ctcctccagcttccagtggctc

SEQ ID NO: 9022890 - DNA, 22 bp, Homo sapiens
ctcctccagcttccagtggctc

SEQ ID NO: 9022891 - DNA, 22 bp, Homo sapiens
ctcctccagtcctccaaggaca

SEQ ID NO: 9022892 - DNA, 22 bp, Homo sapiens
ctcctccagtgggtccctcagg

SEQ ID NO: 9022893 - DNA, 22 bp, Homo sapiens
ctcctccagtgggtccctcagg

SEQ ID NO: 9022894 - DNA, 22 bp, Homo sapiens
ctcctccagtgggtccctcagg

SEQ ID NO: 9022895 - DNA, 22 bp, Homo sapiens
ctcctcccaattgccaagtgct

SEQ ID NO: 9022896 - DNA, 22 bp, Homo sapiens
ctcctcccaattgccaagtgct

SEQ ID NO: 9022897 - DNA, 22 bp, Homo sapiens
tttattccagtgtttctcaaat

SEQ ID NO: 9022898 - DNA, 22 bp, Homo sapiens
ctcctccagtgggtccctcagg

SEQ ID NO: 9022899 - DNA, 22 bp, Homo sapiens
tttattctaacttgctgctcta

SEQ ID NO: 9022900 - DNA, 22 bp, Homo sapiens
tttattctaacttgctgctcta

SEQ ID NO: 9022901 - DNA, 22 bp, Homo sapiens
tttattctaacttgctgctcta

SEQ ID NO: 9022902 - DNA, 18 bp, Homo sapiens
tttattcctgcccccagc

SEQ ID NO: 9022903 - DNA, 22 bp, Homo sapiens
tttattccatgtgtctatgacc

SEQ ID NO: 9022904 - DNA, 22 bp, Homo sapiens
tttattgttgggtcttaagctg

SEQ ID NO: 9022905 - DNA, 22 bp, Homo sapiens
tttattgttgggtcttaagctg

SEQ ID NO: 9022906 - DNA, 22 bp, Homo sapiens
tttattgttatcatgggtgagt

SEQ ID NO: 9022907 - DNA, 22 bp, Homo sapiens
tttattgttgttagtcataagt

SEQ ID NO: 9022908 - DNA, 22 bp, Homo sapiens
tttattgtttagaagggggctg

SEQ ID NO: 9022909 - DNA, 22 bp, Homo sapiens
tttattgtttagaagggggctg

SEQ ID NO: 9022910 - DNA, 22 bp, Homo sapiens
tttattgtttagaagggggctg

SEQ ID NO: 9022911 - DNA, 22 bp, Homo sapiens
tttattgtttagaagggggctg

SEQ ID NO: 9022912 - DNA, 22 bp, Homo sapiens
tttattgttgttagtcataagt

SEQ ID NO: 9022913 - DNA, 22 bp, Homo sapiens
tttattgttgttagtcataagt

SEQ ID NO: 9022914 - DNA, 22 bp, Homo sapiens
tttattgttgggtcttaagctg

SEQ ID NO: 9022915 - DNA, 22 bp, Homo sapiens
tttattgttgttagtcataagt

SEQ ID NO: 9022916 - DNA, 22 bp, Homo sapiens
tttcacaaagcatagcacttta

SEQ ID NO: 9022917 - DNA, 22 bp, Homo sapiens
tttcacaaagcatagcacttta

SEQ ID NO: 9022918 - DNA, 22 bp, Homo sapiens
tttcacaaagcatagcacttta

SEQ ID NO: 9022919 - DNA, 22 bp, Homo sapiens
tttcacaaatgtctttaacttg

SEQ ID NO: 9022920 - DNA, 22 bp, Homo sapiens
tttcacaaatgtctttaacttg

SEQ ID NO: 9022921 - DNA, 22 bp, Homo sapiens
tttcacaaatgtctttaacttg

SEQ ID NO: 9022922 - DNA, 22 bp, Homo sapiens
tttcacaaatgtctttaacttg

SEQ ID NO: 9022923 - DNA, 22 bp, Homo sapiens
tttcacaaatgtctttaacttg

SEQ ID NO: 9022924 - DNA, 22 bp, Homo sapiens
tttcacaggtacaaacactcct

SEQ ID NO: 9022925 - DNA, 22 bp, Homo sapiens
tttcacaggtatccacgggtct

SEQ ID NO: 9022926 - DNA, 22 bp, Homo sapiens
tttcacaggtacaaacactcct

SEQ ID NO: 9022927 - DNA, 22 bp, Homo sapiens
tttcacaggtaagcaatacagg

SEQ ID NO: 9022928 - DNA, 22 bp, Homo sapiens
tttcacaacacaatctcgttaa

SEQ ID NO: 9022929 - DNA, 22 bp, Homo sapiens
tttcacaacacaatctcgttaa

SEQ ID NO: 9022930 - DNA, 22 bp, Homo sapiens
tttcacaggtaagcaatacagg

SEQ ID NO: 9022931 - DNA, 22 bp, Homo sapiens
tttcacaaagcatagcacttta

SEQ ID NO: 9022932 - DNA, 22 bp, Homo sapiens
tttcacaaagcatagcacttta

SEQ ID NO: 9022933 - DNA, 19 bp, Homo sapiens
tttcacaaagagagcgtga

SEQ ID NO: 9022934 - DNA, 22 bp, Homo sapiens
tttcacaaactgaggagacaat

SEQ ID NO: 9022935 - DNA, 22 bp, Homo sapiens
tttcacaaactgaggagacaat

SEQ ID NO: 9022936 - DNA, 21 bp, Homo sapiens
tttcacaaaagtatgtgacaa

SEQ ID NO: 9022937 - DNA, 21 bp, Homo sapiens
tttcacaaaagtatgtgacaa

SEQ ID NO: 9022938 - DNA, 21 bp, Homo sapiens
tttcacaaaagtatgtgacaa

SEQ ID NO: 9022939 - DNA, 21 bp, Homo sapiens
tttcacaaaagtatgtgacaa

SEQ ID NO: 9022940 - DNA, 22 bp, Homo sapiens
tttcacaaactgaggagacaat

SEQ ID NO: 9022941 - DNA, 22 bp, Homo sapiens
tttcaaatggagtcgtgaaatg

SEQ ID NO: 9022942 - DNA, 22 bp, Homo sapiens
ctcctggccctgagctcccagg

SEQ ID NO: 9022943 - DNA, 22 bp, Homo sapiens
ctcctggccctgagctcccagg

SEQ ID NO: 9022944 - DNA, 22 bp, Homo sapiens
tttcaaatggagtcgtgaaatg

SEQ ID NO: 9022945 - DNA, 22 bp, Homo sapiens
tttcaaatggagtcgtgaaatg

SEQ ID NO: 9022946 - DNA, 22 bp, Homo sapiens
tttcaaatggagtcgtgaaatg

SEQ ID NO: 9022947 - DNA, 22 bp, Homo sapiens
tttcaaatggagtcgtgaaatg

SEQ ID NO: 9022948 - DNA, 22 bp, Homo sapiens
tttcaaatggatccctcagcct

SEQ ID NO: 9022949 - DNA, 22 bp, Homo sapiens
tttcaatgtaacatttccaggc

SEQ ID NO: 9022950 - DNA, 22 bp, Homo sapiens
tttcaatgtaacatttccaggc

SEQ ID NO: 9022951 - DNA, 23 bp, Homo sapiens
tttcaaattactctgcagatgac

SEQ ID NO: 9022952 - DNA, 21 bp, Homo sapiens
tttcaatgtgttctttgtagt

SEQ ID NO: 9022953 - DNA, 22 bp, Homo sapiens
tttcaatgtatgtctttctgag

SEQ ID NO: 9022954 - DNA, 22 bp, Homo sapiens
tttcaatttccaggctagaatt

SEQ ID NO: 9022955 - DNA, 21 bp, Homo sapiens
tttcaatttgccttgagtcat

SEQ ID NO: 9022956 - DNA, 22 bp, Homo sapiens
tttcaattgactttggaagaaa

SEQ ID NO: 9022957 - DNA, 22 bp, Homo sapiens
tttcaattccaccaaagcgccc

SEQ ID NO: 9022958 - DNA, 22 bp, Homo sapiens
tttcctagagtctctagaagaa

SEQ ID NO: 9022959 - DNA, 22 bp, Homo sapiens
tttcctactgccctatacacac

SEQ ID NO: 9022960 - DNA, 22 bp, Homo sapiens
tttcctagagtctctagaagaa

SEQ ID NO: 9022961 - DNA, 22 bp, Homo sapiens
tttcctacccttccaggcagag

SEQ ID NO: 9022962 - DNA, 22 bp, Homo sapiens
tttcctaatcccaatgacattt

SEQ ID NO: 9022963 - DNA, 22 bp, Homo sapiens
tttcctaaggctcattttaaaa

SEQ ID NO: 9022964 - DNA, 22 bp, Homo sapiens
tttcctaaggtagtgataattt

SEQ ID NO: 9022965 - DNA, 22 bp, Homo sapiens
tttcctaaggtagtgataattt

SEQ ID NO: 9022966 - DNA, 22 bp, Homo sapiens
tttcctaagggatgcggctcaa

SEQ ID NO: 9022967 - DNA, 22 bp, Homo sapiens
tttcctaaggtagtgataattt

SEQ ID NO: 9022968 - DNA, 22 bp, Homo sapiens
tttcctaatcccaatgacattt

SEQ ID NO: 9022969 - DNA, 22 bp, Homo sapiens
tttcctaatcccaatgacattt

SEQ ID NO: 9022970 - DNA, 20 bp, Homo sapiens
tttcctaagtggtttgctga

SEQ ID NO: 9022971 - DNA, 20 bp, Homo sapiens
tttcctaagtggtttgctga

SEQ ID NO: 9022972 - DNA, 22 bp, Homo sapiens
tttcacatagaaagtgatttac

SEQ ID NO: 9022973 - DNA, 22 bp, Homo sapiens
tttcacatagaaagtgatttac

SEQ ID NO: 9022974 - DNA, 20 bp, Homo sapiens
tttccactgtaatgtatgat

SEQ ID NO: 9022975 - DNA, 20 bp, Homo sapiens
tttccactgtaatgtatgat

SEQ ID NO: 9022976 - DNA, 22 bp, Homo sapiens
tttccactgtagagatgttgaa

SEQ ID NO: 9022977 - DNA, 22 bp, Homo sapiens
tttcctaacacaatgcatgaga

SEQ ID NO: 9022978 - DNA, 22 bp, Homo sapiens
tttccagagcatgtctgctcag

SEQ ID NO: 9022979 - DNA, 22 bp, Homo sapiens
tttcctaagatagatacttcag

SEQ ID NO: 9022980 - DNA, 22 bp, Homo sapiens
tttcctaagatagatacttcag

SEQ ID NO: 9022981 - DNA, 22 bp, Homo sapiens
tttcctaactcatcggatgtac

SEQ ID NO: 9022982 - DNA, 22 bp, Homo sapiens
tttcctaacacaatgcatgaga

SEQ ID NO: 9022983 - DNA, 22 bp, Homo sapiens
tttcctaaggctcattttaaaa

SEQ ID NO: 9022984 - DNA, 22 bp, Homo sapiens
tttcctaactcatcggatgtac

SEQ ID NO: 9022985 - DNA, 22 bp, Homo sapiens
tttcacataaatggagtaaaga

SEQ ID NO: 9022986 - DNA, 22 bp, Homo sapiens
tttcacataaatggagtaaaga

SEQ ID NO: 9022987 - DNA, 22 bp, Homo sapiens
tttcacataaatggagtaaaga

SEQ ID NO: 9022988 - DNA, 22 bp, Homo sapiens
tttcacataaatggagtaaaga

SEQ ID NO: 9022989 - DNA, 22 bp, Homo sapiens
tttcacataaatattatgccta

SEQ ID NO: 9022990 - DNA, 22 bp, Homo sapiens
tttcacataaatattatgccta

SEQ ID NO: 9022991 - DNA, 22 bp, Homo sapiens
tttcacataaatattatgccta

SEQ ID NO: 9022992 - DNA, 22 bp, Homo sapiens
tttcacatacagtgtatagtag

SEQ ID NO: 9022993 - DNA, 22 bp, Homo sapiens
tttcacatacagtgtatagtag

SEQ ID NO: 9022994 - DNA, 22 bp, Homo sapiens
tttcacatacagtgtatagtag

SEQ ID NO: 9022995 - DNA, 22 bp, Homo sapiens
tttcacatacagtgtatagtag

SEQ ID NO: 9022996 - DNA, 22 bp, Homo sapiens
tttcacatagaaagtgatttac

SEQ ID NO: 9022997 - DNA, 20 bp, Homo sapiens
tttccactgtaatgtatgat

SEQ ID NO: 9022998 - DNA, 22 bp, Homo sapiens
tttcacatagaaagtgatttac

SEQ ID NO: 9022999 - DNA, 22 bp, Homo sapiens
tttcacagtgctctgtaagtat

SEQ ID NO: 9023000 - DNA, 22 bp, Homo sapiens
tttcacagtgctctgtaagtat

SEQ ID NO: 9023001 - DNA, 22 bp, Homo sapiens
tttcacagtgctctgtaagtat

SEQ ID NO: 9023002 - DNA, 22 bp, Homo sapiens
tttcacagttagcatgaggact

SEQ ID NO: 9023003 - DNA, 22 bp, Homo sapiens
tttcacagtagaaatcattatg

SEQ ID NO: 9023004 - DNA, 22 bp, Homo sapiens
tttcacagtcaatttggagtca

SEQ ID NO: 9023005 - DNA, 22 bp, Homo sapiens
tttcacagtcaatttggagtca

SEQ ID NO: 9023006 - DNA, 20 bp, Homo sapiens
tttcacagtccctgtttcct

SEQ ID NO: 9023007 - DNA, 22 bp, Homo sapiens
ctctctgctgtatccttaggct

SEQ ID NO: 9023008 - DNA, 22 bp, Homo sapiens
ctctctggaagggggagctgat

SEQ ID NO: 9023009 - DNA, 22 bp, Homo sapiens
ctctctggaagggggagctgat

SEQ ID NO: 9023010 - DNA, 22 bp, Homo sapiens
ctctctggaagggggagctgat

SEQ ID NO: 9023011 - DNA, 22 bp, Homo sapiens
ctctctgagtgagggacaagct

SEQ ID NO: 9023012 - DNA, 22 bp, Homo sapiens
ctctctgaggcaggcctgtggg

SEQ ID NO: 9023013 - DNA, 22 bp, Homo sapiens
ctctctgatgtcaggtcgctga

SEQ ID NO: 9023014 - DNA, 22 bp, Homo sapiens
ctctctgagtggctgtactttc

SEQ ID NO: 9023015 - DNA, 18 bp, Homo sapiens
tttccttgtatgaacata

SEQ ID NO: 9023016 - DNA, 18 bp, Homo sapiens
tttccttgtatgaacata

SEQ ID NO: 9023017 - DNA, 22 bp, Homo sapiens
tttccttgggtctcttagtggc

SEQ ID NO: 9023018 - DNA, 22 bp, Homo sapiens
tttccttgggtctcttagtggc

SEQ ID NO: 9023019 - DNA, 22 bp, Homo sapiens
tttccttgggtctcttagtggc

SEQ ID NO: 9023020 - DNA, 22 bp, Homo sapiens
tttccttgggtctcttagtggc

SEQ ID NO: 9023021 - DNA, 22 bp, Homo sapiens
ctctctggaagggggagctgat

SEQ ID NO: 9023022 - DNA, 22 bp, Homo sapiens
tttccttgcctcctgtccttct

SEQ ID NO: 9023023 - DNA, 22 bp, Homo sapiens
tttccttgcctcctgtccttct

SEQ ID NO: 9023024 - DNA, 22 bp, Homo sapiens
tttccttgcctcctgtccttct

SEQ ID NO: 9023025 - DNA, 22 bp, Homo sapiens
tttccttgcctcctgtccttct

SEQ ID NO: 9023026 - DNA, 22 bp, Homo sapiens
ctctctcttgtgttgctgcaga

SEQ ID NO: 9023027 - DNA, 22 bp, Homo sapiens
ctctctcttgtgttgctgcaga

SEQ ID NO: 9023028 - DNA, 22 bp, Homo sapiens
ctctctcttgtgttgctgcaga

SEQ ID NO: 9023029 - DNA, 22 bp, Homo sapiens
ctctctcttgtgttgctgcaga

SEQ ID NO: 9023030 - DNA, 22 bp, Homo sapiens
ctctctcttgtgttgctgcaga

SEQ ID NO: 9023031 - DNA, 22 bp, Homo sapiens
ctctctcttgtgttgctgcaga

SEQ ID NO: 9023032 - DNA, 22 bp, Homo sapiens
ctctctcttgtgttgctgcaga

SEQ ID NO: 9023033 - DNA, 22 bp, Homo sapiens
ctctctctttagaagcgtctgg

SEQ ID NO: 9023034 - DNA, 22 bp, Homo sapiens
ctctctctttagaagcgtctgg

SEQ ID NO: 9023035 - DNA, 22 bp, Homo sapiens
ctctctctttagaagcgtctgg

SEQ ID NO: 9023036 - DNA, 22 bp, Homo sapiens
ctctctctttagaagcgtctgg

SEQ ID NO: 9023037 - DNA, 22 bp, Homo sapiens
ctctctctttagaagcgtctgg

SEQ ID NO: 9023038 - DNA, 22 bp, Homo sapiens
ctctctgaaactggagagtctc

SEQ ID NO: 9023039 - DNA, 22 bp, Homo sapiens
ctctctctttagaagcgtctgg

SEQ ID NO: 9023040 - DNA, 22 bp, Homo sapiens
ctctctgaggaaggagcatctg

SEQ ID NO: 9023041 - DNA, 22 bp, Homo sapiens
ctctctgaggcaggcctgtggg

SEQ ID NO: 9023042 - DNA, 20 bp, Homo sapiens
ctctctctccattcccaggg

SEQ ID NO: 9023043 - DNA, 20 bp, Homo sapiens
ctctctctccattcccaggg

SEQ ID NO: 9023044 - DNA, 20 bp, Homo sapiens
ctctctctccattcccaggg

SEQ ID NO: 9023045 - DNA, 20 bp, Homo sapiens
ctctctctccattcccaggg

SEQ ID NO: 9023046 - DNA, 20 bp, Homo sapiens
ctctctctccattcccaggg

SEQ ID NO: 9023047 - DNA, 23 bp, Homo sapiens
ctctctctaccatgtgaggacac

SEQ ID NO: 9023048 - DNA, 22 bp, Homo sapiens
ctctctctatgcgttgttccta

SEQ ID NO: 9023049 - DNA, 22 bp, Homo sapiens
ctctctctatgcgttgttccta

SEQ ID NO: 9023050 - DNA, 20 bp, Homo sapiens
ctctctctccattcccaggg

SEQ ID NO: 9023051 - DNA, 23 bp, Homo sapiens
ctctctctaccatgtgaggacac

SEQ ID NO: 9023052 - DNA, 22 bp, Homo sapiens
ctctctctatgcgttgttccta

SEQ ID NO: 9023053 - DNA, 17 bp, Homo sapiens
ctctccttcctctgagg

SEQ ID NO: 9023054 - DNA, 17 bp, Homo sapiens
ctctccttcctctgagg

SEQ ID NO: 9023055 - DNA, 22 bp, Homo sapiens
ctctccaggagctcagagtcta

SEQ ID NO: 9023056 - DNA, 22 bp, Homo sapiens
ctctccaggagctcagagtcta

SEQ ID NO: 9023057 - DNA, 22 bp, Homo sapiens
ctctccaggagctcagagtcta

SEQ ID NO: 9023058 - DNA, 22 bp, Homo sapiens
ctctccaggcgaggtcctactg

SEQ ID NO: 9023059 - DNA, 22 bp, Homo sapiens
ctctccaggcgaggtcctactg

SEQ ID NO: 9023060 - DNA, 22 bp, Homo sapiens
ctctccaggctgggacaggacc

SEQ ID NO: 9023061 - DNA, 22 bp, Homo sapiens
ctctccaggctgggacaggacc

SEQ ID NO: 9023062 - DNA, 22 bp, Homo sapiens
ctctccaggctgggacaggacc

SEQ ID NO: 9023063 - DNA, 22 bp, Homo sapiens
ctctccagggaagcagtgtact

SEQ ID NO: 9023064 - DNA, 22 bp, Homo sapiens
ctctccaggcgaggtcctactg

SEQ ID NO: 9023065 - DNA, 22 bp, Homo sapiens
ctctccaggctgggacaggacc

SEQ ID NO: 9023066 - DNA, 22 bp, Homo sapiens
tttcctcactcatgtcatcagt

SEQ ID NO: 9023067 - DNA, 22 bp, Homo sapiens
tttcctcacttcatgagagttt

SEQ ID NO: 9023068 - DNA, 22 bp, Homo sapiens
ctctccaggagctcagagtcta

SEQ ID NO: 9023069 - DNA, 22 bp, Homo sapiens
tttcctcaactgtcaaatgggg

SEQ ID NO: 9023070 - DNA, 22 bp, Homo sapiens
ctctccagggcatgagttccac

SEQ ID NO: 9023071 - DNA, 22 bp, Homo sapiens
ctctccagggcatgagttccac

SEQ ID NO: 9023072 - DNA, 22 bp, Homo sapiens
ctctccagggcatgagttccac

SEQ ID NO: 9023073 - DNA, 22 bp, Homo sapiens
ctctccaggggaacattgttcc

SEQ ID NO: 9023074 - DNA, 22 bp, Homo sapiens
ctctccagggcatgagttccac

SEQ ID NO: 9023075 - DNA, 22 bp, Homo sapiens
ctctccaggggtagatgccttc

SEQ ID NO: 9023076 - DNA, 22 bp, Homo sapiens
ctctccagggaagcagtgtact

SEQ ID NO: 9023077 - DNA, 22 bp, Homo sapiens
ctctccagggaagcagtgtact

SEQ ID NO: 9023078 - DNA, 22 bp, Homo sapiens
ctctccagggcatgagttccac

SEQ ID NO: 9023079 - DNA, 22 bp, Homo sapiens
ctctccagggcatgagttccac

SEQ ID NO: 9023080 - DNA, 22 bp, Homo sapiens
ctctccaggggtagatgccttc

SEQ ID NO: 9023081 - DNA, 22 bp, Homo sapiens
ctctccaggggaacattgttcc

SEQ ID NO: 9023082 - DNA, 22 bp, Homo sapiens
ctctccaggggtagatgccttc

SEQ ID NO: 9023083 - DNA, 22 bp, Homo sapiens
ctctccaggggtagatgccttc

SEQ ID NO: 9023084 - DNA, 21 bp, Homo sapiens
ctctccaggtaggataaatgt

SEQ ID NO: 9023085 - DNA, 22 bp, Homo sapiens
ctctccagtcaggaactctgac

SEQ ID NO: 9023086 - DNA, 22 bp, Homo sapiens
ctctccagtcaggaactctgac

SEQ ID NO: 9023087 - DNA, 22 bp, Homo sapiens
ctctccagtcatattctcagtc

SEQ ID NO: 9023088 - DNA, 22 bp, Homo sapiens
ctctccagtcatattctcagtc

SEQ ID NO: 9023089 - DNA, 22 bp, Homo sapiens
ctctccaggttagagcacttat

SEQ ID NO: 9023090 - DNA, 22 bp, Homo sapiens
ctctccaggttagagcacttat

SEQ ID NO: 9023091 - DNA, 22 bp, Homo sapiens
ctctcctggtgtggaggacagg

SEQ ID NO: 9023092 - DNA, 22 bp, Homo sapiens
ctctcctggtgtggaggacagg

SEQ ID NO: 9023093 - DNA, 21 bp, Homo sapiens
ctctccagtggttcctgattc

SEQ ID NO: 9023094 - DNA, 22 bp, Homo sapiens
ctctccagtcatattctcagtc

SEQ ID NO: 9023095 - DNA, 22 bp, Homo sapiens
ctctccagtcatattctcagtc

SEQ ID NO: 9023096 - DNA, 22 bp, Homo sapiens
ctccacagcccctccagtggca

SEQ ID NO: 9023097 - DNA, 22 bp, Homo sapiens
ctccacagcccctccagtggca

SEQ ID NO: 9023098 - DNA, 22 bp, Homo sapiens
ctccacagcccctccagtggca

SEQ ID NO: 9023099 - DNA, 22 bp, Homo sapiens
ctccacagcccctccagtggca

SEQ ID NO: 9023100 - DNA, 22 bp, Homo sapiens
ctccacagctcaggctcagagt

SEQ ID NO: 9023101 - DNA, 22 bp, Homo sapiens
ctccacaggtgtactgtacctt

SEQ ID NO: 9023102 - DNA, 22 bp, Homo sapiens
ctccacaggtgtactgtacctt

SEQ ID NO: 9023103 - DNA, 22 bp, Homo sapiens
ctccacaggtggtgtttgcttc

SEQ ID NO: 9023104 - DNA, 19 bp, Homo sapiens
ctccacagggattgtgatt

SEQ ID NO: 9023105 - DNA, 19 bp, Homo sapiens
ctccacagggattgtgatt

SEQ ID NO: 9023106 - DNA, 22 bp, Homo sapiens
ctccaagtatgttaaaatctaa

SEQ ID NO: 9023107 - DNA, 22 bp, Homo sapiens
ctccaaggtttcagaacaaatg

SEQ ID NO: 9023108 - DNA, 22 bp, Homo sapiens
ctccacagagatgctgattgta

SEQ ID NO: 9023109 - DNA, 22 bp, Homo sapiens
ctccacagagatgctgattgta

SEQ ID NO: 9023110 - DNA, 22 bp, Homo sapiens
ctccacagcccctccagtggca

SEQ ID NO: 9023111 - DNA, 22 bp, Homo sapiens
ctccacagcccctccagtggca

SEQ ID NO: 9023112 - DNA, 20 bp, Homo sapiens
ctccaaggcttgcaggaggc

SEQ ID NO: 9023113 - DNA, 20 bp, Homo sapiens
ctccaaggcttgcaggaggc

SEQ ID NO: 9023114 - DNA, 23 bp, Homo sapiens
ctccaagggagggcaaacaacag

SEQ ID NO: 9023115 - DNA, 22 bp, Homo sapiens
ctccaagggtcttccaccagga

SEQ ID NO: 9023116 - DNA, 18 bp, Homo sapiens
ctccaaggtctctggctt

SEQ ID NO: 9023117 - DNA, 22 bp, Homo sapiens
ctccaaattcagtcacagtctg

SEQ ID NO: 9023118 - DNA, 22 bp, Homo sapiens
ctccaacgaggctggggtacaa

SEQ ID NO: 9023119 - DNA, 22 bp, Homo sapiens
ctccaaggagaaatgggcaaca

SEQ ID NO: 9023120 - DNA, 22 bp, Homo sapiens
ctccaaggattctggacccttg

SEQ ID NO: 9023121 - DNA, 22 bp, Homo sapiens
ctccaaggctaggagcatgttc

SEQ ID NO: 9023122 - DNA, 22 bp, Homo sapiens
ttgtacaacgttttaaatttga

SEQ ID NO: 9023123 - DNA, 22 bp, Homo sapiens
ttgtacaacgttttaaatttga

SEQ ID NO: 9023124 - DNA, 22 bp, Homo sapiens
ttgtacaacgttttaaatttga

SEQ ID NO: 9023125 - DNA, 22 bp, Homo sapiens
ttgtacaacacatattctacag

SEQ ID NO: 9023126 - DNA, 22 bp, Homo sapiens
ttgtacaacgttttaaatttga

SEQ ID NO: 9023127 - DNA, 22 bp, Homo sapiens
ttgtacaaatgcatattcctgg

SEQ ID NO: 9023128 - DNA, 22 bp, Homo sapiens
ttgtacaaatgcatattcctgg

SEQ ID NO: 9023129 - DNA, 22 bp, Homo sapiens
ttgtacaaataggaacctctga

SEQ ID NO: 9023130 - DNA, 22 bp, Homo sapiens
ttgtacaaatgcatattcctgg

SEQ ID NO: 9023131 - DNA, 22 bp, Homo sapiens
ttgtacaaatgcatattcctgg

SEQ ID NO: 9023132 - DNA, 22 bp, Homo sapiens
ttgtacaacacatattctacag

SEQ ID NO: 9023133 - DNA, 22 bp, Homo sapiens
ttgtacaacacatattctacag

SEQ ID NO: 9023134 - DNA, 22 bp, Homo sapiens
ttgtacaacacatattctacag

SEQ ID NO: 9023135 - DNA, 22 bp, Homo sapiens
ctccagatccagctgagctgca

SEQ ID NO: 9023136 - DNA, 22 bp, Homo sapiens
ttgtacaagtattatgtgaaca

SEQ ID NO: 9023137 - DNA, 22 bp, Homo sapiens
ttgtacaagtattatgtgaaca

SEQ ID NO: 9023138 - DNA, 22 bp, Homo sapiens
ttgtacaagtattatgtgaaca

SEQ ID NO: 9023139 - DNA, 22 bp, Homo sapiens
ctccagcagaaagggcgagtgg

SEQ ID NO: 9023140 - DNA, 22 bp, Homo sapiens
ctccagattctggatgactggg

SEQ ID NO: 9023141 - DNA, 22 bp, Homo sapiens
ctccagattccgtttattcagg

SEQ ID NO: 9023142 - DNA, 22 bp, Homo sapiens
ttgtacaaagatttcacagctc

SEQ ID NO: 9023143 - DNA, 22 bp, Homo sapiens
ttgtacaaagatttcacagctc

SEQ ID NO: 9023144 - DNA, 22 bp, Homo sapiens
ttgtacaaagatttcacagctc

SEQ ID NO: 9023145 - DNA, 22 bp, Homo sapiens
ttgtacaaaggatttggaagag

SEQ ID NO: 9023146 - DNA, 22 bp, Homo sapiens
ttgtacaaaggatttggaagag

SEQ ID NO: 9023147 - DNA, 22 bp, Homo sapiens
ttgtacaaaggatttggaagag

SEQ ID NO: 9023148 - DNA, 22 bp, Homo sapiens
ttgtacaaataggaacctctga

SEQ ID NO: 9023149 - DNA, 22 bp, Homo sapiens
ttgtacaaaggatttggaagag

SEQ ID NO: 9023150 - DNA, 22 bp, Homo sapiens
ttgtaattgaacccttaggctt

SEQ ID NO: 9023151 - DNA, 22 bp, Homo sapiens
ttgtaattgggtggtttgggac

SEQ ID NO: 9023152 - DNA, 22 bp, Homo sapiens
ttgtaattggacagccatcagg

SEQ ID NO: 9023153 - DNA, 22 bp, Homo sapiens
ttgtaatttgcaaatgtattgt

SEQ ID NO: 9023154 - DNA, 22 bp, Homo sapiens
ttgtaatttgcaaatgtattgt

SEQ ID NO: 9023155 - DNA, 22 bp, Homo sapiens
ttgtaattagtttttgatctgg

SEQ ID NO: 9023156 - DNA, 22 bp, Homo sapiens
ttgtaatttgcaaatgtattgt

SEQ ID NO: 9023157 - DNA, 22 bp, Homo sapiens
ttgtacaaagatttcacagctc

SEQ ID NO: 9023158 - DNA, 22 bp, Homo sapiens
ttgtacaaagatttcacagctc

SEQ ID NO: 9023159 - DNA, 22 bp, Homo sapiens
ttgtaatttgttcccaagcaga

SEQ ID NO: 9023160 - DNA, 22 bp, Homo sapiens
ttgtaatttgcaaatgtattgt

SEQ ID NO: 9023161 - DNA, 22 bp, Homo sapiens
ttgtaatttttcatggtatcac

SEQ ID NO: 9023162 - DNA, 22 bp, Homo sapiens
ttgtaatttgttcccaagcaga

SEQ ID NO: 9023163 - DNA, 22 bp, Homo sapiens
ttggtcacctgctgtcctttgt

SEQ ID NO: 9023164 - DNA, 22 bp, Homo sapiens
ctccaccccgtgccggtgctgg

SEQ ID NO: 9023165 - DNA, 22 bp, Homo sapiens
ctccaccacacatctgtccacc

SEQ ID NO: 9023166 - DNA, 22 bp, Homo sapiens
ctccacagttgctgcttttaat

SEQ ID NO: 9023167 - DNA, 22 bp, Homo sapiens
ttggtcagctaataaggacagg

SEQ ID NO: 9023168 - DNA, 22 bp, Homo sapiens
ttgtaattagtttttgatctgg

SEQ ID NO: 9023169 - DNA, 22 bp, Homo sapiens
ttgtaattaatggcagcaatta

SEQ ID NO: 9023170 - DNA, 22 bp, Homo sapiens
ttgtaattactccaggggtaaa

SEQ ID NO: 9023171 - DNA, 18 bp, Homo sapiens
ttcttttcatgtgatctc

SEQ ID NO: 9023172 - DNA, 18 bp, Homo sapiens
ttcttttcatgtgatctc

SEQ ID NO: 9023173 - DNA, 18 bp, Homo sapiens
ttcttttcatgtgatctc

SEQ ID NO: 9023174 - DNA, 22 bp, Homo sapiens
ttcttttcccaatattttgctg

SEQ ID NO: 9023175 - DNA, 22 bp, Homo sapiens
ttcttttcccaatattttgctg

SEQ ID NO: 9023176 - DNA, 22 bp, Homo sapiens
ttcttttcccaatattttgctg

SEQ ID NO: 9023177 - DNA, 22 bp, Homo sapiens
ttcttttcctacacagcgattt

SEQ ID NO: 9023178 - DNA, 22 bp, Homo sapiens
ttcttttcctacacagcgattt

SEQ ID NO: 9023179 - DNA, 22 bp, Homo sapiens
ttcttttcggcctgtgagaagg

SEQ ID NO: 9023180 - DNA, 22 bp, Homo sapiens
ttcttttcggcctgtgagaagg

SEQ ID NO: 9023181 - DNA, 22 bp, Homo sapiens
ttcttttcctgtggctcatcca

SEQ ID NO: 9023182 - DNA, 22 bp, Homo sapiens
ttcttttcggcctgtgagaagg

SEQ ID NO: 9023183 - DNA, 22 bp, Homo sapiens
ttgaaagggttaaagtggtaaa

SEQ ID NO: 9023184 - DNA, 23 bp, Homo sapiens
ttgaaaggtagctggcagctaga

SEQ ID NO: 9023185 - DNA, 23 bp, Homo sapiens
ttgaaaggtagctggcagctaga

SEQ ID NO: 9023186 - DNA, 22 bp, Homo sapiens
ttgaaaggtgaacatgatgcac

SEQ ID NO: 9023187 - DNA, 22 bp, Homo sapiens
ttgaaaggtgaacatgatgcac

SEQ ID NO: 9023188 - DNA, 22 bp, Homo sapiens
ttgaaaggtgacattgttagag

SEQ ID NO: 9023189 - DNA, 22 bp, Homo sapiens
ttgaaaggtgaacatgatgcac

SEQ ID NO: 9023190 - DNA, 23 bp, Homo sapiens
ttgaaaggtagctggcagctaga

SEQ ID NO: 9023191 - DNA, 22 bp, Homo sapiens
ttgaaaggtgctgtgtgctgat

SEQ ID NO: 9023192 - DNA, 21 bp, Homo sapiens
ttgaaagtaaattcagcagct

SEQ ID NO: 9023193 - DNA, 21 bp, Homo sapiens
ttgaaagtaaattcagcagct

SEQ ID NO: 9023194 - DNA, 22 bp, Homo sapiens
ttcttttacattaagatttcag

SEQ ID NO: 9023195 - DNA, 22 bp, Homo sapiens
ttcttttacattaagatttcag

SEQ ID NO: 9023196 - DNA, 22 bp, Homo sapiens
ttcttttacattaagatttcag

SEQ ID NO: 9023197 - DNA, 22 bp, Homo sapiens
ttcttttacattaagatttcag

SEQ ID NO: 9023198 - DNA, 22 bp, Homo sapiens
ttcttttacattaagatttcag

SEQ ID NO: 9023199 - DNA, 22 bp, Homo sapiens
ttcttttagtcattcagggaag

SEQ ID NO: 9023200 - DNA, 22 bp, Homo sapiens
ttcttttagaatttcctaaggt

SEQ ID NO: 9023201 - DNA, 22 bp, Homo sapiens
ttcttttaatttctgtctgcag

SEQ ID NO: 9023202 - DNA, 22 bp, Homo sapiens
ttcttttaatttctgtctgcag

SEQ ID NO: 9023203 - DNA, 22 bp, Homo sapiens
ttcttttaattgtgggggagtg

SEQ ID NO: 9023204 - DNA, 22 bp, Homo sapiens
ttcttttaatttctgtctgcag

SEQ ID NO: 9023205 - DNA, 22 bp, Homo sapiens
ctcacaggttagttgtgtggat

SEQ ID NO: 9023206 - DNA, 22 bp, Homo sapiens
ttctttctgtccataatgagac

SEQ ID NO: 9023207 - DNA, 22 bp, Homo sapiens
ttctttcttagcaatctatggt

SEQ ID NO: 9023208 - DNA, 22 bp, Homo sapiens
ttctttcttagcaatctatggt

SEQ ID NO: 9023209 - DNA, 22 bp, Homo sapiens
ttctttcttagcaatctatggt

SEQ ID NO: 9023210 - DNA, 22 bp, Homo sapiens
ctcatttactcatctgcaaaac

SEQ ID NO: 9023211 - DNA, 22 bp, Homo sapiens
ctcatttactcatctgcaaaac

SEQ ID NO: 9023212 - DNA, 22 bp, Homo sapiens
ctcatttactactcatgtgacc

SEQ ID NO: 9023213 - DNA, 22 bp, Homo sapiens
ctcatttactcatctgcaaaac

SEQ ID NO: 9023214 - DNA, 22 bp, Homo sapiens
ctcatttaacagattaaaaagt

SEQ ID NO: 9023215 - DNA, 22 bp, Homo sapiens
ctcattgttgggctttgctgga

SEQ ID NO: 9023216 - DNA, 22 bp, Homo sapiens
ctcatttaacagattaaaaagt

SEQ ID NO: 9023217 - DNA, 22 bp, Homo sapiens
ctcatttacctttgcaatcaag

SEQ ID NO: 9023218 - DNA, 22 bp, Homo sapiens
ctcatttatttctcccaaaaca

SEQ ID NO: 9023219 - DNA, 22 bp, Homo sapiens
ctccaaatataatcacattgga

SEQ ID NO: 9023220 - DNA, 22 bp, Homo sapiens
ctccaaatacaatattgttgtt

SEQ ID NO: 9023221 - DNA, 22 bp, Homo sapiens
ctccaaaggataaaagcagagt

SEQ ID NO: 9023222 - DNA, 22 bp, Homo sapiens
ttgaaagtctctgcatgtagga

SEQ ID NO: 9023223 - DNA, 22 bp, Homo sapiens
ttgaaagtccttcttgagttac

SEQ ID NO: 9023224 - DNA, 22 bp, Homo sapiens
ttgaaagtctctgcatgtagga

SEQ ID NO: 9023225 - DNA, 22 bp, Homo sapiens
ttgaaagtctaggcttacagta

SEQ ID NO: 9023226 - DNA, 22 bp, Homo sapiens
ttgaaagtagcagctgcatatg

SEQ ID NO: 9023227 - DNA, 22 bp, Homo sapiens
ttgaaagtagcagctgcatatg

SEQ ID NO: 9023228 - DNA, 22 bp, Homo sapiens
ttgaaagtcacaatggcattaa

SEQ ID NO: 9023229 - DNA, 22 bp, Homo sapiens
ttgaaagtagcagctgcatatg

SEQ ID NO: 9023230 - DNA, 22 bp, Homo sapiens
ttgaaataaggaagctcgaaat

SEQ ID NO: 9023231 - DNA, 22 bp, Homo sapiens
ttgaaagtttatggagtctgca

SEQ ID NO: 9023232 - DNA, 22 bp, Homo sapiens
ttgaaagttatctagattctga

SEQ ID NO: 9023233 - DNA, 22 bp, Homo sapiens
ttgaaagttatctagattctga

SEQ ID NO: 9023234 - DNA, 22 bp, Homo sapiens
ttgaaagtgccaagtcctagtg

SEQ ID NO: 9023235 - DNA, 22 bp, Homo sapiens
ttgaaatagatgcgtcagagat

SEQ ID NO: 9023236 - DNA, 22 bp, Homo sapiens
ctcatctgtatatagtgaatga

SEQ ID NO: 9023237 - DNA, 22 bp, Homo sapiens
ctcatctggcttcagtaacagt

SEQ ID NO: 9023238 - DNA, 22 bp, Homo sapiens
ctcatctgtctgggctggtttt

SEQ ID NO: 9023239 - DNA, 22 bp, Homo sapiens
ctcatctgtatatagtgaatga

SEQ ID NO: 9023240 - DNA, 22 bp, Homo sapiens
ttgaaatactgcattgttcagt

SEQ ID NO: 9023241 - DNA, 22 bp, Homo sapiens
ttgaaatactgcattgttcagt

SEQ ID NO: 9023242 - DNA, 22 bp, Homo sapiens
ttgaaatactgcattgttcagt

SEQ ID NO: 9023243 - DNA, 22 bp, Homo sapiens
ttgaaatactgcattgttcagt

SEQ ID NO: 9023244 - DNA, 22 bp, Homo sapiens
ttgaaatactgcattgttcagt

SEQ ID NO: 9023245 - DNA, 22 bp, Homo sapiens
ttgaaatactgcattgttcagt

SEQ ID NO: 9023246 - DNA, 22 bp, Homo sapiens
ttgaaatactgcattgttcagt

SEQ ID NO: 9023247 - DNA, 22 bp, Homo sapiens
ttgaaatactgcattgttcagt

SEQ ID NO: 9023248 - DNA, 22 bp, Homo sapiens
tttaatatctcacacttccatg

SEQ ID NO: 9023249 - DNA, 22 bp, Homo sapiens
tttaatatctcacacttccatg

SEQ ID NO: 9023250 - DNA, 22 bp, Homo sapiens
tttaatatctcacacttccatg

SEQ ID NO: 9023251 - DNA, 22 bp, Homo sapiens
tttaatatttctttcctgaagc

SEQ ID NO: 9023252 - DNA, 22 bp, Homo sapiens
tttaatattctgcattctcctt

SEQ ID NO: 9023253 - DNA, 22 bp, Homo sapiens
tttaatattctgcattctcctt

SEQ ID NO: 9023254 - DNA, 22 bp, Homo sapiens
tttaatatttctttcctgaagc

SEQ ID NO: 9023255 - DNA, 22 bp, Homo sapiens
tttaatcaggcaaagcataata

SEQ ID NO: 9023256 - DNA, 22 bp, Homo sapiens
tttaatcaggcaaagcataata

SEQ ID NO: 9023257 - DNA, 22 bp, Homo sapiens
tttaatcaggcaaagcataata

SEQ ID NO: 9023258 - DNA, 22 bp, Homo sapiens
tttaatcaggcaaagcataata

SEQ ID NO: 9023259 - DNA, 22 bp, Homo sapiens
tttaatatttctttcctgaagc

SEQ ID NO: 9023260 - DNA, 22 bp, Homo sapiens
tttaatatttctttcctgaagc

SEQ ID NO: 9023261 - DNA, 22 bp, Homo sapiens
tttaatagggcccaatgagact

SEQ ID NO: 9023262 - DNA, 22 bp, Homo sapiens
tttaatagggcccaatgagact

SEQ ID NO: 9023263 - DNA, 22 bp, Homo sapiens
tttaatactatggggatgaaca

SEQ ID NO: 9023264 - DNA, 22 bp, Homo sapiens
tttaatatccagtggatacaaa

SEQ ID NO: 9023265 - DNA, 22 bp, Homo sapiens
tttaatatccagtggatacaaa

SEQ ID NO: 9023266 - DNA, 22 bp, Homo sapiens
tttaatatccagtggatacaaa

SEQ ID NO: 9023267 - DNA, 22 bp, Homo sapiens
tttaatatccagtggatacaaa

SEQ ID NO: 9023268 - DNA, 22 bp, Homo sapiens
tttaatatccagtggatacaaa

SEQ ID NO: 9023269 - DNA, 22 bp, Homo sapiens
tttaatatctcacacttccatg

SEQ ID NO: 9023270 - DNA, 22 bp, Homo sapiens
tttaatatctcacacttccatg

SEQ ID NO: 9023271 - DNA, 22 bp, Homo sapiens
tttaatatccagtggatacaaa

SEQ ID NO: 9023272 - DNA, 22 bp, Homo sapiens
ctcccaggcacagggaggagcc

SEQ ID NO: 9023273 - DNA, 22 bp, Homo sapiens
ctcccaggcacagggaggagcc

SEQ ID NO: 9023274 - DNA, 22 bp, Homo sapiens
ctcccaggcacagggaggagcc

SEQ ID NO: 9023275 - DNA, 22 bp, Homo sapiens
ctcccaggccatgctctagcca

SEQ ID NO: 9023276 - DNA, 22 bp, Homo sapiens
ctcccaggccatgctctagcca

SEQ ID NO: 9023277 - DNA, 22 bp, Homo sapiens
ctcccaggcagggctgcccact

SEQ ID NO: 9023278 - DNA, 22 bp, Homo sapiens
ctcccaggccatgctctagcca

SEQ ID NO: 9023279 - DNA, 22 bp, Homo sapiens
ctcccaggccatgctctagcca

SEQ ID NO: 9023280 - DNA, 22 bp, Homo sapiens
ctcccaggccatgctctagcca

SEQ ID NO: 9023281 - DNA, 22 bp, Homo sapiens
ctcccaggccatgctctagcca

SEQ ID NO: 9023282 - DNA, 22 bp, Homo sapiens
tttaacagatgctatgtctacc

SEQ ID NO: 9023283 - DNA, 22 bp, Homo sapiens
tttaacagatgctatgtctacc

SEQ ID NO: 9023284 - DNA, 22 bp, Homo sapiens
tttaacagatgtgaaattttca

SEQ ID NO: 9023285 - DNA, 22 bp, Homo sapiens
tttaatacagaacttgtcaggg

SEQ ID NO: 9023286 - DNA, 22 bp, Homo sapiens
tttaatacagaacttgtcaggg

SEQ ID NO: 9023287 - DNA, 22 bp, Homo sapiens
tttaagttccttttcaacaact

SEQ ID NO: 9023288 - DNA, 22 bp, Homo sapiens
tttaagttccttttcaacaact

SEQ ID NO: 9023289 - DNA, 22 bp, Homo sapiens
ctcccaaggggtaagggagctg

SEQ ID NO: 9023290 - DNA, 22 bp, Homo sapiens
ctcccacatggaatagcaggga

SEQ ID NO: 9023291 - DNA, 22 bp, Homo sapiens
ctcccacatggaatagcaggga

SEQ ID NO: 9023292 - DNA, 22 bp, Homo sapiens
ctcccaaggggtaagggagctg

SEQ ID NO: 9023293 - DNA, 22 bp, Homo sapiens
ctccatgtctgtaacacatgac

SEQ ID NO: 9023294 - DNA, 22 bp, Homo sapiens
ctccatgggggctggcctgtgt

SEQ ID NO: 9023295 - DNA, 22 bp, Homo sapiens
ctcccagaaaattctcagacaa

SEQ ID NO: 9023296 - DNA, 22 bp, Homo sapiens
ctcccagacatgtgcctccttg

SEQ ID NO: 9023297 - DNA, 22 bp, Homo sapiens
ctcccagacatgtgcctccttg

SEQ ID NO: 9023298 - DNA, 22 bp, Homo sapiens
ctcccagaaaattctcagacaa

SEQ ID NO: 9023299 - DNA, 22 bp, Homo sapiens
ctcccagaaaattctcagacaa

SEQ ID NO: 9023300 - DNA, 22 bp, Homo sapiens
ctcccagaaaattctcagacaa

SEQ ID NO: 9023301 - DNA, 22 bp, Homo sapiens
ctcccactcctggctcaccaca

SEQ ID NO: 9023302 - DNA, 22 bp, Homo sapiens
ctcccactcctggctcaccaca

SEQ ID NO: 9023303 - DNA, 22 bp, Homo sapiens
ctcccactcctggctcaccaca

SEQ ID NO: 9023304 - DNA, 22 bp, Homo sapiens
ctcccagagaccaagctgagaa

SEQ ID NO: 9023305 - DNA, 22 bp, Homo sapiens
ctcccagagaccaagctgagaa

SEQ ID NO: 9023306 - DNA, 22 bp, Homo sapiens
ctcccagagaccaagctgagaa

SEQ ID NO: 9023307 - DNA, 22 bp, Homo sapiens
ctcccagagagcaggtgggccg

SEQ ID NO: 9023308 - DNA, 22 bp, Homo sapiens
ctcccagagaccaagctgagaa

SEQ ID NO: 9023309 - DNA, 22 bp, Homo sapiens
ctcccagagaccaagctgagaa

SEQ ID NO: 9023310 - DNA, 22 bp, Homo sapiens
ctcccagattcctgctgtggga

SEQ ID NO: 9023311 - DNA, 22 bp, Homo sapiens
ctcccagattcctgctgtggga

SEQ ID NO: 9023312 - DNA, 22 bp, Homo sapiens
ctcccagattcctgctgtggga

SEQ ID NO: 9023313 - DNA, 22 bp, Homo sapiens
ctcccagagagcaggtgggccg

SEQ ID NO: 9023314 - DNA, 22 bp, Homo sapiens
ctcccagaggtgtcattcgagc

SEQ ID NO: 9023315 - DNA, 22 bp, Homo sapiens
ctcccagagagcaggtgggccg

SEQ ID NO: 9023316 - DNA, 22 bp, Homo sapiens
ctcccagagagcaggtgggccg

SEQ ID NO: 9023317 - DNA, 22 bp, Homo sapiens
ctcccagccttcgccagtctga

SEQ ID NO: 9023318 - DNA, 22 bp, Homo sapiens
ctcccagccttcgccagtctga

SEQ ID NO: 9023319 - DNA, 22 bp, Homo sapiens
ctcccagccttcgccagtctga

SEQ ID NO: 9023320 - DNA, 22 bp, Homo sapiens
ctcccagccttcgccagtctga

SEQ ID NO: 9023321 - DNA, 22 bp, Homo sapiens
ctcccagccttcgccagtctga

SEQ ID NO: 9023322 - DNA, 22 bp, Homo sapiens
ctcccagccttcgccagtctga

SEQ ID NO: 9023323 - DNA, 22 bp, Homo sapiens
ctcccagccttcgccagtctga

SEQ ID NO: 9023324 - DNA, 22 bp, Homo sapiens
ctcccaggactcagaggagaag

SEQ ID NO: 9023325 - DNA, 22 bp, Homo sapiens
ctcccaggactcagaggagaag

SEQ ID NO: 9023326 - DNA, 22 bp, Homo sapiens
ctcccaggactcagaggagaag

SEQ ID NO: 9023327 - DNA, 22 bp, Homo sapiens
ctcccagccttcgccagtctga

SEQ ID NO: 9023328 - DNA, 22 bp, Homo sapiens
ctcccaggactcagaggagaag

SEQ ID NO: 9023329 - DNA, 22 bp, Homo sapiens
ttgtgggccattcagctgctct

SEQ ID NO: 9023330 - DNA, 22 bp, Homo sapiens
ttgtgggccattcagctgctct

SEQ ID NO: 9023331 - DNA, 22 bp, Homo sapiens
ttgtgggcttgcctggctcttg

SEQ ID NO: 9023332 - DNA, 22 bp, Homo sapiens
ttgtggggaacccctgtcccac

SEQ ID NO: 9023333 - DNA, 22 bp, Homo sapiens
ttgtggggaggatttgatgaga

SEQ ID NO: 9023334 - DNA, 20 bp, Homo sapiens
ttgtgggggcaatggtatgc

SEQ ID NO: 9023335 - DNA, 22 bp, Homo sapiens
ttgtggggcaacagcaggtgaa

SEQ ID NO: 9023336 - DNA, 22 bp, Homo sapiens
ttgtggggcaacagcaggtgaa

SEQ ID NO: 9023337 - DNA, 22 bp, Homo sapiens
ttgtggggcaacagcaggtgaa

SEQ ID NO: 9023338 - DNA, 23 bp, Homo sapiens
ttgtgggcagattccatggggag

SEQ ID NO: 9023339 - DNA, 23 bp, Homo sapiens
ttgtgggcagattccatggggag

SEQ ID NO: 9023340 - DNA, 22 bp, Homo sapiens
ttgtgaaatcgtgtttggaagc

SEQ ID NO: 9023341 - DNA, 22 bp, Homo sapiens
ttgtgggatggctcttcccaaa

SEQ ID NO: 9023342 - DNA, 21 bp, Homo sapiens
ttgtgaaagtccaggaacaac

SEQ ID NO: 9023343 - DNA, 21 bp, Homo sapiens
ttgtgaaagtccaggaacaac

SEQ ID NO: 9023344 - DNA, 18 bp, Homo sapiens
ttgtgaaatattggagtc

SEQ ID NO: 9023345 - DNA, 18 bp, Homo sapiens
ttgtgaaatattggagtc

SEQ ID NO: 9023346 - DNA, 18 bp, Homo sapiens
ttgtgaaatattggagtc

SEQ ID NO: 9023347 - DNA, 22 bp, Homo sapiens
ttgtgaaaagccgcaagtatag

SEQ ID NO: 9023348 - DNA, 22 bp, Homo sapiens
ttgtgaaaagccgcaagtatag

SEQ ID NO: 9023349 - DNA, 22 bp, Homo sapiens
ttgtcttttgtgggaaatatgg

SEQ ID NO: 9023350 - DNA, 22 bp, Homo sapiens
ttgtgaaacattcatggatttg

SEQ ID NO: 9023351 - DNA, 22 bp, Homo sapiens
ttgtgaaaagccgcaagtatag

SEQ ID NO: 9023352 - DNA, 22 bp, Homo sapiens
ttgtgaaacattcatggatttg

SEQ ID NO: 9023353 - DNA, 22 bp, Homo sapiens
ctccatggctttcgcatctgca

SEQ ID NO: 9023354 - DNA, 22 bp, Homo sapiens
ctccatggaaccggggctgctt

SEQ ID NO: 9023355 - DNA, 22 bp, Homo sapiens
ctccatggaaaaggctgttgtt

SEQ ID NO: 9023356 - DNA, 22 bp, Homo sapiens
ctccatggaaccggggctgctt

SEQ ID NO: 9023357 - DNA, 22 bp, Homo sapiens
ctccatggaaccggggctgctt

SEQ ID NO: 9023358 - DNA, 22 bp, Homo sapiens
ttgtgtaatctcttccctgccc

SEQ ID NO: 9023359 - DNA, 22 bp, Homo sapiens
ttgtgtaacttgagcaaacaca

SEQ ID NO: 9023360 - DNA, 22 bp, Homo sapiens
ctccagtgcgcaggacagcccc

SEQ ID NO: 9023361 - DNA, 22 bp, Homo sapiens
ctccagtgcgtcttagtaaacc

SEQ ID NO: 9023362 - DNA, 22 bp, Homo sapiens
ttgtggttaaccgcacattttt

SEQ ID NO: 9023363 - DNA, 22 bp, Homo sapiens
ttgtggttaaccgcacattttt

SEQ ID NO: 9023364 - DNA, 22 bp, Homo sapiens
ttgtgggggctgccctgtacgg

SEQ ID NO: 9023365 - DNA, 22 bp, Homo sapiens
ttgtggggtgatttgccacggg

SEQ ID NO: 9023366 - DNA, 22 bp, Homo sapiens
ttgtgtaacttgagcaaacaca

SEQ ID NO: 9023367 - DNA, 22 bp, Homo sapiens
ttgtgtaaaacctgtgatcttt

SEQ ID NO: 9023368 - DNA, 22 bp, Homo sapiens
ttgtgtaaaacctgtgatcttt

SEQ ID NO: 9023369 - DNA, 22 bp, Homo sapiens
ttgtggttaaccgcacattttt

SEQ ID NO: 9023370 - DNA, 22 bp, Homo sapiens
ttgtggttaaccgcacattttt

SEQ ID NO: 9023371 - DNA, 22 bp, Homo sapiens
ctccagccagagtgcctctgtt

SEQ ID NO: 9023372 - DNA, 22 bp, Homo sapiens
ctccagccagagtgcctctgtt

SEQ ID NO: 9023373 - DNA, 22 bp, Homo sapiens
ctccagccagagtgcctctgtt

SEQ ID NO: 9023374 - DNA, 22 bp, Homo sapiens
ctccagccagagtgcctctgtt

SEQ ID NO: 9023375 - DNA, 22 bp, Homo sapiens
ctccagccagagtgcctctgtt

SEQ ID NO: 9023376 - DNA, 22 bp, Homo sapiens
ctccagccagagtgcctctgtt

SEQ ID NO: 9023377 - DNA, 22 bp, Homo sapiens
ctccagcaggtgcgtctcagag

SEQ ID NO: 9023378 - DNA, 22 bp, Homo sapiens
ctccagcagaaagggcgagtgg

SEQ ID NO: 9023379 - DNA, 22 bp, Homo sapiens
ctccagcaggtgcgtctcagag

SEQ ID NO: 9023380 - DNA, 22 bp, Homo sapiens
ctccagccagagtgcctctgtt

SEQ ID NO: 9023381 - DNA, 20 bp, Homo sapiens
ctccagcccctgccctggtc

SEQ ID NO: 9023382 - DNA, 20 bp, Homo sapiens
ctccagcccctgccctggtc

SEQ ID NO: 9023383 - DNA, 20 bp, Homo sapiens
ctccagcccctgccctggtc

SEQ ID NO: 9023384 - DNA, 20 bp, Homo sapiens
ctccagcccctgccctggtc

SEQ ID NO: 9023385 - DNA, 20 bp, Homo sapiens
ctccagcccctgccctggtc

SEQ ID NO: 9023386 - DNA, 20 bp, Homo sapiens
ctccagcccctgccctggtc

SEQ ID NO: 9023387 - DNA, 22 bp, Homo sapiens
ctccagcctcagatgacggtac

SEQ ID NO: 9023388 - DNA, 22 bp, Homo sapiens
ctccagcctcagatgacggtac

SEQ ID NO: 9023389 - DNA, 20 bp, Homo sapiens
ctccagcccctgccctggtc

SEQ ID NO: 9023390 - DNA, 22 bp, Homo sapiens
ctccagcctcatctcctggctg

SEQ ID NO: 9023391 - DNA, 22 bp, Homo sapiens
ttgtattttgttatgctactgc

SEQ ID NO: 9023392 - DNA, 22 bp, Homo sapiens
ttgtattttgttatgctactgc

SEQ ID NO: 9023393 - DNA, 23 bp, Homo sapiens
ttgtatttttagtagagacaggg

SEQ ID NO: 9023394 - DNA, 22 bp, Homo sapiens
ttgtctgtccaggcaccccaag

SEQ ID NO: 9023395 - DNA, 22 bp, Homo sapiens
ttgtctgtcccagcttgtgcat

SEQ ID NO: 9023396 - DNA, 22 bp, Homo sapiens
ttgtctgtgaaatggaaatagt

SEQ ID NO: 9023397 - DNA, 22 bp, Homo sapiens
ttgtcttaaatggatggacaat

SEQ ID NO: 9023398 - DNA, 23 bp, Homo sapiens
ttgtctgtgcttttccagttgct

SEQ ID NO: 9023399 - DNA, 22 bp, Homo sapiens
ttgtctttcccagcttctagag

SEQ ID NO: 9023400 - DNA, 22 bp, Homo sapiens
ttgtcttaaatggatggacaat

SEQ ID NO: 9023401 - DNA, 22 bp, Homo sapiens
ttgtcttaaatggatggacaat

SEQ ID NO: 9023402 - DNA, 22 bp, Homo sapiens
ttgtcttagagtgaaaacttta

SEQ ID NO: 9023403 - DNA, 22 bp, Homo sapiens
ttgtctttcccagcttctagag

SEQ ID NO: 9023404 - DNA, 22 bp, Homo sapiens
ttgtctttcccagcttctagag

SEQ ID NO: 9023405 - DNA, 22 bp, Homo sapiens
ttgtctttcccagcttctagag

SEQ ID NO: 9023406 - DNA, 22 bp, Homo sapiens
ttgtctttcccagcttctagag

SEQ ID NO: 9023407 - DNA, 22 bp, Homo sapiens
ttgtctttggaaatttaatgtt

SEQ ID NO: 9023408 - DNA, 22 bp, Homo sapiens
ttgtctttggaaatttaatgtt

SEQ ID NO: 9023409 - DNA, 22 bp, Homo sapiens
ttgtcttttgtgggaaatatgg

SEQ ID NO: 9023410 - DNA, 22 bp, Homo sapiens
ctgagccatgagcctgcgccca

SEQ ID NO: 9023411 - DNA, 22 bp, Homo sapiens
ctgagccatgagcctgcgccca

SEQ ID NO: 9023412 - DNA, 22 bp, Homo sapiens
ctgagccatgagcctgcgccca

SEQ ID NO: 9023413 - DNA, 22 bp, Homo sapiens
ctgagccatgggtctaagcact

SEQ ID NO: 9023414 - DNA, 22 bp, Homo sapiens
ctgagccatgggtctaagcact

SEQ ID NO: 9023415 - DNA, 22 bp, Homo sapiens
ctgagccatgggtctaagcact

SEQ ID NO: 9023416 - DNA, 22 bp, Homo sapiens
ctgagccatgagcctgcgccca

SEQ ID NO: 9023417 - DNA, 22 bp, Homo sapiens
ctgagccatccataccagctta

SEQ ID NO: 9023418 - DNA, 22 bp, Homo sapiens
ctgagccatccataccagctta

SEQ ID NO: 9023419 - DNA, 22 bp, Homo sapiens
ctgagccatccataccagctta

SEQ ID NO: 9023420 - DNA, 22 bp, Homo sapiens
ctgagccatgagcctgcgccca

SEQ ID NO: 9023421 - DNA, 22 bp, Homo sapiens
ctgagccataagggaggctggg

SEQ ID NO: 9023422 - DNA, 22 bp, Homo sapiens
ctgagccataagggaggctggg

SEQ ID NO: 9023423 - DNA, 22 bp, Homo sapiens
ctgagccagtagtcagggacaa

SEQ ID NO: 9023424 - DNA, 22 bp, Homo sapiens
ctgagccatccataccagctta

SEQ ID NO: 9023425 - DNA, 22 bp, Homo sapiens
ctgagccatccataccagctta

SEQ ID NO: 9023426 - DNA, 22 bp, Homo sapiens
ctgagccagtagtcagggacaa

SEQ ID NO: 9023427 - DNA, 22 bp, Homo sapiens
ctgagccagtagtcagggacaa

SEQ ID NO: 9023428 - DNA, 22 bp, Homo sapiens
ctgagccagtagtcagggacaa

SEQ ID NO: 9023429 - DNA, 22 bp, Homo sapiens
ctgagccataagggaggctggg

SEQ ID NO: 9023430 - DNA, 22 bp, Homo sapiens
ctgagccataagggaggctggg

SEQ ID NO: 9023431 - DNA, 22 bp, Homo sapiens
ctgagccataagggaggctggg

SEQ ID NO: 9023432 - DNA, 20 bp, Homo sapiens
ctgagccaactctcttcttg

SEQ ID NO: 9023433 - DNA, 22 bp, Homo sapiens
ctgagccaaccacagcaggagc

SEQ ID NO: 9023434 - DNA, 20 bp, Homo sapiens
ctgagccaactctcttcttg

SEQ ID NO: 9023435 - DNA, 20 bp, Homo sapiens
ctgagccaactctcttcttg

SEQ ID NO: 9023436 - DNA, 22 bp, Homo sapiens
ctgactctcctgagatggggag

SEQ ID NO: 9023437 - DNA, 22 bp, Homo sapiens
ctgactctcctcaagcataaat

SEQ ID NO: 9023438 - DNA, 20 bp, Homo sapiens
ctgactctccttggcttgga

SEQ ID NO: 9023439 - DNA, 22 bp, Homo sapiens
ctgactctctgagctcaaggtt

SEQ ID NO: 9023440 - DNA, 22 bp, Homo sapiens
ctgagccaaccacagcaggagc

SEQ ID NO: 9023441 - DNA, 22 bp, Homo sapiens
ctgagccaaccacagcaggagc

SEQ ID NO: 9023442 - DNA, 22 bp, Homo sapiens
ctgagccaaccacagcaggagc

SEQ ID NO: 9023443 - DNA, 22 bp, Homo sapiens
ctgagccaaccacagcaggagc

SEQ ID NO: 9023444 - DNA, 22 bp, Homo sapiens
ctgagccaaccacagcaggagc

SEQ ID NO: 9023445 - DNA, 22 bp, Homo sapiens
ctgactgtaattctgttcttaa

SEQ ID NO: 9023446 - DNA, 19 bp, Homo sapiens
ctgacctggctcagcaaag

SEQ ID NO: 9023447 - DNA, 22 bp, Homo sapiens
ctgacctgtaactgtaagagac

SEQ ID NO: 9023448 - DNA, 22 bp, Homo sapiens
ctgacctgcccttaggcttctc

SEQ ID NO: 9023449 - DNA, 22 bp, Homo sapiens
ctgacctgcggggaggagggcc

SEQ ID NO: 9023450 - DNA, 22 bp, Homo sapiens
ctgacctgcccttaggcttctc

SEQ ID NO: 9023451 - DNA, 22 bp, Homo sapiens
ctgacctgagtggtacaaggca

SEQ ID NO: 9023452 - DNA, 23 bp, Homo sapiens
ctgacctgacccataagcaagga

SEQ ID NO: 9023453 - DNA, 18 bp, Homo sapiens
ctgacctctgagcccctc

SEQ ID NO: 9023454 - DNA, 22 bp, Homo sapiens
ctgaccctttagggtatgttta

SEQ ID NO: 9023455 - DNA, 18 bp, Homo sapiens
ctgacccttttacattcc

SEQ ID NO: 9023456 - DNA, 18 bp, Homo sapiens
ctgacccttttacattcc

SEQ ID NO: 9023457 - DNA, 23 bp, Homo sapiens
ctgactcatcccaccacctcctc

SEQ ID NO: 9023458 - DNA, 16 bp, Homo sapiens
ctgacctgtgcactgt

SEQ ID NO: 9023459 - DNA, 22 bp, Homo sapiens
ctgaccttcgggcgggctgcgg

SEQ ID NO: 9023460 - DNA, 22 bp, Homo sapiens
ctgaccttcccaggggctggaa

SEQ ID NO: 9023461 - DNA, 22 bp, Homo sapiens
ctgactcagcagctgatgatcc

SEQ ID NO: 9023462 - DNA, 22 bp, Homo sapiens
ctgagcccaggcgggagctgag

SEQ ID NO: 9023463 - DNA, 22 bp, Homo sapiens
ctgagcccaggcgggagctgag

SEQ ID NO: 9023464 - DNA, 20 bp, Homo sapiens
ctgagcccagatcccaggtc

SEQ ID NO: 9023465 - DNA, 20 bp, Homo sapiens
ctgagcccagatcccaggtc

SEQ ID NO: 9023466 - DNA, 20 bp, Homo sapiens
ctgagcccccagcctgcagg

SEQ ID NO: 9023467 - DNA, 22 bp, Homo sapiens
ctgagccccatctgaggtgccc

SEQ ID NO: 9023468 - DNA, 22 bp, Homo sapiens
ctgagcccattgggtgctgtta

SEQ ID NO: 9023469 - DNA, 17 bp, Homo sapiens
ctgagccccgggcagct

SEQ ID NO: 9023470 - DNA, 17 bp, Homo sapiens
ctgagccccgggcagct

SEQ ID NO: 9023471 - DNA, 20 bp, Homo sapiens
ctgagcccccagcctgcagg

SEQ ID NO: 9023472 - DNA, 20 bp, Homo sapiens
ctgagcccccagcctgcagg

SEQ ID NO: 9023473 - DNA, 22 bp, Homo sapiens
ctgagcccgggtgctctacccc

SEQ ID NO: 9023474 - DNA, 22 bp, Homo sapiens
ctgagcccctctgacctcagag

SEQ ID NO: 9023475 - DNA, 22 bp, Homo sapiens
ctgagcctcctgcttctatttc

SEQ ID NO: 9023476 - DNA, 22 bp, Homo sapiens
ctgagcctgtgtttctctggca

SEQ ID NO: 9023477 - DNA, 22 bp, Homo sapiens
ctgaggcagagggcagaccaga

SEQ ID NO: 9023478 - DNA, 22 bp, Homo sapiens
ctgaggcagagggcagaccaga

SEQ ID NO: 9023479 - DNA, 22 bp, Homo sapiens
ctgaggcagagggcagaccaga

SEQ ID NO: 9023480 - DNA, 22 bp, Homo sapiens
ctgaggcagagggcagaccaga

SEQ ID NO: 9023481 - DNA, 22 bp, Homo sapiens
ctgaggcagagggcagaccaga

SEQ ID NO: 9023482 - DNA, 22 bp, Homo sapiens
ctgagccctgcctcttgtcact

SEQ ID NO: 9023483 - DNA, 22 bp, Homo sapiens
ctgagccctgcctcttgtcact

SEQ ID NO: 9023484 - DNA, 22 bp, Homo sapiens
ctgagccctggctcgcctggag

SEQ ID NO: 9023485 - DNA, 22 bp, Homo sapiens
ctgagccctggctcgcctggag

SEQ ID NO: 9023486 - DNA, 22 bp, Homo sapiens
ctgagccctggctcgcctggag

SEQ ID NO: 9023487 - DNA, 20 bp, Homo sapiens
ctgagcccttcctgtgaacc

SEQ ID NO: 9023488 - DNA, 22 bp, Homo sapiens
ctgagcccttgaacccaagtcc

SEQ ID NO: 9023489 - DNA, 22 bp, Homo sapiens
ctgagcctccatttcatcaggt

SEQ ID NO: 9023490 - DNA, 22 bp, Homo sapiens
ctgagcctccaggaggggggtg

SEQ ID NO: 9023491 - DNA, 19 bp, Homo sapiens
ctctttggagatccttgga

SEQ ID NO: 9023492 - DNA, 22 bp, Homo sapiens
ctctttggagaagcacgtatta

SEQ ID NO: 9023493 - DNA, 19 bp, Homo sapiens
ctctttggagatccttgga

SEQ ID NO: 9023494 - DNA, 22 bp, Homo sapiens
ctctttggatagaattacaaag

SEQ ID NO: 9023495 - DNA, 22 bp, Homo sapiens
ctctttggatagaattacaaag

SEQ ID NO: 9023496 - DNA, 22 bp, Homo sapiens
ctctttggatagaattacaaag

SEQ ID NO: 9023497 - DNA, 22 bp, Homo sapiens
ctctttggatagaattacaaag

SEQ ID NO: 9023498 - DNA, 22 bp, Homo sapiens
ctctttggatgtttatgataag

SEQ ID NO: 9023499 - DNA, 22 bp, Homo sapiens
ctctttggatgtttatgataag

SEQ ID NO: 9023500 - DNA, 22 bp, Homo sapiens
ctctttggatgtttatgataag

SEQ ID NO: 9023501 - DNA, 22 bp, Homo sapiens
ctgaatatcatttatcattggc

SEQ ID NO: 9023502 - DNA, 22 bp, Homo sapiens
ctctttctgattcgctgggacc

SEQ ID NO: 9023503 - DNA, 22 bp, Homo sapiens
ctctttgaaatccatcactgct

SEQ ID NO: 9023504 - DNA, 18 bp, Homo sapiens
ctctttctttggcacaaa

SEQ ID NO: 9023505 - DNA, 18 bp, Homo sapiens
ctctttctttggcacaaa

SEQ ID NO: 9023506 - DNA, 18 bp, Homo sapiens
ctctttctttggcacaaa

SEQ ID NO: 9023507 - DNA, 22 bp, Homo sapiens
ctctttctggaaggcagagtgg

SEQ ID NO: 9023508 - DNA, 20 bp, Homo sapiens
ctctttgcaatgcagaagac

SEQ ID NO: 9023509 - DNA, 22 bp, Homo sapiens
ctctttggagaagcacgtatta

SEQ ID NO: 9023510 - DNA, 22 bp, Homo sapiens
ctctttggagaagcacgtatta

SEQ ID NO: 9023511 - DNA, 20 bp, Homo sapiens
ctctttgaaatgctcttggg

SEQ ID NO: 9023512 - DNA, 20 bp, Homo sapiens
ctctttgaaatgctcttggg

SEQ ID NO: 9023513 - DNA, 21 bp, Homo sapiens
ctctttatatagtaaagatat

SEQ ID NO: 9023514 - DNA, 17 bp, Homo sapiens
ctctttataaagagtta

SEQ ID NO: 9023515 - DNA, 22 bp, Homo sapiens
ctctttagtttgaaatccacat

SEQ ID NO: 9023516 - DNA, 22 bp, Homo sapiens
ctctttagtggtgatgatgcta

SEQ ID NO: 9023517 - DNA, 17 bp, Homo sapiens
ctctttataaagagtta

SEQ ID NO: 9023518 - DNA, 17 bp, Homo sapiens
ctctttataaagagtta

SEQ ID NO: 9023519 - DNA, 19 bp, Homo sapiens
ctctttccattgtatttgc

SEQ ID NO: 9023520 - DNA, 19 bp, Homo sapiens
ctctttccattgtatttgc

SEQ ID NO: 9023521 - DNA, 22 bp, Homo sapiens
ctctttccagggtaccccaggt

SEQ ID NO: 9023522 - DNA, 22 bp, Homo sapiens
ctctttccagggtaccccaggt

SEQ ID NO: 9023523 - DNA, 21 bp, Homo sapiens
ctctttatatagtaaagatat

SEQ ID NO: 9023524 - DNA, 22 bp, Homo sapiens
ctctttcagttctgatagtctc

SEQ ID NO: 9023525 - DNA, 22 bp, Homo sapiens
ctctttcctcagccacagtcta

SEQ ID NO: 9023526 - DNA, 22 bp, Homo sapiens
ctctttcctcagccacagtcta

SEQ ID NO: 9023527 - DNA, 22 bp, Homo sapiens
ctctttcctcagccacagtcta

SEQ ID NO: 9023528 - DNA, 22 bp, Homo sapiens
ctctttcctcagccacagtcta

SEQ ID NO: 9023529 - DNA, 22 bp, Homo sapiens
ctctttcctcgatgggctcctg

SEQ ID NO: 9023530 - DNA, 22 bp, Homo sapiens
ctctttcctcgatgggctcctg

SEQ ID NO: 9023531 - DNA, 22 bp, Homo sapiens
ctctttcctcgatgggctcctg

SEQ ID NO: 9023532 - DNA, 22 bp, Homo sapiens
ctctttctcattgtcagcagaa

SEQ ID NO: 9023533 - DNA, 22 bp, Homo sapiens
ctctttctcgccgcccgcagtc

SEQ ID NO: 9023534 - DNA, 22 bp, Homo sapiens
ctctttctcattgtcagcagaa

SEQ ID NO: 9023535 - DNA, 22 bp, Homo sapiens
ctctttctcattgtcagcagaa

SEQ ID NO: 9023536 - DNA, 22 bp, Homo sapiens
ctctttctgattcgctgggacc

SEQ ID NO: 9023537 - DNA, 22 bp, Homo sapiens
ctctttctgattcgctgggacc

SEQ ID NO: 9023538 - DNA, 22 bp, Homo sapiens
ctctttctgattcgctgggacc

SEQ ID NO: 9023539 - DNA, 22 bp, Homo sapiens
ctctttctgattcgctgggacc

SEQ ID NO: 9023540 - DNA, 22 bp, Homo sapiens
ctgacagctgaagggtcccaga

SEQ ID NO: 9023541 - DNA, 22 bp, Homo sapiens
ctgacagcaaaggccagtggct

SEQ ID NO: 9023542 - DNA, 22 bp, Homo sapiens
ctgacagattagatgtgcatat

SEQ ID NO: 9023543 - DNA, 22 bp, Homo sapiens
ctgacagggtagacagagggca

SEQ ID NO: 9023544 - DNA, 22 bp, Homo sapiens
ctgacagcagcaaatggagata

SEQ ID NO: 9023545 - DNA, 22 bp, Homo sapiens
ctgacagctgttgcagtgaatg

SEQ ID NO: 9023546 - DNA, 22 bp, Homo sapiens
ctgacaggctgagatccctggt

SEQ ID NO: 9023547 - DNA, 22 bp, Homo sapiens
ctgacaggctgagatccctggt

SEQ ID NO: 9023548 - DNA, 22 bp, Homo sapiens
ctgacagatctggatctgaact

SEQ ID NO: 9023549 - DNA, 22 bp, Homo sapiens
ctgacagatgctgctggcagta

SEQ ID NO: 9023550 - DNA, 22 bp, Homo sapiens
ctgacagatgctgctggcagta

SEQ ID NO: 9023551 - DNA, 22 bp, Homo sapiens
ctgacagattagatgtgcatat

SEQ ID NO: 9023552 - DNA, 22 bp, Homo sapiens
ctgacagattagatgtgcatat

SEQ ID NO: 9023553 - DNA, 22 bp, Homo sapiens
ctgaatcatgccattttgctta

SEQ ID NO: 9023554 - DNA, 22 bp, Homo sapiens
ctgacagatacttatgacataa

SEQ ID NO: 9023555 - DNA, 22 bp, Homo sapiens
ctgacagatacttatgacataa

SEQ ID NO: 9023556 - DNA, 22 bp, Homo sapiens
ctgaatattagtcatgtctgat

SEQ ID NO: 9023557 - DNA, 22 bp, Homo sapiens
ctgaatattagtcatgtctgat

SEQ ID NO: 9023558 - DNA, 22 bp, Homo sapiens
ctgaatatcatttatcattggc

SEQ ID NO: 9023559 - DNA, 19 bp, Homo sapiens
ctgacccaggacaccacgg

SEQ ID NO: 9023560 - DNA, 22 bp, Homo sapiens
ctgaccctagcatctctgtgca

SEQ ID NO: 9023561 - DNA, 22 bp, Homo sapiens
ctgacccatataagagtggagg

SEQ ID NO: 9023562 - DNA, 22 bp, Homo sapiens
ctgaccctggtcaagttgcctc

SEQ ID NO: 9023563 - DNA, 18 bp, Homo sapiens
ctgaccctggctctgggt

SEQ ID NO: 9023564 - DNA, 22 bp, Homo sapiens
ctgaccctggaggcatttctct

SEQ ID NO: 9023565 - DNA, 18 bp, Homo sapiens
ctgaccctggctctgggt

SEQ ID NO: 9023566 - DNA, 22 bp, Homo sapiens
ctgacccagaggaactgcaaag

SEQ ID NO: 9023567 - DNA, 20 bp, Homo sapiens
ctgacccaatctctgtcccc

SEQ ID NO: 9023568 - DNA, 22 bp, Homo sapiens
ctgaccagaccccaggaggctg

SEQ ID NO: 9023569 - DNA, 22 bp, Homo sapiens
ctgaccagggtagaggtgagag

SEQ ID NO: 9023570 - DNA, 22 bp, Homo sapiens
ctgacagtaactaatgtggaga

SEQ ID NO: 9023571 - DNA, 22 bp, Homo sapiens
ctgacaggttggtagctttgga

SEQ ID NO: 9023572 - DNA, 22 bp, Homo sapiens
ctgacaggttggtagctttgga

SEQ ID NO: 9023573 - DNA, 19 bp, Homo sapiens
ctgacatcccaggtcagaa

SEQ ID NO: 9023574 - DNA, 22 bp, Homo sapiens
ctgacagtttttgctgtattgt

SEQ ID NO: 9023575 - DNA, 22 bp, Homo sapiens
ctgacagtgtacactgacagct

SEQ ID NO: 9023576 - DNA, 22 bp, Homo sapiens
ctgacagtttttgctgtattgt

SEQ ID NO: 9023577 - DNA, 22 bp, Homo sapiens
ctgacagtgtacactgacagct

SEQ ID NO: 9023578 - DNA, 22 bp, Homo sapiens
ctgacagtcttgccaagtttct

SEQ ID NO: 9023579 - DNA, 22 bp, Homo sapiens
ctgacagtcttgccaagtttct

SEQ ID NO: 9023580 - DNA, 22 bp, Homo sapiens
ctgacagtctcattgatttgct

SEQ ID NO: 9023581 - DNA, 22 bp, Homo sapiens
ctgacatttactgagcacttac

SEQ ID NO: 9023582 - DNA, 22 bp, Homo sapiens
ctgaccacaggcctctaacagc

SEQ ID NO: 9023583 - DNA, 22 bp, Homo sapiens
ctgacatttactgagcacttac

SEQ ID NO: 9023584 - DNA, 22 bp, Homo sapiens
ctgcagggccatgggttctata

SEQ ID NO: 9023585 - DNA, 22 bp, Homo sapiens
ctgcagggcccaaggtcaacgg

SEQ ID NO: 9023586 - DNA, 22 bp, Homo sapiens
ctgcagggcccaaggtcaacgg

SEQ ID NO: 9023587 - DNA, 22 bp, Homo sapiens
ctgcagggcccaaggtcaacgg

SEQ ID NO: 9023588 - DNA, 22 bp, Homo sapiens
ctgcagggcccaaggtcaacgg

SEQ ID NO: 9023589 - DNA, 22 bp, Homo sapiens
ctgcagggccatgggttctata

SEQ ID NO: 9023590 - DNA, 22 bp, Homo sapiens
ctgcagggcattgtaactcttt

SEQ ID NO: 9023591 - DNA, 22 bp, Homo sapiens
ctgcagggccatgggttctata

SEQ ID NO: 9023592 - DNA, 22 bp, Homo sapiens
ctgcagggcccgcctgagccct

SEQ ID NO: 9023593 - DNA, 22 bp, Homo sapiens
ctgcagggcccgcctgagccct

SEQ ID NO: 9023594 - DNA, 22 bp, Homo sapiens
ctgcagggcccgcctgagccct

SEQ ID NO: 9023595 - DNA, 22 bp, Homo sapiens
ctgcagggcccgcctgagccct

SEQ ID NO: 9023596 - DNA, 22 bp, Homo sapiens
ctgcagggcccgcctgagccct

SEQ ID NO: 9023597 - DNA, 22 bp, Homo sapiens
ctgcagggcccgcctgagccct

SEQ ID NO: 9023598 - DNA, 22 bp, Homo sapiens
ctgcagggcttaccttgctctg

SEQ ID NO: 9023599 - DNA, 22 bp, Homo sapiens
ctgcagggcccgcctgagccct

SEQ ID NO: 9023600 - DNA, 22 bp, Homo sapiens
ctgcagggcttaccttgctctg

SEQ ID NO: 9023601 - DNA, 22 bp, Homo sapiens
ctgcaggggaccaaagtctgac

SEQ ID NO: 9023602 - DNA, 22 bp, Homo sapiens
ctgcaggggaccaaagtctgac

SEQ ID NO: 9023603 - DNA, 22 bp, Homo sapiens
ctgcaggggaccaaagtctgac

SEQ ID NO: 9023604 - DNA, 22 bp, Homo sapiens
ctgcaggggaccaaagtctgac

SEQ ID NO: 9023605 - DNA, 22 bp, Homo sapiens
ctgcaggggcagtccacttcct

SEQ ID NO: 9023606 - DNA, 22 bp, Homo sapiens
ctgcaggggcctcgagcacagg

SEQ ID NO: 9023607 - DNA, 22 bp, Homo sapiens
ctgcaggggcagtccacttcct

SEQ ID NO: 9023608 - DNA, 22 bp, Homo sapiens
ctgcaggggcctcgagcacagg

SEQ ID NO: 9023609 - DNA, 22 bp, Homo sapiens
ctgcaggggcagtccacttcct

SEQ ID NO: 9023610 - DNA, 22 bp, Homo sapiens
ctgcagggcagaagggcataga

SEQ ID NO: 9023611 - DNA, 22 bp, Homo sapiens
ctgcagggcagaagggcataga

SEQ ID NO: 9023612 - DNA, 22 bp, Homo sapiens
ctgcagggcagggcctcctggc

SEQ ID NO: 9023613 - DNA, 22 bp, Homo sapiens
ctgcagggattgcttctgtata

SEQ ID NO: 9023614 - DNA, 22 bp, Homo sapiens
ctgcagggattgcttctgtata

SEQ ID NO: 9023615 - DNA, 22 bp, Homo sapiens
ctgcagggattgcttctgtata

SEQ ID NO: 9023616 - DNA, 22 bp, Homo sapiens
ctgcagggcagggcctcctggc

SEQ ID NO: 9023617 - DNA, 22 bp, Homo sapiens
ctgcagggcagggcctcctggc

SEQ ID NO: 9023618 - DNA, 22 bp, Homo sapiens
ctgcagggcagggcctcctggc

SEQ ID NO: 9023619 - DNA, 22 bp, Homo sapiens
ctgcagggcagggcctcctggc

SEQ ID NO: 9023620 - DNA, 22 bp, Homo sapiens
ctgcagggcattgtaactcttt

SEQ ID NO: 9023621 - DNA, 22 bp, Homo sapiens
ctgcagggcagggcctcctggc

SEQ ID NO: 9023622 - DNA, 22 bp, Homo sapiens
ctgcagggcagaagggcataga

SEQ ID NO: 9023623 - DNA, 22 bp, Homo sapiens
ctgcagggcagggcctcctggc

SEQ ID NO: 9023624 - DNA, 22 bp, Homo sapiens
ctgcagggatgtgaggcccgtt

SEQ ID NO: 9023625 - DNA, 22 bp, Homo sapiens
ctgcagggatgtgaggcccgtt

SEQ ID NO: 9023626 - DNA, 19 bp, Homo sapiens
ctgcagggatgtgcagagt

SEQ ID NO: 9023627 - DNA, 22 bp, Homo sapiens
ctgcagggatgtgaggcccgtt

SEQ ID NO: 9023628 - DNA, 22 bp, Homo sapiens
ctgcagggatgtgaggcccgtt

SEQ ID NO: 9023629 - DNA, 19 bp, Homo sapiens
ctgcagggatgtgcagagt

SEQ ID NO: 9023630 - DNA, 19 bp, Homo sapiens
ctgcagggatgtgcagagt

SEQ ID NO: 9023631 - DNA, 19 bp, Homo sapiens
ctgcagggatgtgcagagt

SEQ ID NO: 9023632 - DNA, 19 bp, Homo sapiens
ctgcagggatgtgcagagt

SEQ ID NO: 9023633 - DNA, 19 bp, Homo sapiens
ctgcagggatgtgcagagt

SEQ ID NO: 9023634 - DNA, 22 bp, Homo sapiens
ctgcaccgtgtctcgggctgcc

SEQ ID NO: 9023635 - DNA, 22 bp, Homo sapiens
ctgcaccgtgtctcgggctgcc

SEQ ID NO: 9023636 - DNA, 22 bp, Homo sapiens
ctgcacctacagccacatttac

SEQ ID NO: 9023637 - DNA, 22 bp, Homo sapiens
ctgcacctacagccacatttac

SEQ ID NO: 9023638 - DNA, 22 bp, Homo sapiens
ctgcaccgtgtctcgggctgcc

SEQ ID NO: 9023639 - DNA, 22 bp, Homo sapiens
ctgcactgaagaaaggagctct

SEQ ID NO: 9023640 - DNA, 22 bp, Homo sapiens
ctgcactgacttccccggctgc

SEQ ID NO: 9023641 - DNA, 22 bp, Homo sapiens
ctgcaccatctggagcacctcc

SEQ ID NO: 9023642 - DNA, 22 bp, Homo sapiens
ctgcaccatctggagcacctcc

SEQ ID NO: 9023643 - DNA, 22 bp, Homo sapiens
ctgcaccatccttcatgctctg

SEQ ID NO: 9023644 - DNA, 22 bp, Homo sapiens
ctgcacccatgagctcaaggga

SEQ ID NO: 9023645 - DNA, 22 bp, Homo sapiens
ctgcacccatgagctcaaggga

SEQ ID NO: 9023646 - DNA, 22 bp, Homo sapiens
ctgcaccctcaaactcctgggc

SEQ ID NO: 9023647 - DNA, 22 bp, Homo sapiens
ctgcaccacagcctgaggcagc

SEQ ID NO: 9023648 - DNA, 22 bp, Homo sapiens
ctgcacagtttgatttcttgct

SEQ ID NO: 9023649 - DNA, 22 bp, Homo sapiens
ctgcagggagcagatggcgtgt

SEQ ID NO: 9023650 - DNA, 22 bp, Homo sapiens
ctgcaggctcgaagacacggat

SEQ ID NO: 9023651 - DNA, 22 bp, Homo sapiens
ctgcagggagaggggacagcct

SEQ ID NO: 9023652 - DNA, 22 bp, Homo sapiens
ctgcaggcccccttcctggagt

SEQ ID NO: 9023653 - DNA, 22 bp, Homo sapiens
ctgcaggcccccttcctggagt

SEQ ID NO: 9023654 - DNA, 22 bp, Homo sapiens
ctgcagggagcagatggcgtgt

SEQ ID NO: 9023655 - DNA, 22 bp, Homo sapiens
ctgcagggagaggggacagcct

SEQ ID NO: 9023656 - DNA, 22 bp, Homo sapiens
ctgcagggagcagatggcgtgt

SEQ ID NO: 9023657 - DNA, 22 bp, Homo sapiens
ctgcagggagcagatggcgtgt

SEQ ID NO: 9023658 - DNA, 22 bp, Homo sapiens
ctgcagggagcagatggcgtgt

SEQ ID NO: 9023659 - DNA, 22 bp, Homo sapiens
ctgcagggagcagatggcgtgt

SEQ ID NO: 9023660 - DNA, 22 bp, Homo sapiens
ctgcagggatgtgaggcccgtt

SEQ ID NO: 9023661 - DNA, 22 bp, Homo sapiens
ctgcagggaggttccttgttct

SEQ ID NO: 9023662 - DNA, 22 bp, Homo sapiens
ctgcagggaggttccttgttct

SEQ ID NO: 9023663 - DNA, 22 bp, Homo sapiens
ctgcagggaggttccttgttct

SEQ ID NO: 9023664 - DNA, 22 bp, Homo sapiens
ctgcactgctgatcccaggtct

SEQ ID NO: 9023665 - DNA, 22 bp, Homo sapiens
ctgcaggcatctaactgtgggc

SEQ ID NO: 9023666 - DNA, 22 bp, Homo sapiens
ctgcaggcatttattcatgcaa

SEQ ID NO: 9023667 - DNA, 22 bp, Homo sapiens
ctgcaggcccccttcctggagt

SEQ ID NO: 9023668 - DNA, 18 bp, Homo sapiens
ctgcacttcagcttgggc

SEQ ID NO: 9023669 - DNA, 22 bp, Homo sapiens
ctgcaggcatctaactgtgggc

SEQ ID NO: 9023670 - DNA, 22 bp, Homo sapiens
ctgcaggcatctaactgtgggc

SEQ ID NO: 9023671 - DNA, 19 bp, Homo sapiens
ctgaggcccatgtaccatg

SEQ ID NO: 9023672 - DNA, 19 bp, Homo sapiens
ctgaggcccatgtaccatg

SEQ ID NO: 9023673 - DNA, 19 bp, Homo sapiens
ctgaggcccatgtaccatg

SEQ ID NO: 9023674 - DNA, 19 bp, Homo sapiens
ctgaggcccatgtaccatg

SEQ ID NO: 9023675 - DNA, 22 bp, Homo sapiens
ctgaggcccctctcttgagctt

SEQ ID NO: 9023676 - DNA, 22 bp, Homo sapiens
ctgaggcccctctcttgagctt

SEQ ID NO: 9023677 - DNA, 22 bp, Homo sapiens
ctgaggcccctctcttgagctt

SEQ ID NO: 9023678 - DNA, 22 bp, Homo sapiens
ctgaggcccctcttgtgagcat

SEQ ID NO: 9023679 - DNA, 22 bp, Homo sapiens
ctgaggcccctcttgtgagcat

SEQ ID NO: 9023680 - DNA, 22 bp, Homo sapiens
ctgaggcccctcttgtgagcat

SEQ ID NO: 9023681 - DNA, 22 bp, Homo sapiens
ctgaggcccctcttgtgagcat

SEQ ID NO: 9023682 - DNA, 22 bp, Homo sapiens
ctgaggcccctcttgtgagcat

SEQ ID NO: 9023683 - DNA, 22 bp, Homo sapiens
ctgaggccggagcactgaagag

SEQ ID NO: 9023684 - DNA, 22 bp, Homo sapiens
ctgaggccggagcactgaagag

SEQ ID NO: 9023685 - DNA, 22 bp, Homo sapiens
ctgaggccggagcactgaagag

SEQ ID NO: 9023686 - DNA, 18 bp, Homo sapiens
ctgaggcccagagagggc

SEQ ID NO: 9023687 - DNA, 17 bp, Homo sapiens
ctgaggcccagggccca

SEQ ID NO: 9023688 - DNA, 17 bp, Homo sapiens
ctgaggcccagggccca

SEQ ID NO: 9023689 - DNA, 17 bp, Homo sapiens
ctgaggcccagggccca

SEQ ID NO: 9023690 - DNA, 17 bp, Homo sapiens
ctgaggcccagggccca

SEQ ID NO: 9023691 - DNA, 17 bp, Homo sapiens
ctgaggcccagggccca

SEQ ID NO: 9023692 - DNA, 17 bp, Homo sapiens
ctgaggcccagggccca

SEQ ID NO: 9023693 - DNA, 18 bp, Homo sapiens
ctgaggcccagagagggc

SEQ ID NO: 9023694 - DNA, 18 bp, Homo sapiens
ctgaggcccagagagggc

SEQ ID NO: 9023695 - DNA, 18 bp, Homo sapiens
ctgaggcccagagagggc

SEQ ID NO: 9023696 - DNA, 18 bp, Homo sapiens
ctgaggcccagagagggc

SEQ ID NO: 9023697 - DNA, 18 bp, Homo sapiens
ctgaggcccagagagggc

SEQ ID NO: 9023698 - DNA, 22 bp, Homo sapiens
ctgaggccagctgcagagctct

SEQ ID NO: 9023699 - DNA, 22 bp, Homo sapiens
ctgaggccagctgcagagctct

SEQ ID NO: 9023700 - DNA, 22 bp, Homo sapiens
ctgaggccagctgcagagctct

SEQ ID NO: 9023701 - DNA, 22 bp, Homo sapiens
ctgaggccagaacccgaccctg

SEQ ID NO: 9023702 - DNA, 22 bp, Homo sapiens
ctgaggccagagtgggcctctt

SEQ ID NO: 9023703 - DNA, 22 bp, Homo sapiens
ctgaggccagaacccgaccctg

SEQ ID NO: 9023704 - DNA, 22 bp, Homo sapiens
ctgaggccagagtgggcctctt

SEQ ID NO: 9023705 - DNA, 22 bp, Homo sapiens
ctgaggccagaacccgaccctg

SEQ ID NO: 9023706 - DNA, 22 bp, Homo sapiens
ctgaggccagaacccgaccctg

SEQ ID NO: 9023707 - DNA, 18 bp, Homo sapiens
ctgaggccaactacactg

SEQ ID NO: 9023708 - DNA, 22 bp, Homo sapiens
ctgaggccagagtgggcctctt

SEQ ID NO: 9023709 - DNA, 22 bp, Homo sapiens
ctgaggccagctgcagagctct

SEQ ID NO: 9023710 - DNA, 22 bp, Homo sapiens
ctgaggccagctgcagagctct

SEQ ID NO: 9023711 - DNA, 22 bp, Homo sapiens
ctgaggccagctgcagagctct

SEQ ID NO: 9023712 - DNA, 22 bp, Homo sapiens
ctgaggccagagtgggcctctt

SEQ ID NO: 9023713 - DNA, 22 bp, Homo sapiens
ctgaggcatgggaagttgggtg

SEQ ID NO: 9023714 - DNA, 22 bp, Homo sapiens
ctgaggcatgggaagttgggtg

SEQ ID NO: 9023715 - DNA, 22 bp, Homo sapiens
ctgaggcatgttacaggacata

SEQ ID NO: 9023716 - DNA, 22 bp, Homo sapiens
ctgaggcatgttacaggacata

SEQ ID NO: 9023717 - DNA, 22 bp, Homo sapiens
ctgaggcatgttacaggacata

SEQ ID NO: 9023718 - DNA, 22 bp, Homo sapiens
ctgaggcatgttacaggacata

SEQ ID NO: 9023719 - DNA, 18 bp, Homo sapiens
ctgaggccaactacactg

SEQ ID NO: 9023720 - DNA, 22 bp, Homo sapiens
ctgaggcatgttacaggacata

SEQ ID NO: 9023721 - DNA, 22 bp, Homo sapiens
ctgaggcatgttacaggacata

SEQ ID NO: 9023722 - DNA, 22 bp, Homo sapiens
ctgcacacatatggcttctctc

SEQ ID NO: 9023723 - DNA, 22 bp, Homo sapiens
ctgcaaaattgttctttgctcc

SEQ ID NO: 9023724 - DNA, 22 bp, Homo sapiens
ctgcaaataggaaaagggcata

SEQ ID NO: 9023725 - DNA, 22 bp, Homo sapiens
ctgcacagagcagggcagacac

SEQ ID NO: 9023726 - DNA, 22 bp, Homo sapiens
ctgcacacatcgcactgcccgt

SEQ ID NO: 9023727 - DNA, 22 bp, Homo sapiens
ctgcacacatcgcactgcccgt

SEQ ID NO: 9023728 - DNA, 22 bp, Homo sapiens
ctgcacagagcagggcagacac

SEQ ID NO: 9023729 - DNA, 22 bp, Homo sapiens
ctgcacagcatgctctgattta

SEQ ID NO: 9023730 - DNA, 22 bp, Homo sapiens
ctgcacagagcagggcagacac

SEQ ID NO: 9023731 - DNA, 22 bp, Homo sapiens
ctgcaaaagtcattgtggtttt

SEQ ID NO: 9023732 - DNA, 22 bp, Homo sapiens
ctgaggccgtctgggtctgcag

SEQ ID NO: 9023733 - DNA, 20 bp, Homo sapiens
ctgcaaaatgacattaggaa

SEQ ID NO: 9023734 - DNA, 22 bp, Homo sapiens
ctgaggccggagcactgaagag

SEQ ID NO: 9023735 - DNA, 22 bp, Homo sapiens
ctgcaaagctgttcacaaattt

SEQ ID NO: 9023736 - DNA, 22 bp, Homo sapiens
ctgcaaagctgttcacaaattt

SEQ ID NO: 9023737 - DNA, 22 bp, Homo sapiens
ctgcaaaattgttctttgctcc

SEQ ID NO: 9023738 - DNA, 22 bp, Homo sapiens
ctgcaaaattgttctttgctcc

SEQ ID NO: 9023739 - DNA, 21 bp, Homo sapiens
ctgcaaatacctagttatctg

SEQ ID NO: 9023740 - DNA, 21 bp, Homo sapiens
ctgcaaatacctagttatctg

SEQ ID NO: 9023741 - DNA, 21 bp, Homo sapiens
ctgcaaatacctagttatctg

SEQ ID NO: 9023742 - DNA, 22 bp, Homo sapiens
ctgcaaaggtgggggaggagct

SEQ ID NO: 9023743 - DNA, 22 bp, Homo sapiens
ctgcaaaggtgggggaggagct

SEQ ID NO: 9023744 - DNA, 22 bp, Homo sapiens
ctgcaaataggaaaagggcata

SEQ ID NO: 9023745 - DNA, 22 bp, Homo sapiens
ctgcacagtaagcttcagagat

SEQ ID NO: 9023746 - DNA, 22 bp, Homo sapiens
ctgcacaggggatgagggcagt

SEQ ID NO: 9023747 - DNA, 22 bp, Homo sapiens
ctgcacaggggatgagggcagt

SEQ ID NO: 9023748 - DNA, 22 bp, Homo sapiens
ctgcacagccctcaagagcctg

SEQ ID NO: 9023749 - DNA, 22 bp, Homo sapiens
ctgcacagccctcaagagcctg

SEQ ID NO: 9023750 - DNA, 22 bp, Homo sapiens
ctgcacagctggccagggagag

SEQ ID NO: 9023751 - DNA, 22 bp, Homo sapiens
ctgcacagctgggcaagatata

SEQ ID NO: 9023752 - DNA, 22 bp, Homo sapiens
ctgcacagctgggcaagatata

SEQ ID NO: 9023753 - DNA, 22 bp, Homo sapiens
ctgcacagctgggcaagatata

SEQ ID NO: 9023754 - DNA, 22 bp, Homo sapiens
ctgcacagctggccagggagag

SEQ ID NO: 9023755 - DNA, 22 bp, Homo sapiens
ttttagttactgcagtagcaaa

SEQ ID NO: 9023756 - DNA, 22 bp, Homo sapiens
ttttagttactgcagtagcaaa

SEQ ID NO: 9023757 - DNA, 18 bp, Homo sapiens
ctctgtgttggtgtgaag

SEQ ID NO: 9023758 - DNA, 22 bp, Homo sapiens
ctcttagtttatctttgacaaa

SEQ ID NO: 9023759 - DNA, 22 bp, Homo sapiens
ctcttagtttgtaaaaataatt

SEQ ID NO: 9023760 - DNA, 22 bp, Homo sapiens
ctctgtttctcagcctatttcc

SEQ ID NO: 9023761 - DNA, 22 bp, Homo sapiens
ttttagtaccaaccagaagatg

SEQ ID NO: 9023762 - DNA, 23 bp, Homo sapiens
ttttagtgactcctttatctgcc

SEQ ID NO: 9023763 - DNA, 23 bp, Homo sapiens
ttttagtgactcctttatctgcc

SEQ ID NO: 9023764 - DNA, 22 bp, Homo sapiens
ttttagttactgcagtagcaaa

SEQ ID NO: 9023765 - DNA, 22 bp, Homo sapiens
ttttagttactgcagtagcaaa

SEQ ID NO: 9023766 - DNA, 22 bp, Homo sapiens
ttttagttactgcagtagcaaa

SEQ ID NO: 9023767 - DNA, 22 bp, Homo sapiens
ctcttcaaaagatgtattagaa

SEQ ID NO: 9023768 - DNA, 22 bp, Homo sapiens
ctcttattttatggcatttgtg

SEQ ID NO: 9023769 - DNA, 22 bp, Homo sapiens
ctcttattttatggcatttgtg

SEQ ID NO: 9023770 - DNA, 22 bp, Homo sapiens
ctcttattttatggcatttgtg

SEQ ID NO: 9023771 - DNA, 22 bp, Homo sapiens
ctcttcaaaagtctaatcctta

SEQ ID NO: 9023772 - DNA, 20 bp, Homo sapiens
ctcttcaaatattttattct

SEQ ID NO: 9023773 - DNA, 20 bp, Homo sapiens
ctcttcaaatattttattct

SEQ ID NO: 9023774 - DNA, 22 bp, Homo sapiens
ctcttattcctacagtaacagg

SEQ ID NO: 9023775 - DNA, 22 bp, Homo sapiens
ctcttattcctacagtaacagg

SEQ ID NO: 9023776 - DNA, 22 bp, Homo sapiens
ctcttattcctacagtaacagg

SEQ ID NO: 9023777 - DNA, 22 bp, Homo sapiens
ctcttattgatgaaggtgctaa

SEQ ID NO: 9023778 - DNA, 22 bp, Homo sapiens
ctcttattgatgaaggtgctaa

SEQ ID NO: 9023779 - DNA, 22 bp, Homo sapiens
ctcttattcctacagtaacagg

SEQ ID NO: 9023780 - DNA, 22 bp, Homo sapiens
ctcttattcctacagtaacagg

SEQ ID NO: 9023781 - DNA, 22 bp, Homo sapiens
ctcttatagacactcttctata

SEQ ID NO: 9023782 - DNA, 22 bp, Homo sapiens
ctcttagtttgtaaaaataatt

SEQ ID NO: 9023783 - DNA, 22 bp, Homo sapiens
ctcttatagacactcttctata

SEQ ID NO: 9023784 - DNA, 22 bp, Homo sapiens
ctcttccatattactcagggta

SEQ ID NO: 9023785 - DNA, 22 bp, Homo sapiens
ctcttccatttctacttcacag

SEQ ID NO: 9023786 - DNA, 22 bp, Homo sapiens
ctcttccatattactcagggta

SEQ ID NO: 9023787 - DNA, 22 bp, Homo sapiens
ctcttccacctccttcaggaga

SEQ ID NO: 9023788 - DNA, 22 bp, Homo sapiens
ctcttcattagttcctgtccca

SEQ ID NO: 9023789 - DNA, 22 bp, Homo sapiens
ctcttcattagttcctgtccca

SEQ ID NO: 9023790 - DNA, 22 bp, Homo sapiens
ctcttcatgtgtttaattttta

SEQ ID NO: 9023791 - DNA, 22 bp, Homo sapiens
ctcttcatgtgtttaattttta

SEQ ID NO: 9023792 - DNA, 22 bp, Homo sapiens
ctcttccacctccttcaggaga

SEQ ID NO: 9023793 - DNA, 22 bp, Homo sapiens
ctcttcatagcaaacatatggg

SEQ ID NO: 9023794 - DNA, 22 bp, Homo sapiens
ctcttcattagttcctgtccca

SEQ ID NO: 9023795 - DNA, 21 bp, Homo sapiens
ctcttcagtggtgagctcttc

SEQ ID NO: 9023796 - DNA, 21 bp, Homo sapiens
ctcttcagtggtgagctcttc

SEQ ID NO: 9023797 - DNA, 22 bp, Homo sapiens
ctcttcagttgttgcatattct

SEQ ID NO: 9023798 - DNA, 22 bp, Homo sapiens
ctcttcagttggtcactattct

SEQ ID NO: 9023799 - DNA, 22 bp, Homo sapiens
ctcttcaatagattgttgaggg

SEQ ID NO: 9023800 - DNA, 22 bp, Homo sapiens
ctcttcaactgccaggcagtct

SEQ ID NO: 9023801 - DNA, 22 bp, Homo sapiens
ctcttcaacagagcagaaggct

SEQ ID NO: 9023802 - DNA, 22 bp, Homo sapiens
ctcttcaaatgatttccttagg

SEQ ID NO: 9023803 - DNA, 22 bp, Homo sapiens
ctcttcactgagataatcctag

SEQ ID NO: 9023804 - DNA, 22 bp, Homo sapiens
ctcttcactgagataatcctag

SEQ ID NO: 9023805 - DNA, 22 bp, Homo sapiens
ctcttcagatatacagtactct

SEQ ID NO: 9023806 - DNA, 22 bp, Homo sapiens
ctcttcagatatacagtactct

SEQ ID NO: 9023807 - DNA, 22 bp, Homo sapiens
ctcttcaggaatatgtcagtca

SEQ ID NO: 9023808 - DNA, 22 bp, Homo sapiens
ctcttcaggaatatgtcagtca

SEQ ID NO: 9023809 - DNA, 22 bp, Homo sapiens
ctcttcaggatggcttgtgatg

SEQ ID NO: 9023810 - DNA, 22 bp, Homo sapiens
ctcttcaggtttctgctctgga

SEQ ID NO: 9023811 - DNA, 22 bp, Homo sapiens
ctcttcaggtttctgctctgga

SEQ ID NO: 9023812 - DNA, 22 bp, Homo sapiens
ctcttcagtaaatgacactgtt

SEQ ID NO: 9023813 - DNA, 22 bp, Homo sapiens
ctcttcagtaaatgacactgtt

SEQ ID NO: 9023814 - DNA, 22 bp, Homo sapiens
ttttcagtgggcaatgatgtga

SEQ ID NO: 9023815 - DNA, 22 bp, Homo sapiens
ttttcagtggtatctttgtaaa

SEQ ID NO: 9023816 - DNA, 22 bp, Homo sapiens
ttttcagtggcttgcatatgtt

SEQ ID NO: 9023817 - DNA, 22 bp, Homo sapiens
ttttcagtaatgtctacataat

SEQ ID NO: 9023818 - DNA, 22 bp, Homo sapiens
ttttcagtaatgtctacataat

SEQ ID NO: 9023819 - DNA, 22 bp, Homo sapiens
ttttcagtaatgtctacataat

SEQ ID NO: 9023820 - DNA, 22 bp, Homo sapiens
ttttcagtaatgtctacataat

SEQ ID NO: 9023821 - DNA, 22 bp, Homo sapiens
ttttcagctaagtcacacgctg

SEQ ID NO: 9023822 - DNA, 22 bp, Homo sapiens
ttttcagaggcctaagaggttt

SEQ ID NO: 9023823 - DNA, 22 bp, Homo sapiens
ttttcagaggcctaagaggttt

SEQ ID NO: 9023824 - DNA, 22 bp, Homo sapiens
ttttcaggtacatcacatactg

SEQ ID NO: 9023825 - DNA, 22 bp, Homo sapiens
ttttcaggccagaagatagacc

SEQ ID NO: 9023826 - DNA, 22 bp, Homo sapiens
ttttcaggccagaagatagacc

SEQ ID NO: 9023827 - DNA, 22 bp, Homo sapiens
ttttcaggctgatttgtgttag

SEQ ID NO: 9023828 - DNA, 22 bp, Homo sapiens
ttttcagaaagatgagaaatta

SEQ ID NO: 9023829 - DNA, 22 bp, Homo sapiens
ttttcacttaaggaatttcatg

SEQ ID NO: 9023830 - DNA, 22 bp, Homo sapiens
ttttcacttaaggaatttcatg

SEQ ID NO: 9023831 - DNA, 22 bp, Homo sapiens
ttttcagaaagatgagaaatta

SEQ ID NO: 9023832 - DNA, 22 bp, Homo sapiens
ttttcagagagcttttatgtcc

SEQ ID NO: 9023833 - DNA, 22 bp, Homo sapiens
ttttcacttaaggaatttcatg

SEQ ID NO: 9023834 - DNA, 22 bp, Homo sapiens
ttttcacttaaggaatttcatg

SEQ ID NO: 9023835 - DNA, 22 bp, Homo sapiens
ttttcacttaaggaatttcatg

SEQ ID NO: 9023836 - DNA, 22 bp, Homo sapiens
ttttcacttaaggaatttcatg

SEQ ID NO: 9023837 - DNA, 22 bp, Homo sapiens
ttttcacattgtcccagcacta

SEQ ID NO: 9023838 - DNA, 22 bp, Homo sapiens
ctcttccatttctacttcacag

SEQ ID NO: 9023839 - DNA, 22 bp, Homo sapiens
ttttcaccatagacactggtcc

SEQ ID NO: 9023840 - DNA, 22 bp, Homo sapiens
ttttcaccagcttgctacaatt

SEQ ID NO: 9023841 - DNA, 22 bp, Homo sapiens
ctcttcttgctagactgagtgc

SEQ ID NO: 9023842 - DNA, 22 bp, Homo sapiens
ctcttcttggaatgctgactgt

SEQ ID NO: 9023843 - DNA, 22 bp, Homo sapiens
ctcttcttggaatgctgactgt

SEQ ID NO: 9023844 - DNA, 22 bp, Homo sapiens
ctcttcttgcctgatgaggcag

SEQ ID NO: 9023845 - DNA, 22 bp, Homo sapiens
ttttcagtggtatctttgtaaa

SEQ ID NO: 9023846 - DNA, 22 bp, Homo sapiens
ttttcagttactgtttatgtga

SEQ ID NO: 9023847 - DNA, 22 bp, Homo sapiens
ttttcagttactgtttatgtga

SEQ ID NO: 9023848 - DNA, 22 bp, Homo sapiens
ttttcagttactgtttatgtga

SEQ ID NO: 9023849 - DNA, 22 bp, Homo sapiens
ttttcagttatagaatggtaga

SEQ ID NO: 9023850 - DNA, 22 bp, Homo sapiens
ttttcagttactgtttatgtga

SEQ ID NO: 9023851 - DNA, 22 bp, Homo sapiens
ctctttactgctactacaaaga

SEQ ID NO: 9023852 - DNA, 22 bp, Homo sapiens
ctctttactgctactacaaaga

SEQ ID NO: 9023853 - DNA, 22 bp, Homo sapiens
ctctttagtctgtgtggagaag

SEQ ID NO: 9023854 - DNA, 22 bp, Homo sapiens
ctctttagtcacagggcttcat

SEQ ID NO: 9023855 - DNA, 22 bp, Homo sapiens
ctctttaagctcctaacagcca

SEQ ID NO: 9023856 - DNA, 22 bp, Homo sapiens
ctctttaagctcctaacagcca

SEQ ID NO: 9023857 - DNA, 22 bp, Homo sapiens
ctcttcttggcccccatgaggg

SEQ ID NO: 9023858 - DNA, 22 bp, Homo sapiens
tttgtacagtgaaagcgaggtt

SEQ ID NO: 9023859 - DNA, 22 bp, Homo sapiens
tttgtacaggtgcaggcatttg

SEQ ID NO: 9023860 - DNA, 22 bp, Homo sapiens
tttgtacactgtctactatgaa

SEQ ID NO: 9023861 - DNA, 22 bp, Homo sapiens
tttgtacactgtctactatgaa

SEQ ID NO: 9023862 - DNA, 22 bp, Homo sapiens
tttgtacagtgatgttgtatgc

SEQ ID NO: 9023863 - DNA, 22 bp, Homo sapiens
tttgtacagtgatgttgtatgc

SEQ ID NO: 9023864 - DNA, 22 bp, Homo sapiens
tttgtacagtgatgttgtatgc

SEQ ID NO: 9023865 - DNA, 22 bp, Homo sapiens
tttgtacacctacctaatacag

SEQ ID NO: 9023866 - DNA, 22 bp, Homo sapiens
tttgtacactgtctactatgaa

SEQ ID NO: 9023867 - DNA, 22 bp, Homo sapiens
tttgtacactgtctactatgaa

SEQ ID NO: 9023868 - DNA, 22 bp, Homo sapiens
tttgtacactgtctactatgaa

SEQ ID NO: 9023869 - DNA, 22 bp, Homo sapiens
tttgtacactgtctactatgaa

SEQ ID NO: 9023870 - DNA, 22 bp, Homo sapiens
tttgtacactgtctactatgaa

SEQ ID NO: 9023871 - DNA, 22 bp, Homo sapiens
tttgtacactgtctactatgaa

SEQ ID NO: 9023872 - DNA, 22 bp, Homo sapiens
tttgtacactgtctactatgaa

SEQ ID NO: 9023873 - DNA, 22 bp, Homo sapiens
tttgtacactgtctactatgaa

SEQ ID NO: 9023874 - DNA, 22 bp, Homo sapiens
tttgtacactgtctactatgaa

SEQ ID NO: 9023875 - DNA, 22 bp, Homo sapiens
tttgtacacaggatgttataat

SEQ ID NO: 9023876 - DNA, 22 bp, Homo sapiens
tttgtacacaggtcattcaggg

SEQ ID NO: 9023877 - DNA, 22 bp, Homo sapiens
tttgtacactgtctactatgaa

SEQ ID NO: 9023878 - DNA, 22 bp, Homo sapiens
tttgtacacctacctaatacag

SEQ ID NO: 9023879 - DNA, 22 bp, Homo sapiens
tttgtacacctacctaatacag

SEQ ID NO: 9023880 - DNA, 22 bp, Homo sapiens
tttgtacacctacctaatacag

SEQ ID NO: 9023881 - DNA, 22 bp, Homo sapiens
tttgggcagaagctgaatgtct

SEQ ID NO: 9023882 - DNA, 22 bp, Homo sapiens
tttgtacacaggatgttataat

SEQ ID NO: 9023883 - DNA, 22 bp, Homo sapiens
tttgggcagaaacatgcgcccc

SEQ ID NO: 9023884 - DNA, 22 bp, Homo sapiens
tttgtacacaggatgttataat

SEQ ID NO: 9023885 - DNA, 22 bp, Homo sapiens
tttgtacacaggatgttataat

SEQ ID NO: 9023886 - DNA, 22 bp, Homo sapiens
tttgtacacaggatgttataat

SEQ ID NO: 9023887 - DNA, 22 bp, Homo sapiens
tttgggcaattcagtgggacct

SEQ ID NO: 9023888 - DNA, 22 bp, Homo sapiens
tttgggcacacaaatattttat

SEQ ID NO: 9023889 - DNA, 22 bp, Homo sapiens
tttgggcacagatattaagtat

SEQ ID NO: 9023890 - DNA, 20 bp, Homo sapiens
tttgggcacggctagatttt

SEQ ID NO: 9023891 - DNA, 22 bp, Homo sapiens
tttgttctgaaaactcaagtcc

SEQ ID NO: 9023892 - DNA, 22 bp, Homo sapiens
tttgttctattttagagatgaa

SEQ ID NO: 9023893 - DNA, 22 bp, Homo sapiens
tttgtacatatataaaatctgt

SEQ ID NO: 9023894 - DNA, 22 bp, Homo sapiens
tttgtacatatataaaatctgt

SEQ ID NO: 9023895 - DNA, 22 bp, Homo sapiens
tttgtacatcctaattctgagt

SEQ ID NO: 9023896 - DNA, 22 bp, Homo sapiens
tttgtacatatataaaatctgt

SEQ ID NO: 9023897 - DNA, 22 bp, Homo sapiens
tttgtacatatataaaatctgt

SEQ ID NO: 9023898 - DNA, 22 bp, Homo sapiens
tttgtacatatataaaatctgt

SEQ ID NO: 9023899 - DNA, 22 bp, Homo sapiens
tttgtacatataaatcttgtat

SEQ ID NO: 9023900 - DNA, 22 bp, Homo sapiens
tttgtacatataaatcttgtat

SEQ ID NO: 9023901 - DNA, 22 bp, Homo sapiens
tttgtacatataaatcttgtat

SEQ ID NO: 9023902 - DNA, 22 bp, Homo sapiens
tttgtacatataaatcttgtat

SEQ ID NO: 9023903 - DNA, 22 bp, Homo sapiens
ttttaagaggaggctgtttgaa

SEQ ID NO: 9023904 - DNA, 22 bp, Homo sapiens
ttttaagaactgttctgtgctt

SEQ ID NO: 9023905 - DNA, 22 bp, Homo sapiens
ttttaagaactgttctgtgctt

SEQ ID NO: 9023906 - DNA, 22 bp, Homo sapiens
ttttaagaactgttctgtgctt

SEQ ID NO: 9023907 - DNA, 22 bp, Homo sapiens
ttttaagaaatgtatgactgtc

SEQ ID NO: 9023908 - DNA, 22 bp, Homo sapiens
tttgttctgaaaatcttccctt

SEQ ID NO: 9023909 - DNA, 22 bp, Homo sapiens
tttgttctgaaaatcttccctt

SEQ ID NO: 9023910 - DNA, 22 bp, Homo sapiens
tttgttctgaaaactcaagtcc

SEQ ID NO: 9023911 - DNA, 22 bp, Homo sapiens
tttgttctgaaaactcaagtcc

SEQ ID NO: 9023912 - DNA, 22 bp, Homo sapiens
ttttaatactgctattgtagga

SEQ ID NO: 9023913 - DNA, 22 bp, Homo sapiens
ttttaatactgctattgtagga

SEQ ID NO: 9023914 - DNA, 22 bp, Homo sapiens
ttttaatactgctattgtagga

SEQ ID NO: 9023915 - DNA, 22 bp, Homo sapiens
ttttaagttggattgctaagta

SEQ ID NO: 9023916 - DNA, 22 bp, Homo sapiens
ttttaagttggattgctaagta

SEQ ID NO: 9023917 - DNA, 22 bp, Homo sapiens
ttttaatactgctattgtagga

SEQ ID NO: 9023918 - DNA, 22 bp, Homo sapiens
ttttaatactgctattgtagga

SEQ ID NO: 9023919 - DNA, 22 bp, Homo sapiens
ttttaagtgcaatctgaatgcg

SEQ ID NO: 9023920 - DNA, 19 bp, Homo sapiens
ttttaagtgccctttcttc

SEQ ID NO: 9023921 - DNA, 19 bp, Homo sapiens
ttttaagtgccctttcttc

SEQ ID NO: 9023922 - DNA, 22 bp, Homo sapiens
ttttaagttaatataattgagg

SEQ ID NO: 9023923 - DNA, 22 bp, Homo sapiens
ttttaagttaatataattgagg

SEQ ID NO: 9023924 - DNA, 22 bp, Homo sapiens
ttttaagttaatataattgagg

SEQ ID NO: 9023925 - DNA, 22 bp, Homo sapiens
ttttaagttaatataattgagg

SEQ ID NO: 9023926 - DNA, 22 bp, Homo sapiens
ttttaagttaatataattgagg

SEQ ID NO: 9023927 - DNA, 22 bp, Homo sapiens
ttttaagatgctagtatttcag

SEQ ID NO: 9023928 - DNA, 22 bp, Homo sapiens
ttttaagatgctagtatttcag

SEQ ID NO: 9023929 - DNA, 19 bp, Homo sapiens
ttttaagtcctctctattc

SEQ ID NO: 9023930 - DNA, 22 bp, Homo sapiens
ttttagattataagtctaattc

SEQ ID NO: 9023931 - DNA, 22 bp, Homo sapiens
ttttagattgggaaatgtaaag

SEQ ID NO: 9023932 - DNA, 22 bp, Homo sapiens
ttttagattataagtctaattc

SEQ ID NO: 9023933 - DNA, 22 bp, Homo sapiens
ttttagatagtttaactgcact

SEQ ID NO: 9023934 - DNA, 22 bp, Homo sapiens
ttttagattataagtctaattc

SEQ ID NO: 9023935 - DNA, 22 bp, Homo sapiens
ttttagaatcaggttgtctggg

SEQ ID NO: 9023936 - DNA, 22 bp, Homo sapiens
ttttagaatcaggttgtctggg

SEQ ID NO: 9023937 - DNA, 22 bp, Homo sapiens
ttttaatactgctattgtagga

SEQ ID NO: 9023938 - DNA, 22 bp, Homo sapiens
ttttagaatcaggttgtctggg

SEQ ID NO: 9023939 - DNA, 22 bp, Homo sapiens
ttttagattgggaaatgtaaag

SEQ ID NO: 9023940 - DNA, 22 bp, Homo sapiens
ttttagattgggaaatgtaaag

SEQ ID NO: 9023941 - DNA, 22 bp, Homo sapiens
ttttagattataagtctaattc

SEQ ID NO: 9023942 - DNA, 22 bp, Homo sapiens
ttttagcacactttctttagcg

SEQ ID NO: 9023943 - DNA, 22 bp, Homo sapiens
ttttagcactaagtgatatgct

SEQ ID NO: 9023944 - DNA, 22 bp, Homo sapiens
ttttagcactaagtgatatgct

SEQ ID NO: 9023945 - DNA, 22 bp, Homo sapiens
ttttagcactaagtgatatgct

SEQ ID NO: 9023946 - DNA, 20 bp, Homo sapiens
ttttagcacttgttatggtg

SEQ ID NO: 9023947 - DNA, 22 bp, Homo sapiens
ttttagctgttgattgttcccc

SEQ ID NO: 9023948 - DNA, 20 bp, Homo sapiens
ttttagcagaaagaaagctc

SEQ ID NO: 9023949 - DNA, 22 bp, Homo sapiens
ctctgcttttatgtgccggcgc

SEQ ID NO: 9023950 - DNA, 22 bp, Homo sapiens
ctctgcttttatgtgccggcgc

SEQ ID NO: 9023951 - DNA, 22 bp, Homo sapiens
ctctggaaaaccactagcagga

SEQ ID NO: 9023952 - DNA, 22 bp, Homo sapiens
ctctggaaaaccactagcagga

SEQ ID NO: 9023953 - DNA, 22 bp, Homo sapiens
ctctggaagaatacacttagaa

SEQ ID NO: 9023954 - DNA, 22 bp, Homo sapiens
tttgctctgacagtgccagaga

SEQ ID NO: 9023955 - DNA, 22 bp, Homo sapiens
tttgctctgacagtgccagaga

SEQ ID NO: 9023956 - DNA, 22 bp, Homo sapiens
tttgctcttatgaacaaggtgg

SEQ ID NO: 9023957 - DNA, 22 bp, Homo sapiens
tttgctctgacagtgccagaga

SEQ ID NO: 9023958 - DNA, 22 bp, Homo sapiens
ctctgctttctcaaaccctgtg

SEQ ID NO: 9023959 - DNA, 20 bp, Homo sapiens
ctctgctttaggagagtcag

SEQ ID NO: 9023960 - DNA, 20 bp, Homo sapiens
tttgctatgcatatctgacc

SEQ ID NO: 9023961 - DNA, 22 bp, Homo sapiens
tttgctattgtgaatagtgcca

SEQ ID NO: 9023962 - DNA, 20 bp, Homo sapiens
tttgctatgcatatctgacc

SEQ ID NO: 9023963 - DNA, 20 bp, Homo sapiens
tttgctatgcatatctgacc

SEQ ID NO: 9023964 - DNA, 22 bp, Homo sapiens
tttgctataaaagggtcacacg

SEQ ID NO: 9023965 - DNA, 22 bp, Homo sapiens
tttgctaatgcctctgaaatca

SEQ ID NO: 9023966 - DNA, 22 bp, Homo sapiens
tttgctagtacacagctgtttc

SEQ ID NO: 9023967 - DNA, 22 bp, Homo sapiens
tttgctaaataagtgattaagt

SEQ ID NO: 9023968 - DNA, 22 bp, Homo sapiens
tttgctaaaagtgatgaagaca

SEQ ID NO: 9023969 - DNA, 22 bp, Homo sapiens
tttgctaaaatgtattgggatt

SEQ ID NO: 9023970 - DNA, 22 bp, Homo sapiens
tttgctaaaaggccattgattt

SEQ ID NO: 9023971 - DNA, 20 bp, Homo sapiens
tttgcgaggccaaggcgggc

SEQ ID NO: 9023972 - DNA, 19 bp, Homo sapiens
tttgccttgcagctgtgtg

SEQ ID NO: 9023973 - DNA, 20 bp, Homo sapiens
tttgcgaggccaaggcgggc

SEQ ID NO: 9023974 - DNA, 21 bp, Homo sapiens
tttgccttcacgaagcatcct

SEQ ID NO: 9023975 - DNA, 21 bp, Homo sapiens
tttgccttcacgaagcatcct

SEQ ID NO: 9023976 - DNA, 22 bp, Homo sapiens
tttgccttctctgaacctattt

SEQ ID NO: 9023977 - DNA, 22 bp, Homo sapiens
tttgccttctctgaacctattt

SEQ ID NO: 9023978 - DNA, 22 bp, Homo sapiens
tttgcctgggaattctagtgta

SEQ ID NO: 9023979 - DNA, 21 bp, Homo sapiens
tttgccttcacgaagcatcct

SEQ ID NO: 9023980 - DNA, 22 bp, Homo sapiens
tttgcctgggaattctagtgta

SEQ ID NO: 9023981 - DNA, 22 bp, Homo sapiens
tttgcctgattctaagagctca

SEQ ID NO: 9023982 - DNA, 22 bp, Homo sapiens
tttgcctctcagagtctacaca

SEQ ID NO: 9023983 - DNA, 20 bp, Homo sapiens
tttgcccttcctctgccttt

SEQ ID NO: 9023984 - DNA, 22 bp, Homo sapiens
tttgccaggcttgcatgaattt

SEQ ID NO: 9023985 - DNA, 22 bp, Homo sapiens
ctctggaatgggtgtttctaac

SEQ ID NO: 9023986 - DNA, 22 bp, Homo sapiens
ctctggaatgtttacatgccct

SEQ ID NO: 9023987 - DNA, 22 bp, Homo sapiens
ctctggaattaaggaagcctgt

SEQ ID NO: 9023988 - DNA, 22 bp, Homo sapiens
tttgggaaataaacctagagga

SEQ ID NO: 9023989 - DNA, 22 bp, Homo sapiens
tttgggaaatagtagaaaatgt

SEQ ID NO: 9023990 - DNA, 22 bp, Homo sapiens
tttgggaacaatgaggatctga

SEQ ID NO: 9023991 - DNA, 20 bp, Homo sapiens
tttgggaaatgcaggtttca

SEQ ID NO: 9023992 - DNA, 22 bp, Homo sapiens
tttggaattggcattctattct

SEQ ID NO: 9023993 - DNA, 22 bp, Homo sapiens
tttggacaaacagaatagagct

SEQ ID NO: 9023994 - DNA, 17 bp, Homo sapiens
tttggaatttaaaggca

SEQ ID NO: 9023995 - DNA, 22 bp, Homo sapiens
tttggaattggcattctattct

SEQ ID NO: 9023996 - DNA, 22 bp, Homo sapiens
ctctggaagatgacctgggtaa

SEQ ID NO: 9023997 - DNA, 22 bp, Homo sapiens
ctctggaattaaggaagcctgt

SEQ ID NO: 9023998 - DNA, 22 bp, Homo sapiens
tttggaattggaaagtgctgtg

SEQ ID NO: 9023999 - DNA, 22 bp, Homo sapiens
tttgggactggagcttggagag

SEQ ID NO: 9024000 - DNA, 22 bp, Homo sapiens
tttgggaatagcagggactgag

SEQ ID NO: 9024001 - DNA, 22 bp, Homo sapiens
tttgggcaaaggtagaaggaga

SEQ ID NO: 9024002 - DNA, 21 bp, Homo sapiens
tttgggcaaaattaaatgaga

SEQ ID NO: 9024003 - DNA, 22 bp, Homo sapiens
tttgggcaagctcactgattca

SEQ ID NO: 9024004 - DNA, 22 bp, Homo sapiens
tttgggcaaggtccagattcct

SEQ ID NO: 9024005 - DNA, 22 bp, Homo sapiens
tttgggcaattcagtgggacct

SEQ ID NO: 9024006 - DNA, 22 bp, Homo sapiens
tttgggcaattcagtgggacct

SEQ ID NO: 9024007 - DNA, 22 bp, Homo sapiens
tttgggaacttggttcagggaa

SEQ ID NO: 9024008 - DNA, 22 bp, Homo sapiens
tttgggaaccagaagttcaaaa

SEQ ID NO: 9024009 - DNA, 22 bp, Homo sapiens
tttgggaactggacttcctgct

SEQ ID NO: 9024010 - DNA, 22 bp, Homo sapiens
tttgggaaggcagacatcccac

SEQ ID NO: 9024011 - DNA, 22 bp, Homo sapiens
tttgggaagtgggagcaaggtg

SEQ ID NO: 9024012 - DNA, 19 bp, Homo sapiens
tttgggaagcccagagtgt

SEQ ID NO: 9024013 - DNA, 22 bp, Homo sapiens
tttgggaagaggaatctctgga

SEQ ID NO: 9024014 - DNA, 22 bp, Homo sapiens
tttgggaagaggaatctctgga

SEQ ID NO: 9024015 - DNA, 19 bp, Homo sapiens
tttgggaagcccagagtgt

SEQ ID NO: 9024016 - DNA, 22 bp, Homo sapiens
tttgggaaggcagacatcccac

SEQ ID NO: 9024017 - DNA, 22 bp, Homo sapiens
ctctgcccagtgcccacaggag

SEQ ID NO: 9024018 - DNA, 20 bp, Homo sapiens
ctctgcccccagactgacag

SEQ ID NO: 9024019 - DNA, 22 bp, Homo sapiens
ctctgcccccagctggtgcttg

SEQ ID NO: 9024020 - DNA, 22 bp, Homo sapiens
ctctgcccgcggatgccacgtc

SEQ ID NO: 9024021 - DNA, 22 bp, Homo sapiens
ctctgcccgtgcctttcccagt

SEQ ID NO: 9024022 - DNA, 22 bp, Homo sapiens
ctctgcccgtgcctttcccagt

SEQ ID NO: 9024023 - DNA, 22 bp, Homo sapiens
ctctgcccgcggatgccacgtc

SEQ ID NO: 9024024 - DNA, 22 bp, Homo sapiens
ctctgcccgcggatgccacgtc

SEQ ID NO: 9024025 - DNA, 22 bp, Homo sapiens
ctctgcccgcggatgccacgtc

SEQ ID NO: 9024026 - DNA, 22 bp, Homo sapiens
ctctgcccgcggatgccacgtc

SEQ ID NO: 9024027 - DNA, 22 bp, Homo sapiens
ctctgcccgcggatgccacgtc

SEQ ID NO: 9024028 - DNA, 19 bp, Homo sapiens
ctctgcctccctcctgggt

SEQ ID NO: 9024029 - DNA, 19 bp, Homo sapiens
ctctgcctccctcctgggt

SEQ ID NO: 9024030 - DNA, 19 bp, Homo sapiens
ctctgcctccctcctgggt

SEQ ID NO: 9024031 - DNA, 19 bp, Homo sapiens
ctctgcctccctcctgggt

SEQ ID NO: 9024032 - DNA, 22 bp, Homo sapiens
ctctgccctcgcacatctgcca

SEQ ID NO: 9024033 - DNA, 22 bp, Homo sapiens
ctctgccctcgcacatctgcca

SEQ ID NO: 9024034 - DNA, 22 bp, Homo sapiens
ctctgccctcgcacatctgcca

SEQ ID NO: 9024035 - DNA, 22 bp, Homo sapiens
ctctgcctcagtgatttcttta

SEQ ID NO: 9024036 - DNA, 22 bp, Homo sapiens
tttgcattttagatttaggcct

SEQ ID NO: 9024037 - DNA, 22 bp, Homo sapiens
tttgcattttgataagatcact

SEQ ID NO: 9024038 - DNA, 22 bp, Homo sapiens
tttgcattttgataagatcact

SEQ ID NO: 9024039 - DNA, 22 bp, Homo sapiens
tttgcattttgataagatcact

SEQ ID NO: 9024040 - DNA, 22 bp, Homo sapiens
tttgcaaagttatttagactca

SEQ ID NO: 9024041 - DNA, 22 bp, Homo sapiens
tttgcaaagttatttagactca

SEQ ID NO: 9024042 - DNA, 22 bp, Homo sapiens
tttgcaaagtgcttgcagagta

SEQ ID NO: 9024043 - DNA, 22 bp, Homo sapiens
tttgcaaagttatttagactca

SEQ ID NO: 9024044 - DNA, 22 bp, Homo sapiens
ctctgccagccaaagtcatcac

SEQ ID NO: 9024045 - DNA, 22 bp, Homo sapiens
ctctgccagccaaaatttatga

SEQ ID NO: 9024046 - DNA, 22 bp, Homo sapiens
ctctgccagccaaaatttatga

SEQ ID NO: 9024047 - DNA, 22 bp, Homo sapiens
ctctgccagccaaaatttatga

SEQ ID NO: 9024048 - DNA, 22 bp, Homo sapiens
ctctgccactcgaagtcaagga

SEQ ID NO: 9024049 - DNA, 22 bp, Homo sapiens
ctctgccactcgaagtcaagga

SEQ ID NO: 9024050 - DNA, 22 bp, Homo sapiens
ctctgccagtttctggcctcag

SEQ ID NO: 9024051 - DNA, 22 bp, Homo sapiens
ctctgccagtttctggcctcag

SEQ ID NO: 9024052 - DNA, 22 bp, Homo sapiens
ctctgccaggcagaacggcttt

SEQ ID NO: 9024053 - DNA, 22 bp, Homo sapiens
ctctgccaggcagaacggcttt

SEQ ID NO: 9024054 - DNA, 22 bp, Homo sapiens
ctctgccagccaaagtcatcac

SEQ ID NO: 9024055 - DNA, 22 bp, Homo sapiens
ctctgccagccaaagtcatcac

SEQ ID NO: 9024056 - DNA, 22 bp, Homo sapiens
ctctgccagccaaagtcatcac

SEQ ID NO: 9024057 - DNA, 22 bp, Homo sapiens
ctctgccatctcactgggtcct

SEQ ID NO: 9024058 - DNA, 22 bp, Homo sapiens
ctctgccatctcactgggtcct

SEQ ID NO: 9024059 - DNA, 22 bp, Homo sapiens
ctctgccatcttggagctcaag

SEQ ID NO: 9024060 - DNA, 22 bp, Homo sapiens
ctctgccagtttctggcctcag

SEQ ID NO: 9024061 - DNA, 22 bp, Homo sapiens
ctctgccatcagtttttctttg

SEQ ID NO: 9024062 - DNA, 22 bp, Homo sapiens
ctctgccatcagtttttctttg

SEQ ID NO: 9024063 - DNA, 22 bp, Homo sapiens
ctctgccagtttctggcctcag

SEQ ID NO: 9024064 - DNA, 21 bp, Homo sapiens
ctctgcccagggcctcctgcc

SEQ ID NO: 9024065 - DNA, 21 bp, Homo sapiens
ctctgcccagggcctcctgcc

SEQ ID NO: 9024066 - DNA, 21 bp, Homo sapiens
ctctgcccagggcctcctgcc

SEQ ID NO: 9024067 - DNA, 21 bp, Homo sapiens
ctctgcccagggcctcctgcc

SEQ ID NO: 9024068 - DNA, 22 bp, Homo sapiens
ctctgcccacgtcttgcccaga

SEQ ID NO: 9024069 - DNA, 22 bp, Homo sapiens
ctctgcccacgtcttgcccaga

SEQ ID NO: 9024070 - DNA, 22 bp, Homo sapiens
ctctgccatttatcagaactgt

SEQ ID NO: 9024071 - DNA, 22 bp, Homo sapiens
ctctgccatttatcagaactgt

SEQ ID NO: 9024072 - DNA, 22 bp, Homo sapiens
ctctgccatcttggagctcaag

SEQ ID NO: 9024073 - DNA, 22 bp, Homo sapiens
ctctgccatcttggagctcaag

SEQ ID NO: 9024074 - DNA, 22 bp, Homo sapiens
ctctgccatttatcagaactgt

SEQ ID NO: 9024075 - DNA, 22 bp, Homo sapiens
ctctgccatttatcagaactgt

SEQ ID NO: 9024076 - DNA, 22 bp, Homo sapiens
ctctgcccacgtcttgcccaga

SEQ ID NO: 9024077 - DNA, 19 bp, Homo sapiens
ctctgccatttgctgcctg

SEQ ID NO: 9024078 - DNA, 22 bp, Homo sapiens
ctctgccactcgaagtcaagga

SEQ ID NO: 9024079 - DNA, 22 bp, Homo sapiens
ctctgccaccatgcttcctgac

SEQ ID NO: 9024080 - DNA, 22 bp, Homo sapiens
ctctgccaccatgcttcctgac

SEQ ID NO: 9024081 - DNA, 22 bp, Homo sapiens
ctctgccaccatgcttcctgac

SEQ ID NO: 9024082 - DNA, 22 bp, Homo sapiens
ctctgccaccatgcttcctgac

SEQ ID NO: 9024083 - DNA, 22 bp, Homo sapiens
ctctgccaagatgacaggtaag

SEQ ID NO: 9024084 - DNA, 22 bp, Homo sapiens
ctctgccaagatgacaggtaag

SEQ ID NO: 9024085 - DNA, 20 bp, Homo sapiens
ctctgcagcaaggcctgggt

SEQ ID NO: 9024086 - DNA, 22 bp, Homo sapiens
tttcctttccaaaattctgcct

SEQ ID NO: 9024087 - DNA, 22 bp, Homo sapiens
tttcctttccaaaattctgcct

SEQ ID NO: 9024088 - DNA, 22 bp, Homo sapiens
tttcctttccaaaattctgcct

SEQ ID NO: 9024089 - DNA, 20 bp, Homo sapiens
ctctgcagcaaggcctgggt

SEQ ID NO: 9024090 - DNA, 22 bp, Homo sapiens
ctctgcagaggcccaaggctga

SEQ ID NO: 9024091 - DNA, 22 bp, Homo sapiens
ctctgcagattcatcccttcac

SEQ ID NO: 9024092 - DNA, 22 bp, Homo sapiens
tttccttgttcatttgccctat

SEQ ID NO: 9024093 - DNA, 22 bp, Homo sapiens
tttccttgttattatttgtcct

SEQ ID NO: 9024094 - DNA, 22 bp, Homo sapiens
tttcctttatgacatcaccact

SEQ ID NO: 9024095 - DNA, 22 bp, Homo sapiens
tttccttgttattatttgtcct

SEQ ID NO: 9024096 - DNA, 22 bp, Homo sapiens
tttccttgttattatttgtcct

SEQ ID NO: 9024097 - DNA, 18 bp, Homo sapiens
tttccttgtatgaacata

SEQ ID NO: 9024098 - DNA, 20 bp, Homo sapiens
tttcctttcattttagtacc

SEQ ID NO: 9024099 - DNA, 20 bp, Homo sapiens
tttcctttcattttagtacc

SEQ ID NO: 9024100 - DNA, 22 bp, Homo sapiens
tttcctttatgacatcaccact

SEQ ID NO: 9024101 - DNA, 20 bp, Homo sapiens
tttcctttcattttagtacc

SEQ ID NO: 9024102 - DNA, 20 bp, Homo sapiens
tttcctttcattttagtacc

SEQ ID NO: 9024103 - DNA, 20 bp, Homo sapiens
tttcctttcattttagtacc

SEQ ID NO: 9024104 - DNA, 20 bp, Homo sapiens
tttcctttcattttagtacc

SEQ ID NO: 9024105 - DNA, 22 bp, Homo sapiens
tttcctttatgacatcaccact

SEQ ID NO: 9024106 - DNA, 22 bp, Homo sapiens
tttcctttatgacatcaccact

SEQ ID NO: 9024107 - DNA, 22 bp, Homo sapiens
tttcctttatgacatcaccact

SEQ ID NO: 9024108 - DNA, 22 bp, Homo sapiens
tttcctttatgacatcaccact

SEQ ID NO: 9024109 - DNA, 22 bp, Homo sapiens
tttcctttatgacatcaccact

SEQ ID NO: 9024110 - DNA, 20 bp, Homo sapiens
tttcctttcattttagtacc

SEQ ID NO: 9024111 - DNA, 22 bp, Homo sapiens
tgtgtattaatgtttgtatatg

SEQ ID NO: 9024112 - DNA, 22 bp, Homo sapiens
tgtgtattaatgtttgtatatg

SEQ ID NO: 9024113 - DNA, 22 bp, Homo sapiens
tgtgtctcaagtcagagcatca

SEQ ID NO: 9024114 - DNA, 22 bp, Homo sapiens
tgtgtattaatgtttgtatatg

SEQ ID NO: 9024115 - DNA, 22 bp, Homo sapiens
tgtgtatgtctgtatgcacaca

SEQ ID NO: 9024116 - DNA, 20 bp, Homo sapiens
tgtgtatgtgcacatgcgaa

SEQ ID NO: 9024117 - DNA, 20 bp, Homo sapiens
tgtgtatgtgcacatgcgaa

SEQ ID NO: 9024118 - DNA, 22 bp, Homo sapiens
tgtgtatgtgtatacactatat

SEQ ID NO: 9024119 - DNA, 22 bp, Homo sapiens
tgtgtatgtaagcatgtgcata

SEQ ID NO: 9024120 - DNA, 22 bp, Homo sapiens
tgtgtatgtaagcatgtgcata

SEQ ID NO: 9024121 - DNA, 23 bp, Homo sapiens
tgtgtatgtatctatgcataggt

SEQ ID NO: 9024122 - DNA, 23 bp, Homo sapiens
tgtgtatgtatctatgcataggt

SEQ ID NO: 9024123 - DNA, 22 bp, Homo sapiens
tgtgtatatgtaaatatagttg

SEQ ID NO: 9024124 - DNA, 22 bp, Homo sapiens
tgtgtatatgtaaatatagttg

SEQ ID NO: 9024125 - DNA, 22 bp, Homo sapiens
tgtgtatattaggacacattct

SEQ ID NO: 9024126 - DNA, 22 bp, Homo sapiens
tgtgtatgcatacacacataga

SEQ ID NO: 9024127 - DNA, 22 bp, Homo sapiens
tgtgtatgcatacacacataga

SEQ ID NO: 9024128 - DNA, 22 bp, Homo sapiens
tgtgtctgcactgagtcctcac

SEQ ID NO: 9024129 - DNA, 22 bp, Homo sapiens
tgtgtctgcactgagtcctcac

SEQ ID NO: 9024130 - DNA, 22 bp, Homo sapiens
tgtgtctgcccttagtacatct

SEQ ID NO: 9024131 - DNA, 23 bp, Homo sapiens
tgtgtctgaggatatatgtgcat

SEQ ID NO: 9024132 - DNA, 23 bp, Homo sapiens
tgtgtctgaggatatatgtgcat

SEQ ID NO: 9024133 - DNA, 23 bp, Homo sapiens
tgtgtctgaggatatatgtgcat

SEQ ID NO: 9024134 - DNA, 22 bp, Homo sapiens
tgtgtctgaactagttgctctc

SEQ ID NO: 9024135 - DNA, 22 bp, Homo sapiens
tgtgtctccatagccagctagc

SEQ ID NO: 9024136 - DNA, 22 bp, Homo sapiens
tgtgtctcctttccctgtctaa

SEQ ID NO: 9024137 - DNA, 22 bp, Homo sapiens
tgtgtctctcctggaagcacgt

SEQ ID NO: 9024138 - DNA, 22 bp, Homo sapiens
tgtgtctgaactagttgctctc

SEQ ID NO: 9024139 - DNA, 22 bp, Homo sapiens
tgtgtctgaacatgctttgtaa

SEQ ID NO: 9024140 - DNA, 22 bp, Homo sapiens
tgtgtctgaacatgctttgtaa

SEQ ID NO: 9024141 - DNA, 22 bp, Homo sapiens
tgtgtctctttgtcctagagct

SEQ ID NO: 9024142 - DNA, 22 bp, Homo sapiens
tgtgtctctttgtcctagagct

SEQ ID NO: 9024143 - DNA, 22 bp, Homo sapiens
cctgggcaacatagtgagaccc

SEQ ID NO: 9024144 - DNA, 22 bp, Homo sapiens
cctgggcaacatagtgagacct

SEQ ID NO: 9024145 - DNA, 22 bp, Homo sapiens
cctgggcaacatagtgagacct

SEQ ID NO: 9024146 - DNA, 22 bp, Homo sapiens
cctgggcaacatagtgagacct

SEQ ID NO: 9024147 - DNA, 22 bp, Homo sapiens
cctgggcaacatagtgagacct

SEQ ID NO: 9024148 - DNA, 22 bp, Homo sapiens
cctgggcaacatagtgagaccc

SEQ ID NO: 9024149 - DNA, 22 bp, Homo sapiens
cctgggcaacatagtgagaccc

SEQ ID NO: 9024150 - DNA, 22 bp, Homo sapiens
cctgggcaacatagtgagaccc

SEQ ID NO: 9024151 - DNA, 22 bp, Homo sapiens
cctgggcaacatagtgagaccc

SEQ ID NO: 9024152 - DNA, 22 bp, Homo sapiens
cctgggcaacatagggagaccc

SEQ ID NO: 9024153 - DNA, 22 bp, Homo sapiens
cctgggcaacatagggagaccc

SEQ ID NO: 9024154 - DNA, 22 bp, Homo sapiens
cctgggcaacatagggagaccc

SEQ ID NO: 9024155 - DNA, 22 bp, Homo sapiens
cctgggcaacatagggagaccc

SEQ ID NO: 9024156 - DNA, 22 bp, Homo sapiens
cctgggcaaatgccagagacaa

SEQ ID NO: 9024157 - DNA, 22 bp, Homo sapiens
cctgggcaaatgccagagacaa

SEQ ID NO: 9024158 - DNA, 22 bp, Homo sapiens
cctgggcaacatagggagaccc

SEQ ID NO: 9024159 - DNA, 22 bp, Homo sapiens
cctgggcaaattatgttactca

SEQ ID NO: 9024160 - DNA, 22 bp, Homo sapiens
cctgggcaacatagggagaccc

SEQ ID NO: 9024161 - DNA, 22 bp, Homo sapiens
cctgggagtgtgccatctctgt

SEQ ID NO: 9024162 - DNA, 22 bp, Homo sapiens
cctgggcaaatgccagagacaa

SEQ ID NO: 9024163 - DNA, 22 bp, Homo sapiens
cctgggcaaatgccagagacaa

SEQ ID NO: 9024164 - DNA, 22 bp, Homo sapiens
tgtgtatatatgtgcacatgta

SEQ ID NO: 9024165 - DNA, 22 bp, Homo sapiens
tgtgtataggttgtgctaatag

SEQ ID NO: 9024166 - DNA, 22 bp, Homo sapiens
tgtgtatagaaagtaggaaagg

SEQ ID NO: 9024167 - DNA, 22 bp, Homo sapiens
tgtgtatagatgcatgcatata

SEQ ID NO: 9024168 - DNA, 22 bp, Homo sapiens
tgtgtatagatgcatgcatata

SEQ ID NO: 9024169 - DNA, 22 bp, Homo sapiens
tgtgtataactcttaattcatt

SEQ ID NO: 9024170 - DNA, 22 bp, Homo sapiens
tgtgtataactcttaattcatt

SEQ ID NO: 9024171 - DNA, 22 bp, Homo sapiens
tgtgtataagtgagaatgctgt

SEQ ID NO: 9024172 - DNA, 22 bp, Homo sapiens
tgtgtataattagaccatttac

SEQ ID NO: 9024173 - DNA, 22 bp, Homo sapiens
tgtgtatacaacttataggagc

SEQ ID NO: 9024174 - DNA, 22 bp, Homo sapiens
tgtgtatacgagtatgaatatg

SEQ ID NO: 9024175 - DNA, 22 bp, Homo sapiens
tgtgtatacgagtatgaatatg

SEQ ID NO: 9024176 - DNA, 22 bp, Homo sapiens
tgtgtatacatacatacacacg

SEQ ID NO: 9024177 - DNA, 22 bp, Homo sapiens
tgtgtatacaacttataggagc

SEQ ID NO: 9024178 - DNA, 22 bp, Homo sapiens
tgtgtatacaacttataggagc

SEQ ID NO: 9024179 - DNA, 22 bp, Homo sapiens
tgtgggtgatgaatttgttctt

SEQ ID NO: 9024180 - DNA, 22 bp, Homo sapiens
tgtgtagctttcttctgtgggg

SEQ ID NO: 9024181 - DNA, 22 bp, Homo sapiens
tgtgtataaaagcagtgcagga

SEQ ID NO: 9024182 - DNA, 22 bp, Homo sapiens
tgtgtataaaagcagtgcagga

SEQ ID NO: 9024183 - DNA, 22 bp, Homo sapiens
tgtgtataaacaagagtctgtg

SEQ ID NO: 9024184 - DNA, 20 bp, Homo sapiens
tgtgtataaatatatgtttc

SEQ ID NO: 9024185 - DNA, 20 bp, Homo sapiens
tgtgtataaatatatgtttc

SEQ ID NO: 9024186 - DNA, 22 bp, Homo sapiens
cctgggcaatatagtgaggccc

SEQ ID NO: 9024187 - DNA, 22 bp, Homo sapiens
cctgggcaacatagtgagacct

SEQ ID NO: 9024188 - DNA, 22 bp, Homo sapiens
tgtgggtcctcctgtgtgcccg

SEQ ID NO: 9024189 - DNA, 22 bp, Homo sapiens
tgtgggtcttccaaagaagggc

SEQ ID NO: 9024190 - DNA, 22 bp, Homo sapiens
tgtgggtgatgaatttgttctt

SEQ ID NO: 9024191 - DNA, 22 bp, Homo sapiens
tggggcagccacatagacaaca

SEQ ID NO: 9024192 - DNA, 22 bp, Homo sapiens
tggggcagccacatagacaaca

SEQ ID NO: 9024193 - DNA, 22 bp, Homo sapiens
tggggcagccacatagacaaca

SEQ ID NO: 9024194 - DNA, 22 bp, Homo sapiens
tggggcagggatgggaaactat

SEQ ID NO: 9024195 - DNA, 22 bp, Homo sapiens
tggggcagggatgggaaactat

SEQ ID NO: 9024196 - DNA, 22 bp, Homo sapiens
tggggcagggatgggaaactat

SEQ ID NO: 9024197 - DNA, 22 bp, Homo sapiens
tggggcagctccatctattcca

SEQ ID NO: 9024198 - DNA, 22 bp, Homo sapiens
tggggcagggatgggaaactat

SEQ ID NO: 9024199 - DNA, 22 bp, Homo sapiens
tggggcagtggcttttcaccct

SEQ ID NO: 9024200 - DNA, 22 bp, Homo sapiens
tggggcagtggcttttcaccct

SEQ ID NO: 9024201 - DNA, 22 bp, Homo sapiens
tggggcagttaataaacattct

SEQ ID NO: 9024202 - DNA, 22 bp, Homo sapiens
tggggcagtggcttttcaccct

SEQ ID NO: 9024203 - DNA, 22 bp, Homo sapiens
tggggcatggatgataagctgg

SEQ ID NO: 9024204 - DNA, 22 bp, Homo sapiens
tggggcatgtgaacctggatgt

SEQ ID NO: 9024205 - DNA, 23 bp, Homo sapiens
tggggccaagtgaggaagggtct

SEQ ID NO: 9024206 - DNA, 23 bp, Homo sapiens
tggggccaagtgaggaagggtct

SEQ ID NO: 9024207 - DNA, 22 bp, Homo sapiens
tggggccacactgatctcccag

SEQ ID NO: 9024208 - DNA, 22 bp, Homo sapiens
tggggctgtgagactacaggat

SEQ ID NO: 9024209 - DNA, 22 bp, Homo sapiens
tggggctgtccttagtctgaga

SEQ ID NO: 9024210 - DNA, 23 bp, Homo sapiens
tggggccaagtgaggaagggtct

SEQ ID NO: 9024211 - DNA, 22 bp, Homo sapiens
tggggcagttaataaacattct

SEQ ID NO: 9024212 - DNA, 23 bp, Homo sapiens
tggggccaagtgaggaagggtct

SEQ ID NO: 9024213 - DNA, 22 bp, Homo sapiens
tggggccacactgatctcccag

SEQ ID NO: 9024214 - DNA, 22 bp, Homo sapiens
tggggccacacatctctttcta

SEQ ID NO: 9024215 - DNA, 22 bp, Homo sapiens
tggggctgtgagactacaggat

SEQ ID NO: 9024216 - DNA, 22 bp, Homo sapiens
tggggctgtgagactacaggat

SEQ ID NO: 9024217 - DNA, 22 bp, Homo sapiens
tggggctgtgagactacaggat

SEQ ID NO: 9024218 - DNA, 22 bp, Homo sapiens
tggggctgtgagactacaggat

SEQ ID NO: 9024219 - DNA, 22 bp, Homo sapiens
tggggctgtgagactacaggat

SEQ ID NO: 9024220 - DNA, 22 bp, Homo sapiens
tggggctgtggattctcacgaa

SEQ ID NO: 9024221 - DNA, 22 bp, Homo sapiens
tggggctgtggattctcacgaa

SEQ ID NO: 9024222 - DNA, 19 bp, Homo sapiens
tggggctgtgttttgaccc

SEQ ID NO: 9024223 - DNA, 19 bp, Homo sapiens
tggggctgtgttttgaccc

SEQ ID NO: 9024224 - DNA, 22 bp, Homo sapiens
cctgggagtggcactcacagca

SEQ ID NO: 9024225 - DNA, 22 bp, Homo sapiens
cctgggagtggcactcacagca

SEQ ID NO: 9024226 - DNA, 22 bp, Homo sapiens
cctgggagtggcactcacagca

SEQ ID NO: 9024227 - DNA, 22 bp, Homo sapiens
cctgggagtggcactcacagca

SEQ ID NO: 9024228 - DNA, 22 bp, Homo sapiens
cctgggagtggcactcacagca

SEQ ID NO: 9024229 - DNA, 22 bp, Homo sapiens
cctgggagtggcactcacagca

SEQ ID NO: 9024230 - DNA, 19 bp, Homo sapiens
cctgggagtcagctgaagg

SEQ ID NO: 9024231 - DNA, 19 bp, Homo sapiens
cctgggagtcagctgaagg

SEQ ID NO: 9024232 - DNA, 22 bp, Homo sapiens
cctgggagtggcactcacagca

SEQ ID NO: 9024233 - DNA, 19 bp, Homo sapiens
cctgggagtcagctgaagg

SEQ ID NO: 9024234 - DNA, 22 bp, Homo sapiens
cctgggagtgcacaggtttcgt

SEQ ID NO: 9024235 - DNA, 22 bp, Homo sapiens
cctgggagtgtgccatctctgt

SEQ ID NO: 9024236 - DNA, 22 bp, Homo sapiens
cctgggagtgtgccatctctgt

SEQ ID NO: 9024237 - DNA, 22 bp, Homo sapiens
cctgggagtgtcagacttgctt

SEQ ID NO: 9024238 - DNA, 22 bp, Homo sapiens
cctgggagtgtgccatctctgt

SEQ ID NO: 9024239 - DNA, 19 bp, Homo sapiens
cctgggagtcagctgaagg

SEQ ID NO: 9024240 - DNA, 19 bp, Homo sapiens
cctgggagtcagctgaagg

SEQ ID NO: 9024241 - DNA, 19 bp, Homo sapiens
cctgggagtcagctgaagg

SEQ ID NO: 9024242 - DNA, 21 bp, Homo sapiens
tgggggagaattggttgcttt

SEQ ID NO: 9024243 - DNA, 22 bp, Homo sapiens
cctgggaggctgaggctgcagt

SEQ ID NO: 9024244 - DNA, 22 bp, Homo sapiens
cctgggaggctgaggctgcagt

SEQ ID NO: 9024245 - DNA, 22 bp, Homo sapiens
cctgggaggctgaggctgcagt

SEQ ID NO: 9024246 - DNA, 21 bp, Homo sapiens
tgggggagaattggttgcttt

SEQ ID NO: 9024247 - DNA, 21 bp, Homo sapiens
tgggggagaattggttgcttt

SEQ ID NO: 9024248 - DNA, 22 bp, Homo sapiens
tgggggaagagcttgttaaagt

SEQ ID NO: 9024249 - DNA, 22 bp, Homo sapiens
tgggggaagagcttgttaaagt

SEQ ID NO: 9024250 - DNA, 22 bp, Homo sapiens
tgggggaaattcagccagatat

SEQ ID NO: 9024251 - DNA, 22 bp, Homo sapiens
tgggggaactgttgcgcgcggg

SEQ ID NO: 9024252 - DNA, 22 bp, Homo sapiens
tgggggaactgttgcgcgcggg

SEQ ID NO: 9024253 - DNA, 22 bp, Homo sapiens
tgggggactgcactggcgtcag

SEQ ID NO: 9024254 - DNA, 22 bp, Homo sapiens
tgggggactgcactggcgtcag

SEQ ID NO: 9024255 - DNA, 21 bp, Homo sapiens
tgggggagaattggttgcttt

SEQ ID NO: 9024256 - DNA, 22 bp, Homo sapiens
tgttacagtactacaattctgc

SEQ ID NO: 9024257 - DNA, 22 bp, Homo sapiens
tgttacagtactacaattctgc

SEQ ID NO: 9024258 - DNA, 22 bp, Homo sapiens
tgttacaagtcttgaggtactt

SEQ ID NO: 9024259 - DNA, 22 bp, Homo sapiens
tgttacaatattatcaactgag

SEQ ID NO: 9024260 - DNA, 22 bp, Homo sapiens
tgttacacagcagaatagcaag

SEQ ID NO: 9024261 - DNA, 22 bp, Homo sapiens
tgttacaatattatcaactgag

SEQ ID NO: 9024262 - DNA, 21 bp, Homo sapiens
tgttacagtccaaatgtttgt

SEQ ID NO: 9024263 - DNA, 22 bp, Homo sapiens
tgttcagagacagaaattctaa

SEQ ID NO: 9024264 - DNA, 19 bp, Homo sapiens
tgttcagatatgtcagctt

SEQ ID NO: 9024265 - DNA, 19 bp, Homo sapiens
tgttcagatatgtcagctt

SEQ ID NO: 9024266 - DNA, 22 bp, Homo sapiens
tgttcagttaacacagacacca

SEQ ID NO: 9024267 - DNA, 22 bp, Homo sapiens
tgttcattaaactactgtgtgg

SEQ ID NO: 9024268 - DNA, 22 bp, Homo sapiens
tgttcattacccatcccaggtc

SEQ ID NO: 9024269 - DNA, 22 bp, Homo sapiens
tgttcattactgctgtttgcca

SEQ ID NO: 9024270 - DNA, 22 bp, Homo sapiens
tgttcattagtggaagtaagtt

SEQ ID NO: 9024271 - DNA, 22 bp, Homo sapiens
tgttcattagtggaagtaagtt

SEQ ID NO: 9024272 - DNA, 22 bp, Homo sapiens
tgttcatattcctgtccgctga

SEQ ID NO: 9024273 - DNA, 22 bp, Homo sapiens
tgttcatagctatcattgtgtc

SEQ ID NO: 9024274 - DNA, 22 bp, Homo sapiens
tgttcattcaacatgtcatcta

SEQ ID NO: 9024275 - DNA, 22 bp, Homo sapiens
tgttcattattcttcatctgcc

SEQ ID NO: 9024276 - DNA, 22 bp, Homo sapiens
tgttcattcgctattgtctatg

SEQ ID NO: 9024277 - DNA, 22 bp, Homo sapiens
tgttcattcgctattgtctatg

SEQ ID NO: 9024278 - DNA, 22 bp, Homo sapiens
tgttcattccggggagggctaa

SEQ ID NO: 9024279 - DNA, 22 bp, Homo sapiens
tgttcattccggggagggctaa

SEQ ID NO: 9024280 - DNA, 22 bp, Homo sapiens
tgttcattgccccctgtgtaaa

SEQ ID NO: 9024281 - DNA, 22 bp, Homo sapiens
tgttcatttgcaacaaccaaat

SEQ ID NO: 9024282 - DNA, 22 bp, Homo sapiens
tgttcattctgtgacctggttc

SEQ ID NO: 9024283 - DNA, 22 bp, Homo sapiens
tgttcattctgtatatgctgta

SEQ ID NO: 9024284 - DNA, 22 bp, Homo sapiens
tgttcatttggcccttttgtat

SEQ ID NO: 9024285 - DNA, 22 bp, Homo sapiens
tgttcattttgaagtacttcaa

SEQ ID NO: 9024286 - DNA, 22 bp, Homo sapiens
tgttcattttgaagtacttcaa

SEQ ID NO: 9024287 - DNA, 22 bp, Homo sapiens
tgttccagaggcagagatagga

SEQ ID NO: 9024288 - DNA, 22 bp, Homo sapiens
tgttccagaggcagagatagga

SEQ ID NO: 9024289 - DNA, 18 bp, Homo sapiens
tgttccaaggaaggaatc

SEQ ID NO: 9024290 - DNA, 23 bp, Homo sapiens
tgttccagatacgccttttcctc

SEQ ID NO: 9024291 - DNA, 23 bp, Homo sapiens
tgttccagatacgccttttcctc

SEQ ID NO: 9024292 - DNA, 22 bp, Homo sapiens
tgttccagggcgcgaaggtggt

SEQ ID NO: 9024293 - DNA, 20 bp, Homo sapiens
tgttccaggaggccagggct

SEQ ID NO: 9024294 - DNA, 22 bp, Homo sapiens
cctggtgtggctgtcacagagg

SEQ ID NO: 9024295 - DNA, 22 bp, Homo sapiens
cctggtgtggccctgtgacatg

SEQ ID NO: 9024296 - DNA, 22 bp, Homo sapiens
cctggtgttgtgaagtagccgt

SEQ ID NO: 9024297 - DNA, 22 bp, Homo sapiens
cctggttgtgagttgagttgag

SEQ ID NO: 9024298 - DNA, 22 bp, Homo sapiens
cctggttgagggaggtgtggac

SEQ ID NO: 9024299 - DNA, 22 bp, Homo sapiens
cctggtttcaggaacataatct

SEQ ID NO: 9024300 - DNA, 22 bp, Homo sapiens
cctggtttatgccagatcctgt

SEQ ID NO: 9024301 - DNA, 22 bp, Homo sapiens
cctggtttaatgctcactgttg

SEQ ID NO: 9024302 - DNA, 22 bp, Homo sapiens
cctggtttaatgctcactgttg

SEQ ID NO: 9024303 - DNA, 22 bp, Homo sapiens
cctggtttatgccagatcctgt

SEQ ID NO: 9024304 - DNA, 22 bp, Homo sapiens
tgtttactggctcctgtggttc

SEQ ID NO: 9024305 - DNA, 22 bp, Homo sapiens
tgtttactggaccagggagggg

SEQ ID NO: 9024306 - DNA, 22 bp, Homo sapiens
tgtttacttaaatgttttcata

SEQ ID NO: 9024307 - DNA, 22 bp, Homo sapiens
tgtttacttaaatgttttcata

SEQ ID NO: 9024308 - DNA, 22 bp, Homo sapiens
cctggtttcaggaacataatct

SEQ ID NO: 9024309 - DNA, 22 bp, Homo sapiens
cctggtttcaggaacataatct

SEQ ID NO: 9024310 - DNA, 22 bp, Homo sapiens
cctggtttctccatgtctcatt

SEQ ID NO: 9024311 - DNA, 22 bp, Homo sapiens
cctggtttgggtgccagtgagt

SEQ ID NO: 9024312 - DNA, 22 bp, Homo sapiens
tgtttactggaccagggagggg

SEQ ID NO: 9024313 - DNA, 22 bp, Homo sapiens
tgtttacttgaggtggaaacaa

SEQ ID NO: 9024314 - DNA, 22 bp, Homo sapiens
tgtttacttctttccatggctt

SEQ ID NO: 9024315 - DNA, 22 bp, Homo sapiens
tgtttacttatgtgggtcacat

SEQ ID NO: 9024316 - DNA, 22 bp, Homo sapiens
tgtttacttatgtgggtcacat

SEQ ID NO: 9024317 - DNA, 22 bp, Homo sapiens
tgtttacttcatcgagtacttc

SEQ ID NO: 9024318 - DNA, 22 bp, Homo sapiens
tgtttacttcatcgagtacttc

SEQ ID NO: 9024319 - DNA, 22 bp, Homo sapiens
cctggtggccttcagcccacaa

SEQ ID NO: 9024320 - DNA, 22 bp, Homo sapiens
cctggtggcgaatggtggtagg

SEQ ID NO: 9024321 - DNA, 22 bp, Homo sapiens
cctggtggcttctgggtggacg

SEQ ID NO: 9024322 - DNA, 22 bp, Homo sapiens
cctggtggagaggggcggagcg

SEQ ID NO: 9024323 - DNA, 22 bp, Homo sapiens
cctggtggagaggggcggagcg

SEQ ID NO: 9024324 - DNA, 20 bp, Homo sapiens
cctggtgtatttcctggggt

SEQ ID NO: 9024325 - DNA, 22 bp, Homo sapiens
cctggtgtcatggatgtcacat

SEQ ID NO: 9024326 - DNA, 22 bp, Homo sapiens
cctggtgggcaggagtgagacc

SEQ ID NO: 9024327 - DNA, 22 bp, Homo sapiens
cctggtgggcaggagtgagacc

SEQ ID NO: 9024328 - DNA, 22 bp, Homo sapiens
cctggtggcttctgggtggacg

SEQ ID NO: 9024329 - DNA, 22 bp, Homo sapiens
cctggtggcttctgggtggacg

SEQ ID NO: 9024330 - DNA, 22 bp, Homo sapiens
cctggtggcttctgggtggacg

SEQ ID NO: 9024331 - DNA, 22 bp, Homo sapiens
cctggtggaaggtgagtgaggc

SEQ ID NO: 9024332 - DNA, 22 bp, Homo sapiens
cctggtggaaggtgagtgaggc

SEQ ID NO: 9024333 - DNA, 22 bp, Homo sapiens
cctggtggagaggggcggagcg

SEQ ID NO: 9024334 - DNA, 22 bp, Homo sapiens
cctggtggagaggggcggagcg

SEQ ID NO: 9024335 - DNA, 22 bp, Homo sapiens
cctgggtgtcatgggcagctgg

SEQ ID NO: 9024336 - DNA, 22 bp, Homo sapiens
cctgggtgtcatgggcagctgg

SEQ ID NO: 9024337 - DNA, 22 bp, Homo sapiens
cctgggtgtcatgggcagctgg

SEQ ID NO: 9024338 - DNA, 22 bp, Homo sapiens
cctgggtgtcatgggcagctgg

SEQ ID NO: 9024339 - DNA, 22 bp, Homo sapiens
cctgggtgtcatgggcagctgg

SEQ ID NO: 9024340 - DNA, 22 bp, Homo sapiens
cctgggtgtcatgggcagctgg

SEQ ID NO: 9024341 - DNA, 22 bp, Homo sapiens
cctggtgcttaccagagctttt

SEQ ID NO: 9024342 - DNA, 22 bp, Homo sapiens
cctggtgcttaccagagctttt

SEQ ID NO: 9024343 - DNA, 22 bp, Homo sapiens
cctggtgcttaccagagctttt

SEQ ID NO: 9024344 - DNA, 18 bp, Homo sapiens
tgttaaggatccagtagt

SEQ ID NO: 9024345 - DNA, 22 bp, Homo sapiens
tgtgttctgaaggagaagagtg

SEQ ID NO: 9024346 - DNA, 22 bp, Homo sapiens
tgtgttctcctacagataagga

SEQ ID NO: 9024347 - DNA, 22 bp, Homo sapiens
tgttaagggtaaacagcagtaa

SEQ ID NO: 9024348 - DNA, 22 bp, Homo sapiens
tgttaaggtcctgacttctgca

SEQ ID NO: 9024349 - DNA, 22 bp, Homo sapiens
tgttaaggggatatagcagggc

SEQ ID NO: 9024350 - DNA, 22 bp, Homo sapiens
tgttaatatactaaaatccact

SEQ ID NO: 9024351 - DNA, 23 bp, Homo sapiens
tgttaatacatctgccactcatt

SEQ ID NO: 9024352 - DNA, 23 bp, Homo sapiens
tgttaatacatctgccactcatt

SEQ ID NO: 9024353 - DNA, 22 bp, Homo sapiens
tgttaagttgccagtgtatgac

SEQ ID NO: 9024354 - DNA, 22 bp, Homo sapiens
tgttaatatactaaaatccact

SEQ ID NO: 9024355 - DNA, 22 bp, Homo sapiens
tgttaatatactaaaatccact

SEQ ID NO: 9024356 - DNA, 22 bp, Homo sapiens
tgttaatatactaaaatccact

SEQ ID NO: 9024357 - DNA, 22 bp, Homo sapiens
tgttaatatactaaaatccact

SEQ ID NO: 9024358 - DNA, 22 bp, Homo sapiens
tgttaatatactaaaatccact

SEQ ID NO: 9024359 - DNA, 22 bp, Homo sapiens
tgttaatcaatcaacagtatta

SEQ ID NO: 9024360 - DNA, 22 bp, Homo sapiens
tgttaatcaacaacaaacagtg

SEQ ID NO: 9024361 - DNA, 17 bp, Homo sapiens
tgttaattccaatgata

SEQ ID NO: 9024362 - DNA, 22 bp, Homo sapiens
tgttaatggctgaagacatcct

SEQ ID NO: 9024363 - DNA, 22 bp, Homo sapiens
tgttaatggctgaagacatcct

SEQ ID NO: 9024364 - DNA, 22 bp, Homo sapiens
tgttacaaactgttgtttctat

SEQ ID NO: 9024365 - DNA, 17 bp, Homo sapiens
tgttaattccaatgata

SEQ ID NO: 9024366 - DNA, 22 bp, Homo sapiens
tgttacaaactgttgtttctat

SEQ ID NO: 9024367 - DNA, 22 bp, Homo sapiens
tgttacaaggaagaatgtaggt

SEQ ID NO: 9024368 - DNA, 22 bp, Homo sapiens
tgttacaagtcttgaggtactt

SEQ ID NO: 9024369 - DNA, 22 bp, Homo sapiens
tgttacaaggaagaatgtaggt

SEQ ID NO: 9024370 - DNA, 22 bp, Homo sapiens
tgttacaagtcttgaggtactt

SEQ ID NO: 9024371 - DNA, 22 bp, Homo sapiens
tgttacaactatagatcccaag

SEQ ID NO: 9024372 - DNA, 22 bp, Homo sapiens
tgttacaactatagatcccaag

SEQ ID NO: 9024373 - DNA, 22 bp, Homo sapiens
tgttacaactatagatcccaag

SEQ ID NO: 9024374 - DNA, 22 bp, Homo sapiens
tgttaatttctttagaagtgga

SEQ ID NO: 9024375 - DNA, 22 bp, Homo sapiens
tgttacaaactgttgtttctat

SEQ ID NO: 9024376 - DNA, 22 bp, Homo sapiens
cctgggctgggcgtctcatggg

SEQ ID NO: 9024377 - DNA, 22 bp, Homo sapiens
cctgggctgggcgtctcatggg

SEQ ID NO: 9024378 - DNA, 22 bp, Homo sapiens
cctgggctgggcgtctcatggg

SEQ ID NO: 9024379 - DNA, 22 bp, Homo sapiens
cctgggctgggcgtctcatggg

SEQ ID NO: 9024380 - DNA, 21 bp, Homo sapiens
cctgggctgtggtttggagac

SEQ ID NO: 9024381 - DNA, 21 bp, Homo sapiens
cctgggctgtggtttggagac

SEQ ID NO: 9024382 - DNA, 21 bp, Homo sapiens
cctgggctgtggtttggagac

SEQ ID NO: 9024383 - DNA, 22 bp, Homo sapiens
cctgggctgttgcatcatcctt

SEQ ID NO: 9024384 - DNA, 22 bp, Homo sapiens
cctgggctgtacctgtgcgcgg

SEQ ID NO: 9024385 - DNA, 22 bp, Homo sapiens
cctgggcttccacgagcagagg

SEQ ID NO: 9024386 - DNA, 22 bp, Homo sapiens
cctgggcttccacgagcagagg

SEQ ID NO: 9024387 - DNA, 22 bp, Homo sapiens
cctgggcttacgacctctgact

SEQ ID NO: 9024388 - DNA, 22 bp, Homo sapiens
cctgggcttccacgagcagagg

SEQ ID NO: 9024389 - DNA, 22 bp, Homo sapiens
cctgggcttacgacctctgact

SEQ ID NO: 9024390 - DNA, 22 bp, Homo sapiens
cctgggcttacgacctctgact

SEQ ID NO: 9024391 - DNA, 22 bp, Homo sapiens
cctgggcttacgacctctgact

SEQ ID NO: 9024392 - DNA, 22 bp, Homo sapiens
cctgggcttacgacctctgact

SEQ ID NO: 9024393 - DNA, 22 bp, Homo sapiens
cctgggctgttgcatcatcctt

SEQ ID NO: 9024394 - DNA, 22 bp, Homo sapiens
cctgggctgttgcatcatcctt

SEQ ID NO: 9024395 - DNA, 22 bp, Homo sapiens
cctgggctgctcatggggatga

SEQ ID NO: 9024396 - DNA, 22 bp, Homo sapiens
cctgggctgctcatggggatga

SEQ ID NO: 9024397 - DNA, 22 bp, Homo sapiens
cctgggctgctcatggggatga

SEQ ID NO: 9024398 - DNA, 22 bp, Homo sapiens
cctgggctggagtacagcagtg

SEQ ID NO: 9024399 - DNA, 22 bp, Homo sapiens
cctgggctgctcatggggatga

SEQ ID NO: 9024400 - DNA, 22 bp, Homo sapiens
cctgggctgctcatggggatga

SEQ ID NO: 9024401 - DNA, 22 bp, Homo sapiens
cctgggctgctcatggggatga

SEQ ID NO: 9024402 - DNA, 22 bp, Homo sapiens
cctgggctgctcatggggatga

SEQ ID NO: 9024403 - DNA, 22 bp, Homo sapiens
cctgggctgcatgatggcattt

SEQ ID NO: 9024404 - DNA, 22 bp, Homo sapiens
cctgggctggagtacagcagtg

SEQ ID NO: 9024405 - DNA, 22 bp, Homo sapiens
cctgggctggagtacagcagtg

SEQ ID NO: 9024406 - DNA, 22 bp, Homo sapiens
cctgggctggagtacagcagtg

SEQ ID NO: 9024407 - DNA, 22 bp, Homo sapiens
cctgggctggagtacagcagtg

SEQ ID NO: 9024408 - DNA, 22 bp, Homo sapiens
cctgggctggagtacagcagtg

SEQ ID NO: 9024409 - DNA, 22 bp, Homo sapiens
cctgggctgaagtcaagtgtgg

SEQ ID NO: 9024410 - DNA, 16 bp, Homo sapiens
cctgggctctgttgga

SEQ ID NO: 9024411 - DNA, 16 bp, Homo sapiens
cctgggctctgttgga

SEQ ID NO: 9024412 - DNA, 22 bp, Homo sapiens
cctgggctctgtcagaattggg

SEQ ID NO: 9024413 - DNA, 16 bp, Homo sapiens
cctgggctctgttgga

SEQ ID NO: 9024414 - DNA, 22 bp, Homo sapiens
cctgggctgcatgatggcattt

SEQ ID NO: 9024415 - DNA, 22 bp, Homo sapiens
cctgggctgcatgatggcattt

SEQ ID NO: 9024416 - DNA, 22 bp, Homo sapiens
cctgggctgcatgatggcattt

SEQ ID NO: 9024417 - DNA, 22 bp, Homo sapiens
tgtgtctggataggtaatggat

SEQ ID NO: 9024418 - DNA, 22 bp, Homo sapiens
tgtgtctgcactgagtcctcac

SEQ ID NO: 9024419 - DNA, 22 bp, Homo sapiens
tgtgtctggataggtaatggat

SEQ ID NO: 9024420 - DNA, 22 bp, Homo sapiens
tgtgtctggataggtaatggat

SEQ ID NO: 9024421 - DNA, 22 bp, Homo sapiens
tgtgtctgcccttagtacatct

SEQ ID NO: 9024422 - DNA, 22 bp, Homo sapiens
tgtgtctggaccggggaggagc

SEQ ID NO: 9024423 - DNA, 22 bp, Homo sapiens
tgtgtctgcccttagtacatct

SEQ ID NO: 9024424 - DNA, 22 bp, Homo sapiens
cctgggctcaagtgatcctcct

SEQ ID NO: 9024425 - DNA, 22 bp, Homo sapiens
cctgggctctatcctgacccag

SEQ ID NO: 9024426 - DNA, 22 bp, Homo sapiens
cctgggctctatcctgacccag

SEQ ID NO: 9024427 - DNA, 22 bp, Homo sapiens
cctgggctcaagtgatcctcct

SEQ ID NO: 9024428 - DNA, 22 bp, Homo sapiens
cctgggctctgaggagggagtc

SEQ ID NO: 9024429 - DNA, 22 bp, Homo sapiens
cctgggctctgaggagggagtc

SEQ ID NO: 9024430 - DNA, 22 bp, Homo sapiens
cctgggctctatcctgacccag

SEQ ID NO: 9024431 - DNA, 22 bp, Homo sapiens
cctgggctctatcctgacccag

SEQ ID NO: 9024432 - DNA, 22 bp, Homo sapiens
cctgggctctgaggagggagtc

SEQ ID NO: 9024433 - DNA, 22 bp, Homo sapiens
cctgggctctgaggagggagtc

SEQ ID NO: 9024434 - DNA, 22 bp, Homo sapiens
cctgggctctgaggagggagtc

SEQ ID NO: 9024435 - DNA, 22 bp, Homo sapiens
cctgggctctgaggagggagtc

SEQ ID NO: 9024436 - DNA, 22 bp, Homo sapiens
cctgggctctgtcagaattggg

SEQ ID NO: 9024437 - DNA, 22 bp, Homo sapiens
cctgggctctgaggagggagtc

SEQ ID NO: 9024438 - DNA, 22 bp, Homo sapiens
cctgggctctgaggagggagtc

SEQ ID NO: 9024439 - DNA, 22 bp, Homo sapiens
cctgggctctgaggagggagtc

SEQ ID NO: 9024440 - DNA, 22 bp, Homo sapiens
ttaaagtttcagaaacttggtc

SEQ ID NO: 9024441 - DNA, 22 bp, Homo sapiens
ttaaagtttcagaaacttggtc

SEQ ID NO: 9024442 - DNA, 22 bp, Homo sapiens
ttaaagtttgcctatgtgttgt

SEQ ID NO: 9024443 - DNA, 22 bp, Homo sapiens
ttaaagttcattaaatgagcca

SEQ ID NO: 9024444 - DNA, 22 bp, Homo sapiens
ttaaagttcattaaatgagcca

SEQ ID NO: 9024445 - DNA, 22 bp, Homo sapiens
ttaaagttcattaaatgagcca

SEQ ID NO: 9024446 - DNA, 19 bp, Homo sapiens
ttaaagtgcgagaagtctt

SEQ ID NO: 9024447 - DNA, 19 bp, Homo sapiens
ttaaagtgcgagaagtctt

SEQ ID NO: 9024448 - DNA, 22 bp, Homo sapiens
cctgtggctggtcaggccagca

SEQ ID NO: 9024449 - DNA, 22 bp, Homo sapiens
ttaaatagctcttgtagaagaa

SEQ ID NO: 9024450 - DNA, 22 bp, Homo sapiens
ttaaatagctcttgtagaagaa

SEQ ID NO: 9024451 - DNA, 22 bp, Homo sapiens
cctgtggcttccacgacctaat

SEQ ID NO: 9024452 - DNA, 22 bp, Homo sapiens
cctgtgggaaaggtctgctctc

SEQ ID NO: 9024453 - DNA, 22 bp, Homo sapiens
ttaaaggctgatcttaatatta

SEQ ID NO: 9024454 - DNA, 22 bp, Homo sapiens
ttaaagtaatctgtgtgaattt

SEQ ID NO: 9024455 - DNA, 22 bp, Homo sapiens
ttaaagggccgatttccaggcc

SEQ ID NO: 9024456 - DNA, 22 bp, Homo sapiens
ttaaagtaatctgtgtgaattt

SEQ ID NO: 9024457 - DNA, 22 bp, Homo sapiens
ttaaagtaatctgtgtgaattt

SEQ ID NO: 9024458 - DNA, 22 bp, Homo sapiens
ttaaagtaatctgtgtgaattt

SEQ ID NO: 9024459 - DNA, 22 bp, Homo sapiens
ttaaagtatagaggacaaaaac

SEQ ID NO: 9024460 - DNA, 19 bp, Homo sapiens
ttaaagtgcgagaagtctt

SEQ ID NO: 9024461 - DNA, 22 bp, Homo sapiens
ttaaagtatggtttaagggctt

SEQ ID NO: 9024462 - DNA, 22 bp, Homo sapiens
ttaaagtctatgtactacactt

SEQ ID NO: 9024463 - DNA, 19 bp, Homo sapiens
ttaaagtgcgagaagtctt

SEQ ID NO: 9024464 - DNA, 22 bp, Homo sapiens
ttaaagtctatgtactacactt

SEQ ID NO: 9024465 - DNA, 22 bp, Homo sapiens
ttaaagtatggtttaagggctt

SEQ ID NO: 9024466 - DNA, 22 bp, Homo sapiens
ttaaagtatagaggacaaaaac

SEQ ID NO: 9024467 - DNA, 22 bp, Homo sapiens
cctgtggtttacatgacagtta

SEQ ID NO: 9024468 - DNA, 22 bp, Homo sapiens
cctgtgggttttctgtagaaat

SEQ ID NO: 9024469 - DNA, 22 bp, Homo sapiens
cctgtggtttactctgtggcta

SEQ ID NO: 9024470 - DNA, 21 bp, Homo sapiens
cctgtgtatatggcttgcatg

SEQ ID NO: 9024471 - DNA, 21 bp, Homo sapiens
cctgtggtctggagggagcac

SEQ ID NO: 9024472 - DNA, 21 bp, Homo sapiens
cctgtggtctggagggagcac

SEQ ID NO: 9024473 - DNA, 22 bp, Homo sapiens
cctgtggttacgcctgtttcca

SEQ ID NO: 9024474 - DNA, 22 bp, Homo sapiens
cctgtgggtcacatgggtgact

SEQ ID NO: 9024475 - DNA, 22 bp, Homo sapiens
cctgtgggtcacatgggtgact

SEQ ID NO: 9024476 - DNA, 22 bp, Homo sapiens
cctgtgggagcccaggcagata

SEQ ID NO: 9024477 - DNA, 22 bp, Homo sapiens
cctgtgggttttcaagatgcta

SEQ ID NO: 9024478 - DNA, 22 bp, Homo sapiens
cctgtgtcatcagctgtggcta

SEQ ID NO: 9024479 - DNA, 22 bp, Homo sapiens
cctgtgtccagttccaggttgt

SEQ ID NO: 9024480 - DNA, 22 bp, Homo sapiens
cctgtgtcatcagctgtggcta

SEQ ID NO: 9024481 - DNA, 22 bp, Homo sapiens
cctgtgtcatcagctgtggcta

SEQ ID NO: 9024482 - DNA, 22 bp, Homo sapiens
cctgtgtcctaatccatcaggc

SEQ ID NO: 9024483 - DNA, 19 bp, Homo sapiens
cctgtgtcccacgtagatg

SEQ ID NO: 9024484 - DNA, 22 bp, Homo sapiens
cctgtgtccagttccaggttgt

SEQ ID NO: 9024485 - DNA, 22 bp, Homo sapiens
cctgtgtcagcccctgcctcca

SEQ ID NO: 9024486 - DNA, 22 bp, Homo sapiens
cctgtgtcagcccctgcctcca

SEQ ID NO: 9024487 - DNA, 22 bp, Homo sapiens
cctgtgtcagcccctgcctcca

SEQ ID NO: 9024488 - DNA, 22 bp, Homo sapiens
cctgtgtcaccggaacggagga

SEQ ID NO: 9024489 - DNA, 22 bp, Homo sapiens
cctgtgtcaccggaacggagga

SEQ ID NO: 9024490 - DNA, 22 bp, Homo sapiens
cctgtgtcaccggaacggagga

SEQ ID NO: 9024491 - DNA, 22 bp, Homo sapiens
cctgtgccctctgcatagcagc

SEQ ID NO: 9024492 - DNA, 22 bp, Homo sapiens
cctgtgccctcagcctggctct

SEQ ID NO: 9024493 - DNA, 22 bp, Homo sapiens
cctgtgccctcagcctggctct

SEQ ID NO: 9024494 - DNA, 22 bp, Homo sapiens
cctgtgccctcagcctggctct

SEQ ID NO: 9024495 - DNA, 22 bp, Homo sapiens
cctgtgccctacacctttccag

SEQ ID NO: 9024496 - DNA, 22 bp, Homo sapiens
cctgtgccctacacctttccag

SEQ ID NO: 9024497 - DNA, 22 bp, Homo sapiens
cctgtgccatcctgagcatccc

SEQ ID NO: 9024498 - DNA, 22 bp, Homo sapiens
cctgtgccatcctgagcatccc

SEQ ID NO: 9024499 - DNA, 22 bp, Homo sapiens
cctgtgccatcctgagcatccc

SEQ ID NO: 9024500 - DNA, 22 bp, Homo sapiens
cctgtgcctgcctgtgagttct

SEQ ID NO: 9024501 - DNA, 22 bp, Homo sapiens
cctgtgccttaaccctttaggc

SEQ ID NO: 9024502 - DNA, 22 bp, Homo sapiens
cctgtgccttaaccctttaggc

SEQ ID NO: 9024503 - DNA, 22 bp, Homo sapiens
cctgtgccttccttaggcacct

SEQ ID NO: 9024504 - DNA, 22 bp, Homo sapiens
cctgtgccctgccaggctggtg

SEQ ID NO: 9024505 - DNA, 22 bp, Homo sapiens
cctgtgccctgccaggctggtg

SEQ ID NO: 9024506 - DNA, 22 bp, Homo sapiens
cctgtgccctggaaggagagag

SEQ ID NO: 9024507 - DNA, 22 bp, Homo sapiens
cctgtgccctggaaggagagag

SEQ ID NO: 9024508 - DNA, 21 bp, Homo sapiens
cctgtgctccacacagggtcc

SEQ ID NO: 9024509 - DNA, 22 bp, Homo sapiens
cctgtgctccctatgtatctgg

SEQ ID NO: 9024510 - DNA, 22 bp, Homo sapiens
cctgtgctccctatgtatctgg

SEQ ID NO: 9024511 - DNA, 22 bp, Homo sapiens
cctgtgccttccttaggcacct

SEQ ID NO: 9024512 - DNA, 19 bp, Homo sapiens
cctgtgctaggagctgacc

SEQ ID NO: 9024513 - DNA, 19 bp, Homo sapiens
cctgtgctaggagctgacc

SEQ ID NO: 9024514 - DNA, 21 bp, Homo sapiens
cctgtgctatcagcttgggtt

SEQ ID NO: 9024515 - DNA, 21 bp, Homo sapiens
cctgtgctatcagcttgggtt

SEQ ID NO: 9024516 - DNA, 21 bp, Homo sapiens
cctgtgctatcagcttgggtt

SEQ ID NO: 9024517 - DNA, 22 bp, Homo sapiens
ttaaaggcatggttagacatgg

SEQ ID NO: 9024518 - DNA, 17 bp, Homo sapiens
ttaaaggatgctctctc

SEQ ID NO: 9024519 - DNA, 22 bp, Homo sapiens
ttaaagcttgattcgaagctta

SEQ ID NO: 9024520 - DNA, 22 bp, Homo sapiens
ttaaaggaattgagtttcttgt

SEQ ID NO: 9024521 - DNA, 22 bp, Homo sapiens
ttaaagctggcgttacagtttg

SEQ ID NO: 9024522 - DNA, 22 bp, Homo sapiens
ttaaagctgtagagttacttgc

SEQ ID NO: 9024523 - DNA, 22 bp, Homo sapiens
ttaaagctgagccctcagaagc

SEQ ID NO: 9024524 - DNA, 22 bp, Homo sapiens
cctgtgctgggtgtgagggaca

SEQ ID NO: 9024525 - DNA, 22 bp, Homo sapiens
cctgtgctgggtgtgagggaca

SEQ ID NO: 9024526 - DNA, 22 bp, Homo sapiens
cctgtgctggacagggctgggc

SEQ ID NO: 9024527 - DNA, 22 bp, Homo sapiens
cctgtgctggacagggctgggc

SEQ ID NO: 9024528 - DNA, 22 bp, Homo sapiens
cctgtgctggacagggctgggc

SEQ ID NO: 9024529 - DNA, 22 bp, Homo sapiens
cctgtgctggacagggctgggc

SEQ ID NO: 9024530 - DNA, 22 bp, Homo sapiens
cctgtgctgggtgtgagggaca

SEQ ID NO: 9024531 - DNA, 21 bp, Homo sapiens
ttaaagctatggtagtgggct

SEQ ID NO: 9024532 - DNA, 22 bp, Homo sapiens
cctgtgcttcagctggaggagg

SEQ ID NO: 9024533 - DNA, 22 bp, Homo sapiens
cctgtctgtattggtttgctat

SEQ ID NO: 9024534 - DNA, 22 bp, Homo sapiens
cctgtctgtattggtttgctat

SEQ ID NO: 9024535 - DNA, 22 bp, Homo sapiens
cctgtctgtcctctcatgagcc

SEQ ID NO: 9024536 - DNA, 22 bp, Homo sapiens
cctgtctgtcctctcatgagcc

SEQ ID NO: 9024537 - DNA, 22 bp, Homo sapiens
cctgtctgtcctctcatgagcc

SEQ ID NO: 9024538 - DNA, 22 bp, Homo sapiens
cctgtctgtcctctcatgagcc

SEQ ID NO: 9024539 - DNA, 22 bp, Homo sapiens
cctgtctgtcctctcatgagcc

SEQ ID NO: 9024540 - DNA, 22 bp, Homo sapiens
cctgtctgtcctttgcattctt

SEQ ID NO: 9024541 - DNA, 22 bp, Homo sapiens
cctgtctggggactccctgggt

SEQ ID NO: 9024542 - DNA, 22 bp, Homo sapiens
cctgtctggggactccctgggt

SEQ ID NO: 9024543 - DNA, 22 bp, Homo sapiens
cctgtctggggactccctgggt

SEQ ID NO: 9024544 - DNA, 18 bp, Homo sapiens
cctgtctggggtccccac

SEQ ID NO: 9024545 - DNA, 18 bp, Homo sapiens
cctgtctggggtccccac

SEQ ID NO: 9024546 - DNA, 18 bp, Homo sapiens
cctgtctggggtccccac

SEQ ID NO: 9024547 - DNA, 22 bp, Homo sapiens
cctgtctggtgagggggttgca

SEQ ID NO: 9024548 - DNA, 22 bp, Homo sapiens
cctgtctgtatcggttcagagt

SEQ ID NO: 9024549 - DNA, 22 bp, Homo sapiens
cctgtctgtatcggttcagagt

SEQ ID NO: 9024550 - DNA, 22 bp, Homo sapiens
cctgtctgtattattcaccact

SEQ ID NO: 9024551 - DNA, 22 bp, Homo sapiens
cctgtctgtattattcaccact

SEQ ID NO: 9024552 - DNA, 22 bp, Homo sapiens
cctgtctggaacatggcctgtt

SEQ ID NO: 9024553 - DNA, 22 bp, Homo sapiens
cctgtctggccaccagggcgat

SEQ ID NO: 9024554 - DNA, 20 bp, Homo sapiens
cctgtctggagacaaagaga

SEQ ID NO: 9024555 - DNA, 22 bp, Homo sapiens
cctgtctggaacatggcctgtt

SEQ ID NO: 9024556 - DNA, 22 bp, Homo sapiens
cctgtctgcatgatccctgcca

SEQ ID NO: 9024557 - DNA, 22 bp, Homo sapiens
cctgtctggaacatggcctgtt

SEQ ID NO: 9024558 - DNA, 20 bp, Homo sapiens
cctgtctggagacaaagaga

SEQ ID NO: 9024559 - DNA, 22 bp, Homo sapiens
cctgtctggaacatggcctgtt

SEQ ID NO: 9024560 - DNA, 22 bp, Homo sapiens
cctgtctggaacatggcctgtt

SEQ ID NO: 9024561 - DNA, 22 bp, Homo sapiens
cctgtctgggcttgagtattta

SEQ ID NO: 9024562 - DNA, 22 bp, Homo sapiens
cctgtctggggactccctgggt

SEQ ID NO: 9024563 - DNA, 22 bp, Homo sapiens
cctgtctggccttccacggggg

SEQ ID NO: 9024564 - DNA, 22 bp, Homo sapiens
cctgtctgggcttgagtattta

SEQ ID NO: 9024565 - DNA, 22 bp, Homo sapiens
cctgtctgggcttgagtattta

SEQ ID NO: 9024566 - DNA, 22 bp, Homo sapiens
cctgtctggccttccacggggg

SEQ ID NO: 9024567 - DNA, 22 bp, Homo sapiens
cctgtctggccaccagggcgat

SEQ ID NO: 9024568 - DNA, 22 bp, Homo sapiens
cctgtctggccaccagggcgat

SEQ ID NO: 9024569 - DNA, 19 bp, Homo sapiens
cctgtctgtcttcagctag

SEQ ID NO: 9024570 - DNA, 19 bp, Homo sapiens
cctgtctgtcttcagctag

SEQ ID NO: 9024571 - DNA, 23 bp, Homo sapiens
cctgtctgtgctgggtggacaca

SEQ ID NO: 9024572 - DNA, 22 bp, Homo sapiens
cctgtctgtcctttgcattctt

SEQ ID NO: 9024573 - DNA, 22 bp, Homo sapiens
cctgtctgtcctttgcattctt

SEQ ID NO: 9024574 - DNA, 22 bp, Homo sapiens
cctgtctgttctgactggtcag

SEQ ID NO: 9024575 - DNA, 22 bp, Homo sapiens
cctgtctgttctgactggtcag

SEQ ID NO: 9024576 - DNA, 22 bp, Homo sapiens
cctgtctgtttcattccttgtt

SEQ ID NO: 9024577 - DNA, 22 bp, Homo sapiens
cctgtctgtttcattccttgtt

SEQ ID NO: 9024578 - DNA, 23 bp, Homo sapiens
cctgtctgtgctgggtggacaca

SEQ ID NO: 9024579 - DNA, 23 bp, Homo sapiens
cctgtctgtgctgggtggacaca

SEQ ID NO: 9024580 - DNA, 23 bp, Homo sapiens
cctgtctgtgctgggtggacaca

SEQ ID NO: 9024581 - DNA, 22 bp, Homo sapiens
cctgtgccatcctgagcatccc

SEQ ID NO: 9024582 - DNA, 22 bp, Homo sapiens
cctgtgccatcctgagcatccc

SEQ ID NO: 9024583 - DNA, 17 bp, Homo sapiens
cctgtcttgtttctgcc

SEQ ID NO: 9024584 - DNA, 22 bp, Homo sapiens
cctgtctgtttgcccattcttg

SEQ ID NO: 9024585 - DNA, 22 bp, Homo sapiens
cctgtctgtttgcccattcttg

SEQ ID NO: 9024586 - DNA, 22 bp, Homo sapiens
cctgtctgaatcatgatttcct

SEQ ID NO: 9024587 - DNA, 22 bp, Homo sapiens
cctgtctgagccagggtgggca

SEQ ID NO: 9024588 - DNA, 22 bp, Homo sapiens
cctgtctgaatcatgatttcct

SEQ ID NO: 9024589 - DNA, 22 bp, Homo sapiens
cctgtctgaatcatgatttcct

SEQ ID NO: 9024590 - DNA, 22 bp, Homo sapiens
cctgtctgaaggcagggggatg

SEQ ID NO: 9024591 - DNA, 22 bp, Homo sapiens
cctgtctctttcaatctgagag

SEQ ID NO: 9024592 - DNA, 22 bp, Homo sapiens
cctgtctgaaggcagggggatg

SEQ ID NO: 9024593 - DNA, 22 bp, Homo sapiens
cctgtctgaatcatgatttcct

SEQ ID NO: 9024594 - DNA, 22 bp, Homo sapiens
cctgtctgcaaggggtggatcc

SEQ ID NO: 9024595 - DNA, 22 bp, Homo sapiens
cctgtctgaggaggtgctcttt

SEQ ID NO: 9024596 - DNA, 22 bp, Homo sapiens
cctgtctgaggaggtgctcttt

SEQ ID NO: 9024597 - DNA, 20 bp, Homo sapiens
cctgtctgcaatggaggtca

SEQ ID NO: 9024598 - DNA, 20 bp, Homo sapiens
cctgtctgcaatggaggtca

SEQ ID NO: 9024599 - DNA, 22 bp, Homo sapiens
cctgtctgcagatatctcaggt

SEQ ID NO: 9024600 - DNA, 22 bp, Homo sapiens
cctgtctgcatgagtgagcata

SEQ ID NO: 9024601 - DNA, 22 bp, Homo sapiens
cctgtctgcatgagtgagcata

SEQ ID NO: 9024602 - DNA, 22 bp, Homo sapiens
cctgtctgcagatatctcaggt

SEQ ID NO: 9024603 - DNA, 22 bp, Homo sapiens
cctgtctgcagatatctcaggt

SEQ ID NO: 9024604 - DNA, 22 bp, Homo sapiens
cctgtctgcaggaaattaccag

SEQ ID NO: 9024605 - DNA, 22 bp, Homo sapiens
cctgtctgcatgagtgagcata

SEQ ID NO: 9024606 - DNA, 22 bp, Homo sapiens
cctgtctgcaggaaattaccag

SEQ ID NO: 9024607 - DNA, 22 bp, Homo sapiens
cctgtctggaacatggcctgtt

SEQ ID NO: 9024608 - DNA, 22 bp, Homo sapiens
cctgtctgcggaggagtggaag

SEQ ID NO: 9024609 - DNA, 22 bp, Homo sapiens
cctgtctgcggaggagtggaag

SEQ ID NO: 9024610 - DNA, 22 bp, Homo sapiens
cctgtctgcatgatccctgcca

SEQ ID NO: 9024611 - DNA, 22 bp, Homo sapiens
cctgtctgcatgatccctgcca

SEQ ID NO: 9024612 - DNA, 22 bp, Homo sapiens
tgtttagaggaactggaatcag

SEQ ID NO: 9024613 - DNA, 22 bp, Homo sapiens
tgtttagactcaaaattgaaag

SEQ ID NO: 9024614 - DNA, 22 bp, Homo sapiens
tgtttagaggaactggaatcag

SEQ ID NO: 9024615 - DNA, 22 bp, Homo sapiens
tgtttagatgcaaagtctcaca

SEQ ID NO: 9024616 - DNA, 22 bp, Homo sapiens
tgtttagatgcaaagtctcaca

SEQ ID NO: 9024617 - DNA, 22 bp, Homo sapiens
tgtttagaatcattcaaaagtt

SEQ ID NO: 9024618 - DNA, 22 bp, Homo sapiens
tgtttagaatcattcaaaagtt

SEQ ID NO: 9024619 - DNA, 22 bp, Homo sapiens
tgtttagacaaggatcaggtta

SEQ ID NO: 9024620 - DNA, 22 bp, Homo sapiens
tgtttacttttaattacctgtc

SEQ ID NO: 9024621 - DNA, 22 bp, Homo sapiens
tgtttactttccttctcacagg

SEQ ID NO: 9024622 - DNA, 22 bp, Homo sapiens
tgtttactttccttctcacagg

SEQ ID NO: 9024623 - DNA, 22 bp, Homo sapiens
cctgtctctgcagggccctgcc

SEQ ID NO: 9024624 - DNA, 22 bp, Homo sapiens
cctgtctctttcaatctgagag

SEQ ID NO: 9024625 - DNA, 22 bp, Homo sapiens
cctgtctctttcaatctgagag

SEQ ID NO: 9024626 - DNA, 22 bp, Homo sapiens
cctgtctctgcagggccctgcc

SEQ ID NO: 9024627 - DNA, 22 bp, Homo sapiens
cctgtctctgttaccacatttg

SEQ ID NO: 9024628 - DNA, 22 bp, Homo sapiens
tgtttagtaggagtttaatact

SEQ ID NO: 9024629 - DNA, 22 bp, Homo sapiens
tgtttataatatgcagtgagca

SEQ ID NO: 9024630 - DNA, 22 bp, Homo sapiens
tgtttataaattttcttgccat

SEQ ID NO: 9024631 - DNA, 22 bp, Homo sapiens
cctgtcactgttgcagccagct

SEQ ID NO: 9024632 - DNA, 22 bp, Homo sapiens
cctgtcactctgagccgctccg

SEQ ID NO: 9024633 - DNA, 22 bp, Homo sapiens
cctgtcactctgagccgctccg

SEQ ID NO: 9024634 - DNA, 22 bp, Homo sapiens
cctgtcagatgaagtaattgtg

SEQ ID NO: 9024635 - DNA, 21 bp, Homo sapiens
cctgtgtgtctgactgggcta

SEQ ID NO: 9024636 - DNA, 20 bp, Homo sapiens
cctgtgtggtttgcactaca

SEQ ID NO: 9024637 - DNA, 22 bp, Homo sapiens
cctgtgtgtaggccaggggagt

SEQ ID NO: 9024638 - DNA, 22 bp, Homo sapiens
cctgtgtgtaggccaggggagt

SEQ ID NO: 9024639 - DNA, 22 bp, Homo sapiens
cctgtgtggtagccagcggtgc

SEQ ID NO: 9024640 - DNA, 20 bp, Homo sapiens
cctgtgtggtttgcactaca

SEQ ID NO: 9024641 - DNA, 22 bp, Homo sapiens
cctgtgtggtagccagcggtgc

SEQ ID NO: 9024642 - DNA, 20 bp, Homo sapiens
cctgtgtggtttgcactaca

SEQ ID NO: 9024643 - DNA, 22 bp, Homo sapiens
cctgtgtgtaggccaggggagt

SEQ ID NO: 9024644 - DNA, 22 bp, Homo sapiens
cctgtgtgtaggccaggggagt

SEQ ID NO: 9024645 - DNA, 19 bp, Homo sapiens
cctgtgtggggtagagatc

SEQ ID NO: 9024646 - DNA, 19 bp, Homo sapiens
cctgtgtggggtagagatc

SEQ ID NO: 9024647 - DNA, 22 bp, Homo sapiens
cctgtgtggccgcactgctccc

SEQ ID NO: 9024648 - DNA, 19 bp, Homo sapiens
cctgtgtggggtagagatc

SEQ ID NO: 9024649 - DNA, 22 bp, Homo sapiens
cctgtgtggccaggctggagtc

SEQ ID NO: 9024650 - DNA, 22 bp, Homo sapiens
cctgtgtggccgcactgctccc

SEQ ID NO: 9024651 - DNA, 20 bp, Homo sapiens
cctgtgtggccagctgaggc

SEQ ID NO: 9024652 - DNA, 22 bp, Homo sapiens
cctgtgtggccaggctggagtc

SEQ ID NO: 9024653 - DNA, 22 bp, Homo sapiens
cctgtgtggccaggctggagtc

SEQ ID NO: 9024654 - DNA, 20 bp, Homo sapiens
cctgtgtggccagctgaggc

SEQ ID NO: 9024655 - DNA, 20 bp, Homo sapiens
cctgtgtggccagctgaggc

SEQ ID NO: 9024656 - DNA, 22 bp, Homo sapiens
cctgtgtgaaggttaggcaggt

SEQ ID NO: 9024657 - DNA, 22 bp, Homo sapiens
cctgtgtctttgcctcagggtc

SEQ ID NO: 9024658 - DNA, 22 bp, Homo sapiens
cctgtgtgaaggttaggcaggt

SEQ ID NO: 9024659 - DNA, 22 bp, Homo sapiens
cctgtgtctttgcctcagggtc

SEQ ID NO: 9024660 - DNA, 22 bp, Homo sapiens
cctgtgtgcacacgaggccatg

SEQ ID NO: 9024661 - DNA, 22 bp, Homo sapiens
cctgtgtgcacacgaggccatg

SEQ ID NO: 9024662 - DNA, 22 bp, Homo sapiens
cctgtgtgcacacgaggccatg

SEQ ID NO: 9024663 - DNA, 22 bp, Homo sapiens
cctgtgtgcacacgaggccatg

SEQ ID NO: 9024664 - DNA, 22 bp, Homo sapiens
cctgtgtgctgatgacgacaga

SEQ ID NO: 9024665 - DNA, 23 bp, Homo sapiens
cctgtgtgcccttaattcacagc

SEQ ID NO: 9024666 - DNA, 23 bp, Homo sapiens
cctgtgtgcccttaattcacagc

SEQ ID NO: 9024667 - DNA, 22 bp, Homo sapiens
cctgtgtgctgatgacgacaga

SEQ ID NO: 9024668 - DNA, 22 bp, Homo sapiens
cctgtgtgctgatgacgacaga

SEQ ID NO: 9024669 - DNA, 22 bp, Homo sapiens
cctgtgtggaaaccgcatgacg

SEQ ID NO: 9024670 - DNA, 22 bp, Homo sapiens
cctgtgtcttccccactggtgt

SEQ ID NO: 9024671 - DNA, 22 bp, Homo sapiens
cctgtgtcttccccactggtgt

SEQ ID NO: 9024672 - DNA, 23 bp, Homo sapiens
cctgtgtctgttgctgaataatg

SEQ ID NO: 9024673 - DNA, 22 bp, Homo sapiens
cctgtgtcttccccactggtgt

SEQ ID NO: 9024674 - DNA, 22 bp, Homo sapiens
cctgtgtctttgcctcagggtc

SEQ ID NO: 9024675 - DNA, 22 bp, Homo sapiens
cctgtgtcttccccactggtgt

SEQ ID NO: 9024676 - DNA, 23 bp, Homo sapiens
cctgtgtctgttgctgaataatg

SEQ ID NO: 9024677 - DNA, 22 bp, Homo sapiens
cctgtgtctgaccatgcacatg

SEQ ID NO: 9024678 - DNA, 22 bp, Homo sapiens
cctgtgtctgaccatgcacatg

SEQ ID NO: 9024679 - DNA, 16 bp, Homo sapiens
cctgtgtctatcaggt

SEQ ID NO: 9024680 - DNA, 22 bp, Homo sapiens
cctgtgtccttggcagatatcc

SEQ ID NO: 9024681 - DNA, 22 bp, Homo sapiens
cctgtgtcctcccactcagtcc

SEQ ID NO: 9024682 - DNA, 19 bp, Homo sapiens
cctgtgtcccacgtagatg

SEQ ID NO: 9024683 - DNA, 22 bp, Homo sapiens
cctgtgtcctcccactcagtcc

SEQ ID NO: 9024684 - DNA, 22 bp, Homo sapiens
cctgtgtcctaatccatcaggc

SEQ ID NO: 9024685 - DNA, 22 bp, Homo sapiens
cctgtgtcctaatccatcaggc

SEQ ID NO: 9024686 - DNA, 22 bp, Homo sapiens
cctgtgtcctaatccatcaggc

SEQ ID NO: 9024687 - DNA, 22 bp, Homo sapiens
ccttcccaggctagaccaacat

SEQ ID NO: 9024688 - DNA, 22 bp, Homo sapiens
ccttccagttcttggttgtaat

SEQ ID NO: 9024689 - DNA, 22 bp, Homo sapiens
ccttcccacattccttacatgc

SEQ ID NO: 9024690 - DNA, 15 bp, Homo sapiens
ccttcccacccaccc

SEQ ID NO: 9024691 - DNA, 22 bp, Homo sapiens
ccttcccaggctagaccaacat

SEQ ID NO: 9024692 - DNA, 22 bp, Homo sapiens
ccttcccatgcagcctgtctga

SEQ ID NO: 9024693 - DNA, 22 bp, Homo sapiens
ccttcccatgcagcctgtctga

SEQ ID NO: 9024694 - DNA, 22 bp, Homo sapiens
ccttcccatgcagcctgtctga

SEQ ID NO: 9024695 - DNA, 22 bp, Homo sapiens
ccttccagtgatatgcgtgaat

SEQ ID NO: 9024696 - DNA, 22 bp, Homo sapiens
ccttccagtgatatgcgtgaat

SEQ ID NO: 9024697 - DNA, 22 bp, Homo sapiens
ccttcaggtcatatatgtcaga

SEQ ID NO: 9024698 - DNA, 22 bp, Homo sapiens
ccttccccaggtgctcactgtc

SEQ ID NO: 9024699 - DNA, 22 bp, Homo sapiens
ccttccccaggtgctcactgtc

SEQ ID NO: 9024700 - DNA, 22 bp, Homo sapiens
ccttccccaggtgctcactgtc

SEQ ID NO: 9024701 - DNA, 22 bp, Homo sapiens
ccttccccaggtgctcactgtc

SEQ ID NO: 9024702 - DNA, 20 bp, Homo sapiens
ccttccccacccgctgaggt

SEQ ID NO: 9024703 - DNA, 20 bp, Homo sapiens
ccttccccacccgctgaggt

SEQ ID NO: 9024704 - DNA, 20 bp, Homo sapiens
ccttccccacccgctgaggt

SEQ ID NO: 9024705 - DNA, 19 bp, Homo sapiens
ccttccccttcagcctctg

SEQ ID NO: 9024706 - DNA, 19 bp, Homo sapiens
ccttccccttcagcctctg

SEQ ID NO: 9024707 - DNA, 19 bp, Homo sapiens
ccttccccttcagcctctg

SEQ ID NO: 9024708 - DNA, 19 bp, Homo sapiens
ccttccccttcagcctctg

SEQ ID NO: 9024709 - DNA, 22 bp, Homo sapiens
ccttccccagtgattctctcag

SEQ ID NO: 9024710 - DNA, 22 bp, Homo sapiens
ccttccccaggtgctcactgtc

SEQ ID NO: 9024711 - DNA, 19 bp, Homo sapiens
ccttcctccccagggccat

SEQ ID NO: 9024712 - DNA, 22 bp, Homo sapiens
ccttcctggagcccatgcagat

SEQ ID NO: 9024713 - DNA, 22 bp, Homo sapiens
ccttcctggctgtccgcctgat

SEQ ID NO: 9024714 - DNA, 22 bp, Homo sapiens
ccttccttcaagcacacatcta

SEQ ID NO: 9024715 - DNA, 17 bp, Homo sapiens
ccttcctcatctccttc

SEQ ID NO: 9024716 - DNA, 17 bp, Homo sapiens
ccttcctcatctccttc

SEQ ID NO: 9024717 - DNA, 17 bp, Homo sapiens
ccttcctcatctccttc

SEQ ID NO: 9024718 - DNA, 17 bp, Homo sapiens
ccttcctcatctccttc

SEQ ID NO: 9024719 - DNA, 17 bp, Homo sapiens
ccttcctcatctccttc

SEQ ID NO: 9024720 - DNA, 22 bp, Homo sapiens
ccttcctaacattgccatgaca

SEQ ID NO: 9024721 - DNA, 22 bp, Homo sapiens
ccttcctcatccatttctcttg

SEQ ID NO: 9024722 - DNA, 19 bp, Homo sapiens
ccttccccttcagcctctg

SEQ ID NO: 9024723 - DNA, 19 bp, Homo sapiens
ccttccccttcagcctctg

SEQ ID NO: 9024724 - DNA, 22 bp, Homo sapiens
ccttccctaaagcgtcgcttag

SEQ ID NO: 9024725 - DNA, 21 bp, Homo sapiens
ttacttttgcaccaacctaat

SEQ ID NO: 9024726 - DNA, 21 bp, Homo sapiens
ttacttttgcaccaacctaat

SEQ ID NO: 9024727 - DNA, 22 bp, Homo sapiens
ttacttttgcaccaaactaata

SEQ ID NO: 9024728 - DNA, 22 bp, Homo sapiens
ttacttttgcaccaaactaata

SEQ ID NO: 9024729 - DNA, 21 bp, Homo sapiens
ttacttttgcaccaacctaat

SEQ ID NO: 9024730 - DNA, 22 bp, Homo sapiens
ttacttttgcaccaaactaata

SEQ ID NO: 9024731 - DNA, 22 bp, Homo sapiens
ttacttttgcaccaaactaata

SEQ ID NO: 9024732 - DNA, 22 bp, Homo sapiens
ttacttttgcaccaaactaata

SEQ ID NO: 9024733 - DNA, 21 bp, Homo sapiens
ttactaaacaaaacatgcagg

SEQ ID NO: 9024734 - DNA, 22 bp, Homo sapiens
ttacttttctattcgatatgtg

SEQ ID NO: 9024735 - DNA, 22 bp, Homo sapiens
ttacttttgcaccaaactaata

SEQ ID NO: 9024736 - DNA, 23 bp, Homo sapiens
ttacttttgcaccaacctaatat

SEQ ID NO: 9024737 - DNA, 23 bp, Homo sapiens
ttacttttgcaccaacctaatat

SEQ ID NO: 9024738 - DNA, 21 bp, Homo sapiens
ttacttttgcaccaacctaat

SEQ ID NO: 9024739 - DNA, 23 bp, Homo sapiens
ttacttttgcaccaacctaatat

SEQ ID NO: 9024740 - DNA, 21 bp, Homo sapiens
ttacttttgcagcaacctaat

SEQ ID NO: 9024741 - DNA, 21 bp, Homo sapiens
ttacttttgcagcaacctaat

SEQ ID NO: 9024742 - DNA, 21 bp, Homo sapiens
ttacttttgcagcaacctaat

SEQ ID NO: 9024743 - DNA, 23 bp, Homo sapiens
ttacttttgcaccaacctaatat

SEQ ID NO: 9024744 - DNA, 21 bp, Homo sapiens
ttacttttgcagcaacctaat

SEQ ID NO: 9024745 - DNA, 22 bp, Homo sapiens
ttagaaaaaacgtcttctagtg

SEQ ID NO: 9024746 - DNA, 22 bp, Homo sapiens
ttagaaaaaggctgtggtctta

SEQ ID NO: 9024747 - DNA, 22 bp, Homo sapiens
ccttccttgagaagcaattcct

SEQ ID NO: 9024748 - DNA, 22 bp, Homo sapiens
ccttccttgtctacaaaagctc

SEQ ID NO: 9024749 - DNA, 22 bp, Homo sapiens
ccttccttgtctacaaaagctc

SEQ ID NO: 9024750 - DNA, 22 bp, Homo sapiens
ccttccttgtctacaaaagctc

SEQ ID NO: 9024751 - DNA, 22 bp, Homo sapiens
ccttccttgtctacaaaagctc

SEQ ID NO: 9024752 - DNA, 22 bp, Homo sapiens
ccttccttgagaagcaattcct

SEQ ID NO: 9024753 - DNA, 22 bp, Homo sapiens
ccttcctttcagggctatgcct

SEQ ID NO: 9024754 - DNA, 22 bp, Homo sapiens
ccttcctttcagggctatgcct

SEQ ID NO: 9024755 - DNA, 22 bp, Homo sapiens
ccttcctttgcaggtcaggtca

SEQ ID NO: 9024756 - DNA, 22 bp, Homo sapiens
ccttcctttgcaggtcaggtca

SEQ ID NO: 9024757 - DNA, 22 bp, Homo sapiens
ccttcctttcagggctatgcct

SEQ ID NO: 9024758 - DNA, 22 bp, Homo sapiens
ccttcctttgcatcatttctag

SEQ ID NO: 9024759 - DNA, 22 bp, Homo sapiens
ccttcctttgcaggtcaggtca

SEQ ID NO: 9024760 - DNA, 22 bp, Homo sapiens
ccttctagcaaatcaacataaa

SEQ ID NO: 9024761 - DNA, 22 bp, Homo sapiens
ccttccttttactgtctccgga

SEQ ID NO: 9024762 - DNA, 22 bp, Homo sapiens
ccttccttttactgtctccgga

SEQ ID NO: 9024763 - DNA, 21 bp, Homo sapiens
ttactaaacaaaacatgcagg

SEQ ID NO: 9024764 - DNA, 21 bp, Homo sapiens
ccttctccacagggtctccgg

SEQ ID NO: 9024765 - DNA, 22 bp, Homo sapiens
ccttctagcaaatcaacataaa

SEQ ID NO: 9024766 - DNA, 22 bp, Homo sapiens
ccttctagcctgcgccagggca

SEQ ID NO: 9024767 - DNA, 22 bp, Homo sapiens
ccttctcagccccagctcccgc

SEQ ID NO: 9024768 - DNA, 22 bp, Homo sapiens
ttagaatttctgctcactttga

SEQ ID NO: 9024769 - DNA, 22 bp, Homo sapiens
ttagaatttctgctcactttga

SEQ ID NO: 9024770 - DNA, 22 bp, Homo sapiens
ttagacaagggctccttaaaag

SEQ ID NO: 9024771 - DNA, 22 bp, Homo sapiens
ttagaatgatagagaatttgtt

SEQ ID NO: 9024772 - DNA, 22 bp, Homo sapiens
ttagaatgatagagaatttgtt

SEQ ID NO: 9024773 - DNA, 22 bp, Homo sapiens
cctttattcaattagtcctaat

SEQ ID NO: 9024774 - DNA, 20 bp, Homo sapiens
cctttagaaactcatatgta

SEQ ID NO: 9024775 - DNA, 22 bp, Homo sapiens
cctttacatctgacttctttca

SEQ ID NO: 9024776 - DNA, 22 bp, Homo sapiens
cctttacagtatggttgtatca

SEQ ID NO: 9024777 - DNA, 22 bp, Homo sapiens
cctttacagtatggttgtatca

SEQ ID NO: 9024778 - DNA, 22 bp, Homo sapiens
ttagaatctaacattcttatct

SEQ ID NO: 9024779 - DNA, 22 bp, Homo sapiens
ttagaatctaacattcttatct

SEQ ID NO: 9024780 - DNA, 22 bp, Homo sapiens
ttagaatcttgtatcagaagtt

SEQ ID NO: 9024781 - DNA, 22 bp, Homo sapiens
ttagaatcttgtatcagaagtt

SEQ ID NO: 9024782 - DNA, 22 bp, Homo sapiens
ttagaatctttagagtctcact

SEQ ID NO: 9024783 - DNA, 22 bp, Homo sapiens
ttagaatctttagagtctcact

SEQ ID NO: 9024784 - DNA, 22 bp, Homo sapiens
ttagaatcaggtgttataatca

SEQ ID NO: 9024785 - DNA, 22 bp, Homo sapiens
ttagaatcaggtgttataatca

SEQ ID NO: 9024786 - DNA, 22 bp, Homo sapiens
ttagaatccatggttgcagtgg

SEQ ID NO: 9024787 - DNA, 22 bp, Homo sapiens
ttagaatctaacattcttatct

SEQ ID NO: 9024788 - DNA, 22 bp, Homo sapiens
ttagaagtgggcctatagtcct

SEQ ID NO: 9024789 - DNA, 22 bp, Homo sapiens
ttagaagtggtaagtagaaaga

SEQ ID NO: 9024790 - DNA, 22 bp, Homo sapiens
ttagaatcagaagagaggtatt

SEQ ID NO: 9024791 - DNA, 22 bp, Homo sapiens
ttagaatcagaagagaggtatt

SEQ ID NO: 9024792 - DNA, 22 bp, Homo sapiens
ttagaagttcaggtctgtaatc

SEQ ID NO: 9024793 - DNA, 22 bp, Homo sapiens
ttagaaaacataagtggtaaag

SEQ ID NO: 9024794 - DNA, 22 bp, Homo sapiens
ttagaaaacataagtggtaaag

SEQ ID NO: 9024795 - DNA, 22 bp, Homo sapiens
ttagaaaaatgttcagtagttt

SEQ ID NO: 9024796 - DNA, 22 bp, Homo sapiens
ttagaaaaatgttcagtagttt

SEQ ID NO: 9024797 - DNA, 22 bp, Homo sapiens
ttagaaaaaggctgtggtctta

SEQ ID NO: 9024798 - DNA, 22 bp, Homo sapiens
ttagaaaaaggctgtggtctta

SEQ ID NO: 9024799 - DNA, 22 bp, Homo sapiens
ttagaaaaaggctgtggtctta

SEQ ID NO: 9024800 - DNA, 22 bp, Homo sapiens
ttagaaaaaggctgtggtctta

SEQ ID NO: 9024801 - DNA, 22 bp, Homo sapiens
ttagaaaaatgttcagtagttt

SEQ ID NO: 9024802 - DNA, 22 bp, Homo sapiens
ttagaagtacatttagaacata

SEQ ID NO: 9024803 - DNA, 22 bp, Homo sapiens
ttagaagtacatttagaacata

SEQ ID NO: 9024804 - DNA, 22 bp, Homo sapiens
ttagaagtacataagacaagga

SEQ ID NO: 9024805 - DNA, 22 bp, Homo sapiens
ttagaagtcatctagtctaaaa

SEQ ID NO: 9024806 - DNA, 22 bp, Homo sapiens
ttagaagtcatctagtctaaaa

SEQ ID NO: 9024807 - DNA, 22 bp, Homo sapiens
ttagaagtgaaatagctgtaca

SEQ ID NO: 9024808 - DNA, 22 bp, Homo sapiens
ttagaagtgaaatagctgtaca

SEQ ID NO: 9024809 - DNA, 22 bp, Homo sapiens
ctacagtagagaggatgtagaa

SEQ ID NO: 9024810 - DNA, 22 bp, Homo sapiens
ctacagtactggatgctcagcc

SEQ ID NO: 9024811 - DNA, 22 bp, Homo sapiens
ctacagtagagaggatgtagaa

SEQ ID NO: 9024812 - DNA, 22 bp, Homo sapiens
ctacagtagagtaggcctctga

SEQ ID NO: 9024813 - DNA, 22 bp, Homo sapiens
ctacagtatgaaacctttactc

SEQ ID NO: 9024814 - DNA, 23 bp, Homo sapiens
ctacaggttaattttcagtggaa

SEQ ID NO: 9024815 - DNA, 22 bp, Homo sapiens
ctacaggctcagggagccctct

SEQ ID NO: 9024816 - DNA, 22 bp, Homo sapiens
ctacaggctcagggagccctct

SEQ ID NO: 9024817 - DNA, 22 bp, Homo sapiens
ctacaggaaggatcttgctcaa

SEQ ID NO: 9024818 - DNA, 22 bp, Homo sapiens
ctacagctgtgtgtttatgtgc

SEQ ID NO: 9024819 - DNA, 22 bp, Homo sapiens
ctacaggctcagggagccctct

SEQ ID NO: 9024820 - DNA, 22 bp, Homo sapiens
ctacaggctcagggagccctct

SEQ ID NO: 9024821 - DNA, 22 bp, Homo sapiens
ctacagcagagctacactaact

SEQ ID NO: 9024822 - DNA, 22 bp, Homo sapiens
ctacagctggccttggaaaact

SEQ ID NO: 9024823 - DNA, 22 bp, Homo sapiens
ctacagccagatgcagaaagtt

SEQ ID NO: 9024824 - DNA, 22 bp, Homo sapiens
ctacagcagagctacactaact

SEQ ID NO: 9024825 - DNA, 22 bp, Homo sapiens
ctacagcagagctacactaact

SEQ ID NO: 9024826 - DNA, 22 bp, Homo sapiens
ctacagctgtaaaaggaatgtc

SEQ ID NO: 9024827 - DNA, 22 bp, Homo sapiens
ctacagctgtgtgtttatgtgc

SEQ ID NO: 9024828 - DNA, 22 bp, Homo sapiens
ctacagctgtgtgtttatgtgc

SEQ ID NO: 9024829 - DNA, 22 bp, Homo sapiens
ctacaggaaggatcttgctcaa

SEQ ID NO: 9024830 - DNA, 22 bp, Homo sapiens
ctacagagtgaatgcagaaaat

SEQ ID NO: 9024831 - DNA, 22 bp, Homo sapiens
ctacagagtgaatgcagaaaat

SEQ ID NO: 9024832 - DNA, 22 bp, Homo sapiens
ctacagagtatctaaagaggta

SEQ ID NO: 9024833 - DNA, 22 bp, Homo sapiens
ctacagagtatctaaagaggta

SEQ ID NO: 9024834 - DNA, 22 bp, Homo sapiens
ctacagagtatctaaagaggta

SEQ ID NO: 9024835 - DNA, 21 bp, Homo sapiens
ctacagaggagagggaaaggc

SEQ ID NO: 9024836 - DNA, 22 bp, Homo sapiens
ctacagataatggcccagaaca

SEQ ID NO: 9024837 - DNA, 22 bp, Homo sapiens
ctacagcagagaccagccacat

SEQ ID NO: 9024838 - DNA, 22 bp, Homo sapiens
ctacagcagagaccagccacat

SEQ ID NO: 9024839 - DNA, 22 bp, Homo sapiens
ctacagcagagaccagccacat

SEQ ID NO: 9024840 - DNA, 22 bp, Homo sapiens
ttcctggctcacagcagtgggg

SEQ ID NO: 9024841 - DNA, 22 bp, Homo sapiens
ctacagtctggcaggaatgtta

SEQ ID NO: 9024842 - DNA, 22 bp, Homo sapiens
ctacagtagaggttgtcaggga

SEQ ID NO: 9024843 - DNA, 22 bp, Homo sapiens
ctacagtatgaaacctttactc

SEQ ID NO: 9024844 - DNA, 20 bp, Homo sapiens
ttcctggctctaggaccttg

SEQ ID NO: 9024845 - DNA, 20 bp, Homo sapiens
ttcctggctctaggaccttg

SEQ ID NO: 9024846 - DNA, 22 bp, Homo sapiens
ttcctggctgaactgaactcct

SEQ ID NO: 9024847 - DNA, 22 bp, Homo sapiens
ttcctgggactggagcagccca

SEQ ID NO: 9024848 - DNA, 22 bp, Homo sapiens
ttcctgggactggagcagccca

SEQ ID NO: 9024849 - DNA, 22 bp, Homo sapiens
ttcctggctgtcatgccctagt

SEQ ID NO: 9024850 - DNA, 22 bp, Homo sapiens
ttcctgggaggctgtgtacttg

SEQ ID NO: 9024851 - DNA, 22 bp, Homo sapiens
ttcctgggaggctgtgtacttg

SEQ ID NO: 9024852 - DNA, 22 bp, Homo sapiens
ttcctgggaggctgtgtacttg

SEQ ID NO: 9024853 - DNA, 22 bp, Homo sapiens
ttcctgggagctagccacatct

SEQ ID NO: 9024854 - DNA, 22 bp, Homo sapiens
ttcctgggagctagccacatct

SEQ ID NO: 9024855 - DNA, 22 bp, Homo sapiens
ttcctgggagctagccacatct

SEQ ID NO: 9024856 - DNA, 22 bp, Homo sapiens
ttcctgggactggagcagccca

SEQ ID NO: 9024857 - DNA, 22 bp, Homo sapiens
ttcctgggctctggctggccta

SEQ ID NO: 9024858 - DNA, 22 bp, Homo sapiens
ttcctgggctctggctggccta

SEQ ID NO: 9024859 - DNA, 22 bp, Homo sapiens
ttcctgggctctggctggccta

SEQ ID NO: 9024860 - DNA, 22 bp, Homo sapiens
ttcctgggccttaaatcttttg

SEQ ID NO: 9024861 - DNA, 22 bp, Homo sapiens
ttcctgggccttaaatcttttg

SEQ ID NO: 9024862 - DNA, 22 bp, Homo sapiens
ttcctgggattattgtcaagca

SEQ ID NO: 9024863 - DNA, 22 bp, Homo sapiens
ttcctgggcaggacgagagtct

SEQ ID NO: 9024864 - DNA, 22 bp, Homo sapiens
ttcctgggcaggacgagagtct

SEQ ID NO: 9024865 - DNA, 22 bp, Homo sapiens
ttcctgggcaggacgagagtct

SEQ ID NO: 9024866 - DNA, 22 bp, Homo sapiens
ttccaggatgctgctgcttttt

SEQ ID NO: 9024867 - DNA, 22 bp, Homo sapiens
ttccaggatgctgctgcttttt

SEQ ID NO: 9024868 - DNA, 22 bp, Homo sapiens
ttccaggatggcaataatgaat

SEQ ID NO: 9024869 - DNA, 22 bp, Homo sapiens
ttccaggatggagacactagta

SEQ ID NO: 9024870 - DNA, 22 bp, Homo sapiens
ttccaggatgctgctgcttttt

SEQ ID NO: 9024871 - DNA, 22 bp, Homo sapiens
ttccaggatagctttcaggaat

SEQ ID NO: 9024872 - DNA, 22 bp, Homo sapiens
ttccaggatagctttcaggaat

SEQ ID NO: 9024873 - DNA, 22 bp, Homo sapiens
ttccaggaggcttggcgggagg

SEQ ID NO: 9024874 - DNA, 22 bp, Homo sapiens
ttccaggaggtcaaaggcctgt

SEQ ID NO: 9024875 - DNA, 22 bp, Homo sapiens
ttccaggaggtcaaaggcctgt

SEQ ID NO: 9024876 - DNA, 22 bp, Homo sapiens
ttccaggaggcattcttagttt

SEQ ID NO: 9024877 - DNA, 22 bp, Homo sapiens
ttccaggaggcactgacagagg

SEQ ID NO: 9024878 - DNA, 22 bp, Homo sapiens
ttccaggaggcattcttagttt

SEQ ID NO: 9024879 - DNA, 22 bp, Homo sapiens
ttccaggaggcttggcgggagg

SEQ ID NO: 9024880 - DNA, 22 bp, Homo sapiens
ttccaggaggaggtactagagg

SEQ ID NO: 9024881 - DNA, 22 bp, Homo sapiens
ttccaggaggaggtactagagg

SEQ ID NO: 9024882 - DNA, 22 bp, Homo sapiens
ttccaggaggcactgacagagg

SEQ ID NO: 9024883 - DNA, 22 bp, Homo sapiens
ttccaggaggaggtactagagg

SEQ ID NO: 9024884 - DNA, 22 bp, Homo sapiens
ttccaggaggcactgacagagg

SEQ ID NO: 9024885 - DNA, 22 bp, Homo sapiens
ctacaacaccaggcacggagtg

SEQ ID NO: 9024886 - DNA, 22 bp, Homo sapiens
ctacaacatagtcttctacaga

SEQ ID NO: 9024887 - DNA, 22 bp, Homo sapiens
ctacaacatagtcttctacaga

SEQ ID NO: 9024888 - DNA, 22 bp, Homo sapiens
ctacaacatagtcttctacaga

SEQ ID NO: 9024889 - DNA, 22 bp, Homo sapiens
ctacaacattatgctttctgtc

SEQ ID NO: 9024890 - DNA, 22 bp, Homo sapiens
ctacagagaactcagctgccct

SEQ ID NO: 9024891 - DNA, 22 bp, Homo sapiens
ctacaacatagtcttctacaga

SEQ ID NO: 9024892 - DNA, 22 bp, Homo sapiens
ctacaacaccaggcacggagtg

SEQ ID NO: 9024893 - DNA, 22 bp, Homo sapiens
ctacaacaccaggcacggagtg

SEQ ID NO: 9024894 - DNA, 22 bp, Homo sapiens
ctacaacatagtcttctacaga

SEQ ID NO: 9024895 - DNA, 22 bp, Homo sapiens
ttccaggatggcaataatgaat

SEQ ID NO: 9024896 - DNA, 22 bp, Homo sapiens
ttccaggatgggctgtcctact

SEQ ID NO: 9024897 - DNA, 22 bp, Homo sapiens
ttccaggatggcaataatgaat

SEQ ID NO: 9024898 - DNA, 22 bp, Homo sapiens
ctacagaggacacaaagatctt

SEQ ID NO: 9024899 - DNA, 22 bp, Homo sapiens
ctacagaggacacaaagatctt

SEQ ID NO: 9024900 - DNA, 22 bp, Homo sapiens
ctacagaggacacaaagatctt

SEQ ID NO: 9024901 - DNA, 22 bp, Homo sapiens
ctacagagtatctaaagaggta

SEQ ID NO: 9024902 - DNA, 21 bp, Homo sapiens
ctacagaggagagggaaaggc

SEQ ID NO: 9024903 - DNA, 21 bp, Homo sapiens
ctacagaggagagggaaaggc

SEQ ID NO: 9024904 - DNA, 22 bp, Homo sapiens
ctacagagaattgtgtgatttt

SEQ ID NO: 9024905 - DNA, 22 bp, Homo sapiens
ctacagagaactcagctgccct

SEQ ID NO: 9024906 - DNA, 22 bp, Homo sapiens
ctacagagaactcagctgccct

SEQ ID NO: 9024907 - DNA, 22 bp, Homo sapiens
ttccaggactcgttctggctca

SEQ ID NO: 9024908 - DNA, 22 bp, Homo sapiens
ttccaggactcgttctggctca

SEQ ID NO: 9024909 - DNA, 22 bp, Homo sapiens
ttccaggactcgttctggctca

SEQ ID NO: 9024910 - DNA, 22 bp, Homo sapiens
ttccaggactgggtgtttgaag

SEQ ID NO: 9024911 - DNA, 22 bp, Homo sapiens
ttccaggacttcatggctctga

SEQ ID NO: 9024912 - DNA, 22 bp, Homo sapiens
ttccaggacttcatggctctga

SEQ ID NO: 9024913 - DNA, 22 bp, Homo sapiens
ttccaggactgggtgtttgaag

SEQ ID NO: 9024914 - DNA, 22 bp, Homo sapiens
ttccaggactgggtgtttgaag

SEQ ID NO: 9024915 - DNA, 22 bp, Homo sapiens
ttccaggagccacacaggggcg

SEQ ID NO: 9024916 - DNA, 22 bp, Homo sapiens
ttccaggaggaaagtttgggtg

SEQ ID NO: 9024917 - DNA, 22 bp, Homo sapiens
ttccaggaggaaagtttgggtg

SEQ ID NO: 9024918 - DNA, 22 bp, Homo sapiens
ttccaggaggaaagtttgggtg

SEQ ID NO: 9024919 - DNA, 22 bp, Homo sapiens
ttccaggagccacacaggggcg

SEQ ID NO: 9024920 - DNA, 22 bp, Homo sapiens
ttccaggagacttccagaaata

SEQ ID NO: 9024921 - DNA, 22 bp, Homo sapiens
ttccaggagaggaaacctgatt

SEQ ID NO: 9024922 - DNA, 22 bp, Homo sapiens
ttccaggacttcatggctctga

SEQ ID NO: 9024923 - DNA, 22 bp, Homo sapiens
ttccaggagacttccagaaata

SEQ ID NO: 9024924 - DNA, 22 bp, Homo sapiens
ttccaggaattcagctctcagt

SEQ ID NO: 9024925 - DNA, 22 bp, Homo sapiens
ttccaggaattcagctctcagt

SEQ ID NO: 9024926 - DNA, 22 bp, Homo sapiens
ttccaggaattcagctctcagt

SEQ ID NO: 9024927 - DNA, 22 bp, Homo sapiens
ctaaatgatattttggtttcct

SEQ ID NO: 9024928 - DNA, 22 bp, Homo sapiens
ctaaatgatattttggtttcct

SEQ ID NO: 9024929 - DNA, 22 bp, Homo sapiens
ctaaatgatattttggtttcct

SEQ ID NO: 9024930 - DNA, 22 bp, Homo sapiens
ttccaggaccaggaagagggga

SEQ ID NO: 9024931 - DNA, 22 bp, Homo sapiens
ttccaggaccaggaagagggga

SEQ ID NO: 9024932 - DNA, 22 bp, Homo sapiens
ttccaggactcgttctggctca

SEQ ID NO: 9024933 - DNA, 22 bp, Homo sapiens
ttccaggacaagatgtttcagg

SEQ ID NO: 9024934 - DNA, 22 bp, Homo sapiens
ttccaggacaagatgtttcagg

SEQ ID NO: 9024935 - DNA, 22 bp, Homo sapiens
ttccaggaccaggaagagggga

SEQ ID NO: 9024936 - DNA, 22 bp, Homo sapiens
ctaaatctagtctttactgatt

SEQ ID NO: 9024937 - DNA, 22 bp, Homo sapiens
ctaaatcaggccttacagcttc

SEQ ID NO: 9024938 - DNA, 22 bp, Homo sapiens
ctaaatgacttccagtggttat

SEQ ID NO: 9024939 - DNA, 22 bp, Homo sapiens
ctaaatgacaggtaccatagtg

SEQ ID NO: 9024940 - DNA, 22 bp, Homo sapiens
ctaaatgacaggtaccatagtg

SEQ ID NO: 9024941 - DNA, 22 bp, Homo sapiens
ctagaaaaatactttattgtga

SEQ ID NO: 9024942 - DNA, 22 bp, Homo sapiens
ctagaaaaatactttattgtga

SEQ ID NO: 9024943 - DNA, 22 bp, Homo sapiens
ctagaaacattacatgtgttaa

SEQ ID NO: 9024944 - DNA, 22 bp, Homo sapiens
ctagaaacattacatgtgttaa

SEQ ID NO: 9024945 - DNA, 22 bp, Homo sapiens
ctagaaacgcctttagcacaac

SEQ ID NO: 9024946 - DNA, 22 bp, Homo sapiens
ttctccttttccagttcccagt

SEQ ID NO: 9024947 - DNA, 22 bp, Homo sapiens
ttctccttttccagttcccagt

SEQ ID NO: 9024948 - DNA, 22 bp, Homo sapiens
ttctccttttccagttcccagt

SEQ ID NO: 9024949 - DNA, 22 bp, Homo sapiens
ttctcctttgtaattctcatcc

SEQ ID NO: 9024950 - DNA, 21 bp, Homo sapiens
ctagaaagaatgttgtcgtct

SEQ ID NO: 9024951 - DNA, 22 bp, Homo sapiens
ctagaaactccatctcactaca

SEQ ID NO: 9024952 - DNA, 20 bp, Homo sapiens
ttctctggatagccagatgt

SEQ ID NO: 9024953 - DNA, 21 bp, Homo sapiens
ttctctggataggccagtcct

SEQ ID NO: 9024954 - DNA, 22 bp, Homo sapiens
ttctctggactatttgcactcc

SEQ ID NO: 9024955 - DNA, 22 bp, Homo sapiens
ttctctggagggctgcccggcc

SEQ ID NO: 9024956 - DNA, 22 bp, Homo sapiens
ctagaaaaatactttattgtga

SEQ ID NO: 9024957 - DNA, 22 bp, Homo sapiens
ctagaaaaatactttattgtga

SEQ ID NO: 9024958 - DNA, 22 bp, Homo sapiens
ctactttacctccatcagactg

SEQ ID NO: 9024959 - DNA, 22 bp, Homo sapiens
ctacttgttcactgtaggtcgc

SEQ ID NO: 9024960 - DNA, 22 bp, Homo sapiens
ctacttgttcactgtaggtcgc

SEQ ID NO: 9024961 - DNA, 22 bp, Homo sapiens
ctacttggtacctgaagatcgg

SEQ ID NO: 9024962 - DNA, 22 bp, Homo sapiens
ctacttctgtgatgaaactaca

SEQ ID NO: 9024963 - DNA, 21 bp, Homo sapiens
ctacttaagtaggggattagg

SEQ ID NO: 9024964 - DNA, 22 bp, Homo sapiens
ctacttagagacatgctaacat

SEQ ID NO: 9024965 - DNA, 22 bp, Homo sapiens
ctacttatgggtggtaccagca

SEQ ID NO: 9024966 - DNA, 21 bp, Homo sapiens
ctacttaagtaggggattagg

SEQ ID NO: 9024967 - DNA, 22 bp, Homo sapiens
ttcctgggctttcccctctggt

SEQ ID NO: 9024968 - DNA, 22 bp, Homo sapiens
ttcctgggctttcccctctggt

SEQ ID NO: 9024969 - DNA, 22 bp, Homo sapiens
ctacatttacacagttaggctt

SEQ ID NO: 9024970 - DNA, 22 bp, Homo sapiens
ctacccaggctggagtgcagta

SEQ ID NO: 9024971 - DNA, 22 bp, Homo sapiens
ctacatttcatccagggagagc

SEQ ID NO: 9024972 - DNA, 22 bp, Homo sapiens
ctacatttcatccagggagagc

SEQ ID NO: 9024973 - DNA, 22 bp, Homo sapiens
ttcctgggctgcagagagcacc

SEQ ID NO: 9024974 - DNA, 22 bp, Homo sapiens
ttcctgggctgcagagagcacc

SEQ ID NO: 9024975 - DNA, 22 bp, Homo sapiens
ttcctgggctgcagagagcacc

SEQ ID NO: 9024976 - DNA, 22 bp, Homo sapiens
ttcctgggctgcagagagcacc

SEQ ID NO: 9024977 - DNA, 22 bp, Homo sapiens
ttcctgggctgcagagagcacc

SEQ ID NO: 9024978 - DNA, 22 bp, Homo sapiens
ctaccctgtatttagagatgca

SEQ ID NO: 9024979 - DNA, 22 bp, Homo sapiens
ctacccaggcttagagggctgg

SEQ ID NO: 9024980 - DNA, 22 bp, Homo sapiens
ctacccaggcttagagggctgg

SEQ ID NO: 9024981 - DNA, 16 bp, Homo sapiens
ctacccagtgagaagg

SEQ ID NO: 9024982 - DNA, 22 bp, Homo sapiens
ctacccaggcttagagggctgg

SEQ ID NO: 9024983 - DNA, 22 bp, Homo sapiens
ctacccaggcttagagggctgg

SEQ ID NO: 9024984 - DNA, 22 bp, Homo sapiens
ctacccaggctggagtgcagta

SEQ ID NO: 9024985 - DNA, 22 bp, Homo sapiens
ctacccttaagtttctgtgggg

SEQ ID NO: 9024986 - DNA, 22 bp, Homo sapiens
ctacccttaagtttctgtgggg

SEQ ID NO: 9024987 - DNA, 22 bp, Homo sapiens
ctaccgggttctcagccaggca

SEQ ID NO: 9024988 - DNA, 22 bp, Homo sapiens
ctacccttaagtttctgtgggg

SEQ ID NO: 9024989 - DNA, 22 bp, Homo sapiens
ctacctgaaaaggttgtggtga

SEQ ID NO: 9024990 - DNA, 22 bp, Homo sapiens
ctactgaaactcagaaattcaa

SEQ ID NO: 9024991 - DNA, 22 bp, Homo sapiens
ctactgaagataactggctctt

SEQ ID NO: 9024992 - DNA, 22 bp, Homo sapiens
ctactgaaactcagaaattcaa

SEQ ID NO: 9024993 - DNA, 22 bp, Homo sapiens
ctactgagtccttcagctgcca

SEQ ID NO: 9024994 - DNA, 22 bp, Homo sapiens
ctactgaagataactggctctt

SEQ ID NO: 9024995 - DNA, 22 bp, Homo sapiens
ctactgaattagactgcatttt

SEQ ID NO: 9024996 - DNA, 22 bp, Homo sapiens
ctactgaattagactgcatttt

SEQ ID NO: 9024997 - DNA, 22 bp, Homo sapiens
ctaccttcaagttcctccctct

SEQ ID NO: 9024998 - DNA, 22 bp, Homo sapiens
ctacctttctgactcttgggat

SEQ ID NO: 9024999 - DNA, 22 bp, Homo sapiens
ctactagatcagtatgcctcaa

SEQ ID NO: 9025000 - DNA, 22 bp, Homo sapiens
ctactctcccatgattctctgt

SEQ ID NO: 9025001 - DNA, 22 bp, Homo sapiens
ctactggccatctgatctacaa

SEQ ID NO: 9025002 - DNA, 22 bp, Homo sapiens
ctactgccattgtctctgccat

SEQ ID NO: 9025003 - DNA, 23 bp, Homo sapiens
ctactgccttgcacaggctagat

SEQ ID NO: 9025004 - DNA, 22 bp, Homo sapiens
ctactgtaatagatgaatttga

SEQ ID NO: 9025005 - DNA, 22 bp, Homo sapiens
ctactgccattgtctctgccat

SEQ ID NO: 9025006 - DNA, 22 bp, Homo sapiens
ctactgtagtggcctatttacc

SEQ ID NO: 9025007 - DNA, 22 bp, Homo sapiens
ctactgtctcatcagtgttatt

SEQ ID NO: 9025008 - DNA, 21 bp, Homo sapiens
ctactgtgagacacaaagtgc

SEQ ID NO: 9025009 - DNA, 22 bp, Homo sapiens
ctatggaagggatgcaaagaaa

SEQ ID NO: 9025010 - DNA, 22 bp, Homo sapiens
ctatggaagggatgcaaagaaa

SEQ ID NO: 9025011 - DNA, 22 bp, Homo sapiens
ctatggaagggatgcaaagaaa

SEQ ID NO: 9025012 - DNA, 22 bp, Homo sapiens
ctatggaaactcaacatttgtt

SEQ ID NO: 9025013 - DNA, 22 bp, Homo sapiens
ctatggaaacctaatcaggaga

SEQ ID NO: 9025014 - DNA, 22 bp, Homo sapiens
ctatggaaacctaatcaggaga

SEQ ID NO: 9025015 - DNA, 22 bp, Homo sapiens
ctatggaaactcaacatttgtt

SEQ ID NO: 9025016 - DNA, 22 bp, Homo sapiens
ctatggcatgtcacctgctgag

SEQ ID NO: 9025017 - DNA, 23 bp, Homo sapiens
ctatggaataccaatgattctca

SEQ ID NO: 9025018 - DNA, 23 bp, Homo sapiens
ctatggaataccaatgattctca

SEQ ID NO: 9025019 - DNA, 22 bp, Homo sapiens
ctatgcagaatttagtgactta

SEQ ID NO: 9025020 - DNA, 22 bp, Homo sapiens
ctatgagaagaaaacaagatta

SEQ ID NO: 9025021 - DNA, 22 bp, Homo sapiens
ctatatatatcatcttccagtt

SEQ ID NO: 9025022 - DNA, 22 bp, Homo sapiens
ctatggtgatagaaatcagaat

SEQ ID NO: 9025023 - DNA, 22 bp, Homo sapiens
ctatggtgatagaaatcagaat

SEQ ID NO: 9025024 - DNA, 22 bp, Homo sapiens
ctatggctcaattctagtggtt

SEQ ID NO: 9025025 - DNA, 22 bp, Homo sapiens
ctattaaacactactgtgcact

SEQ ID NO: 9025026 - DNA, 22 bp, Homo sapiens
ctatgttctcggcactatggat

SEQ ID NO: 9025027 - DNA, 22 bp, Homo sapiens
ctatgttctcggcactatggat

SEQ ID NO: 9025028 - DNA, 22 bp, Homo sapiens
ctattaaacactactgtgcact

SEQ ID NO: 9025029 - DNA, 22 bp, Homo sapiens
ctattaaacactactgtgcact

SEQ ID NO: 9025030 - DNA, 22 bp, Homo sapiens
ctattaaatactcttcaaattg

SEQ ID NO: 9025031 - DNA, 22 bp, Homo sapiens
ctattaaatactcttcaaattg

SEQ ID NO: 9025032 - DNA, 22 bp, Homo sapiens
ctattaaatactcttcaaattg

SEQ ID NO: 9025033 - DNA, 22 bp, Homo sapiens
ctattaaatactcttcaaattg

SEQ ID NO: 9025034 - DNA, 22 bp, Homo sapiens
ctattacaatctgctactatga

SEQ ID NO: 9025035 - DNA, 22 bp, Homo sapiens
ctattacaatctgctactatga

SEQ ID NO: 9025036 - DNA, 22 bp, Homo sapiens
ctattacaatctgctactatga

SEQ ID NO: 9025037 - DNA, 22 bp, Homo sapiens
ctattacaatctgctactatga

SEQ ID NO: 9025038 - DNA, 22 bp, Homo sapiens
ctattaaatactcttcaaattg

SEQ ID NO: 9025039 - DNA, 22 bp, Homo sapiens
ctattaaatactcttcaaattg

SEQ ID NO: 9025040 - DNA, 22 bp, Homo sapiens
ctattacaatctgctactatga

SEQ ID NO: 9025041 - DNA, 22 bp, Homo sapiens
ctattaaatactcttcaaattg

SEQ ID NO: 9025042 - DNA, 22 bp, Homo sapiens
ttctctggatgtttctcagtca

SEQ ID NO: 9025043 - DNA, 22 bp, Homo sapiens
ttctctggccatagctggctag

SEQ ID NO: 9025044 - DNA, 22 bp, Homo sapiens
ttctctggcctgaggcgaggcc

SEQ ID NO: 9025045 - DNA, 22 bp, Homo sapiens
ctagcacagtatggtatcagat

SEQ ID NO: 9025046 - DNA, 22 bp, Homo sapiens
ctagcacagtatggtatcagat

SEQ ID NO: 9025047 - DNA, 22 bp, Homo sapiens
ctagcacagtatggtatcagat

SEQ ID NO: 9025048 - DNA, 22 bp, Homo sapiens
ctagatttgcatgcctacacca

SEQ ID NO: 9025049 - DNA, 22 bp, Homo sapiens
ctagatttgcatgcctacacca

SEQ ID NO: 9025050 - DNA, 22 bp, Homo sapiens
ctagcaagcctaccacgaaact

SEQ ID NO: 9025051 - DNA, 22 bp, Homo sapiens
ctagatttctagttcattatcc

SEQ ID NO: 9025052 - DNA, 23 bp, Homo sapiens
ctagatgcaagctccatgaggga

SEQ ID NO: 9025053 - DNA, 22 bp, Homo sapiens
ttctctggcggtgtgttttcct

SEQ ID NO: 9025054 - DNA, 21 bp, Homo sapiens
ttctctggcttctgtagctgg

SEQ ID NO: 9025055 - DNA, 22 bp, Homo sapiens
ctagcaggtcaaaccagctgat

SEQ ID NO: 9025056 - DNA, 22 bp, Homo sapiens
ctagcagtgtactcaacaaggg

SEQ ID NO: 9025057 - DNA, 22 bp, Homo sapiens
ctagcatcagatgagaagctgt

SEQ ID NO: 9025058 - DNA, 22 bp, Homo sapiens
ctagcatcagatgagaagctgt

SEQ ID NO: 9025059 - DNA, 22 bp, Homo sapiens
ctagcatcagatgagaagctgt

SEQ ID NO: 9025060 - DNA, 22 bp, Homo sapiens
ctagccagactcaagggccacc

SEQ ID NO: 9025061 - DNA, 22 bp, Homo sapiens
ctagccagactcaagggccacc

SEQ ID NO: 9025062 - DNA, 22 bp, Homo sapiens
ctagccagatgattcccaaata

SEQ ID NO: 9025063 - DNA, 22 bp, Homo sapiens
ctagcagggtcgacgtctggcg

SEQ ID NO: 9025064 - DNA, 22 bp, Homo sapiens
ctagccagatgattcccaaata

SEQ ID NO: 9025065 - DNA, 22 bp, Homo sapiens
ctagccagatttaaagagagac

SEQ ID NO: 9025066 - DNA, 22 bp, Homo sapiens
ctagccagatttaaagagagac

SEQ ID NO: 9025067 - DNA, 22 bp, Homo sapiens
ctagccagatttaaagagagac

SEQ ID NO: 9025068 - DNA, 22 bp, Homo sapiens
ctatatacttttcacagatgtt

SEQ ID NO: 9025069 - DNA, 22 bp, Homo sapiens
ctatatatatcatcttccagtt

SEQ ID NO: 9025070 - DNA, 22 bp, Homo sapiens
ctatatacttttcacagatgtt

SEQ ID NO: 9025071 - DNA, 22 bp, Homo sapiens
ctagcagcattcttctagttag

SEQ ID NO: 9025072 - DNA, 22 bp, Homo sapiens
ctagcagcattcttctagttag

SEQ ID NO: 9025073 - DNA, 22 bp, Homo sapiens
ctagcagctctgatatttacaa

SEQ ID NO: 9025074 - DNA, 22 bp, Homo sapiens
ctagcagcatcacaggaagact

SEQ ID NO: 9025075 - DNA, 22 bp, Homo sapiens
ctagcagcatcacaggaagact

SEQ ID NO: 9025076 - DNA, 21 bp, Homo sapiens
ctagcacgattccaagtaata

SEQ ID NO: 9025077 - DNA, 22 bp, Homo sapiens
ctagcagcatcacaggaagact

SEQ ID NO: 9025078 - DNA, 22 bp, Homo sapiens
ctagcaggtcaaaccagctgat

SEQ ID NO: 9025079 - DNA, 22 bp, Homo sapiens
ctagcagggtcgacgtctggcg

SEQ ID NO: 9025080 - DNA, 22 bp, Homo sapiens
ctagcagggtcgacgtctggcg

SEQ ID NO: 9025081 - DNA, 22 bp, Homo sapiens
ctagcaggtcaaaccagctgat

SEQ ID NO: 9025082 - DNA, 22 bp, Homo sapiens
ctagcagggattgggcactggg

SEQ ID NO: 9025083 - DNA, 22 bp, Homo sapiens
ctagcagggattgggcactggg

SEQ ID NO: 9025084 - DNA, 22 bp, Homo sapiens
ctagcaggctaatgtaagcttg

SEQ ID NO: 9025085 - DNA, 22 bp, Homo sapiens
ctagcaggctaatgtaagcttg

SEQ ID NO: 9025086 - DNA, 22 bp, Homo sapiens
ctagcagctctgatatttacaa

SEQ ID NO: 9025087 - DNA, 22 bp, Homo sapiens
ctagcagcattcttctagttag

SEQ ID NO: 9025088 - DNA, 22 bp, Homo sapiens
ctagcagctctgatatttacaa

SEQ ID NO: 9025089 - DNA, 22 bp, Homo sapiens
ctattattaatgtggggctttg

SEQ ID NO: 9025090 - DNA, 22 bp, Homo sapiens
ctattagacacaattagtgatt

SEQ ID NO: 9025091 - DNA, 22 bp, Homo sapiens
ctattagacacaattagtgatt

SEQ ID NO: 9025092 - DNA, 22 bp, Homo sapiens
ctattagaaagcatcttctata

SEQ ID NO: 9025093 - DNA, 22 bp, Homo sapiens
ctattagaaagcatcttctata

SEQ ID NO: 9025094 - DNA, 22 bp, Homo sapiens
ctattagacacaattagtgatt

SEQ ID NO: 9025095 - DNA, 22 bp, Homo sapiens
ctattactgacttctgtattta

SEQ ID NO: 9025096 - DNA, 22 bp, Homo sapiens
ctattagaaagcatcttctata

SEQ ID NO: 9025097 - DNA, 22 bp, Homo sapiens
ctattagaaagcatcttctata

SEQ ID NO: 9025098 - DNA, 22 bp, Homo sapiens
ctcaaaatccataaaatcaggt

SEQ ID NO: 9025099 - DNA, 22 bp, Homo sapiens
ctcaaaatccataaaatcaggt

SEQ ID NO: 9025100 - DNA, 22 bp, Homo sapiens
ctattatttcctcatctataaa

SEQ ID NO: 9025101 - DNA, 22 bp, Homo sapiens
ctatttttctgtaccctaattt

SEQ ID NO: 9025102 - DNA, 22 bp, Homo sapiens
ctattattatcctaatttctgt

SEQ ID NO: 9025103 - DNA, 22 bp, Homo sapiens
ctattattagcaaaaggtggat

SEQ ID NO: 9025104 - DNA, 22 bp, Homo sapiens
ctattattatgttaactggact

SEQ ID NO: 9025105 - DNA, 22 bp, Homo sapiens
ctattatttcctcatctataaa

SEQ ID NO: 9025106 - DNA, 22 bp, Homo sapiens
ctattattatgttaactggact

SEQ ID NO: 9025107 - DNA, 22 bp, Homo sapiens
ctcaagtaaacattctagagat

SEQ ID NO: 9025108 - DNA, 20 bp, Homo sapiens
ctcaagtaaggttataaggt

SEQ ID NO: 9025109 - DNA, 22 bp, Homo sapiens
ctcaagtaagaaacagaattgg

SEQ ID NO: 9025110 - DNA, 22 bp, Homo sapiens
ctcaagtttcatatttgtctag

SEQ ID NO: 9025111 - DNA, 22 bp, Homo sapiens
ctcaagttggcatgaacaaatt

SEQ ID NO: 9025112 - DNA, 22 bp, Homo sapiens
ctcaaaatccataaaatcaggt

SEQ ID NO: 9025113 - DNA, 22 bp, Homo sapiens
ctcaagagatataaaaatgtgg

SEQ ID NO: 9025114 - DNA, 22 bp, Homo sapiens
ctcaagactgatcgcagtggaa

SEQ ID NO: 9025115 - DNA, 22 bp, Homo sapiens
ctcaagactgatcgcagtggaa

SEQ ID NO: 9025116 - DNA, 22 bp, Homo sapiens
ctcaagaggatatgtccagaaa

SEQ ID NO: 9025117 - DNA, 22 bp, Homo sapiens
ctcaaggaaagtctggagaaga

SEQ ID NO: 9025118 - DNA, 22 bp, Homo sapiens
ctcaaggaaagtctggagaaga

SEQ ID NO: 9025119 - DNA, 22 bp, Homo sapiens
ctcaaggacttattcatgcctg

SEQ ID NO: 9025120 - DNA, 22 bp, Homo sapiens
ctcaagcctgctgagttttgga

SEQ ID NO: 9025121 - DNA, 22 bp, Homo sapiens
ctcacagcaaggaggtaaggta

SEQ ID NO: 9025122 - DNA, 22 bp, Homo sapiens
ctcacagcagccagtctgcctt

SEQ ID NO: 9025123 - DNA, 22 bp, Homo sapiens
ctcacagcacttgtgtcattgg

SEQ ID NO: 9025124 - DNA, 22 bp, Homo sapiens
ctcacagcagccagtctgcctt

SEQ ID NO: 9025125 - DNA, 22 bp, Homo sapiens
ctcacagcagctctgcgagata

SEQ ID NO: 9025126 - DNA, 22 bp, Homo sapiens
ctcacagcagctctgcgagata

SEQ ID NO: 9025127 - DNA, 22 bp, Homo sapiens
ctcacagctgcttcaggatcca

SEQ ID NO: 9025128 - DNA, 22 bp, Homo sapiens
ctcacagcatggaattttctgg

SEQ ID NO: 9025129 - DNA, 22 bp, Homo sapiens
ctcacagcatggaattttctgg

SEQ ID NO: 9025130 - DNA, 22 bp, Homo sapiens
ctcacaggagaaagtcatggtc

SEQ ID NO: 9025131 - DNA, 22 bp, Homo sapiens
ctcacaggagaaagtcatggtc

SEQ ID NO: 9025132 - DNA, 22 bp, Homo sapiens
ctcacaggagaaagtcatggtc

SEQ ID NO: 9025133 - DNA, 22 bp, Homo sapiens
ctcacaggagaaagtcatggtc

SEQ ID NO: 9025134 - DNA, 22 bp, Homo sapiens
ctcacaggagaaagtcatggtc

SEQ ID NO: 9025135 - DNA, 22 bp, Homo sapiens
ctcacaggcatctcatcaggct

SEQ ID NO: 9025136 - DNA, 22 bp, Homo sapiens
ctcacaggcatctcatcaggct

SEQ ID NO: 9025137 - DNA, 21 bp, Homo sapiens
ctcacaggatgcagtgttact

SEQ ID NO: 9025138 - DNA, 22 bp, Homo sapiens
ctcacaggcatctcatcaggct

SEQ ID NO: 9025139 - DNA, 22 bp, Homo sapiens
ctcacagggttctatcgaagag

SEQ ID NO: 9025140 - DNA, 22 bp, Homo sapiens
ctcacaggcggtaattcaggga

SEQ ID NO: 9025141 - DNA, 22 bp, Homo sapiens
ctcacaggcggtaattcaggga

SEQ ID NO: 9025142 - DNA, 22 bp, Homo sapiens
ctcacaggtaccagcaccctcc

SEQ ID NO: 9025143 - DNA, 22 bp, Homo sapiens
ctcacaggtaccagcaccctcc

SEQ ID NO: 9025144 - DNA, 22 bp, Homo sapiens
ctcacagggttctatcgaagag

SEQ ID NO: 9025145 - DNA, 22 bp, Homo sapiens
ctcacaggtcatgtggtggctt

SEQ ID NO: 9025146 - DNA, 22 bp, Homo sapiens
ctcacaggtcatgtggtggctt

SEQ ID NO: 9025147 - DNA, 22 bp, Homo sapiens
ctcacaggttagttgtgtggat

SEQ ID NO: 9025148 - DNA, 22 bp, Homo sapiens
ctcacaggtagaataacaacat

SEQ ID NO: 9025149 - DNA, 22 bp, Homo sapiens
ctcacaggtagaataacaacat

SEQ ID NO: 9025150 - DNA, 22 bp, Homo sapiens
ctcacaggtcatgtggtggctt

SEQ ID NO: 9025151 - DNA, 22 bp, Homo sapiens
ctcacagatctgtgcctgaacc

SEQ ID NO: 9025152 - DNA, 22 bp, Homo sapiens
ctcacagatatttgcttcaggt

SEQ ID NO: 9025153 - DNA, 22 bp, Homo sapiens
ctcacagatctgtgcctgaacc

SEQ ID NO: 9025154 - DNA, 22 bp, Homo sapiens
ctcacagagctcatactgggag

SEQ ID NO: 9025155 - DNA, 22 bp, Homo sapiens
ctcacagatacggctattcctg

SEQ ID NO: 9025156 - DNA, 22 bp, Homo sapiens
ctcacagatatttgcttcaggt

SEQ ID NO: 9025157 - DNA, 22 bp, Homo sapiens
ctcacagatgtcctggcacttc

SEQ ID NO: 9025158 - DNA, 22 bp, Homo sapiens
ctcacagatgtcctggcacttc

SEQ ID NO: 9025159 - DNA, 22 bp, Homo sapiens
ctcacagatgctgtgggtcagg

SEQ ID NO: 9025160 - DNA, 22 bp, Homo sapiens
ctcacagatgctgtgggtcagg

SEQ ID NO: 9025161 - DNA, 22 bp, Homo sapiens
ctcacaatttttcagtgactat

SEQ ID NO: 9025162 - DNA, 22 bp, Homo sapiens
ctcaatgagggaaggacagagg

SEQ ID NO: 9025163 - DNA, 22 bp, Homo sapiens
ctcacacacgaagcccttggcc

SEQ ID NO: 9025164 - DNA, 22 bp, Homo sapiens
ctcaatgagaggctttggaaag

SEQ ID NO: 9025165 - DNA, 22 bp, Homo sapiens
ctcaatatgccagaggggaaag

SEQ ID NO: 9025166 - DNA, 22 bp, Homo sapiens
ctcaatgtagacctcaacatat

SEQ ID NO: 9025167 - DNA, 22 bp, Homo sapiens
ctcacagagcctctgtgtcttc

SEQ ID NO: 9025168 - DNA, 22 bp, Homo sapiens
ctcacagagcctctgtgtcttc

SEQ ID NO: 9025169 - DNA, 22 bp, Homo sapiens
ctcacagagctcatactgggag

SEQ ID NO: 9025170 - DNA, 22 bp, Homo sapiens
ctcacagatacggctattcctg

SEQ ID NO: 9025171 - DNA, 22 bp, Homo sapiens
ctcacagagcctctgtgtcttc

SEQ ID NO: 9025172 - DNA, 22 bp, Homo sapiens
cctttccccgcgggaggtgcca

SEQ ID NO: 9025173 - DNA, 22 bp, Homo sapiens
cctttcccgctttgagggcaag

SEQ ID NO: 9025174 - DNA, 22 bp, Homo sapiens
cctttcctgcctcaggaagtag

SEQ ID NO: 9025175 - DNA, 22 bp, Homo sapiens
cctttcctgcctcaggaagtag

SEQ ID NO: 9025176 - DNA, 18 bp, Homo sapiens
cctttcctcccctcagct

SEQ ID NO: 9025177 - DNA, 19 bp, Homo sapiens
cctttcagaacagaagcca

SEQ ID NO: 9025178 - DNA, 22 bp, Homo sapiens
cctttcaaaacagaacactagc

SEQ ID NO: 9025179 - DNA, 22 bp, Homo sapiens
cctttcctgcctcaggaagtag

SEQ ID NO: 9025180 - DNA, 22 bp, Homo sapiens
cctttcctgtgtccttttaagg

SEQ ID NO: 9025181 - DNA, 22 bp, Homo sapiens
cctttcctttttagtgtgggag

SEQ ID NO: 9025182 - DNA, 22 bp, Homo sapiens
cctttctcattttaagcattag

SEQ ID NO: 9025183 - DNA, 22 bp, Homo sapiens
cctttctacagatgcctcttgc

SEQ ID NO: 9025184 - DNA, 22 bp, Homo sapiens
cctttctctatcgacccatcgc

SEQ ID NO: 9025185 - DNA, 16 bp, Homo sapiens
cctttctctgccttcc

SEQ ID NO: 9025186 - DNA, 16 bp, Homo sapiens
cctttctctgccttcc

SEQ ID NO: 9025187 - DNA, 22 bp, Homo sapiens
cctttctctatcgacccatcgc

SEQ ID NO: 9025188 - DNA, 22 bp, Homo sapiens
ttaggacaagataaaacacaag

SEQ ID NO: 9025189 - DNA, 22 bp, Homo sapiens
ttaggaatttatcacagactgg

SEQ ID NO: 9025190 - DNA, 22 bp, Homo sapiens
ttaggaatttatcacagactgg

SEQ ID NO: 9025191 - DNA, 22 bp, Homo sapiens
ttaggaatgagatttctagtga

SEQ ID NO: 9025192 - DNA, 22 bp, Homo sapiens
ttaggaatttatcacagactgg

SEQ ID NO: 9025193 - DNA, 22 bp, Homo sapiens
ttaggaatgagatttctagtga

SEQ ID NO: 9025194 - DNA, 22 bp, Homo sapiens
ttaggaatgagatttctagtga

SEQ ID NO: 9025195 - DNA, 22 bp, Homo sapiens
ttaggaatcacctgcagatctt

SEQ ID NO: 9025196 - DNA, 22 bp, Homo sapiens
ttaggaatatgtattttaaagt

SEQ ID NO: 9025197 - DNA, 22 bp, Homo sapiens
ttaggaatatgtattttaaagt

SEQ ID NO: 9025198 - DNA, 22 bp, Homo sapiens
ttaggaatattttctgagtagt

SEQ ID NO: 9025199 - DNA, 22 bp, Homo sapiens
ttaggaagtttcagaaaatgca

SEQ ID NO: 9025200 - DNA, 22 bp, Homo sapiens
ttaggaatatagactaagtaga

SEQ ID NO: 9025201 - DNA, 18 bp, Homo sapiens
ttaggaagtttctccgtc

SEQ ID NO: 9025202 - DNA, 22 bp, Homo sapiens
ttaggaagttatagtggaaatg

SEQ ID NO: 9025203 - DNA, 22 bp, Homo sapiens
ttaggaagttatagtggaaatg

SEQ ID NO: 9025204 - DNA, 22 bp, Homo sapiens
ttaggaagtttcagaaaatgca

SEQ ID NO: 9025205 - DNA, 22 bp, Homo sapiens
ttaggaagtgtgtccagaagcg

SEQ ID NO: 9025206 - DNA, 22 bp, Homo sapiens
ttaggaagtgtgtccagaagcg

SEQ ID NO: 9025207 - DNA, 22 bp, Homo sapiens
cctttctcttggataccgattg

SEQ ID NO: 9025208 - DNA, 17 bp, Homo sapiens
cctttctctttcatctc

SEQ ID NO: 9025209 - DNA, 17 bp, Homo sapiens
cctttctctttcatctc

SEQ ID NO: 9025210 - DNA, 22 bp, Homo sapiens
cctttctctggcagcaggacag

SEQ ID NO: 9025211 - DNA, 22 bp, Homo sapiens
cctttctctatcgacccatcgc

SEQ ID NO: 9025212 - DNA, 22 bp, Homo sapiens
cctttctctggcagcaggacag

SEQ ID NO: 9025213 - DNA, 22 bp, Homo sapiens
cctttctctttgctgatcatgt

SEQ ID NO: 9025214 - DNA, 22 bp, Homo sapiens
cctttctctttgctgatcatgt

SEQ ID NO: 9025215 - DNA, 17 bp, Homo sapiens
cctttctctttcatctc

SEQ ID NO: 9025216 - DNA, 17 bp, Homo sapiens
cctttctctttcatctc

SEQ ID NO: 9025217 - DNA, 22 bp, Homo sapiens
ttaggaaggacttggattctgg

SEQ ID NO: 9025218 - DNA, 22 bp, Homo sapiens
ttaggaaggccttgaatgccag

SEQ ID NO: 9025219 - DNA, 20 bp, Homo sapiens
ttaggaagtcacaatttcag

SEQ ID NO: 9025220 - DNA, 23 bp, Homo sapiens
cgcccagcctcagtgacctgggc

SEQ ID NO: 9025221 - DNA, 22 bp, Homo sapiens
cgccaggcttggtagctcatgc

SEQ ID NO: 9025222 - DNA, 22 bp, Homo sapiens
cgcatgagacctgccggccatc

SEQ ID NO: 9025223 - DNA, 22 bp, Homo sapiens
cgccaggcttggtagctcatgc

SEQ ID NO: 9025224 - DNA, 22 bp, Homo sapiens
cgccaggcttggtagctcatgc

SEQ ID NO: 9025225 - DNA, 22 bp, Homo sapiens
cgcatccagggcgcaggatctg

SEQ ID NO: 9025226 - DNA, 22 bp, Homo sapiens
cgcatacatagaaacacacaga

SEQ ID NO: 9025227 - DNA, 22 bp, Homo sapiens
cgcagtgagtctgtaaaaggct

SEQ ID NO: 9025228 - DNA, 22 bp, Homo sapiens
cgcagctggatatcatgtgcct

SEQ ID NO: 9025229 - DNA, 22 bp, Homo sapiens
cgcagctggatatcatgtgcct

SEQ ID NO: 9025230 - DNA, 22 bp, Homo sapiens
cgcagctgctgctctgaaacag

SEQ ID NO: 9025231 - DNA, 22 bp, Homo sapiens
cgcagctgccttgtcagccgtt

SEQ ID NO: 9025232 - DNA, 22 bp, Homo sapiens
ttaggcttcatgtgcagaggat

SEQ ID NO: 9025233 - DNA, 22 bp, Homo sapiens
ttaggcttccggcaggcggcgc

SEQ ID NO: 9025234 - DNA, 22 bp, Homo sapiens
ttaggctgttcttgtgttgtta

SEQ ID NO: 9025235 - DNA, 22 bp, Homo sapiens
ttaggctgttcttgtgttgtta

SEQ ID NO: 9025236 - DNA, 22 bp, Homo sapiens
ttaggctgttcttgtgttgtta

SEQ ID NO: 9025237 - DNA, 22 bp, Homo sapiens
ttaggctgttcttgtgttgtta

SEQ ID NO: 9025238 - DNA, 22 bp, Homo sapiens
ttaggctgggctacaacaactg

SEQ ID NO: 9025239 - DNA, 22 bp, Homo sapiens
ttaggctctctgcaactaagta

SEQ ID NO: 9025240 - DNA, 22 bp, Homo sapiens
ttaggcctttgattggggtgct

SEQ ID NO: 9025241 - DNA, 22 bp, Homo sapiens
ttaggcaatttgatttttcaag

SEQ ID NO: 9025242 - DNA, 21 bp, Homo sapiens
ttaggcactgcaattttatgc

SEQ ID NO: 9025243 - DNA, 22 bp, Homo sapiens
ttaggcacttgctttgtgttca

SEQ ID NO: 9025244 - DNA, 22 bp, Homo sapiens
ttaggatttgaaaaggggcaga

SEQ ID NO: 9025245 - DNA, 22 bp, Homo sapiens
ttaggatttgaaaaggggcaga

SEQ ID NO: 9025246 - DNA, 22 bp, Homo sapiens
ttcaagtttactttgaagttta

SEQ ID NO: 9025247 - DNA, 22 bp, Homo sapiens
ttcaagttgtgttttccgggct

SEQ ID NO: 9025248 - DNA, 22 bp, Homo sapiens
ttcaagtttgtatttctgtatt

SEQ ID NO: 9025249 - DNA, 22 bp, Homo sapiens
ttcaagttttcagaatagccac

SEQ ID NO: 9025250 - DNA, 22 bp, Homo sapiens
ttcaagttttcagaatagccac

SEQ ID NO: 9025251 - DNA, 22 bp, Homo sapiens
ttcaagttttatattgaagcaa

SEQ ID NO: 9025252 - DNA, 22 bp, Homo sapiens
ttcaagttttatatccatggct

SEQ ID NO: 9025253 - DNA, 22 bp, Homo sapiens
ttcaagttaatgattctggttt

SEQ ID NO: 9025254 - DNA, 20 bp, Homo sapiens
ttcaagttgggtctctggct

SEQ ID NO: 9025255 - DNA, 20 bp, Homo sapiens
ttcaagttgggtctctggct

SEQ ID NO: 9025256 - DNA, 22 bp, Homo sapiens
ttcaagttctagtgttcacttc

SEQ ID NO: 9025257 - DNA, 22 bp, Homo sapiens
ttcacaattaactttatactta

SEQ ID NO: 9025258 - DNA, 22 bp, Homo sapiens
ttcaataggatgcatgatataa

SEQ ID NO: 9025259 - DNA, 22 bp, Homo sapiens
ttcacaatttcccttcatcagg

SEQ ID NO: 9025260 - DNA, 22 bp, Homo sapiens
ttcaatagaaagtccctagtta

SEQ ID NO: 9025261 - DNA, 22 bp, Homo sapiens
ttcaatagcatacttttgctct

SEQ ID NO: 9025262 - DNA, 22 bp, Homo sapiens
ttcaatagaaatgacattcttt

SEQ ID NO: 9025263 - DNA, 22 bp, Homo sapiens
ttcaatacaccataggaatagt

SEQ ID NO: 9025264 - DNA, 20 bp, Homo sapiens
ttcaatacattactttgatt

SEQ ID NO: 9025265 - DNA, 22 bp, Homo sapiens
ttcaatacaaagaaaggaattt

SEQ ID NO: 9025266 - DNA, 22 bp, Homo sapiens
ttcacaatttcccttcatcagg

SEQ ID NO: 9025267 - DNA, 19 bp, Homo sapiens
ttcacaattatgaaattag

SEQ ID NO: 9025268 - DNA, 22 bp, Homo sapiens
ttcacaatttcccttcatcagg

SEQ ID NO: 9025269 - DNA, 22 bp, Homo sapiens
ttcacaatttcccttcatcagg

SEQ ID NO: 9025270 - DNA, 22 bp, Homo sapiens
ttcacaatttcccttcatcagg

SEQ ID NO: 9025271 - DNA, 22 bp, Homo sapiens
ttcacacacagcttcctattgt

SEQ ID NO: 9025272 - DNA, 22 bp, Homo sapiens
ttcacacacagcttcctattgt

SEQ ID NO: 9025273 - DNA, 22 bp, Homo sapiens
ttcacacagaatctgaggagct

SEQ ID NO: 9025274 - DNA, 22 bp, Homo sapiens
ttcacacagaatctgaggagct

SEQ ID NO: 9025275 - DNA, 22 bp, Homo sapiens
ttcacacagaatctgaggagct

SEQ ID NO: 9025276 - DNA, 22 bp, Homo sapiens
ttcacacagaatctgaggagct

SEQ ID NO: 9025277 - DNA, 22 bp, Homo sapiens
ttcacacagaatctgaggagct

SEQ ID NO: 9025278 - DNA, 22 bp, Homo sapiens
ttcacacagaatctgaggagct

SEQ ID NO: 9025279 - DNA, 22 bp, Homo sapiens
ttcacacagcaactgtatgaat

SEQ ID NO: 9025280 - DNA, 22 bp, Homo sapiens
ttcacacagcaactgtatgaat

SEQ ID NO: 9025281 - DNA, 22 bp, Homo sapiens
ttcacacagcaactgtatgaat

SEQ ID NO: 9025282 - DNA, 22 bp, Homo sapiens
ttcacacagcaactgtatgaat

SEQ ID NO: 9025283 - DNA, 22 bp, Homo sapiens
ttcacacagcaactgtatgaat

SEQ ID NO: 9025284 - DNA, 22 bp, Homo sapiens
cgcccaggctggagagcagtgg

SEQ ID NO: 9025285 - DNA, 22 bp, Homo sapiens
cgcccaggctggagagcagtgg

SEQ ID NO: 9025286 - DNA, 22 bp, Homo sapiens
cgcccaggctggagtgcagtga

SEQ ID NO: 9025287 - DNA, 22 bp, Homo sapiens
cgcccaggctggagtgcagtga

SEQ ID NO: 9025288 - DNA, 22 bp, Homo sapiens
cgcccaggctggagtgcagtga

SEQ ID NO: 9025289 - DNA, 22 bp, Homo sapiens
cgcccaggctggagtgcagtga

SEQ ID NO: 9025290 - DNA, 22 bp, Homo sapiens
cgcccaggctggagagcagtgg

SEQ ID NO: 9025291 - DNA, 22 bp, Homo sapiens
cgcccaggctggagagcagtgg

SEQ ID NO: 9025292 - DNA, 20 bp, Homo sapiens
cgcccaggagggcccatgtg

SEQ ID NO: 9025293 - DNA, 22 bp, Homo sapiens
cgcccagctgaaatctccaggc

SEQ ID NO: 9025294 - DNA, 22 bp, Homo sapiens
cgcccagctgaaatctccaggc

SEQ ID NO: 9025295 - DNA, 22 bp, Homo sapiens
cgcccagctgaaatctccaggc

SEQ ID NO: 9025296 - DNA, 20 bp, Homo sapiens
cgcccaggagggcccatgtg

SEQ ID NO: 9025297 - DNA, 20 bp, Homo sapiens
cgcccaggagggcccatgtg

SEQ ID NO: 9025298 - DNA, 22 bp, Homo sapiens
cgccccagatgcaagacaaaga

SEQ ID NO: 9025299 - DNA, 20 bp, Homo sapiens
cgcccagtgcggttctgacc

SEQ ID NO: 9025300 - DNA, 22 bp, Homo sapiens
cgccccagccagttgagcggcg

SEQ ID NO: 9025301 - DNA, 22 bp, Homo sapiens
cgccccagtctgtaggtgcccc

SEQ ID NO: 9025302 - DNA, 22 bp, Homo sapiens
cgccccagtctgtaggtgcccc

SEQ ID NO: 9025303 - DNA, 22 bp, Homo sapiens
cgcccaggctggagtgcagtgg

SEQ ID NO: 9025304 - DNA, 22 bp, Homo sapiens
cgcccaggctggagtgcagtgg

SEQ ID NO: 9025305 - DNA, 22 bp, Homo sapiens
cgcccaggctggagtgcagtgg

SEQ ID NO: 9025306 - DNA, 22 bp, Homo sapiens
cgcccaggctggagtgcagtgg

SEQ ID NO: 9025307 - DNA, 22 bp, Homo sapiens
cgcccagggcaggaggccgctc

SEQ ID NO: 9025308 - DNA, 22 bp, Homo sapiens
cgcccagggcaggaggccgctc

SEQ ID NO: 9025309 - DNA, 22 bp, Homo sapiens
cgcccagggcaggaggccgctc

SEQ ID NO: 9025310 - DNA, 22 bp, Homo sapiens
cgccccctcggccacctgcggg

SEQ ID NO: 9025311 - DNA, 22 bp, Homo sapiens
cgccccagtctgtaggtgcccc

SEQ ID NO: 9025312 - DNA, 22 bp, Homo sapiens
cgccccagtctgtaggtgcccc

SEQ ID NO: 9025313 - DNA, 22 bp, Homo sapiens
cgcccctcagcgacccaccagc

SEQ ID NO: 9025314 - DNA, 22 bp, Homo sapiens
cgcccctcagcgacccaccagc

SEQ ID NO: 9025315 - DNA, 22 bp, Homo sapiens
cgccccggacgtctgaccaaac

SEQ ID NO: 9025316 - DNA, 22 bp, Homo sapiens
cgcccctcagcgacccaccagc

SEQ ID NO: 9025317 - DNA, 22 bp, Homo sapiens
cgccctccacacagcccctggc

SEQ ID NO: 9025318 - DNA, 22 bp, Homo sapiens
cgccctccacacagcccctggc

SEQ ID NO: 9025319 - DNA, 22 bp, Homo sapiens
cgccctccacacagcccctggc

SEQ ID NO: 9025320 - DNA, 22 bp, Homo sapiens
cgccgcctgctgcagcagctgt

SEQ ID NO: 9025321 - DNA, 22 bp, Homo sapiens
ttcaagtctggagatctggaac

SEQ ID NO: 9025322 - DNA, 22 bp, Homo sapiens
ttcaagtgaggctgtctttaga

SEQ ID NO: 9025323 - DNA, 22 bp, Homo sapiens
ttcaagttaactctccttgtac

SEQ ID NO: 9025324 - DNA, 22 bp, Homo sapiens
cgccggcttgaggcaggcggca

SEQ ID NO: 9025325 - DNA, 22 bp, Homo sapiens
ttcaaattaccacatttgctta

SEQ ID NO: 9025326 - DNA, 22 bp, Homo sapiens
ttcaaatttggtatgcaagcca

SEQ ID NO: 9025327 - DNA, 22 bp, Homo sapiens
ttcaaatttggtatgcaagcca

SEQ ID NO: 9025328 - DNA, 22 bp, Homo sapiens
ttcagaaagtgaatcttgttat

SEQ ID NO: 9025329 - DNA, 22 bp, Homo sapiens
ttcagaaagtgaatcttgttat

SEQ ID NO: 9025330 - DNA, 22 bp, Homo sapiens
ttcagagggacattcaagggaa

SEQ ID NO: 9025331 - DNA, 22 bp, Homo sapiens
ttcagaggctgtatgactagat

SEQ ID NO: 9025332 - DNA, 22 bp, Homo sapiens
ttcacagacattgcagactgaa

SEQ ID NO: 9025333 - DNA, 22 bp, Homo sapiens
ttcagaaagtgaatcttgttat

SEQ ID NO: 9025334 - DNA, 22 bp, Homo sapiens
ttcagaaagtgaatcttgttat

SEQ ID NO: 9025335 - DNA, 22 bp, Homo sapiens
ttcagaaagtgaatcttgttat

SEQ ID NO: 9025336 - DNA, 22 bp, Homo sapiens
ttcacagaattgtcttgactgg

SEQ ID NO: 9025337 - DNA, 22 bp, Homo sapiens
ttcacagaattgtcttgactgg

SEQ ID NO: 9025338 - DNA, 22 bp, Homo sapiens
ttcacagaatggcaagttatgg

SEQ ID NO: 9025339 - DNA, 22 bp, Homo sapiens
ttcacactgtttttcatagtgg

SEQ ID NO: 9025340 - DNA, 22 bp, Homo sapiens
ttcacactctcactccctgacc

SEQ ID NO: 9025341 - DNA, 22 bp, Homo sapiens
ttcacactgaatgggactttat

SEQ ID NO: 9025342 - DNA, 22 bp, Homo sapiens
ttcacacctgctcaattatgag

SEQ ID NO: 9025343 - DNA, 22 bp, Homo sapiens
ttcacaccaagcttcccaaaga

SEQ ID NO: 9025344 - DNA, 22 bp, Homo sapiens
ttcacacagcaactgtatgaat

SEQ ID NO: 9025345 - DNA, 22 bp, Homo sapiens
ttcacaccaaagacaaacaggg

SEQ ID NO: 9025346 - DNA, 22 bp, Homo sapiens
ttcacagaagaggtcacatttc

SEQ ID NO: 9025347 - DNA, 22 bp, Homo sapiens
ttcacagaagaggtcacatttc

SEQ ID NO: 9025348 - DNA, 22 bp, Homo sapiens
ttcacagaagaggtcacatttc

SEQ ID NO: 9025349 - DNA, 22 bp, Homo sapiens
ttcacagaatggcaagttatgg

SEQ ID NO: 9025350 - DNA, 22 bp, Homo sapiens
ttcacagaatggcaagttatgg

SEQ ID NO: 9025351 - DNA, 22 bp, Homo sapiens
ttcagaggtgggctgagaggat

SEQ ID NO: 9025352 - DNA, 20 bp, Homo sapiens
ttcagaggtgaagttgtggt

SEQ ID NO: 9025353 - DNA, 22 bp, Homo sapiens
ttcagaggttagagcagtggga

SEQ ID NO: 9025354 - DNA, 20 bp, Homo sapiens
ttcagaggtgaagttgtggt

SEQ ID NO: 9025355 - DNA, 22 bp, Homo sapiens
ttcagaggtagagaggatcttg

SEQ ID NO: 9025356 - DNA, 22 bp, Homo sapiens
ttcagagggttttagggtcaga

SEQ ID NO: 9025357 - DNA, 22 bp, Homo sapiens
ttcagaggggctaagtacttgc

SEQ ID NO: 9025358 - DNA, 18 bp, Homo sapiens
ttcagagtctggtgagga

SEQ ID NO: 9025359 - DNA, 22 bp, Homo sapiens
ttcagagtggtatgaagtgatg

SEQ ID NO: 9025360 - DNA, 22 bp, Homo sapiens
ttcagagtcagggatctcagag

SEQ ID NO: 9025361 - DNA, 20 bp, Homo sapiens
ttcagagtcagcaaatgcag

SEQ ID NO: 9025362 - DNA, 22 bp, Homo sapiens
ttcagagttagacgaaaagcaa

SEQ ID NO: 9025363 - DNA, 22 bp, Homo sapiens
ttcagataaactacaaataatt

SEQ ID NO: 9025364 - DNA, 22 bp, Homo sapiens
ttcaggattgtgtttttcctga

SEQ ID NO: 9025365 - DNA, 22 bp, Homo sapiens
ttcaggattctttcagactggg

SEQ ID NO: 9025366 - DNA, 19 bp, Homo sapiens
ttcaggattgaccctactg

SEQ ID NO: 9025367 - DNA, 22 bp, Homo sapiens
ttcaggattctgtgtctgacaa

SEQ ID NO: 9025368 - DNA, 20 bp, Homo sapiens
ttcaggattctagaccacac

SEQ ID NO: 9025369 - DNA, 22 bp, Homo sapiens
ttcaggattctctcccatttac

SEQ ID NO: 9025370 - DNA, 22 bp, Homo sapiens
ttcaggcatggaaactggatta

SEQ ID NO: 9025371 - DNA, 22 bp, Homo sapiens
ttcaggcatggaaactggatta

SEQ ID NO: 9025372 - DNA, 22 bp, Homo sapiens
ttcaggcccaacgcacagcttc

SEQ ID NO: 9025373 - DNA, 22 bp, Homo sapiens
ttcaggcatccctacagttagg

SEQ ID NO: 9025374 - DNA, 22 bp, Homo sapiens
ttcaggatggagtaccttttat

SEQ ID NO: 9025375 - DNA, 22 bp, Homo sapiens
ttcaggatggcggatgttgggg

SEQ ID NO: 9025376 - DNA, 22 bp, Homo sapiens
ttcaggattatactctcttccc

SEQ ID NO: 9025377 - DNA, 22 bp, Homo sapiens
ttcaggatgctcagagtagtct

SEQ ID NO: 9025378 - DNA, 22 bp, Homo sapiens
ttcaggatgcagaggttgtagt

SEQ ID NO: 9025379 - DNA, 22 bp, Homo sapiens
ttcaggatgacaccatgtccag

SEQ ID NO: 9025380 - DNA, 22 bp, Homo sapiens
ttcaggatgaaagtgtgcaaca

SEQ ID NO: 9025381 - DNA, 22 bp, Homo sapiens
ttcaggatcatttgttttatct

SEQ ID NO: 9025382 - DNA, 22 bp, Homo sapiens
ttcaggatccccaccgcgttta

SEQ ID NO: 9025383 - DNA, 22 bp, Homo sapiens
ttcaggatccccttgatgggct

SEQ ID NO: 9025384 - DNA, 15 bp, Homo sapiens
ttcaggatatgactc

SEQ ID NO: 9025385 - DNA, 22 bp, Homo sapiens
ttcaggatatgtgatatctgaa

SEQ ID NO: 9025386 - DNA, 22 bp, Homo sapiens
ttcaggatcaagttgccagtag

SEQ ID NO: 9025387 - DNA, 22 bp, Homo sapiens
ttcaggatcactaaaccctcca

SEQ ID NO: 9025388 - DNA, 22 bp, Homo sapiens
ttcagcaaacacgatgcttgtt

SEQ ID NO: 9025389 - DNA, 22 bp, Homo sapiens
ttcaggatatgtgatatctgaa

SEQ ID NO: 9025390 - DNA, 22 bp, Homo sapiens
ttcaggagtgtcaggagtgcct

SEQ ID NO: 9025391 - DNA, 22 bp, Homo sapiens
ttcaggatagtggtgagtggca

SEQ ID NO: 9025392 - DNA, 22 bp, Homo sapiens
ttcagcaaacacgatgcttgtt

SEQ ID NO: 9025393 - DNA, 22 bp, Homo sapiens
ttcagatatcattaatttagta

SEQ ID NO: 9025394 - DNA, 22 bp, Homo sapiens
ttcagattttttaataggtaat

SEQ ID NO: 9025395 - DNA, 22 bp, Homo sapiens
ttcagattttttaataggtaat

SEQ ID NO: 9025396 - DNA, 22 bp, Homo sapiens
ttcagggactttgatgtatcag

SEQ ID NO: 9025397 - DNA, 22 bp, Homo sapiens
ttcaggcttcagtctttcttaa

SEQ ID NO: 9025398 - DNA, 22 bp, Homo sapiens
ttcagggagagcgggacgggtg

SEQ ID NO: 9025399 - DNA, 22 bp, Homo sapiens
ttcagggagagcgggacgggtg

SEQ ID NO: 9025400 - DNA, 22 bp, Homo sapiens
ttcagggagagcgggacgggtg

SEQ ID NO: 9025401 - DNA, 22 bp, Homo sapiens
ttcagggacttagtgtcagttt

SEQ ID NO: 9025402 - DNA, 22 bp, Homo sapiens
ttcagggactttgatgtatcag

SEQ ID NO: 9025403 - DNA, 22 bp, Homo sapiens
ttcagggacttagtgtcagttt

SEQ ID NO: 9025404 - DNA, 22 bp, Homo sapiens
ttcaggcctaatttctagcccc

SEQ ID NO: 9025405 - DNA, 22 bp, Homo sapiens
ttcaggcctctaaagggaaagc

SEQ ID NO: 9025406 - DNA, 22 bp, Homo sapiens
ttcaggcccaacgcacagcttc

SEQ ID NO: 9025407 - DNA, 22 bp, Homo sapiens
ttcaggcccaacgcacagcttc

SEQ ID NO: 9025408 - DNA, 22 bp, Homo sapiens
ttcaggcccagcacagcgcgtg

SEQ ID NO: 9025409 - DNA, 22 bp, Homo sapiens
cggggctgtagcacagctgagc

SEQ ID NO: 9025410 - DNA, 22 bp, Homo sapiens
cggtcaggtgcagcgttggcac

SEQ ID NO: 9025411 - DNA, 22 bp, Homo sapiens
cggtcaggtgcagcgttggcac

SEQ ID NO: 9025412 - DNA, 22 bp, Homo sapiens
cggtcaggtgcagcgttggcac

SEQ ID NO: 9025413 - DNA, 22 bp, Homo sapiens
cgggggagttgaggcacatggg

SEQ ID NO: 9025414 - DNA, 22 bp, Homo sapiens
cggggctgtagcacagctgagc

SEQ ID NO: 9025415 - DNA, 22 bp, Homo sapiens
ttcagggcagctagaaccagga

SEQ ID NO: 9025416 - DNA, 22 bp, Homo sapiens
ttcagggcatgagggacacatc

SEQ ID NO: 9025417 - DNA, 22 bp, Homo sapiens
ttcagggcagacagaagagatg

SEQ ID NO: 9025418 - DNA, 22 bp, Homo sapiens
ttcagggagagcgggacgggtg

SEQ ID NO: 9025419 - DNA, 22 bp, Homo sapiens
ttcagggcagacagaagagatg

SEQ ID NO: 9025420 - DNA, 22 bp, Homo sapiens
ttcatgaagggtgaatatagtc

SEQ ID NO: 9025421 - DNA, 22 bp, Homo sapiens
ttcatgaacgaacatatgtata

SEQ ID NO: 9025422 - DNA, 22 bp, Homo sapiens
ttcatgaacgaacatatgtata

SEQ ID NO: 9025423 - DNA, 22 bp, Homo sapiens
ttcatgaacgaacatatgtata

SEQ ID NO: 9025424 - DNA, 22 bp, Homo sapiens
ttcatgaacgaacatatgtata

SEQ ID NO: 9025425 - DNA, 22 bp, Homo sapiens
ttcatgaagggtgaatatagtc

SEQ ID NO: 9025426 - DNA, 22 bp, Homo sapiens
ttcatgaagggtgaatatagtc

SEQ ID NO: 9025427 - DNA, 22 bp, Homo sapiens
ttcatgaatatattgaattagc

SEQ ID NO: 9025428 - DNA, 22 bp, Homo sapiens
ttcatgaatatattgaattagc

SEQ ID NO: 9025429 - DNA, 22 bp, Homo sapiens
ttcatgaatatattgaattagc

SEQ ID NO: 9025430 - DNA, 22 bp, Homo sapiens
ttcatgaatgttccatgtgagt

SEQ ID NO: 9025431 - DNA, 22 bp, Homo sapiens
ctaaaaatccacactaggtgaa

SEQ ID NO: 9025432 - DNA, 22 bp, Homo sapiens
ttcatgaatgttccatgtgagt

SEQ ID NO: 9025433 - DNA, 22 bp, Homo sapiens
ttcatgaatgttccatgtgagt

SEQ ID NO: 9025434 - DNA, 22 bp, Homo sapiens
ctaaaattacctaccagtttag

SEQ ID NO: 9025435 - DNA, 22 bp, Homo sapiens
ctaaaattacctaccagtttag

SEQ ID NO: 9025436 - DNA, 22 bp, Homo sapiens
ctaaagaagctagcaatctata

SEQ ID NO: 9025437 - DNA, 22 bp, Homo sapiens
ctaaacttttataacattgaga

SEQ ID NO: 9025438 - DNA, 22 bp, Homo sapiens
ctaaagtgccaggaatacaggt

SEQ ID NO: 9025439 - DNA, 22 bp, Homo sapiens
ctaaataatccctctggtctta

SEQ ID NO: 9025440 - DNA, 22 bp, Homo sapiens
ctaaataatccctctggtctta

SEQ ID NO: 9025441 - DNA, 22 bp, Homo sapiens
ctaaataatccctctggtctta

SEQ ID NO: 9025442 - DNA, 22 bp, Homo sapiens
ctaaataatccctctggtctta

SEQ ID NO: 9025443 - DNA, 22 bp, Homo sapiens
ctaaataatccctctggtctta

SEQ ID NO: 9025444 - DNA, 22 bp, Homo sapiens
ctaaataatccctctggtctta

SEQ ID NO: 9025445 - DNA, 22 bp, Homo sapiens
ctaaatactagccttcagattt

SEQ ID NO: 9025446 - DNA, 22 bp, Homo sapiens
ctaaatactagccttcagattt

SEQ ID NO: 9025447 - DNA, 22 bp, Homo sapiens
ctaaatcaggccttacagcttc

SEQ ID NO: 9025448 - DNA, 17 bp, Homo sapiens
ctaaatacttgcgtttc

SEQ ID NO: 9025449 - DNA, 22 bp, Homo sapiens
ctaaatactagccttcagattt

SEQ ID NO: 9025450 - DNA, 17 bp, Homo sapiens
ctaaatacttgcgtttc

SEQ ID NO: 9025451 - DNA, 22 bp, Homo sapiens
ctaaagaagctagcaatctata

SEQ ID NO: 9025452 - DNA, 22 bp, Homo sapiens
ctaaagaagctagcaatctata

SEQ ID NO: 9025453 - DNA, 22 bp, Homo sapiens
ctaaagaattttgcttgaccag

SEQ ID NO: 9025454 - DNA, 22 bp, Homo sapiens
ctaaagatctacagaggctttt

SEQ ID NO: 9025455 - DNA, 22 bp, Homo sapiens
ctaaagataaggaaagtatcct

SEQ ID NO: 9025456 - DNA, 22 bp, Homo sapiens
ctaaagataaggaaagtatcct

SEQ ID NO: 9025457 - DNA, 22 bp, Homo sapiens
ctaaagcaactgagacacatag

SEQ ID NO: 9025458 - DNA, 22 bp, Homo sapiens
ctaaagctcaacaggcactatt

SEQ ID NO: 9025459 - DNA, 22 bp, Homo sapiens
ctaaagtccttatcaagtgtaa

SEQ ID NO: 9025460 - DNA, 22 bp, Homo sapiens
cgtaggtggctcagcacctggg

SEQ ID NO: 9025461 - DNA, 22 bp, Homo sapiens
cgtaccagcataaactgaaggt

SEQ ID NO: 9025462 - DNA, 22 bp, Homo sapiens
cgtagacaactgaaatgcacag

SEQ ID NO: 9025463 - DNA, 22 bp, Homo sapiens
cgtaattctctctagtacccct

SEQ ID NO: 9025464 - DNA, 22 bp, Homo sapiens
cgtaagaaatagcttgtcaaag

SEQ ID NO: 9025465 - DNA, 19 bp, Homo sapiens
cggtggcttgcagggaggt

SEQ ID NO: 9025466 - DNA, 22 bp, Homo sapiens
cggtggctcaggcccccagcag

SEQ ID NO: 9025467 - DNA, 22 bp, Homo sapiens
cggtgcccggtgccaggcgcgg

SEQ ID NO: 9025468 - DNA, 22 bp, Homo sapiens
cggtggagtgctcagctgaacc

SEQ ID NO: 9025469 - DNA, 22 bp, Homo sapiens
cggtctcccgtgtgtgtgcgct

SEQ ID NO: 9025470 - DNA, 22 bp, Homo sapiens
cggtctcccgtgtgtgtgcgct

SEQ ID NO: 9025471 - DNA, 19 bp, Homo sapiens
cggtccatccgattttaca

SEQ ID NO: 9025472 - DNA, 22 bp, Homo sapiens
cgggggagttgaggcacatggg

SEQ ID NO: 9025473 - DNA, 22 bp, Homo sapiens
cgtatcaaagcaaaacatattt

SEQ ID NO: 9025474 - DNA, 22 bp, Homo sapiens
cgtatacatgaagacattgctg

SEQ ID NO: 9025475 - DNA, 22 bp, Homo sapiens
cgtatacatgaagacattgctg

SEQ ID NO: 9025476 - DNA, 22 bp, Homo sapiens
cgtatttagaaggctgctgaaa

SEQ ID NO: 9025477 - DNA, 22 bp, Homo sapiens
cgtatttagaaggctgctgaaa

SEQ ID NO: 9025478 - DNA, 22 bp, Homo sapiens
cgtattcactcaggacacatag

SEQ ID NO: 9025479 - DNA, 22 bp, Homo sapiens
cgtcacttcttagtctattttc

SEQ ID NO: 9025480 - DNA, 22 bp, Homo sapiens
cgtcactggcgtgaagtgagga

SEQ ID NO: 9025481 - DNA, 22 bp, Homo sapiens
ttcatccatgtggttgtgtata

SEQ ID NO: 9025482 - DNA, 22 bp, Homo sapiens
ttcatccatgtggttgtgtata

SEQ ID NO: 9025483 - DNA, 22 bp, Homo sapiens
ttcatccatatgcagagagctt

SEQ ID NO: 9025484 - DNA, 22 bp, Homo sapiens
ttcatccatatgcagagagctt

SEQ ID NO: 9025485 - DNA, 21 bp, Homo sapiens
ttcatcattggtaaaaagtgg

SEQ ID NO: 9025486 - DNA, 22 bp, Homo sapiens
ttcatccatatgcagagagctt

SEQ ID NO: 9025487 - DNA, 22 bp, Homo sapiens
cgtcacttcttagtctattttc

SEQ ID NO: 9025488 - DNA, 22 bp, Homo sapiens
ttcatgaaacttaactgttggg

SEQ ID NO: 9025489 - DNA, 22 bp, Homo sapiens
ttcatgaaagacagcaactgtg

SEQ ID NO: 9025490 - DNA, 22 bp, Homo sapiens
ttcatgaaacttaactgttggg

SEQ ID NO: 9025491 - DNA, 22 bp, Homo sapiens
ttcatctgtagtttttccaagg

SEQ ID NO: 9025492 - DNA, 22 bp, Homo sapiens
ttcatgaaacttaactgttggg

SEQ ID NO: 9025493 - DNA, 22 bp, Homo sapiens
ttcatctgtagcatcttccaat

SEQ ID NO: 9025494 - DNA, 22 bp, Homo sapiens
ttcatctgtagtttttccaagg

SEQ ID NO: 9025495 - DNA, 21 bp, Homo sapiens
ttcatctggccgtattccagg

SEQ ID NO: 9025496 - DNA, 22 bp, Homo sapiens
ttcatctggaatttatgttata

SEQ ID NO: 9025497 - DNA, 22 bp, Homo sapiens
ctttcataaggggttttataat

SEQ ID NO: 9025498 - DNA, 22 bp, Homo sapiens
ctttcataattcagcacattga

SEQ ID NO: 9025499 - DNA, 22 bp, Homo sapiens
ctttcataattcagcacattga

SEQ ID NO: 9025500 - DNA, 22 bp, Homo sapiens
ctttcatagttaaaatagtttg

SEQ ID NO: 9025501 - DNA, 22 bp, Homo sapiens
ctttcatccgcagatgagcctc

SEQ ID NO: 9025502 - DNA, 22 bp, Homo sapiens
ctttcatccgcagatgagcctc

SEQ ID NO: 9025503 - DNA, 22 bp, Homo sapiens
ctttcatgaacagacaaggaac

SEQ ID NO: 9025504 - DNA, 22 bp, Homo sapiens
ctttcatgcagttgacaaggtg

SEQ ID NO: 9025505 - DNA, 19 bp, Homo sapiens
ctttcatgtggttcttctt

SEQ ID NO: 9025506 - DNA, 22 bp, Homo sapiens
ctttcatgcagttgacaaggtg

SEQ ID NO: 9025507 - DNA, 22 bp, Homo sapiens
ctttcatgcacttctttagatc

SEQ ID NO: 9025508 - DNA, 22 bp, Homo sapiens
ctttcattcttagatattagtg

SEQ ID NO: 9025509 - DNA, 22 bp, Homo sapiens
ctttcattcttagatattagtg

SEQ ID NO: 9025510 - DNA, 22 bp, Homo sapiens
ctttcattcttagatattagtg

SEQ ID NO: 9025511 - DNA, 22 bp, Homo sapiens
ctttcattcttagatattagtg

SEQ ID NO: 9025512 - DNA, 22 bp, Homo sapiens
ctttcatttgataagaatgcca

SEQ ID NO: 9025513 - DNA, 22 bp, Homo sapiens
ctttcatttgataagaatgcca

SEQ ID NO: 9025514 - DNA, 22 bp, Homo sapiens
ctttccaactctagtgaaattt

SEQ ID NO: 9025515 - DNA, 22 bp, Homo sapiens
ctttccaactctagtgaaattt

SEQ ID NO: 9025516 - DNA, 23 bp, Homo sapiens
ctttcattgtggtttcacagagc

SEQ ID NO: 9025517 - DNA, 23 bp, Homo sapiens
ctttcattgtggtttcacagagc

SEQ ID NO: 9025518 - DNA, 23 bp, Homo sapiens
ctttcattgtggtttcacagagc

SEQ ID NO: 9025519 - DNA, 23 bp, Homo sapiens
ctttcattgtggtttcacagagc

SEQ ID NO: 9025520 - DNA, 23 bp, Homo sapiens
ctttcattgtggtttcacagagc

SEQ ID NO: 9025521 - DNA, 22 bp, Homo sapiens
ctttcattcttagatattagtg

SEQ ID NO: 9025522 - DNA, 22 bp, Homo sapiens
gaaatcagttctgaaatttaca

SEQ ID NO: 9025523 - DNA, 22 bp, Homo sapiens
gaaatcagttctgaaatttaca

SEQ ID NO: 9025524 - DNA, 22 bp, Homo sapiens
gaaatcaatttcttggttgata

SEQ ID NO: 9025525 - DNA, 22 bp, Homo sapiens
gaaatcacttttttcatagttg

SEQ ID NO: 9025526 - DNA, 22 bp, Homo sapiens
gaaatcacttttttcatagttg

SEQ ID NO: 9025527 - DNA, 22 bp, Homo sapiens
gaaatcacttttttcatagttg

SEQ ID NO: 9025528 - DNA, 22 bp, Homo sapiens
gaaatcaaggctacattcaggt

SEQ ID NO: 9025529 - DNA, 22 bp, Homo sapiens
gaaatcaatttcttggttgata

SEQ ID NO: 9025530 - DNA, 22 bp, Homo sapiens
gaaatcaatttcttggttgata

SEQ ID NO: 9025531 - DNA, 22 bp, Homo sapiens
gaaatcaaggctacattcaggt

SEQ ID NO: 9025532 - DNA, 22 bp, Homo sapiens
gaaatatttctcttgagcccct

SEQ ID NO: 9025533 - DNA, 22 bp, Homo sapiens
gaaatatttctcttgagcccct

SEQ ID NO: 9025534 - DNA, 22 bp, Homo sapiens
gaaatcaaacccttttctgata

SEQ ID NO: 9025535 - DNA, 22 bp, Homo sapiens
gaaatcaaacccttttctgata

SEQ ID NO: 9025536 - DNA, 22 bp, Homo sapiens
gaaatcaaacccttttctgata

SEQ ID NO: 9025537 - DNA, 22 bp, Homo sapiens
gaaatatttctcttgagcccct

SEQ ID NO: 9025538 - DNA, 22 bp, Homo sapiens
gaaatatttctcttgagcccct

SEQ ID NO: 9025539 - DNA, 22 bp, Homo sapiens
gaaatatttctcttgagcccct

SEQ ID NO: 9025540 - DNA, 22 bp, Homo sapiens
gaaatatttctcttgagcccct

SEQ ID NO: 9025541 - DNA, 22 bp, Homo sapiens
ctttccaactgggtgggcagct

SEQ ID NO: 9025542 - DNA, 22 bp, Homo sapiens
ctttccaactgggtgggcagct

SEQ ID NO: 9025543 - DNA, 22 bp, Homo sapiens
ctttccaactctagtgaaattt

SEQ ID NO: 9025544 - DNA, 22 bp, Homo sapiens
ctttccaactgggtgggcagct

SEQ ID NO: 9025545 - DNA, 22 bp, Homo sapiens
ctttatgtccttgaagagttgt

SEQ ID NO: 9025546 - DNA, 18 bp, Homo sapiens
ctttatgtgcagagcttt

SEQ ID NO: 9025547 - DNA, 18 bp, Homo sapiens
ctttatgtgcagagcttt

SEQ ID NO: 9025548 - DNA, 22 bp, Homo sapiens
ctttcaatcaaagtttctagtg

SEQ ID NO: 9025549 - DNA, 22 bp, Homo sapiens
ctttatgtgctgggcattaagg

SEQ ID NO: 9025550 - DNA, 22 bp, Homo sapiens
ctttatgtgctgggcattaagg

SEQ ID NO: 9025551 - DNA, 22 bp, Homo sapiens
ctttcacacacatacatttgga

SEQ ID NO: 9025552 - DNA, 22 bp, Homo sapiens
ctttcaatcaaagtttctagtg

SEQ ID NO: 9025553 - DNA, 22 bp, Homo sapiens
ctttcaatgtgcctgccttggg

SEQ ID NO: 9025554 - DNA, 22 bp, Homo sapiens
ctttcacagccttcgttctgaa

SEQ ID NO: 9025555 - DNA, 22 bp, Homo sapiens
ctttcacagcttgaaaagtatt

SEQ ID NO: 9025556 - DNA, 22 bp, Homo sapiens
ctttcacagcttgaaaagtatt

SEQ ID NO: 9025557 - DNA, 22 bp, Homo sapiens
ctttcacagctgtgcttatgat

SEQ ID NO: 9025558 - DNA, 22 bp, Homo sapiens
ctttcactcgagctcctgcagc

SEQ ID NO: 9025559 - DNA, 22 bp, Homo sapiens
ctttcagaagaggacctttcca

SEQ ID NO: 9025560 - DNA, 22 bp, Homo sapiens
ctttcacagcttgaaaagtatt

SEQ ID NO: 9025561 - DNA, 22 bp, Homo sapiens
ctttcagaggttactcaggaaa

SEQ ID NO: 9025562 - DNA, 22 bp, Homo sapiens
ctttcagaggttactcaggaaa

SEQ ID NO: 9025563 - DNA, 22 bp, Homo sapiens
ctttcagaagccggaagggcag

SEQ ID NO: 9025564 - DNA, 22 bp, Homo sapiens
ctttcagcatccctgggattac

SEQ ID NO: 9025565 - DNA, 22 bp, Homo sapiens
ctttcagggcagacaacgagca

SEQ ID NO: 9025566 - DNA, 22 bp, Homo sapiens
ctttcaggttctataggaagcc

SEQ ID NO: 9025567 - DNA, 22 bp, Homo sapiens
ctttcaggtcacataacgccaa

SEQ ID NO: 9025568 - DNA, 22 bp, Homo sapiens
ctttcagttacagttacacaca

SEQ ID NO: 9025569 - DNA, 22 bp, Homo sapiens
ctttcataaaggaaatgatgag

SEQ ID NO: 9025570 - DNA, 22 bp, Homo sapiens
ctttcataaggggttttataat

SEQ ID NO: 9025571 - DNA, 22 bp, Homo sapiens
ctttcataaaggaaatgatgag

SEQ ID NO: 9025572 - DNA, 22 bp, Homo sapiens
ctttcagttagtacctagtggc

SEQ ID NO: 9025573 - DNA, 22 bp, Homo sapiens
ctttcagttacagttacacaca

SEQ ID NO: 9025574 - DNA, 18 bp, Homo sapiens
ctttcagtaatttcagcc

SEQ ID NO: 9025575 - DNA, 22 bp, Homo sapiens
ctttcagtcagttaactcagaa

SEQ ID NO: 9025576 - DNA, 22 bp, Homo sapiens
ctttcagtcagttaactcagaa

SEQ ID NO: 9025577 - DNA, 22 bp, Homo sapiens
ctttcagttacagttacacaca

SEQ ID NO: 9025578 - DNA, 22 bp, Homo sapiens
ctttcagttaatgactccatag

SEQ ID NO: 9025579 - DNA, 22 bp, Homo sapiens
ctttcagtctttacaaggttgc

SEQ ID NO: 9025580 - DNA, 22 bp, Homo sapiens
ctttcagtctttacaaggttgc

SEQ ID NO: 9025581 - DNA, 22 bp, Homo sapiens
ctttcagtcagttaactcagaa

SEQ ID NO: 9025582 - DNA, 22 bp, Homo sapiens
ctttcagtctttacaaggttgc

SEQ ID NO: 9025583 - DNA, 22 bp, Homo sapiens
gaacagggttgggtgagagagg

SEQ ID NO: 9025584 - DNA, 22 bp, Homo sapiens
gaacagggttgggtgagagagg

SEQ ID NO: 9025585 - DNA, 22 bp, Homo sapiens
gaacagggttgggtgagagagg

SEQ ID NO: 9025586 - DNA, 22 bp, Homo sapiens
gaacagggttgggtgagagagg

SEQ ID NO: 9025587 - DNA, 22 bp, Homo sapiens
gaacagggtttgagaggcttag

SEQ ID NO: 9025588 - DNA, 22 bp, Homo sapiens
gaacagggtttgagaggcttag

SEQ ID NO: 9025589 - DNA, 22 bp, Homo sapiens
gaacagggtttgagaggcttag

SEQ ID NO: 9025590 - DNA, 22 bp, Homo sapiens
gaacagggttgggtgagagagg

SEQ ID NO: 9025591 - DNA, 22 bp, Homo sapiens
gaacagggagtacggcacattt

SEQ ID NO: 9025592 - DNA, 22 bp, Homo sapiens
gaacagggagtacggcacattt

SEQ ID NO: 9025593 - DNA, 21 bp, Homo sapiens
gaacaggaaaagctggcttca

SEQ ID NO: 9025594 - DNA, 22 bp, Homo sapiens
gaacagcttcttgggagctggg

SEQ ID NO: 9025595 - DNA, 22 bp, Homo sapiens
gaacagctgctagagatctgtg

SEQ ID NO: 9025596 - DNA, 22 bp, Homo sapiens
gaacagcatgtaagaagctact

SEQ ID NO: 9025597 - DNA, 22 bp, Homo sapiens
gaacagcatgcatgcaagacta

SEQ ID NO: 9025598 - DNA, 22 bp, Homo sapiens
gaacagcatgcatgcaagacta

SEQ ID NO: 9025599 - DNA, 22 bp, Homo sapiens
gaacagcatgtaagaagctact

SEQ ID NO: 9025600 - DNA, 22 bp, Homo sapiens
gaacagctataatcatctgtcc

SEQ ID NO: 9025601 - DNA, 22 bp, Homo sapiens
gaacagctataatcatctgtcc

SEQ ID NO: 9025602 - DNA, 22 bp, Homo sapiens
gaacagctctgaagcagtaaat

SEQ ID NO: 9025603 - DNA, 22 bp, Homo sapiens
gaacagctataatcatctgtcc

SEQ ID NO: 9025604 - DNA, 22 bp, Homo sapiens
gaacagctgctagagatctgtg

SEQ ID NO: 9025605 - DNA, 22 bp, Homo sapiens
gaacatttggcatgagaatttg

SEQ ID NO: 9025606 - DNA, 22 bp, Homo sapiens
gaacatttggatttgtaaattt

SEQ ID NO: 9025607 - DNA, 22 bp, Homo sapiens
gaacatttggatttgtaaattt

SEQ ID NO: 9025608 - DNA, 22 bp, Homo sapiens
gaacatttggatttgtaaattt

SEQ ID NO: 9025609 - DNA, 22 bp, Homo sapiens
gaacatttggatttgtaaattt

SEQ ID NO: 9025610 - DNA, 22 bp, Homo sapiens
gaacatttggatttgtaaattt

SEQ ID NO: 9025611 - DNA, 22 bp, Homo sapiens
gaacatttggatttgtaaattt

SEQ ID NO: 9025612 - DNA, 22 bp, Homo sapiens
gaacatttgatgatgacattgg

SEQ ID NO: 9025613 - DNA, 17 bp, Homo sapiens
gaacagtgtaagacact

SEQ ID NO: 9025614 - DNA, 17 bp, Homo sapiens
gaacagtgtaagacact

SEQ ID NO: 9025615 - DNA, 17 bp, Homo sapiens
gaacagtgtaagacact

SEQ ID NO: 9025616 - DNA, 22 bp, Homo sapiens
gaacagtacagttgagtagttg

SEQ ID NO: 9025617 - DNA, 22 bp, Homo sapiens
gaacagtactaagagctttaca

SEQ ID NO: 9025618 - DNA, 22 bp, Homo sapiens
gaacagtagatgagatgctaga

SEQ ID NO: 9025619 - DNA, 22 bp, Homo sapiens
gaacagtatcagtagtgccagt

SEQ ID NO: 9025620 - DNA, 22 bp, Homo sapiens
gaacagtaactgtctgctgtgt

SEQ ID NO: 9025621 - DNA, 22 bp, Homo sapiens
gaacagtaaatttatgcagcac

SEQ ID NO: 9025622 - DNA, 22 bp, Homo sapiens
gaacagtaaatttatgcagcac

SEQ ID NO: 9025623 - DNA, 22 bp, Homo sapiens
gaacagtaactgtctgctgtgt

SEQ ID NO: 9025624 - DNA, 22 bp, Homo sapiens
gaacagtacagttgagtagttg

SEQ ID NO: 9025625 - DNA, 22 bp, Homo sapiens
gaacagtgccagcacacaataa

SEQ ID NO: 9025626 - DNA, 22 bp, Homo sapiens
gaacagtgccagcacacaataa

SEQ ID NO: 9025627 - DNA, 22 bp, Homo sapiens
gaacagtatcagtagtgccagt

SEQ ID NO: 9025628 - DNA, 22 bp, Homo sapiens
gaacagtatcagtagtgccagt

SEQ ID NO: 9025629 - DNA, 22 bp, Homo sapiens
gaacagtatttccaggaatccc

SEQ ID NO: 9025630 - DNA, 22 bp, Homo sapiens
gaacagtatttccaggaatccc

SEQ ID NO: 9025631 - DNA, 22 bp, Homo sapiens
gaaatcatctgagtaataatct

SEQ ID NO: 9025632 - DNA, 22 bp, Homo sapiens
gaaatcatctgagtaataatct

SEQ ID NO: 9025633 - DNA, 22 bp, Homo sapiens
gaaatcatctgagtaataatct

SEQ ID NO: 9025634 - DNA, 22 bp, Homo sapiens
gaaatcatgagatctcttggac

SEQ ID NO: 9025635 - DNA, 22 bp, Homo sapiens
gaaatcatctgagtaataatct

SEQ ID NO: 9025636 - DNA, 22 bp, Homo sapiens
gaaatcatattctcagtccttc

SEQ ID NO: 9025637 - DNA, 22 bp, Homo sapiens
gaaatcattagcaaagatatgt

SEQ ID NO: 9025638 - DNA, 22 bp, Homo sapiens
gaaatcattagcaaagatatgt

SEQ ID NO: 9025639 - DNA, 22 bp, Homo sapiens
gaaatcattagcaaagatatgt

SEQ ID NO: 9025640 - DNA, 22 bp, Homo sapiens
gaaatcattagcaaagatatgt

SEQ ID NO: 9025641 - DNA, 22 bp, Homo sapiens
gaaatctacgattagtgaaaat

SEQ ID NO: 9025642 - DNA, 22 bp, Homo sapiens
gaaatccagttccctactctta

SEQ ID NO: 9025643 - DNA, 22 bp, Homo sapiens
gaaatctacgattagtgaaaat

SEQ ID NO: 9025644 - DNA, 22 bp, Homo sapiens
gaaatgattttagtttatcatg

SEQ ID NO: 9025645 - DNA, 22 bp, Homo sapiens
gaaatgattttagtttatcatg

SEQ ID NO: 9025646 - DNA, 22 bp, Homo sapiens
gaaatgcaaattctctctcgct

SEQ ID NO: 9025647 - DNA, 22 bp, Homo sapiens
gaaatgcagaacctgagaccat

SEQ ID NO: 9025648 - DNA, 22 bp, Homo sapiens
gaaatgcagattctgattctgt

SEQ ID NO: 9025649 - DNA, 22 bp, Homo sapiens
gaaatgcagattctgattctgt

SEQ ID NO: 9025650 - DNA, 22 bp, Homo sapiens
gaaatgcagattctgattctgt

SEQ ID NO: 9025651 - DNA, 22 bp, Homo sapiens
gaaatgcaggcttggattcagc

SEQ ID NO: 9025652 - DNA, 22 bp, Homo sapiens
gaaatgcaggcttggattcagc

SEQ ID NO: 9025653 - DNA, 17 bp, Homo sapiens
gaacagcagaggggaca

SEQ ID NO: 9025654 - DNA, 22 bp, Homo sapiens
gaacagcagctcgttctcgatg

SEQ ID NO: 9025655 - DNA, 22 bp, Homo sapiens
gaaatgtactttaaagccatcc

SEQ ID NO: 9025656 - DNA, 22 bp, Homo sapiens
gaacagcagctcgttctcgatg

SEQ ID NO: 9025657 - DNA, 20 bp, Homo sapiens
gaaatgtacacattaccaca

SEQ ID NO: 9025658 - DNA, 20 bp, Homo sapiens
gaaatgtacacattaccaca

SEQ ID NO: 9025659 - DNA, 22 bp, Homo sapiens
gaaatgtaattctcttgaagat

SEQ ID NO: 9025660 - DNA, 20 bp, Homo sapiens
gaaatgtacacattaccaca

SEQ ID NO: 9025661 - DNA, 22 bp, Homo sapiens
gaaatggtgtgctgtgcaatga

SEQ ID NO: 9025662 - DNA, 22 bp, Homo sapiens
gaaatgtactttaaagccatcc

SEQ ID NO: 9025663 - DNA, 22 bp, Homo sapiens
gaaatgtactttaaagccatcc

SEQ ID NO: 9025664 - DNA, 22 bp, Homo sapiens
gaaatgcataatcttagtagat

SEQ ID NO: 9025665 - DNA, 22 bp, Homo sapiens
gaaatgcataatcttagtagat

SEQ ID NO: 9025666 - DNA, 22 bp, Homo sapiens
gaaatgcataatcttagtagat

SEQ ID NO: 9025667 - DNA, 22 bp, Homo sapiens
gaaatgcaggcttggattcagc

SEQ ID NO: 9025668 - DNA, 22 bp, Homo sapiens
gaaatgcaggcttggattcagc

SEQ ID NO: 9025669 - DNA, 22 bp, Homo sapiens
gaaatgcatggatcttggcaga

SEQ ID NO: 9025670 - DNA, 22 bp, Homo sapiens
gaaatgcatggatcttggcaga

SEQ ID NO: 9025671 - DNA, 22 bp, Homo sapiens
gaaatgctacacttgttaatga

SEQ ID NO: 9025672 - DNA, 22 bp, Homo sapiens
gaaatggtaaacattttaatgg

SEQ ID NO: 9025673 - DNA, 22 bp, Homo sapiens
gaaatggtaaacattttaatgg

SEQ ID NO: 9025674 - DNA, 22 bp, Homo sapiens
gaaatgctacacttgttaatga

SEQ ID NO: 9025675 - DNA, 22 bp, Homo sapiens
gaaatgtaattctcttgaagat

SEQ ID NO: 9025676 - DNA, 22 bp, Homo sapiens
gaaatgtaattctcttgaagat

SEQ ID NO: 9025677 - DNA, 22 bp, Homo sapiens
gaaatgtaattctcttgaagat

SEQ ID NO: 9025678 - DNA, 22 bp, Homo sapiens
gaagacatcatggagaggatag

SEQ ID NO: 9025679 - DNA, 22 bp, Homo sapiens
gaagacatcatggagaggatag

SEQ ID NO: 9025680 - DNA, 22 bp, Homo sapiens
gaagacatcgtgtggactaaca

SEQ ID NO: 9025681 - DNA, 22 bp, Homo sapiens
gaagacatgtggattctagttt

SEQ ID NO: 9025682 - DNA, 22 bp, Homo sapiens
gaagacagaaacctgtttggct

SEQ ID NO: 9025683 - DNA, 22 bp, Homo sapiens
gaagacatcatggagaggatag

SEQ ID NO: 9025684 - DNA, 22 bp, Homo sapiens
gaagacagaaacctgtttggct

SEQ ID NO: 9025685 - DNA, 22 bp, Homo sapiens
gaagacactctgcagagttatc

SEQ ID NO: 9025686 - DNA, 22 bp, Homo sapiens
gaagacattttatgcatactct

SEQ ID NO: 9025687 - DNA, 22 bp, Homo sapiens
gaagacctcataattcacatgc

SEQ ID NO: 9025688 - DNA, 22 bp, Homo sapiens
gaagacctgtttatgctgcatt

SEQ ID NO: 9025689 - DNA, 22 bp, Homo sapiens
gaagacgagataaaatggtgtc

SEQ ID NO: 9025690 - DNA, 22 bp, Homo sapiens
gaagacatgtttttaatatgta

SEQ ID NO: 9025691 - DNA, 22 bp, Homo sapiens
gaagacatgtggattctagttt

SEQ ID NO: 9025692 - DNA, 22 bp, Homo sapiens
gaagacatgtttttaatatgta

SEQ ID NO: 9025693 - DNA, 22 bp, Homo sapiens
gaaccagcagactttgacaggt

SEQ ID NO: 9025694 - DNA, 22 bp, Homo sapiens
gaaccatttctgaatagtttgt

SEQ ID NO: 9025695 - DNA, 22 bp, Homo sapiens
gaacccagaggatatgggaaag

SEQ ID NO: 9025696 - DNA, 21 bp, Homo sapiens
gaacccagcagcagtgctctg

SEQ ID NO: 9025697 - DNA, 22 bp, Homo sapiens
gaagacaagctgagtgttgtcc

SEQ ID NO: 9025698 - DNA, 21 bp, Homo sapiens
gaacccagcagcagtgctctg

SEQ ID NO: 9025699 - DNA, 22 bp, Homo sapiens
gaagacaattctgggtggagga

SEQ ID NO: 9025700 - DNA, 22 bp, Homo sapiens
gaagacacaattggtgggtcca

SEQ ID NO: 9025701 - DNA, 21 bp, Homo sapiens
gaacatttgggttgtttctac

SEQ ID NO: 9025702 - DNA, 21 bp, Homo sapiens
gaacatttgggttgtttctac

SEQ ID NO: 9025703 - DNA, 22 bp, Homo sapiens
gaaccacaatgtgaagaaggag

SEQ ID NO: 9025704 - DNA, 22 bp, Homo sapiens
gaaccacacagtgcagtcagga

SEQ ID NO: 9025705 - DNA, 22 bp, Homo sapiens
gaaccacaagattcaaaggggt

SEQ ID NO: 9025706 - DNA, 20 bp, Homo sapiens
gaacatttggccatactgag

SEQ ID NO: 9025707 - DNA, 21 bp, Homo sapiens
gaacatttgggttgtttctac

SEQ ID NO: 9025708 - DNA, 21 bp, Homo sapiens
gaacatttgggttgtttctac

SEQ ID NO: 9025709 - DNA, 20 bp, Homo sapiens
gaacatttggccatactgag

SEQ ID NO: 9025710 - DNA, 22 bp, Homo sapiens
gaagagctgacagtgtcatcct

SEQ ID NO: 9025711 - DNA, 22 bp, Homo sapiens
gaagagctgacagtgtcatcct

SEQ ID NO: 9025712 - DNA, 22 bp, Homo sapiens
gaagagctgcacactggggact

SEQ ID NO: 9025713 - DNA, 22 bp, Homo sapiens
gaagagctgcacactggggact

SEQ ID NO: 9025714 - DNA, 22 bp, Homo sapiens
gaagagctgcagtttcctgggc

SEQ ID NO: 9025715 - DNA, 22 bp, Homo sapiens
gaagagctgcagtttcctgggc

SEQ ID NO: 9025716 - DNA, 22 bp, Homo sapiens
gaagagctgcacactggggact

SEQ ID NO: 9025717 - DNA, 22 bp, Homo sapiens
gaagagctgcacactggggact

SEQ ID NO: 9025718 - DNA, 22 bp, Homo sapiens
gaagagctgctcagaacatgat

SEQ ID NO: 9025719 - DNA, 22 bp, Homo sapiens
gaagagctgctcagaacatgat

SEQ ID NO: 9025720 - DNA, 22 bp, Homo sapiens
gaagagctatgtccagggagca

SEQ ID NO: 9025721 - DNA, 22 bp, Homo sapiens
gaagagctatgtccagggagca

SEQ ID NO: 9025722 - DNA, 22 bp, Homo sapiens
gaagagctatgtccagggagca

SEQ ID NO: 9025723 - DNA, 22 bp, Homo sapiens
gaagagctatgtccagggagca

SEQ ID NO: 9025724 - DNA, 22 bp, Homo sapiens
gaagagctccaaaaacagtgag

SEQ ID NO: 9025725 - DNA, 22 bp, Homo sapiens
gaagagctccaaaaacagtgag

SEQ ID NO: 9025726 - DNA, 22 bp, Homo sapiens
gaagactctaagagaaatatga

SEQ ID NO: 9025727 - DNA, 22 bp, Homo sapiens
gaagagaagcatcaataggtaa

SEQ ID NO: 9025728 - DNA, 22 bp, Homo sapiens
gaagagaagcatcaataggtaa

SEQ ID NO: 9025729 - DNA, 22 bp, Homo sapiens
gaagagaagcatcaataggtaa

SEQ ID NO: 9025730 - DNA, 22 bp, Homo sapiens
gaagagaaggtgtaggccatcc

SEQ ID NO: 9025731 - DNA, 22 bp, Homo sapiens
gaagagctaaaggcacaggctt

SEQ ID NO: 9025732 - DNA, 22 bp, Homo sapiens
gaagagaagcatcaataggtaa

SEQ ID NO: 9025733 - DNA, 22 bp, Homo sapiens
gaagagcttagttgtcctagaa

SEQ ID NO: 9025734 - DNA, 22 bp, Homo sapiens
gaagagcttagttgtcctagaa

SEQ ID NO: 9025735 - DNA, 22 bp, Homo sapiens
gaagaggactgtggcatcctag

SEQ ID NO: 9025736 - DNA, 22 bp, Homo sapiens
gaagagctgtgattcaggctta

SEQ ID NO: 9025737 - DNA, 22 bp, Homo sapiens
gaagagctgtgattcaggctta

SEQ ID NO: 9025738 - DNA, 22 bp, Homo sapiens
gaagagcttagacagaatcaaa

SEQ ID NO: 9025739 - DNA, 22 bp, Homo sapiens
gaagagcttagacagaatcaaa

SEQ ID NO: 9025740 - DNA, 22 bp, Homo sapiens
gaagagctgtagcctgctcttt

SEQ ID NO: 9025741 - DNA, 22 bp, Homo sapiens
gaagagctggaatccagtctgg

SEQ ID NO: 9025742 - DNA, 22 bp, Homo sapiens
gaagagctgtagcctgctcttt

SEQ ID NO: 9025743 - DNA, 22 bp, Homo sapiens
gaagagctggaatccagtctgg

SEQ ID NO: 9025744 - DNA, 22 bp, Homo sapiens
gaagagctggaatccagtctgg

SEQ ID NO: 9025745 - DNA, 22 bp, Homo sapiens
gaagagctgctcagaacatgat

SEQ ID NO: 9025746 - DNA, 22 bp, Homo sapiens
gaagagctgtcagaaaagctaa

SEQ ID NO: 9025747 - DNA, 22 bp, Homo sapiens
gaagagctgtcagaaaagctaa

SEQ ID NO: 9025748 - DNA, 22 bp, Homo sapiens
gaagagctgtcagaaaagctaa

SEQ ID NO: 9025749 - DNA, 22 bp, Homo sapiens
gaagaggatgacaggagccggt

SEQ ID NO: 9025750 - DNA, 22 bp, Homo sapiens
gaagaggactgtggcatcctag

SEQ ID NO: 9025751 - DNA, 22 bp, Homo sapiens
gaagaggatgacaggagccggt

SEQ ID NO: 9025752 - DNA, 22 bp, Homo sapiens
gaagaggatgacaggagccggt

SEQ ID NO: 9025753 - DNA, 22 bp, Homo sapiens
gaagaggatgacaggagccggt

SEQ ID NO: 9025754 - DNA, 22 bp, Homo sapiens
gaagaggcaattgaataagcta

SEQ ID NO: 9025755 - DNA, 22 bp, Homo sapiens
gaagaggctttcctagggcaag

SEQ ID NO: 9025756 - DNA, 22 bp, Homo sapiens
gaagaggctttcctagggcaag

SEQ ID NO: 9025757 - DNA, 20 bp, Homo sapiens
gaagatgggtagaggcacag

SEQ ID NO: 9025758 - DNA, 22 bp, Homo sapiens
gaagatgtgggaactgctgaaa

SEQ ID NO: 9025759 - DNA, 22 bp, Homo sapiens
gaagatgtgggaactgctgaaa

SEQ ID NO: 9025760 - DNA, 22 bp, Homo sapiens
gaagatgttatggagagctcag

SEQ ID NO: 9025761 - DNA, 22 bp, Homo sapiens
gaagatgtgggcccactccaga

SEQ ID NO: 9025762 - DNA, 22 bp, Homo sapiens
gaagatgttatggagagctcag

SEQ ID NO: 9025763 - DNA, 22 bp, Homo sapiens
gaagattaaacatatttagtgt

SEQ ID NO: 9025764 - DNA, 22 bp, Homo sapiens
gaagatgttatggagagctcag

SEQ ID NO: 9025765 - DNA, 22 bp, Homo sapiens
gaagatgttatggagagctcag

SEQ ID NO: 9025766 - DNA, 22 bp, Homo sapiens
gaagattgaaggctgggaatta

SEQ ID NO: 9025767 - DNA, 22 bp, Homo sapiens
gaagattgaaggctgggaatta

SEQ ID NO: 9025768 - DNA, 22 bp, Homo sapiens
gaagattagggttagcataagt

SEQ ID NO: 9025769 - DNA, 22 bp, Homo sapiens
gaagattagaccatttccagct

SEQ ID NO: 9025770 - DNA, 22 bp, Homo sapiens
gaagattaaatgaagtgacctg

SEQ ID NO: 9025771 - DNA, 22 bp, Homo sapiens
gaagattaaatggctcccatat

SEQ ID NO: 9025772 - DNA, 22 bp, Homo sapiens
gaagattaaatgaagtgacctg

SEQ ID NO: 9025773 - DNA, 22 bp, Homo sapiens
gaagattaaacatatttagtgt

SEQ ID NO: 9025774 - DNA, 22 bp, Homo sapiens
gaagattaaacatatttagtgt

SEQ ID NO: 9025775 - DNA, 22 bp, Homo sapiens
gaagattacctgagaccacttg

SEQ ID NO: 9025776 - DNA, 22 bp, Homo sapiens
gaagattacctgagaccacttg

SEQ ID NO: 9025777 - DNA, 22 bp, Homo sapiens
gaagattaatgagaaacctgct

SEQ ID NO: 9025778 - DNA, 22 bp, Homo sapiens
gaagatttctttatgaaagatg

SEQ ID NO: 9025779 - DNA, 22 bp, Homo sapiens
gaagatttctttatgaaagatg

SEQ ID NO: 9025780 - DNA, 22 bp, Homo sapiens
gaagatttctttatgaaagatg

SEQ ID NO: 9025781 - DNA, 22 bp, Homo sapiens
gaagatttctttatgaaagatg

SEQ ID NO: 9025782 - DNA, 22 bp, Homo sapiens
gaagatttctttatgaaagatg

SEQ ID NO: 9025783 - DNA, 22 bp, Homo sapiens
gaagatttcagttaagtatcta

SEQ ID NO: 9025784 - DNA, 22 bp, Homo sapiens
gaagatttcagttaagtatcta

SEQ ID NO: 9025785 - DNA, 22 bp, Homo sapiens
gaagatttcagttaagtatcta

SEQ ID NO: 9025786 - DNA, 22 bp, Homo sapiens
gaagatttcagttaagtatcta

SEQ ID NO: 9025787 - DNA, 22 bp, Homo sapiens
gaagatttcagttaagtatcta

SEQ ID NO: 9025788 - DNA, 22 bp, Homo sapiens
gaagatttctgatgagttactt

SEQ ID NO: 9025789 - DNA, 22 bp, Homo sapiens
gaagatttctgatgagttactt

SEQ ID NO: 9025790 - DNA, 22 bp, Homo sapiens
gaagatttctgatgagttactt

SEQ ID NO: 9025791 - DNA, 22 bp, Homo sapiens
gaagatttataaggaccttatt

SEQ ID NO: 9025792 - DNA, 22 bp, Homo sapiens
gaagatttataaggaccttatt

SEQ ID NO: 9025793 - DNA, 22 bp, Homo sapiens
gaagatttataggagcctatta

SEQ ID NO: 9025794 - DNA, 22 bp, Homo sapiens
gaagatttataggagcctatta

SEQ ID NO: 9025795 - DNA, 22 bp, Homo sapiens
gaagatttaagcacaatagtct

SEQ ID NO: 9025796 - DNA, 22 bp, Homo sapiens
gaagatttaagcacaatagtct

SEQ ID NO: 9025797 - DNA, 22 bp, Homo sapiens
gaagatttaagcacaatagtct

SEQ ID NO: 9025798 - DNA, 22 bp, Homo sapiens
gaagaggttcaacgtggtcatc

SEQ ID NO: 9025799 - DNA, 22 bp, Homo sapiens
gaagagtggttatccctgctgt

SEQ ID NO: 9025800 - DNA, 23 bp, Homo sapiens
gaagagttgcaaagacgggacag

SEQ ID NO: 9025801 - DNA, 22 bp, Homo sapiens
gaagagtggttatccctgctgt

SEQ ID NO: 9025802 - DNA, 22 bp, Homo sapiens
gaagataactttaaaaagtggc

SEQ ID NO: 9025803 - DNA, 22 bp, Homo sapiens
gaagataactttaaaaagtggc

SEQ ID NO: 9025804 - DNA, 22 bp, Homo sapiens
gaagataactttaaaaagtggc

SEQ ID NO: 9025805 - DNA, 22 bp, Homo sapiens
gaagataactttaaaaagtggc

SEQ ID NO: 9025806 - DNA, 22 bp, Homo sapiens
gaagaggtagcattggcaggtg

SEQ ID NO: 9025807 - DNA, 22 bp, Homo sapiens
gaagaggctttcctagggcaag

SEQ ID NO: 9025808 - DNA, 22 bp, Homo sapiens
gaagaggctttcctagggcaag

SEQ ID NO: 9025809 - DNA, 22 bp, Homo sapiens
gaagaggctttcctagggcaag

SEQ ID NO: 9025810 - DNA, 20 bp, Homo sapiens
gaagatgggtagaggcacag

SEQ ID NO: 9025811 - DNA, 22 bp, Homo sapiens
gaagatgggaatgatgagtggg

SEQ ID NO: 9025812 - DNA, 22 bp, Homo sapiens
gaagatgggaatgatgagtggg

SEQ ID NO: 9025813 - DNA, 22 bp, Homo sapiens
gaagatgggaatgatgagtggg

SEQ ID NO: 9025814 - DNA, 22 bp, Homo sapiens
gaagatgggaatgatgagtggg

SEQ ID NO: 9025815 - DNA, 22 bp, Homo sapiens
gaagatctgcagcctcaggcga

SEQ ID NO: 9025816 - DNA, 22 bp, Homo sapiens
gaagatgggaatgatgagtggg

SEQ ID NO: 9025817 - DNA, 22 bp, Homo sapiens
gaagataattcctacttataac

SEQ ID NO: 9025818 - DNA, 22 bp, Homo sapiens
gaagataattcctacttataac

SEQ ID NO: 9025819 - DNA, 22 bp, Homo sapiens
gaagatattctctaaatacttt

SEQ ID NO: 9025820 - DNA, 22 bp, Homo sapiens
gaagatctgcagcctcaggcga

SEQ ID NO: 9025821 - DNA, 19 bp, Homo sapiens
gaagccctgcattctccgc

SEQ ID NO: 9025822 - DNA, 22 bp, Homo sapiens
gaagccctggggtcagtgtcgt

SEQ ID NO: 9025823 - DNA, 22 bp, Homo sapiens
gaagccctgtaggtgcaaaggt

SEQ ID NO: 9025824 - DNA, 22 bp, Homo sapiens
gaagccctggggtcagtgtcgt

SEQ ID NO: 9025825 - DNA, 22 bp, Homo sapiens
gaagcccttagcagagtctgac

SEQ ID NO: 9025826 - DNA, 22 bp, Homo sapiens
gaagcccttagcagagtctgac

SEQ ID NO: 9025827 - DNA, 23 bp, Homo sapiens
gaagccctcattggttctccaga

SEQ ID NO: 9025828 - DNA, 23 bp, Homo sapiens
gaagccctcattggttctccaga

SEQ ID NO: 9025829 - DNA, 22 bp, Homo sapiens
gaagccctcctatagtcatctg

SEQ ID NO: 9025830 - DNA, 22 bp, Homo sapiens
gaagccctaatacacagtacct

SEQ ID NO: 9025831 - DNA, 22 bp, Homo sapiens
gaagccctatcctctcctggga

SEQ ID NO: 9025832 - DNA, 22 bp, Homo sapiens
gaagccctatcctctcctggga

SEQ ID NO: 9025833 - DNA, 22 bp, Homo sapiens
gaagccctaagagaatagagct

SEQ ID NO: 9025834 - DNA, 22 bp, Homo sapiens
gaagccccaaaccctcgccatc

SEQ ID NO: 9025835 - DNA, 22 bp, Homo sapiens
gaagcccatttgtacagcacat

SEQ ID NO: 9025836 - DNA, 22 bp, Homo sapiens
gaagcccatttgtacagcacat

SEQ ID NO: 9025837 - DNA, 22 bp, Homo sapiens
gaagccaggggcctgacaggca

SEQ ID NO: 9025838 - DNA, 22 bp, Homo sapiens
gaagccaggggcctgacaggca

SEQ ID NO: 9025839 - DNA, 22 bp, Homo sapiens
gaagccagtactgtgctctgca

SEQ ID NO: 9025840 - DNA, 22 bp, Homo sapiens
gaagccagtgtttgaagaattt

SEQ ID NO: 9025841 - DNA, 22 bp, Homo sapiens
gaagccagtgtttgaagaattt

SEQ ID NO: 9025842 - DNA, 22 bp, Homo sapiens
gaagccatctttgttccccacc

SEQ ID NO: 9025843 - DNA, 22 bp, Homo sapiens
gaagcccagcaaactgtgatca

SEQ ID NO: 9025844 - DNA, 22 bp, Homo sapiens
gaagcccaggcttccttggctt

SEQ ID NO: 9025845 - DNA, 22 bp, Homo sapiens
gaagatttggattccatgtcac

SEQ ID NO: 9025846 - DNA, 22 bp, Homo sapiens
gaagatttggattccatgtcac

SEQ ID NO: 9025847 - DNA, 22 bp, Homo sapiens
gaagatttgttgtaatttttag

SEQ ID NO: 9025848 - DNA, 22 bp, Homo sapiens
gaagatttgttgtaatttttag

SEQ ID NO: 9025849 - DNA, 22 bp, Homo sapiens
gaagatttgttgtaatttttag

SEQ ID NO: 9025850 - DNA, 22 bp, Homo sapiens
gaagatttgaaacacatagaca

SEQ ID NO: 9025851 - DNA, 22 bp, Homo sapiens
gaagatttgaaacacatagaca

SEQ ID NO: 9025852 - DNA, 22 bp, Homo sapiens
gaagatttgaaacacatagaca

SEQ ID NO: 9025853 - DNA, 22 bp, Homo sapiens
gaagatttgaaacacatagaca

SEQ ID NO: 9025854 - DNA, 22 bp, Homo sapiens
gaagatttgcccatgcactttt

SEQ ID NO: 9025855 - DNA, 22 bp, Homo sapiens
gaagatttgcccatgcactttt

SEQ ID NO: 9025856 - DNA, 22 bp, Homo sapiens
gaagatttgcccatgcactttt

SEQ ID NO: 9025857 - DNA, 22 bp, Homo sapiens
gaagcaaaatgtctgcacatat

SEQ ID NO: 9025858 - DNA, 22 bp, Homo sapiens
gaagcaaaatgtctgcacatat

SEQ ID NO: 9025859 - DNA, 22 bp, Homo sapiens
gaagatttttcttaatgctccg

SEQ ID NO: 9025860 - DNA, 22 bp, Homo sapiens
gaagatttttcttaatgctccg

SEQ ID NO: 9025861 - DNA, 22 bp, Homo sapiens
gaagatttttcttaatgctccg

SEQ ID NO: 9025862 - DNA, 22 bp, Homo sapiens
gaagatttttcttaatgctccg

SEQ ID NO: 9025863 - DNA, 22 bp, Homo sapiens
gaagattttctcctttaaatga

SEQ ID NO: 9025864 - DNA, 22 bp, Homo sapiens
gaagattttctcctttaaatga

SEQ ID NO: 9025865 - DNA, 22 bp, Homo sapiens
gaagattttctcctttaaatga

SEQ ID NO: 9025866 - DNA, 22 bp, Homo sapiens
gaagatttgttgtaatttttag

SEQ ID NO: 9025867 - DNA, 22 bp, Homo sapiens
gaagccagatttggggcatatc

SEQ ID NO: 9025868 - DNA, 22 bp, Homo sapiens
gaagccagcagtggagaaagga

SEQ ID NO: 9025869 - DNA, 22 bp, Homo sapiens
gaagccagatttggggcatatc

SEQ ID NO: 9025870 - DNA, 22 bp, Homo sapiens
gaagccagcagtggagaaagga

SEQ ID NO: 9025871 - DNA, 22 bp, Homo sapiens
gaagccagattatcacaagcca

SEQ ID NO: 9025872 - DNA, 22 bp, Homo sapiens
gaagccagcatccctctcccat

SEQ ID NO: 9025873 - DNA, 22 bp, Homo sapiens
gaagccagccttgtctgcctct

SEQ ID NO: 9025874 - DNA, 22 bp, Homo sapiens
gaagccaggggcctgacaggca

SEQ ID NO: 9025875 - DNA, 22 bp, Homo sapiens
gaagccaggggcctgacaggca

SEQ ID NO: 9025876 - DNA, 22 bp, Homo sapiens
gacagtacaggtagaagtcact

SEQ ID NO: 9025877 - DNA, 22 bp, Homo sapiens
gacagtacaggtagaagtcact

SEQ ID NO: 9025878 - DNA, 22 bp, Homo sapiens
gacagtaaggtggcttcttctt

SEQ ID NO: 9025879 - DNA, 22 bp, Homo sapiens
gacagtaaggtggcttcttctt

SEQ ID NO: 9025880 - DNA, 22 bp, Homo sapiens
gacagtaagtcagagacttggt

SEQ ID NO: 9025881 - DNA, 22 bp, Homo sapiens
gacagtaagtcagagacttggt

SEQ ID NO: 9025882 - DNA, 22 bp, Homo sapiens
gacagtaagtcagagacttggt

SEQ ID NO: 9025883 - DNA, 22 bp, Homo sapiens
gacagtaagtcagagacttggt

SEQ ID NO: 9025884 - DNA, 22 bp, Homo sapiens
gacagtaactgagagatgtaat

SEQ ID NO: 9025885 - DNA, 22 bp, Homo sapiens
gacagtaactgagagatgtaat

SEQ ID NO: 9025886 - DNA, 22 bp, Homo sapiens
gacagtaactgagagatgtaat

SEQ ID NO: 9025887 - DNA, 22 bp, Homo sapiens
gacagtaactgagagatgtaat

SEQ ID NO: 9025888 - DNA, 22 bp, Homo sapiens
gacagtaactgagagatgtaat

SEQ ID NO: 9025889 - DNA, 22 bp, Homo sapiens
gacagtaagaccttaccagcct

SEQ ID NO: 9025890 - DNA, 22 bp, Homo sapiens
gacagtaagaccttaccagcct

SEQ ID NO: 9025891 - DNA, 22 bp, Homo sapiens
gacagtaagagtgtctgggttc

SEQ ID NO: 9025892 - DNA, 22 bp, Homo sapiens
gacagtaagagtgtctgggttc

SEQ ID NO: 9025893 - DNA, 22 bp, Homo sapiens
gaccctggctggagctggcctg

SEQ ID NO: 9025894 - DNA, 22 bp, Homo sapiens
gaccctggcaggtagcctcaca

SEQ ID NO: 9025895 - DNA, 22 bp, Homo sapiens
gaccctggctagggcttaacct

SEQ ID NO: 9025896 - DNA, 22 bp, Homo sapiens
gaccctggcaggtagcctcaca

SEQ ID NO: 9025897 - DNA, 22 bp, Homo sapiens
gaccctggcaggtagcctcaca

SEQ ID NO: 9025898 - DNA, 22 bp, Homo sapiens
gaccccaaaccctgtattcttc

SEQ ID NO: 9025899 - DNA, 22 bp, Homo sapiens
gacagtcacttccaggagagga

SEQ ID NO: 9025900 - DNA, 22 bp, Homo sapiens
gacagtcccccagcagcaaacc

SEQ ID NO: 9025901 - DNA, 22 bp, Homo sapiens
gacagtcccccagcagcaaacc

SEQ ID NO: 9025902 - DNA, 22 bp, Homo sapiens
gacccagtgactcgtctctgtg

SEQ ID NO: 9025903 - DNA, 22 bp, Homo sapiens
gacctagattaacattctgtga

SEQ ID NO: 9025904 - DNA, 22 bp, Homo sapiens
gacctatttaagtgtagttcaa

SEQ ID NO: 9025905 - DNA, 22 bp, Homo sapiens
gacctcagattttcccaggcca

SEQ ID NO: 9025906 - DNA, 22 bp, Homo sapiens
gacctcagattttcccaggcca

SEQ ID NO: 9025907 - DNA, 22 bp, Homo sapiens
gaccctttggaggtagtcacca

SEQ ID NO: 9025908 - DNA, 22 bp, Homo sapiens
gaccggttctgccgtggactgg

SEQ ID NO: 9025909 - DNA, 22 bp, Homo sapiens
gaccctttgacttgtgacatta

SEQ ID NO: 9025910 - DNA, 22 bp, Homo sapiens
gacccttttcagactcaggtac

SEQ ID NO: 9025911 - DNA, 22 bp, Homo sapiens
gaccctttggaggtagtcacca

SEQ ID NO: 9025912 - DNA, 22 bp, Homo sapiens
gaccctttctgagtgagcagtt

SEQ ID NO: 9025913 - DNA, 22 bp, Homo sapiens
gaccctttctgcatgcttatct

SEQ ID NO: 9025914 - DNA, 22 bp, Homo sapiens
gacccttagaatgtgatcttat

SEQ ID NO: 9025915 - DNA, 22 bp, Homo sapiens
gacccttggctgcagcatcaca

SEQ ID NO: 9025916 - DNA, 22 bp, Homo sapiens
gaccctttcacagctgctgggg

SEQ ID NO: 9025917 - DNA, 22 bp, Homo sapiens
gaccctttcagaccctttagta

SEQ ID NO: 9025918 - DNA, 22 bp, Homo sapiens
gacccttagaatgtgatcttat

SEQ ID NO: 9025919 - DNA, 22 bp, Homo sapiens
gacccttagaatgtgatcttat

SEQ ID NO: 9025920 - DNA, 22 bp, Homo sapiens
gaccctgtttctacaaataatt

SEQ ID NO: 9025921 - DNA, 22 bp, Homo sapiens
gaccctgtttctacaaataatt

SEQ ID NO: 9025922 - DNA, 22 bp, Homo sapiens
gaccctggtgggcactggcacc

SEQ ID NO: 9025923 - DNA, 22 bp, Homo sapiens
gaccctggtgggcactggcacc

SEQ ID NO: 9025924 - DNA, 22 bp, Homo sapiens
gaccctggtgggcactggcacc

SEQ ID NO: 9025925 - DNA, 22 bp, Homo sapiens
gaccctggctggagctggcctg

SEQ ID NO: 9025926 - DNA, 22 bp, Homo sapiens
gaccctggggaccatctagccc

SEQ ID NO: 9025927 - DNA, 22 bp, Homo sapiens
gaccctggctggagctggcctg

SEQ ID NO: 9025928 - DNA, 22 bp, Homo sapiens
gaccctggctggagctggcctg

SEQ ID NO: 9025929 - DNA, 22 bp, Homo sapiens
gaccctggtgtccaggtcctgc

SEQ ID NO: 9025930 - DNA, 22 bp, Homo sapiens
gaccctggtgggcactggcacc

SEQ ID NO: 9025931 - DNA, 22 bp, Homo sapiens
gaccctggtgtccaggtcctgc

SEQ ID NO: 9025932 - DNA, 22 bp, Homo sapiens
gaccctggtgggcactggcacc

SEQ ID NO: 9025933 - DNA, 22 bp, Homo sapiens
gaccctgtggctctgtggcaga

SEQ ID NO: 9025934 - DNA, 22 bp, Homo sapiens
gaccctgtttctacaaataatt

SEQ ID NO: 9025935 - DNA, 22 bp, Homo sapiens
gaccctgtttctacaaataatt

SEQ ID NO: 9025936 - DNA, 21 bp, Homo sapiens
gacaggtgattcagagcaggg

SEQ ID NO: 9025937 - DNA, 22 bp, Homo sapiens
gacaggtgagatgaggaacacc

SEQ ID NO: 9025938 - DNA, 22 bp, Homo sapiens
gacagggtttgcaaggacttcg

SEQ ID NO: 9025939 - DNA, 22 bp, Homo sapiens
gacagggtttgcaaggacttcg

SEQ ID NO: 9025940 - DNA, 22 bp, Homo sapiens
gacagggttgagtaaactggga

SEQ ID NO: 9025941 - DNA, 22 bp, Homo sapiens
gacagggtggctgatagggctc

SEQ ID NO: 9025942 - DNA, 22 bp, Homo sapiens
gacagggttgagtaaactggga

SEQ ID NO: 9025943 - DNA, 22 bp, Homo sapiens
gacagggtccaaaggcagggga

SEQ ID NO: 9025944 - DNA, 22 bp, Homo sapiens
gacagggtccaaaggcagggga

SEQ ID NO: 9025945 - DNA, 22 bp, Homo sapiens
gacagggtggctgatagggctc

SEQ ID NO: 9025946 - DNA, 22 bp, Homo sapiens
gacagggtacgggctaggcaca

SEQ ID NO: 9025947 - DNA, 22 bp, Homo sapiens
gacagggtccaaaggcagggga

SEQ ID NO: 9025948 - DNA, 22 bp, Homo sapiens
gacagggtacgggctaggcaca

SEQ ID NO: 9025949 - DNA, 22 bp, Homo sapiens
gacagggtacgggctaggcaca

SEQ ID NO: 9025950 - DNA, 18 bp, Homo sapiens
gacagtaaacttccccat

SEQ ID NO: 9025951 - DNA, 18 bp, Homo sapiens
gacagtaaacttccccat

SEQ ID NO: 9025952 - DNA, 22 bp, Homo sapiens
gacagtaaatgcagtctagcac

SEQ ID NO: 9025953 - DNA, 22 bp, Homo sapiens
gacagtaaatgcagtctagcac

SEQ ID NO: 9025954 - DNA, 22 bp, Homo sapiens
gacagtaactacagttctgtgg

SEQ ID NO: 9025955 - DNA, 22 bp, Homo sapiens
gacagtaactacagttctgtgg

SEQ ID NO: 9025956 - DNA, 22 bp, Homo sapiens
gacaggttgaagtatcaaaggt

SEQ ID NO: 9025957 - DNA, 22 bp, Homo sapiens
gacaggttgaagtatcaaaggt

SEQ ID NO: 9025958 - DNA, 22 bp, Homo sapiens
gacaggttgaagtatcaaaggt

SEQ ID NO: 9025959 - DNA, 20 bp, Homo sapiens
gacaggtgctaaagaggggc

SEQ ID NO: 9025960 - DNA, 22 bp, Homo sapiens
gacaggtgctaagggacctggc

SEQ ID NO: 9025961 - DNA, 20 bp, Homo sapiens
gacaggtgctaaagaggggc

SEQ ID NO: 9025962 - DNA, 22 bp, Homo sapiens
gacaggggtccctctgggctgt

SEQ ID NO: 9025963 - DNA, 22 bp, Homo sapiens
gacaggggtccctctgggctgt

SEQ ID NO: 9025964 - DNA, 22 bp, Homo sapiens
gacaggggtccctctgggctgt

SEQ ID NO: 9025965 - DNA, 22 bp, Homo sapiens
gacaggggtccctctgggctgt

SEQ ID NO: 9025966 - DNA, 22 bp, Homo sapiens
gacaggggtccctctgggctgt

SEQ ID NO: 9025967 - DNA, 22 bp, Homo sapiens
gacaggggtccctctgggctgt

SEQ ID NO: 9025968 - DNA, 22 bp, Homo sapiens
gacaggggctttgcatgcttta

SEQ ID NO: 9025969 - DNA, 21 bp, Homo sapiens
gacaggggaagaagcaaggag

SEQ ID NO: 9025970 - DNA, 21 bp, Homo sapiens
gacaggggaagaagcaaggag

SEQ ID NO: 9025971 - DNA, 21 bp, Homo sapiens
gacaggggaagaagcaaggag

SEQ ID NO: 9025972 - DNA, 21 bp, Homo sapiens
gacaggggaagaagcaaggag

SEQ ID NO: 9025973 - DNA, 21 bp, Homo sapiens
gacaggggccatgggtttcta

SEQ ID NO: 9025974 - DNA, 21 bp, Homo sapiens
gacaggggccatgggtttcta

SEQ ID NO: 9025975 - DNA, 21 bp, Homo sapiens
gacaggggccatgggtttcta

SEQ ID NO: 9025976 - DNA, 22 bp, Homo sapiens
gacaggggctttgcatgcttta

SEQ ID NO: 9025977 - DNA, 22 bp, Homo sapiens
gacaggggctttgcatgcttta

SEQ ID NO: 9025978 - DNA, 22 bp, Homo sapiens
gacaggggctttgcatgcttta

SEQ ID NO: 9025979 - DNA, 23 bp, Homo sapiens
gacagggctgacttggcagctgc

SEQ ID NO: 9025980 - DNA, 22 bp, Homo sapiens
gacagggctgtgggaggagcag

SEQ ID NO: 9025981 - DNA, 23 bp, Homo sapiens
gacagggctgacttggcagctgc

SEQ ID NO: 9025982 - DNA, 22 bp, Homo sapiens
gacagggctgtgggaggagcag

SEQ ID NO: 9025983 - DNA, 22 bp, Homo sapiens
gacagggctgtgggaggagcag

SEQ ID NO: 9025984 - DNA, 22 bp, Homo sapiens
gacagggctgtgggaggagcag

SEQ ID NO: 9025985 - DNA, 22 bp, Homo sapiens
gacagggctgtgggaggagcag

SEQ ID NO: 9025986 - DNA, 22 bp, Homo sapiens
gacagggctgtgggaggagcag

SEQ ID NO: 9025987 - DNA, 22 bp, Homo sapiens
gacagggctgtgggaggagcag

SEQ ID NO: 9025988 - DNA, 21 bp, Homo sapiens
gacaggggaagaagcaaggag

SEQ ID NO: 9025989 - DNA, 22 bp, Homo sapiens
gacagggctgtgggaggagcag

SEQ ID NO: 9025990 - DNA, 22 bp, Homo sapiens
gacaggctgtgatggccgggag

SEQ ID NO: 9025991 - DNA, 22 bp, Homo sapiens
gacaggcttagggagggtgctc

SEQ ID NO: 9025992 - DNA, 22 bp, Homo sapiens
gacaggctggcaatgccctgct

SEQ ID NO: 9025993 - DNA, 22 bp, Homo sapiens
gacaggcttagggagggtgctc

SEQ ID NO: 9025994 - DNA, 22 bp, Homo sapiens
gacaggcttcatgatggcagga

SEQ ID NO: 9025995 - DNA, 22 bp, Homo sapiens
gacaggcttccactatgttgcc

SEQ ID NO: 9025996 - DNA, 22 bp, Homo sapiens
gacaggcttccactatgttgcc

SEQ ID NO: 9025997 - DNA, 22 bp, Homo sapiens
gacaggcttcctaagtgccaga

SEQ ID NO: 9025998 - DNA, 22 bp, Homo sapiens
gacaggcttcctaagtgccaga

SEQ ID NO: 9025999 - DNA, 22 bp, Homo sapiens
gacaggcttcctaagtgccaga

SEQ ID NO: 9026000 - DNA, 22 bp, Homo sapiens
gacaggctttctcaggatgagc

SEQ ID NO: 9026001 - DNA, 22 bp, Homo sapiens
gacagggaaacattgaagtgtc

SEQ ID NO: 9026002 - DNA, 22 bp, Homo sapiens
gacagggaaacattgaagtgtc

SEQ ID NO: 9026003 - DNA, 22 bp, Homo sapiens
gacagggaacttcattagctgt

SEQ ID NO: 9026004 - DNA, 22 bp, Homo sapiens
gacacagaatttactcccgata

SEQ ID NO: 9026005 - DNA, 22 bp, Homo sapiens
gacacagacagttagaggtaat

SEQ ID NO: 9026006 - DNA, 22 bp, Homo sapiens
gacacagaccaccaggccctgg

SEQ ID NO: 9026007 - DNA, 22 bp, Homo sapiens
gacacagaccaccaggccctgg

SEQ ID NO: 9026008 - DNA, 22 bp, Homo sapiens
gacacagagacttgcagttgta

SEQ ID NO: 9026009 - DNA, 22 bp, Homo sapiens
gacacagagataggcctgtgtt

SEQ ID NO: 9026010 - DNA, 22 bp, Homo sapiens
gacacagagacttgcagttgta

SEQ ID NO: 9026011 - DNA, 22 bp, Homo sapiens
gacaggccccctcaggactgat

SEQ ID NO: 9026012 - DNA, 22 bp, Homo sapiens
gacaggcccgagtagctgatga

SEQ ID NO: 9026013 - DNA, 22 bp, Homo sapiens
gacaggctaggttgctgtcctc

SEQ ID NO: 9026014 - DNA, 17 bp, Homo sapiens
gacaggctcagtgacga

SEQ ID NO: 9026015 - DNA, 22 bp, Homo sapiens
gacaggccccctcaggactgat

SEQ ID NO: 9026016 - DNA, 22 bp, Homo sapiens
gacaggccccctcaggactgat

SEQ ID NO: 9026017 - DNA, 22 bp, Homo sapiens
gacaggccaggggctgaggtgg

SEQ ID NO: 9026018 - DNA, 22 bp, Homo sapiens
gacacagagataggcctgtgtt

SEQ ID NO: 9026019 - DNA, 22 bp, Homo sapiens
gacaggccaggggctgaggtgg

SEQ ID NO: 9026020 - DNA, 22 bp, Homo sapiens
gacaggccaggggctgaggtgg

SEQ ID NO: 9026021 - DNA, 22 bp, Homo sapiens
gacacagaattcccctccaagt

SEQ ID NO: 9026022 - DNA, 22 bp, Homo sapiens
gacacagaatgggtgctcagta

SEQ ID NO: 9026023 - DNA, 22 bp, Homo sapiens
gacacagaatgggtgctcagta

SEQ ID NO: 9026024 - DNA, 22 bp, Homo sapiens
gacacagaaggtcacatgttca

SEQ ID NO: 9026025 - DNA, 22 bp, Homo sapiens
gacacagaaggtcacatgttca

SEQ ID NO: 9026026 - DNA, 22 bp, Homo sapiens
gacaagttgtggagaagagggt

SEQ ID NO: 9026027 - DNA, 22 bp, Homo sapiens
gacaataaaatgatcttacagt

SEQ ID NO: 9026028 - DNA, 22 bp, Homo sapiens
gacaataaaatgatcttacagt

SEQ ID NO: 9026029 - DNA, 22 bp, Homo sapiens
gacaagttacacctgtgcttga

SEQ ID NO: 9026030 - DNA, 22 bp, Homo sapiens
gacaataaaatgatcttacagt

SEQ ID NO: 9026031 - DNA, 22 bp, Homo sapiens
gacaagtgggctgcagcttttg

SEQ ID NO: 9026032 - DNA, 22 bp, Homo sapiens
gacaagtgggctgcagcttttg

SEQ ID NO: 9026033 - DNA, 22 bp, Homo sapiens
gacaagtgctgatttatctccc

SEQ ID NO: 9026034 - DNA, 16 bp, Homo sapiens
gacaagtggaggggcc

SEQ ID NO: 9026035 - DNA, 22 bp, Homo sapiens
gacaagtgcccattattcttta

SEQ ID NO: 9026036 - DNA, 22 bp, Homo sapiens
gacaagtgcatgatttctatct

SEQ ID NO: 9026037 - DNA, 22 bp, Homo sapiens
gacaagggttctgcagagcctg

SEQ ID NO: 9026038 - DNA, 22 bp, Homo sapiens
gacaagggttctgcagagcctg

SEQ ID NO: 9026039 - DNA, 22 bp, Homo sapiens
gacaagtcatctggggcctgtg

SEQ ID NO: 9026040 - DNA, 22 bp, Homo sapiens
gacaagtgatgattataattca

SEQ ID NO: 9026041 - DNA, 22 bp, Homo sapiens
gacaagtgatgattataattca

SEQ ID NO: 9026042 - DNA, 22 bp, Homo sapiens
gacaaggcaaccagggaggctt

SEQ ID NO: 9026043 - DNA, 22 bp, Homo sapiens
gacaagctcttgtttcatggtt

SEQ ID NO: 9026044 - DNA, 22 bp, Homo sapiens
gacaaggaaattactagctgga

SEQ ID NO: 9026045 - DNA, 22 bp, Homo sapiens
gacaaggcgcccagcctgccaa

SEQ ID NO: 9026046 - DNA, 22 bp, Homo sapiens
gacaaggcgcccagcctgccaa

SEQ ID NO: 9026047 - DNA, 22 bp, Homo sapiens
gacaagggttctgcagagcctg

SEQ ID NO: 9026048 - DNA, 22 bp, Homo sapiens
gacaaggcagaaagcttaaagg

SEQ ID NO: 9026049 - DNA, 22 bp, Homo sapiens
gacaaggcaaccagggaggctt

SEQ ID NO: 9026050 - DNA, 22 bp, Homo sapiens
gacaaggcagaaagcttaaagg

SEQ ID NO: 9026051 - DNA, 22 bp, Homo sapiens
gaatacattggaaatcagaata

SEQ ID NO: 9026052 - DNA, 22 bp, Homo sapiens
gaatacattggaaatcagaata

SEQ ID NO: 9026053 - DNA, 22 bp, Homo sapiens
gaatacatgtgtgtatagaggt

SEQ ID NO: 9026054 - DNA, 22 bp, Homo sapiens
gaatacatgtgtgtatagaggt

SEQ ID NO: 9026055 - DNA, 22 bp, Homo sapiens
gaatacatgtgtgtatagaggt

SEQ ID NO: 9026056 - DNA, 22 bp, Homo sapiens
gaatacatgattaaagtttgat

SEQ ID NO: 9026057 - DNA, 22 bp, Homo sapiens
gaatacatgatacatgaactgc

SEQ ID NO: 9026058 - DNA, 22 bp, Homo sapiens
gaatacatggcagggagtcatc

SEQ ID NO: 9026059 - DNA, 22 bp, Homo sapiens
gaatacttgggtctggagtcaa

SEQ ID NO: 9026060 - DNA, 22 bp, Homo sapiens
gaatacttttgttaggaaaacg

SEQ ID NO: 9026061 - DNA, 18 bp, Homo sapiens
gaatactgagagcacaaa

SEQ ID NO: 9026062 - DNA, 22 bp, Homo sapiens
gaatacattggaaatcagaata

SEQ ID NO: 9026063 - DNA, 22 bp, Homo sapiens
gaatacattggaaatcagaata

SEQ ID NO: 9026064 - DNA, 22 bp, Homo sapiens
gaatacattggaaatcagaata

SEQ ID NO: 9026065 - DNA, 22 bp, Homo sapiens
gaatacatttgccgtggttctc

SEQ ID NO: 9026066 - DNA, 22 bp, Homo sapiens
gaatacattggaaatcagaata

SEQ ID NO: 9026067 - DNA, 22 bp, Homo sapiens
gaatagctgtaggctagtgtct

SEQ ID NO: 9026068 - DNA, 22 bp, Homo sapiens
gaatagctgtaggctagtgtct

SEQ ID NO: 9026069 - DNA, 22 bp, Homo sapiens
gaatagcttccttttttccaaa

SEQ ID NO: 9026070 - DNA, 22 bp, Homo sapiens
gaatagcttgacaattattttt

SEQ ID NO: 9026071 - DNA, 22 bp, Homo sapiens
gaatagcttagattccttagtg

SEQ ID NO: 9026072 - DNA, 22 bp, Homo sapiens
gaatagttctatggctgcaggg

SEQ ID NO: 9026073 - DNA, 22 bp, Homo sapiens
gaatagattatacttgaagcat

SEQ ID NO: 9026074 - DNA, 22 bp, Homo sapiens
gaatagatcctcatttattgat

SEQ ID NO: 9026075 - DNA, 22 bp, Homo sapiens
gaatagatcctcatttattgat

SEQ ID NO: 9026076 - DNA, 22 bp, Homo sapiens
gaatagatatccttgagggtct

SEQ ID NO: 9026077 - DNA, 22 bp, Homo sapiens
gaatagatagcttggatggttg

SEQ ID NO: 9026078 - DNA, 22 bp, Homo sapiens
gaatagataagtgactatttgg

SEQ ID NO: 9026079 - DNA, 22 bp, Homo sapiens
gaatatattattcagcttttca

SEQ ID NO: 9026080 - DNA, 22 bp, Homo sapiens
gaatatattggtgaaaatagtt

SEQ ID NO: 9026081 - DNA, 22 bp, Homo sapiens
gaatatattattcagcttttca

SEQ ID NO: 9026082 - DNA, 22 bp, Homo sapiens
gaatatattattcagcttttca

SEQ ID NO: 9026083 - DNA, 22 bp, Homo sapiens
gaatatattattcagcttttca

SEQ ID NO: 9026084 - DNA, 23 bp, Homo sapiens
gaatagttttagaaattggagaa

SEQ ID NO: 9026085 - DNA, 23 bp, Homo sapiens
gaatagttttagaaattggagaa

SEQ ID NO: 9026086 - DNA, 21 bp, Homo sapiens
gaatagttctgtggcagcagt

SEQ ID NO: 9026087 - DNA, 22 bp, Homo sapiens
gaatatattggtgaaaatagtt

SEQ ID NO: 9026088 - DNA, 22 bp, Homo sapiens
gaatatattggtgaaaatagtt

SEQ ID NO: 9026089 - DNA, 22 bp, Homo sapiens
gaatatattggtgaaaatagtt

SEQ ID NO: 9026090 - DNA, 22 bp, Homo sapiens
gaatatattggtgaaaatagtt

SEQ ID NO: 9026091 - DNA, 22 bp, Homo sapiens
gaatatattggtgaaaatagtt

SEQ ID NO: 9026092 - DNA, 22 bp, Homo sapiens
gaatatattggtgaaaatagtt

SEQ ID NO: 9026093 - DNA, 22 bp, Homo sapiens
gaatatatttctcttaccttta

SEQ ID NO: 9026094 - DNA, 22 bp, Homo sapiens
gaatattagtatcagttatacc

SEQ ID NO: 9026095 - DNA, 22 bp, Homo sapiens
gacaactgagcagaggaaatga

SEQ ID NO: 9026096 - DNA, 22 bp, Homo sapiens
gaatatcttgtacatctaagta

SEQ ID NO: 9026097 - DNA, 22 bp, Homo sapiens
gaatatgtgcatttatgagtgt

SEQ ID NO: 9026098 - DNA, 22 bp, Homo sapiens
gaatatgtgcatttatgagtgt

SEQ ID NO: 9026099 - DNA, 22 bp, Homo sapiens
gaatatgttctggaagttcttg

SEQ ID NO: 9026100 - DNA, 22 bp, Homo sapiens
gaatatgtttgacatttagttg

SEQ ID NO: 9026101 - DNA, 22 bp, Homo sapiens
gaatatgttctggaagttcttg

SEQ ID NO: 9026102 - DNA, 22 bp, Homo sapiens
gaatatgtgttcctggacaaga

SEQ ID NO: 9026103 - DNA, 22 bp, Homo sapiens
gaatatcccgctatgcaaagta

SEQ ID NO: 9026104 - DNA, 22 bp, Homo sapiens
gaatatcccgctatgcaaagta

SEQ ID NO: 9026105 - DNA, 18 bp, Homo sapiens
gaatatctagcacatagt

SEQ ID NO: 9026106 - DNA, 22 bp, Homo sapiens
gaatatcccgctatgcaaagta

SEQ ID NO: 9026107 - DNA, 22 bp, Homo sapiens
gaatatcccgctatgcaaagta

SEQ ID NO: 9026108 - DNA, 22 bp, Homo sapiens
gaatatatttctcttaccttta

SEQ ID NO: 9026109 - DNA, 22 bp, Homo sapiens
gaatatatttctcttaccttta

SEQ ID NO: 9026110 - DNA, 22 bp, Homo sapiens
gaatatatttctcttaccttta

SEQ ID NO: 9026111 - DNA, 22 bp, Homo sapiens
gaatatatttctcttaccttta

SEQ ID NO: 9026112 - DNA, 22 bp, Homo sapiens
gaatatatttctcttaccttta

SEQ ID NO: 9026113 - DNA, 22 bp, Homo sapiens
gaatatcccgctatgcaaagta

SEQ ID NO: 9026114 - DNA, 22 bp, Homo sapiens
gacaagctcttgtttcatggtt

SEQ ID NO: 9026115 - DNA, 22 bp, Homo sapiens
gacaagatttagagtctgctaa

SEQ ID NO: 9026116 - DNA, 22 bp, Homo sapiens
gacaagcaggctcctgaagaaa

SEQ ID NO: 9026117 - DNA, 22 bp, Homo sapiens
gacaagcaggctcctgaagaaa

SEQ ID NO: 9026118 - DNA, 22 bp, Homo sapiens
gacaagataatgaagtgcaatt

SEQ ID NO: 9026119 - DNA, 22 bp, Homo sapiens
gacaagataatgaagtgcaatt

SEQ ID NO: 9026120 - DNA, 22 bp, Homo sapiens
gacaagatgagcagctcagtgt

SEQ ID NO: 9026121 - DNA, 22 bp, Homo sapiens
gacaagattaaccatagttaag

SEQ ID NO: 9026122 - DNA, 23 bp, Homo sapiens
gaagttctttcttctcatgctgt

SEQ ID NO: 9026123 - DNA, 22 bp, Homo sapiens
gaagttctttatagcagtgtga

SEQ ID NO: 9026124 - DNA, 22 bp, Homo sapiens
gaagttcttatgaaaacttgag

SEQ ID NO: 9026125 - DNA, 22 bp, Homo sapiens
gaagttcttatgaaaacttgag

SEQ ID NO: 9026126 - DNA, 22 bp, Homo sapiens
gaagttctttatagcagtgtga

SEQ ID NO: 9026127 - DNA, 22 bp, Homo sapiens
gaagttcttagtctcatttgca

SEQ ID NO: 9026128 - DNA, 22 bp, Homo sapiens
gaagttcttagtctcatttgca

SEQ ID NO: 9026129 - DNA, 22 bp, Homo sapiens
gaagttctggtgtatgtgataa

SEQ ID NO: 9026130 - DNA, 22 bp, Homo sapiens
gaagttctgggatttccacagt

SEQ ID NO: 9026131 - DNA, 23 bp, Homo sapiens
gaagttctgttcagccagacaag

SEQ ID NO: 9026132 - DNA, 23 bp, Homo sapiens
gaagttctgttcagccagacaag

SEQ ID NO: 9026133 - DNA, 22 bp, Homo sapiens
gaagtttagaagtgacaggttt

SEQ ID NO: 9026134 - DNA, 22 bp, Homo sapiens
gaagtttagaagtgacaggttt

SEQ ID NO: 9026135 - DNA, 22 bp, Homo sapiens
gaagtttagaagtgacaggttt

SEQ ID NO: 9026136 - DNA, 22 bp, Homo sapiens
gaagtttacctctgccttgctt

SEQ ID NO: 9026137 - DNA, 22 bp, Homo sapiens
gaagttctttgctccccagtac

SEQ ID NO: 9026138 - DNA, 22 bp, Homo sapiens
gaagttgtaagcctgggaaggt

SEQ ID NO: 9026139 - DNA, 22 bp, Homo sapiens
gaagttgatagagtacatgatt

SEQ ID NO: 9026140 - DNA, 22 bp, Homo sapiens
gaagttctgaccatatggccaa

SEQ ID NO: 9026141 - DNA, 22 bp, Homo sapiens
gaagttctgaccatatggccaa

SEQ ID NO: 9026142 - DNA, 22 bp, Homo sapiens
gaagttctggctcagagaggaa

SEQ ID NO: 9026143 - DNA, 22 bp, Homo sapiens
gaagttctgggagtggcgccct

SEQ ID NO: 9026144 - DNA, 22 bp, Homo sapiens
gaagttctgggagtggcgccct

SEQ ID NO: 9026145 - DNA, 22 bp, Homo sapiens
gaagttctgggatttccacagt

SEQ ID NO: 9026146 - DNA, 22 bp, Homo sapiens
gaagttctgggatttccacagt

SEQ ID NO: 9026147 - DNA, 22 bp, Homo sapiens
gaagttctcttgggggcctgag

SEQ ID NO: 9026148 - DNA, 22 bp, Homo sapiens
gaagttctgaaataaaatcctg

SEQ ID NO: 9026149 - DNA, 22 bp, Homo sapiens
gaaggaagattctgttggaatc

SEQ ID NO: 9026150 - DNA, 22 bp, Homo sapiens
gaaggaagactggtttaaatgt

SEQ ID NO: 9026151 - DNA, 22 bp, Homo sapiens
gaaggaagattctgttggaatc

SEQ ID NO: 9026152 - DNA, 22 bp, Homo sapiens
gaaggaagactggtttaaatgt

SEQ ID NO: 9026153 - DNA, 22 bp, Homo sapiens
gaaggaaaggtctcatgccttt

SEQ ID NO: 9026154 - DNA, 22 bp, Homo sapiens
gaaggaaatctgtgatttatgc

SEQ ID NO: 9026155 - DNA, 22 bp, Homo sapiens
gaagctttgagagcagaagccc

SEQ ID NO: 9026156 - DNA, 22 bp, Homo sapiens
gaagcttggataactgtatggg

SEQ ID NO: 9026157 - DNA, 22 bp, Homo sapiens
gaagcttgaacagggccaggct

SEQ ID NO: 9026158 - DNA, 22 bp, Homo sapiens
gaagcttcgtggctcttcaaat

SEQ ID NO: 9026159 - DNA, 22 bp, Homo sapiens
gaagcttcgaaagagtgatttc

SEQ ID NO: 9026160 - DNA, 22 bp, Homo sapiens
gaagcctcaacatctctgcgtc

SEQ ID NO: 9026161 - DNA, 22 bp, Homo sapiens
gaagcctcaacatctctgcgtc

SEQ ID NO: 9026162 - DNA, 22 bp, Homo sapiens
gaagctgtgttgatggcatgga

SEQ ID NO: 9026163 - DNA, 22 bp, Homo sapiens
gaagctgtgttgatggcatgga

SEQ ID NO: 9026164 - DNA, 22 bp, Homo sapiens
gaagctgtgctgggggatctgt

SEQ ID NO: 9026165 - DNA, 22 bp, Homo sapiens
gaaggaaaacagatctgcctga

SEQ ID NO: 9026166 - DNA, 22 bp, Homo sapiens
gaaggaaaacagatctgcctga

SEQ ID NO: 9026167 - DNA, 22 bp, Homo sapiens
gaaggaaaacagatctgcctga

SEQ ID NO: 9026168 - DNA, 22 bp, Homo sapiens
gaagctttgtcttgtctcctgg

SEQ ID NO: 9026169 - DNA, 22 bp, Homo sapiens
gaaggaaaaatactctgtaagg

SEQ ID NO: 9026170 - DNA, 22 bp, Homo sapiens
gaaggaaaaatactctgtaagg

SEQ ID NO: 9026171 - DNA, 22 bp, Homo sapiens
gaaggaaaaatactctgtaagg

SEQ ID NO: 9026172 - DNA, 22 bp, Homo sapiens
gaaggaaaaatactctgtaagg

SEQ ID NO: 9026173 - DNA, 22 bp, Homo sapiens
gaatacaagcctgccacctgga

SEQ ID NO: 9026174 - DNA, 22 bp, Homo sapiens
gaatacaagcctgccacctgga

SEQ ID NO: 9026175 - DNA, 22 bp, Homo sapiens
gaatacaagcctgccacctgga

SEQ ID NO: 9026176 - DNA, 22 bp, Homo sapiens
gaatacaagcctgccacctgga

SEQ ID NO: 9026177 - DNA, 22 bp, Homo sapiens
gaatacaagccaggcacaaggc

SEQ ID NO: 9026178 - DNA, 22 bp, Homo sapiens
gaatacaagccaggcacaaggc

SEQ ID NO: 9026179 - DNA, 22 bp, Homo sapiens
gaatacaagccaggcacaaggc

SEQ ID NO: 9026180 - DNA, 22 bp, Homo sapiens
gaatacaagccaggcacaaggc

SEQ ID NO: 9026181 - DNA, 22 bp, Homo sapiens
gaatacaagccaggcacaaggc

SEQ ID NO: 9026182 - DNA, 22 bp, Homo sapiens
gaatacaagccaggcacaaggc

SEQ ID NO: 9026183 - DNA, 22 bp, Homo sapiens
gaatacaccaaggaatcagaat

SEQ ID NO: 9026184 - DNA, 22 bp, Homo sapiens
gaatacacgaatagagcatggt

SEQ ID NO: 9026185 - DNA, 22 bp, Homo sapiens
gaatacacgaaggcaagagtcc

SEQ ID NO: 9026186 - DNA, 22 bp, Homo sapiens
gaatacacgaaggcaagagtcc

SEQ ID NO: 9026187 - DNA, 23 bp, Homo sapiens
gaatacagagataaatagaacac

SEQ ID NO: 9026188 - DNA, 22 bp, Homo sapiens
gaatacacgcacgacacggggg

SEQ ID NO: 9026189 - DNA, 23 bp, Homo sapiens
gaatacagagataaatagaacac

SEQ ID NO: 9026190 - DNA, 22 bp, Homo sapiens
gaatacatgatacatgaactgc

SEQ ID NO: 9026191 - DNA, 22 bp, Homo sapiens
gaatacatctgaaggctatgaa

SEQ ID NO: 9026192 - DNA, 19 bp, Homo sapiens
gaatacagataataagcag

SEQ ID NO: 9026193 - DNA, 22 bp, Homo sapiens
gaatacatatcagatgtgtttc

SEQ ID NO: 9026194 - DNA, 22 bp, Homo sapiens
gaatacatatcagatgtgtttc

SEQ ID NO: 9026195 - DNA, 22 bp, Homo sapiens
gaagtttattttacacatccat

SEQ ID NO: 9026196 - DNA, 22 bp, Homo sapiens
gaagtttattttacacatccat

SEQ ID NO: 9026197 - DNA, 22 bp, Homo sapiens
gaagtttattttacacatccat

SEQ ID NO: 9026198 - DNA, 22 bp, Homo sapiens
gaagtttatttcaatctattca

SEQ ID NO: 9026199 - DNA, 22 bp, Homo sapiens
gaagtttaggttcttatgttta

SEQ ID NO: 9026200 - DNA, 22 bp, Homo sapiens
gaagtttatggtgcttgtaagg

SEQ ID NO: 9026201 - DNA, 22 bp, Homo sapiens
gaagtttagagtgttgtaattt

SEQ ID NO: 9026202 - DNA, 22 bp, Homo sapiens
gaagtttagagtgttgtaattt

SEQ ID NO: 9026203 - DNA, 22 bp, Homo sapiens
gaagtttagagtgttgtaattt

SEQ ID NO: 9026204 - DNA, 22 bp, Homo sapiens
gaagtttagagtttggagtcct

SEQ ID NO: 9026205 - DNA, 22 bp, Homo sapiens
gaagtttagagtttggagtcct

SEQ ID NO: 9026206 - DNA, 22 bp, Homo sapiens
gaagtttaggttcttatgttta

SEQ ID NO: 9026207 - DNA, 22 bp, Homo sapiens
gaataacagcaagtttgcaggc

SEQ ID NO: 9026208 - DNA, 22 bp, Homo sapiens
gaataacagcaagtttgcaggc

SEQ ID NO: 9026209 - DNA, 22 bp, Homo sapiens
gaataacattggaaccctgaag

SEQ ID NO: 9026210 - DNA, 22 bp, Homo sapiens
gaataacattttttcctttaca

SEQ ID NO: 9026211 - DNA, 22 bp, Homo sapiens
gaagttttagtcaaaatgtaga

SEQ ID NO: 9026212 - DNA, 22 bp, Homo sapiens
gaagtttgatttttctcctaga

SEQ ID NO: 9026213 - DNA, 22 bp, Homo sapiens
gaagttttagtcaaaatgtaga

SEQ ID NO: 9026214 - DNA, 22 bp, Homo sapiens
gaataaactcctcagcttcctt

SEQ ID NO: 9026215 - DNA, 22 bp, Homo sapiens
gaggcacatcacttggtgcatt

SEQ ID NO: 9026216 - DNA, 22 bp, Homo sapiens
gaggcacatcacttggtgcatt

SEQ ID NO: 9026217 - DNA, 22 bp, Homo sapiens
gaggcacatcacttggtgcatt

SEQ ID NO: 9026218 - DNA, 22 bp, Homo sapiens
gaggcaatgggctatagcattg

SEQ ID NO: 9026219 - DNA, 22 bp, Homo sapiens
gaggcaccagacatggcctcat

SEQ ID NO: 9026220 - DNA, 22 bp, Homo sapiens
gaggcaccagacatggcctcat

SEQ ID NO: 9026221 - DNA, 22 bp, Homo sapiens
gaggcaccagacatggcctcat

SEQ ID NO: 9026222 - DNA, 22 bp, Homo sapiens
gaggcacatcacttggtgcatt

SEQ ID NO: 9026223 - DNA, 22 bp, Homo sapiens
gaggcacatgactcaccaatgg

SEQ ID NO: 9026224 - DNA, 23 bp, Homo sapiens
gaggcactcaggaaatgtgagtg

SEQ ID NO: 9026225 - DNA, 22 bp, Homo sapiens
gaggcacctcgcgggaggaggc

SEQ ID NO: 9026226 - DNA, 22 bp, Homo sapiens
gaggcacctcgcgggaggaggc

SEQ ID NO: 9026227 - DNA, 22 bp, Homo sapiens
gaggcacctcgcgggaggaggc

SEQ ID NO: 9026228 - DNA, 22 bp, Homo sapiens
gaggcactgaccattttcatat

SEQ ID NO: 9026229 - DNA, 22 bp, Homo sapiens
gaggcactgaatacttgagggt

SEQ ID NO: 9026230 - DNA, 22 bp, Homo sapiens
gaggcactctcgacaagggtgg

SEQ ID NO: 9026231 - DNA, 22 bp, Homo sapiens
gaggcactgaatacttgagggt

SEQ ID NO: 9026232 - DNA, 22 bp, Homo sapiens
gaggcactgagagtgggggatg

SEQ ID NO: 9026233 - DNA, 22 bp, Homo sapiens
gaggcactgagagtgggggatg

SEQ ID NO: 9026234 - DNA, 22 bp, Homo sapiens
gaggcactgagagtgggggatg

SEQ ID NO: 9026235 - DNA, 22 bp, Homo sapiens
gaggcactgcagtacagtgact

SEQ ID NO: 9026236 - DNA, 22 bp, Homo sapiens
gaggcactgcagtacagtgact

SEQ ID NO: 9026237 - DNA, 22 bp, Homo sapiens
gaggcactgcagtacagtgact

SEQ ID NO: 9026238 - DNA, 22 bp, Homo sapiens
gaggcagaagttgcagtgagca

SEQ ID NO: 9026239 - DNA, 22 bp, Homo sapiens
gaggcagaagttgcagtgagca

SEQ ID NO: 9026240 - DNA, 22 bp, Homo sapiens
gaggcactgctgggcccctgta

SEQ ID NO: 9026241 - DNA, 22 bp, Homo sapiens
gaggcactgcagtacagtgact

SEQ ID NO: 9026242 - DNA, 22 bp, Homo sapiens
gaggcactggaggaaaggagaa

SEQ ID NO: 9026243 - DNA, 22 bp, Homo sapiens
gaggcactgctgggcccctgta

SEQ ID NO: 9026244 - DNA, 22 bp, Homo sapiens
gaggcagaagttgcagtgagca

SEQ ID NO: 9026245 - DNA, 22 bp, Homo sapiens
gaggcagaagttgcagtgagca

SEQ ID NO: 9026246 - DNA, 22 bp, Homo sapiens
gaggcagaagttgcagtgagca

SEQ ID NO: 9026247 - DNA, 22 bp, Homo sapiens
gaggcagagaccttcaggacct

SEQ ID NO: 9026248 - DNA, 22 bp, Homo sapiens
gaggcagaagttgcagtgagca

SEQ ID NO: 9026249 - DNA, 22 bp, Homo sapiens
gaggcagaagttgcagtgagca

SEQ ID NO: 9026250 - DNA, 22 bp, Homo sapiens
gaggcagaagttgcagtgagca

SEQ ID NO: 9026251 - DNA, 22 bp, Homo sapiens
gaggcagagaccttcaggacct

SEQ ID NO: 9026252 - DNA, 22 bp, Homo sapiens
gaggcagaagttgcagtgagca

SEQ ID NO: 9026253 - DNA, 22 bp, Homo sapiens
gaggcagagactccaccttcag

SEQ ID NO: 9026254 - DNA, 22 bp, Homo sapiens
gaggcagagactccaccttcag

SEQ ID NO: 9026255 - DNA, 22 bp, Homo sapiens
gaggcagagaccttcaggacct

SEQ ID NO: 9026256 - DNA, 22 bp, Homo sapiens
gaggcagagaccttcaggacct

SEQ ID NO: 9026257 - DNA, 22 bp, Homo sapiens
gaggccagctacccaagggtca

SEQ ID NO: 9026258 - DNA, 22 bp, Homo sapiens
gaggccagctacccaagggtca

SEQ ID NO: 9026259 - DNA, 22 bp, Homo sapiens
gaggccagctacccaagggtca

SEQ ID NO: 9026260 - DNA, 22 bp, Homo sapiens
gaggccagctacccaagggtca

SEQ ID NO: 9026261 - DNA, 22 bp, Homo sapiens
gaggccagctacccaagggtca

SEQ ID NO: 9026262 - DNA, 22 bp, Homo sapiens
gaggccagcgcgcagcactttt

SEQ ID NO: 9026263 - DNA, 22 bp, Homo sapiens
gaggccagctacccaagggtca

SEQ ID NO: 9026264 - DNA, 22 bp, Homo sapiens
gaggccagctagtccaggaagt

SEQ ID NO: 9026265 - DNA, 22 bp, Homo sapiens
gaggccagctagtccaggaagt

SEQ ID NO: 9026266 - DNA, 22 bp, Homo sapiens
gaggccagctagtccaggaagt

SEQ ID NO: 9026267 - DNA, 22 bp, Homo sapiens
gaggccagctagtccaggaagt

SEQ ID NO: 9026268 - DNA, 22 bp, Homo sapiens
gaggccagctagtccaggaagt

SEQ ID NO: 9026269 - DNA, 22 bp, Homo sapiens
gaggccaggacatgaaagctga

SEQ ID NO: 9026270 - DNA, 22 bp, Homo sapiens
gaggccaggaggatctctctaa

SEQ ID NO: 9026271 - DNA, 22 bp, Homo sapiens
gaggccaggacatgaaagctga

SEQ ID NO: 9026272 - DNA, 22 bp, Homo sapiens
gaggccaggacatgaaagctga

SEQ ID NO: 9026273 - DNA, 22 bp, Homo sapiens
gaggccaggacatgaaagctga

SEQ ID NO: 9026274 - DNA, 22 bp, Homo sapiens
gaggccaggacatgaaagctga

SEQ ID NO: 9026275 - DNA, 22 bp, Homo sapiens
gaggccaggaagcccaagatca

SEQ ID NO: 9026276 - DNA, 22 bp, Homo sapiens
gaggccaggaagcccaagatca

SEQ ID NO: 9026277 - DNA, 22 bp, Homo sapiens
gaggccaggaagcccaagatca

SEQ ID NO: 9026278 - DNA, 22 bp, Homo sapiens
gaggccaggaagcccaagatca

SEQ ID NO: 9026279 - DNA, 22 bp, Homo sapiens
gaggccaggaagcccaagatca

SEQ ID NO: 9026280 - DNA, 22 bp, Homo sapiens
gaggccaggacatgaaagctga

SEQ ID NO: 9026281 - DNA, 22 bp, Homo sapiens
gaggccaggaagcccaagatca

SEQ ID NO: 9026282 - DNA, 22 bp, Homo sapiens
gaggccagcgcgcagcactttt

SEQ ID NO: 9026283 - DNA, 22 bp, Homo sapiens
gaggccagcgcgcagcactttt

SEQ ID NO: 9026284 - DNA, 22 bp, Homo sapiens
gaggccagcccctcttgaaggc

SEQ ID NO: 9026285 - DNA, 22 bp, Homo sapiens
gaggccagcgcgcagcactttt

SEQ ID NO: 9026286 - DNA, 22 bp, Homo sapiens
gaggccagcgcgcagcactttt

SEQ ID NO: 9026287 - DNA, 22 bp, Homo sapiens
gaggccagatgtcatgtcttat

SEQ ID NO: 9026288 - DNA, 22 bp, Homo sapiens
gaggccagatgtcatgtcttat

SEQ ID NO: 9026289 - DNA, 22 bp, Homo sapiens
gaggccagcccctcttgaaggc

SEQ ID NO: 9026290 - DNA, 22 bp, Homo sapiens
gaggccagcccctcttgaaggc

SEQ ID NO: 9026291 - DNA, 22 bp, Homo sapiens
gaggccagcccctcttgaaggc

SEQ ID NO: 9026292 - DNA, 22 bp, Homo sapiens
gaggccagatactctcttctgc

SEQ ID NO: 9026293 - DNA, 22 bp, Homo sapiens
gaggcagaggttgcagtgagct

SEQ ID NO: 9026294 - DNA, 22 bp, Homo sapiens
gaggccagatgtcatgtcttat

SEQ ID NO: 9026295 - DNA, 22 bp, Homo sapiens
gaggccagatgtcatgtcttat

SEQ ID NO: 9026296 - DNA, 22 bp, Homo sapiens
gaggcagaggttgcagtgagct

SEQ ID NO: 9026297 - DNA, 22 bp, Homo sapiens
gaggcagaggaaggtggtctct

SEQ ID NO: 9026298 - DNA, 22 bp, Homo sapiens
gaggcagagactccaccttcag

SEQ ID NO: 9026299 - DNA, 22 bp, Homo sapiens
gaggcagaggaaggtggtctct

SEQ ID NO: 9026300 - DNA, 22 bp, Homo sapiens
gaggcagaggaaggtggtctct

SEQ ID NO: 9026301 - DNA, 22 bp, Homo sapiens
gaggcagaggaaggtggtctct

SEQ ID NO: 9026302 - DNA, 22 bp, Homo sapiens
gaggcagaggaaggtggtctct

SEQ ID NO: 9026303 - DNA, 22 bp, Homo sapiens
gaggaggaggaagtggaaccca

SEQ ID NO: 9026304 - DNA, 22 bp, Homo sapiens
gaggaggagtatatattagaat

SEQ ID NO: 9026305 - DNA, 22 bp, Homo sapiens
gaggaggcactagttagtgaca

SEQ ID NO: 9026306 - DNA, 22 bp, Homo sapiens
gaggaggcactagttagtgaca

SEQ ID NO: 9026307 - DNA, 22 bp, Homo sapiens
gaggaggcacttgagcagatgt

SEQ ID NO: 9026308 - DNA, 22 bp, Homo sapiens
gaggaggaggaagtggaaccca

SEQ ID NO: 9026309 - DNA, 22 bp, Homo sapiens
gaggaggaggaagtggaaccca

SEQ ID NO: 9026310 - DNA, 22 bp, Homo sapiens
gaggaggaagttctctgtaggc

SEQ ID NO: 9026311 - DNA, 22 bp, Homo sapiens
gaggaggaagttctctgtaggc

SEQ ID NO: 9026312 - DNA, 22 bp, Homo sapiens
gaggaggaagttctctgtaggc

SEQ ID NO: 9026313 - DNA, 22 bp, Homo sapiens
gaggaggaggaagtggaaccca

SEQ ID NO: 9026314 - DNA, 19 bp, Homo sapiens
gaggaggaaaactagtgta

SEQ ID NO: 9026315 - DNA, 19 bp, Homo sapiens
gaggaggaaaactagtgta

SEQ ID NO: 9026316 - DNA, 19 bp, Homo sapiens
gaggaggaaaactagtgta

SEQ ID NO: 9026317 - DNA, 22 bp, Homo sapiens
gaggaggaaaccctgttcctct

SEQ ID NO: 9026318 - DNA, 22 bp, Homo sapiens
gaggaggaaaccctgttcctct

SEQ ID NO: 9026319 - DNA, 19 bp, Homo sapiens
gaggaggaaaactagtgta

SEQ ID NO: 9026320 - DNA, 19 bp, Homo sapiens
gaggaggaaaactagtgta

SEQ ID NO: 9026321 - DNA, 19 bp, Homo sapiens
gaggaggaaaactagtgta

SEQ ID NO: 9026322 - DNA, 22 bp, Homo sapiens
gaggaggaagttctctgtaggc

SEQ ID NO: 9026323 - DNA, 22 bp, Homo sapiens
gaggaggaagttctctgtaggc

SEQ ID NO: 9026324 - DNA, 22 bp, Homo sapiens
gaggaggaaaggagttgaaatg

SEQ ID NO: 9026325 - DNA, 22 bp, Homo sapiens
gaggaggaagttctctgtaggc

SEQ ID NO: 9026326 - DNA, 22 bp, Homo sapiens
gaggaggaaaggagttgaaatg

SEQ ID NO: 9026327 - DNA, 22 bp, Homo sapiens
gaggcaagagaagccagctttc

SEQ ID NO: 9026328 - DNA, 22 bp, Homo sapiens
gaggcaagagaagccagctttc

SEQ ID NO: 9026329 - DNA, 22 bp, Homo sapiens
gaggcaagagaagccagctttc

SEQ ID NO: 9026330 - DNA, 19 bp, Homo sapiens
gaggcaaggagtttaagcc

SEQ ID NO: 9026331 - DNA, 22 bp, Homo sapiens
gaggcaaggccgcacgtctcag

SEQ ID NO: 9026332 - DNA, 22 bp, Homo sapiens
gaggaggctaagtgggctctgg

SEQ ID NO: 9026333 - DNA, 22 bp, Homo sapiens
gaggaggctaagtgggctctgg

SEQ ID NO: 9026334 - DNA, 22 bp, Homo sapiens
gaggaggctaagtgggctctgg

SEQ ID NO: 9026335 - DNA, 22 bp, Homo sapiens
gaggaggctaagtgggctctgg

SEQ ID NO: 9026336 - DNA, 22 bp, Homo sapiens
gaggaggctatcagcaatcagg

SEQ ID NO: 9026337 - DNA, 22 bp, Homo sapiens
gaggaggctatcagcaatcagg

SEQ ID NO: 9026338 - DNA, 22 bp, Homo sapiens
gaggaggctatcagcaatcagg

SEQ ID NO: 9026339 - DNA, 22 bp, Homo sapiens
gaggaggctaagtgggctctgg

SEQ ID NO: 9026340 - DNA, 22 bp, Homo sapiens
gaggaggctaagtgggctctgg

SEQ ID NO: 9026341 - DNA, 22 bp, Homo sapiens
gaggaggccagtggaaggaagc

SEQ ID NO: 9026342 - DNA, 22 bp, Homo sapiens
gaggaggccagtggaaggaagc

SEQ ID NO: 9026343 - DNA, 22 bp, Homo sapiens
gaggaggcagcctatcccttag

SEQ ID NO: 9026344 - DNA, 22 bp, Homo sapiens
gaggaggccagtggaaggaagc

SEQ ID NO: 9026345 - DNA, 22 bp, Homo sapiens
gaggaggcacttgagcagatgt

SEQ ID NO: 9026346 - DNA, 22 bp, Homo sapiens
gaggaggcacttgagcagatgt

SEQ ID NO: 9026347 - DNA, 19 bp, Homo sapiens
gaggagctatcggagacag

SEQ ID NO: 9026348 - DNA, 22 bp, Homo sapiens
gaggagctgtctttgtgatctt

SEQ ID NO: 9026349 - DNA, 19 bp, Homo sapiens
gaggagctatcggagacag

SEQ ID NO: 9026350 - DNA, 22 bp, Homo sapiens
gaggagctgttccctcacctct

SEQ ID NO: 9026351 - DNA, 22 bp, Homo sapiens
gaggagctgttccctcacctct

SEQ ID NO: 9026352 - DNA, 22 bp, Homo sapiens
gaggagctgttccctcacctct

SEQ ID NO: 9026353 - DNA, 22 bp, Homo sapiens
gaggagctgttccctcacctct

SEQ ID NO: 9026354 - DNA, 22 bp, Homo sapiens
gaggagctgtctttgtgatctt

SEQ ID NO: 9026355 - DNA, 22 bp, Homo sapiens
gaggagctgtctttgtgatctt

SEQ ID NO: 9026356 - DNA, 22 bp, Homo sapiens
gaggagccctgttccccaggcc

SEQ ID NO: 9026357 - DNA, 22 bp, Homo sapiens
gaggagccctgttccccaggcc

SEQ ID NO: 9026358 - DNA, 22 bp, Homo sapiens
gaggagcttcagaggaatctta

SEQ ID NO: 9026359 - DNA, 22 bp, Homo sapiens
gaggagcttgaggctaggagcc

SEQ ID NO: 9026360 - DNA, 22 bp, Homo sapiens
gaggagcttcagaggaatctta

SEQ ID NO: 9026361 - DNA, 22 bp, Homo sapiens
gaggagcttgcatttaagtgcc

SEQ ID NO: 9026362 - DNA, 22 bp, Homo sapiens
gaggagcttgcatttaagtgcc

SEQ ID NO: 9026363 - DNA, 22 bp, Homo sapiens
gaggagcttgaggctaggagcc

SEQ ID NO: 9026364 - DNA, 22 bp, Homo sapiens
gaggagcttgtgagaagatgtc

SEQ ID NO: 9026365 - DNA, 22 bp, Homo sapiens
gaggagcttgtgagaagatgtc

SEQ ID NO: 9026366 - DNA, 22 bp, Homo sapiens
gaggagcttgtgagaagatgtc

SEQ ID NO: 9026367 - DNA, 22 bp, Homo sapiens
gaggaaaataacaactaagggc

SEQ ID NO: 9026368 - DNA, 22 bp, Homo sapiens
gaggaaaataacaactaagggc

SEQ ID NO: 9026369 - DNA, 22 bp, Homo sapiens
gaggaaaatattcagggaggtt

SEQ ID NO: 9026370 - DNA, 22 bp, Homo sapiens
gaggaaaatattcagggaggtt

SEQ ID NO: 9026371 - DNA, 22 bp, Homo sapiens
gaggaaaatattcagggaggtt

SEQ ID NO: 9026372 - DNA, 22 bp, Homo sapiens
gaggaaaatattcagggaggtt

SEQ ID NO: 9026373 - DNA, 22 bp, Homo sapiens
gaggaaaatgcaacaggaatgc

SEQ ID NO: 9026374 - DNA, 22 bp, Homo sapiens
gaggaaaatgcaacaggaatgc

SEQ ID NO: 9026375 - DNA, 22 bp, Homo sapiens
gaggaaaatgcaacaggaatgc

SEQ ID NO: 9026376 - DNA, 22 bp, Homo sapiens
gaggaaaatattcagggaggtt

SEQ ID NO: 9026377 - DNA, 20 bp, Homo sapiens
gaggaaaagctgccaggcct

SEQ ID NO: 9026378 - DNA, 22 bp, Homo sapiens
gaggaaaataacaactaagggc

SEQ ID NO: 9026379 - DNA, 22 bp, Homo sapiens
gaggaaaataacaactaagggc

SEQ ID NO: 9026380 - DNA, 22 bp, Homo sapiens
gaggaaaataacaactaagggc

SEQ ID NO: 9026381 - DNA, 22 bp, Homo sapiens
gaggaaaataacaactaagggc

SEQ ID NO: 9026382 - DNA, 22 bp, Homo sapiens
gaggaaaagagacaggttattg

SEQ ID NO: 9026383 - DNA, 22 bp, Homo sapiens
gaggaaaagagacaggttattg

SEQ ID NO: 9026384 - DNA, 20 bp, Homo sapiens
gaggaaaagctgccaggcct

SEQ ID NO: 9026385 - DNA, 22 bp, Homo sapiens
gaggaaaagagacaggttattg

SEQ ID NO: 9026386 - DNA, 22 bp, Homo sapiens
gagctagacagcaagggcctgc

SEQ ID NO: 9026387 - DNA, 22 bp, Homo sapiens
gagctagaattaggccaatttc

SEQ ID NO: 9026388 - DNA, 22 bp, Homo sapiens
gagctactgaaatattgatttt

SEQ ID NO: 9026389 - DNA, 22 bp, Homo sapiens
gagctagagtttgtagggtaga

SEQ ID NO: 9026390 - DNA, 22 bp, Homo sapiens
gagctagagggagaagggcact

SEQ ID NO: 9026391 - DNA, 22 bp, Homo sapiens
gagctagactgggctctgatgt

SEQ ID NO: 9026392 - DNA, 22 bp, Homo sapiens
gagctaggttttccagtcgcat

SEQ ID NO: 9026393 - DNA, 22 bp, Homo sapiens
gagctagtagaacaagtgagga

SEQ ID NO: 9026394 - DNA, 22 bp, Homo sapiens
gagctaggctagggggagtcgc

SEQ ID NO: 9026395 - DNA, 22 bp, Homo sapiens
gagctagggaggaggcttgctc

SEQ ID NO: 9026396 - DNA, 22 bp, Homo sapiens
gagctagggaggaggcttgctc

SEQ ID NO: 9026397 - DNA, 22 bp, Homo sapiens
gagctaggatatcatgagggta

SEQ ID NO: 9026398 - DNA, 22 bp, Homo sapiens
gagctaagtttctggaggcaga

SEQ ID NO: 9026399 - DNA, 22 bp, Homo sapiens
gagctaaggtcacaagaagcag

SEQ ID NO: 9026400 - DNA, 22 bp, Homo sapiens
gagctaagctatgttatgcagc

SEQ ID NO: 9026401 - DNA, 22 bp, Homo sapiens
gagctaaggcacaggcaggctt

SEQ ID NO: 9026402 - DNA, 20 bp, Homo sapiens
gagctacacaaatgctgctt

SEQ ID NO: 9026403 - DNA, 22 bp, Homo sapiens
gagctacaggcagctgagccct

SEQ ID NO: 9026404 - DNA, 22 bp, Homo sapiens
gagctacaggcagctgagccct

SEQ ID NO: 9026405 - DNA, 22 bp, Homo sapiens
gagctacactgattcatttgtt

SEQ ID NO: 9026406 - DNA, 22 bp, Homo sapiens
gagctacagagtttggtgttca

SEQ ID NO: 9026407 - DNA, 22 bp, Homo sapiens
gagctaagaactgtgccaggtg

SEQ ID NO: 9026408 - DNA, 22 bp, Homo sapiens
gagcgggggctgccgggatttg

SEQ ID NO: 9026409 - DNA, 22 bp, Homo sapiens
gagcgggaggaacggctcgggc

SEQ ID NO: 9026410 - DNA, 22 bp, Homo sapiens
gagcgggaggaacggctcgggc

SEQ ID NO: 9026411 - DNA, 22 bp, Homo sapiens
gagctaagctatgttatgcagc

SEQ ID NO: 9026412 - DNA, 22 bp, Homo sapiens
gagctaagccctggagaggtcg

SEQ ID NO: 9026413 - DNA, 22 bp, Homo sapiens
gagctaagagtctagaaaggct

SEQ ID NO: 9026414 - DNA, 22 bp, Homo sapiens
gagctaagacctgagggcaagt

SEQ ID NO: 9026415 - DNA, 22 bp, Homo sapiens
gagctaagaagcaaataaatca

SEQ ID NO: 9026416 - DNA, 22 bp, Homo sapiens
gagctctgtgtggcttgggtgg

SEQ ID NO: 9026417 - DNA, 22 bp, Homo sapiens
gagctctgtgtagcctgagggt

SEQ ID NO: 9026418 - DNA, 22 bp, Homo sapiens
gagctctgtgtagcctgagggt

SEQ ID NO: 9026419 - DNA, 22 bp, Homo sapiens
gagctctgttctcgtcctgctg

SEQ ID NO: 9026420 - DNA, 22 bp, Homo sapiens
gagctctgttctcgtcctgctg

SEQ ID NO: 9026421 - DNA, 22 bp, Homo sapiens
gagctcttatagttctagcagt

SEQ ID NO: 9026422 - DNA, 22 bp, Homo sapiens
gagctctgatgtttagtggaga

SEQ ID NO: 9026423 - DNA, 22 bp, Homo sapiens
gagctctgatgtttagtggaga

SEQ ID NO: 9026424 - DNA, 22 bp, Homo sapiens
gagctctgatgtttagtggaga

SEQ ID NO: 9026425 - DNA, 22 bp, Homo sapiens
gagctctgaaaaagcttgcctt

SEQ ID NO: 9026426 - DNA, 22 bp, Homo sapiens
gagctataatagagcttcagtg

SEQ ID NO: 9026427 - DNA, 22 bp, Homo sapiens
gagctagtagaacaagtgagga

SEQ ID NO: 9026428 - DNA, 22 bp, Homo sapiens
gagctatagatgtttacatact

SEQ ID NO: 9026429 - DNA, 22 bp, Homo sapiens
gagctctatgtggctggcatgt

SEQ ID NO: 9026430 - DNA, 22 bp, Homo sapiens
gagcctcgtggcggccactgcg

SEQ ID NO: 9026431 - DNA, 22 bp, Homo sapiens
gagcctcgtggcggccactgcg

SEQ ID NO: 9026432 - DNA, 22 bp, Homo sapiens
gagcctcctcctggtgtgccga

SEQ ID NO: 9026433 - DNA, 22 bp, Homo sapiens
gagcctgaatttgacctgctta

SEQ ID NO: 9026434 - DNA, 22 bp, Homo sapiens
gagcctgaaatacaggtcactg

SEQ ID NO: 9026435 - DNA, 22 bp, Homo sapiens
gagcctcgtggcggccactgcg

SEQ ID NO: 9026436 - DNA, 22 bp, Homo sapiens
gagcctgcaggcctcggcctca

SEQ ID NO: 9026437 - DNA, 22 bp, Homo sapiens
gagcctgcagctttcacagcat

SEQ ID NO: 9026438 - DNA, 22 bp, Homo sapiens
gagcctgcccagccctgtccac

SEQ ID NO: 9026439 - DNA, 22 bp, Homo sapiens
gagcctgagtgctgcctcccct

SEQ ID NO: 9026440 - DNA, 22 bp, Homo sapiens
gagcctgagcaatgtgatgttt

SEQ ID NO: 9026441 - DNA, 22 bp, Homo sapiens
gagcctgatgaaacaggcagac

SEQ ID NO: 9026442 - DNA, 22 bp, Homo sapiens
gagcctgatgaaacaggcagac

SEQ ID NO: 9026443 - DNA, 22 bp, Homo sapiens
gagcccttttcctagatactgt

SEQ ID NO: 9026444 - DNA, 22 bp, Homo sapiens
gagccgaggcgcacagctcggg

SEQ ID NO: 9026445 - DNA, 22 bp, Homo sapiens
gagccctgttcaggcctcctca

SEQ ID NO: 9026446 - DNA, 22 bp, Homo sapiens
gagccgtgccagccctgtctcg

SEQ ID NO: 9026447 - DNA, 22 bp, Homo sapiens
gagcctcagggttttgttgaca

SEQ ID NO: 9026448 - DNA, 22 bp, Homo sapiens
gagcctcctcctggtgtgccga

SEQ ID NO: 9026449 - DNA, 22 bp, Homo sapiens
gagccctgttcaggcctcctca

SEQ ID NO: 9026450 - DNA, 22 bp, Homo sapiens
gagccaggtttgaatctcagtc

SEQ ID NO: 9026451 - DNA, 22 bp, Homo sapiens
gagccctgttcaggcctcctca

SEQ ID NO: 9026452 - DNA, 22 bp, Homo sapiens
gagccaggtttgaatctcagtc

SEQ ID NO: 9026453 - DNA, 22 bp, Homo sapiens
gagccaggtttgaatctcagtc

SEQ ID NO: 9026454 - DNA, 22 bp, Homo sapiens
gagccaggtttgaatctcagtc

SEQ ID NO: 9026455 - DNA, 22 bp, Homo sapiens
gagccaggtttgaatctcagtc

SEQ ID NO: 9026456 - DNA, 22 bp, Homo sapiens
gagcctgcgagggagtaaggca

SEQ ID NO: 9026457 - DNA, 22 bp, Homo sapiens
gagcctgcccctccaccaggat

SEQ ID NO: 9026458 - DNA, 22 bp, Homo sapiens
gagcctgcccctccaccaggat

SEQ ID NO: 9026459 - DNA, 22 bp, Homo sapiens
gagcctggacatctcaggccca

SEQ ID NO: 9026460 - DNA, 22 bp, Homo sapiens
gagcctggacatctcaggccca

SEQ ID NO: 9026461 - DNA, 22 bp, Homo sapiens
gagcctggacatctcaggccca

SEQ ID NO: 9026462 - DNA, 22 bp, Homo sapiens
gagcctggacatctcaggccca

SEQ ID NO: 9026463 - DNA, 22 bp, Homo sapiens
gagcctggagctggaacgaagc

SEQ ID NO: 9026464 - DNA, 22 bp, Homo sapiens
gagcctggagctggaacgaagc

SEQ ID NO: 9026465 - DNA, 22 bp, Homo sapiens
gagcctggatagccttgttcca

SEQ ID NO: 9026466 - DNA, 22 bp, Homo sapiens
gagcctggattgaagtgggtgg

SEQ ID NO: 9026467 - DNA, 22 bp, Homo sapiens
gagcctggattgaagtgggtgg

SEQ ID NO: 9026468 - DNA, 22 bp, Homo sapiens
gagcctggatagccttgttcca

SEQ ID NO: 9026469 - DNA, 22 bp, Homo sapiens
gagcctggagctggaacgaagc

SEQ ID NO: 9026470 - DNA, 22 bp, Homo sapiens
gagcctggattgtcaccgactt

SEQ ID NO: 9026471 - DNA, 22 bp, Homo sapiens
gagcggaggcttggaggccagc

SEQ ID NO: 9026472 - DNA, 22 bp, Homo sapiens
gagcctggattgaagtgggtgg

SEQ ID NO: 9026473 - DNA, 22 bp, Homo sapiens
gagcctggattgaagtgggtgg

SEQ ID NO: 9026474 - DNA, 22 bp, Homo sapiens
gagcctggattgaagtgggtgg

SEQ ID NO: 9026475 - DNA, 22 bp, Homo sapiens
gagcttaaaacatagccagact

SEQ ID NO: 9026476 - DNA, 22 bp, Homo sapiens
gagcttaaatggctaaatataa

SEQ ID NO: 9026477 - DNA, 22 bp, Homo sapiens
gagcttaaatggctaaatataa

SEQ ID NO: 9026478 - DNA, 22 bp, Homo sapiens
gagcttaaaacatagccagact

SEQ ID NO: 9026479 - DNA, 22 bp, Homo sapiens
gagctgttctgtgattgatcta

SEQ ID NO: 9026480 - DNA, 22 bp, Homo sapiens
gagctgttgtaagtattagaag

SEQ ID NO: 9026481 - DNA, 22 bp, Homo sapiens
gagctgtttgtgacaggctgtg

SEQ ID NO: 9026482 - DNA, 22 bp, Homo sapiens
gagctgttaagagggagtgaca

SEQ ID NO: 9026483 - DNA, 22 bp, Homo sapiens
gagctgtgttgtctagtaccga

SEQ ID NO: 9026484 - DNA, 22 bp, Homo sapiens
gagctgttcaaggacaggcacg

SEQ ID NO: 9026485 - DNA, 21 bp, Homo sapiens
gagctgttactctctctggag

SEQ ID NO: 9026486 - DNA, 22 bp, Homo sapiens
gagcttaggccagggacaggga

SEQ ID NO: 9026487 - DNA, 23 bp, Homo sapiens
gagcttagtctactcagacatcc

SEQ ID NO: 9026488 - DNA, 22 bp, Homo sapiens
gagcttcagctgccatgactgt

SEQ ID NO: 9026489 - DNA, 22 bp, Homo sapiens
gagcttccagagacatcagagt

SEQ ID NO: 9026490 - DNA, 22 bp, Homo sapiens
gagcttccatccttactgtgtg

SEQ ID NO: 9026491 - DNA, 22 bp, Homo sapiens
gagcttccatggacgccatctg

SEQ ID NO: 9026492 - DNA, 22 bp, Homo sapiens
gagcttccatccttactgtgtg

SEQ ID NO: 9026493 - DNA, 22 bp, Homo sapiens
gagcttccatccttactgtgtg

SEQ ID NO: 9026494 - DNA, 22 bp, Homo sapiens
gagcttggatgtcttttgttca

SEQ ID NO: 9026495 - DNA, 22 bp, Homo sapiens
gagcttggcagtgtcactaggg

SEQ ID NO: 9026496 - DNA, 22 bp, Homo sapiens
gagcttggacaccttggcaggt

SEQ ID NO: 9026497 - DNA, 22 bp, Homo sapiens
gagcttggaagcagatcctcac

SEQ ID NO: 9026498 - DNA, 22 bp, Homo sapiens
gagcttggacaagctctgaagg

SEQ ID NO: 9026499 - DNA, 22 bp, Homo sapiens
gagcttggcagtgtcactaggg

SEQ ID NO: 9026500 - DNA, 22 bp, Homo sapiens
gagcttggctggacctcacgga

SEQ ID NO: 9026501 - DNA, 23 bp, Homo sapiens
gagcttttgtagtagtcactgtg

SEQ ID NO: 9026502 - DNA, 22 bp, Homo sapiens
gagcttttgtgggggccaaggt

SEQ ID NO: 9026503 - DNA, 22 bp, Homo sapiens
gagcttttcccgtctttctcgt

SEQ ID NO: 9026504 - DNA, 22 bp, Homo sapiens
gagcttttcttccagttaatga

SEQ ID NO: 9026505 - DNA, 22 bp, Homo sapiens
gagcttcctgcaggtcactgtg

SEQ ID NO: 9026506 - DNA, 22 bp, Homo sapiens
gagcttcctgcaggtcactgtg

SEQ ID NO: 9026507 - DNA, 22 bp, Homo sapiens
gagcttcctgatgccgaccagt

SEQ ID NO: 9026508 - DNA, 22 bp, Homo sapiens
gagcttcctgatgccgaccagt

SEQ ID NO: 9026509 - DNA, 22 bp, Homo sapiens
gagcttccctctgcagtccctg

SEQ ID NO: 9026510 - DNA, 22 bp, Homo sapiens
gagcttccatggacgccatctg

SEQ ID NO: 9026511 - DNA, 22 bp, Homo sapiens
gagcttccctctgcagtccctg

SEQ ID NO: 9026512 - DNA, 22 bp, Homo sapiens
gagcttcctttttctgcatgac

SEQ ID NO: 9026513 - DNA, 19 bp, Homo sapiens
gagctgagagtagcactgg

SEQ ID NO: 9026514 - DNA, 19 bp, Homo sapiens
gagctgagagtagcactgg

SEQ ID NO: 9026515 - DNA, 19 bp, Homo sapiens
gagctgagagtagcactgg

SEQ ID NO: 9026516 - DNA, 22 bp, Homo sapiens
gagctgtgttcatgaggagaaa

SEQ ID NO: 9026517 - DNA, 22 bp, Homo sapiens
gagctgtgttcatgaggagaaa

SEQ ID NO: 9026518 - DNA, 22 bp, Homo sapiens
gagctgtgttgtctagtaccga

SEQ ID NO: 9026519 - DNA, 22 bp, Homo sapiens
gagctgtgttcatgaggagaaa

SEQ ID NO: 9026520 - DNA, 22 bp, Homo sapiens
gagctgtgttcatgaggagaaa

SEQ ID NO: 9026521 - DNA, 22 bp, Homo sapiens
gagctgagacacactttggcaa

SEQ ID NO: 9026522 - DNA, 22 bp, Homo sapiens
gagctgagaagcagcgcttgat

SEQ ID NO: 9026523 - DNA, 22 bp, Homo sapiens
gagctgagaagcagcgcttgat

SEQ ID NO: 9026524 - DNA, 22 bp, Homo sapiens
gagctgagacacactttggcaa

SEQ ID NO: 9026525 - DNA, 19 bp, Homo sapiens
gagctgagagtagcactgg

SEQ ID NO: 9026526 - DNA, 22 bp, Homo sapiens
gagctgacatccagcagtgacc

SEQ ID NO: 9026527 - DNA, 18 bp, Homo sapiens
gagctgagaagaggatgc

SEQ ID NO: 9026528 - DNA, 18 bp, Homo sapiens
gagctgagaagaggatgc

SEQ ID NO: 9026529 - DNA, 18 bp, Homo sapiens
gagctgagaagaggatgc

SEQ ID NO: 9026530 - DNA, 22 bp, Homo sapiens
gagctgaagtttccatttgtac

SEQ ID NO: 9026531 - DNA, 22 bp, Homo sapiens
gagctgaaggagaaagcagggg

SEQ ID NO: 9026532 - DNA, 21 bp, Homo sapiens
gagctgaatatgttctagggg

SEQ ID NO: 9026533 - DNA, 22 bp, Homo sapiens
gagctgaatcagagatattatt

SEQ ID NO: 9026534 - DNA, 22 bp, Homo sapiens
gagctgaattacggtgagtcat

SEQ ID NO: 9026535 - DNA, 22 bp, Homo sapiens
gagctcttgcttctagtccagg

SEQ ID NO: 9026536 - DNA, 22 bp, Homo sapiens
gagctcttccccatcttacatc

SEQ ID NO: 9026537 - DNA, 22 bp, Homo sapiens
gagctgaacatcatggaaaggc

SEQ ID NO: 9026538 - DNA, 22 bp, Homo sapiens
gagctgaagcgctacagcatcc

SEQ ID NO: 9026539 - DNA, 22 bp, Homo sapiens
gagctgaaatatgaagccaatt

SEQ ID NO: 9026540 - DNA, 22 bp, Homo sapiens
gagctgaacatcatggaaaggc

SEQ ID NO: 9026541 - DNA, 22 bp, Homo sapiens
gagctgaacaaattgcgagtgg

SEQ ID NO: 9026542 - DNA, 22 bp, Homo sapiens
gagcagcaggtggctgtgatgg

SEQ ID NO: 9026543 - DNA, 22 bp, Homo sapiens
gagcagcaggtggctgtgatgg

SEQ ID NO: 9026544 - DNA, 22 bp, Homo sapiens
gagcagcaggtggggctggctt

SEQ ID NO: 9026545 - DNA, 22 bp, Homo sapiens
gagcagcaggtggggctggctt

SEQ ID NO: 9026546 - DNA, 22 bp, Homo sapiens
gagcagcaggtggggctggctt

SEQ ID NO: 9026547 - DNA, 22 bp, Homo sapiens
gagcagcaggtggggctggctt

SEQ ID NO: 9026548 - DNA, 22 bp, Homo sapiens
gagcagcatctccggcttaaag

SEQ ID NO: 9026549 - DNA, 22 bp, Homo sapiens
gagcagcatctccggcttaaag

SEQ ID NO: 9026550 - DNA, 22 bp, Homo sapiens
gagcagcagttgttacaatgat

SEQ ID NO: 9026551 - DNA, 22 bp, Homo sapiens
gagcagcagttgttacaatgat

SEQ ID NO: 9026552 - DNA, 22 bp, Homo sapiens
gagcagcagttgttacaatgat

SEQ ID NO: 9026553 - DNA, 22 bp, Homo sapiens
gagcagcaggtggggctggctt

SEQ ID NO: 9026554 - DNA, 22 bp, Homo sapiens
gagcagcaggtggggctggctt

SEQ ID NO: 9026555 - DNA, 22 bp, Homo sapiens
gagcagcaggtggggctggctt

SEQ ID NO: 9026556 - DNA, 22 bp, Homo sapiens
gagcagcaggccaggttgcagg

SEQ ID NO: 9026557 - DNA, 22 bp, Homo sapiens
gagcagcaggccaggttgcagg

SEQ ID NO: 9026558 - DNA, 22 bp, Homo sapiens
gagcagcaggtggctgtgatgg

SEQ ID NO: 9026559 - DNA, 22 bp, Homo sapiens
gagcagcaggccaggttgcagg

SEQ ID NO: 9026560 - DNA, 18 bp, Homo sapiens
gagcagcaggatcaagaa

SEQ ID NO: 9026561 - DNA, 18 bp, Homo sapiens
gagcagcaggatcaagaa

SEQ ID NO: 9026562 - DNA, 22 bp, Homo sapiens
gagcagcaggccaggttgcagg

SEQ ID NO: 9026563 - DNA, 18 bp, Homo sapiens
gagcagcaggatcaagaa

SEQ ID NO: 9026564 - DNA, 22 bp, Homo sapiens
gagcagcagctgggccaggttc

SEQ ID NO: 9026565 - DNA, 22 bp, Homo sapiens
gagcagcagctgggccaggttc

SEQ ID NO: 9026566 - DNA, 22 bp, Homo sapiens
gagcagcagctgggccaggttc

SEQ ID NO: 9026567 - DNA, 22 bp, Homo sapiens
gagcagcagctgggccaggttc

SEQ ID NO: 9026568 - DNA, 22 bp, Homo sapiens
gagcagcagctgggccaggttc

SEQ ID NO: 9026569 - DNA, 22 bp, Homo sapiens
gagcagcagctgggccaggttc

SEQ ID NO: 9026570 - DNA, 22 bp, Homo sapiens
gagcagcactgagttagcagct

SEQ ID NO: 9026571 - DNA, 22 bp, Homo sapiens
gagcagcactgagttagcagct

SEQ ID NO: 9026572 - DNA, 22 bp, Homo sapiens
gagcagcactgagttagcagct

SEQ ID NO: 9026573 - DNA, 22 bp, Homo sapiens
gagcagcaagcactcaaaggct

SEQ ID NO: 9026574 - DNA, 22 bp, Homo sapiens
gagcagcactgagttagcagct

SEQ ID NO: 9026575 - DNA, 22 bp, Homo sapiens
gagcagcaaagggagggtaaat

SEQ ID NO: 9026576 - DNA, 22 bp, Homo sapiens
gagcagcaaagggagggtaaat

SEQ ID NO: 9026577 - DNA, 22 bp, Homo sapiens
gagcagcaagcactcaaaggct

SEQ ID NO: 9026578 - DNA, 22 bp, Homo sapiens
gagcagcaaagggagggtaaat

SEQ ID NO: 9026579 - DNA, 22 bp, Homo sapiens
gagcagcacttgaggcatgtca

SEQ ID NO: 9026580 - DNA, 22 bp, Homo sapiens
gagcagcagattgtctccatgg

SEQ ID NO: 9026581 - DNA, 22 bp, Homo sapiens
gagcagcacttgaggcatgtca

SEQ ID NO: 9026582 - DNA, 22 bp, Homo sapiens
gagcagcacttgaggcatgtca

SEQ ID NO: 9026583 - DNA, 22 bp, Homo sapiens
gagcagcagattgtctccatgg

SEQ ID NO: 9026584 - DNA, 22 bp, Homo sapiens
gagcagcacttgaggcatgtca

SEQ ID NO: 9026585 - DNA, 22 bp, Homo sapiens
gagcagcagctgggccaggttc

SEQ ID NO: 9026586 - DNA, 22 bp, Homo sapiens
gagcagagtctatttccacact

SEQ ID NO: 9026587 - DNA, 22 bp, Homo sapiens
gagcagagtctatttccacact

SEQ ID NO: 9026588 - DNA, 22 bp, Homo sapiens
gagcagagtctatttccacact

SEQ ID NO: 9026589 - DNA, 22 bp, Homo sapiens
gagcagatgtgtgccaggatgc

SEQ ID NO: 9026590 - DNA, 22 bp, Homo sapiens
gagcagatgtgtgccaggatgc

SEQ ID NO: 9026591 - DNA, 22 bp, Homo sapiens
gagcagatctcaggccttctgt

SEQ ID NO: 9026592 - DNA, 23 bp, Homo sapiens
gagatttagcagacaaagctctt

SEQ ID NO: 9026593 - DNA, 23 bp, Homo sapiens
gagatttagcagacaaagctctt

SEQ ID NO: 9026594 - DNA, 22 bp, Homo sapiens
gagatttagagagacttaaaca

SEQ ID NO: 9026595 - DNA, 21 bp, Homo sapiens
gagatttagaaggatcaattt

SEQ ID NO: 9026596 - DNA, 22 bp, Homo sapiens
gagatttagctgcttaactcct

SEQ ID NO: 9026597 - DNA, 18 bp, Homo sapiens
gagcagaggctcaactgg

SEQ ID NO: 9026598 - DNA, 18 bp, Homo sapiens
gagcagaggctcaactgg

SEQ ID NO: 9026599 - DNA, 22 bp, Homo sapiens
gagcagagtctatttccacact

SEQ ID NO: 9026600 - DNA, 22 bp, Homo sapiens
gagatggagaaggaagctgttt

SEQ ID NO: 9026601 - DNA, 22 bp, Homo sapiens
gagatggagtctttttctgtca

SEQ ID NO: 9026602 - DNA, 22 bp, Homo sapiens
gagatggagtctttttctgtca

SEQ ID NO: 9026603 - DNA, 22 bp, Homo sapiens
gagatggagtctttttctgtca

SEQ ID NO: 9026604 - DNA, 22 bp, Homo sapiens
gagatggagtctttttctgtca

SEQ ID NO: 9026605 - DNA, 22 bp, Homo sapiens
gagatggagtctttttctgtca

SEQ ID NO: 9026606 - DNA, 22 bp, Homo sapiens
gagatggagtctttttctgtca

SEQ ID NO: 9026607 - DNA, 22 bp, Homo sapiens
gagatgtacaatgtgtattaat

SEQ ID NO: 9026608 - DNA, 22 bp, Homo sapiens
gagatggaatctgtgtggaggg

SEQ ID NO: 9026609 - DNA, 22 bp, Homo sapiens
gagatggaaaactgctggtagt

SEQ ID NO: 9026610 - DNA, 20 bp, Homo sapiens
gagatggacagatgaagggg

SEQ ID NO: 9026611 - DNA, 20 bp, Homo sapiens
gagatggacagatgaagggg

SEQ ID NO: 9026612 - DNA, 22 bp, Homo sapiens
gagatggaatctgtgtggaggg

SEQ ID NO: 9026613 - DNA, 22 bp, Homo sapiens
gagatggaatctgtgtggaggg

SEQ ID NO: 9026614 - DNA, 20 bp, Homo sapiens
gagatggacagatgaagggg

SEQ ID NO: 9026615 - DNA, 20 bp, Homo sapiens
gagatggacagatgaagggg

SEQ ID NO: 9026616 - DNA, 22 bp, Homo sapiens
gagatgtttagggtggggagag

SEQ ID NO: 9026617 - DNA, 20 bp, Homo sapiens
gagattaactgagaatctag

SEQ ID NO: 9026618 - DNA, 22 bp, Homo sapiens
gagattataagatagagtcatt

SEQ ID NO: 9026619 - DNA, 22 bp, Homo sapiens
gagattgtttagctaccatggc

SEQ ID NO: 9026620 - DNA, 22 bp, Homo sapiens
gagattgtttagctaccatggc

SEQ ID NO: 9026621 - DNA, 22 bp, Homo sapiens
gagatttaattggattaactta

SEQ ID NO: 9026622 - DNA, 22 bp, Homo sapiens
gagattggcctggcttgccaac

SEQ ID NO: 9026623 - DNA, 22 bp, Homo sapiens
gagattgggtcttgctctgtca

SEQ ID NO: 9026624 - DNA, 22 bp, Homo sapiens
gagattctgtagtcaggcatct

SEQ ID NO: 9026625 - DNA, 22 bp, Homo sapiens
gagattctgtagtcaggcatct

SEQ ID NO: 9026626 - DNA, 22 bp, Homo sapiens
gagattctgtgaaacggacatt

SEQ ID NO: 9026627 - DNA, 22 bp, Homo sapiens
gagattctttccagaactttga

SEQ ID NO: 9026628 - DNA, 22 bp, Homo sapiens
gagccaagcaccacattaagtt

SEQ ID NO: 9026629 - DNA, 22 bp, Homo sapiens
gagccaagcaatatacccaacc

SEQ ID NO: 9026630 - DNA, 22 bp, Homo sapiens
gagccaagattgtgtccctgca

SEQ ID NO: 9026631 - DNA, 22 bp, Homo sapiens
gagccaagatcgcaccactgca

SEQ ID NO: 9026632 - DNA, 22 bp, Homo sapiens
gagccaagatcgcaccactgca

SEQ ID NO: 9026633 - DNA, 22 bp, Homo sapiens
gagccaagggcgtgctggagag

SEQ ID NO: 9026634 - DNA, 22 bp, Homo sapiens
gagccaagctcttctccatgag

SEQ ID NO: 9026635 - DNA, 22 bp, Homo sapiens
gagccaagctcttctccatgag

SEQ ID NO: 9026636 - DNA, 22 bp, Homo sapiens
gagcagcttatgtcaagccaga

SEQ ID NO: 9026637 - DNA, 20 bp, Homo sapiens
gagcagctgtttgcattgca

SEQ ID NO: 9026638 - DNA, 22 bp, Homo sapiens
gagcagcttatgtcaagccaga

SEQ ID NO: 9026639 - DNA, 22 bp, Homo sapiens
gagccaaatgtgcagacattgt

SEQ ID NO: 9026640 - DNA, 22 bp, Homo sapiens
gagcatttttgtctgcatttta

SEQ ID NO: 9026641 - DNA, 22 bp, Homo sapiens
gagccaaatgtgcagacattgt

SEQ ID NO: 9026642 - DNA, 22 bp, Homo sapiens
gagccacagtggattgattcca

SEQ ID NO: 9026643 - DNA, 22 bp, Homo sapiens
gagccaccttcaactcaggaat

SEQ ID NO: 9026644 - DNA, 22 bp, Homo sapiens
gagccacagcaacctcaaagga

SEQ ID NO: 9026645 - DNA, 22 bp, Homo sapiens
gagccaatctttgggctcttgg

SEQ ID NO: 9026646 - DNA, 22 bp, Homo sapiens
gagccaagggttgccatggaga

SEQ ID NO: 9026647 - DNA, 22 bp, Homo sapiens
gagccaagggttgccatggaga

SEQ ID NO: 9026648 - DNA, 22 bp, Homo sapiens
gagccaagggcgtgctggagag

SEQ ID NO: 9026649 - DNA, 22 bp, Homo sapiens
gagccaagggcgtgctggagag

SEQ ID NO: 9026650 - DNA, 22 bp, Homo sapiens
gagcagctgtggggttgaccat

SEQ ID NO: 9026651 - DNA, 22 bp, Homo sapiens
gagcagctgtggggttgaccat

SEQ ID NO: 9026652 - DNA, 22 bp, Homo sapiens
gagcagctgttctgacttgtct

SEQ ID NO: 9026653 - DNA, 20 bp, Homo sapiens
gagcagctgtttgcattgca

SEQ ID NO: 9026654 - DNA, 22 bp, Homo sapiens
gagcagctgttctgacttgtct

SEQ ID NO: 9026655 - DNA, 22 bp, Homo sapiens
gagcagctgtccccaaagcttc

SEQ ID NO: 9026656 - DNA, 22 bp, Homo sapiens
gagcagctggtaggtgaaccca

SEQ ID NO: 9026657 - DNA, 22 bp, Homo sapiens
gagcagctgtccccaaagcttc

SEQ ID NO: 9026658 - DNA, 22 bp, Homo sapiens
gagcagctgtccccaaagcttc

SEQ ID NO: 9026659 - DNA, 22 bp, Homo sapiens
gagcagcctgaggagcgtgggc

SEQ ID NO: 9026660 - DNA, 22 bp, Homo sapiens
gagcagcctgaggagcgtgggc

SEQ ID NO: 9026661 - DNA, 22 bp, Homo sapiens
gagcagctgcagtgcagaccct

SEQ ID NO: 9026662 - DNA, 22 bp, Homo sapiens
gagcagctgcagtgcagaccct

SEQ ID NO: 9026663 - DNA, 22 bp, Homo sapiens
gagcagctggacaggcctccct

SEQ ID NO: 9026664 - DNA, 22 bp, Homo sapiens
gagcagctggacaggcctccct

SEQ ID NO: 9026665 - DNA, 22 bp, Homo sapiens
gagcagctggaggccttgttgg

SEQ ID NO: 9026666 - DNA, 22 bp, Homo sapiens
gagcagctggaggccttgttgg

SEQ ID NO: 9026667 - DNA, 22 bp, Homo sapiens
gagcagctggctgtattggttt

SEQ ID NO: 9026668 - DNA, 22 bp, Homo sapiens
gagcagctggctgtattggttt

SEQ ID NO: 9026669 - DNA, 22 bp, Homo sapiens
gagccagactgcctgaagctca

SEQ ID NO: 9026670 - DNA, 22 bp, Homo sapiens
gagccagactgcctgaagctca

SEQ ID NO: 9026671 - DNA, 22 bp, Homo sapiens
gagccagacaggctagagcggg

SEQ ID NO: 9026672 - DNA, 22 bp, Homo sapiens
gagccagacaggctagagcggg

SEQ ID NO: 9026673 - DNA, 22 bp, Homo sapiens
gagccagagatccaggatggct

SEQ ID NO: 9026674 - DNA, 22 bp, Homo sapiens
gagccagactgcctgaagctca

SEQ ID NO: 9026675 - DNA, 22 bp, Homo sapiens
gagccagaaaagctgcctgact

SEQ ID NO: 9026676 - DNA, 22 bp, Homo sapiens
gagccagaaaagctgcctgact

SEQ ID NO: 9026677 - DNA, 22 bp, Homo sapiens
gagccagaaaagctgcctgact

SEQ ID NO: 9026678 - DNA, 22 bp, Homo sapiens
gagccagaaaagctgcctgact

SEQ ID NO: 9026679 - DNA, 22 bp, Homo sapiens
gagccaccttcaactcaggaat

SEQ ID NO: 9026680 - DNA, 22 bp, Homo sapiens
gagccagggctgtgagctgagc

SEQ ID NO: 9026681 - DNA, 22 bp, Homo sapiens
gagccagggctgtgagctgagc

SEQ ID NO: 9026682 - DNA, 22 bp, Homo sapiens
gagccagccgcaagagctgtga

SEQ ID NO: 9026683 - DNA, 22 bp, Homo sapiens
gagccagcaggacttaagccag

SEQ ID NO: 9026684 - DNA, 22 bp, Homo sapiens
gagccagccgcaagagctgtga

SEQ ID NO: 9026685 - DNA, 22 bp, Homo sapiens
gagccagcaggacttaagccag

SEQ ID NO: 9026686 - DNA, 22 bp, Homo sapiens
gagccagcagccggcaccacca

SEQ ID NO: 9026687 - DNA, 22 bp, Homo sapiens
gagccagcagccggcaccacca

SEQ ID NO: 9026688 - DNA, 22 bp, Homo sapiens
gagccagcagccggcaccacca

SEQ ID NO: 9026689 - DNA, 22 bp, Homo sapiens
gagccagcagccggcaccacca

SEQ ID NO: 9026690 - DNA, 22 bp, Homo sapiens
gagccagagctacaagtgtctg

SEQ ID NO: 9026691 - DNA, 22 bp, Homo sapiens
gagccagagctacaagtgtctg

SEQ ID NO: 9026692 - DNA, 22 bp, Homo sapiens
gagccagagctacaagtgtctg

SEQ ID NO: 9026693 - DNA, 22 bp, Homo sapiens
gagccagagctacaagtgtctg

SEQ ID NO: 9026694 - DNA, 22 bp, Homo sapiens
gagccagattttatgcaagaca

SEQ ID NO: 9026695 - DNA, 22 bp, Homo sapiens
gagccagattttatgcaagaca

SEQ ID NO: 9026696 - DNA, 22 bp, Homo sapiens
gagccaggtcgggccgcggcga

SEQ ID NO: 9026697 - DNA, 22 bp, Homo sapiens
gagccagggtttgaaactagac

SEQ ID NO: 9026698 - DNA, 22 bp, Homo sapiens
gagccaggtcgggccgcggcga

SEQ ID NO: 9026699 - DNA, 22 bp, Homo sapiens
gagccaggtcgggccgcggcga

SEQ ID NO: 9026700 - DNA, 16 bp, Homo sapiens
gagccaggtgccttga

SEQ ID NO: 9026701 - DNA, 22 bp, Homo sapiens
gagccaggttggaggctgcagt

SEQ ID NO: 9026702 - DNA, 22 bp, Homo sapiens
gagccaggttggaggctgcagt

SEQ ID NO: 9026703 - DNA, 22 bp, Homo sapiens
gagccaggttggaggctgcagt

SEQ ID NO: 9026704 - DNA, 22 bp, Homo sapiens
gagccaggttggaggctgcagt

SEQ ID NO: 9026705 - DNA, 22 bp, Homo sapiens
gagccaggggtcagctccgagg

SEQ ID NO: 9026706 - DNA, 22 bp, Homo sapiens
gagccaggggtcagctccgagg

SEQ ID NO: 9026707 - DNA, 22 bp, Homo sapiens
gagccaggggtcagctccgagg

SEQ ID NO: 9026708 - DNA, 22 bp, Homo sapiens
gagccagggtttgaaactagac

SEQ ID NO: 9026709 - DNA, 22 bp, Homo sapiens
gagccagggtttgaaactagac

SEQ ID NO: 9026710 - DNA, 22 bp, Homo sapiens
gagccagggctgtgagctgagc

SEQ ID NO: 9026711 - DNA, 22 bp, Homo sapiens
gagccagggctgtgagctgagc

SEQ ID NO: 9026712 - DNA, 22 bp, Homo sapiens
gagccagggctgtgagctgagc

SEQ ID NO: 9026713 - DNA, 22 bp, Homo sapiens
gagccaggggtcagctccgagg

SEQ ID NO: 9026714 - DNA, 22 bp, Homo sapiens
gagccaggggtcagctccgagg

SEQ ID NO: 9026715 - DNA, 22 bp, Homo sapiens
gagccaggggtcagctccgagg

SEQ ID NO: 9026716 - DNA, 22 bp, Homo sapiens
gagaggctgtgtgccattgttg

SEQ ID NO: 9026717 - DNA, 22 bp, Homo sapiens
gagaggcttaagggctgtgaag

SEQ ID NO: 9026718 - DNA, 22 bp, Homo sapiens
gagaggcttaagggctgtgaag

SEQ ID NO: 9026719 - DNA, 22 bp, Homo sapiens
gagaggctgtgtgccattgttg

SEQ ID NO: 9026720 - DNA, 22 bp, Homo sapiens
gagaggctggtaaagtctgaac

SEQ ID NO: 9026721 - DNA, 22 bp, Homo sapiens
gagaggctggtaaagtctgaac

SEQ ID NO: 9026722 - DNA, 22 bp, Homo sapiens
gagaggctgggttggagatcga

SEQ ID NO: 9026723 - DNA, 22 bp, Homo sapiens
gagaggctggtaaagtctgaac

SEQ ID NO: 9026724 - DNA, 22 bp, Homo sapiens
gagaggctgggttggagatcga

SEQ ID NO: 9026725 - DNA, 22 bp, Homo sapiens
gagaggctgggttggagatcga

SEQ ID NO: 9026726 - DNA, 22 bp, Homo sapiens
gagaggctgggttggagatcga

SEQ ID NO: 9026727 - DNA, 22 bp, Homo sapiens
gagaggcttgtgtgaagaacaa

SEQ ID NO: 9026728 - DNA, 22 bp, Homo sapiens
gagaggcttaagggctgtgaag

SEQ ID NO: 9026729 - DNA, 22 bp, Homo sapiens
gagagggagccagccaggaacc

SEQ ID NO: 9026730 - DNA, 22 bp, Homo sapiens
gagagggagccagccaggaacc

SEQ ID NO: 9026731 - DNA, 22 bp, Homo sapiens
gagagggagccagccaggaacc

SEQ ID NO: 9026732 - DNA, 22 bp, Homo sapiens
gagagggagccagccaggaacc

SEQ ID NO: 9026733 - DNA, 22 bp, Homo sapiens
gagatcctgtaggcagctaaga

SEQ ID NO: 9026734 - DNA, 22 bp, Homo sapiens
gagatgcagaaccctcaggagc

SEQ ID NO: 9026735 - DNA, 22 bp, Homo sapiens
gagatgcagaaccctcaggagc

SEQ ID NO: 9026736 - DNA, 22 bp, Homo sapiens
gagatgatctttcctgtagtcc

SEQ ID NO: 9026737 - DNA, 22 bp, Homo sapiens
gagatgctgtcaggctatctgt

SEQ ID NO: 9026738 - DNA, 22 bp, Homo sapiens
gagatgagtgggggatctctca

SEQ ID NO: 9026739 - DNA, 22 bp, Homo sapiens
gagatgaatgtaaacaaaggca

SEQ ID NO: 9026740 - DNA, 22 bp, Homo sapiens
gagatgaatcattccatggtca

SEQ ID NO: 9026741 - DNA, 22 bp, Homo sapiens
gagatcttcaaggttttagata

SEQ ID NO: 9026742 - DNA, 22 bp, Homo sapiens
gagatctctagcacttcctgta

SEQ ID NO: 9026743 - DNA, 22 bp, Homo sapiens
gagatcggtaaagagcatgcac

SEQ ID NO: 9026744 - DNA, 22 bp, Homo sapiens
gagatctctagcacttcctgta

SEQ ID NO: 9026745 - DNA, 22 bp, Homo sapiens
gagatcggtaaagagcatgcac

SEQ ID NO: 9026746 - DNA, 22 bp, Homo sapiens
gagatcggtaaagagcatgcac

SEQ ID NO: 9026747 - DNA, 22 bp, Homo sapiens
gagaggccatggggtgggatgc

SEQ ID NO: 9026748 - DNA, 22 bp, Homo sapiens
gagaggccaaaatccctgcccc

SEQ ID NO: 9026749 - DNA, 22 bp, Homo sapiens
gagaggccaaaatccctgcccc

SEQ ID NO: 9026750 - DNA, 22 bp, Homo sapiens
gagaggccatggctgtgcagtg

SEQ ID NO: 9026751 - DNA, 22 bp, Homo sapiens
gagacaaaagttggagtgcaag

SEQ ID NO: 9026752 - DNA, 22 bp, Homo sapiens
gagacaaaagttggagtgcaag

SEQ ID NO: 9026753 - DNA, 22 bp, Homo sapiens
gagacaatttctaagatgcttc

SEQ ID NO: 9026754 - DNA, 22 bp, Homo sapiens
gagacaatttctaagatgcttc

SEQ ID NO: 9026755 - DNA, 22 bp, Homo sapiens
gagacacaaacacatttagagg

SEQ ID NO: 9026756 - DNA, 22 bp, Homo sapiens
gagacacaaacacatttagagg

SEQ ID NO: 9026757 - DNA, 22 bp, Homo sapiens
gagaggcatggaacagattctt

SEQ ID NO: 9026758 - DNA, 22 bp, Homo sapiens
gagaggcatggaacagattctt

SEQ ID NO: 9026759 - DNA, 22 bp, Homo sapiens
gagaggcatggaacagattctt

SEQ ID NO: 9026760 - DNA, 22 bp, Homo sapiens
gagaggcatggaacagattctt

SEQ ID NO: 9026761 - DNA, 22 bp, Homo sapiens
gagaggcatggaacagattctt

SEQ ID NO: 9026762 - DNA, 22 bp, Homo sapiens
gagaggccctgaagcccacaga

SEQ ID NO: 9026763 - DNA, 18 bp, Homo sapiens
gagaggcccggctgtgcc

SEQ ID NO: 9026764 - DNA, 22 bp, Homo sapiens
gagaggccctgaagcccacaga

SEQ ID NO: 9026765 - DNA, 18 bp, Homo sapiens
gagaggcccggctgtgcc

SEQ ID NO: 9026766 - DNA, 22 bp, Homo sapiens
gagaggccctgaagcccacaga

SEQ ID NO: 9026767 - DNA, 22 bp, Homo sapiens
gagaggccctgtggtcccagct

SEQ ID NO: 9026768 - DNA, 22 bp, Homo sapiens
gagaggccctgtggtcccagct

SEQ ID NO: 9026769 - DNA, 22 bp, Homo sapiens
gagaggccggcgtcgctgcggc

SEQ ID NO: 9026770 - DNA, 22 bp, Homo sapiens
gagaggcctgagaggctgcgga

SEQ ID NO: 9026771 - DNA, 22 bp, Homo sapiens
gagaggcctgagaggctgcgga

SEQ ID NO: 9026772 - DNA, 19 bp, Homo sapiens
gagaggcctgtgcttgaag

SEQ ID NO: 9026773 - DNA, 22 bp, Homo sapiens
gagaggctatgaggttctgtgt

SEQ ID NO: 9026774 - DNA, 22 bp, Homo sapiens
gagaggctatgaggttctgtgt

SEQ ID NO: 9026775 - DNA, 22 bp, Homo sapiens
gagaggctcagggacttgctga

SEQ ID NO: 9026776 - DNA, 22 bp, Homo sapiens
gacctcaggtttgtaatggaca

SEQ ID NO: 9026777 - DNA, 17 bp, Homo sapiens
gacctcaggtgatctgc

SEQ ID NO: 9026778 - DNA, 22 bp, Homo sapiens
gacctcagtattgttcaggatg

SEQ ID NO: 9026779 - DNA, 22 bp, Homo sapiens
gacctcagtattgttcaggatg

SEQ ID NO: 9026780 - DNA, 17 bp, Homo sapiens
gacctcaggtgatctgc

SEQ ID NO: 9026781 - DNA, 22 bp, Homo sapiens
gacctcaggcttctgtaattaa

SEQ ID NO: 9026782 - DNA, 22 bp, Homo sapiens
gacctcaggcttctgtaattaa

SEQ ID NO: 9026783 - DNA, 22 bp, Homo sapiens
gacctcagattttcccaggcca

SEQ ID NO: 9026784 - DNA, 22 bp, Homo sapiens
gacctcagctgtggggatgctg

SEQ ID NO: 9026785 - DNA, 16 bp, Homo sapiens
gacctcagtgctggct

SEQ ID NO: 9026786 - DNA, 22 bp, Homo sapiens
gacctcagtgaatggtcatgta

SEQ ID NO: 9026787 - DNA, 22 bp, Homo sapiens
gacctcagtgaatggtcatgta

SEQ ID NO: 9026788 - DNA, 22 bp, Homo sapiens
gacctcagtgaatggtcatgta

SEQ ID NO: 9026789 - DNA, 22 bp, Homo sapiens
gacctcatgatccacctgcctt

SEQ ID NO: 9026790 - DNA, 22 bp, Homo sapiens
gacctcatgatccacctgcctt

SEQ ID NO: 9026791 - DNA, 22 bp, Homo sapiens
gacctcatgatccacctgcctt

SEQ ID NO: 9026792 - DNA, 22 bp, Homo sapiens
gacctccgtgtacacctcccag

SEQ ID NO: 9026793 - DNA, 22 bp, Homo sapiens
gacctctcaggaatctcacatg

SEQ ID NO: 9026794 - DNA, 22 bp, Homo sapiens
gacctcgtgatccgccctcctt

SEQ ID NO: 9026795 - DNA, 22 bp, Homo sapiens
gacctcgtgatccgcccgcttt

SEQ ID NO: 9026796 - DNA, 22 bp, Homo sapiens
gacctcgtgatccgccctcctt

SEQ ID NO: 9026797 - DNA, 22 bp, Homo sapiens
gacctccagcggccctgcagag

SEQ ID NO: 9026798 - DNA, 22 bp, Homo sapiens
gacctccagcggccctgcagag

SEQ ID NO: 9026799 - DNA, 22 bp, Homo sapiens
gacctccagcggccctgcagag

SEQ ID NO: 9026800 - DNA, 22 bp, Homo sapiens
gacctccattctgtcatgactg

SEQ ID NO: 9026801 - DNA, 22 bp, Homo sapiens
gacctccagcggccctgcagag

SEQ ID NO: 9026802 - DNA, 22 bp, Homo sapiens
gacctcatgatccacctgcctt

SEQ ID NO: 9026803 - DNA, 22 bp, Homo sapiens
gacctcatgatccacctgcctt

SEQ ID NO: 9026804 - DNA, 22 bp, Homo sapiens
gagaaggaggcgaagcgtgtgc

SEQ ID NO: 9026805 - DNA, 22 bp, Homo sapiens
gagaaggagtagctgacctggg

SEQ ID NO: 9026806 - DNA, 22 bp, Homo sapiens
gagaaggaggcgaagcgtgtgc

SEQ ID NO: 9026807 - DNA, 22 bp, Homo sapiens
gacctgaaagagattaaatgac

SEQ ID NO: 9026808 - DNA, 22 bp, Homo sapiens
gacctgaaagagattaaatgac

SEQ ID NO: 9026809 - DNA, 22 bp, Homo sapiens
gacctgaaagtgtgggcgacct

SEQ ID NO: 9026810 - DNA, 22 bp, Homo sapiens
gacctctcaggaatctcacatg

SEQ ID NO: 9026811 - DNA, 22 bp, Homo sapiens
gacctctgaaggcagagcaggg

SEQ ID NO: 9026812 - DNA, 22 bp, Homo sapiens
gacctctgggtgatgcccaggc

SEQ ID NO: 9026813 - DNA, 22 bp, Homo sapiens
gacctctgggtgatgcccaggc

SEQ ID NO: 9026814 - DNA, 22 bp, Homo sapiens
gacctgaaatgggggcctgtcc

SEQ ID NO: 9026815 - DNA, 22 bp, Homo sapiens
gagaaggactacacatctggcc

SEQ ID NO: 9026816 - DNA, 22 bp, Homo sapiens
gagaaggactacacatctggcc

SEQ ID NO: 9026817 - DNA, 22 bp, Homo sapiens
gacctgaaatttgtggtagaac

SEQ ID NO: 9026818 - DNA, 22 bp, Homo sapiens
gagaaggactacggaaaacaga

SEQ ID NO: 9026819 - DNA, 22 bp, Homo sapiens
gagaaggactacggaaaacaga

SEQ ID NO: 9026820 - DNA, 22 bp, Homo sapiens
gagaaggctgatccttggagtt

SEQ ID NO: 9026821 - DNA, 22 bp, Homo sapiens
gagaaggctgatccttggagtt

SEQ ID NO: 9026822 - DNA, 22 bp, Homo sapiens
gagaaggatgtggctcatagct

SEQ ID NO: 9026823 - DNA, 18 bp, Homo sapiens
gagaaggccacttgtttt

SEQ ID NO: 9026824 - DNA, 22 bp, Homo sapiens
gagaaggctggtcttaagtcga

SEQ ID NO: 9026825 - DNA, 22 bp, Homo sapiens
gagaagggatatggcttcttga

SEQ ID NO: 9026826 - DNA, 22 bp, Homo sapiens
gagaagggcttgggagtcaaca

SEQ ID NO: 9026827 - DNA, 22 bp, Homo sapiens
gagaagggcttgggagtcaaca

SEQ ID NO: 9026828 - DNA, 22 bp, Homo sapiens
gagaagggcttgggagtcaaca

SEQ ID NO: 9026829 - DNA, 22 bp, Homo sapiens
gagaagggggctcgagtgtcct

SEQ ID NO: 9026830 - DNA, 22 bp, Homo sapiens
gagaagggggctcgagtgtcct

SEQ ID NO: 9026831 - DNA, 22 bp, Homo sapiens
gagaagggggctcgagtgtcct

SEQ ID NO: 9026832 - DNA, 22 bp, Homo sapiens
gagaagggggctcgagtgtcct

SEQ ID NO: 9026833 - DNA, 22 bp, Homo sapiens
gagaagggatatgccactctcg

SEQ ID NO: 9026834 - DNA, 22 bp, Homo sapiens
gagaagggatatggcttcttga

SEQ ID NO: 9026835 - DNA, 22 bp, Homo sapiens
gagaagggatatgccactctcg

SEQ ID NO: 9026836 - DNA, 22 bp, Homo sapiens
gagaagggatatgccactctcg

SEQ ID NO: 9026837 - DNA, 22 bp, Homo sapiens
gagaagggatatgccactctcg

SEQ ID NO: 9026838 - DNA, 22 bp, Homo sapiens
gagacaaaagttggagtgcaag

SEQ ID NO: 9026839 - DNA, 22 bp, Homo sapiens
gagaattttctagtagtttcat

SEQ ID NO: 9026840 - DNA, 22 bp, Homo sapiens
gagaatttgtcttgaattttaa

SEQ ID NO: 9026841 - DNA, 22 bp, Homo sapiens
gagaatttgctggcttcattgt

SEQ ID NO: 9026842 - DNA, 22 bp, Homo sapiens
gagaatttcccagtctgtgctg

SEQ ID NO: 9026843 - DNA, 22 bp, Homo sapiens
gagaattttctagtagtttcat

SEQ ID NO: 9026844 - DNA, 22 bp, Homo sapiens
gagaattagggcgtaattcaga

SEQ ID NO: 9026845 - DNA, 22 bp, Homo sapiens
gagaatttcccagtctgtgctg

SEQ ID NO: 9026846 - DNA, 22 bp, Homo sapiens
gagaattagggcgtaattcaga

SEQ ID NO: 9026847 - DNA, 22 bp, Homo sapiens
gagaatgtttctgtctgccctt

SEQ ID NO: 9026848 - DNA, 22 bp, Homo sapiens
gagaattactgtttttataaca

SEQ ID NO: 9026849 - DNA, 22 bp, Homo sapiens
gagaattactgtttttataaca

SEQ ID NO: 9026850 - DNA, 21 bp, Homo sapiens
gagaatctgttttcttgtctt

SEQ ID NO: 9026851 - DNA, 22 bp, Homo sapiens
gagaatctgggttttggctatc

SEQ ID NO: 9026852 - DNA, 22 bp, Homo sapiens
gagaatctttccccacagaagg

SEQ ID NO: 9026853 - DNA, 22 bp, Homo sapiens
gagaatgctggagatttatttt

SEQ ID NO: 9026854 - DNA, 22 bp, Homo sapiens
gagaatgccttggaagaagtcc

SEQ ID NO: 9026855 - DNA, 22 bp, Homo sapiens
gagaatgatgatttccaatttc

SEQ ID NO: 9026856 - DNA, 22 bp, Homo sapiens
gagaatgttaatgttgaagtat

SEQ ID NO: 9026857 - DNA, 22 bp, Homo sapiens
gagaatgtggagcctgtggttg

SEQ ID NO: 9026858 - DNA, 22 bp, Homo sapiens
gagaagggggctcgagtgtcct

SEQ ID NO: 9026859 - DNA, 22 bp, Homo sapiens
gagaagggggctcgagtgtcct

SEQ ID NO: 9026860 - DNA, 22 bp, Homo sapiens
gagaagggggctcgagtgtcct

SEQ ID NO: 9026861 - DNA, 22 bp, Homo sapiens
gagaagggggctcgagtgtcct

SEQ ID NO: 9026862 - DNA, 22 bp, Homo sapiens
gagaatctccagatgaagtcct

SEQ ID NO: 9026863 - DNA, 22 bp, Homo sapiens
gagaatctcaggcacccagaag

SEQ ID NO: 9026864 - DNA, 22 bp, Homo sapiens
gagaagggggctcgagtgtcct

SEQ ID NO: 9026865 - DNA, 22 bp, Homo sapiens
gagaatctctttgacaagcaga

SEQ ID NO: 9026866 - DNA, 19 bp, Homo sapiens
gagaatctctttgatgttt

SEQ ID NO: 9026867 - DNA, 22 bp, Homo sapiens
gagaatctgggttttggctatc

SEQ ID NO: 9026868 - DNA, 22 bp, Homo sapiens
gagaatctgggttttggctatc

SEQ ID NO: 9026869 - DNA, 22 bp, Homo sapiens
ctggcagcccaacctagagtct

SEQ ID NO: 9026870 - DNA, 22 bp, Homo sapiens
ctgccagctcaaagcgcagcta

SEQ ID NO: 9026871 - DNA, 22 bp, Homo sapiens
ctgccagctcaccggctcagac

SEQ ID NO: 9026872 - DNA, 22 bp, Homo sapiens
ctgccagctcaccggctcagac

SEQ ID NO: 9026873 - DNA, 22 bp, Homo sapiens
ctgccagctcaccggctcagac

SEQ ID NO: 9026874 - DNA, 22 bp, Homo sapiens
ctgccagctagctcctagttga

SEQ ID NO: 9026875 - DNA, 22 bp, Homo sapiens
ctgccagctcaaagcgcagcta

SEQ ID NO: 9026876 - DNA, 22 bp, Homo sapiens
ctgccagcaagctaccctggca

SEQ ID NO: 9026877 - DNA, 22 bp, Homo sapiens
ctgccagcactgcctcctgagg

SEQ ID NO: 9026878 - DNA, 22 bp, Homo sapiens
ctgccagcactgcctcctgagg

SEQ ID NO: 9026879 - DNA, 22 bp, Homo sapiens
ctgccagcactgcctcctgagg

SEQ ID NO: 9026880 - DNA, 22 bp, Homo sapiens
ctgccagcagaggccagcgctg

SEQ ID NO: 9026881 - DNA, 22 bp, Homo sapiens
ctgccagccaggccaggtaggc

SEQ ID NO: 9026882 - DNA, 22 bp, Homo sapiens
ctgccagccaggccaggtaggc

SEQ ID NO: 9026883 - DNA, 22 bp, Homo sapiens
ctgccagcagaggccagcgctg

SEQ ID NO: 9026884 - DNA, 22 bp, Homo sapiens
ctgccagcagaggccagcgctg

SEQ ID NO: 9026885 - DNA, 22 bp, Homo sapiens
ctgccagcagaggccagcgctg

SEQ ID NO: 9026886 - DNA, 22 bp, Homo sapiens
ctgccagccaggccaggtaggc

SEQ ID NO: 9026887 - DNA, 22 bp, Homo sapiens
ctggcagcttcctttgcatctg

SEQ ID NO: 9026888 - DNA, 22 bp, Homo sapiens
ctggcagcttcctttgcatctg

SEQ ID NO: 9026889 - DNA, 22 bp, Homo sapiens
ctggcagcttcaggacactcgg

SEQ ID NO: 9026890 - DNA, 22 bp, Homo sapiens
ctggcaggaagaggaaaggtca

SEQ ID NO: 9026891 - DNA, 19 bp, Homo sapiens
ctggcagcctgtctgtgtc

SEQ ID NO: 9026892 - DNA, 22 bp, Homo sapiens
ctggcagcccaacctagagtct

SEQ ID NO: 9026893 - DNA, 22 bp, Homo sapiens
ctggcagcttcaggacactcgg

SEQ ID NO: 9026894 - DNA, 19 bp, Homo sapiens
ctggcagcctgtctgtgtc

SEQ ID NO: 9026895 - DNA, 22 bp, Homo sapiens
ctggcaggaagttagatggtaa

SEQ ID NO: 9026896 - DNA, 22 bp, Homo sapiens
ctggcaggaagttagatggtaa

SEQ ID NO: 9026897 - DNA, 22 bp, Homo sapiens
ctggcaggaagaggaaaggtca

SEQ ID NO: 9026898 - DNA, 22 bp, Homo sapiens
ctggcaggaagaggaaaggtca

SEQ ID NO: 9026899 - DNA, 22 bp, Homo sapiens
ctggcaggaagaggaaaggtca

SEQ ID NO: 9026900 - DNA, 22 bp, Homo sapiens
ctggcaggaagaggaaaggtca

SEQ ID NO: 9026901 - DNA, 22 bp, Homo sapiens
ctggcaggaagttagatggtaa

SEQ ID NO: 9026902 - DNA, 22 bp, Homo sapiens
ctgccacaggggagcaggcaga

SEQ ID NO: 9026903 - DNA, 22 bp, Homo sapiens
ctgccacaggggagcaggcaga

SEQ ID NO: 9026904 - DNA, 22 bp, Homo sapiens
ctgccaccaaatagctgcatga

SEQ ID NO: 9026905 - DNA, 22 bp, Homo sapiens
ctgccaccaaatagctgcatga

SEQ ID NO: 9026906 - DNA, 22 bp, Homo sapiens
ctgccacaggggagcaggcaga

SEQ ID NO: 9026907 - DNA, 22 bp, Homo sapiens
ctgccacaagctggccctgtgt

SEQ ID NO: 9026908 - DNA, 22 bp, Homo sapiens
ctgccacaagctggccctgtgt

SEQ ID NO: 9026909 - DNA, 22 bp, Homo sapiens
ctgccaccatgccccagcagag

SEQ ID NO: 9026910 - DNA, 22 bp, Homo sapiens
ctgccaccatgccccagcagag

SEQ ID NO: 9026911 - DNA, 22 bp, Homo sapiens
ctgccaccatgccccagcagag

SEQ ID NO: 9026912 - DNA, 22 bp, Homo sapiens
ctgccaccatgccccagcagag

SEQ ID NO: 9026913 - DNA, 22 bp, Homo sapiens
ctgccaccatgccccagcagag

SEQ ID NO: 9026914 - DNA, 22 bp, Homo sapiens
ctgccaccaaatagctgcatga

SEQ ID NO: 9026915 - DNA, 22 bp, Homo sapiens
ctgccaccatgccccagcagag

SEQ ID NO: 9026916 - DNA, 22 bp, Homo sapiens
ctgccaccatgccccagcagag

SEQ ID NO: 9026917 - DNA, 22 bp, Homo sapiens
ctgcatcataaaatttagagtt

SEQ ID NO: 9026918 - DNA, 22 bp, Homo sapiens
ctgcatcagtggatatgatggt

SEQ ID NO: 9026919 - DNA, 20 bp, Homo sapiens
ctgcatcatggttaagaaca

SEQ ID NO: 9026920 - DNA, 22 bp, Homo sapiens
ctgcatcaggccaattaagaat

SEQ ID NO: 9026921 - DNA, 22 bp, Homo sapiens
ctgcatcattttcagacaatgg

SEQ ID NO: 9026922 - DNA, 22 bp, Homo sapiens
ctgcatcattttcagacaatgg

SEQ ID NO: 9026923 - DNA, 22 bp, Homo sapiens
ctgccaaggctggggaggacaa

SEQ ID NO: 9026924 - DNA, 22 bp, Homo sapiens
ctgccaaggctggggaggacaa

SEQ ID NO: 9026925 - DNA, 22 bp, Homo sapiens
ctgccaagtaatgcctgggctc

SEQ ID NO: 9026926 - DNA, 22 bp, Homo sapiens
ctgccaagtaatgcctgggctc

SEQ ID NO: 9026927 - DNA, 22 bp, Homo sapiens
ctgcatccatgttgctgcaaag

SEQ ID NO: 9026928 - DNA, 22 bp, Homo sapiens
ctgcatccatgttgctgcaaag

SEQ ID NO: 9026929 - DNA, 22 bp, Homo sapiens
ctgccagaagagaacaccagtt

SEQ ID NO: 9026930 - DNA, 22 bp, Homo sapiens
ctgccagaaggttcctgctgca

SEQ ID NO: 9026931 - DNA, 22 bp, Homo sapiens
ctgccagaaggttcctgctgca

SEQ ID NO: 9026932 - DNA, 22 bp, Homo sapiens
ctgccagaaggttcctgctgca

SEQ ID NO: 9026933 - DNA, 22 bp, Homo sapiens
ctgccactttggagtgctcaga

SEQ ID NO: 9026934 - DNA, 22 bp, Homo sapiens
ctgccactttggagtgctcaga

SEQ ID NO: 9026935 - DNA, 22 bp, Homo sapiens
ctgccagaagagaacaccagtt

SEQ ID NO: 9026936 - DNA, 22 bp, Homo sapiens
ctgccagaagagaacaccagtt

SEQ ID NO: 9026937 - DNA, 22 bp, Homo sapiens
ctgccagacacgttatgctcat

SEQ ID NO: 9026938 - DNA, 22 bp, Homo sapiens
ctgccagagatctgggcagagt

SEQ ID NO: 9026939 - DNA, 21 bp, Homo sapiens
ctgccacctgctccatcagca

SEQ ID NO: 9026940 - DNA, 22 bp, Homo sapiens
ctgccactagctttcacatctt

SEQ ID NO: 9026941 - DNA, 21 bp, Homo sapiens
ctgccacctgctccatcagca

SEQ ID NO: 9026942 - DNA, 22 bp, Homo sapiens
ctgccactctgggtgggcctgg

SEQ ID NO: 9026943 - DNA, 22 bp, Homo sapiens
ctgccactagctttcacatctt

SEQ ID NO: 9026944 - DNA, 22 bp, Homo sapiens
ctgccactagctttcacatctt

SEQ ID NO: 9026945 - DNA, 22 bp, Homo sapiens
ctgccactttcacccagtgctc

SEQ ID NO: 9026946 - DNA, 22 bp, Homo sapiens
ctgccactttcacccagtgctc

SEQ ID NO: 9026947 - DNA, 22 bp, Homo sapiens
ctgccactttggagtgctcaga

SEQ ID NO: 9026948 - DNA, 22 bp, Homo sapiens
ctgccactttcacccagtgctc

SEQ ID NO: 9026949 - DNA, 22 bp, Homo sapiens
ctgccactttcacccagtgctc

SEQ ID NO: 9026950 - DNA, 22 bp, Homo sapiens
ctgccacttactaggcatggtg

SEQ ID NO: 9026951 - DNA, 22 bp, Homo sapiens
ctgccactttcacccagtgctc

SEQ ID NO: 9026952 - DNA, 22 bp, Homo sapiens
ctggccactgcacctcttcctt

SEQ ID NO: 9026953 - DNA, 22 bp, Homo sapiens
ctggccactgcacctcttcctt

SEQ ID NO: 9026954 - DNA, 21 bp, Homo sapiens
ctggccactgcacctcttcct

SEQ ID NO: 9026955 - DNA, 21 bp, Homo sapiens
ctggccactgcacctcttcct

SEQ ID NO: 9026956 - DNA, 21 bp, Homo sapiens
ctggccactgcacctcttcct

SEQ ID NO: 9026957 - DNA, 22 bp, Homo sapiens
ctggccactgattcctcccctg

SEQ ID NO: 9026958 - DNA, 22 bp, Homo sapiens
ctggccagagttggagggtgtg

SEQ ID NO: 9026959 - DNA, 22 bp, Homo sapiens
ctggccagagttggagggtgtg

SEQ ID NO: 9026960 - DNA, 22 bp, Homo sapiens
ctggccagagttggagggtgtg

SEQ ID NO: 9026961 - DNA, 22 bp, Homo sapiens
ctggccagagttggagggtgtg

SEQ ID NO: 9026962 - DNA, 22 bp, Homo sapiens
ctggccagagttggagggtgtg

SEQ ID NO: 9026963 - DNA, 22 bp, Homo sapiens
ctggccagcatggctgaagtac

SEQ ID NO: 9026964 - DNA, 22 bp, Homo sapiens
ctggccagcatggctgaagtac

SEQ ID NO: 9026965 - DNA, 22 bp, Homo sapiens
ctggccagatgttacgtccaat

SEQ ID NO: 9026966 - DNA, 22 bp, Homo sapiens
ctggccagcatggctgaagtac

SEQ ID NO: 9026967 - DNA, 22 bp, Homo sapiens
ctggccagatgttacgtccaat

SEQ ID NO: 9026968 - DNA, 22 bp, Homo sapiens
ctggccagatgttacgtccaat

SEQ ID NO: 9026969 - DNA, 22 bp, Homo sapiens
ctggccagcatttttgctttag

SEQ ID NO: 9026970 - DNA, 22 bp, Homo sapiens
ctggccagcatttttgctttag

SEQ ID NO: 9026971 - DNA, 22 bp, Homo sapiens
ctggccagcatggctgaagtac

SEQ ID NO: 9026972 - DNA, 22 bp, Homo sapiens
ctggccagcatggctgaagtac

SEQ ID NO: 9026973 - DNA, 22 bp, Homo sapiens
ctggccagcctgtcgatgccct

SEQ ID NO: 9026974 - DNA, 22 bp, Homo sapiens
ctggccagcctgtcgatgccct

SEQ ID NO: 9026975 - DNA, 22 bp, Homo sapiens
ctggccagctgacagcagggct

SEQ ID NO: 9026976 - DNA, 22 bp, Homo sapiens
ctggccagcctgtcgatgccct

SEQ ID NO: 9026977 - DNA, 22 bp, Homo sapiens
ctggccagcctgtcgatgccct

SEQ ID NO: 9026978 - DNA, 22 bp, Homo sapiens
ctggccagcctgtcgatgccct

SEQ ID NO: 9026979 - DNA, 22 bp, Homo sapiens
ctggccagcctcccaggtaccc

SEQ ID NO: 9026980 - DNA, 22 bp, Homo sapiens
ctggccagcctcccaggtaccc

SEQ ID NO: 9026981 - DNA, 22 bp, Homo sapiens
ctggccagcctcccaggtaccc

SEQ ID NO: 9026982 - DNA, 22 bp, Homo sapiens
ctggccagcctcccaggtaccc

SEQ ID NO: 9026983 - DNA, 22 bp, Homo sapiens
ctggccagctgacagcagggct

SEQ ID NO: 9026984 - DNA, 22 bp, Homo sapiens
ctggccaggaggtaaccagatg

SEQ ID NO: 9026985 - DNA, 22 bp, Homo sapiens
ctggccaggaggtaaccagatg

SEQ ID NO: 9026986 - DNA, 22 bp, Homo sapiens
ctggccaggcatcccctgatcc

SEQ ID NO: 9026987 - DNA, 22 bp, Homo sapiens
ctggccaggaggtaaccagatg

SEQ ID NO: 9026988 - DNA, 22 bp, Homo sapiens
ctggccaggcatcccctgatcc

SEQ ID NO: 9026989 - DNA, 22 bp, Homo sapiens
ctggccaggcatcccctgatcc

SEQ ID NO: 9026990 - DNA, 22 bp, Homo sapiens
ctggccagctgacagcagggct

SEQ ID NO: 9026991 - DNA, 22 bp, Homo sapiens
ctggccagctgacagcagggct

SEQ ID NO: 9026992 - DNA, 22 bp, Homo sapiens
ctggccagctgacagcagggct

SEQ ID NO: 9026993 - DNA, 22 bp, Homo sapiens
ctggccagctgacagcagggct

SEQ ID NO: 9026994 - DNA, 22 bp, Homo sapiens
ctggccagctgacagcagggct

SEQ ID NO: 9026995 - DNA, 22 bp, Homo sapiens
ctggcaggcggaggttgcagtg

SEQ ID NO: 9026996 - DNA, 22 bp, Homo sapiens
ctggcaggcggcagagcccagg

SEQ ID NO: 9026997 - DNA, 22 bp, Homo sapiens
ctggcaggcggaggttgcagtg

SEQ ID NO: 9026998 - DNA, 22 bp, Homo sapiens
ctggcaggcagacttctgcaag

SEQ ID NO: 9026999 - DNA, 22 bp, Homo sapiens
ctggcaggcagacttctgcaag

SEQ ID NO: 9027000 - DNA, 22 bp, Homo sapiens
ctggcaggcagacttctgcaag

SEQ ID NO: 9027001 - DNA, 22 bp, Homo sapiens
ctggcaggcggaggttgcagtg

SEQ ID NO: 9027002 - DNA, 22 bp, Homo sapiens
ctggccactgattcctcccctg

SEQ ID NO: 9027003 - DNA, 22 bp, Homo sapiens
ctggccacccatgcctccctga

SEQ ID NO: 9027004 - DNA, 22 bp, Homo sapiens
ctggccactgattcctcccctg

SEQ ID NO: 9027005 - DNA, 22 bp, Homo sapiens
ctggcaggctctctggtcggtt

SEQ ID NO: 9027006 - DNA, 22 bp, Homo sapiens
ctggcagggcaggggtttgtgc

SEQ ID NO: 9027007 - DNA, 22 bp, Homo sapiens
ctggccacccatgcctccctga

SEQ ID NO: 9027008 - DNA, 22 bp, Homo sapiens
ctggcagggctctttgggtgct

SEQ ID NO: 9027009 - DNA, 22 bp, Homo sapiens
ctggcaggcggcagagcccagg

SEQ ID NO: 9027010 - DNA, 22 bp, Homo sapiens
ctggcaggcggcagagcccagg

SEQ ID NO: 9027011 - DNA, 22 bp, Homo sapiens
ctggcaggctctctggtcggtt

SEQ ID NO: 9027012 - DNA, 22 bp, Homo sapiens
ctggcaggctctctggtcggtt

SEQ ID NO: 9027013 - DNA, 22 bp, Homo sapiens
ctggcaggctctctggtcggtt

SEQ ID NO: 9027014 - DNA, 22 bp, Homo sapiens
ctggcaggctctctggtcggtt

SEQ ID NO: 9027015 - DNA, 22 bp, Homo sapiens
ctggcaggagttgggattttga

SEQ ID NO: 9027016 - DNA, 22 bp, Homo sapiens
ctggcaggatctaaccagggaa

SEQ ID NO: 9027017 - DNA, 22 bp, Homo sapiens
ctggcaggagctgtggccgtag

SEQ ID NO: 9027018 - DNA, 22 bp, Homo sapiens
ctggcaggagctgtggccgtag

SEQ ID NO: 9027019 - DNA, 22 bp, Homo sapiens
ctggcaggagctgtggccgtag

SEQ ID NO: 9027020 - DNA, 22 bp, Homo sapiens
ctggcaggagctgtggccgtag

SEQ ID NO: 9027021 - DNA, 22 bp, Homo sapiens
ctggcaggagctgtggccgtag

SEQ ID NO: 9027022 - DNA, 22 bp, Homo sapiens
ctggcaggagcattcacagagg

SEQ ID NO: 9027023 - DNA, 20 bp, Homo sapiens
ctggcaggagcgagtctacc

SEQ ID NO: 9027024 - DNA, 20 bp, Homo sapiens
ctggcaggagcgagtctacc

SEQ ID NO: 9027025 - DNA, 20 bp, Homo sapiens
ctggcaggagcgagtctacc

SEQ ID NO: 9027026 - DNA, 22 bp, Homo sapiens
ctggcaggatctaaccagggaa

SEQ ID NO: 9027027 - DNA, 22 bp, Homo sapiens
ctggcaggatctaaccagggaa

SEQ ID NO: 9027028 - DNA, 22 bp, Homo sapiens
ctggcaggcaaattggtgggag

SEQ ID NO: 9027029 - DNA, 22 bp, Homo sapiens
ctggcaggcaaattggtgggag

SEQ ID NO: 9027030 - DNA, 22 bp, Homo sapiens
ctggcaggcactcatgaaataa

SEQ ID NO: 9027031 - DNA, 22 bp, Homo sapiens
ctggcaggcaaattggtgggag

SEQ ID NO: 9027032 - DNA, 22 bp, Homo sapiens
ctggcaggcaaattggtgggag

SEQ ID NO: 9027033 - DNA, 22 bp, Homo sapiens
ctggcaggcaaattggtgggag

SEQ ID NO: 9027034 - DNA, 22 bp, Homo sapiens
ctggcaggcaaattggtgggag

SEQ ID NO: 9027035 - DNA, 22 bp, Homo sapiens
ctggccctgccagagatcaaca

SEQ ID NO: 9027036 - DNA, 22 bp, Homo sapiens
ctggccctcgtcagtttcactg

SEQ ID NO: 9027037 - DNA, 22 bp, Homo sapiens
ctggccctgccagagatcaaca

SEQ ID NO: 9027038 - DNA, 22 bp, Homo sapiens
ctggccctgctccgcgccgcgg

SEQ ID NO: 9027039 - DNA, 22 bp, Homo sapiens
ctggccctgctccgcgccgcgg

SEQ ID NO: 9027040 - DNA, 22 bp, Homo sapiens
ctggccctgcctaatgtacttg

SEQ ID NO: 9027041 - DNA, 22 bp, Homo sapiens
ctggccctgcctaatgtacttg

SEQ ID NO: 9027042 - DNA, 22 bp, Homo sapiens
ctggccctgcctaatgtacttg

SEQ ID NO: 9027043 - DNA, 22 bp, Homo sapiens
ctggccctgctccgcgccgcgg

SEQ ID NO: 9027044 - DNA, 22 bp, Homo sapiens
ctggccctggagggctgtgcga

SEQ ID NO: 9027045 - DNA, 22 bp, Homo sapiens
ctggccctggagggctgtgcga

SEQ ID NO: 9027046 - DNA, 22 bp, Homo sapiens
ctggccctggagggctgtgcga

SEQ ID NO: 9027047 - DNA, 22 bp, Homo sapiens
ctggccctggagggctgtgcga

SEQ ID NO: 9027048 - DNA, 22 bp, Homo sapiens
ctggccctggagggctgtgcga

SEQ ID NO: 9027049 - DNA, 16 bp, Homo sapiens
ctggccctggctctgg

SEQ ID NO: 9027050 - DNA, 22 bp, Homo sapiens
ctggccctggagggctgtgcga

SEQ ID NO: 9027051 - DNA, 22 bp, Homo sapiens
ctggccctggagggctgtgcga

SEQ ID NO: 9027052 - DNA, 22 bp, Homo sapiens
ctggccctcagactcatgggca

SEQ ID NO: 9027053 - DNA, 22 bp, Homo sapiens
ctggccctcagactcatgggca

SEQ ID NO: 9027054 - DNA, 22 bp, Homo sapiens
ctggccctcggagtccagctgc

SEQ ID NO: 9027055 - DNA, 22 bp, Homo sapiens
ctggccctcggagtccagctgc

SEQ ID NO: 9027056 - DNA, 22 bp, Homo sapiens
ctggccctcggagtccagctgc

SEQ ID NO: 9027057 - DNA, 22 bp, Homo sapiens
ctggccctcggagtccagctgc

SEQ ID NO: 9027058 - DNA, 22 bp, Homo sapiens
ctggccctcggagtccagctgc

SEQ ID NO: 9027059 - DNA, 22 bp, Homo sapiens
ctggccctcggagtccagctgc

SEQ ID NO: 9027060 - DNA, 22 bp, Homo sapiens
ctggccctcgtcagtttcactg

SEQ ID NO: 9027061 - DNA, 22 bp, Homo sapiens
ctggccctcggagtccagctgc

SEQ ID NO: 9027062 - DNA, 22 bp, Homo sapiens
ctggccctcgtcagtttcactg

SEQ ID NO: 9027063 - DNA, 22 bp, Homo sapiens
ctggccctcgtcagtttcactg

SEQ ID NO: 9027064 - DNA, 22 bp, Homo sapiens
ctggccctcggagtccagctgc

SEQ ID NO: 9027065 - DNA, 19 bp, Homo sapiens
ctggccaggccaggggccc

SEQ ID NO: 9027066 - DNA, 19 bp, Homo sapiens
ctggccaggccaggggccc

SEQ ID NO: 9027067 - DNA, 22 bp, Homo sapiens
ctggccaggcatcccctgatcc

SEQ ID NO: 9027068 - DNA, 22 bp, Homo sapiens
ctggccaggcatcccctgatcc

SEQ ID NO: 9027069 - DNA, 22 bp, Homo sapiens
ctggccaggcatcccctgatcc

SEQ ID NO: 9027070 - DNA, 22 bp, Homo sapiens
ctggccaggcatcccctgatcc

SEQ ID NO: 9027071 - DNA, 19 bp, Homo sapiens
ctggccaggccaggggccc

SEQ ID NO: 9027072 - DNA, 19 bp, Homo sapiens
ctggccaggccaggggccc

SEQ ID NO: 9027073 - DNA, 19 bp, Homo sapiens
ctggccaggccaggggccc

SEQ ID NO: 9027074 - DNA, 22 bp, Homo sapiens
ctggccaggccccttgcagggc

SEQ ID NO: 9027075 - DNA, 22 bp, Homo sapiens
ctggccctattccaggccttcc

SEQ ID NO: 9027076 - DNA, 22 bp, Homo sapiens
ctggccctattccaggccttcc

SEQ ID NO: 9027077 - DNA, 22 bp, Homo sapiens
ctggccctattccaggccttcc

SEQ ID NO: 9027078 - DNA, 22 bp, Homo sapiens
ctggccctatgagcctcctgat

SEQ ID NO: 9027079 - DNA, 22 bp, Homo sapiens
ctggcccagtctcagagtgtca

SEQ ID NO: 9027080 - DNA, 22 bp, Homo sapiens
ctggcccagtctcagagtgtca

SEQ ID NO: 9027081 - DNA, 22 bp, Homo sapiens
ctggcccagtctcagagtgtca

SEQ ID NO: 9027082 - DNA, 22 bp, Homo sapiens
ctggccaggccccttgcagggc

SEQ ID NO: 9027083 - DNA, 22 bp, Homo sapiens
ctggccaggccccttgcagggc

SEQ ID NO: 9027084 - DNA, 22 bp, Homo sapiens
ctggccaggccccttgcagggc

SEQ ID NO: 9027085 - DNA, 22 bp, Homo sapiens
ctggcccaggtggtcgttgagg

SEQ ID NO: 9027086 - DNA, 22 bp, Homo sapiens
ctggcctggtctggcctctcca

SEQ ID NO: 9027087 - DNA, 22 bp, Homo sapiens
ctggcctggtctggcctctcca

SEQ ID NO: 9027088 - DNA, 22 bp, Homo sapiens
ctggcctgtcctgacccagcct

SEQ ID NO: 9027089 - DNA, 22 bp, Homo sapiens
ctggccctggtaaggacaccca

SEQ ID NO: 9027090 - DNA, 22 bp, Homo sapiens
ctggccctgtggaggcaggaac

SEQ ID NO: 9027091 - DNA, 22 bp, Homo sapiens
ctggccctgtggaggcaggaac

SEQ ID NO: 9027092 - DNA, 22 bp, Homo sapiens
ctggccctgtaggatgtgagtt

SEQ ID NO: 9027093 - DNA, 22 bp, Homo sapiens
ctggccctgtaggatgtgagtt

SEQ ID NO: 9027094 - DNA, 22 bp, Homo sapiens
ctggccctgtaggatgtgagtt

SEQ ID NO: 9027095 - DNA, 22 bp, Homo sapiens
ctggccctgtcagcacagaatc

SEQ ID NO: 9027096 - DNA, 22 bp, Homo sapiens
ctggccctgtcagcacagaatc

SEQ ID NO: 9027097 - DNA, 22 bp, Homo sapiens
ctggccctggctggagcccagg

SEQ ID NO: 9027098 - DNA, 22 bp, Homo sapiens
ctggccctggtaaggacaccca

SEQ ID NO: 9027099 - DNA, 22 bp, Homo sapiens
ctggccctggtaaggacaccca

SEQ ID NO: 9027100 - DNA, 22 bp, Homo sapiens
ctggccctggctggagcccagg

SEQ ID NO: 9027101 - DNA, 22 bp, Homo sapiens
ctggccctggctggagcccagg

SEQ ID NO: 9027102 - DNA, 23 bp, Homo sapiens
ctggccctggctctgtgatcatg

SEQ ID NO: 9027103 - DNA, 23 bp, Homo sapiens
ctggccctggctctgtgatcatg

SEQ ID NO: 9027104 - DNA, 16 bp, Homo sapiens
ctggccctggctctgg

SEQ ID NO: 9027105 - DNA, 23 bp, Homo sapiens
ctggccctggctctgtgatcatg

SEQ ID NO: 9027106 - DNA, 22 bp, Homo sapiens
ctggcctgtcctgacccagcct

SEQ ID NO: 9027107 - DNA, 22 bp, Homo sapiens
ctggcctgtcctgacccagcct

SEQ ID NO: 9027108 - DNA, 22 bp, Homo sapiens
ctggcctgtcctgacccagcct

SEQ ID NO: 9027109 - DNA, 22 bp, Homo sapiens
ctggcctgtgggctgtctccgg

SEQ ID NO: 9027110 - DNA, 22 bp, Homo sapiens
ctggcctgtgggctgtctccgg

SEQ ID NO: 9027111 - DNA, 22 bp, Homo sapiens
ctggcctgtgggctgtctccgg

SEQ ID NO: 9027112 - DNA, 22 bp, Homo sapiens
ctggctcactagccctgccctg

SEQ ID NO: 9027113 - DNA, 22 bp, Homo sapiens
ctggctcacctccgctccagca

SEQ ID NO: 9027114 - DNA, 22 bp, Homo sapiens
ctggctcacctccgctccagca

SEQ ID NO: 9027115 - DNA, 22 bp, Homo sapiens
ctggctcacctccgctccagca

SEQ ID NO: 9027116 - DNA, 22 bp, Homo sapiens
ctggctcacctccgctccagca

SEQ ID NO: 9027117 - DNA, 22 bp, Homo sapiens
ctggctcagacagctgtgcagt

SEQ ID NO: 9027118 - DNA, 22 bp, Homo sapiens
ctggctcagacagctgtgcagt

SEQ ID NO: 9027119 - DNA, 22 bp, Homo sapiens
ctggctcagacagctgtgcagt

SEQ ID NO: 9027120 - DNA, 22 bp, Homo sapiens
ctggctcactagccctgccctg

SEQ ID NO: 9027121 - DNA, 22 bp, Homo sapiens
ctggctcactagccctgccctg

SEQ ID NO: 9027122 - DNA, 22 bp, Homo sapiens
ctggctcactagccctgccctg

SEQ ID NO: 9027123 - DNA, 22 bp, Homo sapiens
ctggctcaggaaagttgctgct

SEQ ID NO: 9027124 - DNA, 22 bp, Homo sapiens
ctggctcagggtggtctgggtc

SEQ ID NO: 9027125 - DNA, 22 bp, Homo sapiens
ctggctcagggtggtctgggtc

SEQ ID NO: 9027126 - DNA, 22 bp, Homo sapiens
ctggctcagacagctgtgcagt

SEQ ID NO: 9027127 - DNA, 22 bp, Homo sapiens
ctggctcaggaaagttgctgct

SEQ ID NO: 9027128 - DNA, 22 bp, Homo sapiens
ctggctcaggaaagttgctgct

SEQ ID NO: 9027129 - DNA, 22 bp, Homo sapiens
ctggctcatccaggtgttgctc

SEQ ID NO: 9027130 - DNA, 22 bp, Homo sapiens
ctggctcatccaggtgttgctc

SEQ ID NO: 9027131 - DNA, 22 bp, Homo sapiens
ctggctcatagagcagctccaa

SEQ ID NO: 9027132 - DNA, 22 bp, Homo sapiens
ctggctcatagagcagctccaa

SEQ ID NO: 9027133 - DNA, 22 bp, Homo sapiens
ctggctcatagagcagctccaa

SEQ ID NO: 9027134 - DNA, 22 bp, Homo sapiens
ctggctcagggtggtctgggtc

SEQ ID NO: 9027135 - DNA, 22 bp, Homo sapiens
ctggctcagtgccttcagaagt

SEQ ID NO: 9027136 - DNA, 22 bp, Homo sapiens
ctggctcagtgccttcagaagt

SEQ ID NO: 9027137 - DNA, 22 bp, Homo sapiens
ctggctcagttcttggttttca

SEQ ID NO: 9027138 - DNA, 22 bp, Homo sapiens
ctggctcagttcttggttttca

SEQ ID NO: 9027139 - DNA, 22 bp, Homo sapiens
ctggctcagttcttggttttca

SEQ ID NO: 9027140 - DNA, 22 bp, Homo sapiens
ctggctcatgtgatgagggcaa

SEQ ID NO: 9027141 - DNA, 22 bp, Homo sapiens
ctggctcattttagcatcaggt

SEQ ID NO: 9027142 - DNA, 22 bp, Homo sapiens
ctggctcatgtgatgagggcaa

SEQ ID NO: 9027143 - DNA, 22 bp, Homo sapiens
ctggctcatgtgatgagggcaa

SEQ ID NO: 9027144 - DNA, 22 bp, Homo sapiens
ctggctcattttagcatcaggt

SEQ ID NO: 9027145 - DNA, 22 bp, Homo sapiens
ctggctcatgtgatgagggcaa

SEQ ID NO: 9027146 - DNA, 23 bp, Homo sapiens
ctggctcatcctggttgcagtgg

SEQ ID NO: 9027147 - DNA, 22 bp, Homo sapiens
ctggctcatccaggtgttgctc

SEQ ID NO: 9027148 - DNA, 23 bp, Homo sapiens
ctggctcatcctggttgcagtgg

SEQ ID NO: 9027149 - DNA, 23 bp, Homo sapiens
ctggctcatcctggttgcagtgg

SEQ ID NO: 9027150 - DNA, 22 bp, Homo sapiens
ctggctcttgcgactcagcttg

SEQ ID NO: 9027151 - DNA, 22 bp, Homo sapiens
ctggctcttctgggttctgtgt

SEQ ID NO: 9027152 - DNA, 21 bp, Homo sapiens
ctggctctgttgtcacccggc

SEQ ID NO: 9027153 - DNA, 22 bp, Homo sapiens
ctggctccaaggaagaggtttt

SEQ ID NO: 9027154 - DNA, 21 bp, Homo sapiens
ctggctctgttgtcacccggc

SEQ ID NO: 9027155 - DNA, 22 bp, Homo sapiens
ctggctccaaggaagaggtttt

SEQ ID NO: 9027156 - DNA, 22 bp, Homo sapiens
ctggctccaaggaagaggtttt

SEQ ID NO: 9027157 - DNA, 22 bp, Homo sapiens
ctggctccaaggaagaggtttt

SEQ ID NO: 9027158 - DNA, 22 bp, Homo sapiens
ctggctccaaattctgatgttc

SEQ ID NO: 9027159 - DNA, 22 bp, Homo sapiens
ctggctcattttagcatcaggt

SEQ ID NO: 9027160 - DNA, 22 bp, Homo sapiens
ctggctcattttagcatcaggt

SEQ ID NO: 9027161 - DNA, 22 bp, Homo sapiens
ctggctgcaggatgaggctgcc

SEQ ID NO: 9027162 - DNA, 22 bp, Homo sapiens
ctggctgcaggatgaggctgcc

SEQ ID NO: 9027163 - DNA, 22 bp, Homo sapiens
ctggctgcaggatgaggctgcc

SEQ ID NO: 9027164 - DNA, 22 bp, Homo sapiens
ctggctgcaggatgaggctgcc

SEQ ID NO: 9027165 - DNA, 22 bp, Homo sapiens
ctggctgcagtagcaagagact

SEQ ID NO: 9027166 - DNA, 22 bp, Homo sapiens
ctggctgcagtagcaagagact

SEQ ID NO: 9027167 - DNA, 22 bp, Homo sapiens
ctggctgcaggatgaggctgcc

SEQ ID NO: 9027168 - DNA, 22 bp, Homo sapiens
ctggctgcaggatgaggctgcc

SEQ ID NO: 9027169 - DNA, 22 bp, Homo sapiens
ctggctgcaggatgaggctgcc

SEQ ID NO: 9027170 - DNA, 22 bp, Homo sapiens
ctggctgcaggaaggagtgggc

SEQ ID NO: 9027171 - DNA, 22 bp, Homo sapiens
ctggctcttgcgactcagcttg

SEQ ID NO: 9027172 - DNA, 22 bp, Homo sapiens
ctggctcttgcgactcagcttg

SEQ ID NO: 9027173 - DNA, 22 bp, Homo sapiens
ctggctcttgcgactcagcttg

SEQ ID NO: 9027174 - DNA, 22 bp, Homo sapiens
ctggctgcaggaaggagtgggc

SEQ ID NO: 9027175 - DNA, 22 bp, Homo sapiens
ctggctgcaggaaggagtgggc

SEQ ID NO: 9027176 - DNA, 22 bp, Homo sapiens
ctggctgtgcagtcttccagaa

SEQ ID NO: 9027177 - DNA, 22 bp, Homo sapiens
ctggctggagctgttgtaggct

SEQ ID NO: 9027178 - DNA, 22 bp, Homo sapiens
ctggctggagcaggcatcttgt

SEQ ID NO: 9027179 - DNA, 22 bp, Homo sapiens
ctggctggagcaggcatcttgt

SEQ ID NO: 9027180 - DNA, 22 bp, Homo sapiens
ctggctgtgcagtcttccagaa

SEQ ID NO: 9027181 - DNA, 22 bp, Homo sapiens
ctggctgtgaaatggcagtgtc

SEQ ID NO: 9027182 - DNA, 22 bp, Homo sapiens
ctggctggacttgtgcatgtca

SEQ ID NO: 9027183 - DNA, 22 bp, Homo sapiens
ctggctggaagttagagaactt

SEQ ID NO: 9027184 - DNA, 22 bp, Homo sapiens
ctggctggagcaggcatcttgt

SEQ ID NO: 9027185 - DNA, 22 bp, Homo sapiens
ctggctggagaaatgaaattct

SEQ ID NO: 9027186 - DNA, 22 bp, Homo sapiens
ctggctggacttgtgcatgtca

SEQ ID NO: 9027187 - DNA, 22 bp, Homo sapiens
ctggctggacttgtgcatgtca

SEQ ID NO: 9027188 - DNA, 22 bp, Homo sapiens
ctggctggaacgccgaggcggc

SEQ ID NO: 9027189 - DNA, 20 bp, Homo sapiens
ctggctggaaacttagcctt

SEQ ID NO: 9027190 - DNA, 20 bp, Homo sapiens
ctggctggaaacttagcctt

SEQ ID NO: 9027191 - DNA, 20 bp, Homo sapiens
ctggctggaaacttagcctt

SEQ ID NO: 9027192 - DNA, 20 bp, Homo sapiens
ctggctggaaacttagcctt

SEQ ID NO: 9027193 - DNA, 22 bp, Homo sapiens
ctggctgcttgttttgatgggt

SEQ ID NO: 9027194 - DNA, 22 bp, Homo sapiens
ctggctgcttgttttgatgggt

SEQ ID NO: 9027195 - DNA, 22 bp, Homo sapiens
ctggctggaacgccgaggcggc

SEQ ID NO: 9027196 - DNA, 22 bp, Homo sapiens
ctggctggaacgccgaggcggc

SEQ ID NO: 9027197 - DNA, 22 bp, Homo sapiens
ctggctggaagttagagaactt

SEQ ID NO: 9027198 - DNA, 16 bp, Homo sapiens
ctggctggaagcctgg

SEQ ID NO: 9027199 - DNA, 22 bp, Homo sapiens
ctggctgcgtctgctctgacag

SEQ ID NO: 9027200 - DNA, 22 bp, Homo sapiens
ctggctgcgtctgctctgacag

SEQ ID NO: 9027201 - DNA, 22 bp, Homo sapiens
ctggctgcgtctgctctgacag

SEQ ID NO: 9027202 - DNA, 22 bp, Homo sapiens
ctggctgcgtctgctctgacag

SEQ ID NO: 9027203 - DNA, 22 bp, Homo sapiens
ctggctgcgtctgctctgacag

SEQ ID NO: 9027204 - DNA, 22 bp, Homo sapiens
ctggctgcgtctgctctgacag

SEQ ID NO: 9027205 - DNA, 22 bp, Homo sapiens
ctggctgctggcctgaggatgc

SEQ ID NO: 9027206 - DNA, 22 bp, Homo sapiens
ctggctgctggcctgaggatgc

SEQ ID NO: 9027207 - DNA, 22 bp, Homo sapiens
ctggctgcttgtagactcgact

SEQ ID NO: 9027208 - DNA, 22 bp, Homo sapiens
ctggctgcttgggacagccatg

SEQ ID NO: 9027209 - DNA, 22 bp, Homo sapiens
ctggctgcttgggacagccatg

SEQ ID NO: 9027210 - DNA, 22 bp, Homo sapiens
ctggctgctggcctgaggatgc

SEQ ID NO: 9027211 - DNA, 22 bp, Homo sapiens
ctggctgctggcctgaggatgc

SEQ ID NO: 9027212 - DNA, 22 bp, Homo sapiens
ctggctgcttgggacagccatg

SEQ ID NO: 9027213 - DNA, 22 bp, Homo sapiens
ctggctgccagcatttggggga

SEQ ID NO: 9027214 - DNA, 22 bp, Homo sapiens
ctggctgccacttcagggtctt

SEQ ID NO: 9027215 - DNA, 22 bp, Homo sapiens
ctggctgcagtagcaagagact

SEQ ID NO: 9027216 - DNA, 22 bp, Homo sapiens
ctggctgcattggcaagtcaat

SEQ ID NO: 9027217 - DNA, 22 bp, Homo sapiens
ctggctgccacttcagggtctt

SEQ ID NO: 9027218 - DNA, 22 bp, Homo sapiens
ctggctgcctatagtctccctt

SEQ ID NO: 9027219 - DNA, 22 bp, Homo sapiens
ctggctgcctatagtctccctt

SEQ ID NO: 9027220 - DNA, 22 bp, Homo sapiens
ctggctgcctatagtctccctt

SEQ ID NO: 9027221 - DNA, 22 bp, Homo sapiens
ctggctgcctggagtgagggag

SEQ ID NO: 9027222 - DNA, 22 bp, Homo sapiens
ctggctgcctggagtgagggag

SEQ ID NO: 9027223 - DNA, 22 bp, Homo sapiens
ctggctttgcgtctttgccaca

SEQ ID NO: 9027224 - DNA, 22 bp, Homo sapiens
ctggctttgctggactgggagt

SEQ ID NO: 9027225 - DNA, 22 bp, Homo sapiens
ctggctttgaaggtctttccta

SEQ ID NO: 9027226 - DNA, 22 bp, Homo sapiens
ctggctttgaaatgcatttcag

SEQ ID NO: 9027227 - DNA, 22 bp, Homo sapiens
ctggctttgaaggtctttccta

SEQ ID NO: 9027228 - DNA, 22 bp, Homo sapiens
ctggctttgaaatgcatttcag

SEQ ID NO: 9027229 - DNA, 18 bp, Homo sapiens
ctggctttcttatccatc

SEQ ID NO: 9027230 - DNA, 22 bp, Homo sapiens
ctggctttctccagaaattttt

SEQ ID NO: 9027231 - DNA, 22 bp, Homo sapiens
ctggctttaggttggagagctg

SEQ ID NO: 9027232 - DNA, 22 bp, Homo sapiens
ctggctttacctcactggggct

SEQ ID NO: 9027233 - DNA, 22 bp, Homo sapiens
ctggctttcatttcaagcacgt

SEQ ID NO: 9027234 - DNA, 22 bp, Homo sapiens
ctggctttcattcattcaggcc

SEQ ID NO: 9027235 - DNA, 22 bp, Homo sapiens
ctggctttaaccctacaaacct

SEQ ID NO: 9027236 - DNA, 22 bp, Homo sapiens
ctggctttaaaatgctcctgga

SEQ ID NO: 9027237 - DNA, 22 bp, Homo sapiens
ctggcttggcttattcatggaa

SEQ ID NO: 9027238 - DNA, 22 bp, Homo sapiens
ctggcttgggtctacctgcctt

SEQ ID NO: 9027239 - DNA, 22 bp, Homo sapiens
ctggctgtgctgactgagaggg

SEQ ID NO: 9027240 - DNA, 22 bp, Homo sapiens
ctggcttttggaggagggtcag

SEQ ID NO: 9027241 - DNA, 22 bp, Homo sapiens
ctggcttttggaaacaggctca

SEQ ID NO: 9027242 - DNA, 22 bp, Homo sapiens
ctgggaaatggcttcgagctca

SEQ ID NO: 9027243 - DNA, 22 bp, Homo sapiens
ctgggaacaggcactgctgtca

SEQ ID NO: 9027244 - DNA, 22 bp, Homo sapiens
ctggcttttcaaactgttcagt

SEQ ID NO: 9027245 - DNA, 22 bp, Homo sapiens
ctggcttttcctaaactgggaa

SEQ ID NO: 9027246 - DNA, 22 bp, Homo sapiens
ctggctttgtatagttccctga

SEQ ID NO: 9027247 - DNA, 22 bp, Homo sapiens
ctgggagctagctctgagctga

SEQ ID NO: 9027248 - DNA, 22 bp, Homo sapiens
ctgggagctcagccctggggtg

SEQ ID NO: 9027249 - DNA, 22 bp, Homo sapiens
ctgggagctagctctgagctga

SEQ ID NO: 9027250 - DNA, 22 bp, Homo sapiens
ctgggagctagctctgagctga

SEQ ID NO: 9027251 - DNA, 22 bp, Homo sapiens
ctgggagctcagccctggggtg

SEQ ID NO: 9027252 - DNA, 22 bp, Homo sapiens
ctgggaagaaattgtgggaggc

SEQ ID NO: 9027253 - DNA, 22 bp, Homo sapiens
ctgggagctagctctgagctga

SEQ ID NO: 9027254 - DNA, 22 bp, Homo sapiens
ctgggagctagctctgagctga

SEQ ID NO: 9027255 - DNA, 22 bp, Homo sapiens
ctgggaactgtactgccttgaa

SEQ ID NO: 9027256 - DNA, 22 bp, Homo sapiens
ctgggaggcaccgcgtcgtgct

SEQ ID NO: 9027257 - DNA, 22 bp, Homo sapiens
ctgggaggcaccgcgtcgtgct

SEQ ID NO: 9027258 - DNA, 22 bp, Homo sapiens
ctgggaggattcattgaggtga

SEQ ID NO: 9027259 - DNA, 22 bp, Homo sapiens
ctgggaggcaccgcgtcgtgct

SEQ ID NO: 9027260 - DNA, 22 bp, Homo sapiens
ctgggaggcaccgcgtcgtgct

SEQ ID NO: 9027261 - DNA, 22 bp, Homo sapiens
ctgggagctgaggctgacgctg

SEQ ID NO: 9027262 - DNA, 22 bp, Homo sapiens
ctgggagctgaggctgacgctg

SEQ ID NO: 9027263 - DNA, 22 bp, Homo sapiens
ctgggagctgaggctgacgctg

SEQ ID NO: 9027264 - DNA, 22 bp, Homo sapiens
ctgggagctgaggctgacgctg

SEQ ID NO: 9027265 - DNA, 22 bp, Homo sapiens
ctgggaggattcattgaggtga

SEQ ID NO: 9027266 - DNA, 22 bp, Homo sapiens
ctgggaggattcattgaggtga

SEQ ID NO: 9027267 - DNA, 22 bp, Homo sapiens
ctgggaggcggagcttgcagtg

SEQ ID NO: 9027268 - DNA, 22 bp, Homo sapiens
ctgggaggcggagcttgcagtg

SEQ ID NO: 9027269 - DNA, 22 bp, Homo sapiens
ctgggcaggagaggtggttgga

SEQ ID NO: 9027270 - DNA, 22 bp, Homo sapiens
ctgggcaggagaggtggttgga

SEQ ID NO: 9027271 - DNA, 22 bp, Homo sapiens
ctgggcaggagaggtggttgga

SEQ ID NO: 9027272 - DNA, 22 bp, Homo sapiens
ctgggaggcggagcttgcagtg

SEQ ID NO: 9027273 - DNA, 22 bp, Homo sapiens
ctgggaggcggagcttgcagtg

SEQ ID NO: 9027274 - DNA, 22 bp, Homo sapiens
ctgggaggcggagcttgcagtg

SEQ ID NO: 9027275 - DNA, 22 bp, Homo sapiens
ctgggaggcagtctctctagaa

SEQ ID NO: 9027276 - DNA, 22 bp, Homo sapiens
ctgggaggcagtctctctagaa

SEQ ID NO: 9027277 - DNA, 22 bp, Homo sapiens
ctgggaggcagtctctctagaa

SEQ ID NO: 9027278 - DNA, 22 bp, Homo sapiens
ctgggaggcccacgttgggaag

SEQ ID NO: 9027279 - DNA, 22 bp, Homo sapiens
ctgggaggcagtctctctagaa

SEQ ID NO: 9027280 - DNA, 22 bp, Homo sapiens
ctgggaggcagtctctctagaa

SEQ ID NO: 9027281 - DNA, 22 bp, Homo sapiens
ctgggaggcccacgttgggaag

SEQ ID NO: 9027282 - DNA, 22 bp, Homo sapiens
ctgggaggcccacgttgggaag

SEQ ID NO: 9027283 - DNA, 22 bp, Homo sapiens
ctgggaggcccacgttgggaag

SEQ ID NO: 9027284 - DNA, 22 bp, Homo sapiens
ctgggaggcccacgttgggaag

SEQ ID NO: 9027285 - DNA, 22 bp, Homo sapiens
ctgggaggcccacgttgggaag

SEQ ID NO: 9027286 - DNA, 22 bp, Homo sapiens
ctgggaggcccacgttgggaag

SEQ ID NO: 9027287 - DNA, 22 bp, Homo sapiens
ctgggaggcagaggttgcagtg

SEQ ID NO: 9027288 - DNA, 22 bp, Homo sapiens
ctgggaggcagaggttgcagtg

SEQ ID NO: 9027289 - DNA, 22 bp, Homo sapiens
ctgggaggcagaggttgtagtg

SEQ ID NO: 9027290 - DNA, 22 bp, Homo sapiens
ctgggaggcagaggttgcagtg

SEQ ID NO: 9027291 - DNA, 22 bp, Homo sapiens
ctgggaggcagaggttgcagtg

SEQ ID NO: 9027292 - DNA, 22 bp, Homo sapiens
ctgggaggcagaggttgcagtg

SEQ ID NO: 9027293 - DNA, 22 bp, Homo sapiens
ctgggaggcagaggttgcagtg

SEQ ID NO: 9027294 - DNA, 22 bp, Homo sapiens
ctgggaggcagaggttgtagtg

SEQ ID NO: 9027295 - DNA, 22 bp, Homo sapiens
ctgggaggcagaggttgtagtg

SEQ ID NO: 9027296 - DNA, 22 bp, Homo sapiens
ctgggaggcagaggttgcagtg

SEQ ID NO: 9027297 - DNA, 22 bp, Homo sapiens
ctgggaggcagtctctctagaa

SEQ ID NO: 9027298 - DNA, 22 bp, Homo sapiens
ctgggaggcactattcaggagg

SEQ ID NO: 9027299 - DNA, 22 bp, Homo sapiens
ctgggaggcactattcaggagg

SEQ ID NO: 9027300 - DNA, 22 bp, Homo sapiens
ctgggaggcagaggttgcagtg

SEQ ID NO: 9027301 - DNA, 22 bp, Homo sapiens
ctgggaggcagaggttgcagtg

SEQ ID NO: 9027302 - DNA, 22 bp, Homo sapiens
ctgggaggcagaggttgcagtg

SEQ ID NO: 9027303 - DNA, 22 bp, Homo sapiens
ctgggaggcactattcaggagg

SEQ ID NO: 9027304 - DNA, 22 bp, Homo sapiens
ctgggaggcactattcaggagg

SEQ ID NO: 9027305 - DNA, 22 bp, Homo sapiens
ctgggaggcactattcaggagg

SEQ ID NO: 9027306 - DNA, 22 bp, Homo sapiens
ctgggaggcactattcaggagg

SEQ ID NO: 9027307 - DNA, 22 bp, Homo sapiens
ctgggccacatcagatgaagac

SEQ ID NO: 9027308 - DNA, 22 bp, Homo sapiens
ctgggccacatcagatgaagac

SEQ ID NO: 9027309 - DNA, 22 bp, Homo sapiens
ctgggccactccagatgcccac

SEQ ID NO: 9027310 - DNA, 22 bp, Homo sapiens
ctgggccactccagatgcccac

SEQ ID NO: 9027311 - DNA, 22 bp, Homo sapiens
ctgggccacttcctcaggggaa

SEQ ID NO: 9027312 - DNA, 22 bp, Homo sapiens
ctgggccactccagatgcccac

SEQ ID NO: 9027313 - DNA, 22 bp, Homo sapiens
ctgggccactccagatgcccac

SEQ ID NO: 9027314 - DNA, 22 bp, Homo sapiens
ctgggccactccagatgcccac

SEQ ID NO: 9027315 - DNA, 22 bp, Homo sapiens
ctgggccacttcctcaggggaa

SEQ ID NO: 9027316 - DNA, 22 bp, Homo sapiens
ctgggccagaagacatttagga

SEQ ID NO: 9027317 - DNA, 22 bp, Homo sapiens
ctgggccacttcctcaggggaa

SEQ ID NO: 9027318 - DNA, 19 bp, Homo sapiens
ctgggccagaatcagctca

SEQ ID NO: 9027319 - DNA, 22 bp, Homo sapiens
ctgggccacatcagatgaagac

SEQ ID NO: 9027320 - DNA, 22 bp, Homo sapiens
ctgggccacatcagatgaagac

SEQ ID NO: 9027321 - DNA, 22 bp, Homo sapiens
ctgggccacagactcaaggcag

SEQ ID NO: 9027322 - DNA, 22 bp, Homo sapiens
ctgggccacagactcaaggcag

SEQ ID NO: 9027323 - DNA, 22 bp, Homo sapiens
ctgggccacatcagatgaagac

SEQ ID NO: 9027324 - DNA, 22 bp, Homo sapiens
ctgggccacagactcaaggcag

SEQ ID NO: 9027325 - DNA, 22 bp, Homo sapiens
ctgggccacaagcctgtgtgat

SEQ ID NO: 9027326 - DNA, 22 bp, Homo sapiens
ctgggccacaagcctgtgtgat

SEQ ID NO: 9027327 - DNA, 22 bp, Homo sapiens
ctgggccacaagcctgtgtgat

SEQ ID NO: 9027328 - DNA, 22 bp, Homo sapiens
ctgggcatcatggtgcgggcac

SEQ ID NO: 9027329 - DNA, 22 bp, Homo sapiens
ctgggcagtttattcagttctg

SEQ ID NO: 9027330 - DNA, 22 bp, Homo sapiens
ctgggcagtttattcagttctg

SEQ ID NO: 9027331 - DNA, 22 bp, Homo sapiens
ctgggcagtttattcagttctg

SEQ ID NO: 9027332 - DNA, 22 bp, Homo sapiens
ctgggcagtttattcagttctg

SEQ ID NO: 9027333 - DNA, 22 bp, Homo sapiens
ctgggcagttttacatcattgc

SEQ ID NO: 9027334 - DNA, 22 bp, Homo sapiens
ctgggcagttttacatcattgc

SEQ ID NO: 9027335 - DNA, 22 bp, Homo sapiens
ctgggcagtttattcagttctg

SEQ ID NO: 9027336 - DNA, 22 bp, Homo sapiens
ctgggcagtttattcagttctg

SEQ ID NO: 9027337 - DNA, 22 bp, Homo sapiens
ctgggcaggagggctctatgga

SEQ ID NO: 9027338 - DNA, 22 bp, Homo sapiens
ctgggcagtttattcagttctg

SEQ ID NO: 9027339 - DNA, 22 bp, Homo sapiens
ctgggcaggagggctctatgga

SEQ ID NO: 9027340 - DNA, 22 bp, Homo sapiens
ctgggccacaaaaaactcctgt

SEQ ID NO: 9027341 - DNA, 22 bp, Homo sapiens
ctgggccacaaaaaactcctgt

SEQ ID NO: 9027342 - DNA, 22 bp, Homo sapiens
ctgggccaagaagttgtgtatg

SEQ ID NO: 9027343 - DNA, 22 bp, Homo sapiens
ctgggcatttttctctgttaca

SEQ ID NO: 9027344 - DNA, 23 bp, Homo sapiens
ctgggcatggagcttcagaggct

SEQ ID NO: 9027345 - DNA, 22 bp, Homo sapiens
ctgggcagttttacatcattgc

SEQ ID NO: 9027346 - DNA, 22 bp, Homo sapiens
ctgggcatgaaaaggatgccag

SEQ ID NO: 9027347 - DNA, 22 bp, Homo sapiens
ctggggctcactccagccctgg

SEQ ID NO: 9027348 - DNA, 22 bp, Homo sapiens
ctggggctcactccagccctgg

SEQ ID NO: 9027349 - DNA, 22 bp, Homo sapiens
ctggggctcactttggtcaggc

SEQ ID NO: 9027350 - DNA, 22 bp, Homo sapiens
ctggggctcactttggtcaggc

SEQ ID NO: 9027351 - DNA, 22 bp, Homo sapiens
ctggggctcactccagccctgg

SEQ ID NO: 9027352 - DNA, 22 bp, Homo sapiens
ctggggccctgggtctgccctc

SEQ ID NO: 9027353 - DNA, 22 bp, Homo sapiens
ctggggccctgggtctgccctc

SEQ ID NO: 9027354 - DNA, 22 bp, Homo sapiens
ctggggccctgggtctgccctc

SEQ ID NO: 9027355 - DNA, 22 bp, Homo sapiens
ctggggctcactccagccctgg

SEQ ID NO: 9027356 - DNA, 22 bp, Homo sapiens
ctggggcccgagccttgggcca

SEQ ID NO: 9027357 - DNA, 22 bp, Homo sapiens
ctggggcccgagccttgggcca

SEQ ID NO: 9027358 - DNA, 22 bp, Homo sapiens
ctggggcccgagccttgggcca

SEQ ID NO: 9027359 - DNA, 22 bp, Homo sapiens
ctggggcccgagccttgggcca

SEQ ID NO: 9027360 - DNA, 22 bp, Homo sapiens
ctggggctctctggaatgcttg

SEQ ID NO: 9027361 - DNA, 22 bp, Homo sapiens
ctggggctctctggaatgcttg

SEQ ID NO: 9027362 - DNA, 22 bp, Homo sapiens
ctggggctgcagcgatcttcat

SEQ ID NO: 9027363 - DNA, 22 bp, Homo sapiens
ctggggctctctggaatgcttg

SEQ ID NO: 9027364 - DNA, 23 bp, Homo sapiens
ctggggctcattgcagtagccat

SEQ ID NO: 9027365 - DNA, 22 bp, Homo sapiens
ctggggctctctggaatgcttg

SEQ ID NO: 9027366 - DNA, 22 bp, Homo sapiens
ctggggctctctggaatgcttg

SEQ ID NO: 9027367 - DNA, 22 bp, Homo sapiens
ctggggctcactccagccctgg

SEQ ID NO: 9027368 - DNA, 22 bp, Homo sapiens
ctggggctcactttggtcaggc

SEQ ID NO: 9027369 - DNA, 22 bp, Homo sapiens
ctggggctcactttggtcaggc

SEQ ID NO: 9027370 - DNA, 22 bp, Homo sapiens
ctggggctcactttggtcaggc

SEQ ID NO: 9027371 - DNA, 23 bp, Homo sapiens
ctggggctcattgcagtagccat

SEQ ID NO: 9027372 - DNA, 23 bp, Homo sapiens
ctggggctcattgcagtagccat

SEQ ID NO: 9027373 - DNA, 22 bp, Homo sapiens
ctggggcattgggagaggcctg

SEQ ID NO: 9027374 - DNA, 22 bp, Homo sapiens
ctggggcatgggcccctagagg

SEQ ID NO: 9027375 - DNA, 20 bp, Homo sapiens
ctggggaggaggatgtgttc

SEQ ID NO: 9027376 - DNA, 22 bp, Homo sapiens
ctggggcattgggagaggcctg

SEQ ID NO: 9027377 - DNA, 22 bp, Homo sapiens
ctggggccacaacggcgcacgc

SEQ ID NO: 9027378 - DNA, 22 bp, Homo sapiens
ctggggccacaacggcgcacgc

SEQ ID NO: 9027379 - DNA, 22 bp, Homo sapiens
ctggggccacaacggcgcacgc

SEQ ID NO: 9027380 - DNA, 22 bp, Homo sapiens
ctggggccacaacggcgcacgc

SEQ ID NO: 9027381 - DNA, 22 bp, Homo sapiens
ctggggccagtgaggaggcttt

SEQ ID NO: 9027382 - DNA, 22 bp, Homo sapiens
ctggggcccatcgagggctgag

SEQ ID NO: 9027383 - DNA, 22 bp, Homo sapiens
ctggggcccatcgagggctgag

SEQ ID NO: 9027384 - DNA, 22 bp, Homo sapiens
ctggggcccatcgagggctgag

SEQ ID NO: 9027385 - DNA, 22 bp, Homo sapiens
ctggggcccatcgagggctgag

SEQ ID NO: 9027386 - DNA, 22 bp, Homo sapiens
ctggggcccatcgagggctgag

SEQ ID NO: 9027387 - DNA, 22 bp, Homo sapiens
ctggggcccatcgagggctgag

SEQ ID NO: 9027388 - DNA, 22 bp, Homo sapiens
ctggggcccatcgagggctgag

SEQ ID NO: 9027389 - DNA, 22 bp, Homo sapiens
ctggggccagtgaggaggcttt

SEQ ID NO: 9027390 - DNA, 22 bp, Homo sapiens
ctggggccagtgaggaggcttt

SEQ ID NO: 9027391 - DNA, 22 bp, Homo sapiens
ctggggccagtgaggaggcttt

SEQ ID NO: 9027392 - DNA, 22 bp, Homo sapiens
ctggggccagtgaggaggcttt

SEQ ID NO: 9027393 - DNA, 22 bp, Homo sapiens
ctggggccagtgaggaggcttt

SEQ ID NO: 9027394 - DNA, 22 bp, Homo sapiens
ctggggccagtgaggaggcttt

SEQ ID NO: 9027395 - DNA, 22 bp, Homo sapiens
ctggggcccatcgagggctgag

SEQ ID NO: 9027396 - DNA, 22 bp, Homo sapiens
ctgggtctggccacaggaagta

SEQ ID NO: 9027397 - DNA, 22 bp, Homo sapiens
ctgggtctggaggccaagggtg

SEQ ID NO: 9027398 - DNA, 22 bp, Homo sapiens
ctgggtctggccacaggaagta

SEQ ID NO: 9027399 - DNA, 22 bp, Homo sapiens
ctgggtctggccacaggaagta

SEQ ID NO: 9027400 - DNA, 22 bp, Homo sapiens
ctgggtctggccacaggaagta

SEQ ID NO: 9027401 - DNA, 22 bp, Homo sapiens
ctgggtctggctactgcttcct

SEQ ID NO: 9027402 - DNA, 22 bp, Homo sapiens
ctgggtctggctactgcttcct

SEQ ID NO: 9027403 - DNA, 22 bp, Homo sapiens
ctgggtctgggcctcctggagt

SEQ ID NO: 9027404 - DNA, 22 bp, Homo sapiens
ctgggtctggtgtcaggcgacg

SEQ ID NO: 9027405 - DNA, 22 bp, Homo sapiens
ctgggtctgggcctcctggagt

SEQ ID NO: 9027406 - DNA, 22 bp, Homo sapiens
ctgggtctctttagggtgccgt

SEQ ID NO: 9027407 - DNA, 22 bp, Homo sapiens
ctgggtctccggcagcctcggg

SEQ ID NO: 9027408 - DNA, 22 bp, Homo sapiens
ctgggtctcttaccatgtgact

SEQ ID NO: 9027409 - DNA, 22 bp, Homo sapiens
ctgggtctggaggccaagggtg

SEQ ID NO: 9027410 - DNA, 22 bp, Homo sapiens
ctgggtctggaggccaagggtg

SEQ ID NO: 9027411 - DNA, 20 bp, Homo sapiens
ctgggtctccttctgcttaa

SEQ ID NO: 9027412 - DNA, 22 bp, Homo sapiens
ctggggtgtgctcagagcaggg

SEQ ID NO: 9027413 - DNA, 22 bp, Homo sapiens
ctgggtaaaggctgcttttcta

SEQ ID NO: 9027414 - DNA, 22 bp, Homo sapiens
ctggggctgcggtggaggagcc

SEQ ID NO: 9027415 - DNA, 22 bp, Homo sapiens
ctggggctgcggtggaggagcc

SEQ ID NO: 9027416 - DNA, 22 bp, Homo sapiens
ctggggctgcggtggaggagcc

SEQ ID NO: 9027417 - DNA, 22 bp, Homo sapiens
ctggggctgcggtggaggagcc

SEQ ID NO: 9027418 - DNA, 22 bp, Homo sapiens
ctggggctgcggtggaggagcc

SEQ ID NO: 9027419 - DNA, 22 bp, Homo sapiens
ctggggtgtgctcagagcaggg

SEQ ID NO: 9027420 - DNA, 22 bp, Homo sapiens
ctggggtgtgctcagagcaggg

SEQ ID NO: 9027421 - DNA, 22 bp, Homo sapiens
ctggggtgtgctcagagcaggg

SEQ ID NO: 9027422 - DNA, 22 bp, Homo sapiens
ctggggctgcagcgatcttcat

SEQ ID NO: 9027423 - DNA, 22 bp, Homo sapiens
ctggggctgcagcgatcttcat

SEQ ID NO: 9027424 - DNA, 22 bp, Homo sapiens
ctggggctgcggacgggagccc

SEQ ID NO: 9027425 - DNA, 22 bp, Homo sapiens
ctggggctgcagcgatcttcat

SEQ ID NO: 9027426 - DNA, 22 bp, Homo sapiens
ctggggctgcggtggaggagcc

SEQ ID NO: 9027427 - DNA, 22 bp, Homo sapiens
ctggggctgcggtggaggagcc

SEQ ID NO: 9027428 - DNA, 22 bp, Homo sapiens
ctggggctgcggacgggagccc

SEQ ID NO: 9027429 - DNA, 22 bp, Homo sapiens
ctggggctgcggacgggagccc

SEQ ID NO: 9027430 - DNA, 22 bp, Homo sapiens
ctggggctgcggacgggagccc

SEQ ID NO: 9027431 - DNA, 23 bp, Homo sapiens
ctgggctgcttgagtccctggct

SEQ ID NO: 9027432 - DNA, 22 bp, Homo sapiens
ctgggctgctcagccccctcgc

SEQ ID NO: 9027433 - DNA, 22 bp, Homo sapiens
ctgggctgctgtccactagggt

SEQ ID NO: 9027434 - DNA, 22 bp, Homo sapiens
ctgggctgctgtccactagggt

SEQ ID NO: 9027435 - DNA, 22 bp, Homo sapiens
ctgggctgctgtccactagggt

SEQ ID NO: 9027436 - DNA, 22 bp, Homo sapiens
ctgggctgctgtccactagggt

SEQ ID NO: 9027437 - DNA, 22 bp, Homo sapiens
ctgggctgctgtccactagggt

SEQ ID NO: 9027438 - DNA, 22 bp, Homo sapiens
ctgggctgcttgctgaaggggt

SEQ ID NO: 9027439 - DNA, 22 bp, Homo sapiens
ctgggctgcttgctgaaggggt

SEQ ID NO: 9027440 - DNA, 22 bp, Homo sapiens
ctgggctgcttgctgaaggggt

SEQ ID NO: 9027441 - DNA, 23 bp, Homo sapiens
ctgggctgcttgagtccctggct

SEQ ID NO: 9027442 - DNA, 23 bp, Homo sapiens
ctgggctgcttgagtccctggct

SEQ ID NO: 9027443 - DNA, 23 bp, Homo sapiens
ctgggctgcttgagtccctggct

SEQ ID NO: 9027444 - DNA, 20 bp, Homo sapiens
ctggggaggaggatgtgttc

SEQ ID NO: 9027445 - DNA, 20 bp, Homo sapiens
ctggggaggaggatgtgttc

SEQ ID NO: 9027446 - DNA, 20 bp, Homo sapiens
ctggggaggaggatgtgttc

SEQ ID NO: 9027447 - DNA, 20 bp, Homo sapiens
ctggggaggaggatgtgttc

SEQ ID NO: 9027448 - DNA, 20 bp, Homo sapiens
ctggggaggaggatgtgttc

SEQ ID NO: 9027449 - DNA, 22 bp, Homo sapiens
ctgggctggacacacttaacct

SEQ ID NO: 9027450 - DNA, 22 bp, Homo sapiens
ctgggctgcttgctgaaggggt

SEQ ID NO: 9027451 - DNA, 22 bp, Homo sapiens
ctgggctgcttgctgaaggggt

SEQ ID NO: 9027452 - DNA, 22 bp, Homo sapiens
ctgggctgcttgctgaaggggt

SEQ ID NO: 9027453 - DNA, 22 bp, Homo sapiens
ctgggctgcttgctgaaggggt

SEQ ID NO: 9027454 - DNA, 22 bp, Homo sapiens
ctgggctgcggtggtaggttgt

SEQ ID NO: 9027455 - DNA, 22 bp, Homo sapiens
ctgggctgcggtggtaggttgt

SEQ ID NO: 9027456 - DNA, 22 bp, Homo sapiens
ctgggctgcggtggtaggttgt

SEQ ID NO: 9027457 - DNA, 22 bp, Homo sapiens
ctgggctgcggtggtaggttgt

SEQ ID NO: 9027458 - DNA, 22 bp, Homo sapiens
ctgggctgcgggcgcccctcca

SEQ ID NO: 9027459 - DNA, 22 bp, Homo sapiens
ctgggctgcgggcgcccctcca

SEQ ID NO: 9027460 - DNA, 22 bp, Homo sapiens
ctgggctgcgggcgcccctcca

SEQ ID NO: 9027461 - DNA, 22 bp, Homo sapiens
ctgggctgctcagccccctcgc

SEQ ID NO: 9027462 - DNA, 22 bp, Homo sapiens
ctgggctgctcagccccctcgc

SEQ ID NO: 9027463 - DNA, 22 bp, Homo sapiens
ctgggctgcggttctctgaagc

SEQ ID NO: 9027464 - DNA, 22 bp, Homo sapiens
ctgggctgcggtggtaggttgt

SEQ ID NO: 9027465 - DNA, 22 bp, Homo sapiens
ctgggctgcggtggtaggttgt

SEQ ID NO: 9027466 - DNA, 22 bp, Homo sapiens
ctgggctgcggttctctgaagc

SEQ ID NO: 9027467 - DNA, 22 bp, Homo sapiens
ctgggctgcggttctctgaagc

SEQ ID NO: 9027468 - DNA, 20 bp, Homo sapiens
ctgggctgcccagctatggg

SEQ ID NO: 9027469 - DNA, 20 bp, Homo sapiens
ctgggctgcccagctatggg

SEQ ID NO: 9027470 - DNA, 20 bp, Homo sapiens
ctgggctgcccagctatggg

SEQ ID NO: 9027471 - DNA, 20 bp, Homo sapiens
ctgggctgcccagctatggg

SEQ ID NO: 9027472 - DNA, 20 bp, Homo sapiens
ctgggctgcccagctatggg

SEQ ID NO: 9027473 - DNA, 20 bp, Homo sapiens
ctgggctgcccagctatggg

SEQ ID NO: 9027474 - DNA, 22 bp, Homo sapiens
ctgggctgccaggtaggcacac

SEQ ID NO: 9027475 - DNA, 22 bp, Homo sapiens
ctgggctgccaggtaggcacac

SEQ ID NO: 9027476 - DNA, 22 bp, Homo sapiens
ctgggctgccaggtaggcacac

SEQ ID NO: 9027477 - DNA, 22 bp, Homo sapiens
ctgggctgccaggtaggcacac

SEQ ID NO: 9027478 - DNA, 22 bp, Homo sapiens
ctgggctgccaggtaggcacac

SEQ ID NO: 9027479 - DNA, 22 bp, Homo sapiens
ctgggctgccaggtaggcacac

SEQ ID NO: 9027480 - DNA, 22 bp, Homo sapiens
ctgggctgcatcaaagaggcat

SEQ ID NO: 9027481 - DNA, 19 bp, Homo sapiens
ctgggccagagctgtcctc

SEQ ID NO: 9027482 - DNA, 19 bp, Homo sapiens
ctgggccagagctgtcctc

SEQ ID NO: 9027483 - DNA, 19 bp, Homo sapiens
ctgggccagagctgtcctc

SEQ ID NO: 9027484 - DNA, 19 bp, Homo sapiens
ctgggccagagctgtcctc

SEQ ID NO: 9027485 - DNA, 19 bp, Homo sapiens
ctgggccagagctgtcctc

SEQ ID NO: 9027486 - DNA, 19 bp, Homo sapiens
ctgggccagagctgtcctc

SEQ ID NO: 9027487 - DNA, 19 bp, Homo sapiens
ctgggccagagctgtcctc

SEQ ID NO: 9027488 - DNA, 22 bp, Homo sapiens
ctgggccagaccttgtggtctt

SEQ ID NO: 9027489 - DNA, 22 bp, Homo sapiens
ctgggccagaccttgtggtctt

SEQ ID NO: 9027490 - DNA, 22 bp, Homo sapiens
ctgggccagatccagcctcaca

SEQ ID NO: 9027491 - DNA, 22 bp, Homo sapiens
ctgggccagatccagcctcaca

SEQ ID NO: 9027492 - DNA, 22 bp, Homo sapiens
ctgggccagatccagcctcaca

SEQ ID NO: 9027493 - DNA, 22 bp, Homo sapiens
ctgggctctgcagttgatgttt

SEQ ID NO: 9027494 - DNA, 22 bp, Homo sapiens
ctgggctctaggaaccattcct

SEQ ID NO: 9027495 - DNA, 22 bp, Homo sapiens
ctgggctctaggaaccattcct

SEQ ID NO: 9027496 - DNA, 22 bp, Homo sapiens
ctgggctctgcggtgtcgctct

SEQ ID NO: 9027497 - DNA, 22 bp, Homo sapiens
ctgggctctgcagttgatgttt

SEQ ID NO: 9027498 - DNA, 22 bp, Homo sapiens
ctgggctgcaggagtggggcaa

SEQ ID NO: 9027499 - DNA, 22 bp, Homo sapiens
ctgggctgcaggagtggggcaa

SEQ ID NO: 9027500 - DNA, 22 bp, Homo sapiens
ctgggctgcaggagtggggcaa

SEQ ID NO: 9027501 - DNA, 22 bp, Homo sapiens
ctgggctgcaggcactaattgg

SEQ ID NO: 9027502 - DNA, 22 bp, Homo sapiens
ctgggctgcagttcctggtcct

SEQ ID NO: 9027503 - DNA, 22 bp, Homo sapiens
ctgggctgcagttcctggtcct

SEQ ID NO: 9027504 - DNA, 22 bp, Homo sapiens
ctgggctgcagttcctggtcct

SEQ ID NO: 9027505 - DNA, 22 bp, Homo sapiens
ctgggctgcagttcctggtcct

SEQ ID NO: 9027506 - DNA, 22 bp, Homo sapiens
ctgggctgcatcaaagaggcat

SEQ ID NO: 9027507 - DNA, 22 bp, Homo sapiens
ctgggctgcagttcctggtcct

SEQ ID NO: 9027508 - DNA, 22 bp, Homo sapiens
ctgggctgcagttcctggtcct

SEQ ID NO: 9027509 - DNA, 22 bp, Homo sapiens
ctgggctgcagttcctggtcct

SEQ ID NO: 9027510 - DNA, 22 bp, Homo sapiens
ctgggctgcagttcctggtcct

SEQ ID NO: 9027511 - DNA, 22 bp, Homo sapiens
ctgggctgcatcaaagaggcat

SEQ ID NO: 9027512 - DNA, 22 bp, Homo sapiens
ctgggctgcatcaaagaggcat

SEQ ID NO: 9027513 - DNA, 22 bp, Homo sapiens
ctgggctgcatcaaagaggcat

SEQ ID NO: 9027514 - DNA, 22 bp, Homo sapiens
ctgggctgcatcaaagaggcat

SEQ ID NO: 9027515 - DNA, 22 bp, Homo sapiens
ctgggctgcagcgggagcgacg

SEQ ID NO: 9027516 - DNA, 22 bp, Homo sapiens
ctgggctgcagcgggagcgacg

SEQ ID NO: 9027517 - DNA, 22 bp, Homo sapiens
ctgggctgcagcgggagcgacg

SEQ ID NO: 9027518 - DNA, 22 bp, Homo sapiens
ctgggctgcagcgggagcgacg

SEQ ID NO: 9027519 - DNA, 22 bp, Homo sapiens
ctgggctgcagcgggagcgacg

SEQ ID NO: 9027520 - DNA, 22 bp, Homo sapiens
ctgggctgcagcgggagcgacg

SEQ ID NO: 9027521 - DNA, 22 bp, Homo sapiens
ctgggctgcaggagtggggcaa

SEQ ID NO: 9027522 - DNA, 22 bp, Homo sapiens
ctgggctgcaggagtggggcaa

SEQ ID NO: 9027523 - DNA, 22 bp, Homo sapiens
ctgggctgcaggagtggggcaa

SEQ ID NO: 9027524 - DNA, 22 bp, Homo sapiens
ctgggctgcaggagtggggcaa

SEQ ID NO: 9027525 - DNA, 22 bp, Homo sapiens
ctgggctgcaggagtggggcaa

SEQ ID NO: 9027526 - DNA, 22 bp, Homo sapiens
ctgggctgcaggagtggggcaa

SEQ ID NO: 9027527 - DNA, 22 bp, Homo sapiens
ctgggctgcaggagtggggcaa

SEQ ID NO: 9027528 - DNA, 22 bp, Homo sapiens
ctgttaagtgtagataatgtgg

SEQ ID NO: 9027529 - DNA, 23 bp, Homo sapiens
ctgttaaattccttaagagcagg

SEQ ID NO: 9027530 - DNA, 22 bp, Homo sapiens
ctgttaatggaggactacagga

SEQ ID NO: 9027531 - DNA, 22 bp, Homo sapiens
ctgttaatctgcttgcatgatg

SEQ ID NO: 9027532 - DNA, 22 bp, Homo sapiens
ctgttaatctgcttgcatgatg

SEQ ID NO: 9027533 - DNA, 22 bp, Homo sapiens
ctgtgtcttctgcttacagtct

SEQ ID NO: 9027534 - DNA, 22 bp, Homo sapiens
ctgttaagcaacatgagtaagt

SEQ ID NO: 9027535 - DNA, 22 bp, Homo sapiens
ctgtgtcttctgcttacagtct

SEQ ID NO: 9027536 - DNA, 17 bp, Homo sapiens
ctgttaattcatttccc

SEQ ID NO: 9027537 - DNA, 17 bp, Homo sapiens
ctgttaattcatttccc

SEQ ID NO: 9027538 - DNA, 22 bp, Homo sapiens
ctgttacatagcttttcttaac

SEQ ID NO: 9027539 - DNA, 22 bp, Homo sapiens
ctgttacccagcaaccccagca

SEQ ID NO: 9027540 - DNA, 22 bp, Homo sapiens
ctgttacatagcttttcttaac

SEQ ID NO: 9027541 - DNA, 22 bp, Homo sapiens
ctgttacaagagagagacatga

SEQ ID NO: 9027542 - DNA, 22 bp, Homo sapiens
ctgttacacggaccttcaaatc

SEQ ID NO: 9027543 - DNA, 22 bp, Homo sapiens
ctgtgtcttcctctgcccaggc

SEQ ID NO: 9027544 - DNA, 22 bp, Homo sapiens
ctgtgtcttcacatttgtgtgc

SEQ ID NO: 9027545 - DNA, 22 bp, Homo sapiens
ctgtgtcttcctctgcccaggc

SEQ ID NO: 9027546 - DNA, 22 bp, Homo sapiens
ctgtgtcttctgcttacagtct

SEQ ID NO: 9027547 - DNA, 22 bp, Homo sapiens
ctgtgtcttcaatgtactggga

SEQ ID NO: 9027548 - DNA, 22 bp, Homo sapiens
ctgtgtcttcacatttgtgtgc

SEQ ID NO: 9027549 - DNA, 22 bp, Homo sapiens
ctgtgtcttcctctgcccaggc

SEQ ID NO: 9027550 - DNA, 22 bp, Homo sapiens
ctgtgtcttcaatgtactggga

SEQ ID NO: 9027551 - DNA, 22 bp, Homo sapiens
ctgtgtcttcaatgtactggga

SEQ ID NO: 9027552 - DNA, 22 bp, Homo sapiens
ctgtgtctgcctgggatccatt

SEQ ID NO: 9027553 - DNA, 22 bp, Homo sapiens
ctgtgtcttcaatgtactggga

SEQ ID NO: 9027554 - DNA, 22 bp, Homo sapiens
ctgtgtctgtggaatagcgaat

SEQ ID NO: 9027555 - DNA, 22 bp, Homo sapiens
ctgtgtctccttggtgggatat

SEQ ID NO: 9027556 - DNA, 22 bp, Homo sapiens
ctgtgtctccttggtgggatat

SEQ ID NO: 9027557 - DNA, 22 bp, Homo sapiens
ctgtgtctcccaaggagggtca

SEQ ID NO: 9027558 - DNA, 22 bp, Homo sapiens
ctgtgtctcccaaggagggtca

SEQ ID NO: 9027559 - DNA, 22 bp, Homo sapiens
ctgtgtctcgttaaagcattgg

SEQ ID NO: 9027560 - DNA, 22 bp, Homo sapiens
ctgtgtctccttggtgggatat

SEQ ID NO: 9027561 - DNA, 22 bp, Homo sapiens
ctgtgtctctacctccccatcc

SEQ ID NO: 9027562 - DNA, 22 bp, Homo sapiens
ctgtgtctcccaaggagggtca

SEQ ID NO: 9027563 - DNA, 22 bp, Homo sapiens
ctgtgtctccttggtgggatat

SEQ ID NO: 9027564 - DNA, 22 bp, Homo sapiens
ctgtgtctcatccgcctctggc

SEQ ID NO: 9027565 - DNA, 22 bp, Homo sapiens
ctgtgtctcatccgcctctggc

SEQ ID NO: 9027566 - DNA, 22 bp, Homo sapiens
ctgtgtctgcctgggatccatt

SEQ ID NO: 9027567 - DNA, 22 bp, Homo sapiens
ctgtgtctctccttacaagact

SEQ ID NO: 9027568 - DNA, 22 bp, Homo sapiens
ctgtgtctgaataactctgtgt

SEQ ID NO: 9027569 - DNA, 22 bp, Homo sapiens
ctgtgtctctccttacaagact

SEQ ID NO: 9027570 - DNA, 22 bp, Homo sapiens
ctgtgtctctccttacaagact

SEQ ID NO: 9027571 - DNA, 22 bp, Homo sapiens
ctgtgtctctccttacaagact

SEQ ID NO: 9027572 - DNA, 22 bp, Homo sapiens
ctgttcacagaatcctcccctg

SEQ ID NO: 9027573 - DNA, 22 bp, Homo sapiens
ctgttcaatttgtttcagttat

SEQ ID NO: 9027574 - DNA, 22 bp, Homo sapiens
ctgttattttcctctgaactct

SEQ ID NO: 9027575 - DNA, 22 bp, Homo sapiens
ctgttattttataattcaagaa

SEQ ID NO: 9027576 - DNA, 22 bp, Homo sapiens
ctgttcagaaaaaatcttcatg

SEQ ID NO: 9027577 - DNA, 22 bp, Homo sapiens
ctgttcagaaaaaatcttcatg

SEQ ID NO: 9027578 - DNA, 18 bp, Homo sapiens
ctgttcagctgaactaca

SEQ ID NO: 9027579 - DNA, 22 bp, Homo sapiens
ctgttcagtaacctataaaaca

SEQ ID NO: 9027580 - DNA, 22 bp, Homo sapiens
ctgttcagtaacctataaaaca

SEQ ID NO: 9027581 - DNA, 22 bp, Homo sapiens
ctgttcatgttgaggcataggg

SEQ ID NO: 9027582 - DNA, 22 bp, Homo sapiens
ctgttccagatcaggacaccgt

SEQ ID NO: 9027583 - DNA, 22 bp, Homo sapiens
ctgttccagatcaggacaccgt

SEQ ID NO: 9027584 - DNA, 22 bp, Homo sapiens
ctgttctccggccagtccagag

SEQ ID NO: 9027585 - DNA, 22 bp, Homo sapiens
ctgttctctggcggtggctgtt

SEQ ID NO: 9027586 - DNA, 22 bp, Homo sapiens
ctgttctatcattaaaagctat

SEQ ID NO: 9027587 - DNA, 20 bp, Homo sapiens
ctgttcctgtcccatgaagc

SEQ ID NO: 9027588 - DNA, 22 bp, Homo sapiens
ctgttcccggtggccgggccag

SEQ ID NO: 9027589 - DNA, 22 bp, Homo sapiens
ctgttctgaccagtgcagggat

SEQ ID NO: 9027590 - DNA, 22 bp, Homo sapiens
ctgttctgaccagtgcagggat

SEQ ID NO: 9027591 - DNA, 22 bp, Homo sapiens
ctgttctgaactgcctgcatgc

SEQ ID NO: 9027592 - DNA, 22 bp, Homo sapiens
ctgttctgaactgcctgcatgc

SEQ ID NO: 9027593 - DNA, 22 bp, Homo sapiens
ctgttctctggcggtggctgtt

SEQ ID NO: 9027594 - DNA, 22 bp, Homo sapiens
ctgttctgaactgcctgcatgc

SEQ ID NO: 9027595 - DNA, 22 bp, Homo sapiens
ctgttctctggcggtggctgtt

SEQ ID NO: 9027596 - DNA, 22 bp, Homo sapiens
ctgttctgctgcataaaaactt

SEQ ID NO: 9027597 - DNA, 22 bp, Homo sapiens
ctgttctgctgcataaaaactt

SEQ ID NO: 9027598 - DNA, 22 bp, Homo sapiens
ctgttctgtaagctgctgttgt

SEQ ID NO: 9027599 - DNA, 22 bp, Homo sapiens
ctgttctgtaagctgctgttgt

SEQ ID NO: 9027600 - DNA, 22 bp, Homo sapiens
ctgttctggagacactgatgaa

SEQ ID NO: 9027601 - DNA, 18 bp, Homo sapiens
ctgttgagatgtggctga

SEQ ID NO: 9027602 - DNA, 18 bp, Homo sapiens
ctgttgagatgtggctga

SEQ ID NO: 9027603 - DNA, 22 bp, Homo sapiens
ctgttgatctcagttagctaga

SEQ ID NO: 9027604 - DNA, 22 bp, Homo sapiens
ctgttgattagaatttcacatc

SEQ ID NO: 9027605 - DNA, 22 bp, Homo sapiens
ctgttgcagaggggcggagagg

SEQ ID NO: 9027606 - DNA, 22 bp, Homo sapiens
ctgttgcatgactgtgcatgct

SEQ ID NO: 9027607 - DNA, 22 bp, Homo sapiens
ctgttgctccagggaacacaga

SEQ ID NO: 9027608 - DNA, 19 bp, Homo sapiens
ctgttgctggggctctctt

SEQ ID NO: 9027609 - DNA, 22 bp, Homo sapiens
ctgttgcttcaggaaacagtaa

SEQ ID NO: 9027610 - DNA, 22 bp, Homo sapiens
ctgtgtctcatccgcctctggc

SEQ ID NO: 9027611 - DNA, 23 bp, Homo sapiens
ctgtgtctatgcagccatatcca

SEQ ID NO: 9027612 - DNA, 22 bp, Homo sapiens
ctgtgtctaatcaggtcagtca

SEQ ID NO: 9027613 - DNA, 22 bp, Homo sapiens
ctgtgtctaatcaggtcagtca

SEQ ID NO: 9027614 - DNA, 22 bp, Homo sapiens
ctgtgtctaatcttatacatca

SEQ ID NO: 9027615 - DNA, 22 bp, Homo sapiens
ctgtgtctaatcaggtcagtca

SEQ ID NO: 9027616 - DNA, 22 bp, Homo sapiens
ctgtgtccttttagttgctgtg

SEQ ID NO: 9027617 - DNA, 22 bp, Homo sapiens
ctgtgtctaatcaggtcagtca

SEQ ID NO: 9027618 - DNA, 22 bp, Homo sapiens
ctgtgtcctttaaaaaagacac

SEQ ID NO: 9027619 - DNA, 22 bp, Homo sapiens
ctgtgtatctctgtgggacaga

SEQ ID NO: 9027620 - DNA, 22 bp, Homo sapiens
ctgtgtcctccccatcacttct

SEQ ID NO: 9027621 - DNA, 22 bp, Homo sapiens
ctgtgtagtcaggtggtcccac

SEQ ID NO: 9027622 - DNA, 22 bp, Homo sapiens
ctgtgtcctcccgctgcaccca

SEQ ID NO: 9027623 - DNA, 22 bp, Homo sapiens
ctgtgtcctcccgctgcaccca

SEQ ID NO: 9027624 - DNA, 22 bp, Homo sapiens
ctgtgtcctcccgctgcaccca

SEQ ID NO: 9027625 - DNA, 22 bp, Homo sapiens
ctgtgtcctccccatcacttct

SEQ ID NO: 9027626 - DNA, 22 bp, Homo sapiens
ctgtgtcctgcgtcaagccaat

SEQ ID NO: 9027627 - DNA, 22 bp, Homo sapiens
ctgtgtcctgcgtcaagccaat

SEQ ID NO: 9027628 - DNA, 22 bp, Homo sapiens
ctgtgtcctgcgtcaagccaat

SEQ ID NO: 9027629 - DNA, 22 bp, Homo sapiens
ctgtgtcctcccgctgcaccca

SEQ ID NO: 9027630 - DNA, 22 bp, Homo sapiens
ctgtgtcctgtctcctaaggtg

SEQ ID NO: 9027631 - DNA, 22 bp, Homo sapiens
ctgtgtcctgtctcctaaggtg

SEQ ID NO: 9027632 - DNA, 22 bp, Homo sapiens
ctgtggctggaataataaatgt

SEQ ID NO: 9027633 - DNA, 22 bp, Homo sapiens
ctgtggctgcgtaggtctggca

SEQ ID NO: 9027634 - DNA, 22 bp, Homo sapiens
ctgtggctgtatttggccagag

SEQ ID NO: 9027635 - DNA, 22 bp, Homo sapiens
ctgtggctgtatttggccagag

SEQ ID NO: 9027636 - DNA, 22 bp, Homo sapiens
ctgtggtgggccctgggcttca

SEQ ID NO: 9027637 - DNA, 22 bp, Homo sapiens
ctgtggtggcctccctgccatg

SEQ ID NO: 9027638 - DNA, 22 bp, Homo sapiens
ctgtggttggagtgcagtgaga

SEQ ID NO: 9027639 - DNA, 22 bp, Homo sapiens
ctgtggctgtgaaacttctcag

SEQ ID NO: 9027640 - DNA, 22 bp, Homo sapiens
ctgtggtggcacagcgggctgg

SEQ ID NO: 9027641 - DNA, 22 bp, Homo sapiens
ctgtggctgcgccatcgaaaac

SEQ ID NO: 9027642 - DNA, 22 bp, Homo sapiens
ctgtggctgcgccatcgaaaac

SEQ ID NO: 9027643 - DNA, 22 bp, Homo sapiens
ctgtggctgcgccctgggggag

SEQ ID NO: 9027644 - DNA, 22 bp, Homo sapiens
ctgtggctgcgccctgggggag

SEQ ID NO: 9027645 - DNA, 22 bp, Homo sapiens
ctgtggctgcgtaggtctggca

SEQ ID NO: 9027646 - DNA, 22 bp, Homo sapiens
ctgtggctgcagccttggtcct

SEQ ID NO: 9027647 - DNA, 22 bp, Homo sapiens
ctgtggctgcagccttggtcct

SEQ ID NO: 9027648 - DNA, 22 bp, Homo sapiens
ctgtggctgcagccttggtcct

SEQ ID NO: 9027649 - DNA, 19 bp, Homo sapiens
ctgtggctgacctctggcc

SEQ ID NO: 9027650 - DNA, 19 bp, Homo sapiens
ctgtggctgacctctggcc

SEQ ID NO: 9027651 - DNA, 20 bp, Homo sapiens
ctgtggctcatgcatctgcc

SEQ ID NO: 9027652 - DNA, 20 bp, Homo sapiens
ctgtggctcatgcatctgcc

SEQ ID NO: 9027653 - DNA, 20 bp, Homo sapiens
ctgtggctcatgcatctgcc

SEQ ID NO: 9027654 - DNA, 22 bp, Homo sapiens
ctgtggctcatatctgtaatct

SEQ ID NO: 9027655 - DNA, 20 bp, Homo sapiens
ctgtggctcatgcatctgcc

SEQ ID NO: 9027656 - DNA, 22 bp, Homo sapiens
ctgtggctccagtgaaccaatg

SEQ ID NO: 9027657 - DNA, 22 bp, Homo sapiens
ctgtggctccatagaagttgca

SEQ ID NO: 9027658 - DNA, 22 bp, Homo sapiens
ctgtggctctcagaggctgctg

SEQ ID NO: 9027659 - DNA, 22 bp, Homo sapiens
ctgtggctctcagaggctgctg

SEQ ID NO: 9027660 - DNA, 22 bp, Homo sapiens
ctgtggctctctgcagggtccc

SEQ ID NO: 9027661 - DNA, 22 bp, Homo sapiens
ctgtcctgaggcaggtggcctg

SEQ ID NO: 9027662 - DNA, 22 bp, Homo sapiens
ctgtcctgagataaagatgagg

SEQ ID NO: 9027663 - DNA, 22 bp, Homo sapiens
ctgtcctgagttcttggaggtc

SEQ ID NO: 9027664 - DNA, 22 bp, Homo sapiens
ctgtcctgagttcttggaggtc

SEQ ID NO: 9027665 - DNA, 22 bp, Homo sapiens
ctgtcctgaggcaggtggcctg

SEQ ID NO: 9027666 - DNA, 22 bp, Homo sapiens
ctgtcctgaggcaggtggcctg

SEQ ID NO: 9027667 - DNA, 22 bp, Homo sapiens
ctgtcctgagttcttggaggtc

SEQ ID NO: 9027668 - DNA, 20 bp, Homo sapiens
ctgtcctgatcttttcagaa

SEQ ID NO: 9027669 - DNA, 22 bp, Homo sapiens
ctgtcctgatggtgccactggt

SEQ ID NO: 9027670 - DNA, 22 bp, Homo sapiens
ctgtcctgatggtgccactggt

SEQ ID NO: 9027671 - DNA, 22 bp, Homo sapiens
ctgtcctgatggtgccactggt

SEQ ID NO: 9027672 - DNA, 22 bp, Homo sapiens
ctgtcctgatggtgccactggt

SEQ ID NO: 9027673 - DNA, 22 bp, Homo sapiens
ctgtcctgatggtgccactggt

SEQ ID NO: 9027674 - DNA, 22 bp, Homo sapiens
ctgtcctgcagttgggggcagg

SEQ ID NO: 9027675 - DNA, 22 bp, Homo sapiens
ctgtcctgcagttgggggcagg

SEQ ID NO: 9027676 - DNA, 22 bp, Homo sapiens
ctgtcctgccagtcctggactc

SEQ ID NO: 9027677 - DNA, 22 bp, Homo sapiens
ctgtcctgccagtcctggactc

SEQ ID NO: 9027678 - DNA, 22 bp, Homo sapiens
ctgtcctgccagtcctggactc

SEQ ID NO: 9027679 - DNA, 22 bp, Homo sapiens
ctgtcctgccagtcctggactc

SEQ ID NO: 9027680 - DNA, 22 bp, Homo sapiens
ctgtcctgcccaccctgcaggg

SEQ ID NO: 9027681 - DNA, 22 bp, Homo sapiens
ctgtcctgcccaccctgcaggg

SEQ ID NO: 9027682 - DNA, 21 bp, Homo sapiens
ctgtcctggtctagaggcaca

SEQ ID NO: 9027683 - DNA, 21 bp, Homo sapiens
ctgtcctggtctagaggcaca

SEQ ID NO: 9027684 - DNA, 22 bp, Homo sapiens
ctgtcctggtgctggggatccc

SEQ ID NO: 9027685 - DNA, 22 bp, Homo sapiens
ctgtcctggtgctggggatccc

SEQ ID NO: 9027686 - DNA, 19 bp, Homo sapiens
ctgtcctggtttggtccct

SEQ ID NO: 9027687 - DNA, 22 bp, Homo sapiens
ctgtcctggtgctggggatccc

SEQ ID NO: 9027688 - DNA, 21 bp, Homo sapiens
ctgtcctggtctagaggcaca

SEQ ID NO: 9027689 - DNA, 22 bp, Homo sapiens
ctgtcctgtagctccatcagtc

SEQ ID NO: 9027690 - DNA, 22 bp, Homo sapiens
ctgtcctgtactttgaggccct

SEQ ID NO: 9027691 - DNA, 22 bp, Homo sapiens
ctgtcctgtactttgaggccct

SEQ ID NO: 9027692 - DNA, 22 bp, Homo sapiens
ctgtcctgtactttgaggccct

SEQ ID NO: 9027693 - DNA, 19 bp, Homo sapiens
ctgtcctggtttggtccct

SEQ ID NO: 9027694 - DNA, 22 bp, Homo sapiens
ctgtcctgtagctccatcagtc

SEQ ID NO: 9027695 - DNA, 22 bp, Homo sapiens
ctgtcctgtagctccatcagtc

SEQ ID NO: 9027696 - DNA, 22 bp, Homo sapiens
ctgtcctgtagctccatcagtc

SEQ ID NO: 9027697 - DNA, 22 bp, Homo sapiens
ctgtcctggagggcataggacg

SEQ ID NO: 9027698 - DNA, 22 bp, Homo sapiens
ctgtcctgcccaccctgcaggg

SEQ ID NO: 9027699 - DNA, 22 bp, Homo sapiens
ctgtcctgcccaccctgcaggg

SEQ ID NO: 9027700 - DNA, 22 bp, Homo sapiens
ctgtcctggagggcataggacg

SEQ ID NO: 9027701 - DNA, 22 bp, Homo sapiens
ctgtcctggagggcataggacg

SEQ ID NO: 9027702 - DNA, 22 bp, Homo sapiens
ctgtcctggagggcataggacg

SEQ ID NO: 9027703 - DNA, 22 bp, Homo sapiens
ctgtcctggccgcccttgtgag

SEQ ID NO: 9027704 - DNA, 22 bp, Homo sapiens
ctgtcctggccgcccttgtgag

SEQ ID NO: 9027705 - DNA, 22 bp, Homo sapiens
ctgtcctggggaaagccagccc

SEQ ID NO: 9027706 - DNA, 22 bp, Homo sapiens
ctgtcctgggggtggtccttgc

SEQ ID NO: 9027707 - DNA, 22 bp, Homo sapiens
ctgtcctgggggtggtccttgc

SEQ ID NO: 9027708 - DNA, 22 bp, Homo sapiens
ctgtcctggtactttgaggttc

SEQ ID NO: 9027709 - DNA, 22 bp, Homo sapiens
ctgtcctggtactttgaggttc

SEQ ID NO: 9027710 - DNA, 22 bp, Homo sapiens
ctgggtgccagcatggctgagt

SEQ ID NO: 9027711 - DNA, 22 bp, Homo sapiens
ctgggtgccagcatggctgagt

SEQ ID NO: 9027712 - DNA, 22 bp, Homo sapiens
ctgggtgccacgggcaccctgg

SEQ ID NO: 9027713 - DNA, 22 bp, Homo sapiens
ctgggtgccagcatggctgagt

SEQ ID NO: 9027714 - DNA, 22 bp, Homo sapiens
ctgggtgcgtgagcgcatgcgt

SEQ ID NO: 9027715 - DNA, 22 bp, Homo sapiens
ctgggtgcgtgagcgcatgcgt

SEQ ID NO: 9027716 - DNA, 22 bp, Homo sapiens
ctgggtgctgtgggctcagagg

SEQ ID NO: 9027717 - DNA, 22 bp, Homo sapiens
ctgggtgctgtgggctcagagg

SEQ ID NO: 9027718 - DNA, 22 bp, Homo sapiens
ctgtccctgagcaactcctgtt

SEQ ID NO: 9027719 - DNA, 22 bp, Homo sapiens
ctgtcctgaaagggagattggg

SEQ ID NO: 9027720 - DNA, 22 bp, Homo sapiens
ctgtcctgaagttttcatgaga

SEQ ID NO: 9027721 - DNA, 22 bp, Homo sapiens
ctgtcctgaagttttcatgaga

SEQ ID NO: 9027722 - DNA, 22 bp, Homo sapiens
ctgtccctgagcaactcctgtt

SEQ ID NO: 9027723 - DNA, 22 bp, Homo sapiens
ctgtcccttcattattcactac

SEQ ID NO: 9027724 - DNA, 22 bp, Homo sapiens
ctgtccctgagcaactcctgtt

SEQ ID NO: 9027725 - DNA, 22 bp, Homo sapiens
ctgtcctctgtcctcagcagga

SEQ ID NO: 9027726 - DNA, 22 bp, Homo sapiens
ctgtcctctgtcctcagcagga

SEQ ID NO: 9027727 - DNA, 22 bp, Homo sapiens
ctgtcctctgtcctcagcagga

SEQ ID NO: 9027728 - DNA, 22 bp, Homo sapiens
ctgtcctctgtcctcagcagga

SEQ ID NO: 9027729 - DNA, 22 bp, Homo sapiens
ctgggtgagttgatgaaggaga

SEQ ID NO: 9027730 - DNA, 22 bp, Homo sapiens
ctgggtgagttgatgaaggaga

SEQ ID NO: 9027731 - DNA, 22 bp, Homo sapiens
ctgggtgacagagtgagatggt

SEQ ID NO: 9027732 - DNA, 22 bp, Homo sapiens
ctgggtctttttcttccattga

SEQ ID NO: 9027733 - DNA, 22 bp, Homo sapiens
ctgggtcttcagcagcaggcgg

SEQ ID NO: 9027734 - DNA, 22 bp, Homo sapiens
ctgggtcttcagcagcaggcgg

SEQ ID NO: 9027735 - DNA, 22 bp, Homo sapiens
ctgggtctttttcttccattga

SEQ ID NO: 9027736 - DNA, 22 bp, Homo sapiens
ctgggtgaatttgaaggaaagg

SEQ ID NO: 9027737 - DNA, 22 bp, Homo sapiens
ctgggtctgtgcccagggacct

SEQ ID NO: 9027738 - DNA, 19 bp, Homo sapiens
ctgggtcttattctgtgaa

SEQ ID NO: 9027739 - DNA, 22 bp, Homo sapiens
ctgggtctgtcactagataaat

SEQ ID NO: 9027740 - DNA, 22 bp, Homo sapiens
ctgggtctgtgcccagggacct

SEQ ID NO: 9027741 - DNA, 22 bp, Homo sapiens
ctgtgcagtggcagcgtgtggg

SEQ ID NO: 9027742 - DNA, 22 bp, Homo sapiens
ctgtgcagtggcagcgtgtggg

SEQ ID NO: 9027743 - DNA, 22 bp, Homo sapiens
ctgtgcagtaggtcagggctgg

SEQ ID NO: 9027744 - DNA, 22 bp, Homo sapiens
ctgtgcagtaggtcagggctgg

SEQ ID NO: 9027745 - DNA, 22 bp, Homo sapiens
ctgtgcagtggcagcgtgtggg

SEQ ID NO: 9027746 - DNA, 22 bp, Homo sapiens
ctgtgagggtcacagccatgcc

SEQ ID NO: 9027747 - DNA, 22 bp, Homo sapiens
ctgtgagggtcacagccatgcc

SEQ ID NO: 9027748 - DNA, 22 bp, Homo sapiens
ctgtgagggtcacagccatgcc

SEQ ID NO: 9027749 - DNA, 22 bp, Homo sapiens
ctgtgcagtaggtcagggctgg

SEQ ID NO: 9027750 - DNA, 22 bp, Homo sapiens
ctgtgagggccagagtcagggc

SEQ ID NO: 9027751 - DNA, 22 bp, Homo sapiens
ctgtgagggccagagtcagggc

SEQ ID NO: 9027752 - DNA, 22 bp, Homo sapiens
ctgtgagggccagagtcagggc

SEQ ID NO: 9027753 - DNA, 22 bp, Homo sapiens
ctgtgagggtcacagccatgcc

SEQ ID NO: 9027754 - DNA, 22 bp, Homo sapiens
ctgtgagggccagagtcagggc

SEQ ID NO: 9027755 - DNA, 22 bp, Homo sapiens
ctgtcctgtggacctgaggacg

SEQ ID NO: 9027756 - DNA, 22 bp, Homo sapiens
ctgtcctgtgcattgtcagatg

SEQ ID NO: 9027757 - DNA, 22 bp, Homo sapiens
ctgtcctgtagctccatcagtc

SEQ ID NO: 9027758 - DNA, 22 bp, Homo sapiens
ctgtcctgtgcattgtcagatg

SEQ ID NO: 9027759 - DNA, 22 bp, Homo sapiens
ctgtgcatggccatcagtgccc

SEQ ID NO: 9027760 - DNA, 22 bp, Homo sapiens
ctgtgcatgtgttctctggtaa

SEQ ID NO: 9027761 - DNA, 22 bp, Homo sapiens
ctgtgcattgttgagtgtttag

SEQ ID NO: 9027762 - DNA, 22 bp, Homo sapiens
ctgtgccacaaactcgcgaaaa

SEQ ID NO: 9027763 - DNA, 22 bp, Homo sapiens
ctgtgcagtgtggggtaggcct

SEQ ID NO: 9027764 - DNA, 22 bp, Homo sapiens
ctgtgcagtgtggggtaggcct

SEQ ID NO: 9027765 - DNA, 22 bp, Homo sapiens
ctgtgcagtgtggggtaggcct

SEQ ID NO: 9027766 - DNA, 22 bp, Homo sapiens
ctgtgccactgccctgccacgc

SEQ ID NO: 9027767 - DNA, 22 bp, Homo sapiens
ctgtgccacctgagggactcta

SEQ ID NO: 9027768 - DNA, 22 bp, Homo sapiens
ctgtgccactgccccaggcctc

SEQ ID NO: 9027769 - DNA, 22 bp, Homo sapiens
ctgtgccactgccccaggcctc

SEQ ID NO: 9027770 - DNA, 22 bp, Homo sapiens
ctgtgccacctgagggactcta

SEQ ID NO: 9027771 - DNA, 22 bp, Homo sapiens
ctgtgccactgggggccggcaa

SEQ ID NO: 9027772 - DNA, 22 bp, Homo sapiens
ctgtgccactgccctgccacgc

SEQ ID NO: 9027773 - DNA, 22 bp, Homo sapiens
ctgtgccactgggggccggcaa

SEQ ID NO: 9027774 - DNA, 22 bp, Homo sapiens
ctgtgccaggcccagctgactt

SEQ ID NO: 9027775 - DNA, 22 bp, Homo sapiens
ctgtgccagcctgtcccaggag

SEQ ID NO: 9027776 - DNA, 22 bp, Homo sapiens
ctgtgccccacagagctccaca

SEQ ID NO: 9027777 - DNA, 22 bp, Homo sapiens
ctgtgccccacagagctccaca

SEQ ID NO: 9027778 - DNA, 22 bp, Homo sapiens
ctgtgcccataatctggtattt

SEQ ID NO: 9027779 - DNA, 22 bp, Homo sapiens
ctgtgcccggcccagggccctg

SEQ ID NO: 9027780 - DNA, 22 bp, Homo sapiens
ctgtgcccggcccagggccctg

SEQ ID NO: 9027781 - DNA, 22 bp, Homo sapiens
ctgtgccccacagagctccaca

SEQ ID NO: 9027782 - DNA, 22 bp, Homo sapiens
ctgtgccccacagagctccaca

SEQ ID NO: 9027783 - DNA, 19 bp, Homo sapiens
ctgtgccctatgacttgta

SEQ ID NO: 9027784 - DNA, 22 bp, Homo sapiens
ctgtgccctctttgctggcctt

SEQ ID NO: 9027785 - DNA, 22 bp, Homo sapiens
ctgtgccctctttgctggcctt

SEQ ID NO: 9027786 - DNA, 19 bp, Homo sapiens
ctgtgccctatgacttgta

SEQ ID NO: 9027787 - DNA, 23 bp, Homo sapiens
ctgtgcccggggctccacctgat

SEQ ID NO: 9027788 - DNA, 23 bp, Homo sapiens
ctgtgcccggggctccacctgat

SEQ ID NO: 9027789 - DNA, 22 bp, Homo sapiens
ctgtggccagatggtgccagtt

SEQ ID NO: 9027790 - DNA, 17 bp, Homo sapiens
ctgtggccacctggatg

SEQ ID NO: 9027791 - DNA, 22 bp, Homo sapiens
ctgtggccccaccctcttggcc

SEQ ID NO: 9027792 - DNA, 22 bp, Homo sapiens
ctgtggccagtcccacacctcc

SEQ ID NO: 9027793 - DNA, 22 bp, Homo sapiens
ctgtggctcatatctgtaatct

SEQ ID NO: 9027794 - DNA, 22 bp, Homo sapiens
ctgtgccatctttttgctacct

SEQ ID NO: 9027795 - DNA, 22 bp, Homo sapiens
ctgtgccattctttgtagcatg

SEQ ID NO: 9027796 - DNA, 22 bp, Homo sapiens
ctgtgcccacctggctctgagg

SEQ ID NO: 9027797 - DNA, 22 bp, Homo sapiens
ctgtgcccacctggctctgagg

SEQ ID NO: 9027798 - DNA, 22 bp, Homo sapiens
ctgtgcccacctggctctgagg

SEQ ID NO: 9027799 - DNA, 22 bp, Homo sapiens
ctgtgcccagctccctgactgc

SEQ ID NO: 9027800 - DNA, 22 bp, Homo sapiens
ctgtgcccagctccctgactgc

SEQ ID NO: 9027801 - DNA, 22 bp, Homo sapiens
ctgtgcccaggcccctggggat

SEQ ID NO: 9027802 - DNA, 22 bp, Homo sapiens
ctgtgcccaggctggagtgcag

SEQ ID NO: 9027803 - DNA, 22 bp, Homo sapiens
ctgtgcccaggctggagtgcag

SEQ ID NO: 9027804 - DNA, 22 bp, Homo sapiens
ctgtgcccaggctggagtgcag

SEQ ID NO: 9027805 - DNA, 22 bp, Homo sapiens
ctgtgccaggcccgggtgggtg

SEQ ID NO: 9027806 - DNA, 22 bp, Homo sapiens
ctgtgccaggcccgggtgggtg

SEQ ID NO: 9027807 - DNA, 22 bp, Homo sapiens
ctgtgccaggcccagctgactt

SEQ ID NO: 9027808 - DNA, 22 bp, Homo sapiens
ctgtgccaggcccagctgactt

SEQ ID NO: 9027809 - DNA, 22 bp, Homo sapiens
ctgtgccaggcccagctgactt

SEQ ID NO: 9027810 - DNA, 22 bp, Homo sapiens
ctgtgccatcctagggctgctg

SEQ ID NO: 9027811 - DNA, 22 bp, Homo sapiens
ctgtgccatcctagggctgctg

SEQ ID NO: 9027812 - DNA, 22 bp, Homo sapiens
ctgtgccatcctagggctgctg

SEQ ID NO: 9027813 - DNA, 22 bp, Homo sapiens
cttcagccagctggggatgcgg

SEQ ID NO: 9027814 - DNA, 22 bp, Homo sapiens
cttcagaagaaaagcagtgtgt

SEQ ID NO: 9027815 - DNA, 22 bp, Homo sapiens
cttcagaagaaaagcagtgtgt

SEQ ID NO: 9027816 - DNA, 22 bp, Homo sapiens
cttcagaactataaaaagtact

SEQ ID NO: 9027817 - DNA, 22 bp, Homo sapiens
cttcagaactataaaaagtact

SEQ ID NO: 9027818 - DNA, 22 bp, Homo sapiens
cttcagaaccagccagaagagg

SEQ ID NO: 9027819 - DNA, 22 bp, Homo sapiens
cttcagaactataaaaagtact

SEQ ID NO: 9027820 - DNA, 22 bp, Homo sapiens
cttattttgctgatgacccagg

SEQ ID NO: 9027821 - DNA, 22 bp, Homo sapiens
cttattttgctgatgacccagg

SEQ ID NO: 9027822 - DNA, 22 bp, Homo sapiens
cttcaaaagccagaagcctgcg

SEQ ID NO: 9027823 - DNA, 22 bp, Homo sapiens
cttattttgctgatgacccagg

SEQ ID NO: 9027824 - DNA, 22 bp, Homo sapiens
cttattttgctgatgacccagg

SEQ ID NO: 9027825 - DNA, 22 bp, Homo sapiens
cttcaaacccagattaaatgca

SEQ ID NO: 9027826 - DNA, 22 bp, Homo sapiens
cttcaaaagccagaagcctgcg

SEQ ID NO: 9027827 - DNA, 22 bp, Homo sapiens
cttcaaacactagaaacacagg

SEQ ID NO: 9027828 - DNA, 22 bp, Homo sapiens
cttcaaaagccagaagcctgcg

SEQ ID NO: 9027829 - DNA, 22 bp, Homo sapiens
cttatttatgtctgtctctaat

SEQ ID NO: 9027830 - DNA, 22 bp, Homo sapiens
cttatttactgatccacagatg

SEQ ID NO: 9027831 - DNA, 22 bp, Homo sapiens
cttatttactgatccacagatg

SEQ ID NO: 9027832 - DNA, 22 bp, Homo sapiens
cttatttcctgacatggaaaga

SEQ ID NO: 9027833 - DNA, 22 bp, Homo sapiens
cttatttcagccctgggcaccc

SEQ ID NO: 9027834 - DNA, 22 bp, Homo sapiens
cttatttctccatccagagtca

SEQ ID NO: 9027835 - DNA, 19 bp, Homo sapiens
cttatttctggttttgggt

SEQ ID NO: 9027836 - DNA, 22 bp, Homo sapiens
cttatttgagagaaaagaaact

SEQ ID NO: 9027837 - DNA, 22 bp, Homo sapiens
cttatttgaatgtatgagtttt

SEQ ID NO: 9027838 - DNA, 19 bp, Homo sapiens
cttatttctggttttgggt

SEQ ID NO: 9027839 - DNA, 22 bp, Homo sapiens
cttatttctccatccagagtca

SEQ ID NO: 9027840 - DNA, 22 bp, Homo sapiens
cttatttcagccctgggcaccc

SEQ ID NO: 9027841 - DNA, 22 bp, Homo sapiens
cttatttcctgacatggaaaga

SEQ ID NO: 9027842 - DNA, 22 bp, Homo sapiens
cttatttctccatccagagtca

SEQ ID NO: 9027843 - DNA, 22 bp, Homo sapiens
cttattttgctgatgacccagg

SEQ ID NO: 9027844 - DNA, 22 bp, Homo sapiens
cttattttgctgatgacccagg

SEQ ID NO: 9027845 - DNA, 22 bp, Homo sapiens
cttattttgctgatgacccagg

SEQ ID NO: 9027846 - DNA, 22 bp, Homo sapiens
cttattttaagtcagtttgggt

SEQ ID NO: 9027847 - DNA, 22 bp, Homo sapiens
cttattttaagtcagtttgggt

SEQ ID NO: 9027848 - DNA, 22 bp, Homo sapiens
cttattttaagtcagtttgggt

SEQ ID NO: 9027849 - DNA, 22 bp, Homo sapiens
cttattttaagtcagtttgggt

SEQ ID NO: 9027850 - DNA, 22 bp, Homo sapiens
cttatttgtactaataaatctg

SEQ ID NO: 9027851 - DNA, 22 bp, Homo sapiens
cttattttaagtcagtttgggt

SEQ ID NO: 9027852 - DNA, 22 bp, Homo sapiens
cttatttgcccatgtttcttta

SEQ ID NO: 9027853 - DNA, 22 bp, Homo sapiens
cttatttgcccatgtttcttta

SEQ ID NO: 9027854 - DNA, 22 bp, Homo sapiens
cttatttgcccatgtttcttta

SEQ ID NO: 9027855 - DNA, 22 bp, Homo sapiens
cttatttgcccatgtttcttta

SEQ ID NO: 9027856 - DNA, 22 bp, Homo sapiens
cttattgtcttacagtaataga

SEQ ID NO: 9027857 - DNA, 22 bp, Homo sapiens
cttattgtgagatgcgataatt

SEQ ID NO: 9027858 - DNA, 22 bp, Homo sapiens
cttattgtgaggtattgagatt

SEQ ID NO: 9027859 - DNA, 22 bp, Homo sapiens
cttattgtcttacagtaataga

SEQ ID NO: 9027860 - DNA, 22 bp, Homo sapiens
cttattgtcctgactcatggcc

SEQ ID NO: 9027861 - DNA, 22 bp, Homo sapiens
cttattgtcttacagtaataga

SEQ ID NO: 9027862 - DNA, 22 bp, Homo sapiens
cttattgtgtgtattttctagt

SEQ ID NO: 9027863 - DNA, 22 bp, Homo sapiens
cttattgtgtctttgaataagt

SEQ ID NO: 9027864 - DNA, 22 bp, Homo sapiens
cttattgtgattcctgcctctt

SEQ ID NO: 9027865 - DNA, 22 bp, Homo sapiens
cttattgtgataccatgcagta

SEQ ID NO: 9027866 - DNA, 22 bp, Homo sapiens
cttattgttcagatagagatga

SEQ ID NO: 9027867 - DNA, 22 bp, Homo sapiens
cttattgttcagatagagatga

SEQ ID NO: 9027868 - DNA, 18 bp, Homo sapiens
cttattgtttaaatggcc

SEQ ID NO: 9027869 - DNA, 22 bp, Homo sapiens
cttattgttcctggaccctgag

SEQ ID NO: 9027870 - DNA, 22 bp, Homo sapiens
cttatttaatgagggttagaat

SEQ ID NO: 9027871 - DNA, 22 bp, Homo sapiens
cttattctactccacaagctct

SEQ ID NO: 9027872 - DNA, 22 bp, Homo sapiens
cttattcttgtcttattgtgct

SEQ ID NO: 9027873 - DNA, 21 bp, Homo sapiens
cttattgctgcacaatgattt

SEQ ID NO: 9027874 - DNA, 22 bp, Homo sapiens
cttattgaaagcccctgtgcct

SEQ ID NO: 9027875 - DNA, 22 bp, Homo sapiens
cttattgcaggactaagaacac

SEQ ID NO: 9027876 - DNA, 22 bp, Homo sapiens
cttattggagagttgggccctt

SEQ ID NO: 9027877 - DNA, 22 bp, Homo sapiens
cttattggagagttgggccctt

SEQ ID NO: 9027878 - DNA, 22 bp, Homo sapiens
cttattggtgctttttctcata

SEQ ID NO: 9027879 - DNA, 22 bp, Homo sapiens
cttattggtgctttttctcata

SEQ ID NO: 9027880 - DNA, 22 bp, Homo sapiens
cttattggtgctttttctcata

SEQ ID NO: 9027881 - DNA, 22 bp, Homo sapiens
cttattggtggagtcaggccct

SEQ ID NO: 9027882 - DNA, 22 bp, Homo sapiens
cttattggtggagtcaggccct

SEQ ID NO: 9027883 - DNA, 22 bp, Homo sapiens
cttattgggatgagaggatgca

SEQ ID NO: 9027884 - DNA, 22 bp, Homo sapiens
cttattgggatgagaggatgca

SEQ ID NO: 9027885 - DNA, 22 bp, Homo sapiens
cttattggtcccaggaggagaa

SEQ ID NO: 9027886 - DNA, 22 bp, Homo sapiens
cttattggtcccaggaggagaa

SEQ ID NO: 9027887 - DNA, 22 bp, Homo sapiens
ctgtttaaccagatctcatatc

SEQ ID NO: 9027888 - DNA, 22 bp, Homo sapiens
ctgtttaaccagatctcatatc

SEQ ID NO: 9027889 - DNA, 22 bp, Homo sapiens
cttatatttgtcaactttacaa

SEQ ID NO: 9027890 - DNA, 22 bp, Homo sapiens
cttatattttaggaacagacaa

SEQ ID NO: 9027891 - DNA, 22 bp, Homo sapiens
cttatattttaggaacagacaa

SEQ ID NO: 9027892 - DNA, 22 bp, Homo sapiens
cttatattttaggaacagacaa

SEQ ID NO: 9027893 - DNA, 22 bp, Homo sapiens
cttatcagattatctgggctgt

SEQ ID NO: 9027894 - DNA, 22 bp, Homo sapiens
cttatattttaggaacagacaa

SEQ ID NO: 9027895 - DNA, 23 bp, Homo sapiens
cttattcattcatgtagcccatt

SEQ ID NO: 9027896 - DNA, 22 bp, Homo sapiens
cttatcagattatctgggctgt

SEQ ID NO: 9027897 - DNA, 22 bp, Homo sapiens
ctgttggcttcagtgcagagaa

SEQ ID NO: 9027898 - DNA, 23 bp, Homo sapiens
ctgttggctgtcagggctggact

SEQ ID NO: 9027899 - DNA, 22 bp, Homo sapiens
ctgttgtaaagctattcatttg

SEQ ID NO: 9027900 - DNA, 22 bp, Homo sapiens
ctgttggagtcattccttccag

SEQ ID NO: 9027901 - DNA, 22 bp, Homo sapiens
ctgttggatgtgacactgttag

SEQ ID NO: 9027902 - DNA, 22 bp, Homo sapiens
ctgttggacttttcaaggtctg

SEQ ID NO: 9027903 - DNA, 22 bp, Homo sapiens
ctgttgcttcaggaaacagtaa

SEQ ID NO: 9027904 - DNA, 22 bp, Homo sapiens
ctgttggcctggtgatgaagct

SEQ ID NO: 9027905 - DNA, 22 bp, Homo sapiens
ctgttggcattaagatagtcat

SEQ ID NO: 9027906 - DNA, 22 bp, Homo sapiens
ctgttgttcatcatctgtcatt

SEQ ID NO: 9027907 - DNA, 22 bp, Homo sapiens
ctgttgttcatcatctgtcatt

SEQ ID NO: 9027908 - DNA, 22 bp, Homo sapiens
ctgttgtatttccaactatgta

SEQ ID NO: 9027909 - DNA, 22 bp, Homo sapiens
cttcaggatttaggaagatgaa

SEQ ID NO: 9027910 - DNA, 22 bp, Homo sapiens
cttcagggaggagcatgggttc

SEQ ID NO: 9027911 - DNA, 22 bp, Homo sapiens
cttcagggaggagcatgggttc

SEQ ID NO: 9027912 - DNA, 19 bp, Homo sapiens
cttcagggaggggccaggc

SEQ ID NO: 9027913 - DNA, 22 bp, Homo sapiens
cttcagtccttaagccaagcaa

SEQ ID NO: 9027914 - DNA, 22 bp, Homo sapiens
cttcagtatcctccacatgtta

SEQ ID NO: 9027915 - DNA, 22 bp, Homo sapiens
cttcagtatcctccacatgtta

SEQ ID NO: 9027916 - DNA, 18 bp, Homo sapiens
cttcagtcttcccacctc

SEQ ID NO: 9027917 - DNA, 18 bp, Homo sapiens
cttcagtcttcccacctc

SEQ ID NO: 9027918 - DNA, 22 bp, Homo sapiens
cttcagtcgccttggcaggggc

SEQ ID NO: 9027919 - DNA, 22 bp, Homo sapiens
cttcagtctagggtgcacttga

SEQ ID NO: 9027920 - DNA, 22 bp, Homo sapiens
cttcagtgatataggcttctcc

SEQ ID NO: 9027921 - DNA, 22 bp, Homo sapiens
cttcagtgattgcagaaagcct

SEQ ID NO: 9027922 - DNA, 22 bp, Homo sapiens
cttcagtgattgcagaaagcct

SEQ ID NO: 9027923 - DNA, 22 bp, Homo sapiens
cttcagtgcatgtttataatca

SEQ ID NO: 9027924 - DNA, 22 bp, Homo sapiens
cttcagtgattgcagaaagcct

SEQ ID NO: 9027925 - DNA, 22 bp, Homo sapiens
cttcagtgattgcagaaagcct

SEQ ID NO: 9027926 - DNA, 22 bp, Homo sapiens
cttcagtgacattccttccctc

SEQ ID NO: 9027927 - DNA, 18 bp, Homo sapiens
cttcagtgacagtctggc

SEQ ID NO: 9027928 - DNA, 22 bp, Homo sapiens
cttcagtgacagccacccaggc

SEQ ID NO: 9027929 - DNA, 22 bp, Homo sapiens
cttcagtgaatgttgagtaagg

SEQ ID NO: 9027930 - DNA, 22 bp, Homo sapiens
cttcagtgaatgttgagtaagg

SEQ ID NO: 9027931 - DNA, 22 bp, Homo sapiens
cttcaggaaaatctctaaggat

SEQ ID NO: 9027932 - DNA, 22 bp, Homo sapiens
cttcagctgtggtctccaaggc

SEQ ID NO: 9027933 - DNA, 22 bp, Homo sapiens
cttcagctgtggtctccaaggc

SEQ ID NO: 9027934 - DNA, 22 bp, Homo sapiens
cttcagctgcagttatgtttag

SEQ ID NO: 9027935 - DNA, 22 bp, Homo sapiens
cttcagctgtggtctccaaggc

SEQ ID NO: 9027936 - DNA, 22 bp, Homo sapiens
cttcaggattaatttggggcct

SEQ ID NO: 9027937 - DNA, 22 bp, Homo sapiens
cttcagctgttagacgtggaaa

SEQ ID NO: 9027938 - DNA, 22 bp, Homo sapiens
cttcaggagtagttacctagca

SEQ ID NO: 9027939 - DNA, 22 bp, Homo sapiens
cttcagccctgagtgccagcag

SEQ ID NO: 9027940 - DNA, 22 bp, Homo sapiens
cttcagccctgagtgccagcag

SEQ ID NO: 9027941 - DNA, 22 bp, Homo sapiens
cttcagccctgagtgccagcag

SEQ ID NO: 9027942 - DNA, 22 bp, Homo sapiens
cttcagcctcatctcagcccgt

SEQ ID NO: 9027943 - DNA, 22 bp, Homo sapiens
cttcagctaggatccctgcagc

SEQ ID NO: 9027944 - DNA, 22 bp, Homo sapiens
cttcagctacctctgatgcaag

SEQ ID NO: 9027945 - DNA, 22 bp, Homo sapiens
cttcagctgcagttatgtttag

SEQ ID NO: 9027946 - DNA, 22 bp, Homo sapiens
cttcagctgcagttatgtttag

SEQ ID NO: 9027947 - DNA, 22 bp, Homo sapiens
cttcagctgcagttatgtttag

SEQ ID NO: 9027948 - DNA, 22 bp, Homo sapiens
cttcagctgcagttatgtttag

SEQ ID NO: 9027949 - DNA, 22 bp, Homo sapiens
cttcagctcttggtaaatgttt

SEQ ID NO: 9027950 - DNA, 22 bp, Homo sapiens
cttcagctgacgtcaaaacacc

SEQ ID NO: 9027951 - DNA, 22 bp, Homo sapiens
cttcctctgtgtcctgggcttg

SEQ ID NO: 9027952 - DNA, 22 bp, Homo sapiens
cttcctctgtgtcctgggcttg

SEQ ID NO: 9027953 - DNA, 22 bp, Homo sapiens
cttcctctgtgtcctgggcttg

SEQ ID NO: 9027954 - DNA, 22 bp, Homo sapiens
cttcctctgtgtcctgggcttc

SEQ ID NO: 9027955 - DNA, 22 bp, Homo sapiens
cttcctctgtgtcctgggcttc

SEQ ID NO: 9027956 - DNA, 22 bp, Homo sapiens
cttcctctgtgtcctgggcttc

SEQ ID NO: 9027957 - DNA, 22 bp, Homo sapiens
cttcctctgtggccagagtgta

SEQ ID NO: 9027958 - DNA, 22 bp, Homo sapiens
cttcctctgcggcgccgggcgc

SEQ ID NO: 9027959 - DNA, 22 bp, Homo sapiens
cttcctctgtggccagagtgta

SEQ ID NO: 9027960 - DNA, 22 bp, Homo sapiens
cttcctgaaggatggcagcctc

SEQ ID NO: 9027961 - DNA, 18 bp, Homo sapiens
cttcctgactagctctgg

SEQ ID NO: 9027962 - DNA, 22 bp, Homo sapiens
cttcctgagcaaggaactatag

SEQ ID NO: 9027963 - DNA, 22 bp, Homo sapiens
cttcctgagcaaggaactatag

SEQ ID NO: 9027964 - DNA, 22 bp, Homo sapiens
cttcctgaacaatgccatcaat

SEQ ID NO: 9027965 - DNA, 22 bp, Homo sapiens
cttcctgaagaggttggtcagg

SEQ ID NO: 9027966 - DNA, 22 bp, Homo sapiens
cttcctgaaagtagtaggttga

SEQ ID NO: 9027967 - DNA, 22 bp, Homo sapiens
cttcctgaaatgtctcaccagt

SEQ ID NO: 9027968 - DNA, 18 bp, Homo sapiens
cttcctcttctggagaaa

SEQ ID NO: 9027969 - DNA, 18 bp, Homo sapiens
cttcctcttctggagaaa

SEQ ID NO: 9027970 - DNA, 22 bp, Homo sapiens
cttcctctgcctcccgtgctca

SEQ ID NO: 9027971 - DNA, 22 bp, Homo sapiens
cttcctctgcctcccgtgctca

SEQ ID NO: 9027972 - DNA, 22 bp, Homo sapiens
cttcctctgcggcgccgggcgc

SEQ ID NO: 9027973 - DNA, 22 bp, Homo sapiens
cttcctctgcctcccgtgctca

SEQ ID NO: 9027974 - DNA, 22 bp, Homo sapiens
cttcctaaaagcttcaagagaa

SEQ ID NO: 9027975 - DNA, 22 bp, Homo sapiens
cttcctaaaagcttcaagagaa

SEQ ID NO: 9027976 - DNA, 22 bp, Homo sapiens
cttccgtgtcagttccaggtgg

SEQ ID NO: 9027977 - DNA, 22 bp, Homo sapiens
cttccgtgtcagttccaggtgg

SEQ ID NO: 9027978 - DNA, 22 bp, Homo sapiens
cttccgtgtcagttccaggtgg

SEQ ID NO: 9027979 - DNA, 22 bp, Homo sapiens
cttccctttttatgtcttcagc

SEQ ID NO: 9027980 - DNA, 22 bp, Homo sapiens
cttccctttttatgtcttcagc

SEQ ID NO: 9027981 - DNA, 22 bp, Homo sapiens
cttccctttttatgtcttcagc

SEQ ID NO: 9027982 - DNA, 22 bp, Homo sapiens
cttcagtggtcatttgtgataa

SEQ ID NO: 9027983 - DNA, 18 bp, Homo sapiens
cttcagtggctgctctgc

SEQ ID NO: 9027984 - DNA, 18 bp, Homo sapiens
cttcagtggctgctctgc

SEQ ID NO: 9027985 - DNA, 23 bp, Homo sapiens
cttcagtgtgggactgcagcgtg

SEQ ID NO: 9027986 - DNA, 23 bp, Homo sapiens
cttcagtgtgggactgcagcgtg

SEQ ID NO: 9027987 - DNA, 23 bp, Homo sapiens
cttcagtgtgggactgcagcgtg

SEQ ID NO: 9027988 - DNA, 22 bp, Homo sapiens
cttcagtgtcctctctagtaga

SEQ ID NO: 9027989 - DNA, 22 bp, Homo sapiens
cttcagtgttcccatctgtaaa

SEQ ID NO: 9027990 - DNA, 22 bp, Homo sapiens
cttcagtgttcccatctgtaaa

SEQ ID NO: 9027991 - DNA, 19 bp, Homo sapiens
cttcagtgttcacctggcc

SEQ ID NO: 9027992 - DNA, 22 bp, Homo sapiens
cttccctttctggtgacttctc

SEQ ID NO: 9027993 - DNA, 22 bp, Homo sapiens
cttccctttttatgtcttcagc

SEQ ID NO: 9027994 - DNA, 22 bp, Homo sapiens
cttgtatacagtgtacacattg

SEQ ID NO: 9027995 - DNA, 22 bp, Homo sapiens
cttgtatacagtgtacacattg

SEQ ID NO: 9027996 - DNA, 22 bp, Homo sapiens
cttgtatagggaaagataaatc

SEQ ID NO: 9027997 - DNA, 22 bp, Homo sapiens
cttgtatatagcatgagtttga

SEQ ID NO: 9027998 - DNA, 22 bp, Homo sapiens
cttgtatagggaaagataaatc

SEQ ID NO: 9027999 - DNA, 22 bp, Homo sapiens
cttgtattaggaagaatgcttt

SEQ ID NO: 9028000 - DNA, 22 bp, Homo sapiens
cttgtattaagcttagagaggc

SEQ ID NO: 9028001 - DNA, 22 bp, Homo sapiens
cttgtattcccctatctctaaa

SEQ ID NO: 9028002 - DNA, 22 bp, Homo sapiens
cttgtattctgcctaaccttca

SEQ ID NO: 9028003 - DNA, 22 bp, Homo sapiens
cttgtattctgcctaaccttca

SEQ ID NO: 9028004 - DNA, 22 bp, Homo sapiens
cttgtattcttccacttaagat

SEQ ID NO: 9028005 - DNA, 22 bp, Homo sapiens
cttgtattgctgttttgcatct

SEQ ID NO: 9028006 - DNA, 22 bp, Homo sapiens
cttgtcagcactttgccgaaaa

SEQ ID NO: 9028007 - DNA, 22 bp, Homo sapiens
cttgtcactctggctccagagc

SEQ ID NO: 9028008 - DNA, 22 bp, Homo sapiens
cttgtcagccaattgtggattt

SEQ ID NO: 9028009 - DNA, 22 bp, Homo sapiens
cttgtcagccaattgtggattt

SEQ ID NO: 9028010 - DNA, 22 bp, Homo sapiens
cttgtcagccaattgtggattt

SEQ ID NO: 9028011 - DNA, 22 bp, Homo sapiens
cttgtctttatttcatattcca

SEQ ID NO: 9028012 - DNA, 22 bp, Homo sapiens
cttgtctttatttcatattcca

SEQ ID NO: 9028013 - DNA, 21 bp, Homo sapiens
cttgtcttgcttagaatagac

SEQ ID NO: 9028014 - DNA, 22 bp, Homo sapiens
cttgtcttgcacacggttgcca

SEQ ID NO: 9028015 - DNA, 22 bp, Homo sapiens
cttgtcttgcacacggttgcca

SEQ ID NO: 9028016 - DNA, 22 bp, Homo sapiens
cttgtcttgcacacggttgcca

SEQ ID NO: 9028017 - DNA, 22 bp, Homo sapiens
cttgtcttgcacacggttgcca

SEQ ID NO: 9028018 - DNA, 22 bp, Homo sapiens
cttgtctttatttcatattcca

SEQ ID NO: 9028019 - DNA, 22 bp, Homo sapiens
ctttatgagccttgtgaaggag

SEQ ID NO: 9028020 - DNA, 22 bp, Homo sapiens
ctttatggaatcaaagactgga

SEQ ID NO: 9028021 - DNA, 22 bp, Homo sapiens
cttgtctgggcagcttgggagt

SEQ ID NO: 9028022 - DNA, 22 bp, Homo sapiens
ctttatgtactgtgtatttgaa

SEQ ID NO: 9028023 - DNA, 22 bp, Homo sapiens
ctttatgtccaccagactgcaa

SEQ ID NO: 9028024 - DNA, 22 bp, Homo sapiens
ctttatgtccaccagactgcaa

SEQ ID NO: 9028025 - DNA, 22 bp, Homo sapiens
ctttatgtccaccagactgcaa

SEQ ID NO: 9028026 - DNA, 22 bp, Homo sapiens
cttgtcagccaattgtggattt

SEQ ID NO: 9028027 - DNA, 22 bp, Homo sapiens
cttgtcagtgtactttcttttg

SEQ ID NO: 9028028 - DNA, 22 bp, Homo sapiens
cttgtccccagcaggttggttt

SEQ ID NO: 9028029 - DNA, 22 bp, Homo sapiens
cttgtcctttacttgagactca

SEQ ID NO: 9028030 - DNA, 22 bp, Homo sapiens
cttgtcagtgtactttcttttg

SEQ ID NO: 9028031 - DNA, 22 bp, Homo sapiens
cttgtcctttacttgagactca

SEQ ID NO: 9028032 - DNA, 22 bp, Homo sapiens
cttgtctgggcagcttgggagt

SEQ ID NO: 9028033 - DNA, 22 bp, Homo sapiens
cttgtcctttacttgagactca

SEQ ID NO: 9028034 - DNA, 23 bp, Homo sapiens
cttgtctaattcatggtgaaggc

SEQ ID NO: 9028035 - DNA, 22 bp, Homo sapiens
cttgtcctttacttgagactca

SEQ ID NO: 9028036 - DNA, 22 bp, Homo sapiens
cttgccagcatttatagggatt

SEQ ID NO: 9028037 - DNA, 22 bp, Homo sapiens
cttgccaggatcagagtcacag

SEQ ID NO: 9028038 - DNA, 21 bp, Homo sapiens
cttgccaggccaggtgtcctc

SEQ ID NO: 9028039 - DNA, 22 bp, Homo sapiens
cttgccagcatttatagggatt

SEQ ID NO: 9028040 - DNA, 22 bp, Homo sapiens
cttgccagcaggcgctgtgtac

SEQ ID NO: 9028041 - DNA, 22 bp, Homo sapiens
cttgccagtgttgcagaagctc

SEQ ID NO: 9028042 - DNA, 22 bp, Homo sapiens
cttgccagtgttgcagaagctc

SEQ ID NO: 9028043 - DNA, 22 bp, Homo sapiens
cttgcagtttaggtcctctgtg

SEQ ID NO: 9028044 - DNA, 22 bp, Homo sapiens
cttgcagtttaggtcctctgtg

SEQ ID NO: 9028045 - DNA, 22 bp, Homo sapiens
cttgcatgcatttgaagatcat

SEQ ID NO: 9028046 - DNA, 22 bp, Homo sapiens
cttgccaatggtacaaacgatt

SEQ ID NO: 9028047 - DNA, 22 bp, Homo sapiens
cttgccaaattaacatacagaa

SEQ ID NO: 9028048 - DNA, 22 bp, Homo sapiens
cttgccaatggtacaaacgatt

SEQ ID NO: 9028049 - DNA, 22 bp, Homo sapiens
cttgccagcacttggccagctg

SEQ ID NO: 9028050 - DNA, 22 bp, Homo sapiens
cttgccagcacttggccagctg

SEQ ID NO: 9028051 - DNA, 22 bp, Homo sapiens
cttgcctacttgtcaaccagca

SEQ ID NO: 9028052 - DNA, 22 bp, Homo sapiens
cttgggtataaaacttggctat

SEQ ID NO: 9028053 - DNA, 22 bp, Homo sapiens
cttgggggccattaaggggcct

SEQ ID NO: 9028054 - DNA, 22 bp, Homo sapiens
cttgggggccattaaggggcct

SEQ ID NO: 9028055 - DNA, 20 bp, Homo sapiens
cttgccagttccctggcaga

SEQ ID NO: 9028056 - DNA, 22 bp, Homo sapiens
cttgccagtgttgcagaagctc

SEQ ID NO: 9028057 - DNA, 20 bp, Homo sapiens
cttgcccagggtctcctgcc

SEQ ID NO: 9028058 - DNA, 22 bp, Homo sapiens
cttgcccaccagtcagtggctt

SEQ ID NO: 9028059 - DNA, 22 bp, Homo sapiens
cttgtagaattgaaatggtctc

SEQ ID NO: 9028060 - DNA, 22 bp, Homo sapiens
cttgtagaattgaaatggtctc

SEQ ID NO: 9028061 - DNA, 22 bp, Homo sapiens
cttgtacattgatttctgcatt

SEQ ID NO: 9028062 - DNA, 22 bp, Homo sapiens
cttgtacatgataatctcactc

SEQ ID NO: 9028063 - DNA, 22 bp, Homo sapiens
cttgtagaattgaaatggtctc

SEQ ID NO: 9028064 - DNA, 22 bp, Homo sapiens
cttgtagaattgaaatggtctc

SEQ ID NO: 9028065 - DNA, 22 bp, Homo sapiens
cttgtagacccctggactcacg

SEQ ID NO: 9028066 - DNA, 22 bp, Homo sapiens
cttgtagacccctggactcacg

SEQ ID NO: 9028067 - DNA, 22 bp, Homo sapiens
cttgtagacccctggactcacg

SEQ ID NO: 9028068 - DNA, 22 bp, Homo sapiens
cttgtatacagagaaggctcat

SEQ ID NO: 9028069 - DNA, 22 bp, Homo sapiens
cttgtagctgcttcttctgaag

SEQ ID NO: 9028070 - DNA, 22 bp, Homo sapiens
cttgtacaggatattataggct

SEQ ID NO: 9028071 - DNA, 22 bp, Homo sapiens
cttgtacatagagaagaagcct

SEQ ID NO: 9028072 - DNA, 20 bp, Homo sapiens
cttgtacatgataaagattt

SEQ ID NO: 9028073 - DNA, 20 bp, Homo sapiens
cttgtacatgataaagattt

SEQ ID NO: 9028074 - DNA, 20 bp, Homo sapiens
cttgtacatgataaagattt

SEQ ID NO: 9028075 - DNA, 22 bp, Homo sapiens
cttgtacatcactggcagatgg

SEQ ID NO: 9028076 - DNA, 22 bp, Homo sapiens
cttgtacaggaatccatggtat

SEQ ID NO: 9028077 - DNA, 22 bp, Homo sapiens
cttgtacaggaatccatggtat

SEQ ID NO: 9028078 - DNA, 22 bp, Homo sapiens
cttgtacaggatattataggct

SEQ ID NO: 9028079 - DNA, 22 bp, Homo sapiens
cttgggtgctggaggctgccgc

SEQ ID NO: 9028080 - DNA, 22 bp, Homo sapiens
cttgacttcttctagaaataag

SEQ ID NO: 9028081 - DNA, 22 bp, Homo sapiens
cttgatctacatagtgaaaccc

SEQ ID NO: 9028082 - DNA, 22 bp, Homo sapiens
cttgatttattacccactatat

SEQ ID NO: 9028083 - DNA, 22 bp, Homo sapiens
cttgcaggattttgctgctgta

SEQ ID NO: 9028084 - DNA, 22 bp, Homo sapiens
cttgcaggcagggcctcctgga

SEQ ID NO: 9028085 - DNA, 22 bp, Homo sapiens
cttgcaggcagggacactgtct

SEQ ID NO: 9028086 - DNA, 22 bp, Homo sapiens
cttgcaggcagggcctcctgga

SEQ ID NO: 9028087 - DNA, 22 bp, Homo sapiens
cttgcaggcagggcctcctgga

SEQ ID NO: 9028088 - DNA, 22 bp, Homo sapiens
cttgcaggcccagccttacaag

SEQ ID NO: 9028089 - DNA, 22 bp, Homo sapiens
cttgcaggcccagccttacaag

SEQ ID NO: 9028090 - DNA, 22 bp, Homo sapiens
cttgcaggcagggcctcctgga

SEQ ID NO: 9028091 - DNA, 23 bp, Homo sapiens
cttgcagggctggaggcttagaa

SEQ ID NO: 9028092 - DNA, 22 bp, Homo sapiens
cttgcagtgtggccttgaagag

SEQ ID NO: 9028093 - DNA, 22 bp, Homo sapiens
cttgcagggctgatgggaagtg

SEQ ID NO: 9028094 - DNA, 22 bp, Homo sapiens
cttgcaggcctttctagctcta

SEQ ID NO: 9028095 - DNA, 22 bp, Homo sapiens
cttgcaggcctttctagctcta

SEQ ID NO: 9028096 - DNA, 22 bp, Homo sapiens
cttgcagggctgatgggaagtg

SEQ ID NO: 9028097 - DNA, 20 bp, Homo sapiens
cttgcaggagtgggtagagt

SEQ ID NO: 9028098 - DNA, 23 bp, Homo sapiens
cttgcaggaagcagatggcacac

SEQ ID NO: 9028099 - DNA, 22 bp, Homo sapiens
cttgcaggattttgctgctgta

SEQ ID NO: 9028100 - DNA, 23 bp, Homo sapiens
cttgcaggaagcagatggcacac

SEQ ID NO: 9028101 - DNA, 23 bp, Homo sapiens
cttgcaggaagcagatggcacac

SEQ ID NO: 9028102 - DNA, 22 bp, Homo sapiens
cttgcacagtgactaacacgta

SEQ ID NO: 9028103 - DNA, 22 bp, Homo sapiens
cttgcacatttcacacaatagg

SEQ ID NO: 9028104 - DNA, 22 bp, Homo sapiens
cttgcacatttcacacaatagg

SEQ ID NO: 9028105 - DNA, 22 bp, Homo sapiens
cttgcagaggctgttccagatg

SEQ ID NO: 9028106 - DNA, 22 bp, Homo sapiens
cttgcagatgtgactaaattaa

SEQ ID NO: 9028107 - DNA, 22 bp, Homo sapiens
cttcctggcaaagcaatcagag

SEQ ID NO: 9028108 - DNA, 22 bp, Homo sapiens
cttcctggatgagcaggctgat

SEQ ID NO: 9028109 - DNA, 22 bp, Homo sapiens
cttcctggatgagcaggctgat

SEQ ID NO: 9028110 - DNA, 22 bp, Homo sapiens
cttcctggatgagcaggctgat

SEQ ID NO: 9028111 - DNA, 22 bp, Homo sapiens
cttcctggatgaagcccagcat

SEQ ID NO: 9028112 - DNA, 22 bp, Homo sapiens
cttcctggatgaagcccagcat

SEQ ID NO: 9028113 - DNA, 19 bp, Homo sapiens
cttcctggaggagagcctc

SEQ ID NO: 9028114 - DNA, 19 bp, Homo sapiens
cttcctggaggagagcctc

SEQ ID NO: 9028115 - DNA, 19 bp, Homo sapiens
cttcctggaggagagcctc

SEQ ID NO: 9028116 - DNA, 22 bp, Homo sapiens
cttcctggatgaagcccagcat

SEQ ID NO: 9028117 - DNA, 19 bp, Homo sapiens
cttcctggaggagagcctc

SEQ ID NO: 9028118 - DNA, 22 bp, Homo sapiens
cttcctgaggtgctgagcacag

SEQ ID NO: 9028119 - DNA, 22 bp, Homo sapiens
cttcctgcaacacctgtgttgc

SEQ ID NO: 9028120 - DNA, 22 bp, Homo sapiens
cttcctgaggtgctgagcacag

SEQ ID NO: 9028121 - DNA, 22 bp, Homo sapiens
cttcctgcatggagtctgaatg

SEQ ID NO: 9028122 - DNA, 22 bp, Homo sapiens
cttcctgcaggacagccatctg

SEQ ID NO: 9028123 - DNA, 22 bp, Homo sapiens
cttcctgcattgtgccagagtt

SEQ ID NO: 9028124 - DNA, 22 bp, Homo sapiens
cttcctgcccacttcctgctgg

SEQ ID NO: 9028125 - DNA, 22 bp, Homo sapiens
cttcctgcattgtgccagagtt

SEQ ID NO: 9028126 - DNA, 22 bp, Homo sapiens
cttcctgcccacttcctgctgg

SEQ ID NO: 9028127 - DNA, 22 bp, Homo sapiens
cttcctgggacacctaactcta

SEQ ID NO: 9028128 - DNA, 22 bp, Homo sapiens
cttcctgggacacctaactcta

SEQ ID NO: 9028129 - DNA, 22 bp, Homo sapiens
cttcctgggcaatgttctgctt

SEQ ID NO: 9028130 - DNA, 22 bp, Homo sapiens
cttcctggctcggtgcctcacc

SEQ ID NO: 9028131 - DNA, 22 bp, Homo sapiens
cttcctggccattgccatggca

SEQ ID NO: 9028132 - DNA, 22 bp, Homo sapiens
cttcctggcatgggtctcatga

SEQ ID NO: 9028133 - DNA, 22 bp, Homo sapiens
cttgacaactggcagatatata

SEQ ID NO: 9028134 - DNA, 22 bp, Homo sapiens
cttcctgggtcagcctggaggt

SEQ ID NO: 9028135 - DNA, 22 bp, Homo sapiens
cttcctgggtctggagactgga

SEQ ID NO: 9028136 - DNA, 22 bp, Homo sapiens
cttgacagtcccaggaaaatag

SEQ ID NO: 9028137 - DNA, 22 bp, Homo sapiens
ggttttattaactttaacatca

SEQ ID NO: 9028138 - DNA, 22 bp, Homo sapiens
ggttttattaactttaacatca

SEQ ID NO: 9028139 - DNA, 22 bp, Homo sapiens
ggttttattaccccttaaacac

SEQ ID NO: 9028140 - DNA, 22 bp, Homo sapiens
ggttttattaactttaacatca

SEQ ID NO: 9028141 - DNA, 22 bp, Homo sapiens
ggttttatagcagtactatcag

SEQ ID NO: 9028142 - DNA, 22 bp, Homo sapiens
ggttttatcctacccacacagc

SEQ ID NO: 9028143 - DNA, 22 bp, Homo sapiens
gtaaaacatgttttaactagga

SEQ ID NO: 9028144 - DNA, 22 bp, Homo sapiens
gtaaaacatgttttaactagga

SEQ ID NO: 9028145 - DNA, 22 bp, Homo sapiens
gtaaaacatgttttaactagga

SEQ ID NO: 9028146 - DNA, 22 bp, Homo sapiens
gtaaaacatgttttaactagga

SEQ ID NO: 9028147 - DNA, 22 bp, Homo sapiens
gtaaaacaagctttatggttcc

SEQ ID NO: 9028148 - DNA, 22 bp, Homo sapiens
gtaaaacaagctttatggttcc

SEQ ID NO: 9028149 - DNA, 22 bp, Homo sapiens
gtaaaacaagctttatggttcc

SEQ ID NO: 9028150 - DNA, 22 bp, Homo sapiens
gtaaaacatgttttaactagga

SEQ ID NO: 9028151 - DNA, 22 bp, Homo sapiens
gtaaaacaagctttatggttcc

SEQ ID NO: 9028152 - DNA, 22 bp, Homo sapiens
ggtttggttctgagagttggca

SEQ ID NO: 9028153 - DNA, 22 bp, Homo sapiens
ggtttggttttggccatcttcc

SEQ ID NO: 9028154 - DNA, 22 bp, Homo sapiens
ggtttggttctgagagttggca

SEQ ID NO: 9028155 - DNA, 22 bp, Homo sapiens
ggtttctagcagagtctcttta

SEQ ID NO: 9028156 - DNA, 22 bp, Homo sapiens
ggtttctctgggtgtgggtgct

SEQ ID NO: 9028157 - DNA, 22 bp, Homo sapiens
ggtttgcacgatatttccatgg

SEQ ID NO: 9028158 - DNA, 22 bp, Homo sapiens
ggtttcctttgcttctcctgag

SEQ ID NO: 9028159 - DNA, 22 bp, Homo sapiens
ggtttgacagcttggggctgtc

SEQ ID NO: 9028160 - DNA, 22 bp, Homo sapiens
ggtttcaacttttgtgaggaat

SEQ ID NO: 9028161 - DNA, 22 bp, Homo sapiens
ggtttcaatgagaagtgcttgt

SEQ ID NO: 9028162 - DNA, 22 bp, Homo sapiens
ggtttccaagtggttgaaaagt

SEQ ID NO: 9028163 - DNA, 22 bp, Homo sapiens
ggtttccaaagatagagtagta

SEQ ID NO: 9028164 - DNA, 22 bp, Homo sapiens
ggtttccaaagatagagtagta

SEQ ID NO: 9028165 - DNA, 22 bp, Homo sapiens
ggtttccaccttgctatgagaa

SEQ ID NO: 9028166 - DNA, 22 bp, Homo sapiens
ggtttccacatccatggaatgg

SEQ ID NO: 9028167 - DNA, 22 bp, Homo sapiens
ggtttccaatgacaaacactgt

SEQ ID NO: 9028168 - DNA, 22 bp, Homo sapiens
ggtttccacttgctgaagaaag

SEQ ID NO: 9028169 - DNA, 22 bp, Homo sapiens
ggtttccacttgctgaagaaag

SEQ ID NO: 9028170 - DNA, 22 bp, Homo sapiens
ggtttccattattttatgggtg

SEQ ID NO: 9028171 - DNA, 22 bp, Homo sapiens
ggtttccaggagaagagatttg

SEQ ID NO: 9028172 - DNA, 22 bp, Homo sapiens
ggtttccattattttatgggtg

SEQ ID NO: 9028173 - DNA, 14 bp, Homo sapiens
ggtttccattttta

SEQ ID NO: 9028174 - DNA, 22 bp, Homo sapiens
ggtttcctggtcagctgaggca

SEQ ID NO: 9028175 - DNA, 22 bp, Homo sapiens
gtacatttcatttaaatgatgt

SEQ ID NO: 9028176 - DNA, 22 bp, Homo sapiens
gtacatttcatttaaatgatgt

SEQ ID NO: 9028177 - DNA, 22 bp, Homo sapiens
gtacatttcatttaaatgatgt

SEQ ID NO: 9028178 - DNA, 22 bp, Homo sapiens
gtacatttatttttgcagcata

SEQ ID NO: 9028179 - DNA, 22 bp, Homo sapiens
gtacatttcagtttccttaaga

SEQ ID NO: 9028180 - DNA, 22 bp, Homo sapiens
gtacatttcagtttccttaaga

SEQ ID NO: 9028181 - DNA, 22 bp, Homo sapiens
gtacatttcagtttccttaaga

SEQ ID NO: 9028182 - DNA, 22 bp, Homo sapiens
gtacatttaggattcattgaaa

SEQ ID NO: 9028183 - DNA, 22 bp, Homo sapiens
gtacatttatttttgcagcata

SEQ ID NO: 9028184 - DNA, 22 bp, Homo sapiens
gtaaaactgtctaatggtatat

SEQ ID NO: 9028185 - DNA, 22 bp, Homo sapiens
gtacatttaggattcattgaaa

SEQ ID NO: 9028186 - DNA, 23 bp, Homo sapiens
gtaaaatacgcagtgcagtgtga

SEQ ID NO: 9028187 - DNA, 22 bp, Homo sapiens
gtaaaactgcagaacttggagg

SEQ ID NO: 9028188 - DNA, 22 bp, Homo sapiens
gtaaaactgcagaacttggagg

SEQ ID NO: 9028189 - DNA, 22 bp, Homo sapiens
gtaaaacatgttttaactagga

SEQ ID NO: 9028190 - DNA, 22 bp, Homo sapiens
gtaaaactgcagaacttggagg

SEQ ID NO: 9028191 - DNA, 22 bp, Homo sapiens
gtaaaactgtctaatggtatat

SEQ ID NO: 9028192 - DNA, 22 bp, Homo sapiens
gtaaaactgtctaatggtatat

SEQ ID NO: 9028193 - DNA, 22 bp, Homo sapiens
gtaaaactgtctaatggtatat

SEQ ID NO: 9028194 - DNA, 22 bp, Homo sapiens
gtaaaactgtctaatggtatat

SEQ ID NO: 9028195 - DNA, 22 bp, Homo sapiens
gtaaaactgtctaatggtatat

SEQ ID NO: 9028196 - DNA, 22 bp, Homo sapiens
gtacatttctcttgttcttatt

SEQ ID NO: 9028197 - DNA, 22 bp, Homo sapiens
gtacatttctcttgttcttatt

SEQ ID NO: 9028198 - DNA, 22 bp, Homo sapiens
gtacatttctcccaacactaaa

SEQ ID NO: 9028199 - DNA, 22 bp, Homo sapiens
gtacatttctcccaacactaaa

SEQ ID NO: 9028200 - DNA, 22 bp, Homo sapiens
gtacattttactttgtttgaat

SEQ ID NO: 9028201 - DNA, 22 bp, Homo sapiens
gtacattttactttgtttgaat

SEQ ID NO: 9028202 - DNA, 22 bp, Homo sapiens
gtacatttctcttgttcttatt

SEQ ID NO: 9028203 - DNA, 22 bp, Homo sapiens
gtacattttactttgtttgaat

SEQ ID NO: 9028204 - DNA, 22 bp, Homo sapiens
gtaccaaatctgtattaggaaa

SEQ ID NO: 9028205 - DNA, 22 bp, Homo sapiens
gtaccctgtggccagccagcca

SEQ ID NO: 9028206 - DNA, 22 bp, Homo sapiens
gtaccctgtggccagccagcca

SEQ ID NO: 9028207 - DNA, 22 bp, Homo sapiens
gtacccaggcacgccttgctga

SEQ ID NO: 9028208 - DNA, 22 bp, Homo sapiens
gtacccagtgattccttcttca

SEQ ID NO: 9028209 - DNA, 22 bp, Homo sapiens
gtacccagaggcatgatcccag

SEQ ID NO: 9028210 - DNA, 22 bp, Homo sapiens
gtacccaagcaatcagtggaca

SEQ ID NO: 9028211 - DNA, 22 bp, Homo sapiens
gtacattttgaggttaaaacaa

SEQ ID NO: 9028212 - DNA, 22 bp, Homo sapiens
gtacattttgaggttaaaacaa

SEQ ID NO: 9028213 - DNA, 22 bp, Homo sapiens
gtaccagtctctgtgggcacct

SEQ ID NO: 9028214 - DNA, 20 bp, Homo sapiens
gtacattttcaggaggggat

SEQ ID NO: 9028215 - DNA, 22 bp, Homo sapiens
gtacattttgaggttaaaacaa

SEQ ID NO: 9028216 - DNA, 22 bp, Homo sapiens
gtagaattacctctctatgtcc

SEQ ID NO: 9028217 - DNA, 22 bp, Homo sapiens
gtagaattttaataatggagat

SEQ ID NO: 9028218 - DNA, 22 bp, Homo sapiens
gtagaatcccagtggctatatt

SEQ ID NO: 9028219 - DNA, 22 bp, Homo sapiens
gtagaatatatggttagtattg

SEQ ID NO: 9028220 - DNA, 22 bp, Homo sapiens
gtagaactctttcctgcgtggg

SEQ ID NO: 9028221 - DNA, 22 bp, Homo sapiens
gtagaactctttcctgcgtggg

SEQ ID NO: 9028222 - DNA, 22 bp, Homo sapiens
gtagaataaatgtacacatctg

SEQ ID NO: 9028223 - DNA, 20 bp, Homo sapiens
gtagaaccatgtgtgctggg

SEQ ID NO: 9028224 - DNA, 22 bp, Homo sapiens
gtagaaccttctttactagagt

SEQ ID NO: 9028225 - DNA, 22 bp, Homo sapiens
gtagaactccagttctgtggca

SEQ ID NO: 9028226 - DNA, 22 bp, Homo sapiens
gtagaactccagttctgtggca

SEQ ID NO: 9028227 - DNA, 22 bp, Homo sapiens
gtagaactaggacttcaggtat

SEQ ID NO: 9028228 - DNA, 22 bp, Homo sapiens
gtagaaatgtaaccaggagata

SEQ ID NO: 9028229 - DNA, 22 bp, Homo sapiens
gtagaaatgtaaccaggagata

SEQ ID NO: 9028230 - DNA, 22 bp, Homo sapiens
gtagaaattccatttactttga

SEQ ID NO: 9028231 - DNA, 22 bp, Homo sapiens
gtagaaattccatttactttga

SEQ ID NO: 9028232 - DNA, 22 bp, Homo sapiens
gtagaaattccatttactttga

SEQ ID NO: 9028233 - DNA, 22 bp, Homo sapiens
gtagaacactggggctctgttg

SEQ ID NO: 9028234 - DNA, 22 bp, Homo sapiens
gtagaacactggggctctgttg

SEQ ID NO: 9028235 - DNA, 22 bp, Homo sapiens
gtagaaatggtgtgtttcttct

SEQ ID NO: 9028236 - DNA, 22 bp, Homo sapiens
gtagaaatggtgtgtttcttct

SEQ ID NO: 9028237 - DNA, 22 bp, Homo sapiens
gtagaaatgtaaccaggagata

SEQ ID NO: 9028238 - DNA, 22 bp, Homo sapiens
gtacgtgcatgcacgtgtgcct

SEQ ID NO: 9028239 - DNA, 23 bp, Homo sapiens
gtagacagatgggccaaggtaat

SEQ ID NO: 9028240 - DNA, 22 bp, Homo sapiens
gtattacatttagtaattaggc

SEQ ID NO: 9028241 - DNA, 22 bp, Homo sapiens
gtattagaagaaattataggta

SEQ ID NO: 9028242 - DNA, 22 bp, Homo sapiens
gtattagaagaaattataggta

SEQ ID NO: 9028243 - DNA, 23 bp, Homo sapiens
gtagacagatgggccaaggtaat

SEQ ID NO: 9028244 - DNA, 22 bp, Homo sapiens
gtagacaagcacaggactcaga

SEQ ID NO: 9028245 - DNA, 22 bp, Homo sapiens
gtagacaaatttcttctctcaa

SEQ ID NO: 9028246 - DNA, 22 bp, Homo sapiens
gtattagactgagaaatggagt

SEQ ID NO: 9028247 - DNA, 22 bp, Homo sapiens
gtattagactgagaaatggagt

SEQ ID NO: 9028248 - DNA, 18 bp, Homo sapiens
gtattagttttcagagag

SEQ ID NO: 9028249 - DNA, 22 bp, Homo sapiens
gtattagttatctactgctgtg

SEQ ID NO: 9028250 - DNA, 22 bp, Homo sapiens
gtattagtcaattacagtgggg

SEQ ID NO: 9028251 - DNA, 22 bp, Homo sapiens
gtattattgtcatgaaataata

SEQ ID NO: 9028252 - DNA, 22 bp, Homo sapiens
gtattattgtcatgaaataata

SEQ ID NO: 9028253 - DNA, 22 bp, Homo sapiens
gtatttaattccattaagttag

SEQ ID NO: 9028254 - DNA, 22 bp, Homo sapiens
gtatttaattccattaagttag

SEQ ID NO: 9028255 - DNA, 22 bp, Homo sapiens
gtattgtattgaacacatgtga

SEQ ID NO: 9028256 - DNA, 22 bp, Homo sapiens
gtattgtatatttgcaaataca

SEQ ID NO: 9028257 - DNA, 22 bp, Homo sapiens
gtattgtatatttgcaaataca

SEQ ID NO: 9028258 - DNA, 22 bp, Homo sapiens
gtatttataggggaatgagagt

SEQ ID NO: 9028259 - DNA, 22 bp, Homo sapiens
gtatttaattctgtgcttctag

SEQ ID NO: 9028260 - DNA, 22 bp, Homo sapiens
gtatttcacatatggatatgct

SEQ ID NO: 9028261 - DNA, 23 bp, Homo sapiens
gtatttcagcattctcagttaaa

SEQ ID NO: 9028262 - DNA, 22 bp, Homo sapiens
gtatttataggggaatgagagt

SEQ ID NO: 9028263 - DNA, 21 bp, Homo sapiens
gtattgcagagttatgtgctc

SEQ ID NO: 9028264 - DNA, 22 bp, Homo sapiens
gtattgcaattactcttcttct

SEQ ID NO: 9028265 - DNA, 17 bp, Homo sapiens
gtattctttgccttcca

SEQ ID NO: 9028266 - DNA, 22 bp, Homo sapiens
gtattgccggaggcacctcctt

SEQ ID NO: 9028267 - DNA, 22 bp, Homo sapiens
gtattgggattatgggtgtgag

SEQ ID NO: 9028268 - DNA, 22 bp, Homo sapiens
gtattgcttgagcccaggagtt

SEQ ID NO: 9028269 - DNA, 20 bp, Homo sapiens
gtattggggcctggaggaag

SEQ ID NO: 9028270 - DNA, 22 bp, Homo sapiens
gtattgggtgagggcaaagggt

SEQ ID NO: 9028271 - DNA, 22 bp, Homo sapiens
gtattgtagctacaatagacgt

SEQ ID NO: 9028272 - DNA, 22 bp, Homo sapiens
gtattccttcagaagacgttta

SEQ ID NO: 9028273 - DNA, 22 bp, Homo sapiens
gtattctgggccgattacaaaa

SEQ ID NO: 9028274 - DNA, 22 bp, Homo sapiens
gtattctgggccgattacaaaa

SEQ ID NO: 9028275 - DNA, 22 bp, Homo sapiens
gtattcctaagtcatgacaaat

SEQ ID NO: 9028276 - DNA, 22 bp, Homo sapiens
gtattcatttatttactcatcc

SEQ ID NO: 9028277 - DNA, 22 bp, Homo sapiens
gtattccattagtgttaatatc

SEQ ID NO: 9028278 - DNA, 22 bp, Homo sapiens
gtattcaaggattttgttctac

SEQ ID NO: 9028279 - DNA, 22 bp, Homo sapiens
gtattcaagcgagcagatgtct

SEQ ID NO: 9028280 - DNA, 22 bp, Homo sapiens
gtattcaagcgagcagatgtct

SEQ ID NO: 9028281 - DNA, 22 bp, Homo sapiens
gtattcacctaaatgtagtttg

SEQ ID NO: 9028282 - DNA, 22 bp, Homo sapiens
gtattcacatggtggtagattg

SEQ ID NO: 9028283 - DNA, 22 bp, Homo sapiens
gtattcatattaaacatatcaa

SEQ ID NO: 9028284 - DNA, 22 bp, Homo sapiens
gtattcagtttgattgtctaca

SEQ ID NO: 9028285 - DNA, 22 bp, Homo sapiens
gtattctgtttacagtgagcaa

SEQ ID NO: 9028286 - DNA, 20 bp, Homo sapiens
gtattctgtattctgctcag

SEQ ID NO: 9028287 - DNA, 22 bp, Homo sapiens
gtattcttaaggattgagcaaa

SEQ ID NO: 9028288 - DNA, 21 bp, Homo sapiens
gtattctttatgaagtgaaaa

SEQ ID NO: 9028289 - DNA, 22 bp, Homo sapiens
gtccacaaaattactatcttac

SEQ ID NO: 9028290 - DNA, 22 bp, Homo sapiens
gtccaaggtctttggagataga

SEQ ID NO: 9028291 - DNA, 22 bp, Homo sapiens
gtccacaacatcagactaactg

SEQ ID NO: 9028292 - DNA, 22 bp, Homo sapiens
gtccacaaaattactatcttac

SEQ ID NO: 9028293 - DNA, 22 bp, Homo sapiens
gtccacaagcaggaagtgagcc

SEQ ID NO: 9028294 - DNA, 22 bp, Homo sapiens
gtccacaacatcagactaactg

SEQ ID NO: 9028295 - DNA, 22 bp, Homo sapiens
gtccaaggatgcaggatgctgt

SEQ ID NO: 9028296 - DNA, 22 bp, Homo sapiens
gtccaaaagagccagccgggcg

SEQ ID NO: 9028297 - DNA, 22 bp, Homo sapiens
gtccaaaagagccagccgggcg

SEQ ID NO: 9028298 - DNA, 22 bp, Homo sapiens
gtccaaattccacagatttctc

SEQ ID NO: 9028299 - DNA, 22 bp, Homo sapiens
gtccaaatttttcacatgtaga

SEQ ID NO: 9028300 - DNA, 22 bp, Homo sapiens
gtcatttttttcgtaatagtgg

SEQ ID NO: 9028301 - DNA, 22 bp, Homo sapiens
gtcatttttttcgtaatagtgg

SEQ ID NO: 9028302 - DNA, 22 bp, Homo sapiens
gtccaaaagagccagccgggcg

SEQ ID NO: 9028303 - DNA, 22 bp, Homo sapiens
gtccaaaagagccagccgggcg

SEQ ID NO: 9028304 - DNA, 22 bp, Homo sapiens
gtccaagagaactgaaatagga

SEQ ID NO: 9028305 - DNA, 22 bp, Homo sapiens
gtccaagagatgtaacgaagaa

SEQ ID NO: 9028306 - DNA, 22 bp, Homo sapiens
gtccaagagatgtaacgaagaa

SEQ ID NO: 9028307 - DNA, 22 bp, Homo sapiens
gtccaagagtcaagaagggggc

SEQ ID NO: 9028308 - DNA, 22 bp, Homo sapiens
gtccaagagtcaagaagggggc

SEQ ID NO: 9028309 - DNA, 22 bp, Homo sapiens
gtcatttttgactttgaagtga

SEQ ID NO: 9028310 - DNA, 22 bp, Homo sapiens
gtcatttttgactttgaagtga

SEQ ID NO: 9028311 - DNA, 22 bp, Homo sapiens
gtcatttttttcgtaatagtgg

SEQ ID NO: 9028312 - DNA, 22 bp, Homo sapiens
gtcatttttcactgcatataga

SEQ ID NO: 9028313 - DNA, 22 bp, Homo sapiens
gtcattttctagaattatttga

SEQ ID NO: 9028314 - DNA, 22 bp, Homo sapiens
gtcattttgctgcatatttaga

SEQ ID NO: 9028315 - DNA, 22 bp, Homo sapiens
gtcattttgctgcatatttaga

SEQ ID NO: 9028316 - DNA, 22 bp, Homo sapiens
gtcatttttcactgcatataga

SEQ ID NO: 9028317 - DNA, 23 bp, Homo sapiens
gtatttcagcattctcagttaaa

SEQ ID NO: 9028318 - DNA, 23 bp, Homo sapiens
gtatttcagcattctcagttaaa

SEQ ID NO: 9028319 - DNA, 22 bp, Homo sapiens
gtatttccattagtgtgtgcac

SEQ ID NO: 9028320 - DNA, 22 bp, Homo sapiens
gtatttcatcttgaaaaccagt

SEQ ID NO: 9028321 - DNA, 22 bp, Homo sapiens
gtatttccattagtgtgtgcac

SEQ ID NO: 9028322 - DNA, 22 bp, Homo sapiens
gtcattttctagaattatttga

SEQ ID NO: 9028323 - DNA, 22 bp, Homo sapiens
gtcattttatgggaacagattt

SEQ ID NO: 9028324 - DNA, 22 bp, Homo sapiens
gtcccatttcaagaaattcatg

SEQ ID NO: 9028325 - DNA, 22 bp, Homo sapiens
gtcccattccctgtatcttaga

SEQ ID NO: 9028326 - DNA, 22 bp, Homo sapiens
gtccccagagctggtggtggtt

SEQ ID NO: 9028327 - DNA, 22 bp, Homo sapiens
gtccccagaaaggtgaggcagg

SEQ ID NO: 9028328 - DNA, 22 bp, Homo sapiens
gtccccagaaaggtgaggcagg

SEQ ID NO: 9028329 - DNA, 22 bp, Homo sapiens
gtccccagaaaggtgaggcagg

SEQ ID NO: 9028330 - DNA, 22 bp, Homo sapiens
gtccagaaagggcagtgatttg

SEQ ID NO: 9028331 - DNA, 22 bp, Homo sapiens
gtccacttggcacaaggcactt

SEQ ID NO: 9028332 - DNA, 22 bp, Homo sapiens
gtccacttgctgtgttcttaat

SEQ ID NO: 9028333 - DNA, 22 bp, Homo sapiens
gtccagaagcagtgcacatcac

SEQ ID NO: 9028334 - DNA, 22 bp, Homo sapiens
gtccagaagcagtgcacatcac

SEQ ID NO: 9028335 - DNA, 22 bp, Homo sapiens
gtccagaagcagtgcacatcac

SEQ ID NO: 9028336 - DNA, 23 bp, Homo sapiens
gtccagaacccaggctggggtgg

SEQ ID NO: 9028337 - DNA, 22 bp, Homo sapiens
gtccactgctgtgtgcttcacc

SEQ ID NO: 9028338 - DNA, 22 bp, Homo sapiens
gtccacttcaggactggccgct

SEQ ID NO: 9028339 - DNA, 22 bp, Homo sapiens
gtccacttctgcctttctggat

SEQ ID NO: 9028340 - DNA, 22 bp, Homo sapiens
gtccacttctgacttgttcaga

SEQ ID NO: 9028341 - DNA, 21 bp, Homo sapiens
gtccacttccttcctgcttct

SEQ ID NO: 9028342 - DNA, 18 bp, Homo sapiens
gtccacagattcttcact

SEQ ID NO: 9028343 - DNA, 18 bp, Homo sapiens
gtccacagccctcacagc

SEQ ID NO: 9028344 - DNA, 18 bp, Homo sapiens
gtccacagccctcacagc

SEQ ID NO: 9028345 - DNA, 22 bp, Homo sapiens
gtccacagctggccagggcctc

SEQ ID NO: 9028346 - DNA, 22 bp, Homo sapiens
gtccacagctctgaggtctccc

SEQ ID NO: 9028347 - DNA, 22 bp, Homo sapiens
gtccacagctctgaggtctccc

SEQ ID NO: 9028348 - DNA, 22 bp, Homo sapiens
gtccacagggatggccacacat

SEQ ID NO: 9028349 - DNA, 22 bp, Homo sapiens
gtccacagggatggccacacat

SEQ ID NO: 9028350 - DNA, 22 bp, Homo sapiens
gtccacataggaacccagcttc

SEQ ID NO: 9028351 - DNA, 22 bp, Homo sapiens
gtccaccatagggagggcgtgg

SEQ ID NO: 9028352 - DNA, 22 bp, Homo sapiens
gtccaccatagggagggcgtgg

SEQ ID NO: 9028353 - DNA, 22 bp, Homo sapiens
gtccactcccagtgcctgaggc

SEQ ID NO: 9028354 - DNA, 22 bp, Homo sapiens
gtcccctggcccccagcgtcgg

SEQ ID NO: 9028355 - DNA, 22 bp, Homo sapiens
gtcccctgtccagggccagcca

SEQ ID NO: 9028356 - DNA, 22 bp, Homo sapiens
gtcccctggcccccagcgtcgg

SEQ ID NO: 9028357 - DNA, 22 bp, Homo sapiens
gtcccctcagccacccatgggg

SEQ ID NO: 9028358 - DNA, 22 bp, Homo sapiens
gtccccagctgtgacgagagcc

SEQ ID NO: 9028359 - DNA, 22 bp, Homo sapiens
gtccccagctgtgacgagagcc

SEQ ID NO: 9028360 - DNA, 22 bp, Homo sapiens
gtccccagctgtgacgagagcc

SEQ ID NO: 9028361 - DNA, 22 bp, Homo sapiens
gtccccagctgtgacgagagcc

SEQ ID NO: 9028362 - DNA, 22 bp, Homo sapiens
gtcccccacacttccatgtcac

SEQ ID NO: 9028363 - DNA, 22 bp, Homo sapiens
gtcccccacacttccatgtcac

SEQ ID NO: 9028364 - DNA, 22 bp, Homo sapiens
gtcccctcaaaattcatatgtt

SEQ ID NO: 9028365 - DNA, 22 bp, Homo sapiens
gtcccctcaaaattcatatgtt

SEQ ID NO: 9028366 - DNA, 22 bp, Homo sapiens
gtccccgccgtcgctcaggctg

SEQ ID NO: 9028367 - DNA, 22 bp, Homo sapiens
gtccctcaaggtccagtcatgg

SEQ ID NO: 9028368 - DNA, 22 bp, Homo sapiens
gtccctagtggaaagacatgat

SEQ ID NO: 9028369 - DNA, 22 bp, Homo sapiens
gtcccgcattgggcattcctgg

SEQ ID NO: 9028370 - DNA, 22 bp, Homo sapiens
gtcccgcattgggcattcctgg

SEQ ID NO: 9028371 - DNA, 22 bp, Homo sapiens
gtccctctcaaatttatatgct

SEQ ID NO: 9028372 - DNA, 22 bp, Homo sapiens
gtccctcagtagtgcacagtgg

SEQ ID NO: 9028373 - DNA, 22 bp, Homo sapiens
gtccctcactggaccatatgaa

SEQ ID NO: 9028374 - DNA, 22 bp, Homo sapiens
gtccctcactggaccatatgaa

SEQ ID NO: 9028375 - DNA, 22 bp, Homo sapiens
gtccctcactggaccatatgaa

SEQ ID NO: 9028376 - DNA, 22 bp, Homo sapiens
gtccctctgctctagagagcca

SEQ ID NO: 9028377 - DNA, 22 bp, Homo sapiens
gtccctctgtgtccctgcagtc

SEQ ID NO: 9028378 - DNA, 22 bp, Homo sapiens
gtccctctgtgtccctgcagtc

SEQ ID NO: 9028379 - DNA, 22 bp, Homo sapiens
gtccctctgtgtccctgcagtc

SEQ ID NO: 9028380 - DNA, 22 bp, Homo sapiens
gtccctctgtgtccctgcagtc

SEQ ID NO: 9028381 - DNA, 22 bp, Homo sapiens
gtccctgcatcaccacgggact

SEQ ID NO: 9028382 - DNA, 22 bp, Homo sapiens
gtccctgacacccgggtggagg

SEQ ID NO: 9028383 - DNA, 22 bp, Homo sapiens
gtccctgataagagccatcgat

SEQ ID NO: 9028384 - DNA, 22 bp, Homo sapiens
gtccctgcatcaccacgggact

SEQ ID NO: 9028385 - DNA, 22 bp, Homo sapiens
gtcctgggcctgctgaggctga

SEQ ID NO: 9028386 - DNA, 22 bp, Homo sapiens
gtcctgggcccaggggctgcct

SEQ ID NO: 9028387 - DNA, 22 bp, Homo sapiens
gtcctgggcccaggggctgcct

SEQ ID NO: 9028388 - DNA, 22 bp, Homo sapiens
gtcctgggaggggctggtcctg

SEQ ID NO: 9028389 - DNA, 22 bp, Homo sapiens
gtcctgggcccaggggctgcct

SEQ ID NO: 9028390 - DNA, 22 bp, Homo sapiens
gtcctgggcccaggggctgcct

SEQ ID NO: 9028391 - DNA, 22 bp, Homo sapiens
gtcctgggcccaggggctgcct

SEQ ID NO: 9028392 - DNA, 22 bp, Homo sapiens
gtcctgggaggggctggtcctg

SEQ ID NO: 9028393 - DNA, 22 bp, Homo sapiens
gtcctgggaggggctggtcctg

SEQ ID NO: 9028394 - DNA, 22 bp, Homo sapiens
gtcctgggcatgcagggctttc

SEQ ID NO: 9028395 - DNA, 20 bp, Homo sapiens
gtcctgggagccacagcaca

SEQ ID NO: 9028396 - DNA, 20 bp, Homo sapiens
gtcctgggagccacagcaca

SEQ ID NO: 9028397 - DNA, 20 bp, Homo sapiens
gtcctgggagccacagcaca

SEQ ID NO: 9028398 - DNA, 17 bp, Homo sapiens
gtcctgggaggagagag

SEQ ID NO: 9028399 - DNA, 17 bp, Homo sapiens
gtcctgggaggagagag

SEQ ID NO: 9028400 - DNA, 17 bp, Homo sapiens
gtcctgggaggagagag

SEQ ID NO: 9028401 - DNA, 17 bp, Homo sapiens
gtcctgggaggagagag

SEQ ID NO: 9028402 - DNA, 17 bp, Homo sapiens
gtcctgggaggagagag

SEQ ID NO: 9028403 - DNA, 22 bp, Homo sapiens
gtcctgggaggggctggtcctg

SEQ ID NO: 9028404 - DNA, 20 bp, Homo sapiens
gtcctgggagccacagcaca

SEQ ID NO: 9028405 - DNA, 20 bp, Homo sapiens
gtcctgggagccacagcaca

SEQ ID NO: 9028406 - DNA, 22 bp, Homo sapiens
gtcctgggagatgggaccctga

SEQ ID NO: 9028407 - DNA, 22 bp, Homo sapiens
gtcctgggagatgggaccctga

SEQ ID NO: 9028408 - DNA, 22 bp, Homo sapiens
gtcctgggaaggaagccaggga

SEQ ID NO: 9028409 - DNA, 22 bp, Homo sapiens
gtcctgggaaggaagccaggga

SEQ ID NO: 9028410 - DNA, 22 bp, Homo sapiens
gtcctgggaaggaagccaggga

SEQ ID NO: 9028411 - DNA, 22 bp, Homo sapiens
gtcctgggaaggaagccaggga

SEQ ID NO: 9028412 - DNA, 22 bp, Homo sapiens
gtcctgggaaggaagccaggga

SEQ ID NO: 9028413 - DNA, 22 bp, Homo sapiens
gtccctgccctcctgggactca

SEQ ID NO: 9028414 - DNA, 22 bp, Homo sapiens
gtccctgccctcctgggactca

SEQ ID NO: 9028415 - DNA, 22 bp, Homo sapiens
gtccctgcatctgcaggccatg

SEQ ID NO: 9028416 - DNA, 22 bp, Homo sapiens
gtccctgcatctgcaggccatg

SEQ ID NO: 9028417 - DNA, 22 bp, Homo sapiens
gtccctggaatggactctgcgc

SEQ ID NO: 9028418 - DNA, 22 bp, Homo sapiens
gtccctggaatggactctgcgc

SEQ ID NO: 9028419 - DNA, 22 bp, Homo sapiens
gtccctggaatggactctgcgc

SEQ ID NO: 9028420 - DNA, 22 bp, Homo sapiens
gtcctgggaactggacagctaa

SEQ ID NO: 9028421 - DNA, 22 bp, Homo sapiens
gtcctgggaactggacagctaa

SEQ ID NO: 9028422 - DNA, 22 bp, Homo sapiens
gtcctgggaactggacagctaa

SEQ ID NO: 9028423 - DNA, 22 bp, Homo sapiens
gtgaccataatagattatgagt

SEQ ID NO: 9028424 - DNA, 22 bp, Homo sapiens
gtgaccatcatctcagctagtt

SEQ ID NO: 9028425 - DNA, 22 bp, Homo sapiens
gtgaaggagttatcagtggtta

SEQ ID NO: 9028426 - DNA, 22 bp, Homo sapiens
gtgaaggagttatcagtggtta

SEQ ID NO: 9028427 - DNA, 22 bp, Homo sapiens
gtgaccatttgacatatccttg

SEQ ID NO: 9028428 - DNA, 22 bp, Homo sapiens
gtgaccatcatctcagctagtt

SEQ ID NO: 9028429 - DNA, 22 bp, Homo sapiens
gtgaccatcatctcagctagtt

SEQ ID NO: 9028430 - DNA, 23 bp, Homo sapiens
gtgacccaaggaccttccagaat

SEQ ID NO: 9028431 - DNA, 22 bp, Homo sapiens
gtgaaggaccaatatgactcat

SEQ ID NO: 9028432 - DNA, 18 bp, Homo sapiens
gtgaagctttattgaatg

SEQ ID NO: 9028433 - DNA, 22 bp, Homo sapiens
gtgaaggaggggccacagatat

SEQ ID NO: 9028434 - DNA, 22 bp, Homo sapiens
gtgaagacttggagaagttaag

SEQ ID NO: 9028435 - DNA, 21 bp, Homo sapiens
gtgaagactttgcctttaaga

SEQ ID NO: 9028436 - DNA, 22 bp, Homo sapiens
gtgaagagctgttgcagagatt

SEQ ID NO: 9028437 - DNA, 22 bp, Homo sapiens
gtgaagagctgttgcagagatt

SEQ ID NO: 9028438 - DNA, 17 bp, Homo sapiens
gtgaagagtcattgaat

SEQ ID NO: 9028439 - DNA, 17 bp, Homo sapiens
gtgaagagtcattgaat

SEQ ID NO: 9028440 - DNA, 22 bp, Homo sapiens
gtgaacttccagatgataaaca

SEQ ID NO: 9028441 - DNA, 22 bp, Homo sapiens
gtgaactgctgagttttatcat

SEQ ID NO: 9028442 - DNA, 22 bp, Homo sapiens
gtgaactcagtctctcttgcta

SEQ ID NO: 9028443 - DNA, 22 bp, Homo sapiens
gtgaactctgactctcatgcct

SEQ ID NO: 9028444 - DNA, 22 bp, Homo sapiens
gtgaacctctgaaaggcagtga

SEQ ID NO: 9028445 - DNA, 22 bp, Homo sapiens
gtgaagaccagggaacgctggc

SEQ ID NO: 9028446 - DNA, 22 bp, Homo sapiens
gtgaagaaggcaatacaaagaa

SEQ ID NO: 9028447 - DNA, 22 bp, Homo sapiens
gtgaagcacgctgccgcactgg

SEQ ID NO: 9028448 - DNA, 22 bp, Homo sapiens
gtgaagcagagtgtggaagcaa

SEQ ID NO: 9028449 - DNA, 22 bp, Homo sapiens
gtgaagcagggaaggaaaggat

SEQ ID NO: 9028450 - DNA, 22 bp, Homo sapiens
gtgaagcacatgggcgttgggt

SEQ ID NO: 9028451 - DNA, 22 bp, Homo sapiens
gtgaagatgcctcaggtgaccc

SEQ ID NO: 9028452 - DNA, 22 bp, Homo sapiens
gtgaagcatatgcttctctgcc

SEQ ID NO: 9028453 - DNA, 22 bp, Homo sapiens
gtgaagcataactgaaggattt

SEQ ID NO: 9028454 - DNA, 22 bp, Homo sapiens
gtgaagcagttgcgtgggttcc

SEQ ID NO: 9028455 - DNA, 22 bp, Homo sapiens
gtgaagcagggaaggaaaggat

SEQ ID NO: 9028456 - DNA, 22 bp, Homo sapiens
gtgaaaataaggctggttcttg

SEQ ID NO: 9028457 - DNA, 22 bp, Homo sapiens
gtgaaacaccctccaatgcaca

SEQ ID NO: 9028458 - DNA, 22 bp, Homo sapiens
gtgaaactgctttgtaaactgt

SEQ ID NO: 9028459 - DNA, 22 bp, Homo sapiens
gtgaaacttcacattttgatag

SEQ ID NO: 9028460 - DNA, 22 bp, Homo sapiens
gtgaaacttcacattttgatag

SEQ ID NO: 9028461 - DNA, 22 bp, Homo sapiens
gtgaaactgctttgtaaactgt

SEQ ID NO: 9028462 - DNA, 22 bp, Homo sapiens
gtctggagtggggcctgagaat

SEQ ID NO: 9028463 - DNA, 22 bp, Homo sapiens
gtgaaaagcaacattgtggacc

SEQ ID NO: 9028464 - DNA, 22 bp, Homo sapiens
gtgaaaataaggctggttcttg

SEQ ID NO: 9028465 - DNA, 18 bp, Homo sapiens
gtctggaggtcaggagct

SEQ ID NO: 9028466 - DNA, 22 bp, Homo sapiens
gtgaaagtaagaaagtaggact

SEQ ID NO: 9028467 - DNA, 22 bp, Homo sapiens
gtgaaagtaagaaagtaggact

SEQ ID NO: 9028468 - DNA, 22 bp, Homo sapiens
gtgaaatatttaacgtccaggt

SEQ ID NO: 9028469 - DNA, 22 bp, Homo sapiens
gtgaaatatttaacgtccaggt

SEQ ID NO: 9028470 - DNA, 22 bp, Homo sapiens
gtgaaatatttaacgtccaggt

SEQ ID NO: 9028471 - DNA, 22 bp, Homo sapiens
gtgaaattgtatttggcattga

SEQ ID NO: 9028472 - DNA, 22 bp, Homo sapiens
gtgaaatctgaggcccatgatg

SEQ ID NO: 9028473 - DNA, 22 bp, Homo sapiens
gtgaaatgaatctggaaatatt

SEQ ID NO: 9028474 - DNA, 22 bp, Homo sapiens
gtgaaatattttgtttatgtca

SEQ ID NO: 9028475 - DNA, 22 bp, Homo sapiens
gtgaaatattttgtttatgtca

SEQ ID NO: 9028476 - DNA, 22 bp, Homo sapiens
gtgaaatattttgtttatgtca

SEQ ID NO: 9028477 - DNA, 22 bp, Homo sapiens
gtgaacattttcttgcaaattg

SEQ ID NO: 9028478 - DNA, 22 bp, Homo sapiens
gtgaaccaagaagtcaaagcga

SEQ ID NO: 9028479 - DNA, 22 bp, Homo sapiens
gtgaactaaggattcaaacttc

SEQ ID NO: 9028480 - DNA, 22 bp, Homo sapiens
gtgaactattgggtatcataaa

SEQ ID NO: 9028481 - DNA, 22 bp, Homo sapiens
gtgaacattgaggcagaaagga

SEQ ID NO: 9028482 - DNA, 22 bp, Homo sapiens
gtgaacattgaggcagaaagga

SEQ ID NO: 9028483 - DNA, 22 bp, Homo sapiens
gtgaacattttcttgcaaattg

SEQ ID NO: 9028484 - DNA, 22 bp, Homo sapiens
gtgaacatcagattacatgaga

SEQ ID NO: 9028485 - DNA, 22 bp, Homo sapiens
gtgaacatcagattacatgaga

SEQ ID NO: 9028486 - DNA, 22 bp, Homo sapiens
gtgaacatcagattacatgaga

SEQ ID NO: 9028487 - DNA, 22 bp, Homo sapiens
gtgaacagataatagaaatgaa

SEQ ID NO: 9028488 - DNA, 22 bp, Homo sapiens
gtgaacaaaatagcacatatta

SEQ ID NO: 9028489 - DNA, 19 bp, Homo sapiens
gtgaacaaggagaatggga

SEQ ID NO: 9028490 - DNA, 19 bp, Homo sapiens
gtgaacaaggagaatggga

SEQ ID NO: 9028491 - DNA, 22 bp, Homo sapiens
gtgaacagactgttctctacag

SEQ ID NO: 9028492 - DNA, 22 bp, Homo sapiens
gtgaacaaggagactacaactt

SEQ ID NO: 9028493 - DNA, 22 bp, Homo sapiens
gtctgcctcagccgggggccgc

SEQ ID NO: 9028494 - DNA, 22 bp, Homo sapiens
gtctgcccttggctcagccata

SEQ ID NO: 9028495 - DNA, 22 bp, Homo sapiens
gtctgcccttggctcagccata

SEQ ID NO: 9028496 - DNA, 22 bp, Homo sapiens
gtctgcctctattgcctacctg

SEQ ID NO: 9028497 - DNA, 22 bp, Homo sapiens
gtctgcctctattgcctacctg

SEQ ID NO: 9028498 - DNA, 22 bp, Homo sapiens
gtctgcctctttctttctgggt

SEQ ID NO: 9028499 - DNA, 22 bp, Homo sapiens
gtctgcctgcaatccagagact

SEQ ID NO: 9028500 - DNA, 22 bp, Homo sapiens
gtctgcctgctagtggctgcct

SEQ ID NO: 9028501 - DNA, 22 bp, Homo sapiens
gtctgcctgggacgctgggagt

SEQ ID NO: 9028502 - DNA, 22 bp, Homo sapiens
gtctgcctgtctggatgacaga

SEQ ID NO: 9028503 - DNA, 18 bp, Homo sapiens
gtctgccttctcccttcc

SEQ ID NO: 9028504 - DNA, 22 bp, Homo sapiens
gtctgctcatgctaccgcgggc

SEQ ID NO: 9028505 - DNA, 22 bp, Homo sapiens
gtctgctcatgctaccgcgggc

SEQ ID NO: 9028506 - DNA, 22 bp, Homo sapiens
gtctgctcatgctaccgcgggc

SEQ ID NO: 9028507 - DNA, 22 bp, Homo sapiens
gtctgctcatgctaccgcgggc

SEQ ID NO: 9028508 - DNA, 22 bp, Homo sapiens
gtctgctcatgctaccgcgggc

SEQ ID NO: 9028509 - DNA, 22 bp, Homo sapiens
gtctgctgcagagcatggcttt

SEQ ID NO: 9028510 - DNA, 22 bp, Homo sapiens
gtctgctgacagagcatggacc

SEQ ID NO: 9028511 - DNA, 22 bp, Homo sapiens
gtctgctgacagagcatggacc

SEQ ID NO: 9028512 - DNA, 22 bp, Homo sapiens
gtctgctcatgctaccgcgggc

SEQ ID NO: 9028513 - DNA, 22 bp, Homo sapiens
gtctgctggtgcctggcctgcg

SEQ ID NO: 9028514 - DNA, 22 bp, Homo sapiens
gtctgctggcacgtcacagata

SEQ ID NO: 9028515 - DNA, 22 bp, Homo sapiens
gtctgctggtgcctggcctgcg

SEQ ID NO: 9028516 - DNA, 22 bp, Homo sapiens
gtctgctggcacgtcacagata

SEQ ID NO: 9028517 - DNA, 22 bp, Homo sapiens
gtctgctgcagtcgtggctcta

SEQ ID NO: 9028518 - DNA, 22 bp, Homo sapiens
gtctgctgcttctgttgaagca

SEQ ID NO: 9028519 - DNA, 22 bp, Homo sapiens
gtctgctggcacgtcacagata

SEQ ID NO: 9028520 - DNA, 22 bp, Homo sapiens
gtctgctgtgccttggggaaaa

SEQ ID NO: 9028521 - DNA, 22 bp, Homo sapiens
gtctgctgtgccttggggaaaa

SEQ ID NO: 9028522 - DNA, 22 bp, Homo sapiens
gtctgctgtaggtaggacagca

SEQ ID NO: 9028523 - DNA, 22 bp, Homo sapiens
gtctgctgtaggtaggacagca

SEQ ID NO: 9028524 - DNA, 22 bp, Homo sapiens
gtctgccctgcagacatgcctc

SEQ ID NO: 9028525 - DNA, 22 bp, Homo sapiens
gtctgccctgcagacatgcctc

SEQ ID NO: 9028526 - DNA, 22 bp, Homo sapiens
gtctgccctgctgatctcaccc

SEQ ID NO: 9028527 - DNA, 22 bp, Homo sapiens
gtctgcccttggcctgggactt

SEQ ID NO: 9028528 - DNA, 22 bp, Homo sapiens
gtctgcccttggcctgggactt

SEQ ID NO: 9028529 - DNA, 22 bp, Homo sapiens
gtctgcccggccttcctccacc

SEQ ID NO: 9028530 - DNA, 22 bp, Homo sapiens
gtctgcccggccttcctccacc

SEQ ID NO: 9028531 - DNA, 22 bp, Homo sapiens
gtctgccctcacatgcactctt

SEQ ID NO: 9028532 - DNA, 22 bp, Homo sapiens
gtctgccctcacatgcactctt

SEQ ID NO: 9028533 - DNA, 22 bp, Homo sapiens
gtctgccctcacatgcactctt

SEQ ID NO: 9028534 - DNA, 22 bp, Homo sapiens
gtctgccctgagctcccagtgc

SEQ ID NO: 9028535 - DNA, 22 bp, Homo sapiens
gtctgccctcacgccagctggg

SEQ ID NO: 9028536 - DNA, 22 bp, Homo sapiens
gtctgccccagaccctgaccca

SEQ ID NO: 9028537 - DNA, 22 bp, Homo sapiens
gtctgccccagaccctgaccca

SEQ ID NO: 9028538 - DNA, 22 bp, Homo sapiens
gtctgcccggccttcctccacc

SEQ ID NO: 9028539 - DNA, 22 bp, Homo sapiens
gtcctgggggcagctgtgtcca

SEQ ID NO: 9028540 - DNA, 22 bp, Homo sapiens
gtcctgggggcagctgtgtcca

SEQ ID NO: 9028541 - DNA, 22 bp, Homo sapiens
gtcctgggggcagctgtgtcca

SEQ ID NO: 9028542 - DNA, 22 bp, Homo sapiens
gtcctgggggcagctgtgtcca

SEQ ID NO: 9028543 - DNA, 22 bp, Homo sapiens
gtcctgggggcagctgtgtcca

SEQ ID NO: 9028544 - DNA, 22 bp, Homo sapiens
gtcctggggaatacagaagccg

SEQ ID NO: 9028545 - DNA, 22 bp, Homo sapiens
gtcctggggaatacagaagccg

SEQ ID NO: 9028546 - DNA, 22 bp, Homo sapiens
gtcctggggatacagaagtgaa

SEQ ID NO: 9028547 - DNA, 22 bp, Homo sapiens
gtcctggggattatagagtgtt

SEQ ID NO: 9028548 - DNA, 22 bp, Homo sapiens
gtcctggggattatagagtgtt

SEQ ID NO: 9028549 - DNA, 22 bp, Homo sapiens
gtcctggggattatagagtgtt

SEQ ID NO: 9028550 - DNA, 22 bp, Homo sapiens
gtcctggggattatagagtgtt

SEQ ID NO: 9028551 - DNA, 22 bp, Homo sapiens
gtcctggggattatagagtgtt

SEQ ID NO: 9028552 - DNA, 22 bp, Homo sapiens
gtcctggggatacagaagtgaa

SEQ ID NO: 9028553 - DNA, 22 bp, Homo sapiens
gtcctggggatacagaagtgaa

SEQ ID NO: 9028554 - DNA, 22 bp, Homo sapiens
gtcctggggaatacagaagccg

SEQ ID NO: 9028555 - DNA, 22 bp, Homo sapiens
gtcctggggaatacagaagccg

SEQ ID NO: 9028556 - DNA, 22 bp, Homo sapiens
gtcctgggcggagggctgctgt

SEQ ID NO: 9028557 - DNA, 22 bp, Homo sapiens
gtcctgggcggagggctgctgt

SEQ ID NO: 9028558 - DNA, 22 bp, Homo sapiens
gtcctgggcctgctgaggctga

SEQ ID NO: 9028559 - DNA, 22 bp, Homo sapiens
gtcctgggcctgctgaggctga

SEQ ID NO: 9028560 - DNA, 22 bp, Homo sapiens
gtcctgggcctgctgaggctga

SEQ ID NO: 9028561 - DNA, 22 bp, Homo sapiens
gtcctgggcctgctgaggctga

SEQ ID NO: 9028562 - DNA, 22 bp, Homo sapiens
gtcctgggcctgctgaggctga

SEQ ID NO: 9028563 - DNA, 22 bp, Homo sapiens
gtgcaggtggatttgggctcaa

SEQ ID NO: 9028564 - DNA, 22 bp, Homo sapiens
gtgcagggtcctaattgttaag

SEQ ID NO: 9028565 - DNA, 22 bp, Homo sapiens
gtgcagggtagcgacggcagga

SEQ ID NO: 9028566 - DNA, 22 bp, Homo sapiens
gtgcaggtgttttggctgccag

SEQ ID NO: 9028567 - DNA, 22 bp, Homo sapiens
gtgcaggtgttttggctgccag

SEQ ID NO: 9028568 - DNA, 22 bp, Homo sapiens
gtgcaggtgttttggctgccag

SEQ ID NO: 9028569 - DNA, 22 bp, Homo sapiens
gtgcagtgaccctggagagctg

SEQ ID NO: 9028570 - DNA, 22 bp, Homo sapiens
gtgcagtgaccctggagagctg

SEQ ID NO: 9028571 - DNA, 22 bp, Homo sapiens
gtgcagtgagcagtgcagcacc

SEQ ID NO: 9028572 - DNA, 22 bp, Homo sapiens
gtgcagtggcagatcctagctc

SEQ ID NO: 9028573 - DNA, 22 bp, Homo sapiens
gtgcagtgaaaaaagaatgtcc

SEQ ID NO: 9028574 - DNA, 22 bp, Homo sapiens
gtgcagtgaaaaaagaatgtcc

SEQ ID NO: 9028575 - DNA, 22 bp, Homo sapiens
gtgcagtgaccctggagagctg

SEQ ID NO: 9028576 - DNA, 22 bp, Homo sapiens
gtgcagtgaccctggagagctg

SEQ ID NO: 9028577 - DNA, 22 bp, Homo sapiens
gtgcagtgaccctggagagctg

SEQ ID NO: 9028578 - DNA, 21 bp, Homo sapiens
gtgcagaggaatgtagggggc

SEQ ID NO: 9028579 - DNA, 22 bp, Homo sapiens
gtgcagagcaagggctgagggc

SEQ ID NO: 9028580 - DNA, 22 bp, Homo sapiens
gtgcagagcaagggctgagggc

SEQ ID NO: 9028581 - DNA, 22 bp, Homo sapiens
gtgcagagcaagggctgagggc

SEQ ID NO: 9028582 - DNA, 22 bp, Homo sapiens
gtgcagagcaagggctgagggc

SEQ ID NO: 9028583 - DNA, 21 bp, Homo sapiens
gtgcagaggaatgtagggggc

SEQ ID NO: 9028584 - DNA, 21 bp, Homo sapiens
gtgcagaggaatgtagggggc

SEQ ID NO: 9028585 - DNA, 22 bp, Homo sapiens
gtgcagaggacgtggcggcctc

SEQ ID NO: 9028586 - DNA, 21 bp, Homo sapiens
gtgcagaggaatgtagggggc

SEQ ID NO: 9028587 - DNA, 22 bp, Homo sapiens
gtgcagaggacgtggcggcctc

SEQ ID NO: 9028588 - DNA, 22 bp, Homo sapiens
gtgcagaggacgtggcggcctc

SEQ ID NO: 9028589 - DNA, 22 bp, Homo sapiens
gtgcagaggacgtggcggcctc

SEQ ID NO: 9028590 - DNA, 22 bp, Homo sapiens
gtgcagaggacgtggcggcctc

SEQ ID NO: 9028591 - DNA, 22 bp, Homo sapiens
gtgcagaggacgtggcggcctc

SEQ ID NO: 9028592 - DNA, 20 bp, Homo sapiens
gtgcagaggcagcctgtggg

SEQ ID NO: 9028593 - DNA, 20 bp, Homo sapiens
gtgcagaggcagcctgtggg

SEQ ID NO: 9028594 - DNA, 20 bp, Homo sapiens
gtgcagaggcagcctgtggg

SEQ ID NO: 9028595 - DNA, 22 bp, Homo sapiens
gtgcagaggtcacaaaagtgaa

SEQ ID NO: 9028596 - DNA, 22 bp, Homo sapiens
gtgcagagtgctacattttatt

SEQ ID NO: 9028597 - DNA, 20 bp, Homo sapiens
gtgcagaggcagcctgtggg

SEQ ID NO: 9028598 - DNA, 22 bp, Homo sapiens
gtgcagggtagcgacggcagga

SEQ ID NO: 9028599 - DNA, 22 bp, Homo sapiens
gtgcagatcctgattgcagttc

SEQ ID NO: 9028600 - DNA, 22 bp, Homo sapiens
gtgcagatcctgattgcagttc

SEQ ID NO: 9028601 - DNA, 22 bp, Homo sapiens
gtgcagagtgtctgtggactga

SEQ ID NO: 9028602 - DNA, 22 bp, Homo sapiens
gtgcagagtgtctgtggactga

SEQ ID NO: 9028603 - DNA, 22 bp, Homo sapiens
gtgcagagtgtctgtggactga

SEQ ID NO: 9028604 - DNA, 22 bp, Homo sapiens
gtgcagttgaagcatggggaga

SEQ ID NO: 9028605 - DNA, 22 bp, Homo sapiens
gtgcagttcttgtaacatgctg

SEQ ID NO: 9028606 - DNA, 22 bp, Homo sapiens
gtgcagttgagacaataggctg

SEQ ID NO: 9028607 - DNA, 22 bp, Homo sapiens
gtgcagttgaagcatggggaga

SEQ ID NO: 9028608 - DNA, 22 bp, Homo sapiens
gtgcagttgagacaataggctg

SEQ ID NO: 9028609 - DNA, 22 bp, Homo sapiens
gtgcagttgtggacatgacaac

SEQ ID NO: 9028610 - DNA, 22 bp, Homo sapiens
gtgcagttgatagttttagtga

SEQ ID NO: 9028611 - DNA, 22 bp, Homo sapiens
gtgcagtgtgtaatccaggaac

SEQ ID NO: 9028612 - DNA, 19 bp, Homo sapiens
gtgcagttcagagttcaat

SEQ ID NO: 9028613 - DNA, 22 bp, Homo sapiens
gtgcagtgtgtaatccaggaac

SEQ ID NO: 9028614 - DNA, 22 bp, Homo sapiens
gtgcagttgaagcatggggaga

SEQ ID NO: 9028615 - DNA, 22 bp, Homo sapiens
gtgcagttcccaaggtcacaca

SEQ ID NO: 9028616 - DNA, 22 bp, Homo sapiens
gtgcatatggttacagcaccgc

SEQ ID NO: 9028617 - DNA, 22 bp, Homo sapiens
gtgcatatatgtgcagcatcaa

SEQ ID NO: 9028618 - DNA, 22 bp, Homo sapiens
gtgcatatatgcacatatgtgt

SEQ ID NO: 9028619 - DNA, 22 bp, Homo sapiens
gtgcatatatatgggagggagc

SEQ ID NO: 9028620 - DNA, 22 bp, Homo sapiens
gtgcatatatgcacatatgtgt

SEQ ID NO: 9028621 - DNA, 22 bp, Homo sapiens
gtgcataatttggcaatagaat

SEQ ID NO: 9028622 - DNA, 22 bp, Homo sapiens
gtgcataaatagcagagctgtg

SEQ ID NO: 9028623 - DNA, 22 bp, Homo sapiens
gtgcattctctgattttcacaa

SEQ ID NO: 9028624 - DNA, 22 bp, Homo sapiens
gtgcatttatatttgcctttgg

SEQ ID NO: 9028625 - DNA, 22 bp, Homo sapiens
gtgcattccaccgtgcaggttg

SEQ ID NO: 9028626 - DNA, 22 bp, Homo sapiens
gtgcattctatcaaatggtaca

SEQ ID NO: 9028627 - DNA, 22 bp, Homo sapiens
gtgcattccaaggcactttaga

SEQ ID NO: 9028628 - DNA, 19 bp, Homo sapiens
gtgcattccaaagcaccat

SEQ ID NO: 9028629 - DNA, 19 bp, Homo sapiens
gtgcattccaaagcaccat

SEQ ID NO: 9028630 - DNA, 22 bp, Homo sapiens
gtgcatatgtacctgtgatcat

SEQ ID NO: 9028631 - DNA, 22 bp, Homo sapiens
gtgcatttggtgactctcaccc

SEQ ID NO: 9028632 - DNA, 20 bp, Homo sapiens
gtgcatttcacctgtactgt

SEQ ID NO: 9028633 - DNA, 22 bp, Homo sapiens
gtgcatttctcatacactaaat

SEQ ID NO: 9028634 - DNA, 22 bp, Homo sapiens
gtgcatttgacgaatactcact

SEQ ID NO: 9028635 - DNA, 22 bp, Homo sapiens
gtgccacatggtccatgtatca

SEQ ID NO: 9028636 - DNA, 22 bp, Homo sapiens
gtgccacatggcctaatagaga

SEQ ID NO: 9028637 - DNA, 22 bp, Homo sapiens
gtgccaaggtgctaagggcatg

SEQ ID NO: 9028638 - DNA, 22 bp, Homo sapiens
gtgccaaagaacataaggctga

SEQ ID NO: 9028639 - DNA, 19 bp, Homo sapiens
gtgccaaatgtgttataca

SEQ ID NO: 9028640 - DNA, 22 bp, Homo sapiens
gtgccacctctgccccagaggg

SEQ ID NO: 9028641 - DNA, 22 bp, Homo sapiens
gtgctaggattacaggcatggg

SEQ ID NO: 9028642 - DNA, 22 bp, Homo sapiens
gtgctatgattggacagaatag

SEQ ID NO: 9028643 - DNA, 22 bp, Homo sapiens
gtgctagggacaaagcagtgaa

SEQ ID NO: 9028644 - DNA, 22 bp, Homo sapiens
gtgagcaggataggggctccct

SEQ ID NO: 9028645 - DNA, 22 bp, Homo sapiens
gtgagcagctcagggtggtctc

SEQ ID NO: 9028646 - DNA, 22 bp, Homo sapiens
gtgagcaggataggggctccct

SEQ ID NO: 9028647 - DNA, 22 bp, Homo sapiens
gtgagcagctcagggtggtctc

SEQ ID NO: 9028648 - DNA, 22 bp, Homo sapiens
gtgagcaggataggggctccct

SEQ ID NO: 9028649 - DNA, 22 bp, Homo sapiens
gtgagcagctcagggtggtctc

SEQ ID NO: 9028650 - DNA, 22 bp, Homo sapiens
gtgagcagctcagggtggtctc

SEQ ID NO: 9028651 - DNA, 22 bp, Homo sapiens
gtgagcagcctcacctgagggt

SEQ ID NO: 9028652 - DNA, 22 bp, Homo sapiens
gtgagcagcctcacctgagggt

SEQ ID NO: 9028653 - DNA, 22 bp, Homo sapiens
gtgagcagcctcacctgagggt

SEQ ID NO: 9028654 - DNA, 23 bp, Homo sapiens
gtgagcagcccactaggaatgcc

SEQ ID NO: 9028655 - DNA, 23 bp, Homo sapiens
gtgagcagcccactaggaatgcc

SEQ ID NO: 9028656 - DNA, 23 bp, Homo sapiens
gtgagcagcccactaggaatgcc

SEQ ID NO: 9028657 - DNA, 22 bp, Homo sapiens
gtgagcagcctcacctgagggt

SEQ ID NO: 9028658 - DNA, 22 bp, Homo sapiens
gtgagcagcctcacctgagggt

SEQ ID NO: 9028659 - DNA, 23 bp, Homo sapiens
gtgagcagcccactaggaatgcc

SEQ ID NO: 9028660 - DNA, 23 bp, Homo sapiens
gtgagcagcccactaggaatgcc

SEQ ID NO: 9028661 - DNA, 22 bp, Homo sapiens
gtgagagaaattggagggaatg

SEQ ID NO: 9028662 - DNA, 22 bp, Homo sapiens
gtgagagaaattggagggaatg

SEQ ID NO: 9028663 - DNA, 22 bp, Homo sapiens
gtgagacacccaagagtcagat

SEQ ID NO: 9028664 - DNA, 19 bp, Homo sapiens
gtgagaccctgcatagggc

SEQ ID NO: 9028665 - DNA, 22 bp, Homo sapiens
gtgagacatcttgggaagtgat

SEQ ID NO: 9028666 - DNA, 22 bp, Homo sapiens
gtgagactcgcctttgtgtagc

SEQ ID NO: 9028667 - DNA, 19 bp, Homo sapiens
gtgagaccctgcatagggc

SEQ ID NO: 9028668 - DNA, 22 bp, Homo sapiens
gtgagactcgcctttgtgtagc

SEQ ID NO: 9028669 - DNA, 22 bp, Homo sapiens
gtgagacctccttgggctgact

SEQ ID NO: 9028670 - DNA, 22 bp, Homo sapiens
gtgagactcgcctttgtgtagc

SEQ ID NO: 9028671 - DNA, 22 bp, Homo sapiens
gtgactcacacaggcctgggct

SEQ ID NO: 9028672 - DNA, 22 bp, Homo sapiens
gtgactctcactttacctgact

SEQ ID NO: 9028673 - DNA, 22 bp, Homo sapiens
gtgacgtgaggggctcctgttg

SEQ ID NO: 9028674 - DNA, 22 bp, Homo sapiens
gtgactgttgtttgctacgtgc

SEQ ID NO: 9028675 - DNA, 22 bp, Homo sapiens
gtgagaaatgacaaatgtgtcg

SEQ ID NO: 9028676 - DNA, 22 bp, Homo sapiens
gtgagaagataagtattgcaaa

SEQ ID NO: 9028677 - DNA, 22 bp, Homo sapiens
gtgagaataccagcagtgagaa

SEQ ID NO: 9028678 - DNA, 22 bp, Homo sapiens
gtgagacaagatttgtaggcag

SEQ ID NO: 9028679 - DNA, 22 bp, Homo sapiens
gtgagcaggatttcatggtgta

SEQ ID NO: 9028680 - DNA, 22 bp, Homo sapiens
gtgagcaggatttcatggtgta

SEQ ID NO: 9028681 - DNA, 22 bp, Homo sapiens
gtgagcaggatttcatggtgta

SEQ ID NO: 9028682 - DNA, 22 bp, Homo sapiens
gtgagcaggatttcatggtgta

SEQ ID NO: 9028683 - DNA, 22 bp, Homo sapiens
gtgagcaggatttcatggtgta

SEQ ID NO: 9028684 - DNA, 22 bp, Homo sapiens
gtgcacatcgtgcaggtttgtt

SEQ ID NO: 9028685 - DNA, 22 bp, Homo sapiens
gtgcacatcgtgcaggtttgtt

SEQ ID NO: 9028686 - DNA, 22 bp, Homo sapiens
gtgcacatatttgtgcatgcat

SEQ ID NO: 9028687 - DNA, 22 bp, Homo sapiens
gtgcacatcgtgcaggtttgtt

SEQ ID NO: 9028688 - DNA, 21 bp, Homo sapiens
gtgcacagtcctgcacacagg

SEQ ID NO: 9028689 - DNA, 22 bp, Homo sapiens
gtgcagagaggtggagggactt

SEQ ID NO: 9028690 - DNA, 22 bp, Homo sapiens
gtgcagagaggtggagggactt

SEQ ID NO: 9028691 - DNA, 22 bp, Homo sapiens
gtgcagagaggtggagggactt

SEQ ID NO: 9028692 - DNA, 22 bp, Homo sapiens
gtgcagagaggaccttggggag

SEQ ID NO: 9028693 - DNA, 22 bp, Homo sapiens
gtgcagagaaggagcagtagtt

SEQ ID NO: 9028694 - DNA, 22 bp, Homo sapiens
gtgcagagaaatgagaagtcga

SEQ ID NO: 9028695 - DNA, 22 bp, Homo sapiens
gtgcagacttacagattatccc

SEQ ID NO: 9028696 - DNA, 22 bp, Homo sapiens
gtgcagagaaggagcagtagtt

SEQ ID NO: 9028697 - DNA, 22 bp, Homo sapiens
gtgcagagaaggagcagtagtt

SEQ ID NO: 9028698 - DNA, 22 bp, Homo sapiens
gtgcagagaaggagcagtagtt

SEQ ID NO: 9028699 - DNA, 22 bp, Homo sapiens
gtgcacccccaaggaggtggag

SEQ ID NO: 9028700 - DNA, 19 bp, Homo sapiens
gtgcactgtcactttgctc

SEQ ID NO: 9028701 - DNA, 22 bp, Homo sapiens
gtgcagaatcagtacagaacga

SEQ ID NO: 9028702 - DNA, 22 bp, Homo sapiens
gtgcagaccttagttcaagcca

SEQ ID NO: 9028703 - DNA, 22 bp, Homo sapiens
gtgcagaccttccagaaagaac

SEQ ID NO: 9028704 - DNA, 22 bp, Homo sapiens
gtgcagaagtaacaattaaaga

SEQ ID NO: 9028705 - DNA, 22 bp, Homo sapiens
gtgcagaagtaacaattaaaga

SEQ ID NO: 9028706 - DNA, 22 bp, Homo sapiens
gggctgagccacagcttttgtt

SEQ ID NO: 9028707 - DNA, 22 bp, Homo sapiens
gggctgagccacagcttttgtt

SEQ ID NO: 9028708 - DNA, 22 bp, Homo sapiens
gggctgagcacatactgacagc

SEQ ID NO: 9028709 - DNA, 22 bp, Homo sapiens
gggctgagcacatactgacagc

SEQ ID NO: 9028710 - DNA, 22 bp, Homo sapiens
gggctgagcacatactgacagc

SEQ ID NO: 9028711 - DNA, 22 bp, Homo sapiens
gggctgagcacatactgacagc

SEQ ID NO: 9028712 - DNA, 22 bp, Homo sapiens
gggctgagccacagcttttgtt

SEQ ID NO: 9028713 - DNA, 22 bp, Homo sapiens
gggctgagccacagcttttgtt

SEQ ID NO: 9028714 - DNA, 22 bp, Homo sapiens
gggctgagccatttgaaccttg

SEQ ID NO: 9028715 - DNA, 22 bp, Homo sapiens
gggctgagccatttgaaccttg

SEQ ID NO: 9028716 - DNA, 22 bp, Homo sapiens
gggctgagccatttgaaccttg

SEQ ID NO: 9028717 - DNA, 22 bp, Homo sapiens
gggctgagccatttgaaccttg

SEQ ID NO: 9028718 - DNA, 22 bp, Homo sapiens
gggctgagctaagctgggttga

SEQ ID NO: 9028719 - DNA, 22 bp, Homo sapiens
gggctgagctgttctgagttta

SEQ ID NO: 9028720 - DNA, 22 bp, Homo sapiens
gggctgagctgttctgagttta

SEQ ID NO: 9028721 - DNA, 22 bp, Homo sapiens
gggctgagctaagctgggttga

SEQ ID NO: 9028722 - DNA, 22 bp, Homo sapiens
gggctgagctaagctgggttga

SEQ ID NO: 9028723 - DNA, 22 bp, Homo sapiens
gggctgagctgttctgagttta

SEQ ID NO: 9028724 - DNA, 22 bp, Homo sapiens
gggctgaggaacatattttgtt

SEQ ID NO: 9028725 - DNA, 22 bp, Homo sapiens
gggctgaggctaccactggtct

SEQ ID NO: 9028726 - DNA, 22 bp, Homo sapiens
gggctgaggctaccactggtct

SEQ ID NO: 9028727 - DNA, 22 bp, Homo sapiens
gggctgagctgttctgagttta

SEQ ID NO: 9028728 - DNA, 22 bp, Homo sapiens
gggctgagctgttctgagttta

SEQ ID NO: 9028729 - DNA, 22 bp, Homo sapiens
gggctgaggaacatattttgtt

SEQ ID NO: 9028730 - DNA, 22 bp, Homo sapiens
gggctgagattggtgccctgtc

SEQ ID NO: 9028731 - DNA, 22 bp, Homo sapiens
gggctgagattggtgccctgtc

SEQ ID NO: 9028732 - DNA, 22 bp, Homo sapiens
gggctgagattggtgccctgtc

SEQ ID NO: 9028733 - DNA, 22 bp, Homo sapiens
gggctgagattggtgccctgtc

SEQ ID NO: 9028734 - DNA, 22 bp, Homo sapiens
gggctgagagctggaatctgag

SEQ ID NO: 9028735 - DNA, 22 bp, Homo sapiens
gggctgagagtgactgttctgt

SEQ ID NO: 9028736 - DNA, 22 bp, Homo sapiens
gggctgagcacatactgacagc

SEQ ID NO: 9028737 - DNA, 22 bp, Homo sapiens
gggctgagcacatactgacagc

SEQ ID NO: 9028738 - DNA, 22 bp, Homo sapiens
gggctgagattggtgccctgtc

SEQ ID NO: 9028739 - DNA, 22 bp, Homo sapiens
gggctgagattggtgccctgtc

SEQ ID NO: 9028740 - DNA, 22 bp, Homo sapiens
gggctgagattggtgccctgtc

SEQ ID NO: 9028741 - DNA, 22 bp, Homo sapiens
gggctgagagctggaatctgag

SEQ ID NO: 9028742 - DNA, 22 bp, Homo sapiens
gggctgagagctggaatctgag

SEQ ID NO: 9028743 - DNA, 22 bp, Homo sapiens
gggctgagagctggaatctgag

SEQ ID NO: 9028744 - DNA, 22 bp, Homo sapiens
gggctgagagctggaatctgag

SEQ ID NO: 9028745 - DNA, 22 bp, Homo sapiens
gggctgagagctggaatctgag

SEQ ID NO: 9028746 - DNA, 22 bp, Homo sapiens
gggctgagagtgactgttctgt

SEQ ID NO: 9028747 - DNA, 22 bp, Homo sapiens
gggctgagagctggaatctgag

SEQ ID NO: 9028748 - DNA, 22 bp, Homo sapiens
gggctgagagctggaatctgag

SEQ ID NO: 9028749 - DNA, 22 bp, Homo sapiens
gggctgagagctggaatctgag

SEQ ID NO: 9028750 - DNA, 21 bp, Homo sapiens
gggccacaccttctgcagacc

SEQ ID NO: 9028751 - DNA, 21 bp, Homo sapiens
gggccacaccttctgcagacc

SEQ ID NO: 9028752 - DNA, 21 bp, Homo sapiens
gggccacaccttctgcagacc

SEQ ID NO: 9028753 - DNA, 22 bp, Homo sapiens
gggctgagagctggaatctgag

SEQ ID NO: 9028754 - DNA, 22 bp, Homo sapiens
gggcatggccaggtgaggggtc

SEQ ID NO: 9028755 - DNA, 22 bp, Homo sapiens
gggcatggccaggtgaggggtc

SEQ ID NO: 9028756 - DNA, 22 bp, Homo sapiens
gggcatggccaggtgaggggtc

SEQ ID NO: 9028757 - DNA, 22 bp, Homo sapiens
gggcatggccaggtgaggggtc

SEQ ID NO: 9028758 - DNA, 18 bp, Homo sapiens
gggcatggatgcagcatc

SEQ ID NO: 9028759 - DNA, 18 bp, Homo sapiens
gggcatggatgcagcatc

SEQ ID NO: 9028760 - DNA, 22 bp, Homo sapiens
gggcatggccaggtgaggggtc

SEQ ID NO: 9028761 - DNA, 22 bp, Homo sapiens
gggcatggcgtgtgctggattc

SEQ ID NO: 9028762 - DNA, 22 bp, Homo sapiens
gggcatggccaggtgaggggtc

SEQ ID NO: 9028763 - DNA, 22 bp, Homo sapiens
gggcatggccaggtgaggggtc

SEQ ID NO: 9028764 - DNA, 22 bp, Homo sapiens
gggcatggccaggtgaggggtc

SEQ ID NO: 9028765 - DNA, 22 bp, Homo sapiens
gggcatggtgagggatatgaag

SEQ ID NO: 9028766 - DNA, 22 bp, Homo sapiens
gggcatggccaggtgaggggtc

SEQ ID NO: 9028767 - DNA, 22 bp, Homo sapiens
gggcatggcgtgtgctggattc

SEQ ID NO: 9028768 - DNA, 22 bp, Homo sapiens
gggcatggggcggacctggttc

SEQ ID NO: 9028769 - DNA, 22 bp, Homo sapiens
gggcatggcgtgtgctggattc

SEQ ID NO: 9028770 - DNA, 22 bp, Homo sapiens
gggcatggggcggacctggttc

SEQ ID NO: 9028771 - DNA, 22 bp, Homo sapiens
gggcatggggcggacctggttc

SEQ ID NO: 9028772 - DNA, 22 bp, Homo sapiens
gggcatggcgtgtgctggattc

SEQ ID NO: 9028773 - DNA, 22 bp, Homo sapiens
gggcatggggcggacctggttc

SEQ ID NO: 9028774 - DNA, 22 bp, Homo sapiens
gggcatggtggcaggcacctgt

SEQ ID NO: 9028775 - DNA, 22 bp, Homo sapiens
gggcatggtgctggtgttcatg

SEQ ID NO: 9028776 - DNA, 22 bp, Homo sapiens
gggcatggtgctggtgttcatg

SEQ ID NO: 9028777 - DNA, 22 bp, Homo sapiens
gggcatggtgatgtgcacctgt

SEQ ID NO: 9028778 - DNA, 22 bp, Homo sapiens
gggcatggtgatgtgcacctgt

SEQ ID NO: 9028779 - DNA, 22 bp, Homo sapiens
gggcatggtggcaggcacctgt

SEQ ID NO: 9028780 - DNA, 22 bp, Homo sapiens
gggcatgtagtgtgcatagaga

SEQ ID NO: 9028781 - DNA, 22 bp, Homo sapiens
gggcatggtggtgcacacctgt

SEQ ID NO: 9028782 - DNA, 22 bp, Homo sapiens
gggcatgtaggaatccatggag

SEQ ID NO: 9028783 - DNA, 22 bp, Homo sapiens
gggcattcctaagcgagaagag

SEQ ID NO: 9028784 - DNA, 22 bp, Homo sapiens
gggccaaggggagctggaaggg

SEQ ID NO: 9028785 - DNA, 22 bp, Homo sapiens
gggccaaggggagctggaaggg

SEQ ID NO: 9028786 - DNA, 22 bp, Homo sapiens
gggcatttaaacaagcatacaa

SEQ ID NO: 9028787 - DNA, 22 bp, Homo sapiens
gggccaagggtgcgtggcagga

SEQ ID NO: 9028788 - DNA, 22 bp, Homo sapiens
gggccaagggtgcgtggcagga

SEQ ID NO: 9028789 - DNA, 22 bp, Homo sapiens
gggccaagggtgcgtggcagga

SEQ ID NO: 9028790 - DNA, 22 bp, Homo sapiens
gggccaagggtgcgtggcagga

SEQ ID NO: 9028791 - DNA, 22 bp, Homo sapiens
gggccaaggggagctggaaggg

SEQ ID NO: 9028792 - DNA, 22 bp, Homo sapiens
gggccaaggggagctggaaggg

SEQ ID NO: 9028793 - DNA, 22 bp, Homo sapiens
gggccaagggtgcgtggcagga

SEQ ID NO: 9028794 - DNA, 22 bp, Homo sapiens
gggccaaggggagctggaaggg

SEQ ID NO: 9028795 - DNA, 22 bp, Homo sapiens
gggccacacagaacctcctggt

SEQ ID NO: 9028796 - DNA, 22 bp, Homo sapiens
gggccacacagaacctcctggt

SEQ ID NO: 9028797 - DNA, 22 bp, Homo sapiens
gggccacacagaacctcctggt

SEQ ID NO: 9028798 - DNA, 22 bp, Homo sapiens
gggccacacagggcagctccct

SEQ ID NO: 9028799 - DNA, 22 bp, Homo sapiens
gggccacacagggcagctccct

SEQ ID NO: 9028800 - DNA, 22 bp, Homo sapiens
gggccacacagggcagctccct

SEQ ID NO: 9028801 - DNA, 22 bp, Homo sapiens
gggctgcacgtattctgctcac

SEQ ID NO: 9028802 - DNA, 22 bp, Homo sapiens
gggctgcacagatcttcaaggg

SEQ ID NO: 9028803 - DNA, 22 bp, Homo sapiens
gggctgcaatgcttcagttgtt

SEQ ID NO: 9028804 - DNA, 22 bp, Homo sapiens
gggctgcaatgcttcagttgtt

SEQ ID NO: 9028805 - DNA, 22 bp, Homo sapiens
gggctgattcgatgggggtaga

SEQ ID NO: 9028806 - DNA, 22 bp, Homo sapiens
gggctgcatcagcaggacccgg

SEQ ID NO: 9028807 - DNA, 22 bp, Homo sapiens
gggctgcatcagcaggacccgg

SEQ ID NO: 9028808 - DNA, 22 bp, Homo sapiens
gggctgccaagcctgcctgcct

SEQ ID NO: 9028809 - DNA, 22 bp, Homo sapiens
gggctgccaagcctgcctgcct

SEQ ID NO: 9028810 - DNA, 22 bp, Homo sapiens
gggctgccaagcctgcctgcct

SEQ ID NO: 9028811 - DNA, 22 bp, Homo sapiens
gggctgccaagcctgcctgcct

SEQ ID NO: 9028812 - DNA, 22 bp, Homo sapiens
gggctgcctgagcatctcctcc

SEQ ID NO: 9028813 - DNA, 22 bp, Homo sapiens
gggctgcctttcttctgggagc

SEQ ID NO: 9028814 - DNA, 22 bp, Homo sapiens
gggctgcctttcttctgggagc

SEQ ID NO: 9028815 - DNA, 22 bp, Homo sapiens
gggctgcctttcttctgggagc

SEQ ID NO: 9028816 - DNA, 22 bp, Homo sapiens
gggctgcgtgtggaggatgtaa

SEQ ID NO: 9028817 - DNA, 22 bp, Homo sapiens
gggctgctacgagaactgaata

SEQ ID NO: 9028818 - DNA, 22 bp, Homo sapiens
gggctgccttttaattcttccc

SEQ ID NO: 9028819 - DNA, 22 bp, Homo sapiens
gggctgctataacaagatacct

SEQ ID NO: 9028820 - DNA, 23 bp, Homo sapiens
gggctgctccaggccaaggctgg

SEQ ID NO: 9028821 - DNA, 22 bp, Homo sapiens
gggctgctgccaatcacagcct

SEQ ID NO: 9028822 - DNA, 23 bp, Homo sapiens
gggctgctccaggccaaggctgg

SEQ ID NO: 9028823 - DNA, 22 bp, Homo sapiens
gggctgagtgggcctcttactt

SEQ ID NO: 9028824 - DNA, 22 bp, Homo sapiens
gggctgagtgtcccaggccgaa

SEQ ID NO: 9028825 - DNA, 22 bp, Homo sapiens
gggctgagtgtcccaggccgaa

SEQ ID NO: 9028826 - DNA, 22 bp, Homo sapiens
gggctgagtgtcccaggccgaa

SEQ ID NO: 9028827 - DNA, 22 bp, Homo sapiens
gggctgaggctaccactggtct

SEQ ID NO: 9028828 - DNA, 22 bp, Homo sapiens
gggctgagggccaattcctact

SEQ ID NO: 9028829 - DNA, 22 bp, Homo sapiens
gggctgaggctaccactggtct

SEQ ID NO: 9028830 - DNA, 22 bp, Homo sapiens
gggctgagggccaattcctact

SEQ ID NO: 9028831 - DNA, 22 bp, Homo sapiens
gggctgagttcctgcctcactc

SEQ ID NO: 9028832 - DNA, 22 bp, Homo sapiens
gggctgagttcctgcctcactc

SEQ ID NO: 9028833 - DNA, 22 bp, Homo sapiens
gggctgagttcctgcctcactc

SEQ ID NO: 9028834 - DNA, 22 bp, Homo sapiens
gggctgagtgtcccaggccgaa

SEQ ID NO: 9028835 - DNA, 22 bp, Homo sapiens
gggctgagtgtcccaggccgaa

SEQ ID NO: 9028836 - DNA, 22 bp, Homo sapiens
gggctgagtgtcccaggccgaa

SEQ ID NO: 9028837 - DNA, 22 bp, Homo sapiens
gggctgagtgtcccaggccgaa

SEQ ID NO: 9028838 - DNA, 22 bp, Homo sapiens
gggctgagtgtcccaggccgaa

SEQ ID NO: 9028839 - DNA, 22 bp, Homo sapiens
gggctgagttcctgcctcactc

SEQ ID NO: 9028840 - DNA, 22 bp, Homo sapiens
gggctgagttcctgcctcactc

SEQ ID NO: 9028841 - DNA, 22 bp, Homo sapiens
gggctgctgcccaggaggcacc

SEQ ID NO: 9028842 - DNA, 22 bp, Homo sapiens
gggctgctgcccaggaggcacc

SEQ ID NO: 9028843 - DNA, 22 bp, Homo sapiens
gggctgctgcccaggaggcacc

SEQ ID NO: 9028844 - DNA, 22 bp, Homo sapiens
gggctgctgccaccaggtggat

SEQ ID NO: 9028845 - DNA, 22 bp, Homo sapiens
gggctgctgccaccaggtggat

SEQ ID NO: 9028846 - DNA, 22 bp, Homo sapiens
gggctgctgccaatcacagcct

SEQ ID NO: 9028847 - DNA, 22 bp, Homo sapiens
gggctgctgtagagaacatgtt

SEQ ID NO: 9028848 - DNA, 22 bp, Homo sapiens
gggctgctgggcaagaaacatt

SEQ ID NO: 9028849 - DNA, 22 bp, Homo sapiens
gggctgctgtagagaacatgtt

SEQ ID NO: 9028850 - DNA, 22 bp, Homo sapiens
gggctgctgtagagaacatgtt

SEQ ID NO: 9028851 - DNA, 22 bp, Homo sapiens
gggctgctgctgccagcgacac

SEQ ID NO: 9028852 - DNA, 22 bp, Homo sapiens
gggctgctgcccaggaggcacc

SEQ ID NO: 9028853 - DNA, 22 bp, Homo sapiens
gggctgctgctgccagcgacac

SEQ ID NO: 9028854 - DNA, 22 bp, Homo sapiens
gggcttcttgccatggggacgg

SEQ ID NO: 9028855 - DNA, 22 bp, Homo sapiens
gggcttcttgccatggggacgg

SEQ ID NO: 9028856 - DNA, 17 bp, Homo sapiens
gggcttgctgagtgtgt

SEQ ID NO: 9028857 - DNA, 22 bp, Homo sapiens
gggcttgctaagaagagcgcat

SEQ ID NO: 9028858 - DNA, 22 bp, Homo sapiens
gggcttgaggtgaaggtaggga

SEQ ID NO: 9028859 - DNA, 22 bp, Homo sapiens
gggctgctgtagagaacatgtt

SEQ ID NO: 9028860 - DNA, 22 bp, Homo sapiens
gggctgctgtgttcctgaggca

SEQ ID NO: 9028861 - DNA, 22 bp, Homo sapiens
gggcttcttgagctgccggccc

SEQ ID NO: 9028862 - DNA, 22 bp, Homo sapiens
gggctgctgtgttcctgaggca

SEQ ID NO: 9028863 - DNA, 22 bp, Homo sapiens
gggctgctgtgttcctgaggca

SEQ ID NO: 9028864 - DNA, 22 bp, Homo sapiens
gggcttcttgcaggggcaacat

SEQ ID NO: 9028865 - DNA, 22 bp, Homo sapiens
gggcttcttgcaggggcaacat

SEQ ID NO: 9028866 - DNA, 22 bp, Homo sapiens
gggcttcttgagctgccggccc

SEQ ID NO: 9028867 - DNA, 22 bp, Homo sapiens
gggcttcttgagctgccggccc

SEQ ID NO: 9028868 - DNA, 19 bp, Homo sapiens
gggcttggggctgaagcct

SEQ ID NO: 9028869 - DNA, 22 bp, Homo sapiens
gggcttggcacatgggctcagc

SEQ ID NO: 9028870 - DNA, 19 bp, Homo sapiens
gggcttggggctgaagcct

SEQ ID NO: 9028871 - DNA, 19 bp, Homo sapiens
gggcttggggctgaagcct

SEQ ID NO: 9028872 - DNA, 19 bp, Homo sapiens
gggcttggggctgaagcct

SEQ ID NO: 9028873 - DNA, 22 bp, Homo sapiens
gggcttgggtattgtgagaggt

SEQ ID NO: 9028874 - DNA, 22 bp, Homo sapiens
gggcttgggtattgtgagaggt

SEQ ID NO: 9028875 - DNA, 22 bp, Homo sapiens
gggcttgggtattgtgagaggt

SEQ ID NO: 9028876 - DNA, 22 bp, Homo sapiens
gggcttggctcataagtggatg

SEQ ID NO: 9028877 - DNA, 22 bp, Homo sapiens
gggcttggctcataagtggatg

SEQ ID NO: 9028878 - DNA, 22 bp, Homo sapiens
gggcttggccccagaagagcta

SEQ ID NO: 9028879 - DNA, 22 bp, Homo sapiens
gggcttggccccagaagagcta

SEQ ID NO: 9028880 - DNA, 22 bp, Homo sapiens
gggcttggagtaggctgatgaa

SEQ ID NO: 9028881 - DNA, 22 bp, Homo sapiens
gggcttggagtaggctgatgaa

SEQ ID NO: 9028882 - DNA, 20 bp, Homo sapiens
gggcttggaggactcgaggg

SEQ ID NO: 9028883 - DNA, 20 bp, Homo sapiens
gggcttggaggactcgaggg

SEQ ID NO: 9028884 - DNA, 22 bp, Homo sapiens
gggcttgctgtttagttccatt

SEQ ID NO: 9028885 - DNA, 22 bp, Homo sapiens
gggcttgcttaaggtcacccgg

SEQ ID NO: 9028886 - DNA, 20 bp, Homo sapiens
gggcttggaggactcgaggg

SEQ ID NO: 9028887 - DNA, 22 bp, Homo sapiens
gggcttggagtaggctgatgaa

SEQ ID NO: 9028888 - DNA, 22 bp, Homo sapiens
gggcttggcacatgggctcagc

SEQ ID NO: 9028889 - DNA, 22 bp, Homo sapiens
gggcttggagtaggctgatgaa

SEQ ID NO: 9028890 - DNA, 22 bp, Homo sapiens
gggcttggagtaggctgatgaa

SEQ ID NO: 9028891 - DNA, 22 bp, Homo sapiens
gggcttggcacatgggctcagc

SEQ ID NO: 9028892 - DNA, 22 bp, Homo sapiens
gggcttggcacatgggctcagc

SEQ ID NO: 9028893 - DNA, 22 bp, Homo sapiens
ggggctctgctctgagccgtgt

SEQ ID NO: 9028894 - DNA, 22 bp, Homo sapiens
ggggctgacgggcatgtggctt

SEQ ID NO: 9028895 - DNA, 22 bp, Homo sapiens
ggggctgacgggcatgtggctt

SEQ ID NO: 9028896 - DNA, 22 bp, Homo sapiens
ggggctgacgggcatgtggctt

SEQ ID NO: 9028897 - DNA, 22 bp, Homo sapiens
ggggctgaacctggaggtggtc

SEQ ID NO: 9028898 - DNA, 22 bp, Homo sapiens
ggggctgaacctggaggtggtc

SEQ ID NO: 9028899 - DNA, 22 bp, Homo sapiens
ggggctccagtcttcacatttt

SEQ ID NO: 9028900 - DNA, 22 bp, Homo sapiens
ggggctcagttcggacagcctg

SEQ ID NO: 9028901 - DNA, 22 bp, Homo sapiens
ggggctcagttcggacagcctg

SEQ ID NO: 9028902 - DNA, 22 bp, Homo sapiens
ggggctcaggggaagtgtccag

SEQ ID NO: 9028903 - DNA, 22 bp, Homo sapiens
ggggctcagttcggacagcctg

SEQ ID NO: 9028904 - DNA, 22 bp, Homo sapiens
ggggctcagttcggacagcctg

SEQ ID NO: 9028905 - DNA, 20 bp, Homo sapiens
ggggctgcatgcagagaaga

SEQ ID NO: 9028906 - DNA, 20 bp, Homo sapiens
ggggctgcatgcagagaaga

SEQ ID NO: 9028907 - DNA, 22 bp, Homo sapiens
ggggctgctcccacccctgagg

SEQ ID NO: 9028908 - DNA, 22 bp, Homo sapiens
ggggctgctcccacccctgagg

SEQ ID NO: 9028909 - DNA, 22 bp, Homo sapiens
ggggctgatggaactcaggcct

SEQ ID NO: 9028910 - DNA, 22 bp, Homo sapiens
ggggctgatggaactcaggcct

SEQ ID NO: 9028911 - DNA, 22 bp, Homo sapiens
ggggctgatggaactcaggcct

SEQ ID NO: 9028912 - DNA, 22 bp, Homo sapiens
ggggctgagtcagtgggaagag

SEQ ID NO: 9028913 - DNA, 22 bp, Homo sapiens
ggggctgagtcagtgggaagag

SEQ ID NO: 9028914 - DNA, 22 bp, Homo sapiens
ggggctgctggtatttccagtt

SEQ ID NO: 9028915 - DNA, 22 bp, Homo sapiens
ggggctgctcgccgcgcgtttc

SEQ ID NO: 9028916 - DNA, 22 bp, Homo sapiens
ggggctggctcactaagagact

SEQ ID NO: 9028917 - DNA, 22 bp, Homo sapiens
ggggctggctcactaagagact

SEQ ID NO: 9028918 - DNA, 22 bp, Homo sapiens
ggggctggctcactaagagact

SEQ ID NO: 9028919 - DNA, 22 bp, Homo sapiens
ggggctgggatttgaacccagg

SEQ ID NO: 9028920 - DNA, 22 bp, Homo sapiens
ggggctgggatttgaacccagg

SEQ ID NO: 9028921 - DNA, 22 bp, Homo sapiens
ggggctggctcactaagagact

SEQ ID NO: 9028922 - DNA, 22 bp, Homo sapiens
ggggctggctcactaagagact

SEQ ID NO: 9028923 - DNA, 22 bp, Homo sapiens
ggggctggctcactaagagact

SEQ ID NO: 9028924 - DNA, 22 bp, Homo sapiens
ggggctggctcactaagagact

SEQ ID NO: 9028925 - DNA, 22 bp, Homo sapiens
ggggctggctcactaagagact

SEQ ID NO: 9028926 - DNA, 22 bp, Homo sapiens
ggggctggctcactaagagact

SEQ ID NO: 9028927 - DNA, 22 bp, Homo sapiens
ggggctaactttctgagggtag

SEQ ID NO: 9028928 - DNA, 22 bp, Homo sapiens
ggggctcacacctccctaaggg

SEQ ID NO: 9028929 - DNA, 21 bp, Homo sapiens
ggggcgtggcctgccagttgc

SEQ ID NO: 9028930 - DNA, 22 bp, Homo sapiens
ggggcctccagcactaggcagc

SEQ ID NO: 9028931 - DNA, 22 bp, Homo sapiens
ggggcctccagcactaggcagc

SEQ ID NO: 9028932 - DNA, 22 bp, Homo sapiens
ggggcctccagcactaggcagc

SEQ ID NO: 9028933 - DNA, 22 bp, Homo sapiens
ggggccgaccgcggttcaggcc

SEQ ID NO: 9028934 - DNA, 22 bp, Homo sapiens
ggggccgaccgcggttcaggcc

SEQ ID NO: 9028935 - DNA, 22 bp, Homo sapiens
ggggaaggatatgattagacta

SEQ ID NO: 9028936 - DNA, 22 bp, Homo sapiens
ggggccgaccgcggttcaggcc

SEQ ID NO: 9028937 - DNA, 22 bp, Homo sapiens
ggggccgaccgcggttcaggcc

SEQ ID NO: 9028938 - DNA, 22 bp, Homo sapiens
ggggccgaccgcggttcaggcc

SEQ ID NO: 9028939 - DNA, 22 bp, Homo sapiens
ggggaaggatatgattagacta

SEQ ID NO: 9028940 - DNA, 22 bp, Homo sapiens
ggggaaggaaagttattagcag

SEQ ID NO: 9028941 - DNA, 22 bp, Homo sapiens
ggggaagatggccctccatgtg

SEQ ID NO: 9028942 - DNA, 22 bp, Homo sapiens
ggggaagagcattgcacggtgt

SEQ ID NO: 9028943 - DNA, 22 bp, Homo sapiens
ggggaagaggcgtgatggatcc

SEQ ID NO: 9028944 - DNA, 22 bp, Homo sapiens
ggggaagagcattgcacggtgt

SEQ ID NO: 9028945 - DNA, 22 bp, Homo sapiens
ggggaagagcattgcacggtgt

SEQ ID NO: 9028946 - DNA, 22 bp, Homo sapiens
ggggaagaatggcagaaaacat

SEQ ID NO: 9028947 - DNA, 22 bp, Homo sapiens
ggggaagacctggcactacagc

SEQ ID NO: 9028948 - DNA, 22 bp, Homo sapiens
ggggaagacctggcactacagc

SEQ ID NO: 9028949 - DNA, 22 bp, Homo sapiens
ggggaagagcattgcacggtgt

SEQ ID NO: 9028950 - DNA, 22 bp, Homo sapiens
ggggaagatggccctccatgtg

SEQ ID NO: 9028951 - DNA, 22 bp, Homo sapiens
gggcttgggtattgtgagaggt

SEQ ID NO: 9028952 - DNA, 22 bp, Homo sapiens
gggcttgggtattgtgagaggt

SEQ ID NO: 9028953 - DNA, 22 bp, Homo sapiens
gggcttggtggagagaatgctg

SEQ ID NO: 9028954 - DNA, 22 bp, Homo sapiens
gggcttggtggagagaatgctg

SEQ ID NO: 9028955 - DNA, 22 bp, Homo sapiens
ggggaagaatggcagaaaacat

SEQ ID NO: 9028956 - DNA, 22 bp, Homo sapiens
gggtggagtagaaagatgaatt

SEQ ID NO: 9028957 - DNA, 22 bp, Homo sapiens
gggtggagtagaaagatgaatt

SEQ ID NO: 9028958 - DNA, 22 bp, Homo sapiens
gggtggaggtgggttttgagat

SEQ ID NO: 9028959 - DNA, 22 bp, Homo sapiens
gggtggagtagaaagatgaatt

SEQ ID NO: 9028960 - DNA, 22 bp, Homo sapiens
gggtggagtagaaagatgaatt

SEQ ID NO: 9028961 - DNA, 22 bp, Homo sapiens
gggtggagtgtgaaatctggct

SEQ ID NO: 9028962 - DNA, 22 bp, Homo sapiens
gggtggagtgtgaaatctggct

SEQ ID NO: 9028963 - DNA, 20 bp, Homo sapiens
gggtggagttgcggtctgtg

SEQ ID NO: 9028964 - DNA, 20 bp, Homo sapiens
gggtggagttgcggtctgtg

SEQ ID NO: 9028965 - DNA, 22 bp, Homo sapiens
gggtggagtgtgaaatctggct

SEQ ID NO: 9028966 - DNA, 22 bp, Homo sapiens
gggtggagcttggacaccagta

SEQ ID NO: 9028967 - DNA, 22 bp, Homo sapiens
gggtggagcttggacaccagta

SEQ ID NO: 9028968 - DNA, 22 bp, Homo sapiens
gggtggagcttggacaccagta

SEQ ID NO: 9028969 - DNA, 22 bp, Homo sapiens
gggtggagcttggacaccagta

SEQ ID NO: 9028970 - DNA, 22 bp, Homo sapiens
gggtagggtgacttaggctggc

SEQ ID NO: 9028971 - DNA, 22 bp, Homo sapiens
gggtggaggagaacaggcccca

SEQ ID NO: 9028972 - DNA, 22 bp, Homo sapiens
gggtggaggagaacaggcccca

SEQ ID NO: 9028973 - DNA, 22 bp, Homo sapiens
gggtggaggagaacaggcccca

SEQ ID NO: 9028974 - DNA, 22 bp, Homo sapiens
gggtggagcttggacaccagta

SEQ ID NO: 9028975 - DNA, 22 bp, Homo sapiens
gggtagggtgacttaggctggc

SEQ ID NO: 9028976 - DNA, 22 bp, Homo sapiens
gggtagggtgacttaggctggc

SEQ ID NO: 9028977 - DNA, 22 bp, Homo sapiens
gggtaggccagaagggcctgga

SEQ ID NO: 9028978 - DNA, 22 bp, Homo sapiens
gggtaggccgtgggtcaccagg

SEQ ID NO: 9028979 - DNA, 22 bp, Homo sapiens
gggtaggctctgcaggctgggt

SEQ ID NO: 9028980 - DNA, 22 bp, Homo sapiens
gggtaggaaatccagaggtggc

SEQ ID NO: 9028981 - DNA, 22 bp, Homo sapiens
gggtaggagaggtgtctgtgtg

SEQ ID NO: 9028982 - DNA, 22 bp, Homo sapiens
gggtaggatggtagaagggacc

SEQ ID NO: 9028983 - DNA, 22 bp, Homo sapiens
gggtaggatggtagaagggacc

SEQ ID NO: 9028984 - DNA, 22 bp, Homo sapiens
gggtaggcaaagcaatgacgtt

SEQ ID NO: 9028985 - DNA, 22 bp, Homo sapiens
gggtaggcaaagcaatgacgtt

SEQ ID NO: 9028986 - DNA, 22 bp, Homo sapiens
gggtaggcagtgcgtcctgcct

SEQ ID NO: 9028987 - DNA, 22 bp, Homo sapiens
gggtaggcaaagcaatgacgtt

SEQ ID NO: 9028988 - DNA, 22 bp, Homo sapiens
gggtaggcaaagcaatgacgtt

SEQ ID NO: 9028989 - DNA, 22 bp, Homo sapiens
ggggctgggatttgaacccagg

SEQ ID NO: 9028990 - DNA, 22 bp, Homo sapiens
ggggctgggatttgaacccagg

SEQ ID NO: 9028991 - DNA, 22 bp, Homo sapiens
ggggctgggatttgaacccagg

SEQ ID NO: 9028992 - DNA, 22 bp, Homo sapiens
ggggctgggatttgaacccagg

SEQ ID NO: 9028993 - DNA, 22 bp, Homo sapiens
ggggctgggatttgaacccagg

SEQ ID NO: 9028994 - DNA, 22 bp, Homo sapiens
ggggctggtggtggtttctcca

SEQ ID NO: 9028995 - DNA, 22 bp, Homo sapiens
ggggctggtggtggtttctcca

SEQ ID NO: 9028996 - DNA, 22 bp, Homo sapiens
ggggctggtggtggtttctcca

SEQ ID NO: 9028997 - DNA, 22 bp, Homo sapiens
ggggtgggcgtgcagggacacc

SEQ ID NO: 9028998 - DNA, 22 bp, Homo sapiens
ggggctggtggtggtttctcca

SEQ ID NO: 9028999 - DNA, 22 bp, Homo sapiens
ggggtgggcgtgcagggacacc

SEQ ID NO: 9029000 - DNA, 22 bp, Homo sapiens
ggggtgggcgtgcagggacacc

SEQ ID NO: 9029001 - DNA, 22 bp, Homo sapiens
ggggtgggcgtgcagggacacc

SEQ ID NO: 9029002 - DNA, 22 bp, Homo sapiens
ggggctggtggtggtttctcca

SEQ ID NO: 9029003 - DNA, 22 bp, Homo sapiens
ggggctggtggtggtttctcca

SEQ ID NO: 9029004 - DNA, 22 bp, Homo sapiens
ggggtgggcgtgcagggacacc

SEQ ID NO: 9029005 - DNA, 22 bp, Homo sapiens
ggggtgggcgtgcagggacacc

SEQ ID NO: 9029006 - DNA, 22 bp, Homo sapiens
ggggtgggcgtgcagggacacc

SEQ ID NO: 9029007 - DNA, 22 bp, Homo sapiens
ggggtgggcgtgcagggacacc

SEQ ID NO: 9029008 - DNA, 22 bp, Homo sapiens
ggggtgggcgtgcagggacacc

SEQ ID NO: 9029009 - DNA, 22 bp, Homo sapiens
ggggtgggcgtgcagggacacc

SEQ ID NO: 9029010 - DNA, 22 bp, Homo sapiens
ggggtgggcgtgcagggacacc

SEQ ID NO: 9029011 - DNA, 22 bp, Homo sapiens
ggggtgggcgtgcagggacacc

SEQ ID NO: 9029012 - DNA, 22 bp, Homo sapiens
ggggtgggcgtgcagggacacc

SEQ ID NO: 9029013 - DNA, 22 bp, Homo sapiens
ggggtgggcgtgcagggacacc

SEQ ID NO: 9029014 - DNA, 22 bp, Homo sapiens
ggggtggggttactcattgtgc

SEQ ID NO: 9029015 - DNA, 22 bp, Homo sapiens
ggggtggggttactcattgtgc

SEQ ID NO: 9029016 - DNA, 22 bp, Homo sapiens
ggggtggggttactcattgtgc

SEQ ID NO: 9029017 - DNA, 22 bp, Homo sapiens
ggggtggggttactcattgtgc

SEQ ID NO: 9029018 - DNA, 22 bp, Homo sapiens
ggggtggggttactcattgtgc

SEQ ID NO: 9029019 - DNA, 22 bp, Homo sapiens
ggggtgtgagtagagctgggga

SEQ ID NO: 9029020 - DNA, 22 bp, Homo sapiens
ggggtgtgagtagagctgggga

SEQ ID NO: 9029021 - DNA, 22 bp, Homo sapiens
ggggtgtgagtagagctgggga

SEQ ID NO: 9029022 - DNA, 22 bp, Homo sapiens
ggggtggggttactcattgtgc

SEQ ID NO: 9029023 - DNA, 22 bp, Homo sapiens
ggggtggggttactcattgtgc

SEQ ID NO: 9029024 - DNA, 22 bp, Homo sapiens
ggggtgtgtctgacaatggtat

SEQ ID NO: 9029025 - DNA, 22 bp, Homo sapiens
ggggtgtggacggctgtgccag

SEQ ID NO: 9029026 - DNA, 22 bp, Homo sapiens
ggggtgtggacggctgtgccag

SEQ ID NO: 9029027 - DNA, 22 bp, Homo sapiens
ggggtgtggacggctgtgccag

SEQ ID NO: 9029028 - DNA, 22 bp, Homo sapiens
ggggtgtgagtagagctgggga

SEQ ID NO: 9029029 - DNA, 22 bp, Homo sapiens
gggtaggaaatccagaggtggc

SEQ ID NO: 9029030 - DNA, 22 bp, Homo sapiens
ggggttgatcacagaggggtct

SEQ ID NO: 9029031 - DNA, 20 bp, Homo sapiens
ggggttgaccctcttggact

SEQ ID NO: 9029032 - DNA, 21 bp, Homo sapiens
ggggttggcaagagcagagac

SEQ ID NO: 9029033 - DNA, 22 bp, Homo sapiens
ggggttgatcacagaggggtct

SEQ ID NO: 9029034 - DNA, 22 bp, Homo sapiens
ggtggcctgcaagtgcagatgg

SEQ ID NO: 9029035 - DNA, 17 bp, Homo sapiens
ggtggcctgcagtggct

SEQ ID NO: 9029036 - DNA, 17 bp, Homo sapiens
ggtggcctgcagtggct

SEQ ID NO: 9029037 - DNA, 17 bp, Homo sapiens
ggtggcctgcagtggct

SEQ ID NO: 9029038 - DNA, 22 bp, Homo sapiens
ggtggcctgaattagctcaggg

SEQ ID NO: 9029039 - DNA, 17 bp, Homo sapiens
ggtggcctgcagtggct

SEQ ID NO: 9029040 - DNA, 22 bp, Homo sapiens
ggtggcctgccctgatccctgg

SEQ ID NO: 9029041 - DNA, 22 bp, Homo sapiens
ggtggcctgccctgatccctgg

SEQ ID NO: 9029042 - DNA, 22 bp, Homo sapiens
ggtggcctggctctcaccttgg

SEQ ID NO: 9029043 - DNA, 18 bp, Homo sapiens
ggtggccttgacttctct

SEQ ID NO: 9029044 - DNA, 22 bp, Homo sapiens
ggtggcctccagggcataggtg

SEQ ID NO: 9029045 - DNA, 22 bp, Homo sapiens
ggtggcctccagggcataggtg

SEQ ID NO: 9029046 - DNA, 22 bp, Homo sapiens
ggtggcctcagcaaggctggca

SEQ ID NO: 9029047 - DNA, 22 bp, Homo sapiens
ggtggcctcggtggtgcacagg

SEQ ID NO: 9029048 - DNA, 22 bp, Homo sapiens
ggtggcctccagggcataggtg

SEQ ID NO: 9029049 - DNA, 22 bp, Homo sapiens
ggtggcctcgccgcggctctgc

SEQ ID NO: 9029050 - DNA, 22 bp, Homo sapiens
ggtggcctcggtggtgcacagg

SEQ ID NO: 9029051 - DNA, 22 bp, Homo sapiens
ggtggcctcggtggtgcacagg

SEQ ID NO: 9029052 - DNA, 22 bp, Homo sapiens
ggtggcctcttgtttagccagc

SEQ ID NO: 9029053 - DNA, 18 bp, Homo sapiens
ggtggcggggatggaggt

SEQ ID NO: 9029054 - DNA, 18 bp, Homo sapiens
ggtggcggggatggaggt

SEQ ID NO: 9029055 - DNA, 18 bp, Homo sapiens
ggtggcggggatggaggt

SEQ ID NO: 9029056 - DNA, 22 bp, Homo sapiens
ggtggctcaaagagagcacaga

SEQ ID NO: 9029057 - DNA, 22 bp, Homo sapiens
ggtggcggccacttcagccctg

SEQ ID NO: 9029058 - DNA, 22 bp, Homo sapiens
ggtggccttttatgagcagggt

SEQ ID NO: 9029059 - DNA, 22 bp, Homo sapiens
ggtggccttttatgagcagggt

SEQ ID NO: 9029060 - DNA, 18 bp, Homo sapiens
ggtggcggggatggaggt

SEQ ID NO: 9029061 - DNA, 19 bp, Homo sapiens
ggtggctcagggcccagcc

SEQ ID NO: 9029062 - DNA, 22 bp, Homo sapiens
ggtggctcacgcctgtaagccc

SEQ ID NO: 9029063 - DNA, 22 bp, Homo sapiens
ggtggctcagtgtcaggccctg

SEQ ID NO: 9029064 - DNA, 22 bp, Homo sapiens
ggtggctcagtgtcaggccctg

SEQ ID NO: 9029065 - DNA, 22 bp, Homo sapiens
ggtggctcagtgtcaggccctg

SEQ ID NO: 9029066 - DNA, 22 bp, Homo sapiens
ggtggctcccacccagctttga

SEQ ID NO: 9029067 - DNA, 22 bp, Homo sapiens
ggtggctccgcttccatgggct

SEQ ID NO: 9029068 - DNA, 22 bp, Homo sapiens
ggtggctcagggctccaagcat

SEQ ID NO: 9029069 - DNA, 18 bp, Homo sapiens
ggtggctcagtcatgggg

SEQ ID NO: 9029070 - DNA, 19 bp, Homo sapiens
ggtggctcagggcccagcc

SEQ ID NO: 9029071 - DNA, 22 bp, Homo sapiens
ggtggctcagggctccaagcat

SEQ ID NO: 9029072 - DNA, 22 bp, Homo sapiens
ggtggctcagggctccaagcat

SEQ ID NO: 9029073 - DNA, 22 bp, Homo sapiens
ggtctggcctccgggcaggtgg

SEQ ID NO: 9029074 - DNA, 22 bp, Homo sapiens
ggtctggcctccgggcaggtgg

SEQ ID NO: 9029075 - DNA, 22 bp, Homo sapiens
ggtggcctcagcaaggctggca

SEQ ID NO: 9029076 - DNA, 22 bp, Homo sapiens
ggtggcctagggcccagcctgt

SEQ ID NO: 9029077 - DNA, 22 bp, Homo sapiens
ggtggcctagggcccagcctgt

SEQ ID NO: 9029078 - DNA, 22 bp, Homo sapiens
ggtctggcaggtgaggactcag

SEQ ID NO: 9029079 - DNA, 22 bp, Homo sapiens
ggtctggcaggtgaggactcag

SEQ ID NO: 9029080 - DNA, 22 bp, Homo sapiens
ggtctggccaatagacagcccc

SEQ ID NO: 9029081 - DNA, 22 bp, Homo sapiens
ggtctggcactcatgcagcagg

SEQ ID NO: 9029082 - DNA, 22 bp, Homo sapiens
ggtctgaatcactgtgcctatc

SEQ ID NO: 9029083 - DNA, 22 bp, Homo sapiens
ggtctggagcttggctaaggga

SEQ ID NO: 9029084 - DNA, 22 bp, Homo sapiens
ggtctggatgctgaggttccca

SEQ ID NO: 9029085 - DNA, 22 bp, Homo sapiens
ggtctctgtttggggctggcaa

SEQ ID NO: 9029086 - DNA, 22 bp, Homo sapiens
ggtctctgtttggggctggcaa

SEQ ID NO: 9029087 - DNA, 22 bp, Homo sapiens
ggtctcttagtgcaacatacta

SEQ ID NO: 9029088 - DNA, 22 bp, Homo sapiens
ggtctcttcaggagcttgagcg

SEQ ID NO: 9029089 - DNA, 21 bp, Homo sapiens
ggtctcttcatctgtaacctg

SEQ ID NO: 9029090 - DNA, 21 bp, Homo sapiens
ggtctcttcatctgtaacctg

SEQ ID NO: 9029091 - DNA, 22 bp, Homo sapiens
ggtctcttccagctttatcact

SEQ ID NO: 9029092 - DNA, 22 bp, Homo sapiens
ggtctcttgtccaaggtcacac

SEQ ID NO: 9029093 - DNA, 22 bp, Homo sapiens
ggtctctttccttggcttgcac

SEQ ID NO: 9029094 - DNA, 22 bp, Homo sapiens
ggtctctttgcttcagctacag

SEQ ID NO: 9029095 - DNA, 22 bp, Homo sapiens
ggtctctttgcttcagctacag

SEQ ID NO: 9029096 - DNA, 22 bp, Homo sapiens
ggtctctttgcttcagctacag

SEQ ID NO: 9029097 - DNA, 22 bp, Homo sapiens
ggtctctttgcttcagctacag

SEQ ID NO: 9029098 - DNA, 22 bp, Homo sapiens
ggtctgaagcccacgtggtacc

SEQ ID NO: 9029099 - DNA, 22 bp, Homo sapiens
ggtctggaccctcctggagtgg

SEQ ID NO: 9029100 - DNA, 19 bp, Homo sapiens
ggtgtgtgctggggcctgt

SEQ ID NO: 9029101 - DNA, 22 bp, Homo sapiens
ggtgtgtggtcctctcacttag

SEQ ID NO: 9029102 - DNA, 22 bp, Homo sapiens
ggtgtgtggtcctctcacttag

SEQ ID NO: 9029103 - DNA, 22 bp, Homo sapiens
ggtgtgtggttttgatacagtc

SEQ ID NO: 9029104 - DNA, 22 bp, Homo sapiens
ggtgtgtgtggattagcatgcc

SEQ ID NO: 9029105 - DNA, 22 bp, Homo sapiens
ggtgtgtgtggattagcatgcc

SEQ ID NO: 9029106 - DNA, 22 bp, Homo sapiens
ggtgtgtggttttgatacagtc

SEQ ID NO: 9029107 - DNA, 22 bp, Homo sapiens
ggtgtgtgtggattagcatgcc

SEQ ID NO: 9029108 - DNA, 22 bp, Homo sapiens
ggtgtgtgtggattagcatgcc

SEQ ID NO: 9029109 - DNA, 22 bp, Homo sapiens
ggtgtgtctgccaggaactgca

SEQ ID NO: 9029110 - DNA, 22 bp, Homo sapiens
ggtgtggtttgaagggagatgg

SEQ ID NO: 9029111 - DNA, 22 bp, Homo sapiens
ggtgtgggtccttgtgcttgct

SEQ ID NO: 9029112 - DNA, 22 bp, Homo sapiens
ggtgtggtttgaagggagatgg

SEQ ID NO: 9029113 - DNA, 22 bp, Homo sapiens
ggtgtggtttgaagggagatgg

SEQ ID NO: 9029114 - DNA, 22 bp, Homo sapiens
ggtgtgtgaggagtcacttagt

SEQ ID NO: 9029115 - DNA, 22 bp, Homo sapiens
ggtgtgtgaggagtcacttagt

SEQ ID NO: 9029116 - DNA, 22 bp, Homo sapiens
ggtgtgtgaggagtcacttagt

SEQ ID NO: 9029117 - DNA, 19 bp, Homo sapiens
ggtgtgtgctggggcctgt

SEQ ID NO: 9029118 - DNA, 19 bp, Homo sapiens
ggtgtgtgctggggcctgt

SEQ ID NO: 9029119 - DNA, 19 bp, Homo sapiens
ggtgtgtgctggggcctgt

SEQ ID NO: 9029120 - DNA, 19 bp, Homo sapiens
ggtgtgtgctggggcctgt

SEQ ID NO: 9029121 - DNA, 22 bp, Homo sapiens
ggtgttggaacatggtgagatt

SEQ ID NO: 9029122 - DNA, 22 bp, Homo sapiens
ggtgttcttagtggcactggca

SEQ ID NO: 9029123 - DNA, 22 bp, Homo sapiens
ggtgttaacttgtttatgacaa

SEQ ID NO: 9029124 - DNA, 22 bp, Homo sapiens
ggtgttcaaatgaacacatgca

SEQ ID NO: 9029125 - DNA, 22 bp, Homo sapiens
ggtgttgcagttgaagactggt

SEQ ID NO: 9029126 - DNA, 22 bp, Homo sapiens
ggtgttgggctcactggtcctt

SEQ ID NO: 9029127 - DNA, 22 bp, Homo sapiens
ggtgttggaacatggtgagatt

SEQ ID NO: 9029128 - DNA, 22 bp, Homo sapiens
ggtttatcaatacatattgcta

SEQ ID NO: 9029129 - DNA, 19 bp, Homo sapiens
ggtttatctgtttcttctc

SEQ ID NO: 9029130 - DNA, 22 bp, Homo sapiens
ggtgtttaaaggctcagcagga

SEQ ID NO: 9029131 - DNA, 17 bp, Homo sapiens
ggtgtttaagtgccagc

SEQ ID NO: 9029132 - DNA, 22 bp, Homo sapiens
ggtttattaatgtgaactgtat

SEQ ID NO: 9029133 - DNA, 22 bp, Homo sapiens
ggtttattgaaggccaccccac

SEQ ID NO: 9029134 - DNA, 22 bp, Homo sapiens
ggtttattaatgtgaactgtat

SEQ ID NO: 9029135 - DNA, 22 bp, Homo sapiens
ggtttattaatgtgaactgtat

SEQ ID NO: 9029136 - DNA, 22 bp, Homo sapiens
ggtttattaatgtgaactgtat

SEQ ID NO: 9029137 - DNA, 22 bp, Homo sapiens
ggtttattaatgtgaactgtat

SEQ ID NO: 9029138 - DNA, 22 bp, Homo sapiens
ggtttattgttaataagtttga

SEQ ID NO: 9029139 - DNA, 22 bp, Homo sapiens
ggtttattgttaataagtttga

SEQ ID NO: 9029140 - DNA, 22 bp, Homo sapiens
ggtttattgttaataagtttga

SEQ ID NO: 9029141 - DNA, 22 bp, Homo sapiens
ggtttattgttaataagtttga

SEQ ID NO: 9029142 - DNA, 22 bp, Homo sapiens
ggtttattgaaggccaccccac

SEQ ID NO: 9029143 - DNA, 22 bp, Homo sapiens
ggtttattgttaataagtttga

SEQ ID NO: 9029144 - DNA, 22 bp, Homo sapiens
ggtttattgaaggccaccccac

SEQ ID NO: 9029145 - DNA, 22 bp, Homo sapiens
ggtttattgaaggccaccccac

SEQ ID NO: 9029146 - DNA, 22 bp, Homo sapiens
ggtggctctccctggactcagc

SEQ ID NO: 9029147 - DNA, 22 bp, Homo sapiens
ggtggctctcaggcttctcgga

SEQ ID NO: 9029148 - DNA, 22 bp, Homo sapiens
ggtggctctcaggcttctcgga

SEQ ID NO: 9029149 - DNA, 22 bp, Homo sapiens
ggtggctctcaggcttctcgga

SEQ ID NO: 9029150 - DNA, 19 bp, Homo sapiens
ggtggctctccctcaggga

SEQ ID NO: 9029151 - DNA, 19 bp, Homo sapiens
ggtggctctccctcaggga

SEQ ID NO: 9029152 - DNA, 22 bp, Homo sapiens
ggtggctcggccagtgcaggcc

SEQ ID NO: 9029153 - DNA, 22 bp, Homo sapiens
ggtggctcggccagtgcaggcc

SEQ ID NO: 9029154 - DNA, 22 bp, Homo sapiens
ggtgtccttcgtccgctggcat

SEQ ID NO: 9029155 - DNA, 22 bp, Homo sapiens
ggtggctctctgtcagtgacag

SEQ ID NO: 9029156 - DNA, 22 bp, Homo sapiens
ggtggctctcttaagggcagcg

SEQ ID NO: 9029157 - DNA, 22 bp, Homo sapiens
ggtggctctctgtcagtgacag

SEQ ID NO: 9029158 - DNA, 22 bp, Homo sapiens
ggtggctctctgtcagtgacag

SEQ ID NO: 9029159 - DNA, 22 bp, Homo sapiens
ggtgtgggccctgatgtcagca

SEQ ID NO: 9029160 - DNA, 22 bp, Homo sapiens
ggtgtgggccctgatgtcagca

SEQ ID NO: 9029161 - DNA, 22 bp, Homo sapiens
ggtgtgggccctgatgtcagca

SEQ ID NO: 9029162 - DNA, 22 bp, Homo sapiens
ggtgtgggcagatgccctactt

SEQ ID NO: 9029163 - DNA, 22 bp, Homo sapiens
ggtgtgggcagatgccctactt

SEQ ID NO: 9029164 - DNA, 22 bp, Homo sapiens
ggtgtgggagagattctttcct

SEQ ID NO: 9029165 - DNA, 22 bp, Homo sapiens
ggtgtgggagagattctttcct

SEQ ID NO: 9029166 - DNA, 22 bp, Homo sapiens
ggtgtgggcagatgccctactt

SEQ ID NO: 9029167 - DNA, 21 bp, Homo sapiens
ggtgtgggatggactgaacca

SEQ ID NO: 9029168 - DNA, 21 bp, Homo sapiens
ggtgtgggatggactgaacca

SEQ ID NO: 9029169 - DNA, 22 bp, Homo sapiens
ggtgtggctgtgagtttttgat

SEQ ID NO: 9029170 - DNA, 22 bp, Homo sapiens
ggtgtgggaactacaggttttt

SEQ ID NO: 9029171 - DNA, 22 bp, Homo sapiens
ggtgtgggaactacaggttttt

SEQ ID NO: 9029172 - DNA, 22 bp, Homo sapiens
ggtgtgggaactacaggttttt

SEQ ID NO: 9029173 - DNA, 22 bp, Homo sapiens
ggtgtggatcatctgaggtcag

SEQ ID NO: 9029174 - DNA, 22 bp, Homo sapiens
ggtgtgggccctgatgtcagca

SEQ ID NO: 9029175 - DNA, 22 bp, Homo sapiens
ggtgtggggaggttctgcttct

SEQ ID NO: 9029176 - DNA, 22 bp, Homo sapiens
ggtgtggggaggttctgcttct

SEQ ID NO: 9029177 - DNA, 22 bp, Homo sapiens
ggtgtggggaggttctgcttct

SEQ ID NO: 9029178 - DNA, 22 bp, Homo sapiens
ggtgtggggaggttctgcttct

SEQ ID NO: 9029179 - DNA, 22 bp, Homo sapiens
ggtgtgggggcaagtttgagat

SEQ ID NO: 9029180 - DNA, 22 bp, Homo sapiens
ggtgtgggggcaagtttgagat

SEQ ID NO: 9029181 - DNA, 22 bp, Homo sapiens
ggtgtgggtccttgtgcttgct

SEQ ID NO: 9029182 - DNA, 22 bp, Homo sapiens
ggtgtggtttgaagggagatgg

SEQ ID NO: 9029183 - DNA, 22 bp, Homo sapiens
ggtgtgggtccttgtgcttgct

SEQ ID NO: 9029184 - DNA, 22 bp, Homo sapiens
ggtgtgggtccttgtgcttgct

SEQ ID NO: 9029185 - DNA, 22 bp, Homo sapiens
ggtgtgggtcagctttattaat

SEQ ID NO: 9029186 - DNA, 22 bp, Homo sapiens
ggtgtgggggcagctctgatat

SEQ ID NO: 9029187 - DNA, 22 bp, Homo sapiens
ggtgtgggggcagctctgatat

SEQ ID NO: 9029188 - DNA, 22 bp, Homo sapiens
ggtgtgggggcagctctgatat

SEQ ID NO: 9029189 - DNA, 22 bp, Homo sapiens
ggtcacatctaaatggagcatt

SEQ ID NO: 9029190 - DNA, 22 bp, Homo sapiens
ggtcacatgagatgctgccctc

SEQ ID NO: 9029191 - DNA, 22 bp, Homo sapiens
ggtcacatctaaatggagcatt

SEQ ID NO: 9029192 - DNA, 19 bp, Homo sapiens
ggtcacaggggttacaagg

SEQ ID NO: 9029193 - DNA, 22 bp, Homo sapiens
ggtcacatatcctcggtttgga

SEQ ID NO: 9029194 - DNA, 22 bp, Homo sapiens
ggtagtacatggaagagtacac

SEQ ID NO: 9029195 - DNA, 22 bp, Homo sapiens
ggtagtcagtgttagtttgatt

SEQ ID NO: 9029196 - DNA, 22 bp, Homo sapiens
ggtagtcatggatagctatgag

SEQ ID NO: 9029197 - DNA, 22 bp, Homo sapiens
ggtaggggcagggccaagctgt

SEQ ID NO: 9029198 - DNA, 22 bp, Homo sapiens
ggtcacatggttgagcttgatc

SEQ ID NO: 9029199 - DNA, 22 bp, Homo sapiens
ggtcacatgcggggctgtagcc

SEQ ID NO: 9029200 - DNA, 22 bp, Homo sapiens
ggtcacatgtgatttgagccaa

SEQ ID NO: 9029201 - DNA, 23 bp, Homo sapiens
ggtcacatgtgagattaaacttg

SEQ ID NO: 9029202 - DNA, 22 bp, Homo sapiens
ggtcacccatgatcacatcacc

SEQ ID NO: 9029203 - DNA, 22 bp, Homo sapiens
ggtcacgtgaccgcacctgcct

SEQ ID NO: 9029204 - DNA, 22 bp, Homo sapiens
ggtcacattctgaggtattagg

SEQ ID NO: 9029205 - DNA, 22 bp, Homo sapiens
ggtcacattctgaggaatcagg

SEQ ID NO: 9029206 - DNA, 22 bp, Homo sapiens
ggtcacccatgatcacatcacc

SEQ ID NO: 9029207 - DNA, 22 bp, Homo sapiens
ggtcactggtctctgcttccat

SEQ ID NO: 9029208 - DNA, 22 bp, Homo sapiens
ggtcactggtctctgcttccat

SEQ ID NO: 9029209 - DNA, 22 bp, Homo sapiens
ggtcactgtcttctgggctctg

SEQ ID NO: 9029210 - DNA, 22 bp, Homo sapiens
ggtcacttcagataactggtgt

SEQ ID NO: 9029211 - DNA, 22 bp, Homo sapiens
ggtcacttctttcatcgaaact

SEQ ID NO: 9029212 - DNA, 18 bp, Homo sapiens
ggtcactgagatgctact

SEQ ID NO: 9029213 - DNA, 22 bp, Homo sapiens
ggtcactgatgtgttccctggg

SEQ ID NO: 9029214 - DNA, 22 bp, Homo sapiens
ggtcactgccctcccttttgca

SEQ ID NO: 9029215 - DNA, 22 bp, Homo sapiens
ggtcactgagctgtaattctgt

SEQ ID NO: 9029216 - DNA, 22 bp, Homo sapiens
ggtcactgatgtgttccctggg

SEQ ID NO: 9029217 - DNA, 22 bp, Homo sapiens
ggtcagaacaagggtaaataaa

SEQ ID NO: 9029218 - DNA, 22 bp, Homo sapiens
ggtcagaacaagcaaataatag

SEQ ID NO: 9029219 - DNA, 22 bp, Homo sapiens
ggtcagaaggcagttaaacaaa

SEQ ID NO: 9029220 - DNA, 22 bp, Homo sapiens
ggtcagaaggattctgggaaat

SEQ ID NO: 9029221 - DNA, 22 bp, Homo sapiens
ggtcagaagtgcaaaatcagtt

SEQ ID NO: 9029222 - DNA, 22 bp, Homo sapiens
ggtcagaagtgcaaaatcagtt

SEQ ID NO: 9029223 - DNA, 22 bp, Homo sapiens
ggtcagagaaaagtagggtgtt

SEQ ID NO: 9029224 - DNA, 22 bp, Homo sapiens
ggtcagagaaaagtagggtgtt

SEQ ID NO: 9029225 - DNA, 22 bp, Homo sapiens
ggtcagagaaaagtagggtgtt

SEQ ID NO: 9029226 - DNA, 22 bp, Homo sapiens
ggtcagagaaaagtagggtgtt

SEQ ID NO: 9029227 - DNA, 22 bp, Homo sapiens
ggtcagaattaggtctagagta

SEQ ID NO: 9029228 - DNA, 22 bp, Homo sapiens
ggtcagagaaagtggtagtaga

SEQ ID NO: 9029229 - DNA, 19 bp, Homo sapiens
ggtcagagagatccaggct

SEQ ID NO: 9029230 - DNA, 19 bp, Homo sapiens
ggtcagagagatccaggct

SEQ ID NO: 9029231 - DNA, 22 bp, Homo sapiens
ggtcagagatgaggtctaaagt

SEQ ID NO: 9029232 - DNA, 22 bp, Homo sapiens
ggtcagagctggagagataggg

SEQ ID NO: 9029233 - DNA, 22 bp, Homo sapiens
ggtcagagccgttagcattcag

SEQ ID NO: 9029234 - DNA, 22 bp, Homo sapiens
ggtcagagctggagagataggg

SEQ ID NO: 9029235 - DNA, 22 bp, Homo sapiens
ggtcagagccatggagcaactg

SEQ ID NO: 9029236 - DNA, 22 bp, Homo sapiens
ggtcagagccatggagcaactg

SEQ ID NO: 9029237 - DNA, 22 bp, Homo sapiens
ggtcagagccgttagcattcag

SEQ ID NO: 9029238 - DNA, 22 bp, Homo sapiens
ggtcagaggaggaataggacat

SEQ ID NO: 9029239 - DNA, 22 bp, Homo sapiens
ggtcagaggaggaataggacat

SEQ ID NO: 9029240 - DNA, 22 bp, Homo sapiens
ggtcagaggaggaataggacat

SEQ ID NO: 9029241 - DNA, 22 bp, Homo sapiens
ggtcagaggggattccttggga

SEQ ID NO: 9029242 - DNA, 22 bp, Homo sapiens
ggtcagaggggattccttggga

SEQ ID NO: 9029243 - DNA, 22 bp, Homo sapiens
ggtcagagggtgggctgcctgt

SEQ ID NO: 9029244 - DNA, 22 bp, Homo sapiens
ggtcagagggtgggctgcctgt

SEQ ID NO: 9029245 - DNA, 22 bp, Homo sapiens
ggtcagagggtgggctgcctgt

SEQ ID NO: 9029246 - DNA, 22 bp, Homo sapiens
ggtcagagggtgggctgcctgt

SEQ ID NO: 9029247 - DNA, 22 bp, Homo sapiens
gggtggcaggattggcaggagt

SEQ ID NO: 9029248 - DNA, 22 bp, Homo sapiens
gggtggcaggattggcaggagt

SEQ ID NO: 9029249 - DNA, 22 bp, Homo sapiens
gggtggcaggattggcaggagt

SEQ ID NO: 9029250 - DNA, 22 bp, Homo sapiens
gggtggcagctgttgccaaggt

SEQ ID NO: 9029251 - DNA, 22 bp, Homo sapiens
gggtggcaggattggcaggagt

SEQ ID NO: 9029252 - DNA, 22 bp, Homo sapiens
gggtggcaggattggcaggagt

SEQ ID NO: 9029253 - DNA, 22 bp, Homo sapiens
gggtggcaggattggcaggagt

SEQ ID NO: 9029254 - DNA, 22 bp, Homo sapiens
gggtggcaggattggcaggagt

SEQ ID NO: 9029255 - DNA, 22 bp, Homo sapiens
gggtggcaggattggcaggagt

SEQ ID NO: 9029256 - DNA, 22 bp, Homo sapiens
gggtggcagctgttgccaaggt

SEQ ID NO: 9029257 - DNA, 22 bp, Homo sapiens
gggtggcagctgttgccaaggt

SEQ ID NO: 9029258 - DNA, 22 bp, Homo sapiens
gggtggcacaggtgcagagggt

SEQ ID NO: 9029259 - DNA, 22 bp, Homo sapiens
gggtggcacaggtgcagagggt

SEQ ID NO: 9029260 - DNA, 22 bp, Homo sapiens
gggtggcacaggtgcagagggt

SEQ ID NO: 9029261 - DNA, 22 bp, Homo sapiens
gggtggcacaggtgcagagggt

SEQ ID NO: 9029262 - DNA, 22 bp, Homo sapiens
gggtggcacaggtgcagagggt

SEQ ID NO: 9029263 - DNA, 22 bp, Homo sapiens
gggtggcacaggtgcagagggt

SEQ ID NO: 9029264 - DNA, 22 bp, Homo sapiens
gggtggcacaggtgcagagggt

SEQ ID NO: 9029265 - DNA, 20 bp, Homo sapiens
gggtggagttgcggtctgtg

SEQ ID NO: 9029266 - DNA, 20 bp, Homo sapiens
gggtggagttgcggtctgtg

SEQ ID NO: 9029267 - DNA, 20 bp, Homo sapiens
gggtggagttgcggtctgtg

SEQ ID NO: 9029268 - DNA, 22 bp, Homo sapiens
gggtggcacaggtgcagagggt

SEQ ID NO: 9029269 - DNA, 22 bp, Homo sapiens
gggtggcaaaggcgctgaaagg

SEQ ID NO: 9029270 - DNA, 22 bp, Homo sapiens
gggtggcatctctctgagctgt

SEQ ID NO: 9029271 - DNA, 21 bp, Homo sapiens
gggtggccgcatgggtgcgtg

SEQ ID NO: 9029272 - DNA, 22 bp, Homo sapiens
gggtggccttaggcaagtcact

SEQ ID NO: 9029273 - DNA, 22 bp, Homo sapiens
gggtggccttcatagctcaggg

SEQ ID NO: 9029274 - DNA, 22 bp, Homo sapiens
gggtggccttcatagctcaggg

SEQ ID NO: 9029275 - DNA, 22 bp, Homo sapiens
gggtggcatctctctgagctgt

SEQ ID NO: 9029276 - DNA, 22 bp, Homo sapiens
gggtggcatagggtgatggctt

SEQ ID NO: 9029277 - DNA, 22 bp, Homo sapiens
gggtggcaggattggcaggagt

SEQ ID NO: 9029278 - DNA, 22 bp, Homo sapiens
gggtggcatagggtgatggctt

SEQ ID NO: 9029279 - DNA, 22 bp, Homo sapiens
gggtggcatagggtgatggctt

SEQ ID NO: 9029280 - DNA, 22 bp, Homo sapiens
gggtggcatagggtgatggctt

SEQ ID NO: 9029281 - DNA, 22 bp, Homo sapiens
gggtggctgagaacaggacccc

SEQ ID NO: 9029282 - DNA, 22 bp, Homo sapiens
ggtaggggaagacaagtgaaaa

SEQ ID NO: 9029283 - DNA, 22 bp, Homo sapiens
ggtagggctgcaatggtagtga

SEQ ID NO: 9029284 - DNA, 22 bp, Homo sapiens
gggtggctcctatgggcatagc

SEQ ID NO: 9029285 - DNA, 22 bp, Homo sapiens
ggtctagagtggggcctggaaa

SEQ ID NO: 9029286 - DNA, 22 bp, Homo sapiens
ggtcggggatggccaggctccc

SEQ ID NO: 9029287 - DNA, 22 bp, Homo sapiens
ggtcggggatggccaggctccc

SEQ ID NO: 9029288 - DNA, 22 bp, Homo sapiens
ggtcgtctcagtctgactgaag

SEQ ID NO: 9029289 - DNA, 22 bp, Homo sapiens
ggtctagatgaaattaaatgtt

SEQ ID NO: 9029290 - DNA, 22 bp, Homo sapiens
ggtctagatcaagaacagaact

SEQ ID NO: 9029291 - DNA, 22 bp, Homo sapiens
ggtctaggtgtaattgtttact

SEQ ID NO: 9029292 - DNA, 22 bp, Homo sapiens
ggtctcagactggcaggcagtg

SEQ ID NO: 9029293 - DNA, 22 bp, Homo sapiens
ggtctagggtcattatggtaca

SEQ ID NO: 9029294 - DNA, 22 bp, Homo sapiens
ggtcgctgtgtaggttcagcta

SEQ ID NO: 9029295 - DNA, 22 bp, Homo sapiens
ggtcgctgtgtaggttcagcta

SEQ ID NO: 9029296 - DNA, 22 bp, Homo sapiens
ggtcgctgtgtaggttcagcta

SEQ ID NO: 9029297 - DNA, 22 bp, Homo sapiens
ggtccttgggtctcctgtgttt

SEQ ID NO: 9029298 - DNA, 20 bp, Homo sapiens
ggtccttgtcacaaggagag

SEQ ID NO: 9029299 - DNA, 22 bp, Homo sapiens
ggtcgagtcacttgttgccttt

SEQ ID NO: 9029300 - DNA, 22 bp, Homo sapiens
ggtcgagtcacttgttgccttt

SEQ ID NO: 9029301 - DNA, 22 bp, Homo sapiens
ggtccttgtgtctctatggccc

SEQ ID NO: 9029302 - DNA, 22 bp, Homo sapiens
ggtcctttgccatctctccacc

SEQ ID NO: 9029303 - DNA, 22 bp, Homo sapiens
ggtcagcagtgcagggcagagc

SEQ ID NO: 9029304 - DNA, 22 bp, Homo sapiens
ggtccctggggaactaggctgt

SEQ ID NO: 9029305 - DNA, 22 bp, Homo sapiens
ggtcagcaggtccagccagtgc

SEQ ID NO: 9029306 - DNA, 22 bp, Homo sapiens
ggtcagcagtgcagggcagagc

SEQ ID NO: 9029307 - DNA, 22 bp, Homo sapiens
ggtcagaggtcccagaagaagc

SEQ ID NO: 9029308 - DNA, 22 bp, Homo sapiens
ggtcagaggtcacaagctggca

SEQ ID NO: 9029309 - DNA, 22 bp, Homo sapiens
ggtcagaggtcccagaagaagc

SEQ ID NO: 9029310 - DNA, 22 bp, Homo sapiens
ggtcagcaatttggactgggct

SEQ ID NO: 9029311 - DNA, 22 bp, Homo sapiens
ggtccctggttccctctgagct

SEQ ID NO: 9029312 - DNA, 22 bp, Homo sapiens
ggtccctgggtcttcttacgtc

SEQ ID NO: 9029313 - DNA, 22 bp, Homo sapiens
ggtccctggggaactaggctgt

SEQ ID NO: 9029314 - DNA, 20 bp, Homo sapiens
ggtcctgtactctcattgaa

SEQ ID NO: 9029315 - DNA, 20 bp, Homo sapiens
ggtcctgtactctcattgaa

SEQ ID NO: 9029316 - DNA, 22 bp, Homo sapiens
ggtccctggttccctctgagct

SEQ ID NO: 9029317 - DNA, 22 bp, Homo sapiens
ggtccttcagtaggttccagac

SEQ ID NO: 9029318 - DNA, 22 bp, Homo sapiens
ggtcctgtctgacatcactgct

SEQ ID NO: 9029319 - DNA, 22 bp, Homo sapiens
ggtccttgcttcggtccagtac

SEQ ID NO: 9029320 - DNA, 22 bp, Homo sapiens
ggtctctgagtgaggacctggg

SEQ ID NO: 9029321 - DNA, 22 bp, Homo sapiens
ggtctctgacttagagatggat

SEQ ID NO: 9029322 - DNA, 22 bp, Homo sapiens
ggtctctgacttagagatggat

SEQ ID NO: 9029323 - DNA, 22 bp, Homo sapiens
ggtctctgcagctcccggcccc

SEQ ID NO: 9029324 - DNA, 22 bp, Homo sapiens
ggtctctgctcagatgccactt

SEQ ID NO: 9029325 - DNA, 22 bp, Homo sapiens
ggtctctgcagctcccggcccc

SEQ ID NO: 9029326 - DNA, 22 bp, Homo sapiens
ggtctctgtcactgagtggccc

SEQ ID NO: 9029327 - DNA, 22 bp, Homo sapiens
ggtctctgtcactgagtggccc

SEQ ID NO: 9029328 - DNA, 22 bp, Homo sapiens
ggtctcctgaggctgccacacc

SEQ ID NO: 9029329 - DNA, 22 bp, Homo sapiens
ggtctcctgaggctgccacacc

SEQ ID NO: 9029330 - DNA, 22 bp, Homo sapiens
ggtctcctgaggctgccacacc

SEQ ID NO: 9029331 - DNA, 22 bp, Homo sapiens
ggtctcccttgctggttggctg

SEQ ID NO: 9029332 - DNA, 22 bp, Homo sapiens
ggtctccagctgggaccctgca

SEQ ID NO: 9029333 - DNA, 22 bp, Homo sapiens
ggtctccagctgggaccctgca

SEQ ID NO: 9029334 - DNA, 22 bp, Homo sapiens
ggtctctgaacttccactgcgc

SEQ ID NO: 9029335 - DNA, 22 bp, Homo sapiens
ggtctccttgggaaagcaggaa

SEQ ID NO: 9029336 - DNA, 22 bp, Homo sapiens
ggtctctctgctttcccccaga

SEQ ID NO: 9029337 - DNA, 22 bp, Homo sapiens
ggtctccaaagcttaggactac

SEQ ID NO: 9029338 - DNA, 22 bp, Homo sapiens
ggtctccaaagcttaggactac

SEQ ID NO: 9029339 - DNA, 22 bp, Homo sapiens
ggtctccaaagctgcattgatg

SEQ ID NO: 9029340 - DNA, 19 bp, Homo sapiens
ggtctcagtgcagctgcag

SEQ ID NO: 9029341 - DNA, 22 bp, Homo sapiens
ggtctccaaagctgcattgatg

SEQ ID NO: 9029342 - DNA, 22 bp, Homo sapiens
ggtctcatgtcctatgtgctta

SEQ ID NO: 9029343 - DNA, 22 bp, Homo sapiens
ggtctcatctttcagcgtcgag

SEQ ID NO: 9029344 - DNA, 22 bp, Homo sapiens
ggtctcaggtagggcctaggaa

SEQ ID NO: 9029345 - DNA, 22 bp, Homo sapiens
ggtctcaggtagggcctaggaa

SEQ ID NO: 9029346 - DNA, 22 bp, Homo sapiens
ggtctcaggtagggcctaggaa

SEQ ID NO: 9029347 - DNA, 22 bp, Homo sapiens
ggtctcagtgaaggagtgtgct

SEQ ID NO: 9029348 - DNA, 22 bp, Homo sapiens
ggtctcagccctcgccagcagc

SEQ ID NO: 9029349 - DNA, 22 bp, Homo sapiens
ggtctcagaggtttctgctcag

SEQ ID NO: 9029350 - DNA, 22 bp, Homo sapiens
ggtctcaggagactggagagca

SEQ ID NO: 9029351 - DNA, 22 bp, Homo sapiens
ggtctcagctggagtccttggt

SEQ ID NO: 9029352 - DNA, 22 bp, Homo sapiens
ggtctcagctggagtccttggt

SEQ ID NO: 9029353 - DNA, 22 bp, Homo sapiens
ggctgggcaggtctgcacaggg

SEQ ID NO: 9029354 - DNA, 21 bp, Homo sapiens
ggctgggcaggacccacccct

SEQ ID NO: 9029355 - DNA, 21 bp, Homo sapiens
ggctgggcaggacccacccct

SEQ ID NO: 9029356 - DNA, 21 bp, Homo sapiens
ggctgggcaggacccacccct

SEQ ID NO: 9029357 - DNA, 21 bp, Homo sapiens
ggctgggcaggacccacccct

SEQ ID NO: 9029358 - DNA, 22 bp, Homo sapiens
ggctgggcaggtctgcacaggg

SEQ ID NO: 9029359 - DNA, 22 bp, Homo sapiens
ggctgggcaggtctgcacaggg

SEQ ID NO: 9029360 - DNA, 22 bp, Homo sapiens
ggctgggcaggtctgcacaggg

SEQ ID NO: 9029361 - DNA, 22 bp, Homo sapiens
ggctgggcaggtctgcacaggg

SEQ ID NO: 9029362 - DNA, 22 bp, Homo sapiens
ggctgggcaggtctgcacaggg

SEQ ID NO: 9029363 - DNA, 22 bp, Homo sapiens
ggctgggcaggtctgcacaggg

SEQ ID NO: 9029364 - DNA, 22 bp, Homo sapiens
ggctgggccagggcctgtggac

SEQ ID NO: 9029365 - DNA, 22 bp, Homo sapiens
ggctgggcatccatccatgaga

SEQ ID NO: 9029366 - DNA, 22 bp, Homo sapiens
ggctgggcatccatccatgaga

SEQ ID NO: 9029367 - DNA, 22 bp, Homo sapiens
ggctgggcatccatccatgaga

SEQ ID NO: 9029368 - DNA, 22 bp, Homo sapiens
ggctgggcatccatccatgaga

SEQ ID NO: 9029369 - DNA, 22 bp, Homo sapiens
ggctgggcatccatccatgaga

SEQ ID NO: 9029370 - DNA, 22 bp, Homo sapiens
ggctgggcatccatccatgaga

SEQ ID NO: 9029371 - DNA, 22 bp, Homo sapiens
ggctgggccagggcctgtggac

SEQ ID NO: 9029372 - DNA, 22 bp, Homo sapiens
ggctgggccagggcctgtggac

SEQ ID NO: 9029373 - DNA, 22 bp, Homo sapiens
ggctgggccagggcctgtggac

SEQ ID NO: 9029374 - DNA, 22 bp, Homo sapiens
ggctgggccagggcctgtggac

SEQ ID NO: 9029375 - DNA, 19 bp, Homo sapiens
ggctgggccctgtttctcc

SEQ ID NO: 9029376 - DNA, 19 bp, Homo sapiens
ggctgggccctgtttctcc

SEQ ID NO: 9029377 - DNA, 22 bp, Homo sapiens
ggctgggccagggcctgtggac

SEQ ID NO: 9029378 - DNA, 22 bp, Homo sapiens
ggctgggctccgggagcatgcg

SEQ ID NO: 9029379 - DNA, 22 bp, Homo sapiens
ggctgggctccgggagcatgcg

SEQ ID NO: 9029380 - DNA, 22 bp, Homo sapiens
ggctgggctccgggagcatgcg

SEQ ID NO: 9029381 - DNA, 22 bp, Homo sapiens
ggctgggctccgggagcatgcg

SEQ ID NO: 9029382 - DNA, 22 bp, Homo sapiens
ggctgggctccgggagcatgcg

SEQ ID NO: 9029383 - DNA, 22 bp, Homo sapiens
ggctgggctcgctgattggctg

SEQ ID NO: 9029384 - DNA, 22 bp, Homo sapiens
ggctgggctcgctgattggctg

SEQ ID NO: 9029385 - DNA, 22 bp, Homo sapiens
ggctgggctcgctgattggctg

SEQ ID NO: 9029386 - DNA, 22 bp, Homo sapiens
ggctgggctccgggagcatgcg

SEQ ID NO: 9029387 - DNA, 22 bp, Homo sapiens
ggctgggctccgggagcatgcg

SEQ ID NO: 9029388 - DNA, 22 bp, Homo sapiens
ggctgggctccgggagcatgcg

SEQ ID NO: 9029389 - DNA, 22 bp, Homo sapiens
ggctgggctccgggagcatgcg

SEQ ID NO: 9029390 - DNA, 22 bp, Homo sapiens
ggctgggctccgggagcatgcg

SEQ ID NO: 9029391 - DNA, 22 bp, Homo sapiens
ggctgggctccgggagcatgcg

SEQ ID NO: 9029392 - DNA, 22 bp, Homo sapiens
ggctgggcctctccctcagctg

SEQ ID NO: 9029393 - DNA, 22 bp, Homo sapiens
ggctgggcctctccctcagctg

SEQ ID NO: 9029394 - DNA, 22 bp, Homo sapiens
ggctgggcctctccctcagctg

SEQ ID NO: 9029395 - DNA, 22 bp, Homo sapiens
ggctgggcctctccctcagctg

SEQ ID NO: 9029396 - DNA, 22 bp, Homo sapiens
ggctgggcctctccctcagctg

SEQ ID NO: 9029397 - DNA, 22 bp, Homo sapiens
ggctgggcctctccctcagctg

SEQ ID NO: 9029398 - DNA, 22 bp, Homo sapiens
ggctgggccgcggctacccaga

SEQ ID NO: 9029399 - DNA, 22 bp, Homo sapiens
ggctgggccgcggctacccaga

SEQ ID NO: 9029400 - DNA, 19 bp, Homo sapiens
ggctgggccctgtttctcc

SEQ ID NO: 9029401 - DNA, 22 bp, Homo sapiens
ggctgggccgcggctacccaga

SEQ ID NO: 9029402 - DNA, 22 bp, Homo sapiens
ggctgggccgcggctacccaga

SEQ ID NO: 9029403 - DNA, 22 bp, Homo sapiens
ggctgggccgcggctacccaga

SEQ ID NO: 9029404 - DNA, 18 bp, Homo sapiens
ggcttctgggacatttta

SEQ ID NO: 9029405 - DNA, 22 bp, Homo sapiens
ggcttctggtgggagcatgact

SEQ ID NO: 9029406 - DNA, 22 bp, Homo sapiens
ggcttctgtcctctggatctgt

SEQ ID NO: 9029407 - DNA, 22 bp, Homo sapiens
ggcttctgctcagcctgcacgc

SEQ ID NO: 9029408 - DNA, 22 bp, Homo sapiens
ggcttctgctcagcctgcacgc

SEQ ID NO: 9029409 - DNA, 22 bp, Homo sapiens
ggcttctgctcagcctgcacgc

SEQ ID NO: 9029410 - DNA, 22 bp, Homo sapiens
ggcttctgccttgccagttctt

SEQ ID NO: 9029411 - DNA, 22 bp, Homo sapiens
ggcttctgccttgccagttctt

SEQ ID NO: 9029412 - DNA, 22 bp, Homo sapiens
ggcttctgctcagcctgcacgc

SEQ ID NO: 9029413 - DNA, 22 bp, Homo sapiens
ggcttctgccacgagagggaag

SEQ ID NO: 9029414 - DNA, 22 bp, Homo sapiens
ggcttctcgtgccgaagcaaga

SEQ ID NO: 9029415 - DNA, 22 bp, Homo sapiens
ggcttctctgtctagtttctac

SEQ ID NO: 9029416 - DNA, 22 bp, Homo sapiens
ggcttctgaaatctctgtgcgt

SEQ ID NO: 9029417 - DNA, 22 bp, Homo sapiens
ggcttctgaaccaggccctgga

SEQ ID NO: 9029418 - DNA, 22 bp, Homo sapiens
ggcttctgaaccaggccctgga

SEQ ID NO: 9029419 - DNA, 22 bp, Homo sapiens
ggcttctgaaccaggccctgga

SEQ ID NO: 9029420 - DNA, 22 bp, Homo sapiens
ggcttctgagtgctctgctgtt

SEQ ID NO: 9029421 - DNA, 22 bp, Homo sapiens
ggctgggctgctgggtcagagc

SEQ ID NO: 9029422 - DNA, 22 bp, Homo sapiens
ggctgggctgctgggtcagagc

SEQ ID NO: 9029423 - DNA, 22 bp, Homo sapiens
ggctgggctgctgggtcagagc

SEQ ID NO: 9029424 - DNA, 22 bp, Homo sapiens
ggctgggctgctgggtcagagc

SEQ ID NO: 9029425 - DNA, 22 bp, Homo sapiens
ggctgggctgctgggtcagagc

SEQ ID NO: 9029426 - DNA, 22 bp, Homo sapiens
ggcttctccaggtactgagcat

SEQ ID NO: 9029427 - DNA, 22 bp, Homo sapiens
ggctgggctgcggctgtacctg

SEQ ID NO: 9029428 - DNA, 22 bp, Homo sapiens
ggctgggctgcggctgtacctg

SEQ ID NO: 9029429 - DNA, 22 bp, Homo sapiens
ggctgggctcgctgattggctg

SEQ ID NO: 9029430 - DNA, 22 bp, Homo sapiens
ggctgggctgctgggtcagagc

SEQ ID NO: 9029431 - DNA, 22 bp, Homo sapiens
ggctgggctgctgggtcagagc

SEQ ID NO: 9029432 - DNA, 22 bp, Homo sapiens
ggctgggctgcggctgtacctg

SEQ ID NO: 9029433 - DNA, 22 bp, Homo sapiens
ggctgggctgcggctgtacctg

SEQ ID NO: 9029434 - DNA, 22 bp, Homo sapiens
ggcttctcccctttgagtcttc

SEQ ID NO: 9029435 - DNA, 22 bp, Homo sapiens
ggcttctctaaagatcatgcgt

SEQ ID NO: 9029436 - DNA, 22 bp, Homo sapiens
ggcttctctcttcacatggctt

SEQ ID NO: 9029437 - DNA, 22 bp, Homo sapiens
ggctgctggcctctccccggcc

SEQ ID NO: 9029438 - DNA, 22 bp, Homo sapiens
ggctgctgggaatatgccagct

SEQ ID NO: 9029439 - DNA, 22 bp, Homo sapiens
ggctgctggccagcctaggagt

SEQ ID NO: 9029440 - DNA, 22 bp, Homo sapiens
ggctgctggccagcctaggagt

SEQ ID NO: 9029441 - DNA, 22 bp, Homo sapiens
ggctgctgggaatatgccagct

SEQ ID NO: 9029442 - DNA, 22 bp, Homo sapiens
ggctgctgggaatatgccagct

SEQ ID NO: 9029443 - DNA, 22 bp, Homo sapiens
ggctgctgggaatatgccagct

SEQ ID NO: 9029444 - DNA, 22 bp, Homo sapiens
ggctgctggagttgggtctctc

SEQ ID NO: 9029445 - DNA, 22 bp, Homo sapiens
ggctgctggagttgggtctctc

SEQ ID NO: 9029446 - DNA, 22 bp, Homo sapiens
ggctgctggattgtgtatctgt

SEQ ID NO: 9029447 - DNA, 22 bp, Homo sapiens
ggctgctggcagatgtagttta

SEQ ID NO: 9029448 - DNA, 22 bp, Homo sapiens
ggctgctggcattgaggtaggt

SEQ ID NO: 9029449 - DNA, 22 bp, Homo sapiens
ggctgctggcattgaggtaggt

SEQ ID NO: 9029450 - DNA, 22 bp, Homo sapiens
ggctgggaggccgtgctgacct

SEQ ID NO: 9029451 - DNA, 22 bp, Homo sapiens
ggctgggaggccgtgctgacct

SEQ ID NO: 9029452 - DNA, 22 bp, Homo sapiens
ggctgggaggccgtgctgacct

SEQ ID NO: 9029453 - DNA, 22 bp, Homo sapiens
ggctgggcaaacaagactcttc

SEQ ID NO: 9029454 - DNA, 22 bp, Homo sapiens
ggctgggaggccgtgctgacct

SEQ ID NO: 9029455 - DNA, 22 bp, Homo sapiens
ggctgggaggccgtgctgacct

SEQ ID NO: 9029456 - DNA, 21 bp, Homo sapiens
ggctgctgggagagctgcgtg

SEQ ID NO: 9029457 - DNA, 22 bp, Homo sapiens
ggctgggaggccgtgctgacct

SEQ ID NO: 9029458 - DNA, 22 bp, Homo sapiens
ggctgggcaaacaagactcttc

SEQ ID NO: 9029459 - DNA, 22 bp, Homo sapiens
ggctgggcaaacaagactcttc

SEQ ID NO: 9029460 - DNA, 22 bp, Homo sapiens
ggctgggcaaacaagactcttc

SEQ ID NO: 9029461 - DNA, 22 bp, Homo sapiens
ggctgggcagcagctgttaagc

SEQ ID NO: 9029462 - DNA, 22 bp, Homo sapiens
ggctgggcagcagctgttaagc

SEQ ID NO: 9029463 - DNA, 22 bp, Homo sapiens
ggctgggcagcagctgttaagc

SEQ ID NO: 9029464 - DNA, 22 bp, Homo sapiens
ggctgggcaaacaagactcttc

SEQ ID NO: 9029465 - DNA, 22 bp, Homo sapiens
ggctggcttgcggagtcacaga

SEQ ID NO: 9029466 - DNA, 21 bp, Homo sapiens
ggctgctgggagagctgcgtg

SEQ ID NO: 9029467 - DNA, 21 bp, Homo sapiens
ggctgctgggagagctgcgtg

SEQ ID NO: 9029468 - DNA, 22 bp, Homo sapiens
ggctggcttggtgagctgtcac

SEQ ID NO: 9029469 - DNA, 22 bp, Homo sapiens
ggctggcttggtgagctgtcac

SEQ ID NO: 9029470 - DNA, 22 bp, Homo sapiens
ggctggcttggtgagctgtcac

SEQ ID NO: 9029471 - DNA, 22 bp, Homo sapiens
ggctggcttggtgagctgtcac

SEQ ID NO: 9029472 - DNA, 22 bp, Homo sapiens
ggctggcttgcggagtcacaga

SEQ ID NO: 9029473 - DNA, 22 bp, Homo sapiens
ggctgctgccctcctaagtgca

SEQ ID NO: 9029474 - DNA, 22 bp, Homo sapiens
ggctgctgccctcctaagtgca

SEQ ID NO: 9029475 - DNA, 22 bp, Homo sapiens
ggctgctgcccacccctgcatg

SEQ ID NO: 9029476 - DNA, 22 bp, Homo sapiens
ggctgctgcccacccctgcatg

SEQ ID NO: 9029477 - DNA, 22 bp, Homo sapiens
ggctgctgcccacccctgcatg

SEQ ID NO: 9029478 - DNA, 22 bp, Homo sapiens
ggctgctgcccacccctgcatg

SEQ ID NO: 9029479 - DNA, 22 bp, Homo sapiens
ggctgctggaagactgaacaag

SEQ ID NO: 9029480 - DNA, 22 bp, Homo sapiens
ggctgctgctgtgtaggcctgt

SEQ ID NO: 9029481 - DNA, 22 bp, Homo sapiens
ggctgctgctgtgtaggcctgt

SEQ ID NO: 9029482 - DNA, 22 bp, Homo sapiens
ggctgctgagtcacgacagtga

SEQ ID NO: 9029483 - DNA, 22 bp, Homo sapiens
ggctgctgacttcatccagctt

SEQ ID NO: 9029484 - DNA, 22 bp, Homo sapiens
ggctgctgagtcacgacagtga

SEQ ID NO: 9029485 - DNA, 22 bp, Homo sapiens
ggctgctgagttggccaggaga

SEQ ID NO: 9029486 - DNA, 22 bp, Homo sapiens
ggctgctgagttggccaggaga

SEQ ID NO: 9029487 - DNA, 22 bp, Homo sapiens
ggctgctgagttggccaggaga

SEQ ID NO: 9029488 - DNA, 22 bp, Homo sapiens
ggctgctgagttggccaggaga

SEQ ID NO: 9029489 - DNA, 22 bp, Homo sapiens
ggctgagcactttaggcaggag

SEQ ID NO: 9029490 - DNA, 22 bp, Homo sapiens
ggctgagcactttaggcaggag

SEQ ID NO: 9029491 - DNA, 22 bp, Homo sapiens
ggctgagcactttaggcaggag

SEQ ID NO: 9029492 - DNA, 22 bp, Homo sapiens
ggctgctgacttcatccagctt

SEQ ID NO: 9029493 - DNA, 22 bp, Homo sapiens
ggctgctgacttcatccagctt

SEQ ID NO: 9029494 - DNA, 22 bp, Homo sapiens
ggctgctgacaaacatgatcat

SEQ ID NO: 9029495 - DNA, 22 bp, Homo sapiens
ggctgagcactttaggcaggag

SEQ ID NO: 9029496 - DNA, 22 bp, Homo sapiens
ggctgagcaattttgatgacat

SEQ ID NO: 9029497 - DNA, 22 bp, Homo sapiens
ggctgagcaattttgatgacat

SEQ ID NO: 9029498 - DNA, 22 bp, Homo sapiens
ggctccagatgtctcctggcaa

SEQ ID NO: 9029499 - DNA, 22 bp, Homo sapiens
ggctccagatgtctcctggcaa

SEQ ID NO: 9029500 - DNA, 22 bp, Homo sapiens
ggctccagatgtctcctggcaa

SEQ ID NO: 9029501 - DNA, 22 bp, Homo sapiens
ggctccagatgtctcctggcaa

SEQ ID NO: 9029502 - DNA, 22 bp, Homo sapiens
ggctccagatgtctcctggcaa

SEQ ID NO: 9029503 - DNA, 22 bp, Homo sapiens
ggctccagccctggctcttcac

SEQ ID NO: 9029504 - DNA, 22 bp, Homo sapiens
ggctccagccctggctcttcac

SEQ ID NO: 9029505 - DNA, 22 bp, Homo sapiens
ggctccagctaatggtttctat

SEQ ID NO: 9029506 - DNA, 22 bp, Homo sapiens
ggctccagctaatggtttctat

SEQ ID NO: 9029507 - DNA, 22 bp, Homo sapiens
ggctccaggagatgctgggcag

SEQ ID NO: 9029508 - DNA, 18 bp, Homo sapiens
ggctccaggacctaccca

SEQ ID NO: 9029509 - DNA, 22 bp, Homo sapiens
ggctccaggagatgctgggcag

SEQ ID NO: 9029510 - DNA, 22 bp, Homo sapiens
ggctccaggagatgctgggcag

SEQ ID NO: 9029511 - DNA, 22 bp, Homo sapiens
ggctccaggagatgctgggcag

SEQ ID NO: 9029512 - DNA, 18 bp, Homo sapiens
ggctccaggacctaccca

SEQ ID NO: 9029513 - DNA, 18 bp, Homo sapiens
ggctccaggacctaccca

SEQ ID NO: 9029514 - DNA, 18 bp, Homo sapiens
ggctccaggacctaccca

SEQ ID NO: 9029515 - DNA, 18 bp, Homo sapiens
ggctccaggacctaccca

SEQ ID NO: 9029516 - DNA, 22 bp, Homo sapiens
ggctccaggaacctcctctcct

SEQ ID NO: 9029517 - DNA, 22 bp, Homo sapiens
ggctccaggaacctcctctcct

SEQ ID NO: 9029518 - DNA, 22 bp, Homo sapiens
ggctccaggaacctcctctcct

SEQ ID NO: 9029519 - DNA, 18 bp, Homo sapiens
ggctccaggacctaccca

SEQ ID NO: 9029520 - DNA, 22 bp, Homo sapiens
ggctccagctaatggtttctat

SEQ ID NO: 9029521 - DNA, 22 bp, Homo sapiens
ggctccaggaacctcctctcct

SEQ ID NO: 9029522 - DNA, 22 bp, Homo sapiens
ggctccaggaacctcctctcct

SEQ ID NO: 9029523 - DNA, 22 bp, Homo sapiens
ggctccaggagatgctgggcag

SEQ ID NO: 9029524 - DNA, 22 bp, Homo sapiens
ggctccaggagatgctgggcag

SEQ ID NO: 9029525 - DNA, 22 bp, Homo sapiens
ggctccaggagatgctgggcag

SEQ ID NO: 9029526 - DNA, 22 bp, Homo sapiens
ggctccaggagggccttggcca

SEQ ID NO: 9029527 - DNA, 22 bp, Homo sapiens
ggctccaggagggccttggcca

SEQ ID NO: 9029528 - DNA, 22 bp, Homo sapiens
ggctccaggagggccttggcca

SEQ ID NO: 9029529 - DNA, 22 bp, Homo sapiens
ggctccaggagggccttggcca

SEQ ID NO: 9029530 - DNA, 22 bp, Homo sapiens
ggctccaggagggccttggcca

SEQ ID NO: 9029531 - DNA, 22 bp, Homo sapiens
ggctccaggagggccttggcca

SEQ ID NO: 9029532 - DNA, 22 bp, Homo sapiens
ggctccaggagggccttggcca

SEQ ID NO: 9029533 - DNA, 23 bp, Homo sapiens
ggctccaggcctgacgggcgcgg

SEQ ID NO: 9029534 - DNA, 23 bp, Homo sapiens
ggctccaggcctgacgggcgcgg

SEQ ID NO: 9029535 - DNA, 22 bp, Homo sapiens
ggctccaggagggccttggcca

SEQ ID NO: 9029536 - DNA, 22 bp, Homo sapiens
ggctctgctcctggtgccagtg

SEQ ID NO: 9029537 - DNA, 22 bp, Homo sapiens
ggctctggaatgtgtagtcagg

SEQ ID NO: 9029538 - DNA, 22 bp, Homo sapiens
ggctctggaatgtgtagtcagg

SEQ ID NO: 9029539 - DNA, 22 bp, Homo sapiens
ggctctggagacatgtggagag

SEQ ID NO: 9029540 - DNA, 22 bp, Homo sapiens
ggctccagatgtcccctggcaa

SEQ ID NO: 9029541 - DNA, 22 bp, Homo sapiens
ggctccagatgtcccctggcaa

SEQ ID NO: 9029542 - DNA, 22 bp, Homo sapiens
ggctccagatgtctcctggcaa

SEQ ID NO: 9029543 - DNA, 22 bp, Homo sapiens
ggctccagatgtctcctggcaa

SEQ ID NO: 9029544 - DNA, 22 bp, Homo sapiens
ggctccagatgtcccctggcaa

SEQ ID NO: 9029545 - DNA, 22 bp, Homo sapiens
ggctccagatgtcccctggcaa

SEQ ID NO: 9029546 - DNA, 22 bp, Homo sapiens
ggctccagatgtcccctggcaa

SEQ ID NO: 9029547 - DNA, 22 bp, Homo sapiens
ggctccagatgtcccctggcaa

SEQ ID NO: 9029548 - DNA, 22 bp, Homo sapiens
ggctccagatgtcccctggcaa

SEQ ID NO: 9029549 - DNA, 22 bp, Homo sapiens
ggctccagaggccttacctgca

SEQ ID NO: 9029550 - DNA, 22 bp, Homo sapiens
ggctccagaggccttacctgca

SEQ ID NO: 9029551 - DNA, 22 bp, Homo sapiens
ggctccagaggccttacctgca

SEQ ID NO: 9029552 - DNA, 16 bp, Homo sapiens
ggctccagaatagcga

SEQ ID NO: 9029553 - DNA, 22 bp, Homo sapiens
ggctccagaggccttacctgca

SEQ ID NO: 9029554 - DNA, 22 bp, Homo sapiens
ggctccagaaacttcagtccat

SEQ ID NO: 9029555 - DNA, 22 bp, Homo sapiens
ggctccagaaatcatagagcag

SEQ ID NO: 9029556 - DNA, 22 bp, Homo sapiens
ggctccagaaatcatagagcag

SEQ ID NO: 9029557 - DNA, 22 bp, Homo sapiens
ggctccagaaatcatagagcag

SEQ ID NO: 9029558 - DNA, 16 bp, Homo sapiens
ggctccagaatagcga

SEQ ID NO: 9029559 - DNA, 22 bp, Homo sapiens
ggctccactgctgaccactcca

SEQ ID NO: 9029560 - DNA, 22 bp, Homo sapiens
ggctccaccctgcttccagaag

SEQ ID NO: 9029561 - DNA, 22 bp, Homo sapiens
ggctccaccctgcttccagaag

SEQ ID NO: 9029562 - DNA, 22 bp, Homo sapiens
ggctccagaaacttcagtccat

SEQ ID NO: 9029563 - DNA, 22 bp, Homo sapiens
ggctccagaaacttcagtccat

SEQ ID NO: 9029564 - DNA, 22 bp, Homo sapiens
ggctccagaaacttcagtccat

SEQ ID NO: 9029565 - DNA, 22 bp, Homo sapiens
ggctccagaaacttcagtccat

SEQ ID NO: 9029566 - DNA, 21 bp, Homo sapiens
ggcggcgcagagctgcggctc

SEQ ID NO: 9029567 - DNA, 22 bp, Homo sapiens
ggcggccgcagctcttgctctg

SEQ ID NO: 9029568 - DNA, 22 bp, Homo sapiens
ggcgctgtcgtgagctcgcccg

SEQ ID NO: 9029569 - DNA, 22 bp, Homo sapiens
ggcggagcttgcagtgagccga

SEQ ID NO: 9029570 - DNA, 22 bp, Homo sapiens
ggcggaggttgcagtaagccga

SEQ ID NO: 9029571 - DNA, 22 bp, Homo sapiens
ggcgggaagttcttgcccactt

SEQ ID NO: 9029572 - DNA, 22 bp, Homo sapiens
ggcgggaagttcttgcccactt

SEQ ID NO: 9029573 - DNA, 22 bp, Homo sapiens
ggcggctactcctcctggtgag

SEQ ID NO: 9029574 - DNA, 22 bp, Homo sapiens
ggctccaccctgcttccagaag

SEQ ID NO: 9029575 - DNA, 22 bp, Homo sapiens
ggcgggcagatgcggacacgcg

SEQ ID NO: 9029576 - DNA, 22 bp, Homo sapiens
ggcgggaggctgaggagttggt

SEQ ID NO: 9029577 - DNA, 22 bp, Homo sapiens
ggcgggaggctgaggagttggt

SEQ ID NO: 9029578 - DNA, 22 bp, Homo sapiens
ggcgggaggctgaggagttggt

SEQ ID NO: 9029579 - DNA, 22 bp, Homo sapiens
ggcgggagcagcagctctgagc

SEQ ID NO: 9029580 - DNA, 22 bp, Homo sapiens
ggctctggagacatgtggagag

SEQ ID NO: 9029581 - DNA, 22 bp, Homo sapiens
ggctctggagacatgtggagag

SEQ ID NO: 9029582 - DNA, 22 bp, Homo sapiens
ggctctggagacatgtggagag

SEQ ID NO: 9029583 - DNA, 22 bp, Homo sapiens
ggctctggagacatgtggagag

SEQ ID NO: 9029584 - DNA, 22 bp, Homo sapiens
ggctctggagatgtccgacctg

SEQ ID NO: 9029585 - DNA, 22 bp, Homo sapiens
ggctctggagacatgtggagag

SEQ ID NO: 9029586 - DNA, 22 bp, Homo sapiens
ggctctggagcacagacgtctg

SEQ ID NO: 9029587 - DNA, 22 bp, Homo sapiens
ggctctggagcacagacgtctg

SEQ ID NO: 9029588 - DNA, 22 bp, Homo sapiens
ggctctggagatgtccgacctg

SEQ ID NO: 9029589 - DNA, 22 bp, Homo sapiens
ggctctggagatgtccgacctg

SEQ ID NO: 9029590 - DNA, 22 bp, Homo sapiens
ggctctggagcacagacgtctg

SEQ ID NO: 9029591 - DNA, 22 bp, Homo sapiens
ggctctggagatgtccgacctg

SEQ ID NO: 9029592 - DNA, 22 bp, Homo sapiens
ggctctggcaaggggaggctac

SEQ ID NO: 9029593 - DNA, 22 bp, Homo sapiens
ggctctggcaaggggaggctac

SEQ ID NO: 9029594 - DNA, 22 bp, Homo sapiens
ggctctggagcacagacgtctg

SEQ ID NO: 9029595 - DNA, 22 bp, Homo sapiens
ggctctggagcacagacgtctg

SEQ ID NO: 9029596 - DNA, 22 bp, Homo sapiens
ggctctggagcacagacgtctg

SEQ ID NO: 9029597 - DNA, 22 bp, Homo sapiens
ggctctggcaaggggaggctac

SEQ ID NO: 9029598 - DNA, 22 bp, Homo sapiens
ggctctggcgagctttagtaca

SEQ ID NO: 9029599 - DNA, 22 bp, Homo sapiens
ggctctggcaaggggaggctac

SEQ ID NO: 9029600 - DNA, 22 bp, Homo sapiens
ggctctggcggctctttcaata

SEQ ID NO: 9029601 - DNA, 19 bp, Homo sapiens
ggctctggcggctgtagcc

SEQ ID NO: 9029602 - DNA, 19 bp, Homo sapiens
ggctctggcggctgtagcc

SEQ ID NO: 9029603 - DNA, 22 bp, Homo sapiens
ggctctggcggctctttcaata

SEQ ID NO: 9029604 - DNA, 19 bp, Homo sapiens
ggctctggcggctgtagcc

SEQ ID NO: 9029605 - DNA, 19 bp, Homo sapiens
ggctctggcggctgtagcc

SEQ ID NO: 9029606 - DNA, 19 bp, Homo sapiens
ggctctggcggctgtagcc

SEQ ID NO: 9029607 - DNA, 22 bp, Homo sapiens
ggctctggcgtccaatggagcg

SEQ ID NO: 9029608 - DNA, 22 bp, Homo sapiens
ggctctggcgtccaatggagcg

SEQ ID NO: 9029609 - DNA, 22 bp, Homo sapiens
ggctctggcgtccaatggagcg

SEQ ID NO: 9029610 - DNA, 22 bp, Homo sapiens
ggctctggctactccaccctgt

SEQ ID NO: 9029611 - DNA, 22 bp, Homo sapiens
ggctctggctactccaccctgt

SEQ ID NO: 9029612 - DNA, 22 bp, Homo sapiens
ggctctggcgtccaatggagcg

SEQ ID NO: 9029613 - DNA, 22 bp, Homo sapiens
ggctctggctcctggctttgtg

SEQ ID NO: 9029614 - DNA, 22 bp, Homo sapiens
ggctctggctcctggctttgtg

SEQ ID NO: 9029615 - DNA, 22 bp, Homo sapiens
ggctctggctactccaccctgt

SEQ ID NO: 9029616 - DNA, 22 bp, Homo sapiens
ggctctgggcatagaaggaagc

SEQ ID NO: 9029617 - DNA, 22 bp, Homo sapiens
ggctctgggccagagttggctt

SEQ ID NO: 9029618 - DNA, 22 bp, Homo sapiens
ggctgaaaggtagtagtaggct

SEQ ID NO: 9029619 - DNA, 22 bp, Homo sapiens
ggctgaagaactgggagtctca

SEQ ID NO: 9029620 - DNA, 22 bp, Homo sapiens
ggctgaaggatgaaagctgcag

SEQ ID NO: 9029621 - DNA, 22 bp, Homo sapiens
ggctgaagaactgggagtctca

SEQ ID NO: 9029622 - DNA, 22 bp, Homo sapiens
ggctctgggccagagttggctt

SEQ ID NO: 9029623 - DNA, 22 bp, Homo sapiens
ggctcttgggagctcagagttg

SEQ ID NO: 9029624 - DNA, 23 bp, Homo sapiens
ggctgagaagtcccatgataggt

SEQ ID NO: 9029625 - DNA, 22 bp, Homo sapiens
ggctgagacaacctgggaccca

SEQ ID NO: 9029626 - DNA, 22 bp, Homo sapiens
ggctgagacaacctgggaccca

SEQ ID NO: 9029627 - DNA, 22 bp, Homo sapiens
ggctgagactagagtgaggcat

SEQ ID NO: 9029628 - DNA, 22 bp, Homo sapiens
ggctgagactagagtgaggcat

SEQ ID NO: 9029629 - DNA, 22 bp, Homo sapiens
ggctgagactagagtgaggcat

SEQ ID NO: 9029630 - DNA, 22 bp, Homo sapiens
ggctgagactagagtgaggcat

SEQ ID NO: 9029631 - DNA, 22 bp, Homo sapiens
ggctgagactagagtgaggcat

SEQ ID NO: 9029632 - DNA, 22 bp, Homo sapiens
ggctgagactagagtgaggcat

SEQ ID NO: 9029633 - DNA, 22 bp, Homo sapiens
ggctgaagtgtagtggctcact

SEQ ID NO: 9029634 - DNA, 22 bp, Homo sapiens
ggctgaagttctttttgttcag

SEQ ID NO: 9029635 - DNA, 22 bp, Homo sapiens
ggctgaagtgtagtggctcact

SEQ ID NO: 9029636 - DNA, 22 bp, Homo sapiens
ggctgaaggatgaaagctgcag

SEQ ID NO: 9029637 - DNA, 22 bp, Homo sapiens
ggctgaaggaactttttccatg

SEQ ID NO: 9029638 - DNA, 22 bp, Homo sapiens
ggctgaagtgtagtggctcact

SEQ ID NO: 9029639 - DNA, 22 bp, Homo sapiens
ggctgaagtgtagtggctcact

SEQ ID NO: 9029640 - DNA, 22 bp, Homo sapiens
ggctgagaagacagtggggtgg

SEQ ID NO: 9029641 - DNA, 22 bp, Homo sapiens
ggctgagaaggagtgggtgagg

SEQ ID NO: 9029642 - DNA, 23 bp, Homo sapiens
gggcagcttaagcttgtttttct

SEQ ID NO: 9029643 - DNA, 22 bp, Homo sapiens
gggcagctgtcttggttctcaa

SEQ ID NO: 9029644 - DNA, 22 bp, Homo sapiens
gggcagctgtatctgagcttat

SEQ ID NO: 9029645 - DNA, 22 bp, Homo sapiens
gggcagctggatagttttaaat

SEQ ID NO: 9029646 - DNA, 22 bp, Homo sapiens
gggcagctgcccctctctgggc

SEQ ID NO: 9029647 - DNA, 22 bp, Homo sapiens
gggcagctggcttataggtttg

SEQ ID NO: 9029648 - DNA, 22 bp, Homo sapiens
gggcagctggccaggtattctg

SEQ ID NO: 9029649 - DNA, 22 bp, Homo sapiens
gggcagctgccagaggccatgg

SEQ ID NO: 9029650 - DNA, 22 bp, Homo sapiens
gggcagctgccagaggccatgg

SEQ ID NO: 9029651 - DNA, 22 bp, Homo sapiens
gggcagctgcccctctctgggc

SEQ ID NO: 9029652 - DNA, 22 bp, Homo sapiens
gggcagctgccactccgcttgc

SEQ ID NO: 9029653 - DNA, 22 bp, Homo sapiens
gggcagctgccaagtgcatcgc

SEQ ID NO: 9029654 - DNA, 22 bp, Homo sapiens
gggcagctgcagggatggtgac

SEQ ID NO: 9029655 - DNA, 22 bp, Homo sapiens
gggcagctctggctgtgggaag

SEQ ID NO: 9029656 - DNA, 22 bp, Homo sapiens
gggcagctctggctgtgggaag

SEQ ID NO: 9029657 - DNA, 22 bp, Homo sapiens
gggcagctctggctgtgggaag

SEQ ID NO: 9029658 - DNA, 22 bp, Homo sapiens
gggcagctctgcccatcagagg

SEQ ID NO: 9029659 - DNA, 22 bp, Homo sapiens
gggcagctctgcccatcagagg

SEQ ID NO: 9029660 - DNA, 22 bp, Homo sapiens
gggcagctctttggtatccttc

SEQ ID NO: 9029661 - DNA, 21 bp, Homo sapiens
gggcagctctgttttattttc

SEQ ID NO: 9029662 - DNA, 22 bp, Homo sapiens
gggcagctgcagggatggtgac

SEQ ID NO: 9029663 - DNA, 22 bp, Homo sapiens
gggcacagctgctacccagtgc

SEQ ID NO: 9029664 - DNA, 22 bp, Homo sapiens
gggcacagctgctacccagtgc

SEQ ID NO: 9029665 - DNA, 22 bp, Homo sapiens
gggcacaggaatttgggatgtg

SEQ ID NO: 9029666 - DNA, 22 bp, Homo sapiens
gggcacaggaatttgggatgtg

SEQ ID NO: 9029667 - DNA, 22 bp, Homo sapiens
gggcacaggaatttgggatgtg

SEQ ID NO: 9029668 - DNA, 22 bp, Homo sapiens
gggcacaggaatttgggatgtg

SEQ ID NO: 9029669 - DNA, 22 bp, Homo sapiens
gggcacaggaatttgggatgtg

SEQ ID NO: 9029670 - DNA, 22 bp, Homo sapiens
gggcacaggaatttgggatgtg

SEQ ID NO: 9029671 - DNA, 22 bp, Homo sapiens
gggcacaggaatttgggatgtg

SEQ ID NO: 9029672 - DNA, 22 bp, Homo sapiens
gggcacaggagaaggatctggc

SEQ ID NO: 9029673 - DNA, 22 bp, Homo sapiens
gggcacaggagaaggatctggc

SEQ ID NO: 9029674 - DNA, 22 bp, Homo sapiens
gggcacaggagaaggatctggc

SEQ ID NO: 9029675 - DNA, 22 bp, Homo sapiens
gggcaggatgcagtttcagaga

SEQ ID NO: 9029676 - DNA, 22 bp, Homo sapiens
gggcaggctgagcatgtcacct

SEQ ID NO: 9029677 - DNA, 22 bp, Homo sapiens
gggcaggctgagcatgtcacct

SEQ ID NO: 9029678 - DNA, 22 bp, Homo sapiens
gggcaggaggctaattctgcat

SEQ ID NO: 9029679 - DNA, 22 bp, Homo sapiens
gggcatgcctgcgcagtgcatg

SEQ ID NO: 9029680 - DNA, 22 bp, Homo sapiens
gggcaggctgagcatgtcacct

SEQ ID NO: 9029681 - DNA, 22 bp, Homo sapiens
gggcaggctgagcatgtcacct

SEQ ID NO: 9029682 - DNA, 23 bp, Homo sapiens
gggcatggagtgtaggtggaagg

SEQ ID NO: 9029683 - DNA, 22 bp, Homo sapiens
gggcatggaggtctgtctgcag

SEQ ID NO: 9029684 - DNA, 22 bp, Homo sapiens
gggcatggaggtctgtctgcag

SEQ ID NO: 9029685 - DNA, 23 bp, Homo sapiens
gggcatggagtgtaggtggaagg

SEQ ID NO: 9029686 - DNA, 23 bp, Homo sapiens
gggcatggagtgtaggtggaagg

SEQ ID NO: 9029687 - DNA, 23 bp, Homo sapiens
gggcatggagtgtaggtggaagg

SEQ ID NO: 9029688 - DNA, 23 bp, Homo sapiens
gggcatggagtgtaggtggaagg

SEQ ID NO: 9029689 - DNA, 19 bp, Homo sapiens
gggcatggatgagcttacc

SEQ ID NO: 9029690 - DNA, 19 bp, Homo sapiens
gggcatggatgagcttacc

SEQ ID NO: 9029691 - DNA, 19 bp, Homo sapiens
gggcatggatgagcttacc

SEQ ID NO: 9029692 - DNA, 18 bp, Homo sapiens
gggcatggatgcagcatc

SEQ ID NO: 9029693 - DNA, 18 bp, Homo sapiens
gggcatggatgcagcatc

SEQ ID NO: 9029694 - DNA, 18 bp, Homo sapiens
gggcatggatgcagcatc

SEQ ID NO: 9029695 - DNA, 22 bp, Homo sapiens
gggcaggagagggccacctgga

SEQ ID NO: 9029696 - DNA, 22 bp, Homo sapiens
gggcaggagagaacagtcatgg

SEQ ID NO: 9029697 - DNA, 22 bp, Homo sapiens
gggcaggagagaacagtcatgg

SEQ ID NO: 9029698 - DNA, 22 bp, Homo sapiens
gggcaggagagaacagtcatgg

SEQ ID NO: 9029699 - DNA, 22 bp, Homo sapiens
gggcaggagagaacagtcatgg

SEQ ID NO: 9029700 - DNA, 22 bp, Homo sapiens
gggcaggaggctaattctgcat

SEQ ID NO: 9029701 - DNA, 22 bp, Homo sapiens
gggcaggagagggccacctgga

SEQ ID NO: 9029702 - DNA, 22 bp, Homo sapiens
gggcaggagagggccacctgga

SEQ ID NO: 9029703 - DNA, 22 bp, Homo sapiens
gggcaggagagggccacctgga

SEQ ID NO: 9029704 - DNA, 22 bp, Homo sapiens
gggcaggagaaggtggatgtcc

SEQ ID NO: 9029705 - DNA, 22 bp, Homo sapiens
gggcaggagaaggtggatgtcc

SEQ ID NO: 9029706 - DNA, 22 bp, Homo sapiens
gggcaggagaaggtggatgtcc

SEQ ID NO: 9029707 - DNA, 22 bp, Homo sapiens
gggcaggaacaaatcaaatgat

SEQ ID NO: 9029708 - DNA, 16 bp, Homo sapiens
gggcaggaatcagggt

SEQ ID NO: 9029709 - DNA, 16 bp, Homo sapiens
gggcaggaatcagggt

SEQ ID NO: 9029710 - DNA, 22 bp, Homo sapiens
gggcaggagaaggtggatgtcc

SEQ ID NO: 9029711 - DNA, 22 bp, Homo sapiens
gggcaggagaaggtggatgtcc

SEQ ID NO: 9029712 - DNA, 22 bp, Homo sapiens
gggcaggagaaggtggatgtcc

SEQ ID NO: 9029713 - DNA, 22 bp, Homo sapiens
gggcaggagaaggtggatgtcc

SEQ ID NO: 9029714 - DNA, 22 bp, Homo sapiens
gggcaggagaaggtggatgtcc

SEQ ID NO: 9029715 - DNA, 22 bp, Homo sapiens
gggcaggagagaacagtcatgg

SEQ ID NO: 9029716 - DNA, 22 bp, Homo sapiens
gggatggggagctggaaagggg

SEQ ID NO: 9029717 - DNA, 22 bp, Homo sapiens
gggatggggagctggaaagggg

SEQ ID NO: 9029718 - DNA, 22 bp, Homo sapiens
gggaggagcttggagattcact

SEQ ID NO: 9029719 - DNA, 22 bp, Homo sapiens
gggaggagcttggagattcact

SEQ ID NO: 9029720 - DNA, 22 bp, Homo sapiens
gggaggagctgagtgtgtgtgc

SEQ ID NO: 9029721 - DNA, 22 bp, Homo sapiens
gggaggagcttggagattcact

SEQ ID NO: 9029722 - DNA, 22 bp, Homo sapiens
gggaggagctgagtgtgtgtgc

SEQ ID NO: 9029723 - DNA, 22 bp, Homo sapiens
gggaggacggtccagggcaaag

SEQ ID NO: 9029724 - DNA, 22 bp, Homo sapiens
gggaggacggtccagggcaaag

SEQ ID NO: 9029725 - DNA, 22 bp, Homo sapiens
gggaggagctgagtgtgtgtgc

SEQ ID NO: 9029726 - DNA, 22 bp, Homo sapiens
gggaggagctgagtgtgtgtgc

SEQ ID NO: 9029727 - DNA, 22 bp, Homo sapiens
gggaggagctgagtgtgtgtgc

SEQ ID NO: 9029728 - DNA, 22 bp, Homo sapiens
gggatggggggaagcgtccatg

SEQ ID NO: 9029729 - DNA, 22 bp, Homo sapiens
gggatggggagctggaaagggg

SEQ ID NO: 9029730 - DNA, 22 bp, Homo sapiens
gggatggggggaagcgtccatg

SEQ ID NO: 9029731 - DNA, 22 bp, Homo sapiens
gggatggggggaagcgtccatg

SEQ ID NO: 9029732 - DNA, 22 bp, Homo sapiens
gggatggggggaagcgtccatg

SEQ ID NO: 9029733 - DNA, 22 bp, Homo sapiens
gggatggggagctggaaagggg

SEQ ID NO: 9029734 - DNA, 22 bp, Homo sapiens
gggatggggagctggaaagggg

SEQ ID NO: 9029735 - DNA, 22 bp, Homo sapiens
gggatggggagctggaaagggg

SEQ ID NO: 9029736 - DNA, 22 bp, Homo sapiens
gggatggggagctggaaagggg

SEQ ID NO: 9029737 - DNA, 22 bp, Homo sapiens
gggatggggagctggaaagggg

SEQ ID NO: 9029738 - DNA, 22 bp, Homo sapiens
gggaggaaagagaagtggtcca

SEQ ID NO: 9029739 - DNA, 22 bp, Homo sapiens
gggagcttctggaaggcaggaa

SEQ ID NO: 9029740 - DNA, 22 bp, Homo sapiens
gggaggaaatgtgcagcgaatt

SEQ ID NO: 9029741 - DNA, 22 bp, Homo sapiens
gggagctgtgggattggttgag

SEQ ID NO: 9029742 - DNA, 23 bp, Homo sapiens
gggagctgtggtgaaaagaggtg

SEQ ID NO: 9029743 - DNA, 23 bp, Homo sapiens
gggagctgtggtgaaaagaggtg

SEQ ID NO: 9029744 - DNA, 19 bp, Homo sapiens
gggagctgtctgcccgtgg

SEQ ID NO: 9029745 - DNA, 19 bp, Homo sapiens
gggagctgtctgcccgtgg

SEQ ID NO: 9029746 - DNA, 22 bp, Homo sapiens
gggagctgtgggattggttgag

SEQ ID NO: 9029747 - DNA, 19 bp, Homo sapiens
gggagctgtctgcccgtgg

SEQ ID NO: 9029748 - DNA, 22 bp, Homo sapiens
gggaggaaggcttgggtgagta

SEQ ID NO: 9029749 - DNA, 22 bp, Homo sapiens
gggaggaaggcttgggtgagta

SEQ ID NO: 9029750 - DNA, 22 bp, Homo sapiens
gggaggaaggcttgggtgagta

SEQ ID NO: 9029751 - DNA, 22 bp, Homo sapiens
gggaggaatgcaacttatttag

SEQ ID NO: 9029752 - DNA, 22 bp, Homo sapiens
gggaggaaatgtgcagcgaatt

SEQ ID NO: 9029753 - DNA, 22 bp, Homo sapiens
gggaggaaatgtgcagcgaatt

SEQ ID NO: 9029754 - DNA, 22 bp, Homo sapiens
gggaggaaggcttgggtgagta

SEQ ID NO: 9029755 - DNA, 22 bp, Homo sapiens
gggatggggtcgggaccctgct

SEQ ID NO: 9029756 - DNA, 22 bp, Homo sapiens
gggatggggtcgggaccctgct

SEQ ID NO: 9029757 - DNA, 22 bp, Homo sapiens
gggatggggtcaacatgtacct

SEQ ID NO: 9029758 - DNA, 22 bp, Homo sapiens
gggatggggtcaacatgtacct

SEQ ID NO: 9029759 - DNA, 22 bp, Homo sapiens
gggatggggtcgggaccctgct

SEQ ID NO: 9029760 - DNA, 22 bp, Homo sapiens
gggatggggtcaacatgtacct

SEQ ID NO: 9029761 - DNA, 22 bp, Homo sapiens
gggatggggtcgggaccctgct

SEQ ID NO: 9029762 - DNA, 22 bp, Homo sapiens
gggatggggtcgggaccctgct

SEQ ID NO: 9029763 - DNA, 22 bp, Homo sapiens
gggatggtggcttgcatctgta

SEQ ID NO: 9029764 - DNA, 22 bp, Homo sapiens
gggcaaaatacttataaaggct

SEQ ID NO: 9029765 - DNA, 19 bp, Homo sapiens
gggcaaagtgatcgtcctg

SEQ ID NO: 9029766 - DNA, 22 bp, Homo sapiens
gggcaaaacctgggcatcatga

SEQ ID NO: 9029767 - DNA, 22 bp, Homo sapiens
gggatttgtgggatggccagtg

SEQ ID NO: 9029768 - DNA, 22 bp, Homo sapiens
gggattcatcaactgttttaca

SEQ ID NO: 9029769 - DNA, 22 bp, Homo sapiens
gggatgtcgtgggtggcagctg

SEQ ID NO: 9029770 - DNA, 22 bp, Homo sapiens
gggatttcaccatgttggttgg

SEQ ID NO: 9029771 - DNA, 22 bp, Homo sapiens
gggatttcaccatgttggttgg

SEQ ID NO: 9029772 - DNA, 22 bp, Homo sapiens
gggattgaattgggggatcaca

SEQ ID NO: 9029773 - DNA, 22 bp, Homo sapiens
gggatttagtaggatagtatac

SEQ ID NO: 9029774 - DNA, 19 bp, Homo sapiens
gggcacagcctccccccag

SEQ ID NO: 9029775 - DNA, 19 bp, Homo sapiens
gggcacagcctccccccag

SEQ ID NO: 9029776 - DNA, 22 bp, Homo sapiens
gggcacagcctaactatggaga

SEQ ID NO: 9029777 - DNA, 19 bp, Homo sapiens
gggcacagcctccccccag

SEQ ID NO: 9029778 - DNA, 22 bp, Homo sapiens
gggcacagctgctacccagtgc

SEQ ID NO: 9029779 - DNA, 22 bp, Homo sapiens
gggcacagcctaactatggaga

SEQ ID NO: 9029780 - DNA, 22 bp, Homo sapiens
gggcacagcctaactatggaga

SEQ ID NO: 9029781 - DNA, 22 bp, Homo sapiens
gggcacagcctaactatggaga

SEQ ID NO: 9029782 - DNA, 22 bp, Homo sapiens
gggcacagcccagtggggtccc

SEQ ID NO: 9029783 - DNA, 22 bp, Homo sapiens
gggcacagcccagtggggtccc

SEQ ID NO: 9029784 - DNA, 22 bp, Homo sapiens
gggcaagcagtgaggacagcac

SEQ ID NO: 9029785 - DNA, 22 bp, Homo sapiens
gggcaagaagctggaagcattc

SEQ ID NO: 9029786 - DNA, 22 bp, Homo sapiens
gggcaagcacagcgagcgtgcg

SEQ ID NO: 9029787 - DNA, 22 bp, Homo sapiens
gggcaaagtggtggaggcagtt

SEQ ID NO: 9029788 - DNA, 22 bp, Homo sapiens
gggcaaagtggtggaggcagtt

SEQ ID NO: 9029789 - DNA, 22 bp, Homo sapiens
gggcaactgaaaaattgtattc

SEQ ID NO: 9029790 - DNA, 22 bp, Homo sapiens
gggcaagaagctggaagcattc

SEQ ID NO: 9029791 - DNA, 22 bp, Homo sapiens
gggagagaagggcatgtacact

SEQ ID NO: 9029792 - DNA, 22 bp, Homo sapiens
gggagagaattattgccagacc

SEQ ID NO: 9029793 - DNA, 22 bp, Homo sapiens
gggagagaattattgccagacc

SEQ ID NO: 9029794 - DNA, 22 bp, Homo sapiens
gggagagaattattgccagacc

SEQ ID NO: 9029795 - DNA, 20 bp, Homo sapiens
gggagacagggccagtgtcc

SEQ ID NO: 9029796 - DNA, 22 bp, Homo sapiens
gggagacagttcagatagtttc

SEQ ID NO: 9029797 - DNA, 22 bp, Homo sapiens
gggagacccccaatgccaggtc

SEQ ID NO: 9029798 - DNA, 22 bp, Homo sapiens
gggagacccccaatgccaggtc

SEQ ID NO: 9029799 - DNA, 22 bp, Homo sapiens
gggagacagttcagatagtttc

SEQ ID NO: 9029800 - DNA, 22 bp, Homo sapiens
gggagacaagaagtagcctgct

SEQ ID NO: 9029801 - DNA, 22 bp, Homo sapiens
gggagacaagaagtagcctgct

SEQ ID NO: 9029802 - DNA, 22 bp, Homo sapiens
gggagacaagaagtagcctgct

SEQ ID NO: 9029803 - DNA, 22 bp, Homo sapiens
gggagacaagaagtagcctgct

SEQ ID NO: 9029804 - DNA, 22 bp, Homo sapiens
gggagacacgctgcaggcataa

SEQ ID NO: 9029805 - DNA, 22 bp, Homo sapiens
gggagacacgctgcaggcataa

SEQ ID NO: 9029806 - DNA, 22 bp, Homo sapiens
gggagacacgctgcaggcataa

SEQ ID NO: 9029807 - DNA, 22 bp, Homo sapiens
gggagacacttgctttagaggg

SEQ ID NO: 9029808 - DNA, 19 bp, Homo sapiens
gggagacagctctgggctg

SEQ ID NO: 9029809 - DNA, 22 bp, Homo sapiens
gggagacacgctgcaggcataa

SEQ ID NO: 9029810 - DNA, 22 bp, Homo sapiens
gggagagaattattgccagacc

SEQ ID NO: 9029811 - DNA, 22 bp, Homo sapiens
gggagagagaaaacgtggcgca

SEQ ID NO: 9029812 - DNA, 19 bp, Homo sapiens
gggagagccaggctcaccc

SEQ ID NO: 9029813 - DNA, 19 bp, Homo sapiens
gggagagccaggctcaccc

SEQ ID NO: 9029814 - DNA, 22 bp, Homo sapiens
gggagagagagctcatgttgaa

SEQ ID NO: 9029815 - DNA, 22 bp, Homo sapiens
gggagagatgctgattgccaat

SEQ ID NO: 9029816 - DNA, 22 bp, Homo sapiens
gggagagcgcgctagggccgag

SEQ ID NO: 9029817 - DNA, 22 bp, Homo sapiens
gggagagcgcgctagggccgag

SEQ ID NO: 9029818 - DNA, 19 bp, Homo sapiens
gggagagccaggctcaccc

SEQ ID NO: 9029819 - DNA, 22 bp, Homo sapiens
gggagaggttacccgagcaact

SEQ ID NO: 9029820 - DNA, 22 bp, Homo sapiens
gggagaggttacccgagcaact

SEQ ID NO: 9029821 - DNA, 22 bp, Homo sapiens
gggagaggttacccgagcaact

SEQ ID NO: 9029822 - DNA, 22 bp, Homo sapiens
gggagagcgggaggtgccacag

SEQ ID NO: 9029823 - DNA, 18 bp, Homo sapiens
gggagctgggaagctggt

SEQ ID NO: 9029824 - DNA, 18 bp, Homo sapiens
gggagctgggaagctggt

SEQ ID NO: 9029825 - DNA, 22 bp, Homo sapiens
gggagctgggctggttttgctg

SEQ ID NO: 9029826 - DNA, 22 bp, Homo sapiens
gggagctggggcatttataccc

SEQ ID NO: 9029827 - DNA, 22 bp, Homo sapiens
gggagctggttcctgccctcca

SEQ ID NO: 9029828 - DNA, 22 bp, Homo sapiens
gggagctgtaagggacaggtag

SEQ ID NO: 9029829 - DNA, 22 bp, Homo sapiens
gggagctggttcctgccctcca

SEQ ID NO: 9029830 - DNA, 22 bp, Homo sapiens
gggagctggttcctgccctcca

SEQ ID NO: 9029831 - DNA, 22 bp, Homo sapiens
gggagctggttcctgccctcca

SEQ ID NO: 9029832 - DNA, 22 bp, Homo sapiens
gggagctggttcctgccctcca

SEQ ID NO: 9029833 - DNA, 22 bp, Homo sapiens
gggagctgtaagggacaggtag

SEQ ID NO: 9029834 - DNA, 22 bp, Homo sapiens
gggagctgtaagggacaggtag

SEQ ID NO: 9029835 - DNA, 22 bp, Homo sapiens
gggagctgtaagggacaggtag

SEQ ID NO: 9029836 - DNA, 22 bp, Homo sapiens
gggagctgtagtccagataccg

SEQ ID NO: 9029837 - DNA, 22 bp, Homo sapiens
gggagctgtaagggacaggtag

SEQ ID NO: 9029838 - DNA, 22 bp, Homo sapiens
gggagctgtagtccagataccg

SEQ ID NO: 9029839 - DNA, 19 bp, Homo sapiens
gggagctgtctgcccgtgg

SEQ ID NO: 9029840 - DNA, 22 bp, Homo sapiens
gggagctgtcatcagtgttgtc

SEQ ID NO: 9029841 - DNA, 22 bp, Homo sapiens
gggagctgtcatcagtgttgtc

SEQ ID NO: 9029842 - DNA, 17 bp, Homo sapiens
gggagatgaagggatat

SEQ ID NO: 9029843 - DNA, 17 bp, Homo sapiens
gggagatgaagggatat

SEQ ID NO: 9029844 - DNA, 22 bp, Homo sapiens
gggagatgaatcagaagtgatc

SEQ ID NO: 9029845 - DNA, 17 bp, Homo sapiens
gggagatgaagggatat

SEQ ID NO: 9029846 - DNA, 17 bp, Homo sapiens
gggagatgaagggatat

SEQ ID NO: 9029847 - DNA, 22 bp, Homo sapiens
gggagatgaatcagaagtgatc

SEQ ID NO: 9029848 - DNA, 22 bp, Homo sapiens
gggagctggcggattccccagg

SEQ ID NO: 9029849 - DNA, 18 bp, Homo sapiens
gggagctgggaagctggt

SEQ ID NO: 9029850 - DNA, 18 bp, Homo sapiens
gggagctgggaagctggt

SEQ ID NO: 9029851 - DNA, 18 bp, Homo sapiens
gggagctgggaagctggt

SEQ ID NO: 9029852 - DNA, 22 bp, Homo sapiens
gggagaggttacccgagcaact

SEQ ID NO: 9029853 - DNA, 22 bp, Homo sapiens
gggagaggttacccgagcaact

SEQ ID NO: 9029854 - DNA, 22 bp, Homo sapiens
gggagaggttacccgagcaact

SEQ ID NO: 9029855 - DNA, 22 bp, Homo sapiens
gggagaggttacccgagcaact

SEQ ID NO: 9029856 - DNA, 22 bp, Homo sapiens
gggagagtagctggaaggttct

SEQ ID NO: 9029857 - DNA, 22 bp, Homo sapiens
gggagaggttacccgagcaact

SEQ ID NO: 9029858 - DNA, 22 bp, Homo sapiens
gggagaggttacccgagcaact

SEQ ID NO: 9029859 - DNA, 22 bp, Homo sapiens
gggacatgaagcatcggaggca

SEQ ID NO: 9029860 - DNA, 22 bp, Homo sapiens
gggacatgaagcatcggaggca

SEQ ID NO: 9029861 - DNA, 22 bp, Homo sapiens
gggacatctttctagtcagggt

SEQ ID NO: 9029862 - DNA, 22 bp, Homo sapiens
gggacatgaggccatagtgatt

SEQ ID NO: 9029863 - DNA, 22 bp, Homo sapiens
gggacatgcccctcagtgggtg

SEQ ID NO: 9029864 - DNA, 22 bp, Homo sapiens
gggacaggctgagacttgagct

SEQ ID NO: 9029865 - DNA, 22 bp, Homo sapiens
gggacaggctgagacttgagct

SEQ ID NO: 9029866 - DNA, 22 bp, Homo sapiens
gggacaggctgagacttgagct

SEQ ID NO: 9029867 - DNA, 22 bp, Homo sapiens
gggacaggctgagacttgagct

SEQ ID NO: 9029868 - DNA, 22 bp, Homo sapiens
gggacaggctgagacttgagct

SEQ ID NO: 9029869 - DNA, 22 bp, Homo sapiens
gggacaggcccctcgctagctt

SEQ ID NO: 9029870 - DNA, 22 bp, Homo sapiens
gggacaggcccctcgctagctt

SEQ ID NO: 9029871 - DNA, 22 bp, Homo sapiens
gggagacaaaggtgaggttctt

SEQ ID NO: 9029872 - DNA, 22 bp, Homo sapiens
gggagacaaaggtgaggttctt

SEQ ID NO: 9029873 - DNA, 23 bp, Homo sapiens
gggagaatatgaggatgatggtg

SEQ ID NO: 9029874 - DNA, 23 bp, Homo sapiens
gggaccagctagggctgtgacct

SEQ ID NO: 9029875 - DNA, 23 bp, Homo sapiens
gggaccagctagggctgtgacct

SEQ ID NO: 9029876 - DNA, 23 bp, Homo sapiens
gggaccagctagggctgtgacct

SEQ ID NO: 9029877 - DNA, 22 bp, Homo sapiens
gggagaagtggaaatctcatta

SEQ ID NO: 9029878 - DNA, 22 bp, Homo sapiens
gggaccagaggctgtgcacaat

SEQ ID NO: 9029879 - DNA, 22 bp, Homo sapiens
gggaccagaggctgtgcacaat

SEQ ID NO: 9029880 - DNA, 22 bp, Homo sapiens
gggaccagaggctgtgcacaat

SEQ ID NO: 9029881 - DNA, 22 bp, Homo sapiens
gggaccagaggctgtgcacaat

SEQ ID NO: 9029882 - DNA, 22 bp, Homo sapiens
gggaccagaggctgtgcacaat

SEQ ID NO: 9029883 - DNA, 23 bp, Homo sapiens
gggaccagctagggctgtgacct

SEQ ID NO: 9029884 - DNA, 23 bp, Homo sapiens
gggaccagctagggctgtgacct

SEQ ID NO: 9029885 - DNA, 23 bp, Homo sapiens
gggaccagctagggctgtgacct

SEQ ID NO: 9029886 - DNA, 23 bp, Homo sapiens
gggaccagctagggctgtgacct

SEQ ID NO: 9029887 - DNA, 23 bp, Homo sapiens
gggaccagctagggctgtgacct

SEQ ID NO: 9029888 - DNA, 22 bp, Homo sapiens
gggacatggaggcgcgcaggca

SEQ ID NO: 9029889 - DNA, 22 bp, Homo sapiens
gggacatggaggcgcgcaggca

SEQ ID NO: 9029890 - DNA, 22 bp, Homo sapiens
gggacatgcccctcagtgggtg

SEQ ID NO: 9029891 - DNA, 22 bp, Homo sapiens
gggacatgcccctcagtgggtg

SEQ ID NO: 9029892 - DNA, 22 bp, Homo sapiens
gggacatggaggcgcgcaggca

SEQ ID NO: 9029893 - DNA, 22 bp, Homo sapiens
gggaccagaagaaggatggtga

SEQ ID NO: 9029894 - DNA, 22 bp, Homo sapiens
gggaccagaagaaggatggtga

SEQ ID NO: 9029895 - DNA, 22 bp, Homo sapiens
gggaccagaagaaggatggtga

SEQ ID NO: 9029896 - DNA, 22 bp, Homo sapiens
gggaccagaagaaggatggtga

SEQ ID NO: 9029897 - DNA, 22 bp, Homo sapiens
gggaccagaagaaggatggtga

SEQ ID NO: 9029898 - DNA, 22 bp, Homo sapiens
gggaccagaagaaggatggtga

SEQ ID NO: 9029899 - DNA, 22 bp, Homo sapiens
gggaccagaagaaggatggtga

SEQ ID NO: 9029900 - DNA, 22 bp, Homo sapiens
gggaccagaagaaggatggtga

SEQ ID NO: 9029901 - DNA, 22 bp, Homo sapiens
gggaccactccgacatgtaggg

SEQ ID NO: 9029902 - DNA, 22 bp, Homo sapiens
ggctttagggcaggcagtgtta

SEQ ID NO: 9029903 - DNA, 22 bp, Homo sapiens
ggctttagtgtaggtttctgtt

SEQ ID NO: 9029904 - DNA, 22 bp, Homo sapiens
ggctttatagggtagaggatca

SEQ ID NO: 9029905 - DNA, 16 bp, Homo sapiens
ggctttaatttatccc

SEQ ID NO: 9029906 - DNA, 22 bp, Homo sapiens
ggctttagggcaggcagtgtta

SEQ ID NO: 9029907 - DNA, 22 bp, Homo sapiens
ggctttaatagataaggtttct

SEQ ID NO: 9029908 - DNA, 22 bp, Homo sapiens
ggctttaaggtttaggaagcaa

SEQ ID NO: 9029909 - DNA, 22 bp, Homo sapiens
gggacagctggtctacctggta

SEQ ID NO: 9029910 - DNA, 22 bp, Homo sapiens
gggacaggcaaaggtatgcttc

SEQ ID NO: 9029911 - DNA, 22 bp, Homo sapiens
gggacaggcaaaggtatgcttc

SEQ ID NO: 9029912 - DNA, 22 bp, Homo sapiens
gggacaggcaaaggtatgcttc

SEQ ID NO: 9029913 - DNA, 22 bp, Homo sapiens
gggacagccatgtgcagatgcc

SEQ ID NO: 9029914 - DNA, 22 bp, Homo sapiens
gggacagccatgtgcagatgcc

SEQ ID NO: 9029915 - DNA, 22 bp, Homo sapiens
gggacagcagaaagaaggcaag

SEQ ID NO: 9029916 - DNA, 22 bp, Homo sapiens
gggacagcagaaagaaggcaag

SEQ ID NO: 9029917 - DNA, 22 bp, Homo sapiens
ggcttgggagcaggcatgtgac

SEQ ID NO: 9029918 - DNA, 22 bp, Homo sapiens
ggcttgggagcaggcatgtgac

SEQ ID NO: 9029919 - DNA, 22 bp, Homo sapiens
ggcttgggagcaggcatgtgac

SEQ ID NO: 9029920 - DNA, 22 bp, Homo sapiens
ggcttggcttgaaattaaggtt

SEQ ID NO: 9029921 - DNA, 22 bp, Homo sapiens
ggcttggcttgggctcagaggc

SEQ ID NO: 9029922 - DNA, 22 bp, Homo sapiens
ggcttgggagcaggcatgtgac

SEQ ID NO: 9029923 - DNA, 22 bp, Homo sapiens
ggcttggcttgggctcagaggc

SEQ ID NO: 9029924 - DNA, 22 bp, Homo sapiens
ggcttcttaatcatgagagtga

SEQ ID NO: 9029925 - DNA, 22 bp, Homo sapiens
ggcttggctacaagccatgggc

SEQ ID NO: 9029926 - DNA, 22 bp, Homo sapiens
ggcttggctacaagccatgggc

SEQ ID NO: 9029927 - DNA, 20 bp, Homo sapiens
ggcttggctgcctggggagg

SEQ ID NO: 9029928 - DNA, 20 bp, Homo sapiens
ggcttggctgcctggggagg

SEQ ID NO: 9029929 - DNA, 20 bp, Homo sapiens
ggcttggctgcctggggagg

SEQ ID NO: 9029930 - DNA, 22 bp, Homo sapiens
ggcttggctgtagctttagcgc

SEQ ID NO: 9029931 - DNA, 22 bp, Homo sapiens
ggcttggctgtagctttagcgc

SEQ ID NO: 9029932 - DNA, 16 bp, Homo sapiens
ggcttggctccatggc

SEQ ID NO: 9029933 - DNA, 22 bp, Homo sapiens
ggcttgtccttctggttgtctt

SEQ ID NO: 9029934 - DNA, 22 bp, Homo sapiens
ggcttgtcatgttgatgttctt

SEQ ID NO: 9029935 - DNA, 22 bp, Homo sapiens
ggcttgtccttgggctgtgcat

SEQ ID NO: 9029936 - DNA, 22 bp, Homo sapiens
ggcttgtccttctggttgtctt

SEQ ID NO: 9029937 - DNA, 19 bp, Homo sapiens
ggcttgtctcggcagccgc

SEQ ID NO: 9029938 - DNA, 19 bp, Homo sapiens
ggcttgtctcggcagccgc

SEQ ID NO: 9029939 - DNA, 22 bp, Homo sapiens
ggcttgtccttgggctgtgcat

SEQ ID NO: 9029940 - DNA, 21 bp, Homo sapiens
ggcttgtcaccatagctactg

SEQ ID NO: 9029941 - DNA, 22 bp, Homo sapiens
ggcttgtcatgttgatgttctt

SEQ ID NO: 9029942 - DNA, 22 bp, Homo sapiens
ggcttgggagcaggcatgtgac

SEQ ID NO: 9029943 - DNA, 22 bp, Homo sapiens
ggcttgggagcaggcatgtgac

SEQ ID NO: 9029944 - DNA, 22 bp, Homo sapiens
ggcttgggagcaggcatgtgac

SEQ ID NO: 9029945 - DNA, 22 bp, Homo sapiens
ggctttaaggagtaaaaatgcc

SEQ ID NO: 9029946 - DNA, 19 bp, Homo sapiens
ggctttaactcttgtagct

SEQ ID NO: 9029947 - DNA, 22 bp, Homo sapiens
ggctttaacagcagctttgctg

SEQ ID NO: 9029948 - DNA, 22 bp, Homo sapiens
ggctttaacaacagaaatttat

SEQ ID NO: 9029949 - DNA, 22 bp, Homo sapiens
ggctttaaacactgaaattgca

SEQ ID NO: 9029950 - DNA, 21 bp, Homo sapiens
ggctttaaagcagaggagtga

SEQ ID NO: 9029951 - DNA, 20 bp, Homo sapiens
ggcttgtctgagtccctggc

SEQ ID NO: 9029952 - DNA, 22 bp, Homo sapiens
ggcttgttgaaacacagattgt

SEQ ID NO: 9029953 - DNA, 20 bp, Homo sapiens
ggcttgtctgagtccctggc

SEQ ID NO: 9029954 - DNA, 22 bp, Homo sapiens
ggcagtgaatctgagagcctgg

SEQ ID NO: 9029955 - DNA, 22 bp, Homo sapiens
ggcagtgaatgaaacagaggct

SEQ ID NO: 9029956 - DNA, 22 bp, Homo sapiens
ggcagtgaatctgagagcctgg

SEQ ID NO: 9029957 - DNA, 22 bp, Homo sapiens
ggcagtgaacagaaatgcagaa

SEQ ID NO: 9029958 - DNA, 22 bp, Homo sapiens
ggcagtgaatctgagagcctgg

SEQ ID NO: 9029959 - DNA, 22 bp, Homo sapiens
ggcagtgaatgaaacagaggct

SEQ ID NO: 9029960 - DNA, 22 bp, Homo sapiens
ggcagtgaatctgagagcctgg

SEQ ID NO: 9029961 - DNA, 22 bp, Homo sapiens
ggcagtgaatgaaacagaggct

SEQ ID NO: 9029962 - DNA, 21 bp, Homo sapiens
ggcatggcacctctgggcagg

SEQ ID NO: 9029963 - DNA, 20 bp, Homo sapiens
ggcatggcaaatgttcttgc

SEQ ID NO: 9029964 - DNA, 22 bp, Homo sapiens
ggcatggacgtctctgaggcca

SEQ ID NO: 9029965 - DNA, 22 bp, Homo sapiens
ggcagtgaatgaaacagaggct

SEQ ID NO: 9029966 - DNA, 22 bp, Homo sapiens
ggcagtgaatgaaacagaggct

SEQ ID NO: 9029967 - DNA, 22 bp, Homo sapiens
ggcatggacgtctctgaggcca

SEQ ID NO: 9029968 - DNA, 22 bp, Homo sapiens
ggcatggacgtctctgaggcca

SEQ ID NO: 9029969 - DNA, 22 bp, Homo sapiens
ggcagtctgcaatttcattagc

SEQ ID NO: 9029970 - DNA, 22 bp, Homo sapiens
ggcagtctcctgccctctaacc

SEQ ID NO: 9029971 - DNA, 22 bp, Homo sapiens
ggcagtcttatcagcattggac

SEQ ID NO: 9029972 - DNA, 22 bp, Homo sapiens
ggcagtctagtgtccttgggcc

SEQ ID NO: 9029973 - DNA, 22 bp, Homo sapiens
ggcagtgaaaaagtatgtttcc

SEQ ID NO: 9029974 - DNA, 22 bp, Homo sapiens
ggcagtgaacagaaatgcagaa

SEQ ID NO: 9029975 - DNA, 22 bp, Homo sapiens
ggcagtgaacagaaatgcagaa

SEQ ID NO: 9029976 - DNA, 22 bp, Homo sapiens
ggcagtgaacagaaatgcagaa

SEQ ID NO: 9029977 - DNA, 22 bp, Homo sapiens
ggcatggctcggagtcagaaca

SEQ ID NO: 9029978 - DNA, 22 bp, Homo sapiens
ggcatggctcggagtcagaaca

SEQ ID NO: 9029979 - DNA, 22 bp, Homo sapiens
ggcatggcctgtaagacggaga

SEQ ID NO: 9029980 - DNA, 22 bp, Homo sapiens
ggcatgggccgaggtgcctcct

SEQ ID NO: 9029981 - DNA, 22 bp, Homo sapiens
ggcatgggagtgagcaacctta

SEQ ID NO: 9029982 - DNA, 22 bp, Homo sapiens
ggcatggctgttggggatagag

SEQ ID NO: 9029983 - DNA, 22 bp, Homo sapiens
ggcatggggtgtatgtggcacg

SEQ ID NO: 9029984 - DNA, 22 bp, Homo sapiens
ggcatgggccgaggtgcctcct

SEQ ID NO: 9029985 - DNA, 22 bp, Homo sapiens
ggcatggggtgtatgtggcacg

SEQ ID NO: 9029986 - DNA, 22 bp, Homo sapiens
ggcatggggtgtatgtggcacg

SEQ ID NO: 9029987 - DNA, 22 bp, Homo sapiens
ggcatggggtgtatgtggcacg

SEQ ID NO: 9029988 - DNA, 22 bp, Homo sapiens
ggcatgggccgaggtgcctcct

SEQ ID NO: 9029989 - DNA, 22 bp, Homo sapiens
ggcatgggccgaggtgcctcct

SEQ ID NO: 9029990 - DNA, 22 bp, Homo sapiens
ggcatgggccgaggtgcctcct

SEQ ID NO: 9029991 - DNA, 22 bp, Homo sapiens
ggcatgggccgaggtgcctcct

SEQ ID NO: 9029992 - DNA, 22 bp, Homo sapiens
ggcatgggccgaggtgcctcct

SEQ ID NO: 9029993 - DNA, 22 bp, Homo sapiens
ggcaggtggacgtgctaaagct

SEQ ID NO: 9029994 - DNA, 22 bp, Homo sapiens
ggcaggtggacgtgctaaagct

SEQ ID NO: 9029995 - DNA, 22 bp, Homo sapiens
ggcaggtggacgtgctaaagct

SEQ ID NO: 9029996 - DNA, 22 bp, Homo sapiens
ggcaggtggcactgctgctccc

SEQ ID NO: 9029997 - DNA, 22 bp, Homo sapiens
ggcaggcagaggctgagacagg

SEQ ID NO: 9029998 - DNA, 22 bp, Homo sapiens
ggcaggcagaggctgagacagg

SEQ ID NO: 9029999 - DNA, 22 bp, Homo sapiens
ggcaggcagaggctgagacagg

SEQ ID NO: 9030000 - DNA, 22 bp, Homo sapiens
ggcaggtggaagttggcagagc

SEQ ID NO: 9030001 - DNA, 22 bp, Homo sapiens
ggcaggcagatggctgcaccaa

SEQ ID NO: 9030002 - DNA, 22 bp, Homo sapiens
ggcaggtggaagttggcagagc

SEQ ID NO: 9030003 - DNA, 22 bp, Homo sapiens
ggcaggtggcactgctgctccc

SEQ ID NO: 9030004 - DNA, 21 bp, Homo sapiens
ggcaggtgggtctctgttgct

SEQ ID NO: 9030005 - DNA, 22 bp, Homo sapiens
ggcaggtgggaaccctccccac

SEQ ID NO: 9030006 - DNA, 22 bp, Homo sapiens
ggcagtcacttttgcttgtgcc

SEQ ID NO: 9030007 - DNA, 22 bp, Homo sapiens
ggcaggtgtgagatcgaggcca

SEQ ID NO: 9030008 - DNA, 22 bp, Homo sapiens
ggcaggtggtaaggatttcata

SEQ ID NO: 9030009 - DNA, 22 bp, Homo sapiens
ggcagtcccagcccagaggcgc

SEQ ID NO: 9030010 - DNA, 22 bp, Homo sapiens
ggcagtcagtttggagatggat

SEQ ID NO: 9030011 - DNA, 22 bp, Homo sapiens
ggcagtcagtgtggttcataaa

SEQ ID NO: 9030012 - DNA, 22 bp, Homo sapiens
ggccaaggtgttctgatatgcc

SEQ ID NO: 9030013 - DNA, 22 bp, Homo sapiens
ggccaaggtgttctgatatgcc

SEQ ID NO: 9030014 - DNA, 22 bp, Homo sapiens
ggccaaggtgttctgatatgcc

SEQ ID NO: 9030015 - DNA, 22 bp, Homo sapiens
ggccaaggtggagaaggcactg

SEQ ID NO: 9030016 - DNA, 22 bp, Homo sapiens
ggccaattccaggagccggcgg

SEQ ID NO: 9030017 - DNA, 22 bp, Homo sapiens
ggccaaggtgttctgatatgcc

SEQ ID NO: 9030018 - DNA, 23 bp, Homo sapiens
ggccacaaatagtctcccctggc

SEQ ID NO: 9030019 - DNA, 21 bp, Homo sapiens
ggccacaagcggaggagccgc

SEQ ID NO: 9030020 - DNA, 21 bp, Homo sapiens
ggccacaagcggaggagccgc

SEQ ID NO: 9030021 - DNA, 19 bp, Homo sapiens
ggccaggctgactgtggtc

SEQ ID NO: 9030022 - DNA, 19 bp, Homo sapiens
ggccaggctgactgtggtc

SEQ ID NO: 9030023 - DNA, 19 bp, Homo sapiens
ggccaggctgactgtggtc

SEQ ID NO: 9030024 - DNA, 22 bp, Homo sapiens
ggccacagaacagctacaggac

SEQ ID NO: 9030025 - DNA, 22 bp, Homo sapiens
ggccacagaacagctacaggac

SEQ ID NO: 9030026 - DNA, 19 bp, Homo sapiens
ggccaggctgactgtggtc

SEQ ID NO: 9030027 - DNA, 22 bp, Homo sapiens
ggccacagaacagctacaggac

SEQ ID NO: 9030028 - DNA, 22 bp, Homo sapiens
ggccacagaacagctacaggac

SEQ ID NO: 9030029 - DNA, 22 bp, Homo sapiens
ggccacagaacagctacaggac

SEQ ID NO: 9030030 - DNA, 22 bp, Homo sapiens
ggccacagaacagctacaggac

SEQ ID NO: 9030031 - DNA, 22 bp, Homo sapiens
ggccacagaacagctacaggac

SEQ ID NO: 9030032 - DNA, 20 bp, Homo sapiens
ggcatgggtggggctcccag

SEQ ID NO: 9030033 - DNA, 20 bp, Homo sapiens
ggcatgggtggggctcccag

SEQ ID NO: 9030034 - DNA, 20 bp, Homo sapiens
ggcatgggtggggctcccag

SEQ ID NO: 9030035 - DNA, 22 bp, Homo sapiens
ggcatggggtgtatgtggcacg

SEQ ID NO: 9030036 - DNA, 18 bp, Homo sapiens
ggcatgtgagtgctgagg

SEQ ID NO: 9030037 - DNA, 18 bp, Homo sapiens
ggcatgtgagtgctgagg

SEQ ID NO: 9030038 - DNA, 20 bp, Homo sapiens
ggcatgggtggggctcccag

SEQ ID NO: 9030039 - DNA, 18 bp, Homo sapiens
ggcatgtgagtgctgagg

SEQ ID NO: 9030040 - DNA, 22 bp, Homo sapiens
ggcatgtgcctgaggtcacaca

SEQ ID NO: 9030041 - DNA, 22 bp, Homo sapiens
ggccaaggctcttgagggctga

SEQ ID NO: 9030042 - DNA, 22 bp, Homo sapiens
ggccaaggctcttgagggctga

SEQ ID NO: 9030043 - DNA, 22 bp, Homo sapiens
ggccaaggctcttgagggctga

SEQ ID NO: 9030044 - DNA, 22 bp, Homo sapiens
ggccaaggctcttgagggctga

SEQ ID NO: 9030045 - DNA, 22 bp, Homo sapiens
ggccaaggtggagaaggcactg

SEQ ID NO: 9030046 - DNA, 22 bp, Homo sapiens
ggccaaggtggagaaggcactg

SEQ ID NO: 9030047 - DNA, 22 bp, Homo sapiens
ggccaaggctcttgagggctga

SEQ ID NO: 9030048 - DNA, 22 bp, Homo sapiens
ggccaaggtggagaaggcactg

SEQ ID NO: 9030049 - DNA, 22 bp, Homo sapiens
ggcatgtgcctgaggtcacaca

SEQ ID NO: 9030050 - DNA, 22 bp, Homo sapiens
ggcatgtgttgggaacagcatg

SEQ ID NO: 9030051 - DNA, 22 bp, Homo sapiens
ggcattaactctgtttcaattt

SEQ ID NO: 9030052 - DNA, 22 bp, Homo sapiens
ggcattaagaatatcattaaaa

SEQ ID NO: 9030053 - DNA, 22 bp, Homo sapiens
ggccaaggatggtggctctggt

SEQ ID NO: 9030054 - DNA, 22 bp, Homo sapiens
ggccagtctgggccacggtcgg

SEQ ID NO: 9030055 - DNA, 22 bp, Homo sapiens
ggccagtggctctgtgcttggg

SEQ ID NO: 9030056 - DNA, 22 bp, Homo sapiens
ggccagtggctctgtgcttggg

SEQ ID NO: 9030057 - DNA, 22 bp, Homo sapiens
ggccagtgtgcaggtcagagat

SEQ ID NO: 9030058 - DNA, 22 bp, Homo sapiens
ggccagtctgggccacggtcgg

SEQ ID NO: 9030059 - DNA, 22 bp, Homo sapiens
ggccagtcccctaatccagggc

SEQ ID NO: 9030060 - DNA, 22 bp, Homo sapiens
ggccagtctgggccacggtcgg

SEQ ID NO: 9030061 - DNA, 22 bp, Homo sapiens
ggccagtcccctaatccagggc

SEQ ID NO: 9030062 - DNA, 22 bp, Homo sapiens
ggccagtcccctaatccagggc

SEQ ID NO: 9030063 - DNA, 19 bp, Homo sapiens
ggccatctctgccccagca

SEQ ID NO: 9030064 - DNA, 22 bp, Homo sapiens
ggccagtgtgggagtagttctt

SEQ ID NO: 9030065 - DNA, 19 bp, Homo sapiens
ggccatctctgccccagca

SEQ ID NO: 9030066 - DNA, 22 bp, Homo sapiens
ggccatgcaggtcagaggtggg

SEQ ID NO: 9030067 - DNA, 22 bp, Homo sapiens
ggccatgcctgtgggtgcaggc

SEQ ID NO: 9030068 - DNA, 22 bp, Homo sapiens
ggccatgcaggtcagaggtggg

SEQ ID NO: 9030069 - DNA, 22 bp, Homo sapiens
ggccatgccaggctgcctggga

SEQ ID NO: 9030070 - DNA, 19 bp, Homo sapiens
ggccaggctgactgtggtc

SEQ ID NO: 9030071 - DNA, 19 bp, Homo sapiens
ggccaggctgactgtggtc

SEQ ID NO: 9030072 - DNA, 19 bp, Homo sapiens
ggccaggctgactgtggtc

SEQ ID NO: 9030073 - DNA, 22 bp, Homo sapiens
ggccagggcctggggactgtcc

SEQ ID NO: 9030074 - DNA, 22 bp, Homo sapiens
ggccagggcctggggactgtcc

SEQ ID NO: 9030075 - DNA, 22 bp, Homo sapiens
ggccagggcctggggactgtcc

SEQ ID NO: 9030076 - DNA, 22 bp, Homo sapiens
ggccagggcctggggactgtcc

SEQ ID NO: 9030077 - DNA, 22 bp, Homo sapiens
ggccagggcctggggactgtcc

SEQ ID NO: 9030078 - DNA, 22 bp, Homo sapiens
ggccagggcctggggactgtcc

SEQ ID NO: 9030079 - DNA, 22 bp, Homo sapiens
ggccagggcctggggactgtcc

SEQ ID NO: 9030080 - DNA, 22 bp, Homo sapiens
ggccagggggcttcagactcca

SEQ ID NO: 9030081 - DNA, 22 bp, Homo sapiens
ggccagggggcttcagactcca

SEQ ID NO: 9030082 - DNA, 22 bp, Homo sapiens
ggccagggggcttcagactcca

SEQ ID NO: 9030083 - DNA, 22 bp, Homo sapiens
ggccaggtggctgtcctggcgt

SEQ ID NO: 9030084 - DNA, 22 bp, Homo sapiens
ggccaggtgcggtggctcacac

SEQ ID NO: 9030085 - DNA, 22 bp, Homo sapiens
ggccaggtggctgtcctggcgt

SEQ ID NO: 9030086 - DNA, 22 bp, Homo sapiens
ggccagggggcttcagactcca

SEQ ID NO: 9030087 - DNA, 22 bp, Homo sapiens
ggccagggggcttcagactcca

SEQ ID NO: 9030088 - DNA, 22 bp, Homo sapiens
ggccagggggcttcagactcca

SEQ ID NO: 9030089 - DNA, 22 bp, Homo sapiens
ggccagggggcttcagactcca

SEQ ID NO: 9030090 - DNA, 22 bp, Homo sapiens
ggccttgggtataggtgggtat

SEQ ID NO: 9030091 - DNA, 22 bp, Homo sapiens
ggccttggtaaagggatgcatg

SEQ ID NO: 9030092 - DNA, 22 bp, Homo sapiens
ggccttggtaaagggatgcatg

SEQ ID NO: 9030093 - DNA, 22 bp, Homo sapiens
ggccttggtaatgggggactgt

SEQ ID NO: 9030094 - DNA, 22 bp, Homo sapiens
ggccttggtgccatggccagtt

SEQ ID NO: 9030095 - DNA, 22 bp, Homo sapiens
ggccttggtgccatggccagtt

SEQ ID NO: 9030096 - DNA, 22 bp, Homo sapiens
ggccttggtgccatggccagtt

SEQ ID NO: 9030097 - DNA, 22 bp, Homo sapiens
ggccttggtgccatggccagtt

SEQ ID NO: 9030098 - DNA, 22 bp, Homo sapiens
ggccttggtgctctgtgttgca

SEQ ID NO: 9030099 - DNA, 22 bp, Homo sapiens
ggccttggtggctttgctgatg

SEQ ID NO: 9030100 - DNA, 17 bp, Homo sapiens
ggccttgggctgctctt

SEQ ID NO: 9030101 - DNA, 22 bp, Homo sapiens
ggccttgggctggctgcagtat

SEQ ID NO: 9030102 - DNA, 22 bp, Homo sapiens
ggccttgggctggctgcagtat

SEQ ID NO: 9030103 - DNA, 22 bp, Homo sapiens
ggccttggggaggatggtgtcc

SEQ ID NO: 9030104 - DNA, 22 bp, Homo sapiens
ggccttgggcgagtccctcagt

SEQ ID NO: 9030105 - DNA, 22 bp, Homo sapiens
ggccttgggcgagtccctcagt

SEQ ID NO: 9030106 - DNA, 17 bp, Homo sapiens
ggccttgggctgctctt

SEQ ID NO: 9030107 - DNA, 22 bp, Homo sapiens
ggccttgggcgagtccctcagt

SEQ ID NO: 9030108 - DNA, 19 bp, Homo sapiens
ggccttggggtcccaaagt

SEQ ID NO: 9030109 - DNA, 22 bp, Homo sapiens
ggccttggggtggccttgtccc

SEQ ID NO: 9030110 - DNA, 17 bp, Homo sapiens
ggccttggggcctcagt

SEQ ID NO: 9030111 - DNA, 22 bp, Homo sapiens
ggccttggggaggatggtgtcc

SEQ ID NO: 9030112 - DNA, 17 bp, Homo sapiens
ggccttggggcctcagt

SEQ ID NO: 9030113 - DNA, 20 bp, Homo sapiens
ggccttgggtttcgcctgtt

SEQ ID NO: 9030114 - DNA, 22 bp, Homo sapiens
ggccttgggtataggtgggtat

SEQ ID NO: 9030115 - DNA, 22 bp, Homo sapiens
ggccttggttctgtcacagccg

SEQ ID NO: 9030116 - DNA, 22 bp, Homo sapiens
ggccttggttctgtcacagccg

SEQ ID NO: 9030117 - DNA, 22 bp, Homo sapiens
ggccttggttctgtcacagccg

SEQ ID NO: 9030118 - DNA, 22 bp, Homo sapiens
ggccttggttccaaagcaggca

SEQ ID NO: 9030119 - DNA, 22 bp, Homo sapiens
ggccttggtggctttgctgatg

SEQ ID NO: 9030120 - DNA, 22 bp, Homo sapiens
ggccttggttccaaagcaggca

SEQ ID NO: 9030121 - DNA, 22 bp, Homo sapiens
ggcctttagtggttctggagtc

SEQ ID NO: 9030122 - DNA, 22 bp, Homo sapiens
ggcctttagtggttctggagtc

SEQ ID NO: 9030123 - DNA, 22 bp, Homo sapiens
ggcctttaagcaattgaaaaga

SEQ ID NO: 9030124 - DNA, 22 bp, Homo sapiens
ggcgagcatgagtcactctggg

SEQ ID NO: 9030125 - DNA, 22 bp, Homo sapiens
ggcgagcatgagtcactctggg

SEQ ID NO: 9030126 - DNA, 22 bp, Homo sapiens
ggcgaggccgggacaggctgga

SEQ ID NO: 9030127 - DNA, 22 bp, Homo sapiens
ggcgagcagagcactgccagga

SEQ ID NO: 9030128 - DNA, 22 bp, Homo sapiens
ggcgagcagagcactgccagga

SEQ ID NO: 9030129 - DNA, 22 bp, Homo sapiens
ggcgagcagagccattgcctat

SEQ ID NO: 9030130 - DNA, 22 bp, Homo sapiens
ggcgagcagttcccagggaggt

SEQ ID NO: 9030131 - DNA, 22 bp, Homo sapiens
ggcgagcagcgctgtgtcaggt

SEQ ID NO: 9030132 - DNA, 22 bp, Homo sapiens
ggcgctggtggtcttgcgagcg

SEQ ID NO: 9030133 - DNA, 22 bp, Homo sapiens
ggcgctggccacggtggctctg

SEQ ID NO: 9030134 - DNA, 22 bp, Homo sapiens
ggcgctggccacggtggctctg

SEQ ID NO: 9030135 - DNA, 22 bp, Homo sapiens
ggcgaggccgggacaggctgga

SEQ ID NO: 9030136 - DNA, 22 bp, Homo sapiens
ggcgaggccgggacaggctgga

SEQ ID NO: 9030137 - DNA, 22 bp, Homo sapiens
ggcgctggccacggtggctctg

SEQ ID NO: 9030138 - DNA, 22 bp, Homo sapiens
ggcctgcacagaggtggctcta

SEQ ID NO: 9030139 - DNA, 22 bp, Homo sapiens
ggcctgcacagaggtggctcta

SEQ ID NO: 9030140 - DNA, 22 bp, Homo sapiens
ggcctgcacagaggtggctcta

SEQ ID NO: 9030141 - DNA, 17 bp, Homo sapiens
ggcctgcacctcctgct

SEQ ID NO: 9030142 - DNA, 18 bp, Homo sapiens
ggcctgcagtgaagcaag

SEQ ID NO: 9030143 - DNA, 20 bp, Homo sapiens
ggcctgcagctcccagcaag

SEQ ID NO: 9030144 - DNA, 22 bp, Homo sapiens
ggccttgggatgtggctgcagc

SEQ ID NO: 9030145 - DNA, 22 bp, Homo sapiens
ggccttgggatgtggctgcagc

SEQ ID NO: 9030146 - DNA, 22 bp, Homo sapiens
ggccttgggcagacacgtcaca

SEQ ID NO: 9030147 - DNA, 22 bp, Homo sapiens
ggccttgggcagacacgtcaca

SEQ ID NO: 9030148 - DNA, 22 bp, Homo sapiens
ggccttgggatgtggctgcagc

SEQ ID NO: 9030149 - DNA, 22 bp, Homo sapiens
ggccttgggatgtggctgcagc

SEQ ID NO: 9030150 - DNA, 19 bp, Homo sapiens
ggcctgcccaatgtctgct

SEQ ID NO: 9030151 - DNA, 18 bp, Homo sapiens
ggcctgcagtgaagcaag

SEQ ID NO: 9030152 - DNA, 22 bp, Homo sapiens
ggcctgagtcccacctggctgt

SEQ ID NO: 9030153 - DNA, 22 bp, Homo sapiens
ggcctgagtcccacctggctgt

SEQ ID NO: 9030154 - DNA, 22 bp, Homo sapiens
ggcctgagtcacatcaggagag

SEQ ID NO: 9030155 - DNA, 22 bp, Homo sapiens
ggcctgagtcccacctggctgt

SEQ ID NO: 9030156 - DNA, 22 bp, Homo sapiens
ggcctgagtcacatcaggagag

SEQ ID NO: 9030157 - DNA, 22 bp, Homo sapiens
ggcctgagtcacatcaggagag

SEQ ID NO: 9030158 - DNA, 22 bp, Homo sapiens
ggcctgagtcacatcaggagag

SEQ ID NO: 9030159 - DNA, 21 bp, Homo sapiens
ggcctgagtataggacaggcc

SEQ ID NO: 9030160 - DNA, 21 bp, Homo sapiens
ggcctgagtataggacaggcc

SEQ ID NO: 9030161 - DNA, 21 bp, Homo sapiens
ggcctgagtataggacaggcc

SEQ ID NO: 9030162 - DNA, 22 bp, Homo sapiens
ggcctgagaatgtaccagatct

SEQ ID NO: 9030163 - DNA, 22 bp, Homo sapiens
ggcctgagaatgtaccagatct

SEQ ID NO: 9030164 - DNA, 22 bp, Homo sapiens
ggcctgagaatgtaccagatct

SEQ ID NO: 9030165 - DNA, 22 bp, Homo sapiens
ggcctgagaatgtaccagatct

SEQ ID NO: 9030166 - DNA, 21 bp, Homo sapiens
ggcctgagcacctgtccacct

SEQ ID NO: 9030167 - DNA, 22 bp, Homo sapiens
ggcctgaggcgtcccagctgtg

SEQ ID NO: 9030168 - DNA, 22 bp, Homo sapiens
ggcctgaggcgtcccagctgtg

SEQ ID NO: 9030169 - DNA, 22 bp, Homo sapiens
ggcctgagggtgggctctcagt

SEQ ID NO: 9030170 - DNA, 21 bp, Homo sapiens
ggcctgagtataggacaggcc

SEQ ID NO: 9030171 - DNA, 22 bp, Homo sapiens
ggcctgagggtgggctctcagt

SEQ ID NO: 9030172 - DNA, 22 bp, Homo sapiens
ggcctgagggtgggctctcagt

SEQ ID NO: 9030173 - DNA, 22 bp, Homo sapiens
ggcctgaggcgtcccagctgtg

SEQ ID NO: 9030174 - DNA, 22 bp, Homo sapiens
ggcctgaggcgtcccagctgtg

SEQ ID NO: 9030175 - DNA, 22 bp, Homo sapiens
ggcctgaatgcctgagtgtggg

SEQ ID NO: 9030176 - DNA, 22 bp, Homo sapiens
ggcctgacaagtgggaagaggc

SEQ ID NO: 9030177 - DNA, 22 bp, Homo sapiens
ggcctgagaaccatggggccaa

SEQ ID NO: 9030178 - DNA, 22 bp, Homo sapiens
ggcctgagaaccatggggccaa

SEQ ID NO: 9030179 - DNA, 22 bp, Homo sapiens
ggcctcttatctggctcctgca

SEQ ID NO: 9030180 - DNA, 22 bp, Homo sapiens
ggcctcttatctggctcctgca

SEQ ID NO: 9030181 - DNA, 22 bp, Homo sapiens
ggcctgaaatagctctgaggtt

SEQ ID NO: 9030182 - DNA, 21 bp, Homo sapiens
ggcctgaaaaagtgaatgctt

SEQ ID NO: 9030183 - DNA, 22 bp, Homo sapiens
ggcctgaaataaagtagcagaa

SEQ ID NO: 9030184 - DNA, 22 bp, Homo sapiens
ggcctcagtttctccatgggtt

SEQ ID NO: 9030185 - DNA, 22 bp, Homo sapiens
ggcctcagtttcttcaactgta

SEQ ID NO: 9030186 - DNA, 22 bp, Homo sapiens
ggcctcagtttcttcaactgta

SEQ ID NO: 9030187 - DNA, 22 bp, Homo sapiens
ggcctcagtttctccatgggtt

SEQ ID NO: 9030188 - DNA, 22 bp, Homo sapiens
ggcctcagtttctccatgggtt

SEQ ID NO: 9030189 - DNA, 22 bp, Homo sapiens
ggcctcagtttctccatgggtt

SEQ ID NO: 9030190 - DNA, 22 bp, Homo sapiens
ggcctcagggttgggcccatta

SEQ ID NO: 9030191 - DNA, 22 bp, Homo sapiens
ggcctcagggttgggcccatta

SEQ ID NO: 9030192 - DNA, 22 bp, Homo sapiens
ggcctcagtgggccgctgcagg

SEQ ID NO: 9030193 - DNA, 22 bp, Homo sapiens
ggcctcagggttgggcccatta

SEQ ID NO: 9030194 - DNA, 23 bp, Homo sapiens
ggcctcagtgatgatgggttaaa

SEQ ID NO: 9030195 - DNA, 22 bp, Homo sapiens
ggcctcagtgggccgctgcagg

SEQ ID NO: 9030196 - DNA, 20 bp, Homo sapiens
ggcctcagtgtccttgtttg

SEQ ID NO: 9030197 - DNA, 20 bp, Homo sapiens
ggcctcagtgtccttgtttg

SEQ ID NO: 9030198 - DNA, 22 bp, Homo sapiens
ggcctcagtgggccgctgcagg

SEQ ID NO: 9030199 - DNA, 22 bp, Homo sapiens
ggcctcagtgggccgctgcagg

SEQ ID NO: 9030200 - DNA, 22 bp, Homo sapiens
ggcctcagtgggccgctgcagg

SEQ ID NO: 9030201 - DNA, 22 bp, Homo sapiens
ggcctctggttcgtggtgacct

SEQ ID NO: 9030202 - DNA, 21 bp, Homo sapiens
ggcctctgtcatcctgggaag

SEQ ID NO: 9030203 - DNA, 21 bp, Homo sapiens
ggcctctgtcatcctgggaag

SEQ ID NO: 9030204 - DNA, 21 bp, Homo sapiens
ggcctctgtcatcctgggaag

SEQ ID NO: 9030205 - DNA, 23 bp, Homo sapiens
ggcctctgtgttctgcccacatg

SEQ ID NO: 9030206 - DNA, 22 bp, Homo sapiens
ggcctctggttcacagggagga

SEQ ID NO: 9030207 - DNA, 22 bp, Homo sapiens
ggcctctggttcacagggagga

SEQ ID NO: 9030208 - DNA, 22 bp, Homo sapiens
ggcctctggttcgtggtgacct

SEQ ID NO: 9030209 - DNA, 22 bp, Homo sapiens
ggcctctggttcgtggtgacct

SEQ ID NO: 9030210 - DNA, 22 bp, Homo sapiens
ggcctcttagagttaactgctt

SEQ ID NO: 9030211 - DNA, 22 bp, Homo sapiens
ggcctctgtttggagccaggat

SEQ ID NO: 9030212 - DNA, 22 bp, Homo sapiens
ggcctctgtttggagccaggat

SEQ ID NO: 9030213 - DNA, 22 bp, Homo sapiens
ggcctctgtttggagccaggat

SEQ ID NO: 9030214 - DNA, 23 bp, Homo sapiens
ggcctctgtgttctgcccacatg

SEQ ID NO: 9030215 - DNA, 22 bp, Homo sapiens
ggcctctgttctgcattcctcc

SEQ ID NO: 9030216 - DNA, 22 bp, Homo sapiens
ggcctctgtttggagccaggat

SEQ ID NO: 9030217 - DNA, 21 bp, Homo sapiens
ggcctcagccacctggctctg

SEQ ID NO: 9030218 - DNA, 18 bp, Homo sapiens
ggcctcagcctggccgga

SEQ ID NO: 9030219 - DNA, 18 bp, Homo sapiens
ggcctcagcctggccgga

SEQ ID NO: 9030220 - DNA, 21 bp, Homo sapiens
ggcctcagccacctggctctg

SEQ ID NO: 9030221 - DNA, 21 bp, Homo sapiens
ggcctcagccacctggctctg

SEQ ID NO: 9030222 - DNA, 22 bp, Homo sapiens
ggcctcagaggaggtgtgagtc

SEQ ID NO: 9030223 - DNA, 22 bp, Homo sapiens
ggcctcagaggaggtgtgagtc

SEQ ID NO: 9030224 - DNA, 22 bp, Homo sapiens
ggcctcagaggaggtgtgagtc

SEQ ID NO: 9030225 - DNA, 22 bp, Homo sapiens
ggcctcagaggaggtgtgagtc

SEQ ID NO: 9030226 - DNA, 18 bp, Homo sapiens
ggcctcagcctggccgga

SEQ ID NO: 9030227 - DNA, 18 bp, Homo sapiens
ggcctcagcctggccgga

SEQ ID NO: 9030228 - DNA, 23 bp, Homo sapiens
ggcctcagcgcacagaaactgct

SEQ ID NO: 9030229 - DNA, 23 bp, Homo sapiens
ggcctcagcgcacagaaactgct

SEQ ID NO: 9030230 - DNA, 22 bp, Homo sapiens
ggcctcagggtcactctgtaga

SEQ ID NO: 9030231 - DNA, 22 bp, Homo sapiens
ggcctcagggtcactctgtaga

SEQ ID NO: 9030232 - DNA, 22 bp, Homo sapiens
ggcctcagggttgggcccatta

SEQ ID NO: 9030233 - DNA, 22 bp, Homo sapiens
ggcctcagggttgggcccatta

SEQ ID NO: 9030234 - DNA, 23 bp, Homo sapiens
ggcctcagcgcacagaaactgct

SEQ ID NO: 9030235 - DNA, 22 bp, Homo sapiens
ggcctcagggtcactctgtaga

SEQ ID NO: 9030236 - DNA, 22 bp, Homo sapiens
ggcctcagaccggagctggcca

SEQ ID NO: 9030237 - DNA, 22 bp, Homo sapiens
ggcctcagaccggagctggcca

SEQ ID NO: 9030238 - DNA, 22 bp, Homo sapiens
ggcctcagaccggagctggcca

SEQ ID NO: 9030239 - DNA, 22 bp, Homo sapiens
ggccatggcgggagccggcgtc

SEQ ID NO: 9030240 - DNA, 22 bp, Homo sapiens
ggcctcagagaaggctgtgcgg

SEQ ID NO: 9030241 - DNA, 22 bp, Homo sapiens
ggcctcagagaaggctgtgcgg

SEQ ID NO: 9030242 - DNA, 22 bp, Homo sapiens
ggcctcagagaaggctgtgcgg

SEQ ID NO: 9030243 - DNA, 22 bp, Homo sapiens
ggccatgcctgtgggtgcaggc

SEQ ID NO: 9030244 - DNA, 22 bp, Homo sapiens
ggccatgctgttgcctgctggt

SEQ ID NO: 9030245 - DNA, 22 bp, Homo sapiens
ggccatggaccccgagctgacc

SEQ ID NO: 9030246 - DNA, 22 bp, Homo sapiens
ggccatggaccccgagctgacc

SEQ ID NO: 9030247 - DNA, 23 bp, Homo sapiens
ggccatggagacttagaatgggc

SEQ ID NO: 9030248 - DNA, 22 bp, Homo sapiens
ggccatggaccccgagctgacc

SEQ ID NO: 9030249 - DNA, 22 bp, Homo sapiens
ggccatggaccccgagctgacc

SEQ ID NO: 9030250 - DNA, 23 bp, Homo sapiens
ggccatggagacttagaatgggc

SEQ ID NO: 9030251 - DNA, 23 bp, Homo sapiens
ggccatggagacttagaatgggc

SEQ ID NO: 9030252 - DNA, 22 bp, Homo sapiens
ggcacaggaatctgtgaagtgc

SEQ ID NO: 9030253 - DNA, 22 bp, Homo sapiens
ggcacaggaatctgtgaagtgc

SEQ ID NO: 9030254 - DNA, 22 bp, Homo sapiens
ggcacaggaatctgtgaagtgc

SEQ ID NO: 9030255 - DNA, 22 bp, Homo sapiens
ggcacaggaatctgtgaagtgc

SEQ ID NO: 9030256 - DNA, 22 bp, Homo sapiens
ggcacagctgatgcagacacac

SEQ ID NO: 9030257 - DNA, 22 bp, Homo sapiens
ggcacagctgatgcagacacac

SEQ ID NO: 9030258 - DNA, 22 bp, Homo sapiens
ggcacagctcaggtcccagctc

SEQ ID NO: 9030259 - DNA, 22 bp, Homo sapiens
ggcacagctgatgcagacacac

SEQ ID NO: 9030260 - DNA, 22 bp, Homo sapiens
ggcacagctcaggtcccagctc

SEQ ID NO: 9030261 - DNA, 22 bp, Homo sapiens
ggcacagctcaggtcccagctc

SEQ ID NO: 9030262 - DNA, 22 bp, Homo sapiens
ggcacagctacttgctcactct

SEQ ID NO: 9030263 - DNA, 22 bp, Homo sapiens
ggcaccagcaggcaccgatgcc

SEQ ID NO: 9030264 - DNA, 22 bp, Homo sapiens
ggcaccagcaggcaccgatgcc

SEQ ID NO: 9030265 - DNA, 22 bp, Homo sapiens
ggcaccagccacctatttctag

SEQ ID NO: 9030266 - DNA, 22 bp, Homo sapiens
ggcaccagccacctatttctag

SEQ ID NO: 9030267 - DNA, 22 bp, Homo sapiens
ggcaccagcacttgggatggct

SEQ ID NO: 9030268 - DNA, 22 bp, Homo sapiens
ggcaccagcacttgggatggct

SEQ ID NO: 9030269 - DNA, 17 bp, Homo sapiens
ggcaccagacggagagt

SEQ ID NO: 9030270 - DNA, 17 bp, Homo sapiens
ggcaccagacggagagt

SEQ ID NO: 9030271 - DNA, 17 bp, Homo sapiens
ggcaccagacggagagt

SEQ ID NO: 9030272 - DNA, 17 bp, Homo sapiens
ggcaccagacggagagt

SEQ ID NO: 9030273 - DNA, 23 bp, Homo sapiens
ggcaccaacctctgctccctctt

SEQ ID NO: 9030274 - DNA, 17 bp, Homo sapiens
ggcaccagacggagagt

SEQ ID NO: 9030275 - DNA, 22 bp, Homo sapiens
ggcacatgtatgtgggagtgtg

SEQ ID NO: 9030276 - DNA, 22 bp, Homo sapiens
ggcacaggagctagtcaaagcc

SEQ ID NO: 9030277 - DNA, 22 bp, Homo sapiens
ggcacaggagctagtcaaagcc

SEQ ID NO: 9030278 - DNA, 22 bp, Homo sapiens
ggcacagcgactaccatcgaaa

SEQ ID NO: 9030279 - DNA, 21 bp, Homo sapiens
ggcacagcctgaaatgcctca

SEQ ID NO: 9030280 - DNA, 22 bp, Homo sapiens
ggcacagcgactaccatcgaaa

SEQ ID NO: 9030281 - DNA, 21 bp, Homo sapiens
ggcacagcctgaaatgcctca

SEQ ID NO: 9030282 - DNA, 22 bp, Homo sapiens
ggcacagcgactaccatcgaaa

SEQ ID NO: 9030283 - DNA, 22 bp, Homo sapiens
ggcacagcgactaccatcgaaa

SEQ ID NO: 9030284 - DNA, 22 bp, Homo sapiens
ggcacagcgactaccatcgaaa

SEQ ID NO: 9030285 - DNA, 22 bp, Homo sapiens
ggcacagctacttgctcactct

SEQ ID NO: 9030286 - DNA, 22 bp, Homo sapiens
ggcacagctacttgctcactct

SEQ ID NO: 9030287 - DNA, 22 bp, Homo sapiens
ggcacagctacttgctcactct

SEQ ID NO: 9030288 - DNA, 22 bp, Homo sapiens
ggcacagcgactaccatcgaaa

SEQ ID NO: 9030289 - DNA, 22 bp, Homo sapiens
ggcacagctcaggtcccagctc

SEQ ID NO: 9030290 - DNA, 22 bp, Homo sapiens
ggcacagctacttgctcactct

SEQ ID NO: 9030291 - DNA, 22 bp, Homo sapiens
ggcacagccctctctgtggaca

SEQ ID NO: 9030292 - DNA, 22 bp, Homo sapiens
ggcacagccctctctgtggaca

SEQ ID NO: 9030293 - DNA, 22 bp, Homo sapiens
ggcacagccctctctgtggaca

SEQ ID NO: 9030294 - DNA, 22 bp, Homo sapiens
ggcacagccctctctgtggaca

SEQ ID NO: 9030295 - DNA, 22 bp, Homo sapiens
ggcacagccctctctgtggaca

SEQ ID NO: 9030296 - DNA, 22 bp, Homo sapiens
ggcacagcaggagctatgtgaa

SEQ ID NO: 9030297 - DNA, 22 bp, Homo sapiens
ggcacagcaggagctatgtgaa

SEQ ID NO: 9030298 - DNA, 22 bp, Homo sapiens
ggcacagcaggagctatgtgaa

SEQ ID NO: 9030299 - DNA, 22 bp, Homo sapiens
ggcacagccactttggagaact

SEQ ID NO: 9030300 - DNA, 22 bp, Homo sapiens
ggcacagccactttggagaact

SEQ ID NO: 9030301 - DNA, 22 bp, Homo sapiens
ggcacagcaggagctatgtgaa

SEQ ID NO: 9030302 - DNA, 22 bp, Homo sapiens
ggcacagccactttggagaact

SEQ ID NO: 9030303 - DNA, 20 bp, Homo sapiens
ggcagagggcctgggagaag

SEQ ID NO: 9030304 - DNA, 20 bp, Homo sapiens
ggcagagggcctgggagaag

SEQ ID NO: 9030305 - DNA, 20 bp, Homo sapiens
ggcagagggcctgggagaag

SEQ ID NO: 9030306 - DNA, 20 bp, Homo sapiens
ggcagagggcctgggagaag

SEQ ID NO: 9030307 - DNA, 22 bp, Homo sapiens
ggcagaggagctggaaacatgg

SEQ ID NO: 9030308 - DNA, 22 bp, Homo sapiens
ggcagaggaggggtgaatttgc

SEQ ID NO: 9030309 - DNA, 22 bp, Homo sapiens
ggcagaggaggggtgaatttgc

SEQ ID NO: 9030310 - DNA, 22 bp, Homo sapiens
ggcagaggaggggtgaatttgc

SEQ ID NO: 9030311 - DNA, 22 bp, Homo sapiens
ggcagaggagctggaaacatgg

SEQ ID NO: 9030312 - DNA, 22 bp, Homo sapiens
ggcagaggagctggaaacatgg

SEQ ID NO: 9030313 - DNA, 22 bp, Homo sapiens
ggcagaggagctggaaacatgg

SEQ ID NO: 9030314 - DNA, 22 bp, Homo sapiens
ggcagaggagctggaaacatgg

SEQ ID NO: 9030315 - DNA, 22 bp, Homo sapiens
ggcagaggagctggaaacatgg

SEQ ID NO: 9030316 - DNA, 22 bp, Homo sapiens
ggcagaggagctggaaacatgg

SEQ ID NO: 9030317 - DNA, 22 bp, Homo sapiens
ggcagaggagctggaaacatgg

SEQ ID NO: 9030318 - DNA, 22 bp, Homo sapiens
ggcagaggagctggaaacatgg

SEQ ID NO: 9030319 - DNA, 22 bp, Homo sapiens
ggcagaggagctggaaacatgg

SEQ ID NO: 9030320 - DNA, 22 bp, Homo sapiens
ggcagaggagctggaaacatgg

SEQ ID NO: 9030321 - DNA, 22 bp, Homo sapiens
ggcagaggaaggatgaattcac

SEQ ID NO: 9030322 - DNA, 22 bp, Homo sapiens
ggcagaggaaggatgaattcac

SEQ ID NO: 9030323 - DNA, 22 bp, Homo sapiens
ggcagaggaaggatgaattcac

SEQ ID NO: 9030324 - DNA, 22 bp, Homo sapiens
ggcagaggaaggatgaattcac

SEQ ID NO: 9030325 - DNA, 22 bp, Homo sapiens
ggcagaggaagctggaagtggg

SEQ ID NO: 9030326 - DNA, 22 bp, Homo sapiens
ggcagaggaagctggaagtggg

SEQ ID NO: 9030327 - DNA, 22 bp, Homo sapiens
ggcagaggaagctggaagtggg

SEQ ID NO: 9030328 - DNA, 22 bp, Homo sapiens
ggcagaggaagctggaagtggg

SEQ ID NO: 9030329 - DNA, 22 bp, Homo sapiens
ggcaccaggatcagtctgtcat

SEQ ID NO: 9030330 - DNA, 22 bp, Homo sapiens
ggcaccaggacatgactcccag

SEQ ID NO: 9030331 - DNA, 22 bp, Homo sapiens
ggcaccaggacatgactcccag

SEQ ID NO: 9030332 - DNA, 22 bp, Homo sapiens
ggcaccaggacatgactcccag

SEQ ID NO: 9030333 - DNA, 22 bp, Homo sapiens
ggcaccaggacatgactcccag

SEQ ID NO: 9030334 - DNA, 23 bp, Homo sapiens
ggcaccaggccatggagcgggag

SEQ ID NO: 9030335 - DNA, 23 bp, Homo sapiens
ggcaccaggccatggagcgggag

SEQ ID NO: 9030336 - DNA, 22 bp, Homo sapiens
ggcaccaggatcagtctgtcat

SEQ ID NO: 9030337 - DNA, 23 bp, Homo sapiens
ggcaccaggccatggagcgggag

SEQ ID NO: 9030338 - DNA, 22 bp, Homo sapiens
ggcaccaggctgggcataggcc

SEQ ID NO: 9030339 - DNA, 22 bp, Homo sapiens
ggcaccaggctgggcataggcc

SEQ ID NO: 9030340 - DNA, 22 bp, Homo sapiens
ggcaccaggctgggcataggcc

SEQ ID NO: 9030341 - DNA, 20 bp, Homo sapiens
ggcaccaggctaggattgga

SEQ ID NO: 9030342 - DNA, 20 bp, Homo sapiens
ggcaccaggctaggattgga

SEQ ID NO: 9030343 - DNA, 20 bp, Homo sapiens
ggcaccaggctaggattgga

SEQ ID NO: 9030344 - DNA, 20 bp, Homo sapiens
ggcaccaggctaggattgga

SEQ ID NO: 9030345 - DNA, 23 bp, Homo sapiens
ggcaccaggccatggagcgggag

SEQ ID NO: 9030346 - DNA, 22 bp, Homo sapiens
ggcaggaggtgagtggcgggtg

SEQ ID NO: 9030347 - DNA, 22 bp, Homo sapiens
ggcaggaggtgagtggcgggtg

SEQ ID NO: 9030348 - DNA, 22 bp, Homo sapiens
ggcaggaggtgagtggcgggtg

SEQ ID NO: 9030349 - DNA, 22 bp, Homo sapiens
ggcaggaggtgagtggcgggtg

SEQ ID NO: 9030350 - DNA, 22 bp, Homo sapiens
ggcaggaggtgagtggcgggtg

SEQ ID NO: 9030351 - DNA, 22 bp, Homo sapiens
ggcaggagggcggacaatgacc

SEQ ID NO: 9030352 - DNA, 22 bp, Homo sapiens
ggcaggagggcggacaatgacc

SEQ ID NO: 9030353 - DNA, 22 bp, Homo sapiens
ggcaggagggcggacaatgacc

SEQ ID NO: 9030354 - DNA, 22 bp, Homo sapiens
ggcaggagggcggacaatgacc

SEQ ID NO: 9030355 - DNA, 22 bp, Homo sapiens
ggcaggaggtgagtggcgggtg

SEQ ID NO: 9030356 - DNA, 22 bp, Homo sapiens
ggcagaggtagctggaaccagg

SEQ ID NO: 9030357 - DNA, 22 bp, Homo sapiens
ggcaggaggaagagttagcacc

SEQ ID NO: 9030358 - DNA, 22 bp, Homo sapiens
ggcaggaggaagagttagcacc

SEQ ID NO: 9030359 - DNA, 22 bp, Homo sapiens
ggcaggaggaagagttagcacc

SEQ ID NO: 9030360 - DNA, 22 bp, Homo sapiens
ggcaggaggaagagttagcacc

SEQ ID NO: 9030361 - DNA, 22 bp, Homo sapiens
ggcaggagggcggacaatgacc

SEQ ID NO: 9030362 - DNA, 22 bp, Homo sapiens
ggcaggagggcggacaatgacc

SEQ ID NO: 9030363 - DNA, 22 bp, Homo sapiens
ggcaggagggcggacaatgacc

SEQ ID NO: 9030364 - DNA, 22 bp, Homo sapiens
ggcagaggtagctggaaccagg

SEQ ID NO: 9030365 - DNA, 22 bp, Homo sapiens
ggcagaggtagctggaaccagg

SEQ ID NO: 9030366 - DNA, 22 bp, Homo sapiens
ggcagaggtagctggaaccagg

SEQ ID NO: 9030367 - DNA, 22 bp, Homo sapiens
ggcagaggtagctggaaccagg

SEQ ID NO: 9030368 - DNA, 22 bp, Homo sapiens
ggcagaggtagctggaaccagg

SEQ ID NO: 9030369 - DNA, 22 bp, Homo sapiens
ggcagaggtagctggaaccagg

SEQ ID NO: 9030370 - DNA, 22 bp, Homo sapiens
ggcagaggtagctggaaccagg

SEQ ID NO: 9030371 - DNA, 22 bp, Homo sapiens
ggcagaggtagctggaaccagg

SEQ ID NO: 9030372 - DNA, 22 bp, Homo sapiens
ggcagaggtagctggaaccagg

SEQ ID NO: 9030373 - DNA, 22 bp, Homo sapiens
ggcagaggtagctggaaccagg

SEQ ID NO: 9030374 - DNA, 22 bp, Homo sapiens
ggcagaggtagctggaaccagg

SEQ ID NO: 9030375 - DNA, 22 bp, Homo sapiens
ggcagaggtagctggaaccagg

SEQ ID NO: 9030376 - DNA, 22 bp, Homo sapiens
ggcagaggtagctggaaccagg

SEQ ID NO: 9030377 - DNA, 20 bp, Homo sapiens
ggcagagggcctgggagaag

SEQ ID NO: 9030378 - DNA, 20 bp, Homo sapiens
ggcagagggcctgggagaag

SEQ ID NO: 9030379 - DNA, 22 bp, Homo sapiens
ggcagaggtagctggaaccagg

SEQ ID NO: 9030380 - DNA, 20 bp, Homo sapiens
ggcagagggcctgggagaag

SEQ ID NO: 9030381 - DNA, 20 bp, Homo sapiens
ggcagagggcctgggagaag

SEQ ID NO: 9030382 - DNA, 20 bp, Homo sapiens
ggcagagggcctgggagaag

SEQ ID NO: 9030383 - DNA, 20 bp, Homo sapiens
ggcagagggcctgggagaag

SEQ ID NO: 9030384 - DNA, 20 bp, Homo sapiens
ggcagagggcctgggagaag

SEQ ID NO: 9030385 - DNA, 20 bp, Homo sapiens
ggcagagggcctgggagaag

SEQ ID NO: 9030386 - DNA, 20 bp, Homo sapiens
ggcagagggcctgggagaag

SEQ ID NO: 9030387 - DNA, 20 bp, Homo sapiens
ggcagagggcctgggagaag

SEQ ID NO: 9030388 - DNA, 22 bp, Homo sapiens
ggcaggcaaggcagcctggtga

SEQ ID NO: 9030389 - DNA, 22 bp, Homo sapiens
ggcaggcaagtctgctctgtga

SEQ ID NO: 9030390 - DNA, 22 bp, Homo sapiens
ggcaggcaagtctgctctgtga

SEQ ID NO: 9030391 - DNA, 22 bp, Homo sapiens
ggcaggcaatgaggatgggaag

SEQ ID NO: 9030392 - DNA, 22 bp, Homo sapiens
ggcaggcaatgaggatgggaag

SEQ ID NO: 9030393 - DNA, 22 bp, Homo sapiens
ggcaggcaagtctgctctgtga

SEQ ID NO: 9030394 - DNA, 22 bp, Homo sapiens
ggcaggaggtgagtggcgggtg

SEQ ID NO: 9030395 - DNA, 21 bp, Homo sapiens
ggcaggatggcagtggacccc

SEQ ID NO: 9030396 - DNA, 22 bp, Homo sapiens
ggcaggaggtgagtggcgggtg

SEQ ID NO: 9030397 - DNA, 22 bp, Homo sapiens
ggcaggcaacggaccactagtc

SEQ ID NO: 9030398 - DNA, 22 bp, Homo sapiens
ggcaggcaaggcagcctggtga

SEQ ID NO: 9030399 - DNA, 22 bp, Homo sapiens
ggcaggcaaggcagcctggtga

SEQ ID NO: 9030400 - DNA, 22 bp, Homo sapiens
ggcaggcaccagctcagcaata

SEQ ID NO: 9030401 - DNA, 22 bp, Homo sapiens
ggcaggcactgtgctaggcgct

SEQ ID NO: 9030402 - DNA, 22 bp, Homo sapiens
ggcaggcactgtgctaggcgct

SEQ ID NO: 9030403 - DNA, 22 bp, Homo sapiens
ggcaggcactgtgctaggcgct

SEQ ID NO: 9030404 - DNA, 22 bp, Homo sapiens
ggcaggcactgtgctaggcgct

SEQ ID NO: 9030405 - DNA, 22 bp, Homo sapiens
ggcaggcactgtgttttgtgtt

SEQ ID NO: 9030406 - DNA, 22 bp, Homo sapiens
ggcaggcagaggctgagacagg

SEQ ID NO: 9030407 - DNA, 22 bp, Homo sapiens
ggagtcagaatggcagggtggt

SEQ ID NO: 9030408 - DNA, 22 bp, Homo sapiens
ggagtcagaatggcagggtggt

SEQ ID NO: 9030409 - DNA, 22 bp, Homo sapiens
ggagtcagaggaaggcttgctc

SEQ ID NO: 9030410 - DNA, 22 bp, Homo sapiens
ggagtcagaacccaggcttcta

SEQ ID NO: 9030411 - DNA, 19 bp, Homo sapiens
ggagtcactagaagccatc

SEQ ID NO: 9030412 - DNA, 22 bp, Homo sapiens
ggagtcagaacccaggcttcta

SEQ ID NO: 9030413 - DNA, 22 bp, Homo sapiens
ggagtcaccaagtaggagtctt

SEQ ID NO: 9030414 - DNA, 22 bp, Homo sapiens
ggagtcacacaggaagaaggac

SEQ ID NO: 9030415 - DNA, 20 bp, Homo sapiens
ggagtcaccaagagagaccc

SEQ ID NO: 9030416 - DNA, 22 bp, Homo sapiens
ggagtcacctgggaggactggg

SEQ ID NO: 9030417 - DNA, 22 bp, Homo sapiens
ggagtcacctgggaggactggg

SEQ ID NO: 9030418 - DNA, 22 bp, Homo sapiens
ggagtcaccaagtaggagtctt

SEQ ID NO: 9030419 - DNA, 22 bp, Homo sapiens
ggagtcaccaagtaggagtctt

SEQ ID NO: 9030420 - DNA, 22 bp, Homo sapiens
ggagtcaggagcaggctgggct

SEQ ID NO: 9030421 - DNA, 22 bp, Homo sapiens
ggagtcaggatcctggggatgg

SEQ ID NO: 9030422 - DNA, 22 bp, Homo sapiens
ggagtcaggagcaggctgggct

SEQ ID NO: 9030423 - DNA, 22 bp, Homo sapiens
ggagtcaggcagacctagttat

SEQ ID NO: 9030424 - DNA, 22 bp, Homo sapiens
ggagtcaggcagacctagttat

SEQ ID NO: 9030425 - DNA, 21 bp, Homo sapiens
ggagtcagggtctggctgggg

SEQ ID NO: 9030426 - DNA, 22 bp, Homo sapiens
ggagtcagtgatcgcgtgtctc

SEQ ID NO: 9030427 - DNA, 22 bp, Homo sapiens
ggagtcagaggaaggcttgctc

SEQ ID NO: 9030428 - DNA, 22 bp, Homo sapiens
ggagtcagcctgtcagagtgta

SEQ ID NO: 9030429 - DNA, 22 bp, Homo sapiens
ggagtcagcctgtcagagtgta

SEQ ID NO: 9030430 - DNA, 22 bp, Homo sapiens
ggagtcctggactccatctcac

SEQ ID NO: 9030431 - DNA, 22 bp, Homo sapiens
ggagtccctgtccccatacgag

SEQ ID NO: 9030432 - DNA, 22 bp, Homo sapiens
ggagtcccagcaaagccttccc

SEQ ID NO: 9030433 - DNA, 22 bp, Homo sapiens
ggagtccatgcagcttgagaca

SEQ ID NO: 9030434 - DNA, 22 bp, Homo sapiens
ggagtccatgcagcttgagaca

SEQ ID NO: 9030435 - DNA, 22 bp, Homo sapiens
ggagtccaacgtgcagccagga

SEQ ID NO: 9030436 - DNA, 22 bp, Homo sapiens
ggagtcctggactccatctcac

SEQ ID NO: 9030437 - DNA, 22 bp, Homo sapiens
ggagtcctgtgtcttccaggaa

SEQ ID NO: 9030438 - DNA, 22 bp, Homo sapiens
ggagtctgacccttagagatga

SEQ ID NO: 9030439 - DNA, 22 bp, Homo sapiens
ggagtctgacccttagagatga

SEQ ID NO: 9030440 - DNA, 22 bp, Homo sapiens
ggagtctagggtcctgggcctg

SEQ ID NO: 9030441 - DNA, 22 bp, Homo sapiens
ggagtctgacccttagagatga

SEQ ID NO: 9030442 - DNA, 22 bp, Homo sapiens
ggagtctgagtcctcatagaca

SEQ ID NO: 9030443 - DNA, 19 bp, Homo sapiens
ggagtctgagcccaggtat

SEQ ID NO: 9030444 - DNA, 19 bp, Homo sapiens
ggagtctgagcccaggtat

SEQ ID NO: 9030445 - DNA, 22 bp, Homo sapiens
ggagtctgatactgagttcctc

SEQ ID NO: 9030446 - DNA, 22 bp, Homo sapiens
ggagtctgagtcctcatagaca

SEQ ID NO: 9030447 - DNA, 22 bp, Homo sapiens
ggagtgaggcatttgtagctga

SEQ ID NO: 9030448 - DNA, 22 bp, Homo sapiens
ggagtgagcaaatagagatttg

SEQ ID NO: 9030449 - DNA, 21 bp, Homo sapiens
ggagtctgaggaagaaaactg

SEQ ID NO: 9030450 - DNA, 22 bp, Homo sapiens
ggagccagaggctgctgctgtg

SEQ ID NO: 9030451 - DNA, 22 bp, Homo sapiens
ggagccagagcactggggagcc

SEQ ID NO: 9030452 - DNA, 22 bp, Homo sapiens
ggagccagagcactggggagcc

SEQ ID NO: 9030453 - DNA, 22 bp, Homo sapiens
ggagccagagcactggggagcc

SEQ ID NO: 9030454 - DNA, 22 bp, Homo sapiens
ggagccagagcactggggagcc

SEQ ID NO: 9030455 - DNA, 22 bp, Homo sapiens
ggagccagagcactggggagcc

SEQ ID NO: 9030456 - DNA, 22 bp, Homo sapiens
ggagccagaggctgctgctgtg

SEQ ID NO: 9030457 - DNA, 22 bp, Homo sapiens
ggagccagaggctgctgctgtg

SEQ ID NO: 9030458 - DNA, 22 bp, Homo sapiens
ggagccagaggctgctgctgtg

SEQ ID NO: 9030459 - DNA, 22 bp, Homo sapiens
ggagccagaggctgctgctgtg

SEQ ID NO: 9030460 - DNA, 22 bp, Homo sapiens
ggagccagaggctgctgctgtg

SEQ ID NO: 9030461 - DNA, 22 bp, Homo sapiens
ggagccagagtctgcagtgtaa

SEQ ID NO: 9030462 - DNA, 22 bp, Homo sapiens
ggagccagagtctgcagtgtaa

SEQ ID NO: 9030463 - DNA, 22 bp, Homo sapiens
ggagccagagtctgcagtgtaa

SEQ ID NO: 9030464 - DNA, 22 bp, Homo sapiens
ggagccagagtctgcagtgtaa

SEQ ID NO: 9030465 - DNA, 22 bp, Homo sapiens
ggagccagagtctgcagtgtaa

SEQ ID NO: 9030466 - DNA, 22 bp, Homo sapiens
ggagccagagtttaatgtggag

SEQ ID NO: 9030467 - DNA, 22 bp, Homo sapiens
ggagccagagtttaatgtggag

SEQ ID NO: 9030468 - DNA, 22 bp, Homo sapiens
ggagccagagtttaatgtggag

SEQ ID NO: 9030469 - DNA, 22 bp, Homo sapiens
ggagccagagtttaatgtggag

SEQ ID NO: 9030470 - DNA, 22 bp, Homo sapiens
ggagccagagtttaatgtggag

SEQ ID NO: 9030471 - DNA, 22 bp, Homo sapiens
ggagccagattgtataaaaaag

SEQ ID NO: 9030472 - DNA, 22 bp, Homo sapiens
ggagccagagggatgcagttga

SEQ ID NO: 9030473 - DNA, 22 bp, Homo sapiens
ggagccagagggatgcagttga

SEQ ID NO: 9030474 - DNA, 22 bp, Homo sapiens
ggagccagagtctgcagtgtaa

SEQ ID NO: 9030475 - DNA, 22 bp, Homo sapiens
ggagccagagggatgcagttga

SEQ ID NO: 9030476 - DNA, 22 bp, Homo sapiens
ggagccagagggatgcagttga

SEQ ID NO: 9030477 - DNA, 23 bp, Homo sapiens
ggagccagcctgtggggagcggg

SEQ ID NO: 9030478 - DNA, 23 bp, Homo sapiens
ggagccagcctgtggggagcggg

SEQ ID NO: 9030479 - DNA, 23 bp, Homo sapiens
ggagccagcctgtggggagcggg

SEQ ID NO: 9030480 - DNA, 23 bp, Homo sapiens
ggagccagcctgtggggagcggg

SEQ ID NO: 9030481 - DNA, 22 bp, Homo sapiens
ggagccagctccctccttgtga

SEQ ID NO: 9030482 - DNA, 22 bp, Homo sapiens
ggagccagctccctccttgtga

SEQ ID NO: 9030483 - DNA, 19 bp, Homo sapiens
ggagccagctgtggaaggc

SEQ ID NO: 9030484 - DNA, 22 bp, Homo sapiens
ggagccagcagggtgacactga

SEQ ID NO: 9030485 - DNA, 22 bp, Homo sapiens
ggagccagcagggtgacactga

SEQ ID NO: 9030486 - DNA, 22 bp, Homo sapiens
ggagccagcagggtgacactga

SEQ ID NO: 9030487 - DNA, 22 bp, Homo sapiens
ggagccagcagggtgacactga

SEQ ID NO: 9030488 - DNA, 19 bp, Homo sapiens
ggagccagctgtggaaggc

SEQ ID NO: 9030489 - DNA, 19 bp, Homo sapiens
ggagccagctgtggaaggc

SEQ ID NO: 9030490 - DNA, 19 bp, Homo sapiens
ggagccagctgtggaaggc

SEQ ID NO: 9030491 - DNA, 17 bp, Homo sapiens
ggagccaggagcccacc

SEQ ID NO: 9030492 - DNA, 19 bp, Homo sapiens
ggagccagctgtggaaggc

SEQ ID NO: 9030493 - DNA, 19 bp, Homo sapiens
ggagccagctgtggaaggc

SEQ ID NO: 9030494 - DNA, 19 bp, Homo sapiens
ggagccagctgtggaaggc

SEQ ID NO: 9030495 - DNA, 19 bp, Homo sapiens
ggagccagctgtggaaggc

SEQ ID NO: 9030496 - DNA, 22 bp, Homo sapiens
ggagtcacacagagaagataag

SEQ ID NO: 9030497 - DNA, 22 bp, Homo sapiens
ggagtcaaggaaggctctgtga

SEQ ID NO: 9030498 - DNA, 17 bp, Homo sapiens
ggagccaggagcccacc

SEQ ID NO: 9030499 - DNA, 22 bp, Homo sapiens
ggagtaggccccgggagagagt

SEQ ID NO: 9030500 - DNA, 22 bp, Homo sapiens
ggagtgcggtggcaccatctca

SEQ ID NO: 9030501 - DNA, 22 bp, Homo sapiens
ggagtgctcagcgccaacctgg

SEQ ID NO: 9030502 - DNA, 22 bp, Homo sapiens
ggagtgcagtggtgggatctca

SEQ ID NO: 9030503 - DNA, 23 bp, Homo sapiens
ggagtgcaatggcgccatctcgg

SEQ ID NO: 9030504 - DNA, 22 bp, Homo sapiens
ggagtgcagctcacaggacatc

SEQ ID NO: 9030505 - DNA, 23 bp, Homo sapiens
ggagtgcaatggcgccatctcgg

SEQ ID NO: 9030506 - DNA, 22 bp, Homo sapiens
ggagtgagtggccttgtcactg

SEQ ID NO: 9030507 - DNA, 23 bp, Homo sapiens
ggagtgcaatggcgccatctcgg

SEQ ID NO: 9030508 - DNA, 23 bp, Homo sapiens
ggagtgcaatggcgccatctcgg

SEQ ID NO: 9030509 - DNA, 23 bp, Homo sapiens
ggagtgcaatggcgccatctcgg

SEQ ID NO: 9030510 - DNA, 22 bp, Homo sapiens
ggagtgagtactggagtagctg

SEQ ID NO: 9030511 - DNA, 22 bp, Homo sapiens
ggagtgagtactggagtagctg

SEQ ID NO: 9030512 - DNA, 22 bp, Homo sapiens
ggagtgagtactggagtagctg

SEQ ID NO: 9030513 - DNA, 22 bp, Homo sapiens
ggagtgagtggccttgtcactg

SEQ ID NO: 9030514 - DNA, 22 bp, Homo sapiens
ggcaaaaagttcccatcagtgt

SEQ ID NO: 9030515 - DNA, 22 bp, Homo sapiens
ggcaaaaagttcccatcagtgt

SEQ ID NO: 9030516 - DNA, 22 bp, Homo sapiens
ggcaaaaaccgcaataacttct

SEQ ID NO: 9030517 - DNA, 22 bp, Homo sapiens
ggcaaaaaccgcaataacttct

SEQ ID NO: 9030518 - DNA, 22 bp, Homo sapiens
ggcaaaaaccataattactttt

SEQ ID NO: 9030519 - DNA, 22 bp, Homo sapiens
ggcaaaaaccgcaataacttct

SEQ ID NO: 9030520 - DNA, 22 bp, Homo sapiens
ggcaaaaaccataattactttt

SEQ ID NO: 9030521 - DNA, 22 bp, Homo sapiens
ggcaaaaaccacaattactttt

SEQ ID NO: 9030522 - DNA, 22 bp, Homo sapiens
ggcaaaaaccacaattactttt

SEQ ID NO: 9030523 - DNA, 22 bp, Homo sapiens
ggcaaaaacagcaatgactttt

SEQ ID NO: 9030524 - DNA, 22 bp, Homo sapiens
ggattttgttcctagctttaaa

SEQ ID NO: 9030525 - DNA, 22 bp, Homo sapiens
ggcaaaaacagcaatgactttt

SEQ ID NO: 9030526 - DNA, 22 bp, Homo sapiens
ggagtgctcctctccccagtgc

SEQ ID NO: 9030527 - DNA, 22 bp, Homo sapiens
ggcaaacagacttgaccatctt

SEQ ID NO: 9030528 - DNA, 22 bp, Homo sapiens
ggcaaacaccaggcgagggagc

SEQ ID NO: 9030529 - DNA, 22 bp, Homo sapiens
ggcaaaagtattatctctttaa

SEQ ID NO: 9030530 - DNA, 22 bp, Homo sapiens
ggcaaaaatcacccctggttca

SEQ ID NO: 9030531 - DNA, 22 bp, Homo sapiens
ggcaaaaatcacccctggttca

SEQ ID NO: 9030532 - DNA, 22 bp, Homo sapiens
ggcaaagccttccagctgttac

SEQ ID NO: 9030533 - DNA, 22 bp, Homo sapiens
ggcaagaggtccaagaggtctc

SEQ ID NO: 9030534 - DNA, 22 bp, Homo sapiens
ggcaagaggtccaagaggtctc

SEQ ID NO: 9030535 - DNA, 22 bp, Homo sapiens
ggcaagaggtccaagaggtctc

SEQ ID NO: 9030536 - DNA, 22 bp, Homo sapiens
ggcaagaggtccaagaggtctc

SEQ ID NO: 9030537 - DNA, 22 bp, Homo sapiens
ggcaagaggtccaagaggtctc

SEQ ID NO: 9030538 - DNA, 22 bp, Homo sapiens
ggcaagagggcagatggagtgc

SEQ ID NO: 9030539 - DNA, 22 bp, Homo sapiens
ggcaagagtgaggagtgtctct

SEQ ID NO: 9030540 - DNA, 22 bp, Homo sapiens
ggcaagagtgaggagtgtctct

SEQ ID NO: 9030541 - DNA, 22 bp, Homo sapiens
ggcaagagtgaggagtgtctct

SEQ ID NO: 9030542 - DNA, 22 bp, Homo sapiens
ggcaagaggtccaagaggtctc

SEQ ID NO: 9030543 - DNA, 22 bp, Homo sapiens
ggcaagaggtccaagaggtctc

SEQ ID NO: 9030544 - DNA, 19 bp, Homo sapiens
ggcaagcacaaaagctttg

SEQ ID NO: 9030545 - DNA, 22 bp, Homo sapiens
ggcaagctcaggcctcaggtgt

SEQ ID NO: 9030546 - DNA, 22 bp, Homo sapiens
ggcacagcaggagctatgtgaa

SEQ ID NO: 9030547 - DNA, 22 bp, Homo sapiens
ggcaagagttgaagctccagga

SEQ ID NO: 9030548 - DNA, 22 bp, Homo sapiens
ggcaagatccaaggggctagga

SEQ ID NO: 9030549 - DNA, 20 bp, Homo sapiens
ggcaagcaactgagggagga

SEQ ID NO: 9030550 - DNA, 22 bp, Homo sapiens
ggcaagagtgaggagtgtctct

SEQ ID NO: 9030551 - DNA, 22 bp, Homo sapiens
ggcaagagtgaggagtgtctct

SEQ ID NO: 9030552 - DNA, 22 bp, Homo sapiens
ggcaagagttgaagctccagga

SEQ ID NO: 9030553 - DNA, 22 bp, Homo sapiens
ggcaagagttgaagctccagga

SEQ ID NO: 9030554 - DNA, 22 bp, Homo sapiens
ggcaagagttgaagctccagga

SEQ ID NO: 9030555 - DNA, 22 bp, Homo sapiens
ggcaagagggcagatggagtgc

SEQ ID NO: 9030556 - DNA, 22 bp, Homo sapiens
ggcaagaaggcttcaggtagct

SEQ ID NO: 9030557 - DNA, 22 bp, Homo sapiens
ggcaagaaggcttcaggtagct

SEQ ID NO: 9030558 - DNA, 21 bp, Homo sapiens
ggcaagaaacacaatcaagta

SEQ ID NO: 9030559 - DNA, 22 bp, Homo sapiens
ggcaagaaccacaattactttt

SEQ ID NO: 9030560 - DNA, 22 bp, Homo sapiens
ggcaagaacctcaattaccttt

SEQ ID NO: 9030561 - DNA, 22 bp, Homo sapiens
ggcaagaaggcttcaggtagct

SEQ ID NO: 9030562 - DNA, 21 bp, Homo sapiens
ggcaagaaacacaatcaagta

SEQ ID NO: 9030563 - DNA, 21 bp, Homo sapiens
ggcaagaaacacaatcaagta

SEQ ID NO: 9030564 - DNA, 22 bp, Homo sapiens
ggcaactcttcttgcaatgggg

SEQ ID NO: 9030565 - DNA, 22 bp, Homo sapiens
ggcaacctgagcttgtggagaa

SEQ ID NO: 9030566 - DNA, 22 bp, Homo sapiens
ggcaacattctccagatccttt

SEQ ID NO: 9030567 - DNA, 17 bp, Homo sapiens
ggcaacatgttcttctg

SEQ ID NO: 9030568 - DNA, 22 bp, Homo sapiens
ggcaacatgatgtcaaccagga

SEQ ID NO: 9030569 - DNA, 22 bp, Homo sapiens
ggcaaagcggccctgtggccag

SEQ ID NO: 9030570 - DNA, 22 bp, Homo sapiens
ggcaaaggaaaacgtctcagct

SEQ ID NO: 9030571 - DNA, 18 bp, Homo sapiens
ggcaaatgcaattcaaag

SEQ ID NO: 9030572 - DNA, 22 bp, Homo sapiens
ggcaacaactggacatagctgg

SEQ ID NO: 9030573 - DNA, 19 bp, Homo sapiens
ggaccagctttcaggaggc

SEQ ID NO: 9030574 - DNA, 22 bp, Homo sapiens
ggaccaggagctcagagccctc

SEQ ID NO: 9030575 - DNA, 22 bp, Homo sapiens
ggaccaggactggtggtatctc

SEQ ID NO: 9030576 - DNA, 22 bp, Homo sapiens
ggaccaggactggtggtatctc

SEQ ID NO: 9030577 - DNA, 19 bp, Homo sapiens
ggaccagctttcaggaggc

SEQ ID NO: 9030578 - DNA, 22 bp, Homo sapiens
ggaccaggagctcagagccctc

SEQ ID NO: 9030579 - DNA, 22 bp, Homo sapiens
ggaccaggagctcagagccctc

SEQ ID NO: 9030580 - DNA, 22 bp, Homo sapiens
ggaccaggagctcagagccctc

SEQ ID NO: 9030581 - DNA, 22 bp, Homo sapiens
ggaccaggctgagcacctgcct

SEQ ID NO: 9030582 - DNA, 22 bp, Homo sapiens
ggaccaggctgagcacctgcct

SEQ ID NO: 9030583 - DNA, 22 bp, Homo sapiens
ggaccaggccagcctccctgcg

SEQ ID NO: 9030584 - DNA, 22 bp, Homo sapiens
ggaccaggcaagctgaggcggg

SEQ ID NO: 9030585 - DNA, 22 bp, Homo sapiens
ggaccaggcaagctgaggcggg

SEQ ID NO: 9030586 - DNA, 19 bp, Homo sapiens
ggacatcactctaagcctt

SEQ ID NO: 9030587 - DNA, 22 bp, Homo sapiens
ggacatcatattgcccagggcc

SEQ ID NO: 9030588 - DNA, 18 bp, Homo sapiens
ggacatcatcaggtgctt

SEQ ID NO: 9030589 - DNA, 22 bp, Homo sapiens
ggacatgaagcaaaatgggagg

SEQ ID NO: 9030590 - DNA, 22 bp, Homo sapiens
ggacatggaaatcggcttgctc

SEQ ID NO: 9030591 - DNA, 22 bp, Homo sapiens
ggacatggaaatcggcttgctc

SEQ ID NO: 9030592 - DNA, 20 bp, Homo sapiens
ggaccagctgtctgaggggc

SEQ ID NO: 9030593 - DNA, 20 bp, Homo sapiens
ggaccagctgtctgaggggc

SEQ ID NO: 9030594 - DNA, 22 bp, Homo sapiens
ggacatgattagcagggagagc

SEQ ID NO: 9030595 - DNA, 22 bp, Homo sapiens
ggacatgatatttcaggaagac

SEQ ID NO: 9030596 - DNA, 22 bp, Homo sapiens
ggacatggaaatcggcttgctc

SEQ ID NO: 9030597 - DNA, 22 bp, Homo sapiens
ggaccaggggcgcactccctgc

SEQ ID NO: 9030598 - DNA, 22 bp, Homo sapiens
ggaccaggctgagcacctgcct

SEQ ID NO: 9030599 - DNA, 17 bp, Homo sapiens
ggaccaggggttgccat

SEQ ID NO: 9030600 - DNA, 22 bp, Homo sapiens
ggaccagtttcaaactgtacca

SEQ ID NO: 9030601 - DNA, 19 bp, Homo sapiens
ggaccaggtcctgggcagc

SEQ ID NO: 9030602 - DNA, 19 bp, Homo sapiens
ggaccaggtcctgggcagc

SEQ ID NO: 9030603 - DNA, 19 bp, Homo sapiens
ggaccaggtcctgggcagc

SEQ ID NO: 9030604 - DNA, 19 bp, Homo sapiens
ggaccaggtcctgggcagc

SEQ ID NO: 9030605 - DNA, 19 bp, Homo sapiens
ggaccaggtcctgggcagc

SEQ ID NO: 9030606 - DNA, 22 bp, Homo sapiens
ggagacagtatggcttgtagct

SEQ ID NO: 9030607 - DNA, 22 bp, Homo sapiens
ggagacagtatggcttgtagct

SEQ ID NO: 9030608 - DNA, 22 bp, Homo sapiens
ggagacagggttgaaccacgca

SEQ ID NO: 9030609 - DNA, 22 bp, Homo sapiens
ggagacagtatggcttgtagct

SEQ ID NO: 9030610 - DNA, 22 bp, Homo sapiens
ggagacagtatggcttgtagct

SEQ ID NO: 9030611 - DNA, 22 bp, Homo sapiens
ggagacagtatggcttgtagct

SEQ ID NO: 9030612 - DNA, 22 bp, Homo sapiens
ggaccatctctagccagagctt

SEQ ID NO: 9030613 - DNA, 22 bp, Homo sapiens
ggagacagggttgaaccacgca

SEQ ID NO: 9030614 - DNA, 22 bp, Homo sapiens
ggaccatgttccctctgaagct

SEQ ID NO: 9030615 - DNA, 22 bp, Homo sapiens
ggaccatggacaaatttctaga

SEQ ID NO: 9030616 - DNA, 22 bp, Homo sapiens
ggagacagggttgaaccacgca

SEQ ID NO: 9030617 - DNA, 22 bp, Homo sapiens
ggagacagtatggcttgtagct

SEQ ID NO: 9030618 - DNA, 21 bp, Homo sapiens
ggacagtagtagtcaggagag

SEQ ID NO: 9030619 - DNA, 22 bp, Homo sapiens
ggacagtagtcactaaactaga

SEQ ID NO: 9030620 - DNA, 22 bp, Homo sapiens
ggacaggttcagcagtttataa

SEQ ID NO: 9030621 - DNA, 22 bp, Homo sapiens
ggacagtccacctcagtgaaga

SEQ ID NO: 9030622 - DNA, 22 bp, Homo sapiens
ggacaggtgtgaggctggcaca

SEQ ID NO: 9030623 - DNA, 22 bp, Homo sapiens
ggacagtgtctgcttcaggccc

SEQ ID NO: 9030624 - DNA, 22 bp, Homo sapiens
ggacatagaggccctgcatggc

SEQ ID NO: 9030625 - DNA, 22 bp, Homo sapiens
ggacagtgtctgcttcaggccc

SEQ ID NO: 9030626 - DNA, 19 bp, Homo sapiens
ggacagtctcagcctcatg

SEQ ID NO: 9030627 - DNA, 20 bp, Homo sapiens
ggacagtgagacatatctca

SEQ ID NO: 9030628 - DNA, 22 bp, Homo sapiens
ggacacagggctcactctctct

SEQ ID NO: 9030629 - DNA, 23 bp, Homo sapiens
ggacacaggccttgtctgcgcct

SEQ ID NO: 9030630 - DNA, 23 bp, Homo sapiens
ggacacaggccttgtctgcgcct

SEQ ID NO: 9030631 - DNA, 22 bp, Homo sapiens
ggacacaggcagctgggtgggt

SEQ ID NO: 9030632 - DNA, 22 bp, Homo sapiens
ggacacaggcagctgggtgggt

SEQ ID NO: 9030633 - DNA, 22 bp, Homo sapiens
ggacacagctgcagccacaccc

SEQ ID NO: 9030634 - DNA, 22 bp, Homo sapiens
ggacacagctgcagccacaccc

SEQ ID NO: 9030635 - DNA, 22 bp, Homo sapiens
ggacacagctgcagccacaccc

SEQ ID NO: 9030636 - DNA, 22 bp, Homo sapiens
ggacacagtggaagacagcttg

SEQ ID NO: 9030637 - DNA, 22 bp, Homo sapiens
ggacacagtggaagacagcttg

SEQ ID NO: 9030638 - DNA, 22 bp, Homo sapiens
ggacacagtggaagacagcttg

SEQ ID NO: 9030639 - DNA, 22 bp, Homo sapiens
ggacagggtaagtactagtgtg

SEQ ID NO: 9030640 - DNA, 22 bp, Homo sapiens
ggacagggtaagtactagtgtg

SEQ ID NO: 9030641 - DNA, 22 bp, Homo sapiens
ggacagggttggggcatataaa

SEQ ID NO: 9030642 - DNA, 22 bp, Homo sapiens
ggacagggttggggcatataaa

SEQ ID NO: 9030643 - DNA, 22 bp, Homo sapiens
ggacagggtaagtactagtgtg

SEQ ID NO: 9030644 - DNA, 22 bp, Homo sapiens
ggacagggtaagtactagtgtg

SEQ ID NO: 9030645 - DNA, 22 bp, Homo sapiens
ggagagagagattgtgtttatt

SEQ ID NO: 9030646 - DNA, 22 bp, Homo sapiens
ggagagagagctcattagctgc

SEQ ID NO: 9030647 - DNA, 22 bp, Homo sapiens
ggagagagagctcattagctgc

SEQ ID NO: 9030648 - DNA, 22 bp, Homo sapiens
ggagagagagattgtgtttatt

SEQ ID NO: 9030649 - DNA, 22 bp, Homo sapiens
ggagagagacctccatgcccag

SEQ ID NO: 9030650 - DNA, 22 bp, Homo sapiens
ggagagagacctccatgcccag

SEQ ID NO: 9030651 - DNA, 22 bp, Homo sapiens
ggagagagacctccatgcccag

SEQ ID NO: 9030652 - DNA, 22 bp, Homo sapiens
ggagagagacctccatgcccag

SEQ ID NO: 9030653 - DNA, 22 bp, Homo sapiens
ggagagaattccatggacatgt

SEQ ID NO: 9030654 - DNA, 22 bp, Homo sapiens
ggagagaattccatggacatgt

SEQ ID NO: 9030655 - DNA, 22 bp, Homo sapiens
ggagagaccctggagaaggtcc

SEQ ID NO: 9030656 - DNA, 22 bp, Homo sapiens
ggagagaccctggagaaggtcc

SEQ ID NO: 9030657 - DNA, 22 bp, Homo sapiens
ggagcaggctctgtggtttcca

SEQ ID NO: 9030658 - DNA, 22 bp, Homo sapiens
ggagcaggctctgtggtttcca

SEQ ID NO: 9030659 - DNA, 22 bp, Homo sapiens
ggagcaggcagggccgtgtctg

SEQ ID NO: 9030660 - DNA, 22 bp, Homo sapiens
ggagcagggaattacagcgcag

SEQ ID NO: 9030661 - DNA, 22 bp, Homo sapiens
ggagcagggaattacagcgcag

SEQ ID NO: 9030662 - DNA, 22 bp, Homo sapiens
ggagcagcactgccacacagag

SEQ ID NO: 9030663 - DNA, 22 bp, Homo sapiens
ggagcagcactgattagcggtt

SEQ ID NO: 9030664 - DNA, 22 bp, Homo sapiens
ggagcagcactgattagcggtt

SEQ ID NO: 9030665 - DNA, 22 bp, Homo sapiens
ggagcagatgtcttcatggcct

SEQ ID NO: 9030666 - DNA, 22 bp, Homo sapiens
ggagcagatgtcttcatggcct

SEQ ID NO: 9030667 - DNA, 22 bp, Homo sapiens
ggagcagggaattacagcgcag

SEQ ID NO: 9030668 - DNA, 22 bp, Homo sapiens
ggagcagggaattacagcgcag

SEQ ID NO: 9030669 - DNA, 22 bp, Homo sapiens
ggagcagggcagtgaattctgg

SEQ ID NO: 9030670 - DNA, 22 bp, Homo sapiens
ggagcagggaattacagcgcag

SEQ ID NO: 9030671 - DNA, 22 bp, Homo sapiens
ggagcagggcagtgaattctgg

SEQ ID NO: 9030672 - DNA, 22 bp, Homo sapiens
ggagcagttgttgagcaagcca

SEQ ID NO: 9030673 - DNA, 22 bp, Homo sapiens
ggagcagtggtcattcagctgg

SEQ ID NO: 9030674 - DNA, 22 bp, Homo sapiens
ggagcatgcgctctgtgaccga

SEQ ID NO: 9030675 - DNA, 22 bp, Homo sapiens
ggagcatctgaacagggagaag

SEQ ID NO: 9030676 - DNA, 22 bp, Homo sapiens
ggagcatgtggggtgagcaggg

SEQ ID NO: 9030677 - DNA, 22 bp, Homo sapiens
ggagcatgtggggtgagcaggg

SEQ ID NO: 9030678 - DNA, 22 bp, Homo sapiens
ggagcatgtggggtgagcaggg

SEQ ID NO: 9030679 - DNA, 22 bp, Homo sapiens
ggagccagaaatgctgtggttg

SEQ ID NO: 9030680 - DNA, 22 bp, Homo sapiens
ggagccagaaatgctgtggttg

SEQ ID NO: 9030681 - DNA, 22 bp, Homo sapiens
ggagccagaaatgctgtggttg

SEQ ID NO: 9030682 - DNA, 22 bp, Homo sapiens
ggagcatgtggggtgagcaggg

SEQ ID NO: 9030683 - DNA, 22 bp, Homo sapiens
ggagcatgtggggtgagcaggg

SEQ ID NO: 9030684 - DNA, 22 bp, Homo sapiens
ggagccagagcactggggagcc

SEQ ID NO: 9030685 - DNA, 22 bp, Homo sapiens
ggagccagagcactggggagcc

SEQ ID NO: 9030686 - DNA, 22 bp, Homo sapiens
ggagccagagcactggggagcc

SEQ ID NO: 9030687 - DNA, 22 bp, Homo sapiens
ggagccagaaatgctgtggttg

SEQ ID NO: 9030688 - DNA, 22 bp, Homo sapiens
ggagccagaaatgctgtggttg

SEQ ID NO: 9030689 - DNA, 22 bp, Homo sapiens
ggagccagaaatgctgtggttg

SEQ ID NO: 9030690 - DNA, 22 bp, Homo sapiens
ggagaccaggtcagagatggtg

SEQ ID NO: 9030691 - DNA, 18 bp, Homo sapiens
ggagactaaactgttgac

SEQ ID NO: 9030692 - DNA, 22 bp, Homo sapiens
ggagaccaggtcagagatggtg

SEQ ID NO: 9030693 - DNA, 18 bp, Homo sapiens
ggagactaaactgttgac

SEQ ID NO: 9030694 - DNA, 22 bp, Homo sapiens
ggagactacctagcaggctgtt

SEQ ID NO: 9030695 - DNA, 22 bp, Homo sapiens
ggagactcaccccgcattctag

SEQ ID NO: 9030696 - DNA, 22 bp, Homo sapiens
ggagactcaccccgcattctag

SEQ ID NO: 9030697 - DNA, 22 bp, Homo sapiens
ggagactctcattgtcaagctt

SEQ ID NO: 9030698 - DNA, 22 bp, Homo sapiens
ggagacagtgacttagagactg

SEQ ID NO: 9030699 - DNA, 22 bp, Homo sapiens
ggagacagtggtagggcctaag

SEQ ID NO: 9030700 - DNA, 22 bp, Homo sapiens
ggagacagtggtagggcctaag

SEQ ID NO: 9030701 - DNA, 22 bp, Homo sapiens
ggagacagtggtagggcctaag

SEQ ID NO: 9030702 - DNA, 22 bp, Homo sapiens
ggagacagtggtagggcctaag

SEQ ID NO: 9030703 - DNA, 22 bp, Homo sapiens
ggagacagtggtagggcctaag

SEQ ID NO: 9030704 - DNA, 22 bp, Homo sapiens
ggagacagtgacttagagactg

SEQ ID NO: 9030705 - DNA, 22 bp, Homo sapiens
ggagacagtgacttagagactg

SEQ ID NO: 9030706 - DNA, 22 bp, Homo sapiens
ggagacagtgacttagagactg

SEQ ID NO: 9030707 - DNA, 22 bp, Homo sapiens
ggagacagtgacttagagactg

SEQ ID NO: 9030708 - DNA, 22 bp, Homo sapiens
ggagacagtgacttagagactg

SEQ ID NO: 9030709 - DNA, 22 bp, Homo sapiens
ggagacagtgacttagagactg

SEQ ID NO: 9030710 - DNA, 22 bp, Homo sapiens
ggagagaactggctccttctag

SEQ ID NO: 9030711 - DNA, 22 bp, Homo sapiens
ggagagaagggagaatttgttc

SEQ ID NO: 9030712 - DNA, 22 bp, Homo sapiens
ggagagaactggctccttctag

SEQ ID NO: 9030713 - DNA, 22 bp, Homo sapiens
ggagagaatctgaacctgctcc

SEQ ID NO: 9030714 - DNA, 22 bp, Homo sapiens
ggagagaattcagcttaagatt

SEQ ID NO: 9030715 - DNA, 22 bp, Homo sapiens
ggagagaattccatggacatgt

SEQ ID NO: 9030716 - DNA, 22 bp, Homo sapiens
ggagagaattccatggacatgt

SEQ ID NO: 9030717 - DNA, 22 bp, Homo sapiens
ggagagaactgacctgaaagga

SEQ ID NO: 9030718 - DNA, 22 bp, Homo sapiens
ggagagaactgacctgaaagga

SEQ ID NO: 9030719 - DNA, 22 bp, Homo sapiens
ggagagaaattgaggtagcaag

SEQ ID NO: 9030720 - DNA, 22 bp, Homo sapiens
ggagagaaattgaggtagcaag

SEQ ID NO: 9030721 - DNA, 22 bp, Homo sapiens
ggagacttgagtttttgtctta

SEQ ID NO: 9030722 - DNA, 22 bp, Homo sapiens
ggagacttggcttggatgcttc

SEQ ID NO: 9030723 - DNA, 22 bp, Homo sapiens
ggagacttgagtttttgtctta

SEQ ID NO: 9030724 - DNA, 18 bp, Homo sapiens
gctttcaatttctttcct

SEQ ID NO: 9030725 - DNA, 22 bp, Homo sapiens
gctttcaattatgtcagcctgt

SEQ ID NO: 9030726 - DNA, 20 bp, Homo sapiens
gctttcaagcttgtcattgt

SEQ ID NO: 9030727 - DNA, 22 bp, Homo sapiens
gctttattttgtgagggattac

SEQ ID NO: 9030728 - DNA, 18 bp, Homo sapiens
gctttatttcttggggaa

SEQ ID NO: 9030729 - DNA, 22 bp, Homo sapiens
gctttattttgtgagggattac

SEQ ID NO: 9030730 - DNA, 22 bp, Homo sapiens
gctttattttgtgagggattac

SEQ ID NO: 9030731 - DNA, 22 bp, Homo sapiens
gctttattttgtgagggattac

SEQ ID NO: 9030732 - DNA, 22 bp, Homo sapiens
gctttattttgtgagggattac

SEQ ID NO: 9030733 - DNA, 22 bp, Homo sapiens
gctttattttgtgagggattac

SEQ ID NO: 9030734 - DNA, 22 bp, Homo sapiens
gctttattttgtgagggattac

SEQ ID NO: 9030735 - DNA, 22 bp, Homo sapiens
gctttattttgtgagggattac

SEQ ID NO: 9030736 - DNA, 22 bp, Homo sapiens
gctttccctgccctcagaagga

SEQ ID NO: 9030737 - DNA, 22 bp, Homo sapiens
gctttcatgaaaataatctact

SEQ ID NO: 9030738 - DNA, 22 bp, Homo sapiens
gctttcatgaaaataatctact

SEQ ID NO: 9030739 - DNA, 22 bp, Homo sapiens
gctttgcttcctgttctagcct

SEQ ID NO: 9030740 - DNA, 22 bp, Homo sapiens
gctttgctggcttgaaatgctg

SEQ ID NO: 9030741 - DNA, 22 bp, Homo sapiens
gctttgcttccttccccttcaa

SEQ ID NO: 9030742 - DNA, 22 bp, Homo sapiens
gctttggaaactggccctgcgc

SEQ ID NO: 9030743 - DNA, 22 bp, Homo sapiens
gctttggaaactggccctgcgc

SEQ ID NO: 9030744 - DNA, 22 bp, Homo sapiens
gctttggaaataagaggctaaa

SEQ ID NO: 9030745 - DNA, 17 bp, Homo sapiens
gctttggaaagccttcc

SEQ ID NO: 9030746 - DNA, 22 bp, Homo sapiens
gctttggaacttaaatccttgg

SEQ ID NO: 9030747 - DNA, 22 bp, Homo sapiens
gctttggaaggggctggtggag

SEQ ID NO: 9030748 - DNA, 22 bp, Homo sapiens
gctttggaacttaaatccttgg

SEQ ID NO: 9030749 - DNA, 22 bp, Homo sapiens
gctttggaaatatagactcaag

SEQ ID NO: 9030750 - DNA, 22 bp, Homo sapiens
gctttggaacttaaatccttgg

SEQ ID NO: 9030751 - DNA, 22 bp, Homo sapiens
gctttctgatgagcttaagaaa

SEQ ID NO: 9030752 - DNA, 22 bp, Homo sapiens
gctttctgattgcgaaaacaaa

SEQ ID NO: 9030753 - DNA, 22 bp, Homo sapiens
gctttctgatgagcttaagaaa

SEQ ID NO: 9030754 - DNA, 22 bp, Homo sapiens
gctttctgatgagcttaagaaa

SEQ ID NO: 9030755 - DNA, 22 bp, Homo sapiens
gctttctgaagcagtgtttctc

SEQ ID NO: 9030756 - DNA, 22 bp, Homo sapiens
gctttctcttcactgatgttca

SEQ ID NO: 9030757 - DNA, 22 bp, Homo sapiens
gctttctcttcactgatgttca

SEQ ID NO: 9030758 - DNA, 22 bp, Homo sapiens
gctttctgcctgggctccattt

SEQ ID NO: 9030759 - DNA, 22 bp, Homo sapiens
gctttctgattgcgaaaacaaa

SEQ ID NO: 9030760 - DNA, 22 bp, Homo sapiens
gctttctgcctgggctccattt

SEQ ID NO: 9030761 - DNA, 22 bp, Homo sapiens
gctttgctagcactgcgcttcc

SEQ ID NO: 9030762 - DNA, 22 bp, Homo sapiens
gctttgctggcttgaaatgctg

SEQ ID NO: 9030763 - DNA, 22 bp, Homo sapiens
gctttgctatgactcaccagca

SEQ ID NO: 9030764 - DNA, 22 bp, Homo sapiens
gctttggaatctgcatcctctt

SEQ ID NO: 9030765 - DNA, 22 bp, Homo sapiens
gctttggaatgtgctgttatag

SEQ ID NO: 9030766 - DNA, 17 bp, Homo sapiens
gctttggaagggtagac

SEQ ID NO: 9030767 - DNA, 22 bp, Homo sapiens
gctttggacaataactgctttt

SEQ ID NO: 9030768 - DNA, 22 bp, Homo sapiens
gctttggagcctgtgttctgcc

SEQ ID NO: 9030769 - DNA, 22 bp, Homo sapiens
gctttggagttaggactcggcc

SEQ ID NO: 9030770 - DNA, 22 bp, Homo sapiens
gctttggagtcagaaagaccta

SEQ ID NO: 9030771 - DNA, 22 bp, Homo sapiens
ggaagaagcagggcatttgaat

SEQ ID NO: 9030772 - DNA, 22 bp, Homo sapiens
ggaagaagcagggcatttgaat

SEQ ID NO: 9030773 - DNA, 22 bp, Homo sapiens
gctttggagtcagaaagaccta

SEQ ID NO: 9030774 - DNA, 22 bp, Homo sapiens
gctttggagggcaagagctgtt

SEQ ID NO: 9030775 - DNA, 22 bp, Homo sapiens
gctttggagggcaagagctgtt

SEQ ID NO: 9030776 - DNA, 19 bp, Homo sapiens
gctttggagggaggttcta

SEQ ID NO: 9030777 - DNA, 22 bp, Homo sapiens
ggaagaagggtcattggcagcc

SEQ ID NO: 9030778 - DNA, 22 bp, Homo sapiens
ggaagacaagcagtggctgagc

SEQ ID NO: 9030779 - DNA, 22 bp, Homo sapiens
ggaagacaagcagtggctgagc

SEQ ID NO: 9030780 - DNA, 22 bp, Homo sapiens
ggaagacaagcagtggctgagc

SEQ ID NO: 9030781 - DNA, 22 bp, Homo sapiens
ggaagacagaagcctacagctt

SEQ ID NO: 9030782 - DNA, 22 bp, Homo sapiens
ggaagacaagcagtggctgagc

SEQ ID NO: 9030783 - DNA, 22 bp, Homo sapiens
ggaagaggaggagccaggcttt

SEQ ID NO: 9030784 - DNA, 22 bp, Homo sapiens
ggaagaggaggagccaggcttt

SEQ ID NO: 9030785 - DNA, 22 bp, Homo sapiens
ggaagaggaggagccaggcttt

SEQ ID NO: 9030786 - DNA, 22 bp, Homo sapiens
ggaagacagaagcctacagctt

SEQ ID NO: 9030787 - DNA, 22 bp, Homo sapiens
ggaagaggaggagccaggcttt

SEQ ID NO: 9030788 - DNA, 22 bp, Homo sapiens
ggaagaggctgagccaggtccc

SEQ ID NO: 9030789 - DNA, 22 bp, Homo sapiens
ggaagaggctgagccaggtccc

SEQ ID NO: 9030790 - DNA, 22 bp, Homo sapiens
ggaagaggctgaggccatgctg

SEQ ID NO: 9030791 - DNA, 22 bp, Homo sapiens
ggaagaggctgaggccatgctg

SEQ ID NO: 9030792 - DNA, 22 bp, Homo sapiens
ggaagaggctgaggccatgctg

SEQ ID NO: 9030793 - DNA, 22 bp, Homo sapiens
ggaagaggctgaggccatgctg

SEQ ID NO: 9030794 - DNA, 22 bp, Homo sapiens
ggaagaggctgaggccatgctg

SEQ ID NO: 9030795 - DNA, 22 bp, Homo sapiens
ggaagaggctgaggccatgctg

SEQ ID NO: 9030796 - DNA, 22 bp, Homo sapiens
ggaagaggctggtagtgcccgt

SEQ ID NO: 9030797 - DNA, 22 bp, Homo sapiens
ggaagaggctctcattgagggc

SEQ ID NO: 9030798 - DNA, 22 bp, Homo sapiens
ggaagaggctctcattgagggc

SEQ ID NO: 9030799 - DNA, 22 bp, Homo sapiens
ggaagaggctctcattgagggc

SEQ ID NO: 9030800 - DNA, 22 bp, Homo sapiens
ggaagaggctctcattgagggc

SEQ ID NO: 9030801 - DNA, 22 bp, Homo sapiens
ggaagaggctgagccaggtccc

SEQ ID NO: 9030802 - DNA, 22 bp, Homo sapiens
ggaagaggctgagccaggtccc

SEQ ID NO: 9030803 - DNA, 22 bp, Homo sapiens
ggaagaggctctcattgagggc

SEQ ID NO: 9030804 - DNA, 22 bp, Homo sapiens
ggaagaggctctcattgagggc

SEQ ID NO: 9030805 - DNA, 22 bp, Homo sapiens
ggaagcacagcataaagttact

SEQ ID NO: 9030806 - DNA, 22 bp, Homo sapiens
ggaagatgcccaacccagcttt

SEQ ID NO: 9030807 - DNA, 22 bp, Homo sapiens
ggaagcactgaggcagagaggg

SEQ ID NO: 9030808 - DNA, 22 bp, Homo sapiens
ggaagcactgaggcagagaggg

SEQ ID NO: 9030809 - DNA, 22 bp, Homo sapiens
ggaagcactgaggcagagaggg

SEQ ID NO: 9030810 - DNA, 22 bp, Homo sapiens
ggaagcaggaggctggggtaaa

SEQ ID NO: 9030811 - DNA, 22 bp, Homo sapiens
ggaagcaggaggctggggtaaa

SEQ ID NO: 9030812 - DNA, 22 bp, Homo sapiens
ggaagcagcctgaagccaaggg

SEQ ID NO: 9030813 - DNA, 22 bp, Homo sapiens
ggaagcagcctgaagccaaggg

SEQ ID NO: 9030814 - DNA, 22 bp, Homo sapiens
ggaagcagcctgaagccaaggg

SEQ ID NO: 9030815 - DNA, 22 bp, Homo sapiens
ggaagcagcctgaagccaaggg

SEQ ID NO: 9030816 - DNA, 22 bp, Homo sapiens
ggaagcagcctgaagccaaggg

SEQ ID NO: 9030817 - DNA, 22 bp, Homo sapiens
ggaagcagcctgaagccaaggg

SEQ ID NO: 9030818 - DNA, 22 bp, Homo sapiens
ggaagcagcctgaagccaaggg

SEQ ID NO: 9030819 - DNA, 22 bp, Homo sapiens
ggaatctagaaagggagcaagg

SEQ ID NO: 9030820 - DNA, 22 bp, Homo sapiens
ggaatcctggtgttttctgcct

SEQ ID NO: 9030821 - DNA, 22 bp, Homo sapiens
ggaatcctgccagctctgcccc

SEQ ID NO: 9030822 - DNA, 22 bp, Homo sapiens
ggaatcctgccagctctgcccc

SEQ ID NO: 9030823 - DNA, 22 bp, Homo sapiens
ggaatcttcagccatgccaaga

SEQ ID NO: 9030824 - DNA, 22 bp, Homo sapiens
ggaatcttaatggcatggagtt

SEQ ID NO: 9030825 - DNA, 22 bp, Homo sapiens
ggaatctcagtggagctgttag

SEQ ID NO: 9030826 - DNA, 22 bp, Homo sapiens
ggaatcagcaaggaggctcacc

SEQ ID NO: 9030827 - DNA, 22 bp, Homo sapiens
ggaatcagatgaggggcagagc

SEQ ID NO: 9030828 - DNA, 22 bp, Homo sapiens
ggaagatgcccaacccagcttt

SEQ ID NO: 9030829 - DNA, 22 bp, Homo sapiens
ggaagatgagaagtggggctcc

SEQ ID NO: 9030830 - DNA, 22 bp, Homo sapiens
ggaagatgagaagtggggctcc

SEQ ID NO: 9030831 - DNA, 22 bp, Homo sapiens
ggaagagtgcaggtttgtttca

SEQ ID NO: 9030832 - DNA, 22 bp, Homo sapiens
ggaagatgagaagtggggctcc

SEQ ID NO: 9030833 - DNA, 22 bp, Homo sapiens
ggaagattcagcatatatgagt

SEQ ID NO: 9030834 - DNA, 22 bp, Homo sapiens
ggaagattcagcatatatgagt

SEQ ID NO: 9030835 - DNA, 18 bp, Homo sapiens
ggaagattggctatgtgc

SEQ ID NO: 9030836 - DNA, 22 bp, Homo sapiens
ggaagattcagttatctcatga

SEQ ID NO: 9030837 - DNA, 22 bp, Homo sapiens
ggaagattcagttatctcatga

SEQ ID NO: 9030838 - DNA, 22 bp, Homo sapiens
ggaagattttccattcctcttt

SEQ ID NO: 9030839 - DNA, 22 bp, Homo sapiens
ggaagcaaaatcatcagtcatt

SEQ ID NO: 9030840 - DNA, 22 bp, Homo sapiens
ggaagatttcccgtagctgtgc

SEQ ID NO: 9030841 - DNA, 22 bp, Homo sapiens
ggaagaggctggtagtgcccgt

SEQ ID NO: 9030842 - DNA, 22 bp, Homo sapiens
ggaagaggctggtagtgcccgt

SEQ ID NO: 9030843 - DNA, 22 bp, Homo sapiens
ggaagaggctggtagtgcccgt

SEQ ID NO: 9030844 - DNA, 22 bp, Homo sapiens
ggaagagggaaccacgactgta

SEQ ID NO: 9030845 - DNA, 22 bp, Homo sapiens
ggaagagggaaccacgactgta

SEQ ID NO: 9030846 - DNA, 22 bp, Homo sapiens
ggaagagggaaccacgactgta

SEQ ID NO: 9030847 - DNA, 22 bp, Homo sapiens
ggacacagccacttagggtacc

SEQ ID NO: 9030848 - DNA, 22 bp, Homo sapiens
ggacacagccacttagggtacc

SEQ ID NO: 9030849 - DNA, 18 bp, Homo sapiens
ggacacagataggtacag

SEQ ID NO: 9030850 - DNA, 18 bp, Homo sapiens
ggacacagataggtacag

SEQ ID NO: 9030851 - DNA, 22 bp, Homo sapiens
ggacaaagcctggtggcaggtg

SEQ ID NO: 9030852 - DNA, 22 bp, Homo sapiens
ggacaaaccaatagacactggc

SEQ ID NO: 9030853 - DNA, 22 bp, Homo sapiens
ggacacagataatcacacagat

SEQ ID NO: 9030854 - DNA, 18 bp, Homo sapiens
ggacacagataggtacag

SEQ ID NO: 9030855 - DNA, 17 bp, Homo sapiens
ggacacagctcatggct

SEQ ID NO: 9030856 - DNA, 17 bp, Homo sapiens
ggacacagctcatggct

SEQ ID NO: 9030857 - DNA, 17 bp, Homo sapiens
ggacacagctcatggct

SEQ ID NO: 9030858 - DNA, 17 bp, Homo sapiens
ggacacagctcatggct

SEQ ID NO: 9030859 - DNA, 17 bp, Homo sapiens
ggacacagctcatggct

SEQ ID NO: 9030860 - DNA, 22 bp, Homo sapiens
ggaatgtttttcattgctctct

SEQ ID NO: 9030861 - DNA, 22 bp, Homo sapiens
ggaatgtttttcattgctctct

SEQ ID NO: 9030862 - DNA, 22 bp, Homo sapiens
ggaatgttttccagacctagat

SEQ ID NO: 9030863 - DNA, 22 bp, Homo sapiens
ggaatgttttagcttgactttt

SEQ ID NO: 9030864 - DNA, 22 bp, Homo sapiens
ggaatgttttagcttgactttt

SEQ ID NO: 9030865 - DNA, 21 bp, Homo sapiens
ggaattgcaggctgtcttttg

SEQ ID NO: 9030866 - DNA, 22 bp, Homo sapiens
ggaattgctaacattctgaagg

SEQ ID NO: 9030867 - DNA, 22 bp, Homo sapiens
ggaatttagatgtttctcaact

SEQ ID NO: 9030868 - DNA, 22 bp, Homo sapiens
ggacaaaaatcagccatctcta

SEQ ID NO: 9030869 - DNA, 20 bp, Homo sapiens
ggaattgctttcctgtcttt

SEQ ID NO: 9030870 - DNA, 22 bp, Homo sapiens
ggacaaaatccaaacttcttag

SEQ ID NO: 9030871 - DNA, 22 bp, Homo sapiens
ggacaaaacttcttgcatttct

SEQ ID NO: 9030872 - DNA, 22 bp, Homo sapiens
ggacaaaatccaaacttcttag

SEQ ID NO: 9030873 - DNA, 22 bp, Homo sapiens
ggacaaaatccaaacttcttag

SEQ ID NO: 9030874 - DNA, 22 bp, Homo sapiens
ggaatctttttcataagcctca

SEQ ID NO: 9030875 - DNA, 22 bp, Homo sapiens
ggaatgaaacacttctgattct

SEQ ID NO: 9030876 - DNA, 22 bp, Homo sapiens
ggaatgaaacacttctgattct

SEQ ID NO: 9030877 - DNA, 22 bp, Homo sapiens
ggaatgaaacacttctgattct

SEQ ID NO: 9030878 - DNA, 22 bp, Homo sapiens
ggaatctttgaaggattttaag

SEQ ID NO: 9030879 - DNA, 22 bp, Homo sapiens
ggaatgaatttccagctgggtc

SEQ ID NO: 9030880 - DNA, 22 bp, Homo sapiens
ggaatgaagaaatagatggtgt

SEQ ID NO: 9030881 - DNA, 22 bp, Homo sapiens
ggaatgaagaaatagatggtgt

SEQ ID NO: 9030882 - DNA, 22 bp, Homo sapiens
ggaatgaagaaatagatggtgt

SEQ ID NO: 9030883 - DNA, 22 bp, Homo sapiens
ggaatgaagaaatagatggtgt

SEQ ID NO: 9030884 - DNA, 22 bp, Homo sapiens
ggaatgcaattttacaattctg

SEQ ID NO: 9030885 - DNA, 22 bp, Homo sapiens
ggaatgcactgaaaattgtgct

SEQ ID NO: 9030886 - DNA, 22 bp, Homo sapiens
ggaatgcagtaagtgatttgaa

SEQ ID NO: 9030887 - DNA, 22 bp, Homo sapiens
ggaatgagctcggagcagaagg

SEQ ID NO: 9030888 - DNA, 22 bp, Homo sapiens
ggaatgagctcggagcagaagg

SEQ ID NO: 9030889 - DNA, 22 bp, Homo sapiens
ggaatgaatttccagctgggtc

SEQ ID NO: 9030890 - DNA, 18 bp, Homo sapiens
ggaatgtggacaggctgg

SEQ ID NO: 9030891 - DNA, 22 bp, Homo sapiens
ggaatgttctggaacaccgctt

SEQ ID NO: 9030892 - DNA, 22 bp, Homo sapiens
ggaatgttctggtctggttcat

SEQ ID NO: 9030893 - DNA, 22 bp, Homo sapiens
ggaatgttgtcatttacattat

SEQ ID NO: 9030894 - DNA, 22 bp, Homo sapiens
ggaatgttgtcatttacattat

SEQ ID NO: 9030895 - DNA, 22 bp, Homo sapiens
ggaatgttgtcatttacattat

SEQ ID NO: 9030896 - DNA, 23 bp, Homo sapiens
ggaatgtttacctgtgaatgtca

SEQ ID NO: 9030897 - DNA, 22 bp, Homo sapiens
ggaatgtttgctcccttcaggg

SEQ ID NO: 9030898 - DNA, 22 bp, Homo sapiens
ggaatgggagctattagtggaa

SEQ ID NO: 9030899 - DNA, 22 bp, Homo sapiens
gctgtggctgtacagagaccat

SEQ ID NO: 9030900 - DNA, 22 bp, Homo sapiens
gctgtggctgtacagagaccat

SEQ ID NO: 9030901 - DNA, 22 bp, Homo sapiens
gctgtggctgaccaccaggggg

SEQ ID NO: 9030902 - DNA, 22 bp, Homo sapiens
gctgtggctgaccaccaggggg

SEQ ID NO: 9030903 - DNA, 22 bp, Homo sapiens
gctgtggcttgcagctggggct

SEQ ID NO: 9030904 - DNA, 22 bp, Homo sapiens
gctgtggcttgcagctggggct

SEQ ID NO: 9030905 - DNA, 22 bp, Homo sapiens
gctgtggcttgcagctggggct

SEQ ID NO: 9030906 - DNA, 22 bp, Homo sapiens
gctgtggctttctgtttctgtt

SEQ ID NO: 9030907 - DNA, 22 bp, Homo sapiens
gctgtggctttctgtttctgtt

SEQ ID NO: 9030908 - DNA, 19 bp, Homo sapiens
gctgtgggacagcagggtg

SEQ ID NO: 9030909 - DNA, 19 bp, Homo sapiens
gctgtgggacagcagggtg

SEQ ID NO: 9030910 - DNA, 19 bp, Homo sapiens
gctgtgggacagcagggtg

SEQ ID NO: 9030911 - DNA, 19 bp, Homo sapiens
gctgtgggacagcagggtg

SEQ ID NO: 9030912 - DNA, 22 bp, Homo sapiens
gctgtggctccaatggtgagcc

SEQ ID NO: 9030913 - DNA, 22 bp, Homo sapiens
gctgtggcggcagcagctggtg

SEQ ID NO: 9030914 - DNA, 22 bp, Homo sapiens
gctgtggcggcagcagctggtg

SEQ ID NO: 9030915 - DNA, 22 bp, Homo sapiens
gctgtggcggcagcagctggtg

SEQ ID NO: 9030916 - DNA, 22 bp, Homo sapiens
gctgtggctgaagatgcaggga

SEQ ID NO: 9030917 - DNA, 22 bp, Homo sapiens
gctgtggctgaagatgcaggga

SEQ ID NO: 9030918 - DNA, 22 bp, Homo sapiens
gctgtggctctcacaagcaaat

SEQ ID NO: 9030919 - DNA, 19 bp, Homo sapiens
gctgtgggacagcagggtg

SEQ ID NO: 9030920 - DNA, 19 bp, Homo sapiens
gctgtgggacagcagggtg

SEQ ID NO: 9030921 - DNA, 22 bp, Homo sapiens
gctgtgggccacacggctgagt

SEQ ID NO: 9030922 - DNA, 22 bp, Homo sapiens
gctgtgggacaggtccagccag

SEQ ID NO: 9030923 - DNA, 22 bp, Homo sapiens
gctgtgggccacacggctgagt

SEQ ID NO: 9030924 - DNA, 22 bp, Homo sapiens
gctgtgggtaaacgctgagggt

SEQ ID NO: 9030925 - DNA, 22 bp, Homo sapiens
gctgtgggtaaacgctgagggt

SEQ ID NO: 9030926 - DNA, 22 bp, Homo sapiens
gctgtgggtaaacgctgagggt

SEQ ID NO: 9030927 - DNA, 22 bp, Homo sapiens
gctgtggggagagaacacacaa

SEQ ID NO: 9030928 - DNA, 22 bp, Homo sapiens
gctgtgggccatggccaagtga

SEQ ID NO: 9030929 - DNA, 22 bp, Homo sapiens
gctgtgggtaaacgctgagggt

SEQ ID NO: 9030930 - DNA, 22 bp, Homo sapiens
gctgtgggtaaacgctgagggt

SEQ ID NO: 9030931 - DNA, 22 bp, Homo sapiens
gctgtgggtaaacgctgagggt

SEQ ID NO: 9030932 - DNA, 22 bp, Homo sapiens
gctgtgggtccggaccccacgg

SEQ ID NO: 9030933 - DNA, 22 bp, Homo sapiens
gctgtgggtgctggctccaccc

SEQ ID NO: 9030934 - DNA, 22 bp, Homo sapiens
gctgtgggtacaaatacacaat

SEQ ID NO: 9030935 - DNA, 22 bp, Homo sapiens
gctgtgggtttccaatcctgga

SEQ ID NO: 9030936 - DNA, 22 bp, Homo sapiens
gctgtgggtttccaatcctgga

SEQ ID NO: 9030937 - DNA, 22 bp, Homo sapiens
gctgtgggttcctggcatttga

SEQ ID NO: 9030938 - DNA, 22 bp, Homo sapiens
gctgtgggtttccaatcctgga

SEQ ID NO: 9030939 - DNA, 22 bp, Homo sapiens
gctgtgggttcctggcatttga

SEQ ID NO: 9030940 - DNA, 22 bp, Homo sapiens
gctgtgggtttccaatcctgga

SEQ ID NO: 9030941 - DNA, 20 bp, Homo sapiens
gctgtgcctccagctggtgg

SEQ ID NO: 9030942 - DNA, 19 bp, Homo sapiens
gctgtgcccctgccgcttg

SEQ ID NO: 9030943 - DNA, 20 bp, Homo sapiens
gctgtgcctccagctggtgg

SEQ ID NO: 9030944 - DNA, 22 bp, Homo sapiens
gctggggctgggctgaggaaga

SEQ ID NO: 9030945 - DNA, 22 bp, Homo sapiens
gctggggctgggctgaggaaga

SEQ ID NO: 9030946 - DNA, 19 bp, Homo sapiens
gctgtgcccctgccgcttg

SEQ ID NO: 9030947 - DNA, 19 bp, Homo sapiens
gctgtgcccctgccgcttg

SEQ ID NO: 9030948 - DNA, 19 bp, Homo sapiens
gctgtgcctctctcctgct

SEQ ID NO: 9030949 - DNA, 19 bp, Homo sapiens
gctgtgcctctctcctgct

SEQ ID NO: 9030950 - DNA, 19 bp, Homo sapiens
gctgtgcctctctcctgct

SEQ ID NO: 9030951 - DNA, 19 bp, Homo sapiens
gctggggcctgaccagaca

SEQ ID NO: 9030952 - DNA, 19 bp, Homo sapiens
gctggggcctgaccagaca

SEQ ID NO: 9030953 - DNA, 22 bp, Homo sapiens
gctggggcctgaacagtcagct

SEQ ID NO: 9030954 - DNA, 22 bp, Homo sapiens
gctggggcctgaacagtcagct

SEQ ID NO: 9030955 - DNA, 22 bp, Homo sapiens
gctggggcctgaacagtcagct

SEQ ID NO: 9030956 - DNA, 22 bp, Homo sapiens
gctggggctgggctgaggaaga

SEQ ID NO: 9030957 - DNA, 22 bp, Homo sapiens
gctggggctgggctgaggaaga

SEQ ID NO: 9030958 - DNA, 22 bp, Homo sapiens
gctggggctgggctgaggaaga

SEQ ID NO: 9030959 - DNA, 22 bp, Homo sapiens
gctggggctgggctgaggaaga

SEQ ID NO: 9030960 - DNA, 19 bp, Homo sapiens
gctggggcctgaccagaca

SEQ ID NO: 9030961 - DNA, 19 bp, Homo sapiens
gctggggcctgaccagaca

SEQ ID NO: 9030962 - DNA, 22 bp, Homo sapiens
gctggggctgggctgaggaaga

SEQ ID NO: 9030963 - DNA, 22 bp, Homo sapiens
gctggggcctgaacagtcagct

SEQ ID NO: 9030964 - DNA, 22 bp, Homo sapiens
gctggggcctgaacagtcagct

SEQ ID NO: 9030965 - DNA, 22 bp, Homo sapiens
gctggggcctgaacagtcagct

SEQ ID NO: 9030966 - DNA, 22 bp, Homo sapiens
gctggggcctgaacagtcagct

SEQ ID NO: 9030967 - DNA, 22 bp, Homo sapiens
gctggggcctctgtgaggttaa

SEQ ID NO: 9030968 - DNA, 22 bp, Homo sapiens
gctggggcctctgtgaggttaa

SEQ ID NO: 9030969 - DNA, 22 bp, Homo sapiens
gctggggagggcgtcaaggcca

SEQ ID NO: 9030970 - DNA, 22 bp, Homo sapiens
gctggggagggcgtcaaggcca

SEQ ID NO: 9030971 - DNA, 22 bp, Homo sapiens
gctggggagggcgtcaaggcca

SEQ ID NO: 9030972 - DNA, 22 bp, Homo sapiens
gctggggagggcgtcaaggcca

SEQ ID NO: 9030973 - DNA, 19 bp, Homo sapiens
gctgggcttgggtttgtag

SEQ ID NO: 9030974 - DNA, 22 bp, Homo sapiens
gctggggaggcagcagagaaca

SEQ ID NO: 9030975 - DNA, 22 bp, Homo sapiens
gctggggaggcagcagagaaca

SEQ ID NO: 9030976 - DNA, 22 bp, Homo sapiens
gctggggaggcagcagagaaca

SEQ ID NO: 9030977 - DNA, 22 bp, Homo sapiens
gctgggcttggtttccctgctt

SEQ ID NO: 9030978 - DNA, 22 bp, Homo sapiens
gctgggcttggtttccctgctt

SEQ ID NO: 9030979 - DNA, 22 bp, Homo sapiens
gctgggcttctcaatgctgcct

SEQ ID NO: 9030980 - DNA, 19 bp, Homo sapiens
gctgggcttgggtttgtag

SEQ ID NO: 9030981 - DNA, 19 bp, Homo sapiens
gctgggcttgggtttgtag

SEQ ID NO: 9030982 - DNA, 19 bp, Homo sapiens
gctgggcttgggtttgtag

SEQ ID NO: 9030983 - DNA, 22 bp, Homo sapiens
gctgggcttggtttccctgctt

SEQ ID NO: 9030984 - DNA, 22 bp, Homo sapiens
gcttcttgcctgtgtagagaat

SEQ ID NO: 9030985 - DNA, 19 bp, Homo sapiens
gcttctgtttgggcttaga

SEQ ID NO: 9030986 - DNA, 19 bp, Homo sapiens
gcttctgtttgggcttaga

SEQ ID NO: 9030987 - DNA, 22 bp, Homo sapiens
gcttctgtggtgcatctttgct

SEQ ID NO: 9030988 - DNA, 22 bp, Homo sapiens
gcttctgttaacttatgttccc

SEQ ID NO: 9030989 - DNA, 22 bp, Homo sapiens
gcttctgttcaaggatataagg

SEQ ID NO: 9030990 - DNA, 22 bp, Homo sapiens
gcttctgttcaaggatataagg

SEQ ID NO: 9030991 - DNA, 22 bp, Homo sapiens
gcttctgtggtgaggtcacctt

SEQ ID NO: 9030992 - DNA, 22 bp, Homo sapiens
gcttctgtggtgcatctttgct

SEQ ID NO: 9030993 - DNA, 22 bp, Homo sapiens
gcttctgtggttgtcacgacta

SEQ ID NO: 9030994 - DNA, 22 bp, Homo sapiens
gcttctgtggtgcatctttgct

SEQ ID NO: 9030995 - DNA, 22 bp, Homo sapiens
gcttctgtggttgtcacgacta

SEQ ID NO: 9030996 - DNA, 22 bp, Homo sapiens
gcttctgttaacttatgttccc

SEQ ID NO: 9030997 - DNA, 22 bp, Homo sapiens
gcttctgtatttattgtccttt

SEQ ID NO: 9030998 - DNA, 22 bp, Homo sapiens
gcttctgtcttagctacctccc

SEQ ID NO: 9030999 - DNA, 22 bp, Homo sapiens
gcttctgtcttagctacctccc

SEQ ID NO: 9031000 - DNA, 22 bp, Homo sapiens
gcttctgtatttattgtccttt

SEQ ID NO: 9031001 - DNA, 22 bp, Homo sapiens
gcttctgtatttattgtccttt

SEQ ID NO: 9031002 - DNA, 21 bp, Homo sapiens
gcttctgtatctagcaggaac

SEQ ID NO: 9031003 - DNA, 21 bp, Homo sapiens
gcttctgtatctagcaggaac

SEQ ID NO: 9031004 - DNA, 21 bp, Homo sapiens
gcttctgtatctagcaggaac

SEQ ID NO: 9031005 - DNA, 22 bp, Homo sapiens
gcttctgtcttagctacctccc

SEQ ID NO: 9031006 - DNA, 22 bp, Homo sapiens
gcttctgtcttagctacctccc

SEQ ID NO: 9031007 - DNA, 22 bp, Homo sapiens
gcttctgtgagtgcagatgctg

SEQ ID NO: 9031008 - DNA, 22 bp, Homo sapiens
gcttctgtggtgaggtcacctt

SEQ ID NO: 9031009 - DNA, 22 bp, Homo sapiens
gcttctgtggattggctggctt

SEQ ID NO: 9031010 - DNA, 22 bp, Homo sapiens
gcttctgtggattggctggctt

SEQ ID NO: 9031011 - DNA, 22 bp, Homo sapiens
gctgtgtatcagatgccacggg

SEQ ID NO: 9031012 - DNA, 22 bp, Homo sapiens
gctgtgtcagaaactctgggga

SEQ ID NO: 9031013 - DNA, 22 bp, Homo sapiens
gctgtgtcagaaactctgggga

SEQ ID NO: 9031014 - DNA, 22 bp, Homo sapiens
gctgtgtcagaaactctgggga

SEQ ID NO: 9031015 - DNA, 22 bp, Homo sapiens
gctgtgtccaggtgggggtgac

SEQ ID NO: 9031016 - DNA, 22 bp, Homo sapiens
gctgtgtccaggtgggggtgac

SEQ ID NO: 9031017 - DNA, 19 bp, Homo sapiens
gctgtgtcatttcttagga

SEQ ID NO: 9031018 - DNA, 22 bp, Homo sapiens
gctgtgtcctcacacagccttt

SEQ ID NO: 9031019 - DNA, 22 bp, Homo sapiens
gctgtgtatcagatgccacggg

SEQ ID NO: 9031020 - DNA, 22 bp, Homo sapiens
gctgtgtatcagatgccacggg

SEQ ID NO: 9031021 - DNA, 22 bp, Homo sapiens
gctgtgtatcagatgccacggg

SEQ ID NO: 9031022 - DNA, 22 bp, Homo sapiens
gctgtgtaaacttgtacagtgc

SEQ ID NO: 9031023 - DNA, 22 bp, Homo sapiens
gctgtgtaaacttgtacagtgc

SEQ ID NO: 9031024 - DNA, 22 bp, Homo sapiens
gctgtgtgaaaactgggcctgg

SEQ ID NO: 9031025 - DNA, 22 bp, Homo sapiens
gctgtgtgaccctagccagtag

SEQ ID NO: 9031026 - DNA, 22 bp, Homo sapiens
gctgtgtgaccctagccagtag

SEQ ID NO: 9031027 - DNA, 22 bp, Homo sapiens
gctgtgtgaccctagccagtag

SEQ ID NO: 9031028 - DNA, 22 bp, Homo sapiens
gctgtgtgaccctagccagtag

SEQ ID NO: 9031029 - DNA, 22 bp, Homo sapiens
gcttctggtgaggcctcaggaa

SEQ ID NO: 9031030 - DNA, 22 bp, Homo sapiens
gcttctggtgaggcctcaggaa

SEQ ID NO: 9031031 - DNA, 22 bp, Homo sapiens
gctgtgtgaaaactgggcctgg

SEQ ID NO: 9031032 - DNA, 22 bp, Homo sapiens
gctgtgtgaaaactgggcctgg

SEQ ID NO: 9031033 - DNA, 22 bp, Homo sapiens
gctgtgtgaaaactgggcctgg

SEQ ID NO: 9031034 - DNA, 22 bp, Homo sapiens
gctgtgtctgttttacgtcaag

SEQ ID NO: 9031035 - DNA, 22 bp, Homo sapiens
gctgtgtctgttttacgtcaag

SEQ ID NO: 9031036 - DNA, 22 bp, Homo sapiens
gctgtgtctgttttacgtcaag

SEQ ID NO: 9031037 - DNA, 22 bp, Homo sapiens
gctgtgtcctcacacagccttt

SEQ ID NO: 9031038 - DNA, 22 bp, Homo sapiens
gctgtgtcctcacacagccttt

SEQ ID NO: 9031039 - DNA, 22 bp, Homo sapiens
gcttgcctggcatttctggggc

SEQ ID NO: 9031040 - DNA, 23 bp, Homo sapiens
gcttgcctggtgtgtggctgacc

SEQ ID NO: 9031041 - DNA, 22 bp, Homo sapiens
gcttgctagaagcttaaaggta

SEQ ID NO: 9031042 - DNA, 22 bp, Homo sapiens
gcttgctctttagccatggcca

SEQ ID NO: 9031043 - DNA, 22 bp, Homo sapiens
gcttgcatgatatggcatctgg

SEQ ID NO: 9031044 - DNA, 22 bp, Homo sapiens
gcttgccagacactcgaggggg

SEQ ID NO: 9031045 - DNA, 22 bp, Homo sapiens
gcttgaaaattcataggtattt

SEQ ID NO: 9031046 - DNA, 20 bp, Homo sapiens
gcttcttttctggcccatga

SEQ ID NO: 9031047 - DNA, 22 bp, Homo sapiens
gcttgagggtctgagatccact

SEQ ID NO: 9031048 - DNA, 22 bp, Homo sapiens
gcttctttccttgggctggaac

SEQ ID NO: 9031049 - DNA, 22 bp, Homo sapiens
gcttctgttcaaggatataagg

SEQ ID NO: 9031050 - DNA, 22 bp, Homo sapiens
gcttctttggcaaccctgacat

SEQ ID NO: 9031051 - DNA, 22 bp, Homo sapiens
gcttgagttttgggacaaagcc

SEQ ID NO: 9031052 - DNA, 22 bp, Homo sapiens
gcttgcagtggttggcatgacc

SEQ ID NO: 9031053 - DNA, 18 bp, Homo sapiens
gctttatttcttggggaa

SEQ ID NO: 9031054 - DNA, 18 bp, Homo sapiens
gctttatttcttggggaa

SEQ ID NO: 9031055 - DNA, 18 bp, Homo sapiens
gctttatttcttggggaa

SEQ ID NO: 9031056 - DNA, 18 bp, Homo sapiens
gctttatttcttggggaa

SEQ ID NO: 9031057 - DNA, 18 bp, Homo sapiens
gctttatttcttggggaa

SEQ ID NO: 9031058 - DNA, 18 bp, Homo sapiens
gctttatttcttggggaa

SEQ ID NO: 9031059 - DNA, 18 bp, Homo sapiens
gctttatttcttggggaa

SEQ ID NO: 9031060 - DNA, 22 bp, Homo sapiens
gctttatgtgagtagcactgtc

SEQ ID NO: 9031061 - DNA, 22 bp, Homo sapiens
gctttatgtaagtccaaaggca

SEQ ID NO: 9031062 - DNA, 22 bp, Homo sapiens
gcttggaagtaggattgggaga

SEQ ID NO: 9031063 - DNA, 22 bp, Homo sapiens
gcttgctttgtaaatatctgtg

SEQ ID NO: 9031064 - DNA, 19 bp, Homo sapiens
gcttgctttatgaaggggg

SEQ ID NO: 9031065 - DNA, 19 bp, Homo sapiens
gcttgctttatgaaggggg

SEQ ID NO: 9031066 - DNA, 20 bp, Homo sapiens
gcttgctttgtctgatgggc

SEQ ID NO: 9031067 - DNA, 20 bp, Homo sapiens
gcttgctttgtctgatgggc

SEQ ID NO: 9031068 - DNA, 20 bp, Homo sapiens
gcttgctttgtctgatgggc

SEQ ID NO: 9031069 - DNA, 22 bp, Homo sapiens
gcttggaagtaggattgggaga

SEQ ID NO: 9031070 - DNA, 22 bp, Homo sapiens
gcttggaagtaggattgggaga

SEQ ID NO: 9031071 - DNA, 22 bp, Homo sapiens
gcttgctgaacaggaacctggc

SEQ ID NO: 9031072 - DNA, 22 bp, Homo sapiens
gcttgctggtgcctgcaggctc

SEQ ID NO: 9031073 - DNA, 19 bp, Homo sapiens
gcttgctgctaggtaggga

SEQ ID NO: 9031074 - DNA, 22 bp, Homo sapiens
gcttgcttatttgcccttctcc

SEQ ID NO: 9031075 - DNA, 22 bp, Homo sapiens
gcttgctggtgcctgcaggctc

SEQ ID NO: 9031076 - DNA, 22 bp, Homo sapiens
gctggctttgtggtctctcctc

SEQ ID NO: 9031077 - DNA, 22 bp, Homo sapiens
gctggctttgtggtctctcctc

SEQ ID NO: 9031078 - DNA, 22 bp, Homo sapiens
gctggcttttgaagtctagcta

SEQ ID NO: 9031079 - DNA, 22 bp, Homo sapiens
gctgggctggaaggccaaggca

SEQ ID NO: 9031080 - DNA, 22 bp, Homo sapiens
gctgggaacacagccatgagag

SEQ ID NO: 9031081 - DNA, 22 bp, Homo sapiens
gctgggaacacagccatgagag

SEQ ID NO: 9031082 - DNA, 22 bp, Homo sapiens
gctgggctggaaggccaaggca

SEQ ID NO: 9031083 - DNA, 22 bp, Homo sapiens
gctgggctggaaggccaaggca

SEQ ID NO: 9031084 - DNA, 22 bp, Homo sapiens
gctgggctggaaggccaaggca

SEQ ID NO: 9031085 - DNA, 22 bp, Homo sapiens
gctgggctggccgccgagatcg

SEQ ID NO: 9031086 - DNA, 22 bp, Homo sapiens
gctgggctggccgccgagatcg

SEQ ID NO: 9031087 - DNA, 22 bp, Homo sapiens
gctggctttgtcaagggcagca

SEQ ID NO: 9031088 - DNA, 22 bp, Homo sapiens
gctggctttgtcaagggcagca

SEQ ID NO: 9031089 - DNA, 22 bp, Homo sapiens
gctggctttgtggtctctcctc

SEQ ID NO: 9031090 - DNA, 21 bp, Homo sapiens
gctggctttcctggatgtgca

SEQ ID NO: 9031091 - DNA, 22 bp, Homo sapiens
gctggctttgatcttcccatct

SEQ ID NO: 9031092 - DNA, 22 bp, Homo sapiens
gctggctttgcactgggtgcat

SEQ ID NO: 9031093 - DNA, 22 bp, Homo sapiens
gctggctttgcactgggtgcat

SEQ ID NO: 9031094 - DNA, 21 bp, Homo sapiens
gctggctttattctgcgtttg

SEQ ID NO: 9031095 - DNA, 21 bp, Homo sapiens
gctggctttattctgcgtttg

SEQ ID NO: 9031096 - DNA, 20 bp, Homo sapiens
gctggctttcctaaactgct

SEQ ID NO: 9031097 - DNA, 22 bp, Homo sapiens
gctggctttatcgtcagactcc

SEQ ID NO: 9031098 - DNA, 22 bp, Homo sapiens
gctggcttgtcccaggacaaag

SEQ ID NO: 9031099 - DNA, 22 bp, Homo sapiens
gctggctttatggggcttgtgg

SEQ ID NO: 9031100 - DNA, 23 bp, Homo sapiens
gctgggcttactctttcagtgag

SEQ ID NO: 9031101 - DNA, 23 bp, Homo sapiens
gctgggcttactctttcagtgag

SEQ ID NO: 9031102 - DNA, 23 bp, Homo sapiens
gctgggcttactctttcagtgag

SEQ ID NO: 9031103 - DNA, 22 bp, Homo sapiens
gctgggctgtagtttgctgacc

SEQ ID NO: 9031104 - DNA, 23 bp, Homo sapiens
gctgggcttactctttcagtgag

SEQ ID NO: 9031105 - DNA, 23 bp, Homo sapiens
gctgggcttactctttcagtgag

SEQ ID NO: 9031106 - DNA, 22 bp, Homo sapiens
gctgggctggccgccgagatcg

SEQ ID NO: 9031107 - DNA, 22 bp, Homo sapiens
gctgggctgtagtttgctgacc

SEQ ID NO: 9031108 - DNA, 22 bp, Homo sapiens
gctgggctgtagtttgctgacc

SEQ ID NO: 9031109 - DNA, 22 bp, Homo sapiens
gctgggctgtagtttgctgacc

SEQ ID NO: 9031110 - DNA, 22 bp, Homo sapiens
gctgggctgtagtttgctgacc

SEQ ID NO: 9031111 - DNA, 22 bp, Homo sapiens
gctgggctgtagtttgctgacc

SEQ ID NO: 9031112 - DNA, 22 bp, Homo sapiens
gctgggcttctcaatgctgcct

SEQ ID NO: 9031113 - DNA, 22 bp, Homo sapiens
gctgggcttctcaatgctgcct

SEQ ID NO: 9031114 - DNA, 22 bp, Homo sapiens
gctgggcttctcaatgctgcct

SEQ ID NO: 9031115 - DNA, 22 bp, Homo sapiens
gctgggcttcacctccagagtt

SEQ ID NO: 9031116 - DNA, 22 bp, Homo sapiens
gctgggcttcacctccagagtt

SEQ ID NO: 9031117 - DNA, 22 bp, Homo sapiens
gctgggcttcacctccagagtt

SEQ ID NO: 9031118 - DNA, 22 bp, Homo sapiens
gctgggcttcacagagccttta

SEQ ID NO: 9031119 - DNA, 22 bp, Homo sapiens
gctgggcttcacagagccttta

SEQ ID NO: 9031120 - DNA, 22 bp, Homo sapiens
gctgggcttcacctccagagtt

SEQ ID NO: 9031121 - DNA, 22 bp, Homo sapiens
gctgggcttcacctccagagtt

SEQ ID NO: 9031122 - DNA, 21 bp, Homo sapiens
gctggctggctgaccggcctt

SEQ ID NO: 9031123 - DNA, 21 bp, Homo sapiens
gctggctggctgaccggcctt

SEQ ID NO: 9031124 - DNA, 22 bp, Homo sapiens
gctggctggcgggtgcgtcctc

SEQ ID NO: 9031125 - DNA, 22 bp, Homo sapiens
gctggctggcgggtgcgtcctc

SEQ ID NO: 9031126 - DNA, 21 bp, Homo sapiens
gctggctggctgaccggcctt

SEQ ID NO: 9031127 - DNA, 21 bp, Homo sapiens
gctggctggctgaccggcctt

SEQ ID NO: 9031128 - DNA, 22 bp, Homo sapiens
gctggctgtgggctccacgctc

SEQ ID NO: 9031129 - DNA, 22 bp, Homo sapiens
gctggctgtgggctccacgctc

SEQ ID NO: 9031130 - DNA, 22 bp, Homo sapiens
gctggctgtgggctccacgctc

SEQ ID NO: 9031131 - DNA, 22 bp, Homo sapiens
gctggctgtggcttaagcaaac

SEQ ID NO: 9031132 - DNA, 22 bp, Homo sapiens
gctggctgtggcttaagcaaac

SEQ ID NO: 9031133 - DNA, 22 bp, Homo sapiens
gctggctgtgattttgccaaca

SEQ ID NO: 9031134 - DNA, 22 bp, Homo sapiens
gctggctgtgattttgccaaca

SEQ ID NO: 9031135 - DNA, 22 bp, Homo sapiens
gctggctgttgaataatggcat

SEQ ID NO: 9031136 - DNA, 22 bp, Homo sapiens
gctggctgttgaataatggcat

SEQ ID NO: 9031137 - DNA, 22 bp, Homo sapiens
gctggctgtgtttcatctctga

SEQ ID NO: 9031138 - DNA, 22 bp, Homo sapiens
gctggctgtgtttcatctctga

SEQ ID NO: 9031139 - DNA, 22 bp, Homo sapiens
gctggctgtgttccttctgcca

SEQ ID NO: 9031140 - DNA, 22 bp, Homo sapiens
gctggctgtgtttcatctctga

SEQ ID NO: 9031141 - DNA, 22 bp, Homo sapiens
gctggctgtgtttcatctctga

SEQ ID NO: 9031142 - DNA, 22 bp, Homo sapiens
gctggctgtgttccttctgcca

SEQ ID NO: 9031143 - DNA, 22 bp, Homo sapiens
gctggctgtgttccttctgcca

SEQ ID NO: 9031144 - DNA, 22 bp, Homo sapiens
gctggctgtgggctccacgctc

SEQ ID NO: 9031145 - DNA, 22 bp, Homo sapiens
gctggctgtgttccttctgcca

SEQ ID NO: 9031146 - DNA, 22 bp, Homo sapiens
gctggctgtgttccttctgcca

SEQ ID NO: 9031147 - DNA, 22 bp, Homo sapiens
gctggctgtgttccttctgcca

SEQ ID NO: 9031148 - DNA, 22 bp, Homo sapiens
gctggcttccatgcggacatca

SEQ ID NO: 9031149 - DNA, 22 bp, Homo sapiens
gctggcttccatcagagggtga

SEQ ID NO: 9031150 - DNA, 22 bp, Homo sapiens
gctggcttccctacctgcacct

SEQ ID NO: 9031151 - DNA, 21 bp, Homo sapiens
gctggcttcctgagggctgag

SEQ ID NO: 9031152 - DNA, 21 bp, Homo sapiens
gctggcttcctgagggctgag

SEQ ID NO: 9031153 - DNA, 22 bp, Homo sapiens
gctggctgttggaggtacctgc

SEQ ID NO: 9031154 - DNA, 22 bp, Homo sapiens
gctggcttaatgtagctaaaaa

SEQ ID NO: 9031155 - DNA, 22 bp, Homo sapiens
gctggcttaatagggatgggct

SEQ ID NO: 9031156 - DNA, 22 bp, Homo sapiens
gctggcttaatagggatgggct

SEQ ID NO: 9031157 - DNA, 22 bp, Homo sapiens
gctggctgttggaggtacctgc

SEQ ID NO: 9031158 - DNA, 22 bp, Homo sapiens
gctggctgttgaataatggcat

SEQ ID NO: 9031159 - DNA, 22 bp, Homo sapiens
gctggctgttggaggtacctgc

SEQ ID NO: 9031160 - DNA, 22 bp, Homo sapiens
gctggctgttggaggtacctgc

SEQ ID NO: 9031161 - DNA, 22 bp, Homo sapiens
gctggctgttggaggtacctgc

SEQ ID NO: 9031162 - DNA, 17 bp, Homo sapiens
gctggcttctccttgct

SEQ ID NO: 9031163 - DNA, 17 bp, Homo sapiens
gctggcttctccttgct

SEQ ID NO: 9031164 - DNA, 22 bp, Homo sapiens
gctggcttgacagaggcctggg

SEQ ID NO: 9031165 - DNA, 22 bp, Homo sapiens
gctggcttgacagaggcctggg

SEQ ID NO: 9031166 - DNA, 22 bp, Homo sapiens
gctggcttccttctgcagctag

SEQ ID NO: 9031167 - DNA, 22 bp, Homo sapiens
gctggcttccttctgcagctag

SEQ ID NO: 9031168 - DNA, 22 bp, Homo sapiens
gctggcttgtcccaggacaaag

SEQ ID NO: 9031169 - DNA, 18 bp, Homo sapiens
gctggcttgctgggtttg

SEQ ID NO: 9031170 - DNA, 18 bp, Homo sapiens
gctggcttgctgggtttg

SEQ ID NO: 9031171 - DNA, 22 bp, Homo sapiens
gctggcttgtaataggaatttc

SEQ ID NO: 9031172 - DNA, 22 bp, Homo sapiens
gctggcttgatagtttctgctt

SEQ ID NO: 9031173 - DNA, 22 bp, Homo sapiens
gctggcttgacagaggcctggg

SEQ ID NO: 9031174 - DNA, 22 bp, Homo sapiens
gctggagaacccaggaggaaga

SEQ ID NO: 9031175 - DNA, 22 bp, Homo sapiens
gctggagaacccaggaggaaga

SEQ ID NO: 9031176 - DNA, 22 bp, Homo sapiens
gctggagacctcagagaaccca

SEQ ID NO: 9031177 - DNA, 22 bp, Homo sapiens
gctggagacctcagagaaccca

SEQ ID NO: 9031178 - DNA, 22 bp, Homo sapiens
gctggagacctcagagaaccca

SEQ ID NO: 9031179 - DNA, 22 bp, Homo sapiens
gctggagaaactgcagctgagg

SEQ ID NO: 9031180 - DNA, 22 bp, Homo sapiens
gctggagaaactgcagctgagg

SEQ ID NO: 9031181 - DNA, 22 bp, Homo sapiens
gctggagaaactgcagctgagg

SEQ ID NO: 9031182 - DNA, 22 bp, Homo sapiens
gctggagaaactgcagctgagg

SEQ ID NO: 9031183 - DNA, 22 bp, Homo sapiens
gctggagaaacaggaggaggaa

SEQ ID NO: 9031184 - DNA, 22 bp, Homo sapiens
gctggagaaactgcagctgagg

SEQ ID NO: 9031185 - DNA, 22 bp, Homo sapiens
gctggagaaactgcagctgagg

SEQ ID NO: 9031186 - DNA, 22 bp, Homo sapiens
gctgctttactgaagagatatg

SEQ ID NO: 9031187 - DNA, 22 bp, Homo sapiens
gctgctttacaggtgggggagc

SEQ ID NO: 9031188 - DNA, 22 bp, Homo sapiens
gctgctttagaattgaaacaga

SEQ ID NO: 9031189 - DNA, 22 bp, Homo sapiens
gctgctttagaattgaaacaga

SEQ ID NO: 9031190 - DNA, 22 bp, Homo sapiens
gctgctttaggttgagctcagc

SEQ ID NO: 9031191 - DNA, 22 bp, Homo sapiens
gctgctttagacaggagaagca

SEQ ID NO: 9031192 - DNA, 22 bp, Homo sapiens
gctgctttaggttgagctcagc

SEQ ID NO: 9031193 - DNA, 22 bp, Homo sapiens
gctgctttagaattgaaacaga

SEQ ID NO: 9031194 - DNA, 22 bp, Homo sapiens
gctgctttagaattgaaacaga

SEQ ID NO: 9031195 - DNA, 20 bp, Homo sapiens
gctgctttcaaatgacacgt

SEQ ID NO: 9031196 - DNA, 20 bp, Homo sapiens
gctgctttcaaatgacacgt

SEQ ID NO: 9031197 - DNA, 22 bp, Homo sapiens
gctgctttataatctcggcaga

SEQ ID NO: 9031198 - DNA, 22 bp, Homo sapiens
gctgcttgattaggttgacact

SEQ ID NO: 9031199 - DNA, 22 bp, Homo sapiens
gctggagaaacaggaggaggaa

SEQ ID NO: 9031200 - DNA, 22 bp, Homo sapiens
gctggagaaacaggaggaggaa

SEQ ID NO: 9031201 - DNA, 22 bp, Homo sapiens
gctggagaaacaggaggaggaa

SEQ ID NO: 9031202 - DNA, 22 bp, Homo sapiens
gctggagacctcagagaaccca

SEQ ID NO: 9031203 - DNA, 22 bp, Homo sapiens
gctggagagataggcatggggt

SEQ ID NO: 9031204 - DNA, 22 bp, Homo sapiens
gctggagagataggcatggggt

SEQ ID NO: 9031205 - DNA, 22 bp, Homo sapiens
gctggagagataggcatggggt

SEQ ID NO: 9031206 - DNA, 22 bp, Homo sapiens
gctggagagataggcatggggt

SEQ ID NO: 9031207 - DNA, 22 bp, Homo sapiens
gctggctgccttactttgtgga

SEQ ID NO: 9031208 - DNA, 22 bp, Homo sapiens
gctggctgcgtcatcacagggc

SEQ ID NO: 9031209 - DNA, 22 bp, Homo sapiens
gctggctgcgtcatcacagggc

SEQ ID NO: 9031210 - DNA, 22 bp, Homo sapiens
gctggagagataggcatggggt

SEQ ID NO: 9031211 - DNA, 22 bp, Homo sapiens
gctggctgctaggacagctaca

SEQ ID NO: 9031212 - DNA, 22 bp, Homo sapiens
gctggctgctaggacagctaca

SEQ ID NO: 9031213 - DNA, 22 bp, Homo sapiens
gctggctgcgtcatcacagggc

SEQ ID NO: 9031214 - DNA, 22 bp, Homo sapiens
gctggctgcgtcatcacagggc

SEQ ID NO: 9031215 - DNA, 22 bp, Homo sapiens
gctggctgcgtcatcacagggc

SEQ ID NO: 9031216 - DNA, 22 bp, Homo sapiens
gctggctgcgtcatcacagggc

SEQ ID NO: 9031217 - DNA, 22 bp, Homo sapiens
gctggctgctgttgagacttgt

SEQ ID NO: 9031218 - DNA, 22 bp, Homo sapiens
gctggctgctgttgagacttgt

SEQ ID NO: 9031219 - DNA, 22 bp, Homo sapiens
gctggctggaactagcagttgg

SEQ ID NO: 9031220 - DNA, 22 bp, Homo sapiens
gctggctgctaggacagctaca

SEQ ID NO: 9031221 - DNA, 22 bp, Homo sapiens
gctggctgctgttgagacttgt

SEQ ID NO: 9031222 - DNA, 22 bp, Homo sapiens
gctggctgctaggacagctaca

SEQ ID NO: 9031223 - DNA, 22 bp, Homo sapiens
gctggctggaactagcagttgg

SEQ ID NO: 9031224 - DNA, 22 bp, Homo sapiens
gctggctggaatgggagaagaa

SEQ ID NO: 9031225 - DNA, 22 bp, Homo sapiens
gctggctggaatgggagaagaa

SEQ ID NO: 9031226 - DNA, 22 bp, Homo sapiens
gctggctggaatgggagaagaa

SEQ ID NO: 9031227 - DNA, 22 bp, Homo sapiens
gctggctggaatgggagaagaa

SEQ ID NO: 9031228 - DNA, 22 bp, Homo sapiens
gctggctggaactagcagttgg

SEQ ID NO: 9031229 - DNA, 22 bp, Homo sapiens
gctggctggaactagcagttgg

SEQ ID NO: 9031230 - DNA, 19 bp, Homo sapiens
gctggctggaggagggaca

SEQ ID NO: 9031231 - DNA, 19 bp, Homo sapiens
gctggctggaggagggaca

SEQ ID NO: 9031232 - DNA, 22 bp, Homo sapiens
gctggctggaatgggagaagaa

SEQ ID NO: 9031233 - DNA, 22 bp, Homo sapiens
gctggctggaatgggagaagaa

SEQ ID NO: 9031234 - DNA, 22 bp, Homo sapiens
gctggctggaatgggagaagaa

SEQ ID NO: 9031235 - DNA, 22 bp, Homo sapiens
gctggctggaatgggagaagaa

SEQ ID NO: 9031236 - DNA, 22 bp, Homo sapiens
gctggctggaggtgaggaagaa

SEQ ID NO: 9031237 - DNA, 22 bp, Homo sapiens
gctggctggaggtgaggaagaa

SEQ ID NO: 9031238 - DNA, 22 bp, Homo sapiens
gctggctggaggtgaggaagaa

SEQ ID NO: 9031239 - DNA, 22 bp, Homo sapiens
gctggctggaggtgaggaagaa

SEQ ID NO: 9031240 - DNA, 22 bp, Homo sapiens
gctggctggaggagggaggttg

SEQ ID NO: 9031241 - DNA, 22 bp, Homo sapiens
gctggctggaggagggaggttg

SEQ ID NO: 9031242 - DNA, 22 bp, Homo sapiens
gctggctggaggagggaggttg

SEQ ID NO: 9031243 - DNA, 22 bp, Homo sapiens
gctggctggaggagggaggttg

SEQ ID NO: 9031244 - DNA, 19 bp, Homo sapiens
gctggctggaggagggaca

SEQ ID NO: 9031245 - DNA, 22 bp, Homo sapiens
gctggctggaggagggaggttg

SEQ ID NO: 9031246 - DNA, 19 bp, Homo sapiens
gctggctggaggagggaca

SEQ ID NO: 9031247 - DNA, 19 bp, Homo sapiens
gctggctggaggagggaca

SEQ ID NO: 9031248 - DNA, 19 bp, Homo sapiens
gctggctggaggagggaca

SEQ ID NO: 9031249 - DNA, 23 bp, Homo sapiens
gctggctggcagtaaaggttgtt

SEQ ID NO: 9031250 - DNA, 23 bp, Homo sapiens
gctggctggcagtaaaggttgtt

SEQ ID NO: 9031251 - DNA, 22 bp, Homo sapiens
gctggctggcgggtgcgtcctc

SEQ ID NO: 9031252 - DNA, 22 bp, Homo sapiens
gctggctggcgggtgcgtcctc

SEQ ID NO: 9031253 - DNA, 22 bp, Homo sapiens
gctggctggcgggtgcgtcctc

SEQ ID NO: 9031254 - DNA, 22 bp, Homo sapiens
gctggctggcgggtgcgtcctc

SEQ ID NO: 9031255 - DNA, 22 bp, Homo sapiens
gctggctggcgggtgcgtcctc

SEQ ID NO: 9031256 - DNA, 22 bp, Homo sapiens
gctggctggagtgagctaccct

SEQ ID NO: 9031257 - DNA, 22 bp, Homo sapiens
gctggctggatggttggttcgc

SEQ ID NO: 9031258 - DNA, 22 bp, Homo sapiens
gctggctggatggttggttcgc

SEQ ID NO: 9031259 - DNA, 22 bp, Homo sapiens
gctggctggcacgttcgcacgt

SEQ ID NO: 9031260 - DNA, 22 bp, Homo sapiens
gctggctggcacgttcgcacgt

SEQ ID NO: 9031261 - DNA, 22 bp, Homo sapiens
gctggctggaggtgaggaagaa

SEQ ID NO: 9031262 - DNA, 22 bp, Homo sapiens
gctggctggaggtgaggaagaa

SEQ ID NO: 9031263 - DNA, 22 bp, Homo sapiens
gctggctggagtaaggagggag

SEQ ID NO: 9031264 - DNA, 22 bp, Homo sapiens
gctggctggagtaaggagggag

SEQ ID NO: 9031265 - DNA, 22 bp, Homo sapiens
gctggctggaggtgaggaagaa

SEQ ID NO: 9031266 - DNA, 22 bp, Homo sapiens
gctggctggagtaaggagggag

SEQ ID NO: 9031267 - DNA, 22 bp, Homo sapiens
gctggctggagtaaggagggag

SEQ ID NO: 9031268 - DNA, 22 bp, Homo sapiens
gctggctggagtaaggagggag

SEQ ID NO: 9031269 - DNA, 22 bp, Homo sapiens
gctggctggagtaaggagggag

SEQ ID NO: 9031270 - DNA, 22 bp, Homo sapiens
gctggctggagtgagctaccct

SEQ ID NO: 9031271 - DNA, 22 bp, Homo sapiens
gctggctggagtgagctaccct

SEQ ID NO: 9031272 - DNA, 22 bp, Homo sapiens
gctggctggagtgagctaccct

SEQ ID NO: 9031273 - DNA, 22 bp, Homo sapiens
gcctgaggaatgctcctgactt

SEQ ID NO: 9031274 - DNA, 22 bp, Homo sapiens
gccttgccgctcagcagtgggg

SEQ ID NO: 9031275 - DNA, 22 bp, Homo sapiens
gccttgcctcagccatggaaac

SEQ ID NO: 9031276 - DNA, 22 bp, Homo sapiens
gccttggaaagctggagcagtt

SEQ ID NO: 9031277 - DNA, 22 bp, Homo sapiens
gccttgctgattaccttccttt

SEQ ID NO: 9031278 - DNA, 22 bp, Homo sapiens
gccttggactcgggtggactca

SEQ ID NO: 9031279 - DNA, 22 bp, Homo sapiens
gccttggactaccactcccaca

SEQ ID NO: 9031280 - DNA, 22 bp, Homo sapiens
gccttggactaccactcccaca

SEQ ID NO: 9031281 - DNA, 22 bp, Homo sapiens
gccttggaacaattattgctgc

SEQ ID NO: 9031282 - DNA, 22 bp, Homo sapiens
gccttggactcgggtggactca

SEQ ID NO: 9031283 - DNA, 23 bp, Homo sapiens
gccttggagaagtcactcaggga

SEQ ID NO: 9031284 - DNA, 22 bp, Homo sapiens
gccttggagatcactgctcatg

SEQ ID NO: 9031285 - DNA, 22 bp, Homo sapiens
gccttgccgctcagcagtgggg

SEQ ID NO: 9031286 - DNA, 21 bp, Homo sapiens
gccttgccacatgtgccacag

SEQ ID NO: 9031287 - DNA, 22 bp, Homo sapiens
gcctgagctttaattttcttgt

SEQ ID NO: 9031288 - DNA, 20 bp, Homo sapiens
gcctgagctccgcctcctgt

SEQ ID NO: 9031289 - DNA, 20 bp, Homo sapiens
gcctgagctccgcctcctgt

SEQ ID NO: 9031290 - DNA, 20 bp, Homo sapiens
gcctgagctccgcctcctgt

SEQ ID NO: 9031291 - DNA, 20 bp, Homo sapiens
gcctgagctccgcctcctgt

SEQ ID NO: 9031292 - DNA, 20 bp, Homo sapiens
gcctgagctccgcctcctgt

SEQ ID NO: 9031293 - DNA, 22 bp, Homo sapiens
gcctgagctactagggagtctg

SEQ ID NO: 9031294 - DNA, 22 bp, Homo sapiens
gcctgagctactagggagtctg

SEQ ID NO: 9031295 - DNA, 22 bp, Homo sapiens
gcctgagctactagggagtctg

SEQ ID NO: 9031296 - DNA, 20 bp, Homo sapiens
gcctgagctattgccaggat

SEQ ID NO: 9031297 - DNA, 20 bp, Homo sapiens
gcctgagctattgccaggat

SEQ ID NO: 9031298 - DNA, 20 bp, Homo sapiens
gcctgagctattgccaggat

SEQ ID NO: 9031299 - DNA, 22 bp, Homo sapiens
gccttgggattcttggatgctc

SEQ ID NO: 9031300 - DNA, 22 bp, Homo sapiens
gccttgggcacaggcagggccc

SEQ ID NO: 9031301 - DNA, 22 bp, Homo sapiens
gccttggctgttggagcttgat

SEQ ID NO: 9031302 - DNA, 22 bp, Homo sapiens
gccttgggacggaggggtcacc

SEQ ID NO: 9031303 - DNA, 22 bp, Homo sapiens
gccttgggaaagtgggaggaga

SEQ ID NO: 9031304 - DNA, 22 bp, Homo sapiens
gccttgggcacaggcagggccc

SEQ ID NO: 9031305 - DNA, 22 bp, Homo sapiens
gccttgggattcttggatgctc

SEQ ID NO: 9031306 - DNA, 22 bp, Homo sapiens
gccttgggcacaggcagggccc

SEQ ID NO: 9031307 - DNA, 22 bp, Homo sapiens
gccttgggggtgaaagaggcta

SEQ ID NO: 9031308 - DNA, 22 bp, Homo sapiens
gccttgggggtgaaagaggcta

SEQ ID NO: 9031309 - DNA, 22 bp, Homo sapiens
gccttgggggtgaaagaggcta

SEQ ID NO: 9031310 - DNA, 22 bp, Homo sapiens
gccttgggggtgaaagaggcta

SEQ ID NO: 9031311 - DNA, 19 bp, Homo sapiens
gccttggcattctctgctt

SEQ ID NO: 9031312 - DNA, 22 bp, Homo sapiens
gccttggccttcctaggcctga

SEQ ID NO: 9031313 - DNA, 22 bp, Homo sapiens
gccttggaaagctggagcagtt

SEQ ID NO: 9031314 - DNA, 22 bp, Homo sapiens
gccttggccttcctaggcctga

SEQ ID NO: 9031315 - DNA, 22 bp, Homo sapiens
gccttggccttcctaggcctga

SEQ ID NO: 9031316 - DNA, 23 bp, Homo sapiens
gccttggcgatccgtggggcatc

SEQ ID NO: 9031317 - DNA, 23 bp, Homo sapiens
gccttggcgatccgtggggcatc

SEQ ID NO: 9031318 - DNA, 22 bp, Homo sapiens
gccttggctgatgtgcgaatga

SEQ ID NO: 9031319 - DNA, 22 bp, Homo sapiens
gccttggctgccaagctgctga

SEQ ID NO: 9031320 - DNA, 22 bp, Homo sapiens
gccttggctgatgtgcgaatga

SEQ ID NO: 9031321 - DNA, 22 bp, Homo sapiens
gccttggctgttggagcttgat

SEQ ID NO: 9031322 - DNA, 22 bp, Homo sapiens
gccttggctgccaagctgctga

SEQ ID NO: 9031323 - DNA, 21 bp, Homo sapiens
gcctgagcatgtcttcaggtc

SEQ ID NO: 9031324 - DNA, 21 bp, Homo sapiens
gcctgagcatgtcttcaggtc

SEQ ID NO: 9031325 - DNA, 21 bp, Homo sapiens
gcctgagcatgtcttcaggtc

SEQ ID NO: 9031326 - DNA, 21 bp, Homo sapiens
gcctgagcatgtcttcaggtc

SEQ ID NO: 9031327 - DNA, 19 bp, Homo sapiens
gcctgagccagccatgcaa

SEQ ID NO: 9031328 - DNA, 22 bp, Homo sapiens
gcctgagcaggcgtggaccatg

SEQ ID NO: 9031329 - DNA, 22 bp, Homo sapiens
gcctgagcaggcgtggaccatg

SEQ ID NO: 9031330 - DNA, 22 bp, Homo sapiens
gcctgagcaggcgtggaccatg

SEQ ID NO: 9031331 - DNA, 19 bp, Homo sapiens
gcctgagccagccatgcaa

SEQ ID NO: 9031332 - DNA, 19 bp, Homo sapiens
gcctgagccagccatgcaa

SEQ ID NO: 9031333 - DNA, 19 bp, Homo sapiens
gcctgagccagccatgcaa

SEQ ID NO: 9031334 - DNA, 19 bp, Homo sapiens
gcctgagccagccatgcaa

SEQ ID NO: 9031335 - DNA, 22 bp, Homo sapiens
gcctgagccgcctgagcggcgg

SEQ ID NO: 9031336 - DNA, 22 bp, Homo sapiens
gcctgagccgcctgagcggcgg

SEQ ID NO: 9031337 - DNA, 22 bp, Homo sapiens
gcctgagcccaggtgtgcagag

SEQ ID NO: 9031338 - DNA, 22 bp, Homo sapiens
gcctgagcccaggtgtgcagag

SEQ ID NO: 9031339 - DNA, 22 bp, Homo sapiens
gcctgagcccaggtgtgcagag

SEQ ID NO: 9031340 - DNA, 22 bp, Homo sapiens
gcctctgtcatagctcatgtga

SEQ ID NO: 9031341 - DNA, 22 bp, Homo sapiens
gcctctgtggctcagccttgct

SEQ ID NO: 9031342 - DNA, 22 bp, Homo sapiens
gcctctggtccctcatgctgtg

SEQ ID NO: 9031343 - DNA, 22 bp, Homo sapiens
gcctctggtccctcatgctgtg

SEQ ID NO: 9031344 - DNA, 22 bp, Homo sapiens
gcctctgtaggagtgagagcat

SEQ ID NO: 9031345 - DNA, 22 bp, Homo sapiens
gcctctgtcatagctcatgtga

SEQ ID NO: 9031346 - DNA, 18 bp, Homo sapiens
gcctctgttgcttgcctg

SEQ ID NO: 9031347 - DNA, 22 bp, Homo sapiens
gcctgagattggacattattta

SEQ ID NO: 9031348 - DNA, 18 bp, Homo sapiens
gcctctgttgcttgcctg

SEQ ID NO: 9031349 - DNA, 18 bp, Homo sapiens
gcctctgttgcttgcctg

SEQ ID NO: 9031350 - DNA, 22 bp, Homo sapiens
gcctctgtggctcagccttgct

SEQ ID NO: 9031351 - DNA, 18 bp, Homo sapiens
gcctctgttgcttgcctg

SEQ ID NO: 9031352 - DNA, 22 bp, Homo sapiens
gcctgagcaggcgtggaccatg

SEQ ID NO: 9031353 - DNA, 22 bp, Homo sapiens
gcctgagcaggcgtggaccatg

SEQ ID NO: 9031354 - DNA, 18 bp, Homo sapiens
gcctctgttgcttgcctg

SEQ ID NO: 9031355 - DNA, 22 bp, Homo sapiens
gcctgagcagctatacacacag

SEQ ID NO: 9031356 - DNA, 22 bp, Homo sapiens
gcctgagcagctatacacacag

SEQ ID NO: 9031357 - DNA, 22 bp, Homo sapiens
gcctctggtccctcatgctgtg

SEQ ID NO: 9031358 - DNA, 22 bp, Homo sapiens
gcctctggtccctcatgctgtg

SEQ ID NO: 9031359 - DNA, 22 bp, Homo sapiens
gcctctggtccctcatgctgtg

SEQ ID NO: 9031360 - DNA, 22 bp, Homo sapiens
gcctctggtccctcatgctgtg

SEQ ID NO: 9031361 - DNA, 22 bp, Homo sapiens
gcctctggtccctcatgctgtg

SEQ ID NO: 9031362 - DNA, 22 bp, Homo sapiens
gcctctggtccctcatgctgtg

SEQ ID NO: 9031363 - DNA, 22 bp, Homo sapiens
gcctctgggttggtgacaggct

SEQ ID NO: 9031364 - DNA, 22 bp, Homo sapiens
gcctctgggttggtgacaggct

SEQ ID NO: 9031365 - DNA, 22 bp, Homo sapiens
gcctctggtccctcatgctgtg

SEQ ID NO: 9031366 - DNA, 22 bp, Homo sapiens
gcctctgggttggtgacaggct

SEQ ID NO: 9031367 - DNA, 22 bp, Homo sapiens
gcctctgggttggtgacaggct

SEQ ID NO: 9031368 - DNA, 22 bp, Homo sapiens
gcctctgggttggtgacaggct

SEQ ID NO: 9031369 - DNA, 22 bp, Homo sapiens
gcctctggggtggagcccagca

SEQ ID NO: 9031370 - DNA, 22 bp, Homo sapiens
gcctctggggtggagcccagca

SEQ ID NO: 9031371 - DNA, 22 bp, Homo sapiens
gcctctggggtggagcccagca

SEQ ID NO: 9031372 - DNA, 22 bp, Homo sapiens
gcctctggggtggagcccagca

SEQ ID NO: 9031373 - DNA, 22 bp, Homo sapiens
gcctctggggttaatagagttt

SEQ ID NO: 9031374 - DNA, 22 bp, Homo sapiens
gcctctggggttaatagagttt

SEQ ID NO: 9031375 - DNA, 22 bp, Homo sapiens
gcctctgggtgacgaaaggtga

SEQ ID NO: 9031376 - DNA, 22 bp, Homo sapiens
gcctctggggcagctgagtcat

SEQ ID NO: 9031377 - DNA, 22 bp, Homo sapiens
gcctctgggggctcagacctgt

SEQ ID NO: 9031378 - DNA, 22 bp, Homo sapiens
gcctctgggggctcagacctgt

SEQ ID NO: 9031379 - DNA, 22 bp, Homo sapiens
gcctctgggggctcagacctgt

SEQ ID NO: 9031380 - DNA, 22 bp, Homo sapiens
gcctttgaattgttgtggtgag

SEQ ID NO: 9031381 - DNA, 18 bp, Homo sapiens
gcctttgaatgagggatt

SEQ ID NO: 9031382 - DNA, 18 bp, Homo sapiens
gcctttgaatgagggatt

SEQ ID NO: 9031383 - DNA, 22 bp, Homo sapiens
gcctttcctgctctggcattca

SEQ ID NO: 9031384 - DNA, 22 bp, Homo sapiens
gcctttcatgcttggagggcca

SEQ ID NO: 9031385 - DNA, 22 bp, Homo sapiens
gcctttgcctgcgacgtggctg

SEQ ID NO: 9031386 - DNA, 22 bp, Homo sapiens
gcctttgaattgttgtggtgag

SEQ ID NO: 9031387 - DNA, 18 bp, Homo sapiens
gcctttgcacaagcagct

SEQ ID NO: 9031388 - DNA, 21 bp, Homo sapiens
gcctttggtttcttgtcctgc

SEQ ID NO: 9031389 - DNA, 22 bp, Homo sapiens
gcctttggtgacaggcatgtgt

SEQ ID NO: 9031390 - DNA, 18 bp, Homo sapiens
gcctttggactgctccca

SEQ ID NO: 9031391 - DNA, 18 bp, Homo sapiens
gcctttggactgctccca

SEQ ID NO: 9031392 - DNA, 19 bp, Homo sapiens
gcctttgttccttttgtct

SEQ ID NO: 9031393 - DNA, 22 bp, Homo sapiens
gccttttaaggcagagggagat

SEQ ID NO: 9031394 - DNA, 22 bp, Homo sapiens
gcctttgtaactcttttattgt

SEQ ID NO: 9031395 - DNA, 22 bp, Homo sapiens
gcgggtggaacggctccacgtg

SEQ ID NO: 9031396 - DNA, 22 bp, Homo sapiens
gcgggtggaacggctccacgtg

SEQ ID NO: 9031397 - DNA, 22 bp, Homo sapiens
gcggggttccgtgccccagagt

SEQ ID NO: 9031398 - DNA, 22 bp, Homo sapiens
gcggggttccgtgccccagagt

SEQ ID NO: 9031399 - DNA, 22 bp, Homo sapiens
gcgggtggatcatgaggtcagg

SEQ ID NO: 9031400 - DNA, 22 bp, Homo sapiens
gcgggtggatcatgaggtcagg

SEQ ID NO: 9031401 - DNA, 22 bp, Homo sapiens
gcgggtggtgtccctgctcctc

SEQ ID NO: 9031402 - DNA, 22 bp, Homo sapiens
gcgggtggtgtccctgctcctc

SEQ ID NO: 9031403 - DNA, 22 bp, Homo sapiens
gcctttatcttcctgattcaga

SEQ ID NO: 9031404 - DNA, 22 bp, Homo sapiens
gcctttatccctgtacaaggtg

SEQ ID NO: 9031405 - DNA, 22 bp, Homo sapiens
gcctttatcttcctgattcaga

SEQ ID NO: 9031406 - DNA, 22 bp, Homo sapiens
gcctttatcttgggccaagttt

SEQ ID NO: 9031407 - DNA, 22 bp, Homo sapiens
gcctttatcttgggccaagttt

SEQ ID NO: 9031408 - DNA, 22 bp, Homo sapiens
gcctttatgtctgaaaatcagc

SEQ ID NO: 9031409 - DNA, 22 bp, Homo sapiens
gcctttatgtctgaaaatcagc

SEQ ID NO: 9031410 - DNA, 22 bp, Homo sapiens
gcctttattgtttattcagtgc

SEQ ID NO: 9031411 - DNA, 23 bp, Homo sapiens
gcctttattaggcacaggggtac

SEQ ID NO: 9031412 - DNA, 22 bp, Homo sapiens
gcctttattttcaacggagtgt

SEQ ID NO: 9031413 - DNA, 22 bp, Homo sapiens
gcctttattttcaacggagtgt

SEQ ID NO: 9031414 - DNA, 22 bp, Homo sapiens
gcctttatttacgaaagggaaa

SEQ ID NO: 9031415 - DNA, 22 bp, Homo sapiens
gcctttattgtttattcagtgc

SEQ ID NO: 9031416 - DNA, 22 bp, Homo sapiens
gcctttcagtgccttctgttca

SEQ ID NO: 9031417 - DNA, 22 bp, Homo sapiens
gcctttcatctcagctggccgg

SEQ ID NO: 9031418 - DNA, 22 bp, Homo sapiens
gcctttcactggtgccggctgt

SEQ ID NO: 9031419 - DNA, 22 bp, Homo sapiens
gccttgtttcattacacgtggt

SEQ ID NO: 9031420 - DNA, 22 bp, Homo sapiens
gccttgtttcattacacgtggt

SEQ ID NO: 9031421 - DNA, 22 bp, Homo sapiens
gcctttaaagccccgagagccc

SEQ ID NO: 9031422 - DNA, 22 bp, Homo sapiens
gccttgtttctctcccagataa

SEQ ID NO: 9031423 - DNA, 22 bp, Homo sapiens
gcctttaaagctggcaggcttt

SEQ ID NO: 9031424 - DNA, 22 bp, Homo sapiens
gcctttagactttgggacttat

SEQ ID NO: 9031425 - DNA, 22 bp, Homo sapiens
gcctttatccctgtacaaggtg

SEQ ID NO: 9031426 - DNA, 22 bp, Homo sapiens
gcctttatcagtttcatggctt

SEQ ID NO: 9031427 - DNA, 22 bp, Homo sapiens
gcctttatatttttctggtgtt

SEQ ID NO: 9031428 - DNA, 22 bp, Homo sapiens
gcctttatcagtttcatggctt

SEQ ID NO: 9031429 - DNA, 17 bp, Homo sapiens
gcctttatacatgctgc

SEQ ID NO: 9031430 - DNA, 22 bp, Homo sapiens
gcctttatatccctgatatcta

SEQ ID NO: 9031431 - DNA, 22 bp, Homo sapiens
gcctttatatccctgatatcta

SEQ ID NO: 9031432 - DNA, 22 bp, Homo sapiens
gcctttatattacatttggaag

SEQ ID NO: 9031433 - DNA, 22 bp, Homo sapiens
gcgtggggcagcccagggcttc

SEQ ID NO: 9031434 - DNA, 22 bp, Homo sapiens
gcgtgggctggactgggatgaa

SEQ ID NO: 9031435 - DNA, 22 bp, Homo sapiens
gcgtggcttagagtggggtacc

SEQ ID NO: 9031436 - DNA, 22 bp, Homo sapiens
gcgtggcttagagtggggtacc

SEQ ID NO: 9031437 - DNA, 22 bp, Homo sapiens
gcgtggcttagagtggggtacc

SEQ ID NO: 9031438 - DNA, 22 bp, Homo sapiens
gcgtggcttagagtggggtacc

SEQ ID NO: 9031439 - DNA, 22 bp, Homo sapiens
gcgtggcttagagtggggtacc

SEQ ID NO: 9031440 - DNA, 18 bp, Homo sapiens
gcgtggagcgggctcggt

SEQ ID NO: 9031441 - DNA, 22 bp, Homo sapiens
gcgtggagacaactctggggtg

SEQ ID NO: 9031442 - DNA, 22 bp, Homo sapiens
gctacaggagctgtcacatgct

SEQ ID NO: 9031443 - DNA, 22 bp, Homo sapiens
gctacaggggtcagtcctttgc

SEQ ID NO: 9031444 - DNA, 22 bp, Homo sapiens
gctacaggtatatagatgaaac

SEQ ID NO: 9031445 - DNA, 22 bp, Homo sapiens
gctacaggagataaaggcctct

SEQ ID NO: 9031446 - DNA, 22 bp, Homo sapiens
gctacaggtatatagatgaaac

SEQ ID NO: 9031447 - DNA, 22 bp, Homo sapiens
gctacaggtgacagcctctgca

SEQ ID NO: 9031448 - DNA, 22 bp, Homo sapiens
gctacaggtatatagatgaaac

SEQ ID NO: 9031449 - DNA, 22 bp, Homo sapiens
gctacaggagataaaggcctct

SEQ ID NO: 9031450 - DNA, 22 bp, Homo sapiens
gctacaggagctgtcacatgct

SEQ ID NO: 9031451 - DNA, 22 bp, Homo sapiens
gctacaggagataaaggcctct

SEQ ID NO: 9031452 - DNA, 22 bp, Homo sapiens
gctacagagctctgtgaagaga

SEQ ID NO: 9031453 - DNA, 22 bp, Homo sapiens
gcggtgggggaaaggagcggtt

SEQ ID NO: 9031454 - DNA, 22 bp, Homo sapiens
gcggtgggggaaaggagcggtt

SEQ ID NO: 9031455 - DNA, 22 bp, Homo sapiens
gcggtgggggaaaggagcggtt

SEQ ID NO: 9031456 - DNA, 22 bp, Homo sapiens
gcggtgggggaaaggagcggtt

SEQ ID NO: 9031457 - DNA, 22 bp, Homo sapiens
gcggtggggaaaggaggtgctg

SEQ ID NO: 9031458 - DNA, 22 bp, Homo sapiens
gcggtggggaaaggaggtgctg

SEQ ID NO: 9031459 - DNA, 22 bp, Homo sapiens
gcggtcggcagaggggctctgc

SEQ ID NO: 9031460 - DNA, 22 bp, Homo sapiens
gcggtggagccaggcctgggct

SEQ ID NO: 9031461 - DNA, 22 bp, Homo sapiens
gcggtggggaaaggaggtgctg

SEQ ID NO: 9031462 - DNA, 22 bp, Homo sapiens
gcggtatttgtgtgggtgtcga

SEQ ID NO: 9031463 - DNA, 22 bp, Homo sapiens
gcgggttgaagggcgcatcgaa

SEQ ID NO: 9031464 - DNA, 22 bp, Homo sapiens
gcgtctcaaggcccccaggcca

SEQ ID NO: 9031465 - DNA, 22 bp, Homo sapiens
gcgtctcaaggcccccaggcca

SEQ ID NO: 9031466 - DNA, 22 bp, Homo sapiens
gcgtctcaaggcccccaggcca

SEQ ID NO: 9031467 - DNA, 22 bp, Homo sapiens
gcgtctcaaggcccccaggcca

SEQ ID NO: 9031468 - DNA, 22 bp, Homo sapiens
gcgtggagacaactctggggtg

SEQ ID NO: 9031469 - DNA, 22 bp, Homo sapiens
gcgtgcatggccgtgtgtatgc

SEQ ID NO: 9031470 - DNA, 22 bp, Homo sapiens
gcgtctcaaggcccccaggcca

SEQ ID NO: 9031471 - DNA, 21 bp, Homo sapiens
gctccctgctcagctcctggg

SEQ ID NO: 9031472 - DNA, 22 bp, Homo sapiens
gctccctggaatgttggctgcc

SEQ ID NO: 9031473 - DNA, 22 bp, Homo sapiens
gctccctggaggatgtgaactt

SEQ ID NO: 9031474 - DNA, 21 bp, Homo sapiens
gctccctggctgtgtgacctg

SEQ ID NO: 9031475 - DNA, 20 bp, Homo sapiens
gctccctggtagaaatgttt

SEQ ID NO: 9031476 - DNA, 22 bp, Homo sapiens
gctccctggcttttacagtgta

SEQ ID NO: 9031477 - DNA, 21 bp, Homo sapiens
gctccctggctgtgtgacctg

SEQ ID NO: 9031478 - DNA, 22 bp, Homo sapiens
gctccctggtagccatgctctc

SEQ ID NO: 9031479 - DNA, 22 bp, Homo sapiens
gctccctggtagccatgctctc

SEQ ID NO: 9031480 - DNA, 22 bp, Homo sapiens
gctccctggtattgctgccact

SEQ ID NO: 9031481 - DNA, 22 bp, Homo sapiens
gctccctggtattgctgccact

SEQ ID NO: 9031482 - DNA, 22 bp, Homo sapiens
gctccctggtattgctgccact

SEQ ID NO: 9031483 - DNA, 22 bp, Homo sapiens
gctccctggtagccatgctctc

SEQ ID NO: 9031484 - DNA, 22 bp, Homo sapiens
gctccctggtattgctgccact

SEQ ID NO: 9031485 - DNA, 22 bp, Homo sapiens
gctccctggtagccatgctctc

SEQ ID NO: 9031486 - DNA, 22 bp, Homo sapiens
gctccctggtagccatgctctc

SEQ ID NO: 9031487 - DNA, 22 bp, Homo sapiens
gctccctggtagccatgctctc

SEQ ID NO: 9031488 - DNA, 22 bp, Homo sapiens
gctccctggtagccatgctctc

SEQ ID NO: 9031489 - DNA, 23 bp, Homo sapiens
gctccctgtgctccaggagatgc

SEQ ID NO: 9031490 - DNA, 23 bp, Homo sapiens
gctccctgtgctccaggagatgc

SEQ ID NO: 9031491 - DNA, 22 bp, Homo sapiens
gctccctgtctctggggtccat

SEQ ID NO: 9031492 - DNA, 22 bp, Homo sapiens
gctccctgaagagatttggtct

SEQ ID NO: 9031493 - DNA, 22 bp, Homo sapiens
gctccctgactcagttcctgag

SEQ ID NO: 9031494 - DNA, 22 bp, Homo sapiens
gctccctgactcagttcctgag

SEQ ID NO: 9031495 - DNA, 22 bp, Homo sapiens
gctccctgactcagttcctgag

SEQ ID NO: 9031496 - DNA, 17 bp, Homo sapiens
gctccctgaggacagct

SEQ ID NO: 9031497 - DNA, 17 bp, Homo sapiens
gctccctgaggacagct

SEQ ID NO: 9031498 - DNA, 17 bp, Homo sapiens
gctccctgaggacagct

SEQ ID NO: 9031499 - DNA, 17 bp, Homo sapiens
gctccctgaggacagct

SEQ ID NO: 9031500 - DNA, 17 bp, Homo sapiens
gctccctgaggacagct

SEQ ID NO: 9031501 - DNA, 22 bp, Homo sapiens
gctccctgcactctgcagccct

SEQ ID NO: 9031502 - DNA, 22 bp, Homo sapiens
gctccctgcactctgcagccct

SEQ ID NO: 9031503 - DNA, 22 bp, Homo sapiens
gctccctgcactctgcagccct

SEQ ID NO: 9031504 - DNA, 22 bp, Homo sapiens
gctccctgcagctgagagttcc

SEQ ID NO: 9031505 - DNA, 22 bp, Homo sapiens
gctccctgcatttcccaccctt

SEQ ID NO: 9031506 - DNA, 22 bp, Homo sapiens
gctccctgcatttcccaccctt

SEQ ID NO: 9031507 - DNA, 21 bp, Homo sapiens
gctccctgctcagctcctggg

SEQ ID NO: 9031508 - DNA, 21 bp, Homo sapiens
gctccctgctcagctcctggg

SEQ ID NO: 9031509 - DNA, 21 bp, Homo sapiens
gctccctgctcagctcctggg

SEQ ID NO: 9031510 - DNA, 21 bp, Homo sapiens
gctccctgctcagctcctggg

SEQ ID NO: 9031511 - DNA, 22 bp, Homo sapiens
gctccctgcctacacggacctt

SEQ ID NO: 9031512 - DNA, 22 bp, Homo sapiens
gctcccacgcaattcttttcag

SEQ ID NO: 9031513 - DNA, 22 bp, Homo sapiens
gctcccacctttgctatcagta

SEQ ID NO: 9031514 - DNA, 22 bp, Homo sapiens
gctcccacctttgctatcagta

SEQ ID NO: 9031515 - DNA, 22 bp, Homo sapiens
gctcccacctttgctatcagta

SEQ ID NO: 9031516 - DNA, 22 bp, Homo sapiens
gctcccactgcagccctgagcc

SEQ ID NO: 9031517 - DNA, 22 bp, Homo sapiens
gctcccactgcagccctgagcc

SEQ ID NO: 9031518 - DNA, 22 bp, Homo sapiens
gctcccagaaccaaggctgggg

SEQ ID NO: 9031519 - DNA, 22 bp, Homo sapiens
gctcccagaaccaaggctgggg

SEQ ID NO: 9031520 - DNA, 22 bp, Homo sapiens
gctcccagaaccaaggctgggg

SEQ ID NO: 9031521 - DNA, 22 bp, Homo sapiens
gctcccagaaccaaggctgggg

SEQ ID NO: 9031522 - DNA, 22 bp, Homo sapiens
gctcccagaaccaaggctgggg

SEQ ID NO: 9031523 - DNA, 22 bp, Homo sapiens
gctcccagaaccaaggctgggg

SEQ ID NO: 9031524 - DNA, 22 bp, Homo sapiens
gctccctgaaaagaacaaagtc

SEQ ID NO: 9031525 - DNA, 22 bp, Homo sapiens
gctcccaccttaaccttcacat

SEQ ID NO: 9031526 - DNA, 22 bp, Homo sapiens
gctcccaccttaaccttcacat

SEQ ID NO: 9031527 - DNA, 22 bp, Homo sapiens
gctcccacctccagcctgagtt

SEQ ID NO: 9031528 - DNA, 22 bp, Homo sapiens
gctcccacctccagcctgagtt

SEQ ID NO: 9031529 - DNA, 22 bp, Homo sapiens
gctcccacctccagcctgagtt

SEQ ID NO: 9031530 - DNA, 22 bp, Homo sapiens
gctcccaccgccgctatgggta

SEQ ID NO: 9031531 - DNA, 22 bp, Homo sapiens
gctcccaccgccgctatgggta

SEQ ID NO: 9031532 - DNA, 22 bp, Homo sapiens
gctcccaccgccgctatgggta

SEQ ID NO: 9031533 - DNA, 22 bp, Homo sapiens
gctcccacaaccttcttgctcc

SEQ ID NO: 9031534 - DNA, 22 bp, Homo sapiens
gctcccaccaggcagacctacc

SEQ ID NO: 9031535 - DNA, 22 bp, Homo sapiens
gctccaggtatttgccctttta

SEQ ID NO: 9031536 - DNA, 22 bp, Homo sapiens
gctccaggtatttgccctttta

SEQ ID NO: 9031537 - DNA, 20 bp, Homo sapiens
gctccaggtcagagaggacg

SEQ ID NO: 9031538 - DNA, 20 bp, Homo sapiens
gctccaggtcagagaggacg

SEQ ID NO: 9031539 - DNA, 20 bp, Homo sapiens
gctccaggtcagagaggacg

SEQ ID NO: 9031540 - DNA, 20 bp, Homo sapiens
gctccaggtcagagaggacg

SEQ ID NO: 9031541 - DNA, 22 bp, Homo sapiens
gctccaggtgaatcctctcacc

SEQ ID NO: 9031542 - DNA, 22 bp, Homo sapiens
gctccaggtgaatcctctcacc

SEQ ID NO: 9031543 - DNA, 22 bp, Homo sapiens
gctccaggtgaatcctctcacc

SEQ ID NO: 9031544 - DNA, 22 bp, Homo sapiens
gctccaggtgaatcctctcacc

SEQ ID NO: 9031545 - DNA, 22 bp, Homo sapiens
gctcccaactcaggcctcctcc

SEQ ID NO: 9031546 - DNA, 22 bp, Homo sapiens
gctcccaactcaggcctcctcc

SEQ ID NO: 9031547 - DNA, 22 bp, Homo sapiens
gctcccacaaccttcttgctcc

SEQ ID NO: 9031548 - DNA, 22 bp, Homo sapiens
gctccaggtgtcccaggtaaaa

SEQ ID NO: 9031549 - DNA, 22 bp, Homo sapiens
gctccaggtgtcccaggtaaaa

SEQ ID NO: 9031550 - DNA, 22 bp, Homo sapiens
gctccaggtggcttatttgtat

SEQ ID NO: 9031551 - DNA, 22 bp, Homo sapiens
gctcagctctatggacacaaag

SEQ ID NO: 9031552 - DNA, 22 bp, Homo sapiens
gctcagctgagcgaaggacatg

SEQ ID NO: 9031553 - DNA, 22 bp, Homo sapiens
gctcagctatcagtgttcctga

SEQ ID NO: 9031554 - DNA, 18 bp, Homo sapiens
gctcagctatgggaggtt

SEQ ID NO: 9031555 - DNA, 22 bp, Homo sapiens
gctcagctatcagtgttcctga

SEQ ID NO: 9031556 - DNA, 22 bp, Homo sapiens
gctcagctatcagtgttcctga

SEQ ID NO: 9031557 - DNA, 23 bp, Homo sapiens
gctcagcctcagcaggcccagga

SEQ ID NO: 9031558 - DNA, 22 bp, Homo sapiens
gctcagccgaacttcagagcag

SEQ ID NO: 9031559 - DNA, 22 bp, Homo sapiens
gctcagccgaacttcagagcag

SEQ ID NO: 9031560 - DNA, 22 bp, Homo sapiens
gctcagctacttacaggtggct

SEQ ID NO: 9031561 - DNA, 22 bp, Homo sapiens
gctcagctacttacaggtggct

SEQ ID NO: 9031562 - DNA, 22 bp, Homo sapiens
gctcagctacttacaggtggct

SEQ ID NO: 9031563 - DNA, 22 bp, Homo sapiens
gctcagagttaattggatgggt

SEQ ID NO: 9031564 - DNA, 22 bp, Homo sapiens
gctcagagttaattggatgggt

SEQ ID NO: 9031565 - DNA, 22 bp, Homo sapiens
gctcagagttaaatatagtgct

SEQ ID NO: 9031566 - DNA, 22 bp, Homo sapiens
gctcagagttaaatatagtgct

SEQ ID NO: 9031567 - DNA, 22 bp, Homo sapiens
gctcagagtggcctggctaggg

SEQ ID NO: 9031568 - DNA, 22 bp, Homo sapiens
gctcagagttaaatatagtgct

SEQ ID NO: 9031569 - DNA, 22 bp, Homo sapiens
gctcagagttaattggatgggt

SEQ ID NO: 9031570 - DNA, 19 bp, Homo sapiens
gctcagcagacccagtgct

SEQ ID NO: 9031571 - DNA, 22 bp, Homo sapiens
gctcagccgaacttcagagcag

SEQ ID NO: 9031572 - DNA, 21 bp, Homo sapiens
gctcagcaaaggtgaggtgca

SEQ ID NO: 9031573 - DNA, 19 bp, Homo sapiens
gctcagcagacccagtgct

SEQ ID NO: 9031574 - DNA, 22 bp, Homo sapiens
gctccaggcagagcctctttcg

SEQ ID NO: 9031575 - DNA, 22 bp, Homo sapiens
gctccaggcagagcctctttcg

SEQ ID NO: 9031576 - DNA, 22 bp, Homo sapiens
gctccaggcagagcctctttcg

SEQ ID NO: 9031577 - DNA, 22 bp, Homo sapiens
gctccagggacccaagagaaaa

SEQ ID NO: 9031578 - DNA, 22 bp, Homo sapiens
gctccaggataataaagttgtt

SEQ ID NO: 9031579 - DNA, 22 bp, Homo sapiens
gctccaggaggctcccgcgtct

SEQ ID NO: 9031580 - DNA, 22 bp, Homo sapiens
gctccaggaggctcccgcgtct

SEQ ID NO: 9031581 - DNA, 22 bp, Homo sapiens
gctccaggaggctcccgcgtct

SEQ ID NO: 9031582 - DNA, 22 bp, Homo sapiens
gctcagctgagcgaaggacatg

SEQ ID NO: 9031583 - DNA, 22 bp, Homo sapiens
gctcagctgagcgaaggacatg

SEQ ID NO: 9031584 - DNA, 22 bp, Homo sapiens
gctccaggaggctcccgcgtct

SEQ ID NO: 9031585 - DNA, 22 bp, Homo sapiens
gctccagggtggatgacaattc

SEQ ID NO: 9031586 - DNA, 22 bp, Homo sapiens
gctccagggagtacatttatca

SEQ ID NO: 9031587 - DNA, 22 bp, Homo sapiens
gctccagggtcagctcagaact

SEQ ID NO: 9031588 - DNA, 22 bp, Homo sapiens
gctcagagggaacaaggggctg

SEQ ID NO: 9031589 - DNA, 22 bp, Homo sapiens
gctcagaggccactgttggaaa

SEQ ID NO: 9031590 - DNA, 22 bp, Homo sapiens
gctcagaggccaagtgcccgcc

SEQ ID NO: 9031591 - DNA, 22 bp, Homo sapiens
gctcagaggcacgacctcttgg

SEQ ID NO: 9031592 - DNA, 22 bp, Homo sapiens
gctcagaggaggcctttaccta

SEQ ID NO: 9031593 - DNA, 22 bp, Homo sapiens
gctcagaggatgctcctttatg

SEQ ID NO: 9031594 - DNA, 22 bp, Homo sapiens
gctcagaggaggcctttaccta

SEQ ID NO: 9031595 - DNA, 22 bp, Homo sapiens
gctcagaggagcatcataagga

SEQ ID NO: 9031596 - DNA, 22 bp, Homo sapiens
gctcagagcttgaagttccact

SEQ ID NO: 9031597 - DNA, 22 bp, Homo sapiens
gctcagagcttgaagttccact

SEQ ID NO: 9031598 - DNA, 22 bp, Homo sapiens
gctacatagtaacccacaaatc

SEQ ID NO: 9031599 - DNA, 20 bp, Homo sapiens
gctaccagaacaaggccatt

SEQ ID NO: 9031600 - DNA, 22 bp, Homo sapiens
gctacagtagataaggacggtc

SEQ ID NO: 9031601 - DNA, 22 bp, Homo sapiens
gctacaggtgacagcctctgca

SEQ ID NO: 9031602 - DNA, 21 bp, Homo sapiens
gctactcaagaagaaggcttt

SEQ ID NO: 9031603 - DNA, 22 bp, Homo sapiens
gctacccagagcctcaccctgt

SEQ ID NO: 9031604 - DNA, 22 bp, Homo sapiens
gctaccctgggaatctccctca

SEQ ID NO: 9031605 - DNA, 22 bp, Homo sapiens
gctactgattgaccttggagag

SEQ ID NO: 9031606 - DNA, 22 bp, Homo sapiens
gctactgattgaccttggagag

SEQ ID NO: 9031607 - DNA, 23 bp, Homo sapiens
gctcagaggtttttctctggatg

SEQ ID NO: 9031608 - DNA, 23 bp, Homo sapiens
gctcagaggtttttctctggatg

SEQ ID NO: 9031609 - DNA, 23 bp, Homo sapiens
gctcagaggtttttctctggatg

SEQ ID NO: 9031610 - DNA, 22 bp, Homo sapiens
gctcagaggttgttcttgggtt

SEQ ID NO: 9031611 - DNA, 23 bp, Homo sapiens
gctcagaggtgaaatgttttggg

SEQ ID NO: 9031612 - DNA, 22 bp, Homo sapiens
gctcagaggttgttcttgggtt

SEQ ID NO: 9031613 - DNA, 19 bp, Homo sapiens
gctcagagggccctgtgct

SEQ ID NO: 9031614 - DNA, 22 bp, Homo sapiens
gctcagagggttttggccaagt

SEQ ID NO: 9031615 - DNA, 19 bp, Homo sapiens
gctcagagggccctgtgct

SEQ ID NO: 9031616 - DNA, 22 bp, Homo sapiens
gctcagagggttttggccaagt

SEQ ID NO: 9031617 - DNA, 22 bp, Homo sapiens
gctcagagggttttggccaagt

SEQ ID NO: 9031618 - DNA, 19 bp, Homo sapiens
gctcagagtccccctgcgg

SEQ ID NO: 9031619 - DNA, 22 bp, Homo sapiens
gctcagagtggcctggctaggg

SEQ ID NO: 9031620 - DNA, 22 bp, Homo sapiens
gctcagagtggcctggctaggg

SEQ ID NO: 9031621 - DNA, 22 bp, Homo sapiens
gctcagagtggcctggctaggg

SEQ ID NO: 9031622 - DNA, 21 bp, Homo sapiens
gctcagagtattgcactgttt

SEQ ID NO: 9031623 - DNA, 21 bp, Homo sapiens
gctcagagtattgcactgttt

SEQ ID NO: 9031624 - DNA, 21 bp, Homo sapiens
gctcagagtattgcactgttt

SEQ ID NO: 9031625 - DNA, 17 bp, Homo sapiens
gctcagagtacacgtgt

SEQ ID NO: 9031626 - DNA, 23 bp, Homo sapiens
gctcagaggtttttctctggatg

SEQ ID NO: 9031627 - DNA, 22 bp, Homo sapiens
gctcagagggttttggccaagt

SEQ ID NO: 9031628 - DNA, 22 bp, Homo sapiens
gctgctgtgttggagagggact

SEQ ID NO: 9031629 - DNA, 22 bp, Homo sapiens
gctgctgttatgatgttacttt

SEQ ID NO: 9031630 - DNA, 22 bp, Homo sapiens
gctgctgttccggctacagccc

SEQ ID NO: 9031631 - DNA, 21 bp, Homo sapiens
gctgctgtgggccagggaggc

SEQ ID NO: 9031632 - DNA, 21 bp, Homo sapiens
gctgctgtgggccagggaggc

SEQ ID NO: 9031633 - DNA, 21 bp, Homo sapiens
gctgctgtgggccagggaggc

SEQ ID NO: 9031634 - DNA, 22 bp, Homo sapiens
gctgctgtgttctcttgaccca

SEQ ID NO: 9031635 - DNA, 22 bp, Homo sapiens
gctgctgtgtgggagacaggcg

SEQ ID NO: 9031636 - DNA, 22 bp, Homo sapiens
gctgcttcctttcctgctgacc

SEQ ID NO: 9031637 - DNA, 22 bp, Homo sapiens
gctgctttaaaatcagcatagc

SEQ ID NO: 9031638 - DNA, 22 bp, Homo sapiens
gctgctttaactggacggctcc

SEQ ID NO: 9031639 - DNA, 22 bp, Homo sapiens
gctgctttacaggtgggggagc

SEQ ID NO: 9031640 - DNA, 22 bp, Homo sapiens
gctgcttcagggacgtgccagc

SEQ ID NO: 9031641 - DNA, 22 bp, Homo sapiens
gctgcttcctagaaggcccagt

SEQ ID NO: 9031642 - DNA, 22 bp, Homo sapiens
gctgctgttcctccagtggatc

SEQ ID NO: 9031643 - DNA, 21 bp, Homo sapiens
gctgctgtgggccagggaggc

SEQ ID NO: 9031644 - DNA, 22 bp, Homo sapiens
gctgctgtggcagattggattc

SEQ ID NO: 9031645 - DNA, 22 bp, Homo sapiens
gctgctgtgccccatctgcaga

SEQ ID NO: 9031646 - DNA, 22 bp, Homo sapiens
gctgctgtctggtctgagggct

SEQ ID NO: 9031647 - DNA, 22 bp, Homo sapiens
gctgctgtgaattttttaaatg

SEQ ID NO: 9031648 - DNA, 22 bp, Homo sapiens
gctgctgtctcatgcgatgcgg

SEQ ID NO: 9031649 - DNA, 22 bp, Homo sapiens
gctgctgtctcatgcgatgcgg

SEQ ID NO: 9031650 - DNA, 21 bp, Homo sapiens
gctgctcgagatccagtgctt

SEQ ID NO: 9031651 - DNA, 21 bp, Homo sapiens
gctgctcgagatccagtgctt

SEQ ID NO: 9031652 - DNA, 22 bp, Homo sapiens
gctgctcctgagtcccgcgcgc

SEQ ID NO: 9031653 - DNA, 22 bp, Homo sapiens
gctgctccgtctgagctctggt

SEQ ID NO: 9031654 - DNA, 19 bp, Homo sapiens
gctgctcctggctgaccac

SEQ ID NO: 9031655 - DNA, 22 bp, Homo sapiens
gctgctccgtctgagctctggt

SEQ ID NO: 9031656 - DNA, 22 bp, Homo sapiens
gctgctccgtctgagctctggt

SEQ ID NO: 9031657 - DNA, 22 bp, Homo sapiens
gctgctccgtctgagctctggt

SEQ ID NO: 9031658 - DNA, 22 bp, Homo sapiens
gctgctccgcagagtgtgtgtg

SEQ ID NO: 9031659 - DNA, 22 bp, Homo sapiens
gctgctccgcagagtgtgtgtg

SEQ ID NO: 9031660 - DNA, 22 bp, Homo sapiens
gctgctcagtgggcctgagcct

SEQ ID NO: 9031661 - DNA, 22 bp, Homo sapiens
gctgctccagctgtgctgcaga

SEQ ID NO: 9031662 - DNA, 22 bp, Homo sapiens
gctgctccagctgtgctgcaga

SEQ ID NO: 9031663 - DNA, 22 bp, Homo sapiens
gctgctccagctgtgctgcaga

SEQ ID NO: 9031664 - DNA, 22 bp, Homo sapiens
gctgctccagctgtgctgcaga

SEQ ID NO: 9031665 - DNA, 22 bp, Homo sapiens
gctgctccagtgttctgtctag

SEQ ID NO: 9031666 - DNA, 22 bp, Homo sapiens
gctgctccagctgtgctgcaga

SEQ ID NO: 9031667 - DNA, 22 bp, Homo sapiens
gctgcggtcactgcgggggctg

SEQ ID NO: 9031668 - DNA, 22 bp, Homo sapiens
gctgcgtcgagacagcctggca

SEQ ID NO: 9031669 - DNA, 22 bp, Homo sapiens
gctgcgccggatcccacgttcc

SEQ ID NO: 9031670 - DNA, 22 bp, Homo sapiens
gctgccttttgctcctcccacc

SEQ ID NO: 9031671 - DNA, 18 bp, Homo sapiens
gctgcgtgggatgtgacc

SEQ ID NO: 9031672 - DNA, 22 bp, Homo sapiens
gctgctaagcgtttctgttcca

SEQ ID NO: 9031673 - DNA, 18 bp, Homo sapiens
gctgcgtgggatgtgacc

SEQ ID NO: 9031674 - DNA, 20 bp, Homo sapiens
gctgcggttacagagacaca

SEQ ID NO: 9031675 - DNA, 18 bp, Homo sapiens
gctgcgtgggatgtgacc

SEQ ID NO: 9031676 - DNA, 22 bp, Homo sapiens
gctgctcagtgggcctgagcct

SEQ ID NO: 9031677 - DNA, 22 bp, Homo sapiens
gctgctattagtcttctattca

SEQ ID NO: 9031678 - DNA, 20 bp, Homo sapiens
gctgcctgtttctgtaagta

SEQ ID NO: 9031679 - DNA, 20 bp, Homo sapiens
gctgcctgtttctgtaagta

SEQ ID NO: 9031680 - DNA, 20 bp, Homo sapiens
gctgcctgtttctgtaagta

SEQ ID NO: 9031681 - DNA, 22 bp, Homo sapiens
gctgcctgttgaagggtctgtg

SEQ ID NO: 9031682 - DNA, 22 bp, Homo sapiens
gctgcctgttgaagggtctgtg

SEQ ID NO: 9031683 - DNA, 20 bp, Homo sapiens
gctgcctgtttctgtaagta

SEQ ID NO: 9031684 - DNA, 22 bp, Homo sapiens
gctgccttatgtctattagtat

SEQ ID NO: 9031685 - DNA, 22 bp, Homo sapiens
gctgccttaacttcttcgctgt

SEQ ID NO: 9031686 - DNA, 22 bp, Homo sapiens
gctgccttagagggagtggttc

SEQ ID NO: 9031687 - DNA, 22 bp, Homo sapiens
gctgccttatgtctattagtat

SEQ ID NO: 9031688 - DNA, 22 bp, Homo sapiens
gctgccttcagttctgattcat

SEQ ID NO: 9031689 - DNA, 19 bp, Homo sapiens
gctgcctgtcttagccagt

SEQ ID NO: 9031690 - DNA, 22 bp, Homo sapiens
gctgcctgtgcactttctcgta

SEQ ID NO: 9031691 - DNA, 22 bp, Homo sapiens
gctgcctgtctgctgacccagg

SEQ ID NO: 9031692 - DNA, 22 bp, Homo sapiens
gctgcctgtctgctgacccagg

SEQ ID NO: 9031693 - DNA, 22 bp, Homo sapiens
gctgcctgtctgctgacccagg

SEQ ID NO: 9031694 - DNA, 22 bp, Homo sapiens
gctgcctgtctgctgacccagg

SEQ ID NO: 9031695 - DNA, 22 bp, Homo sapiens
gctgcctgtcctgaggagtccg

SEQ ID NO: 9031696 - DNA, 22 bp, Homo sapiens
gctgcctgtcctgaggagtccg

SEQ ID NO: 9031697 - DNA, 22 bp, Homo sapiens
gctgcctgtctgctgacccagg

SEQ ID NO: 9031698 - DNA, 22 bp, Homo sapiens
gctgcctgtggcccttctgggt

SEQ ID NO: 9031699 - DNA, 22 bp, Homo sapiens
gctgcctgtggcccttctgggt

SEQ ID NO: 9031700 - DNA, 22 bp, Homo sapiens
gctgcctgtggcccttctgggt

SEQ ID NO: 9031701 - DNA, 22 bp, Homo sapiens
gctgcctgtgtggccactcact

SEQ ID NO: 9031702 - DNA, 22 bp, Homo sapiens
gctgcctgttgaagggtctgtg

SEQ ID NO: 9031703 - DNA, 22 bp, Homo sapiens
gctgcctgttgaagggtctgtg

SEQ ID NO: 9031704 - DNA, 22 bp, Homo sapiens
gctgagggccgcatagggtcat

SEQ ID NO: 9031705 - DNA, 22 bp, Homo sapiens
gctgagggccgcatagggtcat

SEQ ID NO: 9031706 - DNA, 19 bp, Homo sapiens
gctgagggccacccagccc

SEQ ID NO: 9031707 - DNA, 22 bp, Homo sapiens
gctgcccaattacagggccgtg

SEQ ID NO: 9031708 - DNA, 22 bp, Homo sapiens
gctgcccaattacagggccgtg

SEQ ID NO: 9031709 - DNA, 22 bp, Homo sapiens
gctgagggctgtaacagcagag

SEQ ID NO: 9031710 - DNA, 22 bp, Homo sapiens
gctgagggctgtaacagcagag

SEQ ID NO: 9031711 - DNA, 22 bp, Homo sapiens
gctgagggctgtaacagcagag

SEQ ID NO: 9031712 - DNA, 22 bp, Homo sapiens
gctgagggctgtaacagcagag

SEQ ID NO: 9031713 - DNA, 22 bp, Homo sapiens
gctgagggcagcctcctaggtc

SEQ ID NO: 9031714 - DNA, 22 bp, Homo sapiens
gctgagggatagctgctcactg

SEQ ID NO: 9031715 - DNA, 22 bp, Homo sapiens
gctgagggatagctgctcactg

SEQ ID NO: 9031716 - DNA, 22 bp, Homo sapiens
gctgagggcagcctcctaggtc

SEQ ID NO: 9031717 - DNA, 22 bp, Homo sapiens
gctgagggcatgtgtggcgact

SEQ ID NO: 9031718 - DNA, 22 bp, Homo sapiens
gctgagggcatgtgtggcgact

SEQ ID NO: 9031719 - DNA, 22 bp, Homo sapiens
gctgagggcatgtgtggcgact

SEQ ID NO: 9031720 - DNA, 22 bp, Homo sapiens
gctgagggcatgtgtggcgact

SEQ ID NO: 9031721 - DNA, 22 bp, Homo sapiens
gctgagggcatgtgtggcgact

SEQ ID NO: 9031722 - DNA, 19 bp, Homo sapiens
gctgagggccacccagccc

SEQ ID NO: 9031723 - DNA, 19 bp, Homo sapiens
gctgagggccacccagccc

SEQ ID NO: 9031724 - DNA, 19 bp, Homo sapiens
gctgagggccacccagccc

SEQ ID NO: 9031725 - DNA, 22 bp, Homo sapiens
gctgcccacaatgattacatgg

SEQ ID NO: 9031726 - DNA, 22 bp, Homo sapiens
gctgcccacagcgggtgtttcg

SEQ ID NO: 9031727 - DNA, 22 bp, Homo sapiens
gctgcccacaaccccgtgtcta

SEQ ID NO: 9031728 - DNA, 22 bp, Homo sapiens
gctgcccacaaccccgtgtcta

SEQ ID NO: 9031729 - DNA, 22 bp, Homo sapiens
gctgcccagcaggccccagggg

SEQ ID NO: 9031730 - DNA, 22 bp, Homo sapiens
gctgcccagacattgaatcagg

SEQ ID NO: 9031731 - DNA, 22 bp, Homo sapiens
gctgcccagcaggccccagggg

SEQ ID NO: 9031732 - DNA, 22 bp, Homo sapiens
gctgcccacagcgggtgtttcg

SEQ ID NO: 9031733 - DNA, 22 bp, Homo sapiens
gctgcccagacattgaatcagg

SEQ ID NO: 9031734 - DNA, 22 bp, Homo sapiens
gctgcccaggagaggtggggct

SEQ ID NO: 9031735 - DNA, 22 bp, Homo sapiens
gctgcccaggagaggtggggct

SEQ ID NO: 9031736 - DNA, 22 bp, Homo sapiens
gctgcccagcaggccccagggg

SEQ ID NO: 9031737 - DNA, 22 bp, Homo sapiens
gctgcccaggaagcctggggtt

SEQ ID NO: 9031738 - DNA, 22 bp, Homo sapiens
gctgcccaggaagcctggggtt

SEQ ID NO: 9031739 - DNA, 22 bp, Homo sapiens
gctgcccagtgtgctcatgcag

SEQ ID NO: 9031740 - DNA, 22 bp, Homo sapiens
gctgcccagtgtgctcatgcag

SEQ ID NO: 9031741 - DNA, 22 bp, Homo sapiens
gctgcccagttctgctgctgcc

SEQ ID NO: 9031742 - DNA, 22 bp, Homo sapiens
gctgcccagttctgctgctgcc

SEQ ID NO: 9031743 - DNA, 22 bp, Homo sapiens
gctgcccattccactggatggt

SEQ ID NO: 9031744 - DNA, 22 bp, Homo sapiens
gctgcccagttctgctgctgcc

SEQ ID NO: 9031745 - DNA, 22 bp, Homo sapiens
gctgcccagttctgctgctgcc

SEQ ID NO: 9031746 - DNA, 22 bp, Homo sapiens
gctgcccagggtggagccggct

SEQ ID NO: 9031747 - DNA, 22 bp, Homo sapiens
gctgcccagggtggagccggct

SEQ ID NO: 9031748 - DNA, 22 bp, Homo sapiens
gctgcccaggcaacattgactt

SEQ ID NO: 9031749 - DNA, 22 bp, Homo sapiens
gctgcccaggcaacattgactt

SEQ ID NO: 9031750 - DNA, 22 bp, Homo sapiens
gctgcccagggctgagtgtcct

SEQ ID NO: 9031751 - DNA, 22 bp, Homo sapiens
gctgcccagggctgagtgtcct

SEQ ID NO: 9031752 - DNA, 22 bp, Homo sapiens
gctgcccagggctgagtgtcct

SEQ ID NO: 9031753 - DNA, 22 bp, Homo sapiens
gctgccccgagccatccttcag

SEQ ID NO: 9031754 - DNA, 22 bp, Homo sapiens
gctgccccccggactcggcggg

SEQ ID NO: 9031755 - DNA, 22 bp, Homo sapiens
gctgccccccggactcggcggg

SEQ ID NO: 9031756 - DNA, 22 bp, Homo sapiens
gctgccctaatatcacatgtta

SEQ ID NO: 9031757 - DNA, 22 bp, Homo sapiens
gctgccctaatatcacatgtta

SEQ ID NO: 9031758 - DNA, 22 bp, Homo sapiens
gctgccccgagccatccttcag

SEQ ID NO: 9031759 - DNA, 22 bp, Homo sapiens
gctgcccattccactggatggt

SEQ ID NO: 9031760 - DNA, 22 bp, Homo sapiens
gctgcccattgctctcccactc

SEQ ID NO: 9031761 - DNA, 22 bp, Homo sapiens
gctgcccattccactggatggt

SEQ ID NO: 9031762 - DNA, 22 bp, Homo sapiens
gctgcccattgcacgttgtggc

SEQ ID NO: 9031763 - DNA, 22 bp, Homo sapiens
gctgcccattgctctcccactc

SEQ ID NO: 9031764 - DNA, 22 bp, Homo sapiens
gctgccctacccgaggcactct

SEQ ID NO: 9031765 - DNA, 22 bp, Homo sapiens
gctgccctacccgaggcactct

SEQ ID NO: 9031766 - DNA, 22 bp, Homo sapiens
gctgccctacccgaggcactct

SEQ ID NO: 9031767 - DNA, 22 bp, Homo sapiens
gctgccctagaagtacagagag

SEQ ID NO: 9031768 - DNA, 22 bp, Homo sapiens
gctgccctagaagtacagagag

SEQ ID NO: 9031769 - DNA, 22 bp, Homo sapiens
gctgccctacccgaggcactct

SEQ ID NO: 9031770 - DNA, 22 bp, Homo sapiens
gctgccctagaagtacagagag

SEQ ID NO: 9031771 - DNA, 22 bp, Homo sapiens
gctgccctagaagtacagagag

SEQ ID NO: 9031772 - DNA, 22 bp, Homo sapiens
gctgccctgtggtccagcaggt

SEQ ID NO: 9031773 - DNA, 22 bp, Homo sapiens
gctgccctgtggtagagggtgg

SEQ ID NO: 9031774 - DNA, 22 bp, Homo sapiens
gctgccctgtctgcagcaggac

SEQ ID NO: 9031775 - DNA, 22 bp, Homo sapiens
gctgccctgtggtccagcaggt

SEQ ID NO: 9031776 - DNA, 22 bp, Homo sapiens
gctgccctgtggtccagcaggt

SEQ ID NO: 9031777 - DNA, 22 bp, Homo sapiens
gctgccctgtttagccagggtt

SEQ ID NO: 9031778 - DNA, 22 bp, Homo sapiens
gctgccctgtttagccagggtt

SEQ ID NO: 9031779 - DNA, 22 bp, Homo sapiens
gctgccctgtttagccagggtt

SEQ ID NO: 9031780 - DNA, 22 bp, Homo sapiens
gctgccctgtttagccagggtt

SEQ ID NO: 9031781 - DNA, 22 bp, Homo sapiens
gctgccctgtttagccagggtt

SEQ ID NO: 9031782 - DNA, 22 bp, Homo sapiens
gctgcccttcgtcatctataaa

SEQ ID NO: 9031783 - DNA, 22 bp, Homo sapiens
gctgcccttcgtcatctataaa

SEQ ID NO: 9031784 - DNA, 22 bp, Homo sapiens
gctgcctcactccagcccaata

SEQ ID NO: 9031785 - DNA, 22 bp, Homo sapiens
gctgcctcactccagcccaata

SEQ ID NO: 9031786 - DNA, 22 bp, Homo sapiens
gctgccgacccacaggggttaa

SEQ ID NO: 9031787 - DNA, 22 bp, Homo sapiens
gctgcctacgcttgagccctgg

SEQ ID NO: 9031788 - DNA, 22 bp, Homo sapiens
gctgccgacccacaggggttaa

SEQ ID NO: 9031789 - DNA, 22 bp, Homo sapiens
gctgccgttggctcttcaggcc

SEQ ID NO: 9031790 - DNA, 22 bp, Homo sapiens
gctgcctagttctttatgtgaa

SEQ ID NO: 9031791 - DNA, 22 bp, Homo sapiens
gctgcctcaggcacctcctggc

SEQ ID NO: 9031792 - DNA, 22 bp, Homo sapiens
gctgcctcaggcacctcctggc

SEQ ID NO: 9031793 - DNA, 22 bp, Homo sapiens
gctgcctgtcctgaggagtccg

SEQ ID NO: 9031794 - DNA, 22 bp, Homo sapiens
gctgcctgtcctgaggagtccg

SEQ ID NO: 9031795 - DNA, 22 bp, Homo sapiens
gctgcctgtcctgaggagtccg

SEQ ID NO: 9031796 - DNA, 22 bp, Homo sapiens
gctgcctccaatctgtgccccg

SEQ ID NO: 9031797 - DNA, 22 bp, Homo sapiens
gctgcctccaatctgtgccccg

SEQ ID NO: 9031798 - DNA, 22 bp, Homo sapiens
gctgcctgtcccaggatgagga

SEQ ID NO: 9031799 - DNA, 22 bp, Homo sapiens
gctctggggatgcttctgccgt

SEQ ID NO: 9031800 - DNA, 22 bp, Homo sapiens
gctctggggatgcttctgccgt

SEQ ID NO: 9031801 - DNA, 22 bp, Homo sapiens
gctctggggatgcttctgccgt

SEQ ID NO: 9031802 - DNA, 23 bp, Homo sapiens
gctgaattaagcaatgaagaaat

SEQ ID NO: 9031803 - DNA, 22 bp, Homo sapiens
gctctggggttggaaagtgatc

SEQ ID NO: 9031804 - DNA, 22 bp, Homo sapiens
gctgaataggggtcccaaagat

SEQ ID NO: 9031805 - DNA, 22 bp, Homo sapiens
gctgaataggcacagagggcat

SEQ ID NO: 9031806 - DNA, 22 bp, Homo sapiens
gctctgggctgccctctggaca

SEQ ID NO: 9031807 - DNA, 22 bp, Homo sapiens
gctctgggctgccctctggaca

SEQ ID NO: 9031808 - DNA, 22 bp, Homo sapiens
gctctggggatgcttctgccgt

SEQ ID NO: 9031809 - DNA, 22 bp, Homo sapiens
gctctgggctgccctctggaca

SEQ ID NO: 9031810 - DNA, 22 bp, Homo sapiens
gctctgggctgaatcatttatc

SEQ ID NO: 9031811 - DNA, 22 bp, Homo sapiens
gctctgggctgaatcatttatc

SEQ ID NO: 9031812 - DNA, 22 bp, Homo sapiens
gctctgggctgccctctggaca

SEQ ID NO: 9031813 - DNA, 22 bp, Homo sapiens
gctctgggctgccctctggaca

SEQ ID NO: 9031814 - DNA, 22 bp, Homo sapiens
gctctgggccgggcaccagcct

SEQ ID NO: 9031815 - DNA, 22 bp, Homo sapiens
gctctgggccatcctggccggg

SEQ ID NO: 9031816 - DNA, 22 bp, Homo sapiens
gctctgggccgggcaccagcct

SEQ ID NO: 9031817 - DNA, 22 bp, Homo sapiens
gctctgggccgggcaccagcct

SEQ ID NO: 9031818 - DNA, 22 bp, Homo sapiens
gctctgggccatcctggccggg

SEQ ID NO: 9031819 - DNA, 22 bp, Homo sapiens
gctctgggccatcctggccggg

SEQ ID NO: 9031820 - DNA, 22 bp, Homo sapiens
gctctgggccatcctggccggg

SEQ ID NO: 9031821 - DNA, 22 bp, Homo sapiens
gctctgggattaccagccttag

SEQ ID NO: 9031822 - DNA, 22 bp, Homo sapiens
gctctgggattaccagccttag

SEQ ID NO: 9031823 - DNA, 22 bp, Homo sapiens
gctctgggccatcctggccggg

SEQ ID NO: 9031824 - DNA, 20 bp, Homo sapiens
gctctgggagggatgtgatg

SEQ ID NO: 9031825 - DNA, 20 bp, Homo sapiens
gctctgggagggatgtgatg

SEQ ID NO: 9031826 - DNA, 20 bp, Homo sapiens
gctctgggagggatgtgatg

SEQ ID NO: 9031827 - DNA, 22 bp, Homo sapiens
gctctgggaattcagaaagcct

SEQ ID NO: 9031828 - DNA, 22 bp, Homo sapiens
gctctgggattaccagccttag

SEQ ID NO: 9031829 - DNA, 22 bp, Homo sapiens
gctctgggattaccagccttag

SEQ ID NO: 9031830 - DNA, 22 bp, Homo sapiens
gctctgggattaccagccttag

SEQ ID NO: 9031831 - DNA, 22 bp, Homo sapiens
gctctgggattaccagccttag

SEQ ID NO: 9031832 - DNA, 22 bp, Homo sapiens
gctctgggaactgactgccttc

SEQ ID NO: 9031833 - DNA, 22 bp, Homo sapiens
gctctggcttggggcactcgtc

SEQ ID NO: 9031834 - DNA, 22 bp, Homo sapiens
gctctggcttggggcactcgtc

SEQ ID NO: 9031835 - DNA, 22 bp, Homo sapiens
gctctggcttggggcactcgtc

SEQ ID NO: 9031836 - DNA, 18 bp, Homo sapiens
gctctggctcacctccag

SEQ ID NO: 9031837 - DNA, 22 bp, Homo sapiens
gctctggctcaaaccaccggct

SEQ ID NO: 9031838 - DNA, 22 bp, Homo sapiens
gctctggctcaaaccaccggct

SEQ ID NO: 9031839 - DNA, 18 bp, Homo sapiens
gctctggctcacctccag

SEQ ID NO: 9031840 - DNA, 22 bp, Homo sapiens
gctctgggaaggatcgtagtga

SEQ ID NO: 9031841 - DNA, 22 bp, Homo sapiens
gctctgggaagtcctttaccat

SEQ ID NO: 9031842 - DNA, 22 bp, Homo sapiens
gctctgggaagtcctttaccat

SEQ ID NO: 9031843 - DNA, 22 bp, Homo sapiens
gctctgggaattcagaaagcct

SEQ ID NO: 9031844 - DNA, 22 bp, Homo sapiens
gctctgggaattcagaaagcct

SEQ ID NO: 9031845 - DNA, 22 bp, Homo sapiens
gctctgggaaggatcgtagtga

SEQ ID NO: 9031846 - DNA, 22 bp, Homo sapiens
gctctgggaactgactgccttc

SEQ ID NO: 9031847 - DNA, 22 bp, Homo sapiens
gctctgggaactgactgccttc

SEQ ID NO: 9031848 - DNA, 22 bp, Homo sapiens
gctctgggaactgactgccttc

SEQ ID NO: 9031849 - DNA, 22 bp, Homo sapiens
gctcccttaggccttgccggga

SEQ ID NO: 9031850 - DNA, 22 bp, Homo sapiens
gctcccttagtccttgccggga

SEQ ID NO: 9031851 - DNA, 22 bp, Homo sapiens
gctccctgttctcagccatgat

SEQ ID NO: 9031852 - DNA, 22 bp, Homo sapiens
gctccctgttctcagccatgat

SEQ ID NO: 9031853 - DNA, 22 bp, Homo sapiens
gctccctgttctcagccatgat

SEQ ID NO: 9031854 - DNA, 22 bp, Homo sapiens
gctccgccacgcccactcctac

SEQ ID NO: 9031855 - DNA, 22 bp, Homo sapiens
gctccgtgggcattgctaggtg

SEQ ID NO: 9031856 - DNA, 22 bp, Homo sapiens
gctccctgtgggatgaggcgcc

SEQ ID NO: 9031857 - DNA, 22 bp, Homo sapiens
gctccctgttctcagccatgat

SEQ ID NO: 9031858 - DNA, 22 bp, Homo sapiens
gctccctgtgctctgagtgata

SEQ ID NO: 9031859 - DNA, 23 bp, Homo sapiens
gctccctgtgctccaggagatgc

SEQ ID NO: 9031860 - DNA, 22 bp, Homo sapiens
gctcctccctgtgcagacccag

SEQ ID NO: 9031861 - DNA, 22 bp, Homo sapiens
gctcctctattccccacatttt

SEQ ID NO: 9031862 - DNA, 22 bp, Homo sapiens
gctcctctattccccacatttt

SEQ ID NO: 9031863 - DNA, 22 bp, Homo sapiens
gctctggctcaaaccaccggct

SEQ ID NO: 9031864 - DNA, 22 bp, Homo sapiens
gctctggctcaaaccaccggct

SEQ ID NO: 9031865 - DNA, 22 bp, Homo sapiens
gctgaggctcaagtcatgggtc

SEQ ID NO: 9031866 - DNA, 22 bp, Homo sapiens
gctgaggctcaagtcatgggtc

SEQ ID NO: 9031867 - DNA, 22 bp, Homo sapiens
gctgaggctcaagtcatgggtc

SEQ ID NO: 9031868 - DNA, 22 bp, Homo sapiens
gctgaggctcaagtcatgggtc

SEQ ID NO: 9031869 - DNA, 22 bp, Homo sapiens
gctgaggctcaagtcatgggtc

SEQ ID NO: 9031870 - DNA, 22 bp, Homo sapiens
gctgaggcggaaggattgctag

SEQ ID NO: 9031871 - DNA, 22 bp, Homo sapiens
gctgaggcggaaggattgctag

SEQ ID NO: 9031872 - DNA, 22 bp, Homo sapiens
gctgaggcggaaggattgctag

SEQ ID NO: 9031873 - DNA, 22 bp, Homo sapiens
gctgaggcctcagaaggctgag

SEQ ID NO: 9031874 - DNA, 22 bp, Homo sapiens
gctgaggcctcagaaggctgag

SEQ ID NO: 9031875 - DNA, 22 bp, Homo sapiens
gctgaggcctcagaaggctgag

SEQ ID NO: 9031876 - DNA, 22 bp, Homo sapiens
gctgaggcctcagaaggctgag

SEQ ID NO: 9031877 - DNA, 22 bp, Homo sapiens
gctgaggcctcagaaggctgag

SEQ ID NO: 9031878 - DNA, 22 bp, Homo sapiens
gctgaggccagtttaatgagga

SEQ ID NO: 9031879 - DNA, 22 bp, Homo sapiens
gctgaggccagtttaatgagga

SEQ ID NO: 9031880 - DNA, 22 bp, Homo sapiens
gctgaggccccagggtgatggg

SEQ ID NO: 9031881 - DNA, 22 bp, Homo sapiens
gctgaggccccagggtgatggg

SEQ ID NO: 9031882 - DNA, 22 bp, Homo sapiens
gctgaggccccagggtgatggg

SEQ ID NO: 9031883 - DNA, 22 bp, Homo sapiens
gctgaggccccagggtgatggg

SEQ ID NO: 9031884 - DNA, 22 bp, Homo sapiens
gctgaggccccagggtgatggg

SEQ ID NO: 9031885 - DNA, 22 bp, Homo sapiens
gctgaggccaggccccaccgga

SEQ ID NO: 9031886 - DNA, 22 bp, Homo sapiens
gctgaggccagtttaatgagga

SEQ ID NO: 9031887 - DNA, 22 bp, Homo sapiens
gctgaggccaggccccaccgga

SEQ ID NO: 9031888 - DNA, 22 bp, Homo sapiens
gctgagagtgggtgcagtgctt

SEQ ID NO: 9031889 - DNA, 22 bp, Homo sapiens
gctgagggaccatgtttcagga

SEQ ID NO: 9031890 - DNA, 22 bp, Homo sapiens
gctgagggatagctgctcactg

SEQ ID NO: 9031891 - DNA, 22 bp, Homo sapiens
gctgaggcttagctaaaaattt

SEQ ID NO: 9031892 - DNA, 22 bp, Homo sapiens
gctgaggcttagctaaaaattt

SEQ ID NO: 9031893 - DNA, 22 bp, Homo sapiens
gctgaggcttagctaaaaattt

SEQ ID NO: 9031894 - DNA, 22 bp, Homo sapiens
gctgaggctgggagcagcctgt

SEQ ID NO: 9031895 - DNA, 22 bp, Homo sapiens
gctgaggctcctcgggaggaca

SEQ ID NO: 9031896 - DNA, 22 bp, Homo sapiens
gctgaggctcctcgggaggaca

SEQ ID NO: 9031897 - DNA, 22 bp, Homo sapiens
gctgaggctgggagcagcctgt

SEQ ID NO: 9031898 - DNA, 22 bp, Homo sapiens
gctgaggctgggagcagcctgt

SEQ ID NO: 9031899 - DNA, 22 bp, Homo sapiens
gctgaggctgggagcagcctgt

SEQ ID NO: 9031900 - DNA, 22 bp, Homo sapiens
gctgaggctgggagcagcctgt

SEQ ID NO: 9031901 - DNA, 22 bp, Homo sapiens
gctgaggctcaatccccttctg

SEQ ID NO: 9031902 - DNA, 22 bp, Homo sapiens
gctgaggctcaagtcatgggtc

SEQ ID NO: 9031903 - DNA, 22 bp, Homo sapiens
gctgaggctcaatccccttctg

SEQ ID NO: 9031904 - DNA, 22 bp, Homo sapiens
gctgaggctcaatccccttctg

SEQ ID NO: 9031905 - DNA, 22 bp, Homo sapiens
gctgaggctcctcgggaggaca

SEQ ID NO: 9031906 - DNA, 22 bp, Homo sapiens
gctgaggctcctcgggaggaca

SEQ ID NO: 9031907 - DNA, 22 bp, Homo sapiens
gctgaggctcctcgggaggaca

SEQ ID NO: 9031908 - DNA, 22 bp, Homo sapiens
gctgagagtccaggaaaacatc

SEQ ID NO: 9031909 - DNA, 22 bp, Homo sapiens
gctgagagtccaggaaaacatc

SEQ ID NO: 9031910 - DNA, 22 bp, Homo sapiens
gctgagagtgagcactggatat

SEQ ID NO: 9031911 - DNA, 22 bp, Homo sapiens
gctgagagtgagcactggatat

SEQ ID NO: 9031912 - DNA, 21 bp, Homo sapiens
gctgagaggttgggaagttca

SEQ ID NO: 9031913 - DNA, 22 bp, Homo sapiens
gctgagagtccaggaaaacatc

SEQ ID NO: 9031914 - DNA, 22 bp, Homo sapiens
gctgagaggcactatctccgga

SEQ ID NO: 9031915 - DNA, 17 bp, Homo sapiens
gctgagaggcagcacag

SEQ ID NO: 9031916 - DNA, 22 bp, Homo sapiens
gctgagaggcagccagaccctc

SEQ ID NO: 9031917 - DNA, 17 bp, Homo sapiens
gctgagaggcagcacag

SEQ ID NO: 9031918 - DNA, 17 bp, Homo sapiens
gctgagaggcagcacag

SEQ ID NO: 9031919 - DNA, 22 bp, Homo sapiens
gctgagagcaaggacaaagcat

SEQ ID NO: 9031920 - DNA, 22 bp, Homo sapiens
gctgagagcaaggacaaagcat

SEQ ID NO: 9031921 - DNA, 22 bp, Homo sapiens
gctgagagcacatagaaggggc

SEQ ID NO: 9031922 - DNA, 22 bp, Homo sapiens
gctgagagcaaagcatgtctag

SEQ ID NO: 9031923 - DNA, 22 bp, Homo sapiens
gctgagagcaaagcatgtctag

SEQ ID NO: 9031924 - DNA, 22 bp, Homo sapiens
gctgagagatcaaggcaggatt

SEQ ID NO: 9031925 - DNA, 22 bp, Homo sapiens
gctgagagatcaaggcaggatt

SEQ ID NO: 9031926 - DNA, 22 bp, Homo sapiens
gctgagagcaaagcatgtctag

SEQ ID NO: 9031927 - DNA, 22 bp, Homo sapiens
gctgagagcacatagaaggggc

SEQ ID NO: 9031928 - DNA, 22 bp, Homo sapiens
gctgagagcagtgtggccttaa

SEQ ID NO: 9031929 - DNA, 22 bp, Homo sapiens
gctgagagcacatagaaggggc

SEQ ID NO: 9031930 - DNA, 22 bp, Homo sapiens
gctgagagcacatagaaggggc

SEQ ID NO: 9031931 - DNA, 22 bp, Homo sapiens
gctgagagcggccagctgggaa

SEQ ID NO: 9031932 - DNA, 22 bp, Homo sapiens
gctgagagcggccagctgggaa

SEQ ID NO: 9031933 - DNA, 22 bp, Homo sapiens
gctgagagcggccagctgggaa

SEQ ID NO: 9031934 - DNA, 22 bp, Homo sapiens
gctgagaagtcccatgatccgc

SEQ ID NO: 9031935 - DNA, 22 bp, Homo sapiens
gctgagaatcaagatggagagg

SEQ ID NO: 9031936 - DNA, 22 bp, Homo sapiens
gctgagaatcaagatggagagg

SEQ ID NO: 9031937 - DNA, 22 bp, Homo sapiens
gctgagaatgttcctactggta

SEQ ID NO: 9031938 - DNA, 21 bp, Homo sapiens
gctgagacgcaacctcagtga

SEQ ID NO: 9031939 - DNA, 22 bp, Homo sapiens
gctgacaagtccagagcccttc

SEQ ID NO: 9031940 - DNA, 17 bp, Homo sapiens
gctgagaaggggaagag

SEQ ID NO: 9031941 - DNA, 23 bp, Homo sapiens
gctgaattaagcaatgaagaaat

SEQ ID NO: 9031942 - DNA, 22 bp, Homo sapiens
gctgaattcctgctcttggatt

SEQ ID NO: 9031943 - DNA, 22 bp, Homo sapiens
gctgagagatcaaggcaggatt

SEQ ID NO: 9031944 - DNA, 22 bp, Homo sapiens
gctgagagatcaaggcaggatt

SEQ ID NO: 9031945 - DNA, 22 bp, Homo sapiens
gctgagagatcaaggcaggatt

SEQ ID NO: 9031946 - DNA, 22 bp, Homo sapiens
gctgagagaaaagtgaggttct

SEQ ID NO: 9031947 - DNA, 22 bp, Homo sapiens
gctgagagatcaaggcaggatt

SEQ ID NO: 9031948 - DNA, 22 bp, Homo sapiens
gctgagagatcaaggcaggatt

SEQ ID NO: 9031949 - DNA, 22 bp, Homo sapiens
gctgagacttccactgccatct

SEQ ID NO: 9031950 - DNA, 22 bp, Homo sapiens
gctgagagaaaagtgaggttct

SEQ ID NO: 9031951 - DNA, 22 bp, Homo sapiens
gctgagactggcagcaggaagt

SEQ ID NO: 9031952 - DNA, 23 bp, Homo sapiens
gcacatactacacagaaaatggc

SEQ ID NO: 9031953 - DNA, 23 bp, Homo sapiens
gcacatactacacagaaaatggc

SEQ ID NO: 9031954 - DNA, 22 bp, Homo sapiens
gcacatacgtcagtggctgtca

SEQ ID NO: 9031955 - DNA, 22 bp, Homo sapiens
gcacatacatattagtgtcaca

SEQ ID NO: 9031956 - DNA, 22 bp, Homo sapiens
gcacatatgctgtaagcacatg

SEQ ID NO: 9031957 - DNA, 22 bp, Homo sapiens
gcacatatgctgtaagcacatg

SEQ ID NO: 9031958 - DNA, 22 bp, Homo sapiens
gcacatactgcaaagattacta

SEQ ID NO: 9031959 - DNA, 22 bp, Homo sapiens
gcacatcagccactttgaatgg

SEQ ID NO: 9031960 - DNA, 22 bp, Homo sapiens
gcacatccaatgattgttttga

SEQ ID NO: 9031961 - DNA, 22 bp, Homo sapiens
gcacatgaggctgtctttgtct

SEQ ID NO: 9031962 - DNA, 22 bp, Homo sapiens
gcacatctggagctctgtggaa

SEQ ID NO: 9031963 - DNA, 22 bp, Homo sapiens
gcacatgacagtaagtagagca

SEQ ID NO: 9031964 - DNA, 22 bp, Homo sapiens
gcacatgacagtaagtagagca

SEQ ID NO: 9031965 - DNA, 19 bp, Homo sapiens
gcagacaggtccagagagg

SEQ ID NO: 9031966 - DNA, 17 bp, Homo sapiens
gcacagtgatattattt

SEQ ID NO: 9031967 - DNA, 22 bp, Homo sapiens
gcacagtgatgtcagaattgga

SEQ ID NO: 9031968 - DNA, 17 bp, Homo sapiens
gcacagtgatattattt

SEQ ID NO: 9031969 - DNA, 22 bp, Homo sapiens
gcacagtgcaccactttgaaaa

SEQ ID NO: 9031970 - DNA, 21 bp, Homo sapiens
gcacagtgccaggcacacagt

SEQ ID NO: 9031971 - DNA, 21 bp, Homo sapiens
gcacagtgccaggcacacagt

SEQ ID NO: 9031972 - DNA, 21 bp, Homo sapiens
gcacagtgccaggcacacagt

SEQ ID NO: 9031973 - DNA, 22 bp, Homo sapiens
gcacagtgggtggtcatgtaca

SEQ ID NO: 9031974 - DNA, 21 bp, Homo sapiens
gcacagtgccaggcacacagt

SEQ ID NO: 9031975 - DNA, 22 bp, Homo sapiens
gcacagtggagtgtgtccaggg

SEQ ID NO: 9031976 - DNA, 22 bp, Homo sapiens
gcacagttaaagggtcatgtga

SEQ ID NO: 9031977 - DNA, 22 bp, Homo sapiens
gcacagttgagacttcacagct

SEQ ID NO: 9031978 - DNA, 22 bp, Homo sapiens
gcacagttaaagggtcatgtga

SEQ ID NO: 9031979 - DNA, 20 bp, Homo sapiens
gcacagtttgggaaccatgg

SEQ ID NO: 9031980 - DNA, 22 bp, Homo sapiens
gcacagttgtgacaaccatcgc

SEQ ID NO: 9031981 - DNA, 22 bp, Homo sapiens
gcagactgcgtgaggcgccgcc

SEQ ID NO: 9031982 - DNA, 22 bp, Homo sapiens
gcagactgcgagcgtgctggtg

SEQ ID NO: 9031983 - DNA, 22 bp, Homo sapiens
gcagactgcgagcgtgctggtg

SEQ ID NO: 9031984 - DNA, 21 bp, Homo sapiens
gcagactgccctgctgtcccc

SEQ ID NO: 9031985 - DNA, 21 bp, Homo sapiens
gcagactgccctgctgtcccc

SEQ ID NO: 9031986 - DNA, 22 bp, Homo sapiens
gcagactgtacctggaagaggg

SEQ ID NO: 9031987 - DNA, 22 bp, Homo sapiens
gcagactgtacctggaagaggg

SEQ ID NO: 9031988 - DNA, 22 bp, Homo sapiens
gcagactgtatcaatgtcagta

SEQ ID NO: 9031989 - DNA, 22 bp, Homo sapiens
gcagactgtatcaatgtcagta

SEQ ID NO: 9031990 - DNA, 22 bp, Homo sapiens
gcagactggtcttcagccttgg

SEQ ID NO: 9031991 - DNA, 22 bp, Homo sapiens
gcagactgtacctggaagaggg

SEQ ID NO: 9031992 - DNA, 22 bp, Homo sapiens
gcagactgtacctggaagaggg

SEQ ID NO: 9031993 - DNA, 22 bp, Homo sapiens
gcagaccagcccctggagctgc

SEQ ID NO: 9031994 - DNA, 22 bp, Homo sapiens
gcagacctcaggacatcattag

SEQ ID NO: 9031995 - DNA, 22 bp, Homo sapiens
gcagacggagtatcttgtacat

SEQ ID NO: 9031996 - DNA, 22 bp, Homo sapiens
gcagactctgagagtgagtgcc

SEQ ID NO: 9031997 - DNA, 21 bp, Homo sapiens
gcagactgccctgctgtcccc

SEQ ID NO: 9031998 - DNA, 22 bp, Homo sapiens
gcagacatgtgttctaacagga

SEQ ID NO: 9031999 - DNA, 22 bp, Homo sapiens
gcagacatgggatctattcaca

SEQ ID NO: 9032000 - DNA, 22 bp, Homo sapiens
gcagagaaagttttgtcctcag

SEQ ID NO: 9032001 - DNA, 22 bp, Homo sapiens
gcagagaaagttttgtcctcag

SEQ ID NO: 9032002 - DNA, 22 bp, Homo sapiens
gcagagaaagttttgtcctcag

SEQ ID NO: 9032003 - DNA, 22 bp, Homo sapiens
gcagagaaagttttgtcctcag

SEQ ID NO: 9032004 - DNA, 22 bp, Homo sapiens
gcagagaagatgcccaggcttc

SEQ ID NO: 9032005 - DNA, 22 bp, Homo sapiens
gcagagaacccagcagattggc

SEQ ID NO: 9032006 - DNA, 22 bp, Homo sapiens
gcagagaagatgcccaggcttc

SEQ ID NO: 9032007 - DNA, 22 bp, Homo sapiens
gcagagaacccagcagattggc

SEQ ID NO: 9032008 - DNA, 22 bp, Homo sapiens
gcagagaacccagcagattggc

SEQ ID NO: 9032009 - DNA, 22 bp, Homo sapiens
gcagagaaggattgaaaccaga

SEQ ID NO: 9032010 - DNA, 22 bp, Homo sapiens
gcagagaagatgcccaggcttc

SEQ ID NO: 9032011 - DNA, 22 bp, Homo sapiens
gcagagaagatgcccaggcttc

SEQ ID NO: 9032012 - DNA, 22 bp, Homo sapiens
gcagagaagatgcccaggcttc

SEQ ID NO: 9032013 - DNA, 22 bp, Homo sapiens
gcagagcaccaaagtgaaagat

SEQ ID NO: 9032014 - DNA, 22 bp, Homo sapiens
gcagagattggtgcactgatga

SEQ ID NO: 9032015 - DNA, 22 bp, Homo sapiens
gcagagcaccaaagtgaaagat

SEQ ID NO: 9032016 - DNA, 22 bp, Homo sapiens
gcagagcaccaaagtgaaagat

SEQ ID NO: 9032017 - DNA, 22 bp, Homo sapiens
gcagagcaccaaagtgaaagat

SEQ ID NO: 9032018 - DNA, 18 bp, Homo sapiens
gcagagcagaagctcaag

SEQ ID NO: 9032019 - DNA, 22 bp, Homo sapiens
gcagagcaccctgcagtggtat

SEQ ID NO: 9032020 - DNA, 22 bp, Homo sapiens
gcagatggaaagtgcttgaggg

SEQ ID NO: 9032021 - DNA, 22 bp, Homo sapiens
gcagatggactgtatgacctga

SEQ ID NO: 9032022 - DNA, 22 bp, Homo sapiens
gcagatggactgtatgacctga

SEQ ID NO: 9032023 - DNA, 22 bp, Homo sapiens
gcagatggactgtatgacctga

SEQ ID NO: 9032024 - DNA, 22 bp, Homo sapiens
gcagatggagacgaggttccgc

SEQ ID NO: 9032025 - DNA, 22 bp, Homo sapiens
gcagatggagataaatggaact

SEQ ID NO: 9032026 - DNA, 20 bp, Homo sapiens
gcagagtgtgagagggtgaa

SEQ ID NO: 9032027 - DNA, 22 bp, Homo sapiens
gcagagttcctggaaagcaacc

SEQ ID NO: 9032028 - DNA, 20 bp, Homo sapiens
gcagagtgtgagagggtgaa

SEQ ID NO: 9032029 - DNA, 20 bp, Homo sapiens
gcagagtgtgagagggtgaa

SEQ ID NO: 9032030 - DNA, 20 bp, Homo sapiens
gcagagtgtgagagggtgaa

SEQ ID NO: 9032031 - DNA, 20 bp, Homo sapiens
gcagagtgtgagagggtgaa

SEQ ID NO: 9032032 - DNA, 22 bp, Homo sapiens
gcagaggtctagcaccaagaat

SEQ ID NO: 9032033 - DNA, 22 bp, Homo sapiens
gcagaggtctagcaccaagaat

SEQ ID NO: 9032034 - DNA, 22 bp, Homo sapiens
gcagaggtctcttcaaaataat

SEQ ID NO: 9032035 - DNA, 22 bp, Homo sapiens
gcagaggtctcttcaaaataat

SEQ ID NO: 9032036 - DNA, 22 bp, Homo sapiens
gcagaggtgaccagcagcaggg

SEQ ID NO: 9032037 - DNA, 22 bp, Homo sapiens
gcagaggtgaccagcagcaggg

SEQ ID NO: 9032038 - DNA, 22 bp, Homo sapiens
gcagaggtgagaagggcctccc

SEQ ID NO: 9032039 - DNA, 22 bp, Homo sapiens
gcagagtggtttcagagttgag

SEQ ID NO: 9032040 - DNA, 22 bp, Homo sapiens
gcagagtggtttcagagttgag

SEQ ID NO: 9032041 - DNA, 22 bp, Homo sapiens
gcagaggtcctagccaggagtc

SEQ ID NO: 9032042 - DNA, 22 bp, Homo sapiens
gcagaggtcctagccaggagtc

SEQ ID NO: 9032043 - DNA, 22 bp, Homo sapiens
gcagaggtcctagccaggagtc

SEQ ID NO: 9032044 - DNA, 22 bp, Homo sapiens
gcagaggtcaaatacctcattt

SEQ ID NO: 9032045 - DNA, 22 bp, Homo sapiens
gcagagggtcctgtgccagcag

SEQ ID NO: 9032046 - DNA, 22 bp, Homo sapiens
gcagagggtcctgtgccagcag

SEQ ID NO: 9032047 - DNA, 22 bp, Homo sapiens
gcagaggggaagctgaggaatt

SEQ ID NO: 9032048 - DNA, 22 bp, Homo sapiens
gcagagggggtacttcggccct

SEQ ID NO: 9032049 - DNA, 22 bp, Homo sapiens
gcagagggggtacttcggccct

SEQ ID NO: 9032050 - DNA, 22 bp, Homo sapiens
gcagagggtcctgtgccagcag

SEQ ID NO: 9032051 - DNA, 22 bp, Homo sapiens
gcagagggtcctgtgccagcag

SEQ ID NO: 9032052 - DNA, 22 bp, Homo sapiens
gcagaggggaagctgaggaatt

SEQ ID NO: 9032053 - DNA, 22 bp, Homo sapiens
gcagaggccaggccaccagcaa

SEQ ID NO: 9032054 - DNA, 22 bp, Homo sapiens
gcagaggccaggccaccagcaa

SEQ ID NO: 9032055 - DNA, 22 bp, Homo sapiens
gcagaggccaggccaccagcaa

SEQ ID NO: 9032056 - DNA, 22 bp, Homo sapiens
gcagaggccaggccaccagcaa

SEQ ID NO: 9032057 - DNA, 22 bp, Homo sapiens
gcagaggccaggccaccagcaa

SEQ ID NO: 9032058 - DNA, 22 bp, Homo sapiens
gcagaggccaggccaccagcaa

SEQ ID NO: 9032059 - DNA, 22 bp, Homo sapiens
gcagaggcatttctgacgctgc

SEQ ID NO: 9032060 - DNA, 22 bp, Homo sapiens
gcagaggcatttctgacgctgc

SEQ ID NO: 9032061 - DNA, 22 bp, Homo sapiens
gcagaggcagggccctcctcca

SEQ ID NO: 9032062 - DNA, 22 bp, Homo sapiens
gcagaggcagggccctcctcca

SEQ ID NO: 9032063 - DNA, 22 bp, Homo sapiens
gcagaggcatttctgacgctgc

SEQ ID NO: 9032064 - DNA, 22 bp, Homo sapiens
gcagaggcatttctgacgctgc

SEQ ID NO: 9032065 - DNA, 22 bp, Homo sapiens
gcagaggcatttctgacgctgc

SEQ ID NO: 9032066 - DNA, 22 bp, Homo sapiens
gcagaggcacagccccagatga

SEQ ID NO: 9032067 - DNA, 22 bp, Homo sapiens
gcagaggcacagccccagatga

SEQ ID NO: 9032068 - DNA, 22 bp, Homo sapiens
gcagaggcacagccccagatga

SEQ ID NO: 9032069 - DNA, 21 bp, Homo sapiens
gcagaggcacggcaccaaggg

SEQ ID NO: 9032070 - DNA, 21 bp, Homo sapiens
gcagaggcacggcaccaaggg

SEQ ID NO: 9032071 - DNA, 22 bp, Homo sapiens
gcagaggatcaggctctggaaa

SEQ ID NO: 9032072 - DNA, 22 bp, Homo sapiens
gcagaggatcaggctctggaaa

SEQ ID NO: 9032073 - DNA, 22 bp, Homo sapiens
gcagaggatagcatatgaacct

SEQ ID NO: 9032074 - DNA, 22 bp, Homo sapiens
gcagaggatagcatatgaacct

SEQ ID NO: 9032075 - DNA, 22 bp, Homo sapiens
gcagaggatcaggctctggaaa

SEQ ID NO: 9032076 - DNA, 22 bp, Homo sapiens
gcagaggatcaggctctggaaa

SEQ ID NO: 9032077 - DNA, 22 bp, Homo sapiens
gcagaggcacagccccagatga

SEQ ID NO: 9032078 - DNA, 22 bp, Homo sapiens
gcagaggcacagccccagatga

SEQ ID NO: 9032079 - DNA, 22 bp, Homo sapiens
gcagaggatcaggctctggaaa

SEQ ID NO: 9032080 - DNA, 22 bp, Homo sapiens
gcagagcaggggctgaacctgg

SEQ ID NO: 9032081 - DNA, 22 bp, Homo sapiens
gcagagcagtactctcttgact

SEQ ID NO: 9032082 - DNA, 22 bp, Homo sapiens
gcagagcagtactctcttgact

SEQ ID NO: 9032083 - DNA, 22 bp, Homo sapiens
gcagaggagtgattatgccgtg

SEQ ID NO: 9032084 - DNA, 22 bp, Homo sapiens
gcagaggagtgattatgccgtg

SEQ ID NO: 9032085 - DNA, 22 bp, Homo sapiens
gcagaggatagcatatgaacct

SEQ ID NO: 9032086 - DNA, 22 bp, Homo sapiens
gcagagcagaggtgcaggttgg

SEQ ID NO: 9032087 - DNA, 22 bp, Homo sapiens
gcagagcagaggtgcaggttgg

SEQ ID NO: 9032088 - DNA, 22 bp, Homo sapiens
gcagagcagagcctgcattggc

SEQ ID NO: 9032089 - DNA, 18 bp, Homo sapiens
gcagagcagaagctcaag

SEQ ID NO: 9032090 - DNA, 22 bp, Homo sapiens
gcagagcaggaaggaagtcagg

SEQ ID NO: 9032091 - DNA, 22 bp, Homo sapiens
gcagagcagcaaatggaaagga

SEQ ID NO: 9032092 - DNA, 22 bp, Homo sapiens
gcagagcagcaaatggaaagga

SEQ ID NO: 9032093 - DNA, 22 bp, Homo sapiens
gcagagcaggaaggaagtcagg

SEQ ID NO: 9032094 - DNA, 22 bp, Homo sapiens
gcagagcaggaaggaagtcagg

SEQ ID NO: 9032095 - DNA, 22 bp, Homo sapiens
gcagagcaggaaggaagtcagg

SEQ ID NO: 9032096 - DNA, 22 bp, Homo sapiens
gcaaagcaaatgcctgaaggcg

SEQ ID NO: 9032097 - DNA, 22 bp, Homo sapiens
gcaaagatattagaatagagta

SEQ ID NO: 9032098 - DNA, 23 bp, Homo sapiens
gcaaagactctgccaaaaactgc

SEQ ID NO: 9032099 - DNA, 22 bp, Homo sapiens
gcaaagacggactcaggagtgc

SEQ ID NO: 9032100 - DNA, 22 bp, Homo sapiens
gcaaagaaatgtcagtgagagg

SEQ ID NO: 9032101 - DNA, 22 bp, Homo sapiens
gcaaagaaatgtcagtgagagg

SEQ ID NO: 9032102 - DNA, 22 bp, Homo sapiens
gcaaagaatgcagatttgcctc

SEQ ID NO: 9032103 - DNA, 22 bp, Homo sapiens
gcaaagaaatgtcagtgagagg

SEQ ID NO: 9032104 - DNA, 22 bp, Homo sapiens
gcaaagacaaattagaactcct

SEQ ID NO: 9032105 - DNA, 22 bp, Homo sapiens
gcaaagacaatttgaatagctt

SEQ ID NO: 9032106 - DNA, 22 bp, Homo sapiens
gcaaagaaatgtcagtgagagg

SEQ ID NO: 9032107 - DNA, 22 bp, Homo sapiens
gcaaagaaagttttaatgaggt

SEQ ID NO: 9032108 - DNA, 22 bp, Homo sapiens
gcaaagaaagttttaatgaggt

SEQ ID NO: 9032109 - DNA, 22 bp, Homo sapiens
gcaaagaaagccaaggtctaac

SEQ ID NO: 9032110 - DNA, 22 bp, Homo sapiens
gcaaagaaagccaaggtctaac

SEQ ID NO: 9032111 - DNA, 22 bp, Homo sapiens
gcaaactgttggagtagagtct

SEQ ID NO: 9032112 - DNA, 22 bp, Homo sapiens
gaggcccagcagcgcaggtctt

SEQ ID NO: 9032113 - DNA, 22 bp, Homo sapiens
gaggcccagcagcgcaggtctt

SEQ ID NO: 9032114 - DNA, 22 bp, Homo sapiens
gcaaactgttggagtagagtct

SEQ ID NO: 9032115 - DNA, 22 bp, Homo sapiens
gcaaactgttggagtagagtct

SEQ ID NO: 9032116 - DNA, 22 bp, Homo sapiens
gcaaactgttggagtagagtct

SEQ ID NO: 9032117 - DNA, 22 bp, Homo sapiens
gcaaagaaagccaaggtctaac

SEQ ID NO: 9032118 - DNA, 22 bp, Homo sapiens
gcaaagaaagccaaggtctaac

SEQ ID NO: 9032119 - DNA, 22 bp, Homo sapiens
gaggccatgcctcctgatcagt

SEQ ID NO: 9032120 - DNA, 22 bp, Homo sapiens
gaggccataagaagttcttggg

SEQ ID NO: 9032121 - DNA, 22 bp, Homo sapiens
gaggccagtgtgctgtgttttc

SEQ ID NO: 9032122 - DNA, 22 bp, Homo sapiens
gaggccagtgtgctgtgttttc

SEQ ID NO: 9032123 - DNA, 22 bp, Homo sapiens
gaggcccaaggactctgtcccg

SEQ ID NO: 9032124 - DNA, 22 bp, Homo sapiens
gaggcccaaggactctgtcccg

SEQ ID NO: 9032125 - DNA, 22 bp, Homo sapiens
gaggccattcagctgggcagca

SEQ ID NO: 9032126 - DNA, 22 bp, Homo sapiens
gaggccaggacatgaaagctga

SEQ ID NO: 9032127 - DNA, 22 bp, Homo sapiens
gaggccaggaggatctctctaa

SEQ ID NO: 9032128 - DNA, 22 bp, Homo sapiens
gaggccagggtaccatcaacat

SEQ ID NO: 9032129 - DNA, 22 bp, Homo sapiens
gaggccagtgaaatgttataaa

SEQ ID NO: 9032130 - DNA, 22 bp, Homo sapiens
gaggccaggaggatctctctaa

SEQ ID NO: 9032131 - DNA, 22 bp, Homo sapiens
gaggccagtgaaatgttataaa

SEQ ID NO: 9032132 - DNA, 22 bp, Homo sapiens
gaggccagtgtgctgtgttttc

SEQ ID NO: 9032133 - DNA, 22 bp, Homo sapiens
gaggccagtgaaatgttataaa

SEQ ID NO: 9032134 - DNA, 22 bp, Homo sapiens
gaggcccacagggagtaccaag

SEQ ID NO: 9032135 - DNA, 22 bp, Homo sapiens
gaggcccaatgcttccctcctt

SEQ ID NO: 9032136 - DNA, 22 bp, Homo sapiens
gaggcccaatgcttccctcctt

SEQ ID NO: 9032137 - DNA, 20 bp, Homo sapiens
gaggcccagagaggtgaagc

SEQ ID NO: 9032138 - DNA, 20 bp, Homo sapiens
gaggcccagagaggtgaagc

SEQ ID NO: 9032139 - DNA, 20 bp, Homo sapiens
gaggcccagagaggtgaagc

SEQ ID NO: 9032140 - DNA, 20 bp, Homo sapiens
gaggcccagagaggtgaagc

SEQ ID NO: 9032141 - DNA, 22 bp, Homo sapiens
gaggcccagcagcgcaggtctt

SEQ ID NO: 9032142 - DNA, 22 bp, Homo sapiens
gaggcccagcagcgcaggtctt

SEQ ID NO: 9032143 - DNA, 22 bp, Homo sapiens
gaggcccagagaggttgcatga

SEQ ID NO: 9032144 - DNA, 22 bp, Homo sapiens
gaggcccagagaggttgcatga

SEQ ID NO: 9032145 - DNA, 22 bp, Homo sapiens
gaggcccagagaggttgcatga

SEQ ID NO: 9032146 - DNA, 22 bp, Homo sapiens
gcaaagcaatcaggagtagcat

SEQ ID NO: 9032147 - DNA, 22 bp, Homo sapiens
gcaaagcaatcaggagtagcat

SEQ ID NO: 9032148 - DNA, 22 bp, Homo sapiens
gcaaagcaatcaggagtagcat

SEQ ID NO: 9032149 - DNA, 22 bp, Homo sapiens
gcaaagcacaccctcagagttt

SEQ ID NO: 9032150 - DNA, 22 bp, Homo sapiens
gcaaagcacaccctcagagttt

SEQ ID NO: 9032151 - DNA, 22 bp, Homo sapiens
gcaaagcaagattcagatgtag

SEQ ID NO: 9032152 - DNA, 22 bp, Homo sapiens
gcaaagctgggtgtgaatgcac

SEQ ID NO: 9032153 - DNA, 22 bp, Homo sapiens
gcaaagtgaaatggggcagaga

SEQ ID NO: 9032154 - DNA, 22 bp, Homo sapiens
gcaaagtgaaatggggcagaga

SEQ ID NO: 9032155 - DNA, 22 bp, Homo sapiens
gcaaagtgcttcagtgggagct

SEQ ID NO: 9032156 - DNA, 22 bp, Homo sapiens
gcaaagttcctactttactgga

SEQ ID NO: 9032157 - DNA, 22 bp, Homo sapiens
gcaaagtattaagtattaagtt

SEQ ID NO: 9032158 - DNA, 22 bp, Homo sapiens
gcaaagtattaaccaacaggat

SEQ ID NO: 9032159 - DNA, 22 bp, Homo sapiens
gcaaagtattaagtattaagtt

SEQ ID NO: 9032160 - DNA, 22 bp, Homo sapiens
gcaaataatatactttgatctc

SEQ ID NO: 9032161 - DNA, 21 bp, Homo sapiens
gcaaagtgtgggcataaacag

SEQ ID NO: 9032162 - DNA, 22 bp, Homo sapiens
gcaaatacatgttgagcaccta

SEQ ID NO: 9032163 - DNA, 22 bp, Homo sapiens
gcaaatagaagattctgttgac

SEQ ID NO: 9032164 - DNA, 22 bp, Homo sapiens
gcaaatacatgttgagcaccta

SEQ ID NO: 9032165 - DNA, 22 bp, Homo sapiens
gcaaatacatgttgagcaccta

SEQ ID NO: 9032166 - DNA, 22 bp, Homo sapiens
gcaaagtaaagggttccagata

SEQ ID NO: 9032167 - DNA, 22 bp, Homo sapiens
gcaaaggcttcttttattctcc

SEQ ID NO: 9032168 - DNA, 22 bp, Homo sapiens
gcaaagtaaaaatagattctga

SEQ ID NO: 9032169 - DNA, 17 bp, Homo sapiens
gcaaaggtgaggagaga

SEQ ID NO: 9032170 - DNA, 22 bp, Homo sapiens
gcaaagggaaagtggcagggtc

SEQ ID NO: 9032171 - DNA, 22 bp, Homo sapiens
gcaaagggaaagtggcagggtc

SEQ ID NO: 9032172 - DNA, 22 bp, Homo sapiens
gcaaaggcttcttttattctcc

SEQ ID NO: 9032173 - DNA, 22 bp, Homo sapiens
gcaaaggcttcttttattctcc

SEQ ID NO: 9032174 - DNA, 22 bp, Homo sapiens
gcaaaggctagagacacaggga

SEQ ID NO: 9032175 - DNA, 22 bp, Homo sapiens
gcacacatgtgagtgtcctttc

SEQ ID NO: 9032176 - DNA, 22 bp, Homo sapiens
gcacacatgcgtgtatatgggt

SEQ ID NO: 9032177 - DNA, 22 bp, Homo sapiens
gcacacatgcgtgtatatgggt

SEQ ID NO: 9032178 - DNA, 22 bp, Homo sapiens
gcacacatgcgtgtatatgggt

SEQ ID NO: 9032179 - DNA, 22 bp, Homo sapiens
gcacacattcggattcttaacc

SEQ ID NO: 9032180 - DNA, 22 bp, Homo sapiens
gcacacattcggattcttaacc

SEQ ID NO: 9032181 - DNA, 22 bp, Homo sapiens
gcacacatgcatgcacaggagt

SEQ ID NO: 9032182 - DNA, 22 bp, Homo sapiens
gcacacatcttgtaatcctgag

SEQ ID NO: 9032183 - DNA, 22 bp, Homo sapiens
gcacacatgcatgtgtgcatcc

SEQ ID NO: 9032184 - DNA, 19 bp, Homo sapiens
gcacacatacaccctttgg

SEQ ID NO: 9032185 - DNA, 22 bp, Homo sapiens
gcacacagtatatgctcattaa

SEQ ID NO: 9032186 - DNA, 19 bp, Homo sapiens
gcacacagtagggctggca

SEQ ID NO: 9032187 - DNA, 22 bp, Homo sapiens
gcacacagtatatgctcattaa

SEQ ID NO: 9032188 - DNA, 22 bp, Homo sapiens
gcacacagtatatgctcattaa

SEQ ID NO: 9032189 - DNA, 22 bp, Homo sapiens
gcacacagtatatgctcattaa

SEQ ID NO: 9032190 - DNA, 22 bp, Homo sapiens
gcacacatatatatgagcatgt

SEQ ID NO: 9032191 - DNA, 20 bp, Homo sapiens
gcacacatagaaatgcatat

SEQ ID NO: 9032192 - DNA, 22 bp, Homo sapiens
gcacacagtagggattcaatga

SEQ ID NO: 9032193 - DNA, 22 bp, Homo sapiens
gcacacagtagggattcaatga

SEQ ID NO: 9032194 - DNA, 22 bp, Homo sapiens
gcacacagtagggattcaatga

SEQ ID NO: 9032195 - DNA, 22 bp, Homo sapiens
gcacacagtactatatgctaca

SEQ ID NO: 9032196 - DNA, 22 bp, Homo sapiens
gcacacagtagggattcaatga

SEQ ID NO: 9032197 - DNA, 22 bp, Homo sapiens
gcacacagtagggattcaatga

SEQ ID NO: 9032198 - DNA, 19 bp, Homo sapiens
gcacacagtagggctggca

SEQ ID NO: 9032199 - DNA, 19 bp, Homo sapiens
gcacacagtagggctggca

SEQ ID NO: 9032200 - DNA, 19 bp, Homo sapiens
gcacacagtagggctggca

SEQ ID NO: 9032201 - DNA, 19 bp, Homo sapiens
gcacacagtagggctggca

SEQ ID NO: 9032202 - DNA, 19 bp, Homo sapiens
gcacacagtagggctggca

SEQ ID NO: 9032203 - DNA, 19 bp, Homo sapiens
gcacacagtagggctggca

SEQ ID NO: 9032204 - DNA, 22 bp, Homo sapiens
gcacacagaatcagtgggcata

SEQ ID NO: 9032205 - DNA, 22 bp, Homo sapiens
gcacacagaacatttggatcct

SEQ ID NO: 9032206 - DNA, 22 bp, Homo sapiens
gcacacagaatcagtgggcata

SEQ ID NO: 9032207 - DNA, 22 bp, Homo sapiens
gcacacagaatcagtgggcata

SEQ ID NO: 9032208 - DNA, 22 bp, Homo sapiens
gcacacagaatcagtgggcata

SEQ ID NO: 9032209 - DNA, 22 bp, Homo sapiens
gcacacagaatcagtgggcata

SEQ ID NO: 9032210 - DNA, 22 bp, Homo sapiens
gcacacagaacatttggatcct

SEQ ID NO: 9032211 - DNA, 22 bp, Homo sapiens
gcacacagaatcagtgggcata

SEQ ID NO: 9032212 - DNA, 22 bp, Homo sapiens
gcaaatattcaagacttttcca

SEQ ID NO: 9032213 - DNA, 22 bp, Homo sapiens
gcaaatagaagattctgttgac

SEQ ID NO: 9032214 - DNA, 22 bp, Homo sapiens
gcaaatatttctaattcctgaa

SEQ ID NO: 9032215 - DNA, 22 bp, Homo sapiens
gcaaatatttctaattcctgaa

SEQ ID NO: 9032216 - DNA, 22 bp, Homo sapiens
gcaaatatttctaattcctgaa

SEQ ID NO: 9032217 - DNA, 22 bp, Homo sapiens
gcacacactgttttcctcacat

SEQ ID NO: 9032218 - DNA, 22 bp, Homo sapiens
gcacaggtcaggagatgagatt

SEQ ID NO: 9032219 - DNA, 22 bp, Homo sapiens
gcacaggttgcaaaagttcaca

SEQ ID NO: 9032220 - DNA, 22 bp, Homo sapiens
gcacaggttgcaaaagttcaca

SEQ ID NO: 9032221 - DNA, 20 bp, Homo sapiens
gcacagtagcagtgcaaatg

SEQ ID NO: 9032222 - DNA, 22 bp, Homo sapiens
gcacagtaggctcagctctatc

SEQ ID NO: 9032223 - DNA, 22 bp, Homo sapiens
gcacagtacctgtcacagaggc

SEQ ID NO: 9032224 - DNA, 22 bp, Homo sapiens
gcacagtacctgtcacagaggc

SEQ ID NO: 9032225 - DNA, 21 bp, Homo sapiens
gcacagtaagaaaagctgcct

SEQ ID NO: 9032226 - DNA, 22 bp, Homo sapiens
gcacagtcaacacttattcacc

SEQ ID NO: 9032227 - DNA, 22 bp, Homo sapiens
gcacagtgataggcagttgtgc

SEQ ID NO: 9032228 - DNA, 22 bp, Homo sapiens
gcacagtaggtatttacccagt

SEQ ID NO: 9032229 - DNA, 22 bp, Homo sapiens
gcacagtaggtatttacccagt

SEQ ID NO: 9032230 - DNA, 22 bp, Homo sapiens
gcacagtattgcacaactctag

SEQ ID NO: 9032231 - DNA, 22 bp, Homo sapiens
gcacagtatttagtagaatgag

SEQ ID NO: 9032232 - DNA, 22 bp, Homo sapiens
gcacagtatttagtagaatgag

SEQ ID NO: 9032233 - DNA, 22 bp, Homo sapiens
gcacaggctccggaggagagct

SEQ ID NO: 9032234 - DNA, 22 bp, Homo sapiens
gcacaggctccggaggagagct

SEQ ID NO: 9032235 - DNA, 22 bp, Homo sapiens
gcacaggctccggaggagagct

SEQ ID NO: 9032236 - DNA, 22 bp, Homo sapiens
gcacagggctgccaggcggctt

SEQ ID NO: 9032237 - DNA, 22 bp, Homo sapiens
gcacagggctgccaggcggctt

SEQ ID NO: 9032238 - DNA, 22 bp, Homo sapiens
gcacaggctctcttggggacac

SEQ ID NO: 9032239 - DNA, 22 bp, Homo sapiens
gcacaggctccggaggagagct

SEQ ID NO: 9032240 - DNA, 22 bp, Homo sapiens
gcacaggctccggaggagagct

SEQ ID NO: 9032241 - DNA, 22 bp, Homo sapiens
gcacagggctgccaggcggctt

SEQ ID NO: 9032242 - DNA, 22 bp, Homo sapiens
gcacagggctgccaggcggctt

SEQ ID NO: 9032243 - DNA, 22 bp, Homo sapiens
gcacagggctgccaggcggctt

SEQ ID NO: 9032244 - DNA, 22 bp, Homo sapiens
gcacagggctgccaggcggctt

SEQ ID NO: 9032245 - DNA, 22 bp, Homo sapiens
gcacagggctgccaggcggctt

SEQ ID NO: 9032246 - DNA, 22 bp, Homo sapiens
gcacagggctgccaggcggctt

SEQ ID NO: 9032247 - DNA, 22 bp, Homo sapiens
gcacactgtgaatttgcatatg

SEQ ID NO: 9032248 - DNA, 22 bp, Homo sapiens
gcacacttaatactcactgtgc

SEQ ID NO: 9032249 - DNA, 22 bp, Homo sapiens
gcacactgcggtgatgtgagtc

SEQ ID NO: 9032250 - DNA, 22 bp, Homo sapiens
gcacactggagcctggaagatt

SEQ ID NO: 9032251 - DNA, 22 bp, Homo sapiens
gcacactgtgaatttgcatatg

SEQ ID NO: 9032252 - DNA, 22 bp, Homo sapiens
gcacactgcggtgatgtgagtc

SEQ ID NO: 9032253 - DNA, 22 bp, Homo sapiens
gcacactgcggtgatgtgagtc

SEQ ID NO: 9032254 - DNA, 22 bp, Homo sapiens
gcacactcctggatcctagaga

SEQ ID NO: 9032255 - DNA, 19 bp, Homo sapiens
gcacaccctgcaccaccat

SEQ ID NO: 9032256 - DNA, 22 bp, Homo sapiens
gcacaccttagaggggagctgc

SEQ ID NO: 9032257 - DNA, 22 bp, Homo sapiens
gcacacggcagcctcctcctga

SEQ ID NO: 9032258 - DNA, 22 bp, Homo sapiens
gcacacattctagccttttgtg

SEQ ID NO: 9032259 - DNA, 22 bp, Homo sapiens
gcacagaaatgtctacacatgt

SEQ ID NO: 9032260 - DNA, 22 bp, Homo sapiens
gcacagaacagagaaatagcca

SEQ ID NO: 9032261 - DNA, 22 bp, Homo sapiens
gcacagaacagagaaatagcca

SEQ ID NO: 9032262 - DNA, 22 bp, Homo sapiens
gcacagaacagagaaatagcca

SEQ ID NO: 9032263 - DNA, 22 bp, Homo sapiens
gcacagaaatgtctacacatgt

SEQ ID NO: 9032264 - DNA, 22 bp, Homo sapiens
gcacagaacactggtgagtccc

SEQ ID NO: 9032265 - DNA, 22 bp, Homo sapiens
gcacagaaatgtctacacatgt

SEQ ID NO: 9032266 - DNA, 22 bp, Homo sapiens
gcacaggccatgggaggacagc

SEQ ID NO: 9032267 - DNA, 22 bp, Homo sapiens
gcacaggccatgggaggacagc

SEQ ID NO: 9032268 - DNA, 22 bp, Homo sapiens
gcacaggccatgggaggacagc

SEQ ID NO: 9032269 - DNA, 22 bp, Homo sapiens
gcacaggctccggaggagagct

SEQ ID NO: 9032270 - DNA, 22 bp, Homo sapiens
gcacaggccatgggaggacagc

SEQ ID NO: 9032271 - DNA, 22 bp, Homo sapiens
gcacaggccatgggaggacagc

SEQ ID NO: 9032272 - DNA, 22 bp, Homo sapiens
gcagatggcagcccaggctggg

SEQ ID NO: 9032273 - DNA, 22 bp, Homo sapiens
gcagatggcagcccaggctggg

SEQ ID NO: 9032274 - DNA, 22 bp, Homo sapiens
gcagatggcagcccaggctggg

SEQ ID NO: 9032275 - DNA, 22 bp, Homo sapiens
gcagatggcagcccaggctggg

SEQ ID NO: 9032276 - DNA, 22 bp, Homo sapiens
gcagatggcagcccaggctggg

SEQ ID NO: 9032277 - DNA, 22 bp, Homo sapiens
gcagatggcagcccaggctggg

SEQ ID NO: 9032278 - DNA, 22 bp, Homo sapiens
gcagatggatcacctgaggtcg

SEQ ID NO: 9032279 - DNA, 22 bp, Homo sapiens
gcagatggatcacctgaggtcg

SEQ ID NO: 9032280 - DNA, 22 bp, Homo sapiens
gcagatggatcacctgaggtcg

SEQ ID NO: 9032281 - DNA, 23 bp, Homo sapiens
gcagatggccccagagtgctgcc

SEQ ID NO: 9032282 - DNA, 23 bp, Homo sapiens
gcagatggccccagagtgctgcc

SEQ ID NO: 9032283 - DNA, 22 bp, Homo sapiens
gcagatggcagcccaggctggg

SEQ ID NO: 9032284 - DNA, 22 bp, Homo sapiens
gcagatggcagcccaggctggg

SEQ ID NO: 9032285 - DNA, 22 bp, Homo sapiens
gcagatggcgcagtggaagttc

SEQ ID NO: 9032286 - DNA, 22 bp, Homo sapiens
gcagatggcgcagtggaagttc

SEQ ID NO: 9032287 - DNA, 22 bp, Homo sapiens
gcagatggctcagacactgggg

SEQ ID NO: 9032288 - DNA, 23 bp, Homo sapiens
gcagatggccccagagtgctgcc

SEQ ID NO: 9032289 - DNA, 23 bp, Homo sapiens
gcagatggccccagagtgctgcc

SEQ ID NO: 9032290 - DNA, 23 bp, Homo sapiens
gcagatggccccagagtgctgcc

SEQ ID NO: 9032291 - DNA, 22 bp, Homo sapiens
gcagatgggagccccaggggag

SEQ ID NO: 9032292 - DNA, 22 bp, Homo sapiens
gcagatgggagccccaggggag

SEQ ID NO: 9032293 - DNA, 21 bp, Homo sapiens
gcagatgggagtcatcaggct

SEQ ID NO: 9032294 - DNA, 22 bp, Homo sapiens
gcagatgggagccccaggggag

SEQ ID NO: 9032295 - DNA, 22 bp, Homo sapiens
gcagatgggagccccaggggag

SEQ ID NO: 9032296 - DNA, 21 bp, Homo sapiens
gcagatgggaagagacgaggc

SEQ ID NO: 9032297 - DNA, 21 bp, Homo sapiens
gcagatgggaagagacgaggc

SEQ ID NO: 9032298 - DNA, 22 bp, Homo sapiens
gcagatggctgagcctgcagat

SEQ ID NO: 9032299 - DNA, 22 bp, Homo sapiens
gcagatggctgagcctgcagat

SEQ ID NO: 9032300 - DNA, 22 bp, Homo sapiens
gcagatggctcagacactgggg

SEQ ID NO: 9032301 - DNA, 22 bp, Homo sapiens
gcagatggctcagacactgggg

SEQ ID NO: 9032302 - DNA, 22 bp, Homo sapiens
gcagatggctcagacactgggg

SEQ ID NO: 9032303 - DNA, 22 bp, Homo sapiens
gcagatggtggaggcaagaggc

SEQ ID NO: 9032304 - DNA, 22 bp, Homo sapiens
gcagatggtggaggcaagaggc

SEQ ID NO: 9032305 - DNA, 22 bp, Homo sapiens
gcagatggtggaggcaagaggc

SEQ ID NO: 9032306 - DNA, 22 bp, Homo sapiens
gcagatggtgggggaggagtac

SEQ ID NO: 9032307 - DNA, 22 bp, Homo sapiens
gcagatggtggggcaggaaaat

SEQ ID NO: 9032308 - DNA, 21 bp, Homo sapiens
gcagatgggagtcatcaggct

SEQ ID NO: 9032309 - DNA, 21 bp, Homo sapiens
gcagatgggagtcatcaggct

SEQ ID NO: 9032310 - DNA, 21 bp, Homo sapiens
gcagatgggagtcatcaggct

SEQ ID NO: 9032311 - DNA, 22 bp, Homo sapiens
gcagatggtgccatgtcttgtg

SEQ ID NO: 9032312 - DNA, 22 bp, Homo sapiens
gcagatggtgccatgtcttgtg

SEQ ID NO: 9032313 - DNA, 22 bp, Homo sapiens
gcagatggtgccatgtcttgtg

SEQ ID NO: 9032314 - DNA, 22 bp, Homo sapiens
gcagatggtgccatgtcttgtg

SEQ ID NO: 9032315 - DNA, 22 bp, Homo sapiens
gcagatgtaatggctggaggtc

SEQ ID NO: 9032316 - DNA, 22 bp, Homo sapiens
gcagatgtaatggctggaggtc

SEQ ID NO: 9032317 - DNA, 22 bp, Homo sapiens
gcagcccagcagggcccggagc

SEQ ID NO: 9032318 - DNA, 22 bp, Homo sapiens
gcagcccacagctggaggccta

SEQ ID NO: 9032319 - DNA, 22 bp, Homo sapiens
gcagcccagagcgcaggacccc

SEQ ID NO: 9032320 - DNA, 22 bp, Homo sapiens
gcagcccaggtggagtaatcta

SEQ ID NO: 9032321 - DNA, 22 bp, Homo sapiens
gcagcccaggtctctctcactc

SEQ ID NO: 9032322 - DNA, 22 bp, Homo sapiens
gcagcccaggaggcgggagccc

SEQ ID NO: 9032323 - DNA, 22 bp, Homo sapiens
gcagcccaggaccctggacaga

SEQ ID NO: 9032324 - DNA, 22 bp, Homo sapiens
gcagcccaggagcaggcgaccc

SEQ ID NO: 9032325 - DNA, 22 bp, Homo sapiens
gcagcccaggagcaggcgaccc

SEQ ID NO: 9032326 - DNA, 22 bp, Homo sapiens
gcagcccaggagcaggcgaccc

SEQ ID NO: 9032327 - DNA, 22 bp, Homo sapiens
gcagcccaggaggcgggagccc

SEQ ID NO: 9032328 - DNA, 22 bp, Homo sapiens
gcagcccaggaggcgggagccc

SEQ ID NO: 9032329 - DNA, 22 bp, Homo sapiens
gcagccctcgggtactcacgtg

SEQ ID NO: 9032330 - DNA, 22 bp, Homo sapiens
gcagccctcttggtcactaggc

SEQ ID NO: 9032331 - DNA, 22 bp, Homo sapiens
gcagccctcgctagctctcccc

SEQ ID NO: 9032332 - DNA, 22 bp, Homo sapiens
gcagccctgcagctccacaccg

SEQ ID NO: 9032333 - DNA, 22 bp, Homo sapiens
gcagccctgcagctccacaccg

SEQ ID NO: 9032334 - DNA, 22 bp, Homo sapiens
gcagccctcgctagctctcccc

SEQ ID NO: 9032335 - DNA, 22 bp, Homo sapiens
gcagccctcgggtactcacgtg

SEQ ID NO: 9032336 - DNA, 22 bp, Homo sapiens
gcagccctagcgacaaattgat

SEQ ID NO: 9032337 - DNA, 22 bp, Homo sapiens
gcagccctccctgggtgtgtct

SEQ ID NO: 9032338 - DNA, 22 bp, Homo sapiens
gcagccctccctgggtgtgtct

SEQ ID NO: 9032339 - DNA, 22 bp, Homo sapiens
gcagcccataacatttgaggcc

SEQ ID NO: 9032340 - DNA, 22 bp, Homo sapiens
gcagcccataacatttgaggcc

SEQ ID NO: 9032341 - DNA, 22 bp, Homo sapiens
gcagcccaggtgtagctctttg

SEQ ID NO: 9032342 - DNA, 22 bp, Homo sapiens
gcagccctaacctgtcatagtg

SEQ ID NO: 9032343 - DNA, 22 bp, Homo sapiens
gcagccctaacctgtcatagtg

SEQ ID NO: 9032344 - DNA, 22 bp, Homo sapiens
gcagccctagcgacaaattgat

SEQ ID NO: 9032345 - DNA, 22 bp, Homo sapiens
gcaggaaaggttgagactttgc

SEQ ID NO: 9032346 - DNA, 19 bp, Homo sapiens
gcaggaaatgagtgattgc

SEQ ID NO: 9032347 - DNA, 21 bp, Homo sapiens
gcaggaacaggtcatgatctg

SEQ ID NO: 9032348 - DNA, 22 bp, Homo sapiens
gcaggaacagtttatctctggc

SEQ ID NO: 9032349 - DNA, 18 bp, Homo sapiens
gcagcttttgattcaccc

SEQ ID NO: 9032350 - DNA, 22 bp, Homo sapiens
gcagctttttggatgtcagtta

SEQ ID NO: 9032351 - DNA, 22 bp, Homo sapiens
gcaggaaaaccttcccatgttt

SEQ ID NO: 9032352 - DNA, 22 bp, Homo sapiens
gcaggaagaggctcgaagcccc

SEQ ID NO: 9032353 - DNA, 22 bp, Homo sapiens
gcaggaagaggctcgaagcccc

SEQ ID NO: 9032354 - DNA, 23 bp, Homo sapiens
gcaggaactcagggtaggcagca

SEQ ID NO: 9032355 - DNA, 22 bp, Homo sapiens
gcaggaagatgagctcaggtaa

SEQ ID NO: 9032356 - DNA, 22 bp, Homo sapiens
gcaggaagaggctcgaagcccc

SEQ ID NO: 9032357 - DNA, 22 bp, Homo sapiens
gcaggaagaggctcgaagcccc

SEQ ID NO: 9032358 - DNA, 22 bp, Homo sapiens
gcaggacaaaatttccagggtg

SEQ ID NO: 9032359 - DNA, 23 bp, Homo sapiens
gcaggacaacagagtgggaaggc

SEQ ID NO: 9032360 - DNA, 22 bp, Homo sapiens
gcaggacacagatgcaaggcca

SEQ ID NO: 9032361 - DNA, 23 bp, Homo sapiens
gcaggacaacagagtgggaaggc

SEQ ID NO: 9032362 - DNA, 22 bp, Homo sapiens
gcaggaagggaaaggttgactc

SEQ ID NO: 9032363 - DNA, 22 bp, Homo sapiens
gcaggaagggaaaggttgactc

SEQ ID NO: 9032364 - DNA, 22 bp, Homo sapiens
gcaggaagggaaaggttgactc

SEQ ID NO: 9032365 - DNA, 22 bp, Homo sapiens
gcaggaagggaaaggttgactc

SEQ ID NO: 9032366 - DNA, 22 bp, Homo sapiens
gcaggaagcatagaagaatgcc

SEQ ID NO: 9032367 - DNA, 22 bp, Homo sapiens
gcaggaagcatagaagaatgcc

SEQ ID NO: 9032368 - DNA, 22 bp, Homo sapiens
gcaggaagatgagctcaggtaa

SEQ ID NO: 9032369 - DNA, 22 bp, Homo sapiens
gcaggaagatgagctcaggtaa

SEQ ID NO: 9032370 - DNA, 22 bp, Homo sapiens
gcaggaagcatagaagaatgcc

SEQ ID NO: 9032371 - DNA, 22 bp, Homo sapiens
gcaggaagcatagaagaatgcc

SEQ ID NO: 9032372 - DNA, 22 bp, Homo sapiens
gcaggaagcatagaagaatgcc

SEQ ID NO: 9032373 - DNA, 22 bp, Homo sapiens
gcaggaagccttaccaagccca

SEQ ID NO: 9032374 - DNA, 22 bp, Homo sapiens
gcaggaagccttaccaagccca

SEQ ID NO: 9032375 - DNA, 22 bp, Homo sapiens
gcaggaagccttaccaagccca

SEQ ID NO: 9032376 - DNA, 22 bp, Homo sapiens
gcagctgtcatttacaacaggg

SEQ ID NO: 9032377 - DNA, 22 bp, Homo sapiens
gcagctgtcatttacaacaggg

SEQ ID NO: 9032378 - DNA, 22 bp, Homo sapiens
gcagctgtcatttacaacaggg

SEQ ID NO: 9032379 - DNA, 22 bp, Homo sapiens
gcagctgtcgctaggagctgtg

SEQ ID NO: 9032380 - DNA, 22 bp, Homo sapiens
gcagctgtcggaaagctaagtg

SEQ ID NO: 9032381 - DNA, 22 bp, Homo sapiens
gcagctgtcgctaggagctgtg

SEQ ID NO: 9032382 - DNA, 22 bp, Homo sapiens
gcagctgtcgctaggagctgtg

SEQ ID NO: 9032383 - DNA, 22 bp, Homo sapiens
gcagcctccgcactgcgagtcc

SEQ ID NO: 9032384 - DNA, 22 bp, Homo sapiens
gcagcctcagggcactcagatg

SEQ ID NO: 9032385 - DNA, 22 bp, Homo sapiens
gcagcctcagggcactcagatg

SEQ ID NO: 9032386 - DNA, 22 bp, Homo sapiens
gcagcctccgcactgcgagtcc

SEQ ID NO: 9032387 - DNA, 22 bp, Homo sapiens
gcagcctccgcactgcgagtcc

SEQ ID NO: 9032388 - DNA, 22 bp, Homo sapiens
gcagcctctgatgatggccgta

SEQ ID NO: 9032389 - DNA, 22 bp, Homo sapiens
gcagctttctttttgcatgtct

SEQ ID NO: 9032390 - DNA, 22 bp, Homo sapiens
gcagctttgaagacttatttgc

SEQ ID NO: 9032391 - DNA, 20 bp, Homo sapiens
gcagctgtgcattcttagga

SEQ ID NO: 9032392 - DNA, 22 bp, Homo sapiens
gcagctgtcggaaagctaagtg

SEQ ID NO: 9032393 - DNA, 20 bp, Homo sapiens
gcagctgtgcattcttagga

SEQ ID NO: 9032394 - DNA, 22 bp, Homo sapiens
gcagctttctaagctttattgc

SEQ ID NO: 9032395 - DNA, 20 bp, Homo sapiens
gcagccgtggagactaggag

SEQ ID NO: 9032396 - DNA, 22 bp, Homo sapiens
gcagccctttctgggcagggga

SEQ ID NO: 9032397 - DNA, 22 bp, Homo sapiens
gcagccctgcaggcagctccag

SEQ ID NO: 9032398 - DNA, 22 bp, Homo sapiens
gcagccctgcaggcagctccag

SEQ ID NO: 9032399 - DNA, 22 bp, Homo sapiens
gcagcctcaaactccccagctc

SEQ ID NO: 9032400 - DNA, 22 bp, Homo sapiens
gcagcctcaaactccccagctc

SEQ ID NO: 9032401 - DNA, 20 bp, Homo sapiens
gcagcctcaacaggcacagc

SEQ ID NO: 9032402 - DNA, 20 bp, Homo sapiens
gcagcctcaacaggcacagc

SEQ ID NO: 9032403 - DNA, 20 bp, Homo sapiens
gcagcctcaacaggcacagc

SEQ ID NO: 9032404 - DNA, 20 bp, Homo sapiens
gcagcctcaacaggcacagc

SEQ ID NO: 9032405 - DNA, 22 bp, Homo sapiens
gcagcctcagggcactcagatg

SEQ ID NO: 9032406 - DNA, 22 bp, Homo sapiens
gcagcctcagggcactcagatg

SEQ ID NO: 9032407 - DNA, 22 bp, Homo sapiens
gcaggcaggtggcatcttgtga

SEQ ID NO: 9032408 - DNA, 22 bp, Homo sapiens
gcaggcagtcatctttcatatt

SEQ ID NO: 9032409 - DNA, 22 bp, Homo sapiens
gcaggcagtcatctttcatatt

SEQ ID NO: 9032410 - DNA, 22 bp, Homo sapiens
gcaggcagtcatctttcatatt

SEQ ID NO: 9032411 - DNA, 19 bp, Homo sapiens
gcaggcagtggcattcgga

SEQ ID NO: 9032412 - DNA, 22 bp, Homo sapiens
gcaggcagttatttagtagaat

SEQ ID NO: 9032413 - DNA, 19 bp, Homo sapiens
gcaggcagtggcattcgga

SEQ ID NO: 9032414 - DNA, 19 bp, Homo sapiens
gcaggcagtggcattcgga

SEQ ID NO: 9032415 - DNA, 19 bp, Homo sapiens
gcaggcagtggcattcgga

SEQ ID NO: 9032416 - DNA, 22 bp, Homo sapiens
gcaggcagttatttagtagaat

SEQ ID NO: 9032417 - DNA, 22 bp, Homo sapiens
gcaggcagttatttagtagaat

SEQ ID NO: 9032418 - DNA, 22 bp, Homo sapiens
gcaggcagttatttagtagaat

SEQ ID NO: 9032419 - DNA, 22 bp, Homo sapiens
gcaggcagttgcagttttctag

SEQ ID NO: 9032420 - DNA, 22 bp, Homo sapiens
gcagggaagacccggagcagcg

SEQ ID NO: 9032421 - DNA, 22 bp, Homo sapiens
gcagggaagacccggagcagcg

SEQ ID NO: 9032422 - DNA, 22 bp, Homo sapiens
gcagggaagacccggagcagcg

SEQ ID NO: 9032423 - DNA, 21 bp, Homo sapiens
gcagggacaaagcttcaggag

SEQ ID NO: 9032424 - DNA, 21 bp, Homo sapiens
gcagggacaaagcttcaggag

SEQ ID NO: 9032425 - DNA, 21 bp, Homo sapiens
gcagggacaaagcttcaggag

SEQ ID NO: 9032426 - DNA, 22 bp, Homo sapiens
gcagggacaactgtgcacctga

SEQ ID NO: 9032427 - DNA, 22 bp, Homo sapiens
gcagggaaggggcatgctggag

SEQ ID NO: 9032428 - DNA, 22 bp, Homo sapiens
gcagggaaggggcatgctggag

SEQ ID NO: 9032429 - DNA, 22 bp, Homo sapiens
gcagggaaggggcatgctggag

SEQ ID NO: 9032430 - DNA, 22 bp, Homo sapiens
gcagggaaggggcatgctggag

SEQ ID NO: 9032431 - DNA, 22 bp, Homo sapiens
gcagggaagacccggagcagcg

SEQ ID NO: 9032432 - DNA, 22 bp, Homo sapiens
gcagggaagacccggagcagcg

SEQ ID NO: 9032433 - DNA, 22 bp, Homo sapiens
gcagggaagacccggagcagcg

SEQ ID NO: 9032434 - DNA, 22 bp, Homo sapiens
gcagggaagacccggagcagcg

SEQ ID NO: 9032435 - DNA, 22 bp, Homo sapiens
gcagggaagatcttggagctgc

SEQ ID NO: 9032436 - DNA, 22 bp, Homo sapiens
gcagggaagggaaacagagacc

SEQ ID NO: 9032437 - DNA, 22 bp, Homo sapiens
gcagggaagggaaacagagacc

SEQ ID NO: 9032438 - DNA, 22 bp, Homo sapiens
gcagggaagggaaacagagacc

SEQ ID NO: 9032439 - DNA, 22 bp, Homo sapiens
gcagggaagatcttggagctgc

SEQ ID NO: 9032440 - DNA, 22 bp, Homo sapiens
gcagggaagatcttggagctgc

SEQ ID NO: 9032441 - DNA, 22 bp, Homo sapiens
gcagggaagatcttggagctgc

SEQ ID NO: 9032442 - DNA, 22 bp, Homo sapiens
gcaggcagccacgattcccttg

SEQ ID NO: 9032443 - DNA, 22 bp, Homo sapiens
gcaggcagccacgattcccttg

SEQ ID NO: 9032444 - DNA, 22 bp, Homo sapiens
gcaggcagccacgattcccttg

SEQ ID NO: 9032445 - DNA, 22 bp, Homo sapiens
gcaggcagccacgattcccttg

SEQ ID NO: 9032446 - DNA, 19 bp, Homo sapiens
gcaggcagctggggtatcc

SEQ ID NO: 9032447 - DNA, 19 bp, Homo sapiens
gcaggcagctggggtatcc

SEQ ID NO: 9032448 - DNA, 19 bp, Homo sapiens
gcaggcagctggggtatcc

SEQ ID NO: 9032449 - DNA, 22 bp, Homo sapiens
gcaggcaggtggcatcttgtga

SEQ ID NO: 9032450 - DNA, 22 bp, Homo sapiens
gcaggcaggtggcatcttgtga

SEQ ID NO: 9032451 - DNA, 22 bp, Homo sapiens
gcaggcagatcacctgtcagga

SEQ ID NO: 9032452 - DNA, 22 bp, Homo sapiens
gcaggcagatcacctgtcagga

SEQ ID NO: 9032453 - DNA, 22 bp, Homo sapiens
gcaggcagatcacctgtcagga

SEQ ID NO: 9032454 - DNA, 22 bp, Homo sapiens
gcaggcagagtcaatttgatcc

SEQ ID NO: 9032455 - DNA, 22 bp, Homo sapiens
gcaggcagagtcaatttgatcc

SEQ ID NO: 9032456 - DNA, 22 bp, Homo sapiens
gcaggcagagtcaatttgatcc

SEQ ID NO: 9032457 - DNA, 22 bp, Homo sapiens
gcaggcagatcacctgtcagga

SEQ ID NO: 9032458 - DNA, 16 bp, Homo sapiens
gcaggcagatcacatg

SEQ ID NO: 9032459 - DNA, 22 bp, Homo sapiens
gcaggacacagatgcaaggcca

SEQ ID NO: 9032460 - DNA, 22 bp, Homo sapiens
gcaggcagaggtggaggagaca

SEQ ID NO: 9032461 - DNA, 22 bp, Homo sapiens
gcaggcagaggtggaggagaca

SEQ ID NO: 9032462 - DNA, 22 bp, Homo sapiens
gcaggcagaggtggaggagaca

SEQ ID NO: 9032463 - DNA, 22 bp, Homo sapiens
gcaggcagaggtggaggagaca

SEQ ID NO: 9032464 - DNA, 22 bp, Homo sapiens
gcagggctgggtgggagacaga

SEQ ID NO: 9032465 - DNA, 22 bp, Homo sapiens
gcagggctgggtgggagacaga

SEQ ID NO: 9032466 - DNA, 22 bp, Homo sapiens
gcagggctgggtgggagacaga

SEQ ID NO: 9032467 - DNA, 22 bp, Homo sapiens
gcagggctgtaatttgagcctg

SEQ ID NO: 9032468 - DNA, 22 bp, Homo sapiens
gcagggctgggtgggagacaga

SEQ ID NO: 9032469 - DNA, 22 bp, Homo sapiens
gcagggctgtggacactttggt

SEQ ID NO: 9032470 - DNA, 22 bp, Homo sapiens
gcagggctggggctgctcctga

SEQ ID NO: 9032471 - DNA, 22 bp, Homo sapiens
gcagggctggggctgctcctga

SEQ ID NO: 9032472 - DNA, 22 bp, Homo sapiens
gcagggctggggctgctcctga

SEQ ID NO: 9032473 - DNA, 22 bp, Homo sapiens
gcagggctggggctgctcctga

SEQ ID NO: 9032474 - DNA, 22 bp, Homo sapiens
gcagggctgaaggtcccaggcc

SEQ ID NO: 9032475 - DNA, 22 bp, Homo sapiens
gcagggctggggctgctcctga

SEQ ID NO: 9032476 - DNA, 22 bp, Homo sapiens
gcagggctggggctgctcctga

SEQ ID NO: 9032477 - DNA, 22 bp, Homo sapiens
gcagggctggggctgctcctga

SEQ ID NO: 9032478 - DNA, 22 bp, Homo sapiens
gcagggctgggtcctgtctcat

SEQ ID NO: 9032479 - DNA, 22 bp, Homo sapiens
gcagggctgggtcctgtctcat

SEQ ID NO: 9032480 - DNA, 22 bp, Homo sapiens
gcagggctgggtcctgtctcat

SEQ ID NO: 9032481 - DNA, 22 bp, Homo sapiens
gcagggctgggtcctgtctcat

SEQ ID NO: 9032482 - DNA, 22 bp, Homo sapiens
gcagggctgttcaggagggtgg

SEQ ID NO: 9032483 - DNA, 22 bp, Homo sapiens
gcagggctgttcaggagggtgg

SEQ ID NO: 9032484 - DNA, 22 bp, Homo sapiens
gcagggctgtggacactttggt

SEQ ID NO: 9032485 - DNA, 22 bp, Homo sapiens
gcagggctgtggacactttggt

SEQ ID NO: 9032486 - DNA, 22 bp, Homo sapiens
gcagggctgtggacactttggt

SEQ ID NO: 9032487 - DNA, 22 bp, Homo sapiens
gcagggctgttcaggagggtgg

SEQ ID NO: 9032488 - DNA, 22 bp, Homo sapiens
gcagggctgttcaggagggtgg

SEQ ID NO: 9032489 - DNA, 22 bp, Homo sapiens
gcagggctgttcaggagggtgg

SEQ ID NO: 9032490 - DNA, 22 bp, Homo sapiens
gcagggcttgcagcagctagac

SEQ ID NO: 9032491 - DNA, 22 bp, Homo sapiens
gcagggcttagaaatggtggct

SEQ ID NO: 9032492 - DNA, 22 bp, Homo sapiens
gcagggcttagaaatggtggct

SEQ ID NO: 9032493 - DNA, 22 bp, Homo sapiens
gcagggcttagaaatggtggct

SEQ ID NO: 9032494 - DNA, 22 bp, Homo sapiens
gcaggggagtccactctatgca

SEQ ID NO: 9032495 - DNA, 22 bp, Homo sapiens
gcagggcttgcagcagctagac

SEQ ID NO: 9032496 - DNA, 22 bp, Homo sapiens
gcagggcttgcagcagctagac

SEQ ID NO: 9032497 - DNA, 22 bp, Homo sapiens
gcagggcttgcagcagctagac

SEQ ID NO: 9032498 - DNA, 22 bp, Homo sapiens
gcagggacagggcagggccttt

SEQ ID NO: 9032499 - DNA, 22 bp, Homo sapiens
gcagggacagggcagggccttt

SEQ ID NO: 9032500 - DNA, 22 bp, Homo sapiens
gcagggacagggcagggccttt

SEQ ID NO: 9032501 - DNA, 22 bp, Homo sapiens
gcagggacacctttgtgaagct

SEQ ID NO: 9032502 - DNA, 22 bp, Homo sapiens
gcagggacacctttgtgaagct

SEQ ID NO: 9032503 - DNA, 22 bp, Homo sapiens
gcagggacatctttgtctagta

SEQ ID NO: 9032504 - DNA, 22 bp, Homo sapiens
gcagggaccaaaagaggcagta

SEQ ID NO: 9032505 - DNA, 22 bp, Homo sapiens
gcagggacatcttcagatcact

SEQ ID NO: 9032506 - DNA, 22 bp, Homo sapiens
gcagggacatcttcagatcact

SEQ ID NO: 9032507 - DNA, 22 bp, Homo sapiens
gcagggacatcttcagatcact

SEQ ID NO: 9032508 - DNA, 18 bp, Homo sapiens
gcagggacacagggtcac

SEQ ID NO: 9032509 - DNA, 18 bp, Homo sapiens
gcagggacacagggtcac

SEQ ID NO: 9032510 - DNA, 18 bp, Homo sapiens
gcagggacacagggtcac

SEQ ID NO: 9032511 - DNA, 18 bp, Homo sapiens
gcagggacacagggtcac

SEQ ID NO: 9032512 - DNA, 22 bp, Homo sapiens
gcagggacacctttgtgaagct

SEQ ID NO: 9032513 - DNA, 18 bp, Homo sapiens
gcagggacacagggtcac

SEQ ID NO: 9032514 - DNA, 22 bp, Homo sapiens
gcagggacaactgtgcacctga

SEQ ID NO: 9032515 - DNA, 22 bp, Homo sapiens
gcagggacaactgtgcacctga

SEQ ID NO: 9032516 - DNA, 22 bp, Homo sapiens
gcagggacaaggcaggtgttct

SEQ ID NO: 9032517 - DNA, 22 bp, Homo sapiens
gcagggacaaggcaggtgttct

SEQ ID NO: 9032518 - DNA, 22 bp, Homo sapiens
gcagggaccaaaagaggcagta

SEQ ID NO: 9032519 - DNA, 22 bp, Homo sapiens
gcagggaccaaaagaggcagta

SEQ ID NO: 9032520 - DNA, 22 bp, Homo sapiens
gcagggaccaaaagaggcagta

SEQ ID NO: 9032521 - DNA, 22 bp, Homo sapiens
gcagggaccaaaagaggcagta

SEQ ID NO: 9032522 - DNA, 22 bp, Homo sapiens
gcagggaccaaaagaggcagta

SEQ ID NO: 9032523 - DNA, 22 bp, Homo sapiens
gcagggaccaaaagaggcagta

SEQ ID NO: 9032524 - DNA, 22 bp, Homo sapiens
gcagggaccaaaagaggcagta

SEQ ID NO: 9032525 - DNA, 21 bp, Homo sapiens
gcagggaccgcgacttctggg

SEQ ID NO: 9032526 - DNA, 21 bp, Homo sapiens
gcagggaccgcgacttctggg

SEQ ID NO: 9032527 - DNA, 22 bp, Homo sapiens
gcagggaccagggccagatcca

SEQ ID NO: 9032528 - DNA, 22 bp, Homo sapiens
gcagggaccagggccagatcca

SEQ ID NO: 9032529 - DNA, 22 bp, Homo sapiens
gcagggaccaaaagaggcagta

SEQ ID NO: 9032530 - DNA, 22 bp, Homo sapiens
gcagggacctgccactgctgtc

SEQ ID NO: 9032531 - DNA, 22 bp, Homo sapiens
gcagggacctgccactgctgtc

SEQ ID NO: 9032532 - DNA, 22 bp, Homo sapiens
gcagggacctcactacccccag

SEQ ID NO: 9032533 - DNA, 22 bp, Homo sapiens
gcagggacctatgacgatggaa

SEQ ID NO: 9032534 - DNA, 22 bp, Homo sapiens
gcagggacctatgacgatggaa

SEQ ID NO: 9032535 - DNA, 22 bp, Homo sapiens
gcagggacctgccactgctgtc

SEQ ID NO: 9032536 - DNA, 22 bp, Homo sapiens
gcagggctctgctgtagtccta

SEQ ID NO: 9032537 - DNA, 22 bp, Homo sapiens
gcagggctctgctgtagtccta

SEQ ID NO: 9032538 - DNA, 22 bp, Homo sapiens
gcagggctgaaggtcccaggcc

SEQ ID NO: 9032539 - DNA, 22 bp, Homo sapiens
gcagggctctgctgtagtccta

SEQ ID NO: 9032540 - DNA, 22 bp, Homo sapiens
gcagggctctgctgtagtccta

SEQ ID NO: 9032541 - DNA, 22 bp, Homo sapiens
gccaggcagccaccctctgcga

SEQ ID NO: 9032542 - DNA, 22 bp, Homo sapiens
gccaggcagccaccctctgcga

SEQ ID NO: 9032543 - DNA, 22 bp, Homo sapiens
gccaggcagccaccctctgcga

SEQ ID NO: 9032544 - DNA, 22 bp, Homo sapiens
gccaggcagccaccctctgcga

SEQ ID NO: 9032545 - DNA, 22 bp, Homo sapiens
gccaggcagccaccctctgcga

SEQ ID NO: 9032546 - DNA, 22 bp, Homo sapiens
gccaggcagccaccctctgcga

SEQ ID NO: 9032547 - DNA, 22 bp, Homo sapiens
gccaggcagcagcgaggatggt

SEQ ID NO: 9032548 - DNA, 22 bp, Homo sapiens
gccaggcagcagcgaggatggt

SEQ ID NO: 9032549 - DNA, 22 bp, Homo sapiens
gccaggcagcagcgaggatggt

SEQ ID NO: 9032550 - DNA, 22 bp, Homo sapiens
gccaggcagcagcgaggatggt

SEQ ID NO: 9032551 - DNA, 22 bp, Homo sapiens
gccaggcagcaggaagccagtg

SEQ ID NO: 9032552 - DNA, 22 bp, Homo sapiens
gccaggcagcaggaagccagtg

SEQ ID NO: 9032553 - DNA, 22 bp, Homo sapiens
gccaggcagcaggaagccagtg

SEQ ID NO: 9032554 - DNA, 22 bp, Homo sapiens
gccaggcagatatgtgagctta

SEQ ID NO: 9032555 - DNA, 22 bp, Homo sapiens
gccaggcagagccccgtgcagc

SEQ ID NO: 9032556 - DNA, 22 bp, Homo sapiens
gccaggcagagccccgtgcagc

SEQ ID NO: 9032557 - DNA, 22 bp, Homo sapiens
gccaggcagatatgtgagctta

SEQ ID NO: 9032558 - DNA, 22 bp, Homo sapiens
gccaggcagatatgtgagctta

SEQ ID NO: 9032559 - DNA, 22 bp, Homo sapiens
gccaggcagatatgtgagctta

SEQ ID NO: 9032560 - DNA, 22 bp, Homo sapiens
gccaggcagatatgtgagctta

SEQ ID NO: 9032561 - DNA, 22 bp, Homo sapiens
gccaggcagatatgtgagctta

SEQ ID NO: 9032562 - DNA, 22 bp, Homo sapiens
gccaggcagcagcgaggatggt

SEQ ID NO: 9032563 - DNA, 22 bp, Homo sapiens
gccaggcagcagcgaggatggt

SEQ ID NO: 9032564 - DNA, 22 bp, Homo sapiens
gccaggcagcagcgaggatggt

SEQ ID NO: 9032565 - DNA, 22 bp, Homo sapiens
gccaggcaggtgtcggagccct

SEQ ID NO: 9032566 - DNA, 22 bp, Homo sapiens
gccaggcaggtgtcggagccct

SEQ ID NO: 9032567 - DNA, 22 bp, Homo sapiens
gccaggcaggtgtcggagccct

SEQ ID NO: 9032568 - DNA, 22 bp, Homo sapiens
gccaggcaggtgtcggagccct

SEQ ID NO: 9032569 - DNA, 22 bp, Homo sapiens
gccaggcagttcaagtacacca

SEQ ID NO: 9032570 - DNA, 18 bp, Homo sapiens
gccaggcagggtggggaa

SEQ ID NO: 9032571 - DNA, 18 bp, Homo sapiens
gccaggcagggtggggaa

SEQ ID NO: 9032572 - DNA, 18 bp, Homo sapiens
gccaggcagggtggggaa

SEQ ID NO: 9032573 - DNA, 22 bp, Homo sapiens
gccaggcaggtgtcggagccct

SEQ ID NO: 9032574 - DNA, 18 bp, Homo sapiens
gccaggcagggtggggaa

SEQ ID NO: 9032575 - DNA, 18 bp, Homo sapiens
gccaggcagggtggggaa

SEQ ID NO: 9032576 - DNA, 18 bp, Homo sapiens
gccaggcagggtggggaa

SEQ ID NO: 9032577 - DNA, 22 bp, Homo sapiens
gccaggcaggccacgctgtgtt

SEQ ID NO: 9032578 - DNA, 22 bp, Homo sapiens
gccaggcaggccacgctgtgtt

SEQ ID NO: 9032579 - DNA, 22 bp, Homo sapiens
gccaggcaggccacgctgtgtt

SEQ ID NO: 9032580 - DNA, 22 bp, Homo sapiens
gccaggcaggccacgctgtgtt

SEQ ID NO: 9032581 - DNA, 22 bp, Homo sapiens
gccaggcagctgggagggtgcc

SEQ ID NO: 9032582 - DNA, 22 bp, Homo sapiens
gccaggcagctgggagggtgcc

SEQ ID NO: 9032583 - DNA, 22 bp, Homo sapiens
gccaggcagctgggagggtgcc

SEQ ID NO: 9032584 - DNA, 22 bp, Homo sapiens
gccaggcagctgggagggtgcc

SEQ ID NO: 9032585 - DNA, 22 bp, Homo sapiens
gccaggcagctagcaacccctg

SEQ ID NO: 9032586 - DNA, 22 bp, Homo sapiens
gccaggcagctagcaacccctg

SEQ ID NO: 9032587 - DNA, 22 bp, Homo sapiens
gccaggcagctgggagggtgcc

SEQ ID NO: 9032588 - DNA, 22 bp, Homo sapiens
gccaggcagctagcaacccctg

SEQ ID NO: 9032589 - DNA, 22 bp, Homo sapiens
gccaggcagctagcaacccctg

SEQ ID NO: 9032590 - DNA, 22 bp, Homo sapiens
gccaggcagctagcaacccctg

SEQ ID NO: 9032591 - DNA, 21 bp, Homo sapiens
gccagggagttaaagagtctt

SEQ ID NO: 9032592 - DNA, 22 bp, Homo sapiens
gccagggagtctgggccacaga

SEQ ID NO: 9032593 - DNA, 22 bp, Homo sapiens
gccagggagtctgggccacaga

SEQ ID NO: 9032594 - DNA, 22 bp, Homo sapiens
gccagggagtctgggccacaga

SEQ ID NO: 9032595 - DNA, 22 bp, Homo sapiens
gccagggcaggggagcatctgc

SEQ ID NO: 9032596 - DNA, 22 bp, Homo sapiens
gccagggcaggggagcatctgc

SEQ ID NO: 9032597 - DNA, 22 bp, Homo sapiens
gccagggcaggggagcatctgc

SEQ ID NO: 9032598 - DNA, 22 bp, Homo sapiens
gccagggcaggggagcatctgc

SEQ ID NO: 9032599 - DNA, 21 bp, Homo sapiens
gccagggagttaaagagtctt

SEQ ID NO: 9032600 - DNA, 22 bp, Homo sapiens
gccagggctgtgcaggtttgtt

SEQ ID NO: 9032601 - DNA, 22 bp, Homo sapiens
gccagggctcgcggtccctcgt

SEQ ID NO: 9032602 - DNA, 22 bp, Homo sapiens
gccagggctgtgcaggtttgtt

SEQ ID NO: 9032603 - DNA, 22 bp, Homo sapiens
gccagggctgtgcaggtttgtt

SEQ ID NO: 9032604 - DNA, 22 bp, Homo sapiens
gccagggctgtgcaggtttgtt

SEQ ID NO: 9032605 - DNA, 22 bp, Homo sapiens
gccagggctgtgcaggtttgtt

SEQ ID NO: 9032606 - DNA, 22 bp, Homo sapiens
gccagggctcgcggtccctcgt

SEQ ID NO: 9032607 - DNA, 22 bp, Homo sapiens
gccagggctcgcggtccctcgt

SEQ ID NO: 9032608 - DNA, 22 bp, Homo sapiens
gccagggctcgcggtccctcgt

SEQ ID NO: 9032609 - DNA, 22 bp, Homo sapiens
gccagggctcgcggtccctcgt

SEQ ID NO: 9032610 - DNA, 22 bp, Homo sapiens
gccagggcaggggagcatctgc

SEQ ID NO: 9032611 - DNA, 22 bp, Homo sapiens
gccagggcaggggagcatctgc

SEQ ID NO: 9032612 - DNA, 17 bp, Homo sapiens
gccagggagaggaagcc

SEQ ID NO: 9032613 - DNA, 22 bp, Homo sapiens
gccagggaggctgtagggtcct

SEQ ID NO: 9032614 - DNA, 22 bp, Homo sapiens
gccagggaggctgtagggtcct

SEQ ID NO: 9032615 - DNA, 22 bp, Homo sapiens
gccagggaggctgtagggtcct

SEQ ID NO: 9032616 - DNA, 22 bp, Homo sapiens
gccagggaggctgtagggtcct

SEQ ID NO: 9032617 - DNA, 21 bp, Homo sapiens
gccagggaagagagttggctg

SEQ ID NO: 9032618 - DNA, 17 bp, Homo sapiens
gccagggagaggaagcc

SEQ ID NO: 9032619 - DNA, 21 bp, Homo sapiens
gccagggaagagagttggctg

SEQ ID NO: 9032620 - DNA, 21 bp, Homo sapiens
gccagggaagagagttggctg

SEQ ID NO: 9032621 - DNA, 21 bp, Homo sapiens
gccagggaagagagttggctg

SEQ ID NO: 9032622 - DNA, 21 bp, Homo sapiens
gccagggaagagagttggctg

SEQ ID NO: 9032623 - DNA, 22 bp, Homo sapiens
gccagggaacccaagggcctca

SEQ ID NO: 9032624 - DNA, 22 bp, Homo sapiens
gccagggaacccaagggcctca

SEQ ID NO: 9032625 - DNA, 22 bp, Homo sapiens
gccagggaacccaagggcctca

SEQ ID NO: 9032626 - DNA, 22 bp, Homo sapiens
gccagggaacccaagggcctca

SEQ ID NO: 9032627 - DNA, 22 bp, Homo sapiens
gccagggaacccaagggcctca

SEQ ID NO: 9032628 - DNA, 22 bp, Homo sapiens
gccaggcatgggcttctgggcg

SEQ ID NO: 9032629 - DNA, 22 bp, Homo sapiens
gccaggcatgggcttctgggcg

SEQ ID NO: 9032630 - DNA, 22 bp, Homo sapiens
gccaggcatgtcctctgcagaa

SEQ ID NO: 9032631 - DNA, 22 bp, Homo sapiens
gccaggcatgtcctctgcagaa

SEQ ID NO: 9032632 - DNA, 22 bp, Homo sapiens
gccaggcagttcaagtacacca

SEQ ID NO: 9032633 - DNA, 22 bp, Homo sapiens
gccaggcatgggcttctgggcg

SEQ ID NO: 9032634 - DNA, 22 bp, Homo sapiens
gccaggcatgggcttctgggcg

SEQ ID NO: 9032635 - DNA, 21 bp, Homo sapiens
gccagcctgtttacctgtggt

SEQ ID NO: 9032636 - DNA, 22 bp, Homo sapiens
gccagccttctgtggcctgcaa

SEQ ID NO: 9032637 - DNA, 22 bp, Homo sapiens
gccagccttctgtggcctgcaa

SEQ ID NO: 9032638 - DNA, 22 bp, Homo sapiens
gccagccttctgtggcctgcaa

SEQ ID NO: 9032639 - DNA, 23 bp, Homo sapiens
gccagccttgctctcctgcagcc

SEQ ID NO: 9032640 - DNA, 23 bp, Homo sapiens
gccagccttgctctcctgcagcc

SEQ ID NO: 9032641 - DNA, 23 bp, Homo sapiens
gccagccttgctctcctgcagcc

SEQ ID NO: 9032642 - DNA, 22 bp, Homo sapiens
gccagccttctgtggcctgcaa

SEQ ID NO: 9032643 - DNA, 23 bp, Homo sapiens
gccagccttgctctcctgcagcc

SEQ ID NO: 9032644 - DNA, 22 bp, Homo sapiens
gccagcctgtgggggctctgtg

SEQ ID NO: 9032645 - DNA, 22 bp, Homo sapiens
gccagcctgtgggggctctgtg

SEQ ID NO: 9032646 - DNA, 22 bp, Homo sapiens
gccagcctgtgggggctctgtg

SEQ ID NO: 9032647 - DNA, 21 bp, Homo sapiens
gccagcctgtttacctgtggt

SEQ ID NO: 9032648 - DNA, 21 bp, Homo sapiens
gccagcctgtttacctgtggt

SEQ ID NO: 9032649 - DNA, 21 bp, Homo sapiens
gccagcctgtttacctgtggt

SEQ ID NO: 9032650 - DNA, 21 bp, Homo sapiens
gccagcctgtttacctgtggt

SEQ ID NO: 9032651 - DNA, 22 bp, Homo sapiens
gccagcctgtgcttggccaggc

SEQ ID NO: 9032652 - DNA, 22 bp, Homo sapiens
gccagcctgtgcttggccaggc

SEQ ID NO: 9032653 - DNA, 22 bp, Homo sapiens
gccagcctgtgcttggccaggc

SEQ ID NO: 9032654 - DNA, 22 bp, Homo sapiens
gccagcctgtgggggctctgtg

SEQ ID NO: 9032655 - DNA, 22 bp, Homo sapiens
gccagcctgtgggggctctgtg

SEQ ID NO: 9032656 - DNA, 18 bp, Homo sapiens
gccagccctccaacctcc

SEQ ID NO: 9032657 - DNA, 20 bp, Homo sapiens
gccagccctgacacaggagc

SEQ ID NO: 9032658 - DNA, 18 bp, Homo sapiens
gccagccctccaacctcc

SEQ ID NO: 9032659 - DNA, 20 bp, Homo sapiens
gccagccctgacacaggagc

SEQ ID NO: 9032660 - DNA, 20 bp, Homo sapiens
gccagccctgacacaggagc

SEQ ID NO: 9032661 - DNA, 20 bp, Homo sapiens
gccagccctgacacaggagc

SEQ ID NO: 9032662 - DNA, 20 bp, Homo sapiens
gccagccctgacacaggagc

SEQ ID NO: 9032663 - DNA, 22 bp, Homo sapiens
gccagccctgggagacttatgg

SEQ ID NO: 9032664 - DNA, 20 bp, Homo sapiens
gccagccctgacacaggagc

SEQ ID NO: 9032665 - DNA, 21 bp, Homo sapiens
gccacccctggcacaggtgct

SEQ ID NO: 9032666 - DNA, 22 bp, Homo sapiens
gccagcctgtgcttggccaggc

SEQ ID NO: 9032667 - DNA, 22 bp, Homo sapiens
gccagccctgggagacttatgg

SEQ ID NO: 9032668 - DNA, 22 bp, Homo sapiens
gccacccccaagtaggtggtct

SEQ ID NO: 9032669 - DNA, 22 bp, Homo sapiens
gccacccccaagtaggtggtct

SEQ ID NO: 9032670 - DNA, 22 bp, Homo sapiens
gccaccccataggtgttaggtg

SEQ ID NO: 9032671 - DNA, 22 bp, Homo sapiens
gccaccccataggtgttaggtg

SEQ ID NO: 9032672 - DNA, 22 bp, Homo sapiens
gccaccccataggtgttaggtg

SEQ ID NO: 9032673 - DNA, 21 bp, Homo sapiens
gccacccctggcacaggtgct

SEQ ID NO: 9032674 - DNA, 21 bp, Homo sapiens
gccacccctggcacaggtgct

SEQ ID NO: 9032675 - DNA, 21 bp, Homo sapiens
gccacccctggcacaggtgct

SEQ ID NO: 9032676 - DNA, 22 bp, Homo sapiens
gccaccagtgggggcctgggca

SEQ ID NO: 9032677 - DNA, 22 bp, Homo sapiens
gccaccatcttcccatgccaac

SEQ ID NO: 9032678 - DNA, 22 bp, Homo sapiens
gccaccatgtctggctgagttt

SEQ ID NO: 9032679 - DNA, 22 bp, Homo sapiens
gccaccccaacctccctaagtt

SEQ ID NO: 9032680 - DNA, 22 bp, Homo sapiens
gccaccccaacctccctaagtt

SEQ ID NO: 9032681 - DNA, 22 bp, Homo sapiens
gccaccccaacctccctaagtt

SEQ ID NO: 9032682 - DNA, 22 bp, Homo sapiens
gccaccccaacctccctaagtt

SEQ ID NO: 9032683 - DNA, 22 bp, Homo sapiens
gccaccccaacctccctaagtt

SEQ ID NO: 9032684 - DNA, 22 bp, Homo sapiens
gccagctctgtggctgtacttg

SEQ ID NO: 9032685 - DNA, 22 bp, Homo sapiens
gccagctctcattgtataggct

SEQ ID NO: 9032686 - DNA, 22 bp, Homo sapiens
gccagctctcattgtataggct

SEQ ID NO: 9032687 - DNA, 22 bp, Homo sapiens
gccagctctgtggctgtacttg

SEQ ID NO: 9032688 - DNA, 22 bp, Homo sapiens
gccagctcttgatgggtgggta

SEQ ID NO: 9032689 - DNA, 22 bp, Homo sapiens
gccagctcccaagtgagcccct

SEQ ID NO: 9032690 - DNA, 22 bp, Homo sapiens
gccagctcccaagtgagcccct

SEQ ID NO: 9032691 - DNA, 22 bp, Homo sapiens
gccagctcagtttcaaagtagg

SEQ ID NO: 9032692 - DNA, 22 bp, Homo sapiens
gccagctccgcaggatggcgcg

SEQ ID NO: 9032693 - DNA, 22 bp, Homo sapiens
gccagctcccaagtgagcccct

SEQ ID NO: 9032694 - DNA, 22 bp, Homo sapiens
gccagctcagatgcaggaagga

SEQ ID NO: 9032695 - DNA, 22 bp, Homo sapiens
gccagctcagatgcaggaagga

SEQ ID NO: 9032696 - DNA, 22 bp, Homo sapiens
gccagctcagtgccaggcccct

SEQ ID NO: 9032697 - DNA, 22 bp, Homo sapiens
gccagctcagtgccaggcccct

SEQ ID NO: 9032698 - DNA, 22 bp, Homo sapiens
gccagctcagtttcaaagtagg

SEQ ID NO: 9032699 - DNA, 22 bp, Homo sapiens
gccagctcagtgccaggcccct

SEQ ID NO: 9032700 - DNA, 23 bp, Homo sapiens
gccagccttgctctcctgcagcc

SEQ ID NO: 9032701 - DNA, 21 bp, Homo sapiens
gccagcggccgccctccagga

SEQ ID NO: 9032702 - DNA, 22 bp, Homo sapiens
gccagctcagatgcaggaagga

SEQ ID NO: 9032703 - DNA, 22 bp, Homo sapiens
gccagctcagatgcaggaagga

SEQ ID NO: 9032704 - DNA, 22 bp, Homo sapiens
gccagctcagatgcaggaagga

SEQ ID NO: 9032705 - DNA, 22 bp, Homo sapiens
gccagctcagatgcaggaagga

SEQ ID NO: 9032706 - DNA, 22 bp, Homo sapiens
gccagctgaagggaagctcctg

SEQ ID NO: 9032707 - DNA, 22 bp, Homo sapiens
gccagctgaagggaagctcctg

SEQ ID NO: 9032708 - DNA, 22 bp, Homo sapiens
gccagctgaatttccaactgtt

SEQ ID NO: 9032709 - DNA, 22 bp, Homo sapiens
gccagctgacaccttgattttg

SEQ ID NO: 9032710 - DNA, 22 bp, Homo sapiens
gccaggcactgctctaagccct

SEQ ID NO: 9032711 - DNA, 22 bp, Homo sapiens
gccagctgaaatttcagttctg

SEQ ID NO: 9032712 - DNA, 22 bp, Homo sapiens
gccagctgaagccctggtggaa

SEQ ID NO: 9032713 - DNA, 22 bp, Homo sapiens
gccagctgaagggaagctcctg

SEQ ID NO: 9032714 - DNA, 22 bp, Homo sapiens
gccagctgaagccctggtggaa

SEQ ID NO: 9032715 - DNA, 22 bp, Homo sapiens
gccaggcagacaggtcatcagg

SEQ ID NO: 9032716 - DNA, 22 bp, Homo sapiens
gccaggcagagccccgtgcagc

SEQ ID NO: 9032717 - DNA, 22 bp, Homo sapiens
gccaggcagacaggtcatcagg

SEQ ID NO: 9032718 - DNA, 22 bp, Homo sapiens
gccaggcagacaggtcatcagg

SEQ ID NO: 9032719 - DNA, 22 bp, Homo sapiens
gccaggcactgctctaagccct

SEQ ID NO: 9032720 - DNA, 22 bp, Homo sapiens
gccaggcactgctctaagccct

SEQ ID NO: 9032721 - DNA, 22 bp, Homo sapiens
gccaggcactgctctaagccct

SEQ ID NO: 9032722 - DNA, 22 bp, Homo sapiens
gccaggcactgctctaagccct

SEQ ID NO: 9032723 - DNA, 20 bp, Homo sapiens
gccaggcactgttctcaata

SEQ ID NO: 9032724 - DNA, 20 bp, Homo sapiens
gccaggcactgttctcaata

SEQ ID NO: 9032725 - DNA, 20 bp, Homo sapiens
gccaggcactgttctcaata

SEQ ID NO: 9032726 - DNA, 22 bp, Homo sapiens
gccaggcactgctctaagccct

SEQ ID NO: 9032727 - DNA, 20 bp, Homo sapiens
gccaggcactgttctcaata

SEQ ID NO: 9032728 - DNA, 22 bp, Homo sapiens
gcatgcagtcaaccagtaaggg

SEQ ID NO: 9032729 - DNA, 22 bp, Homo sapiens
gcatgcagtcaaccagtaaggg

SEQ ID NO: 9032730 - DNA, 22 bp, Homo sapiens
gcatgcagtaaaattcagcaac

SEQ ID NO: 9032731 - DNA, 22 bp, Homo sapiens
gcatgcagtaaaattcagcaac

SEQ ID NO: 9032732 - DNA, 22 bp, Homo sapiens
gcatgcatgtgtgcagacagtc

SEQ ID NO: 9032733 - DNA, 22 bp, Homo sapiens
gcatgctgcaccagagcctctc

SEQ ID NO: 9032734 - DNA, 22 bp, Homo sapiens
gcatgctgcccagggactctct

SEQ ID NO: 9032735 - DNA, 22 bp, Homo sapiens
gcatgctgcccagggactctct

SEQ ID NO: 9032736 - DNA, 22 bp, Homo sapiens
gcatgctgctgaggctggaata

SEQ ID NO: 9032737 - DNA, 22 bp, Homo sapiens
gcatgctgctgaggctggaata

SEQ ID NO: 9032738 - DNA, 22 bp, Homo sapiens
gcatgctgctgaggctggaata

SEQ ID NO: 9032739 - DNA, 22 bp, Homo sapiens
gcatgctgctgaggctggaata

SEQ ID NO: 9032740 - DNA, 22 bp, Homo sapiens
gcatgctgagcccacgcctggg

SEQ ID NO: 9032741 - DNA, 22 bp, Homo sapiens
gcatgctgcaccagagcctctc

SEQ ID NO: 9032742 - DNA, 22 bp, Homo sapiens
gcatgctgcaccagagcctctc

SEQ ID NO: 9032743 - DNA, 21 bp, Homo sapiens
gcatgcctgcatcttagtgtt

SEQ ID NO: 9032744 - DNA, 21 bp, Homo sapiens
gcatgcctgcatcttagtgtt

SEQ ID NO: 9032745 - DNA, 22 bp, Homo sapiens
gcatggccttgctgtagtggta

SEQ ID NO: 9032746 - DNA, 20 bp, Homo sapiens
gcatggctaatctgtactga

SEQ ID NO: 9032747 - DNA, 22 bp, Homo sapiens
gcatggccttgtgctccttctc

SEQ ID NO: 9032748 - DNA, 22 bp, Homo sapiens
gcatggccttgtgctccttctc

SEQ ID NO: 9032749 - DNA, 22 bp, Homo sapiens
gcatggctattatgaggcagaa

SEQ ID NO: 9032750 - DNA, 22 bp, Homo sapiens
gcatggctgttgaagtcagctc

SEQ ID NO: 9032751 - DNA, 22 bp, Homo sapiens
gcatggctgtgagcaccctgcc

SEQ ID NO: 9032752 - DNA, 22 bp, Homo sapiens
gcatggctgttgaagtcagctc

SEQ ID NO: 9032753 - DNA, 22 bp, Homo sapiens
gcatggcttccaaaagtgctaa

SEQ ID NO: 9032754 - DNA, 22 bp, Homo sapiens
gcatggcttacagaggctgcag

SEQ ID NO: 9032755 - DNA, 22 bp, Homo sapiens
gcatggcttacagaggctgcag

SEQ ID NO: 9032756 - DNA, 22 bp, Homo sapiens
gcatggctattatgaggcagaa

SEQ ID NO: 9032757 - DNA, 22 bp, Homo sapiens
gcatggctattctaactcacat

SEQ ID NO: 9032758 - DNA, 22 bp, Homo sapiens
gcatggctctggcctcagtgtg

SEQ ID NO: 9032759 - DNA, 22 bp, Homo sapiens
gcatggctgctccctggctgca

SEQ ID NO: 9032760 - DNA, 22 bp, Homo sapiens
gcatggctgctccctggctgca

SEQ ID NO: 9032761 - DNA, 22 bp, Homo sapiens
gcatggctggtgtcctgaggga

SEQ ID NO: 9032762 - DNA, 22 bp, Homo sapiens
gcatggctgctccctggctgca

SEQ ID NO: 9032763 - DNA, 22 bp, Homo sapiens
gccaccagggggctccagtgag

SEQ ID NO: 9032764 - DNA, 22 bp, Homo sapiens
gccaccagggggtgcaaggtcc

SEQ ID NO: 9032765 - DNA, 22 bp, Homo sapiens
gccaccaggttagatccagcct

SEQ ID NO: 9032766 - DNA, 22 bp, Homo sapiens
gccaccaggttagatccagcct

SEQ ID NO: 9032767 - DNA, 22 bp, Homo sapiens
gccaccagggggtgcaaggtcc

SEQ ID NO: 9032768 - DNA, 22 bp, Homo sapiens
gccaccagtagctaacaacagt

SEQ ID NO: 9032769 - DNA, 22 bp, Homo sapiens
gccaccagtgggggcctgggca

SEQ ID NO: 9032770 - DNA, 22 bp, Homo sapiens
gccaccagtgggggcctgggca

SEQ ID NO: 9032771 - DNA, 22 bp, Homo sapiens
gccaccagtgggggcctgggca

SEQ ID NO: 9032772 - DNA, 22 bp, Homo sapiens
gccaccagtgggggcctgggca

SEQ ID NO: 9032773 - DNA, 22 bp, Homo sapiens
gccaccagtgggggcctgggca

SEQ ID NO: 9032774 - DNA, 22 bp, Homo sapiens
gccaccaggagcccagtccaaa

SEQ ID NO: 9032775 - DNA, 22 bp, Homo sapiens
gccaccaggagcccagtccaaa

SEQ ID NO: 9032776 - DNA, 22 bp, Homo sapiens
gccaccaggagcccagtccaaa

SEQ ID NO: 9032777 - DNA, 22 bp, Homo sapiens
gccaccagccccatgcgctgtg

SEQ ID NO: 9032778 - DNA, 22 bp, Homo sapiens
gccaccagccccatgcgctgtg

SEQ ID NO: 9032779 - DNA, 22 bp, Homo sapiens
gccaccaggagcccagtccaaa

SEQ ID NO: 9032780 - DNA, 22 bp, Homo sapiens
gccaccagggggctccagtgag

SEQ ID NO: 9032781 - DNA, 22 bp, Homo sapiens
gccaccagggggctccagtgag

SEQ ID NO: 9032782 - DNA, 22 bp, Homo sapiens
gccaccagggggctccagtgag

SEQ ID NO: 9032783 - DNA, 22 bp, Homo sapiens
gccaccagggggctccagtgag

SEQ ID NO: 9032784 - DNA, 22 bp, Homo sapiens
gccaccagggggctccagtgag

SEQ ID NO: 9032785 - DNA, 22 bp, Homo sapiens
gccaccagggggctccagtgag

SEQ ID NO: 9032786 - DNA, 22 bp, Homo sapiens
gccacattagccctcaccatct

SEQ ID NO: 9032787 - DNA, 22 bp, Homo sapiens
gccacattagccctcaccatct

SEQ ID NO: 9032788 - DNA, 22 bp, Homo sapiens
gccaccagcagaaaaggggcca

SEQ ID NO: 9032789 - DNA, 19 bp, Homo sapiens
gccacattcttccaggtgt

SEQ ID NO: 9032790 - DNA, 22 bp, Homo sapiens
gccaccagcagaaaaggggcca

SEQ ID NO: 9032791 - DNA, 22 bp, Homo sapiens
gccaccagcagaaaaggggcca

SEQ ID NO: 9032792 - DNA, 22 bp, Homo sapiens
gccaccagcagaaaaggggcca

SEQ ID NO: 9032793 - DNA, 22 bp, Homo sapiens
gccacatgtcatgtgctcagta

SEQ ID NO: 9032794 - DNA, 22 bp, Homo sapiens
gccacatgtcatgtgctcagta

SEQ ID NO: 9032795 - DNA, 22 bp, Homo sapiens
gccacatgtcatgtgctcagta

SEQ ID NO: 9032796 - DNA, 22 bp, Homo sapiens
gccacatgcaattgcagcacgt

SEQ ID NO: 9032797 - DNA, 22 bp, Homo sapiens
gccacatgcaattgcagcacgt

SEQ ID NO: 9032798 - DNA, 22 bp, Homo sapiens
gccacatgcaattgcagcacgt

SEQ ID NO: 9032799 - DNA, 19 bp, Homo sapiens
gccacatcttttccagagt

SEQ ID NO: 9032800 - DNA, 22 bp, Homo sapiens
gccacatgcaattgcagcacgt

SEQ ID NO: 9032801 - DNA, 22 bp, Homo sapiens
gccacaggcttaggagggaggt

SEQ ID NO: 9032802 - DNA, 22 bp, Homo sapiens
gccacaggcttaggagggaggt

SEQ ID NO: 9032803 - DNA, 22 bp, Homo sapiens
gccacaggcttaggagggaggt

SEQ ID NO: 9032804 - DNA, 22 bp, Homo sapiens
gccacaggcttaggagggaggt

SEQ ID NO: 9032805 - DNA, 22 bp, Homo sapiens
gccacaggcttaggagggaggt

SEQ ID NO: 9032806 - DNA, 22 bp, Homo sapiens
gccacaggcttaggagggaggt

SEQ ID NO: 9032807 - DNA, 22 bp, Homo sapiens
gccacaggcttaggagggaggt

SEQ ID NO: 9032808 - DNA, 22 bp, Homo sapiens
gccacaggcttaggagggaggt

SEQ ID NO: 9032809 - DNA, 22 bp, Homo sapiens
gccacaggctccagcatcagta

SEQ ID NO: 9032810 - DNA, 22 bp, Homo sapiens
gcatggcttcggggtgctgcct

SEQ ID NO: 9032811 - DNA, 20 bp, Homo sapiens
gccacagttttctcactgca

SEQ ID NO: 9032812 - DNA, 20 bp, Homo sapiens
gccacagttttctcactgca

SEQ ID NO: 9032813 - DNA, 22 bp, Homo sapiens
gccacaggcttaggagggaggt

SEQ ID NO: 9032814 - DNA, 22 bp, Homo sapiens
gccacaggcttaggagggaggt

SEQ ID NO: 9032815 - DNA, 22 bp, Homo sapiens
gccacatccttcagaaagcttt

SEQ ID NO: 9032816 - DNA, 22 bp, Homo sapiens
gcatgcaggagagaaagacggc

SEQ ID NO: 9032817 - DNA, 22 bp, Homo sapiens
gcatgcaggataggttgagctc

SEQ ID NO: 9032818 - DNA, 22 bp, Homo sapiens
gcatgcaggaagggcttgggga

SEQ ID NO: 9032819 - DNA, 22 bp, Homo sapiens
gcatgcaatgtatcagtgatag

SEQ ID NO: 9032820 - DNA, 22 bp, Homo sapiens
gcatgcaatgtatcagtgatag

SEQ ID NO: 9032821 - DNA, 22 bp, Homo sapiens
gcagtgggagcttaggcagtgc

SEQ ID NO: 9032822 - DNA, 22 bp, Homo sapiens
gcatgcaatctatccttaggaa

SEQ ID NO: 9032823 - DNA, 22 bp, Homo sapiens
gcatgcaattatggtattagat

SEQ ID NO: 9032824 - DNA, 22 bp, Homo sapiens
gcagtgggagcttaggcagtgc

SEQ ID NO: 9032825 - DNA, 22 bp, Homo sapiens
gcagtgggagcttaggcagtgc

SEQ ID NO: 9032826 - DNA, 22 bp, Homo sapiens
gcagtgggagcttaggcagtgc

SEQ ID NO: 9032827 - DNA, 22 bp, Homo sapiens
gcagtggctaggagtctggcgt

SEQ ID NO: 9032828 - DNA, 22 bp, Homo sapiens
gcagtggctaggagtctggcgt

SEQ ID NO: 9032829 - DNA, 22 bp, Homo sapiens
gcagtggctaggagtctggcgt

SEQ ID NO: 9032830 - DNA, 22 bp, Homo sapiens
gcagtggctaggagtctggcgt

SEQ ID NO: 9032831 - DNA, 22 bp, Homo sapiens
gcagtgggaaggttggcacatg

SEQ ID NO: 9032832 - DNA, 22 bp, Homo sapiens
gcagtggctaagctcgcatgca

SEQ ID NO: 9032833 - DNA, 22 bp, Homo sapiens
gcagtggctaagctcgcatgca

SEQ ID NO: 9032834 - DNA, 22 bp, Homo sapiens
gcagtggctaggagtctggcgt

SEQ ID NO: 9032835 - DNA, 22 bp, Homo sapiens
gcagtggctaggagtctggcgt

SEQ ID NO: 9032836 - DNA, 22 bp, Homo sapiens
gcagtggctaagctcgcatgca

SEQ ID NO: 9032837 - DNA, 22 bp, Homo sapiens
gcagtggccacatggaggagga

SEQ ID NO: 9032838 - DNA, 22 bp, Homo sapiens
gcagtggcccagcttgcaggct

SEQ ID NO: 9032839 - DNA, 22 bp, Homo sapiens
gcagtggccacatggaggagga

SEQ ID NO: 9032840 - DNA, 22 bp, Homo sapiens
gcagtggccacatggaggagga

SEQ ID NO: 9032841 - DNA, 22 bp, Homo sapiens
gcagtggccacatggaggagga

SEQ ID NO: 9032842 - DNA, 22 bp, Homo sapiens
gcagtggccacatggaggagga

SEQ ID NO: 9032843 - DNA, 22 bp, Homo sapiens
gcagtggcccagcttgcaggct

SEQ ID NO: 9032844 - DNA, 22 bp, Homo sapiens
gcagtggcatgatgtgggctca

SEQ ID NO: 9032845 - DNA, 22 bp, Homo sapiens
gcagtggccacatggaggagga

SEQ ID NO: 9032846 - DNA, 22 bp, Homo sapiens
gcagtggccacatggaggagga

SEQ ID NO: 9032847 - DNA, 22 bp, Homo sapiens
gcagtggaagcctctttaagca

SEQ ID NO: 9032848 - DNA, 22 bp, Homo sapiens
gcagtgagttatgatcatgcca

SEQ ID NO: 9032849 - DNA, 22 bp, Homo sapiens
gcagtgatggggatctcactgg

SEQ ID NO: 9032850 - DNA, 22 bp, Homo sapiens
gcagtgaagccagatctgaaat

SEQ ID NO: 9032851 - DNA, 22 bp, Homo sapiens
gcagtgaagccagatctgaaat

SEQ ID NO: 9032852 - DNA, 22 bp, Homo sapiens
gcagtgaatctggcaagaattt

SEQ ID NO: 9032853 - DNA, 22 bp, Homo sapiens
gcagtgaatctggcaagaattt

SEQ ID NO: 9032854 - DNA, 22 bp, Homo sapiens
gcagtgacatacctggagggca

SEQ ID NO: 9032855 - DNA, 22 bp, Homo sapiens
gcagtgaatttaacactcagat

SEQ ID NO: 9032856 - DNA, 22 bp, Homo sapiens
gcaggggagtggcaggcccgga

SEQ ID NO: 9032857 - DNA, 22 bp, Homo sapiens
gcaggggagtggcaggcccgga

SEQ ID NO: 9032858 - DNA, 22 bp, Homo sapiens
gcaggggagtggcaggcccgga

SEQ ID NO: 9032859 - DNA, 22 bp, Homo sapiens
gcaggggagtggatgatggatt

SEQ ID NO: 9032860 - DNA, 22 bp, Homo sapiens
gcaggggagtggatgatggatt

SEQ ID NO: 9032861 - DNA, 22 bp, Homo sapiens
gcaggggagtggatgatggatt

SEQ ID NO: 9032862 - DNA, 22 bp, Homo sapiens
gcaggggagtggatgatggatt

SEQ ID NO: 9032863 - DNA, 22 bp, Homo sapiens
gcaggggagtccactctatgca

SEQ ID NO: 9032864 - DNA, 22 bp, Homo sapiens
gcaggggagtggatgatggatt

SEQ ID NO: 9032865 - DNA, 22 bp, Homo sapiens
gcaggggagtccactctatgca

SEQ ID NO: 9032866 - DNA, 22 bp, Homo sapiens
gcaggggagtggatgatggatt

SEQ ID NO: 9032867 - DNA, 22 bp, Homo sapiens
gcaggggagtccactctatgca

SEQ ID NO: 9032868 - DNA, 22 bp, Homo sapiens
gcagtggcaccgctggctctgg

SEQ ID NO: 9032869 - DNA, 22 bp, Homo sapiens
gcagtggcaccgctggctctgg

SEQ ID NO: 9032870 - DNA, 22 bp, Homo sapiens
gcagtggatggccagcaggggc

SEQ ID NO: 9032871 - DNA, 22 bp, Homo sapiens
gcagtggatggccagcaggggc

SEQ ID NO: 9032872 - DNA, 22 bp, Homo sapiens
gcagtggatggccagcaggggc

SEQ ID NO: 9032873 - DNA, 22 bp, Homo sapiens
gcagtggatccaatggtatctt

SEQ ID NO: 9032874 - DNA, 22 bp, Homo sapiens
gcagtggatggccagcaggggc

SEQ ID NO: 9032875 - DNA, 22 bp, Homo sapiens
gcagtggatccaatggtatctt

SEQ ID NO: 9032876 - DNA, 17 bp, Homo sapiens
gcagtggaggggtagtt

SEQ ID NO: 9032877 - DNA, 23 bp, Homo sapiens
gcagtggaatgtctctgtttgga

SEQ ID NO: 9032878 - DNA, 17 bp, Homo sapiens
gcagtggaggggtagtt

SEQ ID NO: 9032879 - DNA, 17 bp, Homo sapiens
gcagtggaggggtagtt

SEQ ID NO: 9032880 - DNA, 22 bp, Homo sapiens
gcagtggcatgatgtgggctca

SEQ ID NO: 9032881 - DNA, 22 bp, Homo sapiens
gcagtggcatgatgtgggctca

SEQ ID NO: 9032882 - DNA, 22 bp, Homo sapiens
gcagtggcatgatgtgggctca

SEQ ID NO: 9032883 - DNA, 22 bp, Homo sapiens
gcagtggcatgatgtgggctca

SEQ ID NO: 9032884 - DNA, 22 bp, Homo sapiens
gcagtggcatgatgtgggctca

SEQ ID NO: 9032885 - DNA, 22 bp, Homo sapiens
gcagtggcagctgagggggtat

SEQ ID NO: 9032886 - DNA, 22 bp, Homo sapiens
gcagtggcagctgagggggtat

SEQ ID NO: 9032887 - DNA, 22 bp, Homo sapiens
gcagtggcagctgagggggtat

SEQ ID NO: 9032888 - DNA, 22 bp, Homo sapiens
gcagtggcatgatgtgggctca

SEQ ID NO: 9032889 - DNA, 22 bp, Homo sapiens
gcagtggcatgatgtgggctca

SEQ ID NO: 9032890 - DNA, 22 bp, Homo sapiens
gcagtggcagagacagcaccaa

SEQ ID NO: 9032891 - DNA, 22 bp, Homo sapiens
gcagtggcaccgctggctctgg

SEQ ID NO: 9032892 - DNA, 22 bp, Homo sapiens
gcagtggcaccgctggctctgg

SEQ ID NO: 9032893 - DNA, 22 bp, Homo sapiens
gcagtggcaccgctggctctgg

SEQ ID NO: 9032894 - DNA, 22 bp, Homo sapiens
gcagtggcagctgagggggtat

SEQ ID NO: 9032895 - DNA, 22 bp, Homo sapiens
gcagtggcagagacagcaccaa

SEQ ID NO: 9032896 - DNA, 22 bp, Homo sapiens
gcccagccctgaggtcacagct

SEQ ID NO: 9032897 - DNA, 22 bp, Homo sapiens
gcccagccctgaggtcacagct

SEQ ID NO: 9032898 - DNA, 22 bp, Homo sapiens
gcccagccctgaggtcacagct

SEQ ID NO: 9032899 - DNA, 22 bp, Homo sapiens
gcccagccctgaggtcacagct

SEQ ID NO: 9032900 - DNA, 22 bp, Homo sapiens
gcccagcctccaagctccaagg

SEQ ID NO: 9032901 - DNA, 22 bp, Homo sapiens
gcccagctccattcttggtgag

SEQ ID NO: 9032902 - DNA, 22 bp, Homo sapiens
gcccagcctccaagctccaagg

SEQ ID NO: 9032903 - DNA, 22 bp, Homo sapiens
gcccagcctccaagctccaagg

SEQ ID NO: 9032904 - DNA, 22 bp, Homo sapiens
gcccagcctccaagctccaagg

SEQ ID NO: 9032905 - DNA, 22 bp, Homo sapiens
gcccagcgagcagaggtggacg

SEQ ID NO: 9032906 - DNA, 22 bp, Homo sapiens
gcccagctccattcttggtgag

SEQ ID NO: 9032907 - DNA, 22 bp, Homo sapiens
gcccagctccattcttggtgag

SEQ ID NO: 9032908 - DNA, 22 bp, Homo sapiens
gcccagctcctctgcagaccct

SEQ ID NO: 9032909 - DNA, 22 bp, Homo sapiens
gcccagctgagaagcgcggggc

SEQ ID NO: 9032910 - DNA, 22 bp, Homo sapiens
gcccagctcctctgcagaccct

SEQ ID NO: 9032911 - DNA, 22 bp, Homo sapiens
gcccagctgcaccctggtgggt

SEQ ID NO: 9032912 - DNA, 22 bp, Homo sapiens
gcccagctgcaccctggtgggt

SEQ ID NO: 9032913 - DNA, 22 bp, Homo sapiens
gcccagctggcttccagcacat

SEQ ID NO: 9032914 - DNA, 22 bp, Homo sapiens
gcccagctgagaagcgcggggc

SEQ ID NO: 9032915 - DNA, 22 bp, Homo sapiens
gcccagctgcaccctggtgggt

SEQ ID NO: 9032916 - DNA, 22 bp, Homo sapiens
gcccagctgcaccctggtgggt

SEQ ID NO: 9032917 - DNA, 22 bp, Homo sapiens
gcccagcactcctctctgacat

SEQ ID NO: 9032918 - DNA, 22 bp, Homo sapiens
gcccagcactcctctctgacat

SEQ ID NO: 9032919 - DNA, 22 bp, Homo sapiens
gcccagcactcctctctgacat

SEQ ID NO: 9032920 - DNA, 22 bp, Homo sapiens
gcccagcacctctctcagggtt

SEQ ID NO: 9032921 - DNA, 22 bp, Homo sapiens
gcccagcactcctctctgacat

SEQ ID NO: 9032922 - DNA, 22 bp, Homo sapiens
gcccagcactaaaagctttgct

SEQ ID NO: 9032923 - DNA, 22 bp, Homo sapiens
gcccagcacctctctcagggtt

SEQ ID NO: 9032924 - DNA, 22 bp, Homo sapiens
gcccagcacctctctcagggtt

SEQ ID NO: 9032925 - DNA, 22 bp, Homo sapiens
gcccagcacctctctcagggtt

SEQ ID NO: 9032926 - DNA, 22 bp, Homo sapiens
gcccagcacctctctcagggtt

SEQ ID NO: 9032927 - DNA, 22 bp, Homo sapiens
gcccagcacattgctgaggacc

SEQ ID NO: 9032928 - DNA, 22 bp, Homo sapiens
gcccagcacctctctcagggtt

SEQ ID NO: 9032929 - DNA, 22 bp, Homo sapiens
gcccagcagctggtggagaagg

SEQ ID NO: 9032930 - DNA, 22 bp, Homo sapiens
gcccagccctgaggtcacagct

SEQ ID NO: 9032931 - DNA, 22 bp, Homo sapiens
gcccagcagctggtggagaagg

SEQ ID NO: 9032932 - DNA, 22 bp, Homo sapiens
gcccagcagctggtggagaagg

SEQ ID NO: 9032933 - DNA, 22 bp, Homo sapiens
gcccagcagatctcagtgtctc

SEQ ID NO: 9032934 - DNA, 22 bp, Homo sapiens
gcccagcagatctcagtgtctc

SEQ ID NO: 9032935 - DNA, 22 bp, Homo sapiens
gcccagcagatctcagtgtctc

SEQ ID NO: 9032936 - DNA, 22 bp, Homo sapiens
gcccagcagatctcagtgtctc

SEQ ID NO: 9032937 - DNA, 22 bp, Homo sapiens
gcccagcagatctcagtgtctc

SEQ ID NO: 9032938 - DNA, 22 bp, Homo sapiens
gccagggggtcagcaggcactt

SEQ ID NO: 9032939 - DNA, 22 bp, Homo sapiens
gccagggggtcagcaggcactt

SEQ ID NO: 9032940 - DNA, 22 bp, Homo sapiens
gccagggggtcagcaggcactt

SEQ ID NO: 9032941 - DNA, 22 bp, Homo sapiens
gccagggggtcagcaggcactt

SEQ ID NO: 9032942 - DNA, 22 bp, Homo sapiens
gccagggggtcagcaggcactt

SEQ ID NO: 9032943 - DNA, 22 bp, Homo sapiens
gccagggggtcagcaggcactt

SEQ ID NO: 9032944 - DNA, 22 bp, Homo sapiens
gccaggggacgcggagcgacga

SEQ ID NO: 9032945 - DNA, 22 bp, Homo sapiens
gccaggggacgcggagcgacga

SEQ ID NO: 9032946 - DNA, 22 bp, Homo sapiens
gccaggggacgcggagcgacga

SEQ ID NO: 9032947 - DNA, 22 bp, Homo sapiens
gccaggggacgcggagcgacga

SEQ ID NO: 9032948 - DNA, 22 bp, Homo sapiens
gccaggggacgcggagcgacga

SEQ ID NO: 9032949 - DNA, 22 bp, Homo sapiens
gccagggtgtgcagggacagga

SEQ ID NO: 9032950 - DNA, 22 bp, Homo sapiens
gccagggttcgaatccgtatgg

SEQ ID NO: 9032951 - DNA, 22 bp, Homo sapiens
gccagggttcgaatccgtatgg

SEQ ID NO: 9032952 - DNA, 22 bp, Homo sapiens
gccagggttcgaatccgtatgg

SEQ ID NO: 9032953 - DNA, 22 bp, Homo sapiens
gccagggtgagggctgagaggt

SEQ ID NO: 9032954 - DNA, 22 bp, Homo sapiens
gccagggtggcagaaggcccca

SEQ ID NO: 9032955 - DNA, 22 bp, Homo sapiens
gccagggtgtgcagggacagga

SEQ ID NO: 9032956 - DNA, 22 bp, Homo sapiens
gccaggggtgcccacccaagga

SEQ ID NO: 9032957 - DNA, 21 bp, Homo sapiens
gcccagcaaggtgagaaggcc

SEQ ID NO: 9032958 - DNA, 21 bp, Homo sapiens
gcccagcaaggtgagaaggcc

SEQ ID NO: 9032959 - DNA, 21 bp, Homo sapiens
gcccagcaaggtgagaaggcc

SEQ ID NO: 9032960 - DNA, 22 bp, Homo sapiens
gcccagcacagctggaagagtc

SEQ ID NO: 9032961 - DNA, 22 bp, Homo sapiens
gcccagcacagctggaagagtc

SEQ ID NO: 9032962 - DNA, 22 bp, Homo sapiens
gccagggttgccaatgggggca

SEQ ID NO: 9032963 - DNA, 22 bp, Homo sapiens
gccagggttgccaatgggggca

SEQ ID NO: 9032964 - DNA, 22 bp, Homo sapiens
gcccagcaaggaccaagggccg

SEQ ID NO: 9032965 - DNA, 22 bp, Homo sapiens
gcccagcaaggaccaagggccg

SEQ ID NO: 9032966 - DNA, 21 bp, Homo sapiens
gcccagcaaggtgagaaggcc

SEQ ID NO: 9032967 - DNA, 22 bp, Homo sapiens
gcccagcacagctggaagagtc

SEQ ID NO: 9032968 - DNA, 22 bp, Homo sapiens
gcccagcacagctggaagagtc

SEQ ID NO: 9032969 - DNA, 22 bp, Homo sapiens
gcccagcacatctggccttgaa

SEQ ID NO: 9032970 - DNA, 22 bp, Homo sapiens
gcccagcacatctggccttgaa

SEQ ID NO: 9032971 - DNA, 22 bp, Homo sapiens
gcccagcacatctggccttgaa

SEQ ID NO: 9032972 - DNA, 22 bp, Homo sapiens
gcccagcacatctggccttgaa

SEQ ID NO: 9032973 - DNA, 22 bp, Homo sapiens
gcccagcacattgctgaggacc

SEQ ID NO: 9032974 - DNA, 22 bp, Homo sapiens
gcccagcacattgctgaggacc

SEQ ID NO: 9032975 - DNA, 22 bp, Homo sapiens
gcccagcacattgctgaggacc

SEQ ID NO: 9032976 - DNA, 22 bp, Homo sapiens
gcccagcacattgctgaggacc

SEQ ID NO: 9032977 - DNA, 22 bp, Homo sapiens
gcccagcacattgctgaggacc

SEQ ID NO: 9032978 - DNA, 22 bp, Homo sapiens
gcccagcacattgctgaggacc

SEQ ID NO: 9032979 - DNA, 22 bp, Homo sapiens
gcccagcacattgctgaggacc

SEQ ID NO: 9032980 - DNA, 22 bp, Homo sapiens
gcccagcacattgctgaggacc

SEQ ID NO: 9032981 - DNA, 22 bp, Homo sapiens
gcccagcacattgctgaggacc

SEQ ID NO: 9032982 - DNA, 22 bp, Homo sapiens
gccccaccttgagagcagaaac

SEQ ID NO: 9032983 - DNA, 22 bp, Homo sapiens
gccccacctgctaccttccagc

SEQ ID NO: 9032984 - DNA, 22 bp, Homo sapiens
gccccacctgctaccttccagc

SEQ ID NO: 9032985 - DNA, 22 bp, Homo sapiens
gccccaccttgagagcagaaac

SEQ ID NO: 9032986 - DNA, 22 bp, Homo sapiens
gccccaccttgagagcagaaac

SEQ ID NO: 9032987 - DNA, 22 bp, Homo sapiens
gccccacctgctaccttccagc

SEQ ID NO: 9032988 - DNA, 22 bp, Homo sapiens
gccccaccgagggtgcagtcct

SEQ ID NO: 9032989 - DNA, 22 bp, Homo sapiens
gccccaccgagggtgcagtcct

SEQ ID NO: 9032990 - DNA, 22 bp, Homo sapiens
gccccaccgagggtgcagtcct

SEQ ID NO: 9032991 - DNA, 22 bp, Homo sapiens
gccccacctgctaccttccagc

SEQ ID NO: 9032992 - DNA, 22 bp, Homo sapiens
gccccacctgctaccttccagc

SEQ ID NO: 9032993 - DNA, 22 bp, Homo sapiens
gcccatgtgatttcctgggagt

SEQ ID NO: 9032994 - DNA, 22 bp, Homo sapiens
gcccatgtctgacagggtgggg

SEQ ID NO: 9032995 - DNA, 22 bp, Homo sapiens
gccccacagcctgcggtctcag

SEQ ID NO: 9032996 - DNA, 22 bp, Homo sapiens
gcccatggtcagggaggcaggg

SEQ ID NO: 9032997 - DNA, 22 bp, Homo sapiens
gcccatggtccaggaagacaga

SEQ ID NO: 9032998 - DNA, 22 bp, Homo sapiens
gcccatggtccaggaagacaga

SEQ ID NO: 9032999 - DNA, 22 bp, Homo sapiens
gcccaggagaggccagggctga

SEQ ID NO: 9033000 - DNA, 22 bp, Homo sapiens
gcccaggagcctggagatgtgt

SEQ ID NO: 9033001 - DNA, 22 bp, Homo sapiens
gcccaggagcctggagatgtgt

SEQ ID NO: 9033002 - DNA, 22 bp, Homo sapiens
gcccaggagcctggagatgtgt

SEQ ID NO: 9033003 - DNA, 22 bp, Homo sapiens
gcccaggactcagggtgtcgcg

SEQ ID NO: 9033004 - DNA, 22 bp, Homo sapiens
gcccaggactcagggtgtcgcg

SEQ ID NO: 9033005 - DNA, 22 bp, Homo sapiens
gcccaggagaggccagggctga

SEQ ID NO: 9033006 - DNA, 22 bp, Homo sapiens
gcccaggagaggccagggctga

SEQ ID NO: 9033007 - DNA, 22 bp, Homo sapiens
gcccaggagaggccagggctga

SEQ ID NO: 9033008 - DNA, 22 bp, Homo sapiens
gcccatgggcctgaggccctag

SEQ ID NO: 9033009 - DNA, 22 bp, Homo sapiens
gcccatggtcagggaggcaggg

SEQ ID NO: 9033010 - DNA, 22 bp, Homo sapiens
gcccatgggcctgaggccctag

SEQ ID NO: 9033011 - DNA, 22 bp, Homo sapiens
gcccatggcttccctaggcaca

SEQ ID NO: 9033012 - DNA, 22 bp, Homo sapiens
gcccatggcttccctaggcaca

SEQ ID NO: 9033013 - DNA, 22 bp, Homo sapiens
gcccatggcttccctaggcaca

SEQ ID NO: 9033014 - DNA, 22 bp, Homo sapiens
gcccatggcagaactgtgagca

SEQ ID NO: 9033015 - DNA, 22 bp, Homo sapiens
gcccatggcagaactgtgagca

SEQ ID NO: 9033016 - DNA, 22 bp, Homo sapiens
gcccaggagcctggagatgtgt

SEQ ID NO: 9033017 - DNA, 22 bp, Homo sapiens
gcccaggaggagaggctgcagt

SEQ ID NO: 9033018 - DNA, 22 bp, Homo sapiens
gcccaggaggagaggctgcagt

SEQ ID NO: 9033019 - DNA, 22 bp, Homo sapiens
gcccatggcagaactgtgagca

SEQ ID NO: 9033020 - DNA, 22 bp, Homo sapiens
gcccagctgtctggcagggatg

SEQ ID NO: 9033021 - DNA, 22 bp, Homo sapiens
gcccagctgtctggcagggatg

SEQ ID NO: 9033022 - DNA, 22 bp, Homo sapiens
gcccagctgtctggcagggatg

SEQ ID NO: 9033023 - DNA, 22 bp, Homo sapiens
gcccagctggcttccagcacat

SEQ ID NO: 9033024 - DNA, 22 bp, Homo sapiens
gcccagctggcttccagcacat

SEQ ID NO: 9033025 - DNA, 22 bp, Homo sapiens
gcccagctggcttccagcacat

SEQ ID NO: 9033026 - DNA, 22 bp, Homo sapiens
gcccagctggcttccagcacat

SEQ ID NO: 9033027 - DNA, 22 bp, Homo sapiens
gcccagctttttgaggcaggca

SEQ ID NO: 9033028 - DNA, 22 bp, Homo sapiens
gcccagctttttgaggcaggca

SEQ ID NO: 9033029 - DNA, 22 bp, Homo sapiens
gcccagctttttgaggcaggca

SEQ ID NO: 9033030 - DNA, 22 bp, Homo sapiens
gcccagcttttcacttccacac

SEQ ID NO: 9033031 - DNA, 22 bp, Homo sapiens
gcccagcttttcacttccacac

SEQ ID NO: 9033032 - DNA, 22 bp, Homo sapiens
gcccaggaaatgccccgtggtg

SEQ ID NO: 9033033 - DNA, 22 bp, Homo sapiens
gcccaggaaatgccccgtggtg

SEQ ID NO: 9033034 - DNA, 22 bp, Homo sapiens
gcccaggaaataaaagtgggct

SEQ ID NO: 9033035 - DNA, 22 bp, Homo sapiens
gcccaggaaataaaagtgggct

SEQ ID NO: 9033036 - DNA, 22 bp, Homo sapiens
gcccaggaaataaaagtgggct

SEQ ID NO: 9033037 - DNA, 22 bp, Homo sapiens
gcccagctttttgaggcaggca

SEQ ID NO: 9033038 - DNA, 22 bp, Homo sapiens
gcccaggaaagatagggcctca

SEQ ID NO: 9033039 - DNA, 22 bp, Homo sapiens
gcccaggaaagatagggcctca

SEQ ID NO: 9033040 - DNA, 22 bp, Homo sapiens
gcccaggaagttgaggctgccg

SEQ ID NO: 9033041 - DNA, 22 bp, Homo sapiens
gcccaggaagttgaggctgccg

SEQ ID NO: 9033042 - DNA, 22 bp, Homo sapiens
gcccaggaagttgaggctgccg

SEQ ID NO: 9033043 - DNA, 22 bp, Homo sapiens
gcccaggaagttgaggctgccg

SEQ ID NO: 9033044 - DNA, 22 bp, Homo sapiens
gcccaggaagttgaggctgccg

SEQ ID NO: 9033045 - DNA, 16 bp, Homo sapiens
gcccaggacgggaggc

SEQ ID NO: 9033046 - DNA, 16 bp, Homo sapiens
gcccaggacgggaggc

SEQ ID NO: 9033047 - DNA, 16 bp, Homo sapiens
gcccaggacgggaggc

SEQ ID NO: 9033048 - DNA, 20 bp, Homo sapiens
gcccaggaatttgcatttct

SEQ ID NO: 9033049 - DNA, 20 bp, Homo sapiens
gcccaggaatttgcatttct

SEQ ID NO: 9033050 - DNA, 20 bp, Homo sapiens
gcccaggaatttgcatttct

SEQ ID NO: 9033051 - DNA, 17 bp, Homo sapiens
gcccaggaaggacggcc

SEQ ID NO: 9033052 - DNA, 17 bp, Homo sapiens
gcccaggaaggacggcc

SEQ ID NO: 9033053 - DNA, 22 bp, Homo sapiens
gcccaggaagtgactcagatgt

SEQ ID NO: 9033054 - DNA, 22 bp, Homo sapiens
gcccaggaagtgactcagatgt

SEQ ID NO: 9033055 - DNA, 22 bp, Homo sapiens
gcccaggaagtgactcagatgt

SEQ ID NO: 9033056 - DNA, 22 bp, Homo sapiens
gcccaggaagtgactcagatgt

SEQ ID NO: 9033057 - DNA, 17 bp, Homo sapiens
gcccaggaaggacggcc

SEQ ID NO: 9033058 - DNA, 17 bp, Homo sapiens
gcccaggaaggacggcc

SEQ ID NO: 9033059 - DNA, 22 bp, Homo sapiens
gcccaggaagccaccgggaagt

SEQ ID NO: 9033060 - DNA, 22 bp, Homo sapiens
gcccaggaaatgccccgtggtg

SEQ ID NO: 9033061 - DNA, 17 bp, Homo sapiens
gccctggagccaggcta

SEQ ID NO: 9033062 - DNA, 17 bp, Homo sapiens
gccctggagccaggcta

SEQ ID NO: 9033063 - DNA, 20 bp, Homo sapiens
gccctggagccttgtcctgg

SEQ ID NO: 9033064 - DNA, 22 bp, Homo sapiens
gccctggagctagactaggaca

SEQ ID NO: 9033065 - DNA, 22 bp, Homo sapiens
gccctggagggccagcgactgg

SEQ ID NO: 9033066 - DNA, 22 bp, Homo sapiens
gccctggagggccagcgactgg

SEQ ID NO: 9033067 - DNA, 22 bp, Homo sapiens
gccctggagctagactaggaca

SEQ ID NO: 9033068 - DNA, 22 bp, Homo sapiens
gccccaggggaggtgccctgca

SEQ ID NO: 9033069 - DNA, 22 bp, Homo sapiens
gccccaggggaggtgccctgca

SEQ ID NO: 9033070 - DNA, 22 bp, Homo sapiens
gccccaggggaggtgccctgca

SEQ ID NO: 9033071 - DNA, 22 bp, Homo sapiens
gccccaggggaggtgccctgca

SEQ ID NO: 9033072 - DNA, 22 bp, Homo sapiens
gccctggagagggatatggcat

SEQ ID NO: 9033073 - DNA, 17 bp, Homo sapiens
gccctggagccaggcta

SEQ ID NO: 9033074 - DNA, 17 bp, Homo sapiens
gccctggagccaggcta

SEQ ID NO: 9033075 - DNA, 17 bp, Homo sapiens
gccctggagccaggcta

SEQ ID NO: 9033076 - DNA, 17 bp, Homo sapiens
gccctggagccaggcta

SEQ ID NO: 9033077 - DNA, 17 bp, Homo sapiens
gccctggagccaggcta

SEQ ID NO: 9033078 - DNA, 15 bp, Homo sapiens
gccccaggaatcaaa

SEQ ID NO: 9033079 - DNA, 22 bp, Homo sapiens
gccccaggataaatttgtaaga

SEQ ID NO: 9033080 - DNA, 22 bp, Homo sapiens
gccccaggggaggtgccctgca

SEQ ID NO: 9033081 - DNA, 22 bp, Homo sapiens
gccccagcctgggaactggagg

SEQ ID NO: 9033082 - DNA, 22 bp, Homo sapiens
gccccagcctgggaactggagg

SEQ ID NO: 9033083 - DNA, 22 bp, Homo sapiens
gccccagctctgccacaactag

SEQ ID NO: 9033084 - DNA, 22 bp, Homo sapiens
gccccagctctgccacaactag

SEQ ID NO: 9033085 - DNA, 22 bp, Homo sapiens
gccccagaaagttcaaggcaca

SEQ ID NO: 9033086 - DNA, 22 bp, Homo sapiens
gccccagaaagttcaaggcaca

SEQ ID NO: 9033087 - DNA, 22 bp, Homo sapiens
gccccagaaagttcaaggcaca

SEQ ID NO: 9033088 - DNA, 22 bp, Homo sapiens
gccccagaaggggaaagcctgg

SEQ ID NO: 9033089 - DNA, 22 bp, Homo sapiens
gccccagaaagttcaaggcaca

SEQ ID NO: 9033090 - DNA, 22 bp, Homo sapiens
gccccagaaagttcaaggcaca

SEQ ID NO: 9033091 - DNA, 22 bp, Homo sapiens
gccccagacataagtagggggt

SEQ ID NO: 9033092 - DNA, 22 bp, Homo sapiens
gccccagaaggggaaagcctgg

SEQ ID NO: 9033093 - DNA, 22 bp, Homo sapiens
gccccagacataagtagggggt

SEQ ID NO: 9033094 - DNA, 22 bp, Homo sapiens
gccccagatggaggaagctggg

SEQ ID NO: 9033095 - DNA, 22 bp, Homo sapiens
gccccagatggaggaagctggg

SEQ ID NO: 9033096 - DNA, 22 bp, Homo sapiens
gccccagatggaggaagctggg

SEQ ID NO: 9033097 - DNA, 22 bp, Homo sapiens
gccccagcagcaatgcggttga

SEQ ID NO: 9033098 - DNA, 22 bp, Homo sapiens
gccccagccaaggtgacacgaa

SEQ ID NO: 9033099 - DNA, 22 bp, Homo sapiens
gccccagccaaggtgacacgaa

SEQ ID NO: 9033100 - DNA, 22 bp, Homo sapiens
gccccagccaaggtgacacgaa

SEQ ID NO: 9033101 - DNA, 22 bp, Homo sapiens
gccccagccaaggtgacacgaa

SEQ ID NO: 9033102 - DNA, 22 bp, Homo sapiens
gccccagccaaggtgacacgaa

SEQ ID NO: 9033103 - DNA, 22 bp, Homo sapiens
gccccagccctgtggaccatgg

SEQ ID NO: 9033104 - DNA, 22 bp, Homo sapiens
gccccagcctagttttctttca

SEQ ID NO: 9033105 - DNA, 22 bp, Homo sapiens
gccccagcctcccgagtagctg

SEQ ID NO: 9033106 - DNA, 22 bp, Homo sapiens
gccccagcctcccgagtagctg

SEQ ID NO: 9033107 - DNA, 22 bp, Homo sapiens
gccccagcctcccgagtagctg

SEQ ID NO: 9033108 - DNA, 22 bp, Homo sapiens
gccccagcctcccgagtagctg

SEQ ID NO: 9033109 - DNA, 22 bp, Homo sapiens
gccccagcctcccgagtagctg

SEQ ID NO: 9033110 - DNA, 22 bp, Homo sapiens
gccctgtgccagtcacgctgtg

SEQ ID NO: 9033111 - DNA, 22 bp, Homo sapiens
gccctgtgccagtcacgctgtg

SEQ ID NO: 9033112 - DNA, 22 bp, Homo sapiens
gccctgtgccagtcacgctgtg

SEQ ID NO: 9033113 - DNA, 22 bp, Homo sapiens
gccctgtgccagtcacgctgtg

SEQ ID NO: 9033114 - DNA, 22 bp, Homo sapiens
gccctgggctccctgctccaca

SEQ ID NO: 9033115 - DNA, 22 bp, Homo sapiens
gccctgtgcgactctagaggtt

SEQ ID NO: 9033116 - DNA, 22 bp, Homo sapiens
gccctgtgcgactctagaggtt

SEQ ID NO: 9033117 - DNA, 22 bp, Homo sapiens
gccctgtgcgactctagaggtt

SEQ ID NO: 9033118 - DNA, 22 bp, Homo sapiens
gccctgggcaaggttctggcca

SEQ ID NO: 9033119 - DNA, 22 bp, Homo sapiens
gccctgggattgggtggaggct

SEQ ID NO: 9033120 - DNA, 22 bp, Homo sapiens
gccctgggattgggtggaggct

SEQ ID NO: 9033121 - DNA, 22 bp, Homo sapiens
gccctgtggacagtgagaagtg

SEQ ID NO: 9033122 - DNA, 22 bp, Homo sapiens
gccctgtggacagtgagaagtg

SEQ ID NO: 9033123 - DNA, 22 bp, Homo sapiens
gccctgtggacccaggaactct

SEQ ID NO: 9033124 - DNA, 22 bp, Homo sapiens
gccctgtggacagtgagaagtg

SEQ ID NO: 9033125 - DNA, 22 bp, Homo sapiens
gccctgtggattaatgagcagg

SEQ ID NO: 9033126 - DNA, 22 bp, Homo sapiens
gccctgggcaaggttctggcca

SEQ ID NO: 9033127 - DNA, 22 bp, Homo sapiens
gccctgtggattaatgagcagg

SEQ ID NO: 9033128 - DNA, 22 bp, Homo sapiens
gccctgtggccccagtgggctc

SEQ ID NO: 9033129 - DNA, 22 bp, Homo sapiens
gccctgtggacccaggaactct

SEQ ID NO: 9033130 - DNA, 22 bp, Homo sapiens
gccctgtggacccaggaactct

SEQ ID NO: 9033131 - DNA, 22 bp, Homo sapiens
gccctgtggattaatgagcagg

SEQ ID NO: 9033132 - DNA, 22 bp, Homo sapiens
gccctgtgcttggatggcagat

SEQ ID NO: 9033133 - DNA, 22 bp, Homo sapiens
gccctgtgcttggatggcagat

SEQ ID NO: 9033134 - DNA, 22 bp, Homo sapiens
gccctgtgcttggatggcagat

SEQ ID NO: 9033135 - DNA, 22 bp, Homo sapiens
gccctgtgcttggatggcagat

SEQ ID NO: 9033136 - DNA, 22 bp, Homo sapiens
gccctgtgcttggatggcagat

SEQ ID NO: 9033137 - DNA, 22 bp, Homo sapiens
gccctgtgcgctgagttcaggg

SEQ ID NO: 9033138 - DNA, 22 bp, Homo sapiens
gccctgtgctataggttagggc

SEQ ID NO: 9033139 - DNA, 22 bp, Homo sapiens
gccctgtgctataggttagggc

SEQ ID NO: 9033140 - DNA, 22 bp, Homo sapiens
gccctgtgctcatgggaacatc

SEQ ID NO: 9033141 - DNA, 22 bp, Homo sapiens
gccctggatgtacaggcatgtt

SEQ ID NO: 9033142 - DNA, 22 bp, Homo sapiens
gccctggatgtacaggcatgtt

SEQ ID NO: 9033143 - DNA, 22 bp, Homo sapiens
gccctggatgtacaggcatgtt

SEQ ID NO: 9033144 - DNA, 22 bp, Homo sapiens
gccctggcacctcgttgcccag

SEQ ID NO: 9033145 - DNA, 22 bp, Homo sapiens
gccctggatgtacaggcatgtt

SEQ ID NO: 9033146 - DNA, 22 bp, Homo sapiens
gccctggatgtacaggcatgtt

SEQ ID NO: 9033147 - DNA, 22 bp, Homo sapiens
gccctggatgctcatggcatca

SEQ ID NO: 9033148 - DNA, 22 bp, Homo sapiens
gccctggatgctcatggcatca

SEQ ID NO: 9033149 - DNA, 22 bp, Homo sapiens
gccctggagggccagcgactgg

SEQ ID NO: 9033150 - DNA, 22 bp, Homo sapiens
gccctggatgctcatggcatca

SEQ ID NO: 9033151 - DNA, 22 bp, Homo sapiens
gccctggatggcaggagccatc

SEQ ID NO: 9033152 - DNA, 22 bp, Homo sapiens
gccctggatggcaggagccatc

SEQ ID NO: 9033153 - DNA, 22 bp, Homo sapiens
gccctggatggcaggagccatc

SEQ ID NO: 9033154 - DNA, 22 bp, Homo sapiens
gccctggatggcaggagccatc

SEQ ID NO: 9033155 - DNA, 22 bp, Homo sapiens
gccctggatggcaggagccatc

SEQ ID NO: 9033156 - DNA, 22 bp, Homo sapiens
gccctggatggcaggagccatc

SEQ ID NO: 9033157 - DNA, 22 bp, Homo sapiens
gccctggcacctcgttgcccag

SEQ ID NO: 9033158 - DNA, 22 bp, Homo sapiens
gccctggcctcctggaacaggc

SEQ ID NO: 9033159 - DNA, 22 bp, Homo sapiens
gccctggcctggcgcgttgtca

SEQ ID NO: 9033160 - DNA, 22 bp, Homo sapiens
gccctggccttcatctcagaca

SEQ ID NO: 9033161 - DNA, 22 bp, Homo sapiens
gccctggccttcatctcagaca

SEQ ID NO: 9033162 - DNA, 22 bp, Homo sapiens
gccctgggattgggtggaggct

SEQ ID NO: 9033163 - DNA, 22 bp, Homo sapiens
gccctgggattgggtggaggct

SEQ ID NO: 9033164 - DNA, 22 bp, Homo sapiens
gccctgggattgggtggaggct

SEQ ID NO: 9033165 - DNA, 22 bp, Homo sapiens
gcctcctggttgcttctccaac

SEQ ID NO: 9033166 - DNA, 22 bp, Homo sapiens
gcctcctggttgcttctccaac

SEQ ID NO: 9033167 - DNA, 22 bp, Homo sapiens
gcctctggagtcgcagcgtctt

SEQ ID NO: 9033168 - DNA, 22 bp, Homo sapiens
gcctcctggttgcttctccaac

SEQ ID NO: 9033169 - DNA, 22 bp, Homo sapiens
gcctcctgggttcatgccattc

SEQ ID NO: 9033170 - DNA, 22 bp, Homo sapiens
gcctcctggggtgccatcatct

SEQ ID NO: 9033171 - DNA, 22 bp, Homo sapiens
gcctcctggcctttgctcctca

SEQ ID NO: 9033172 - DNA, 22 bp, Homo sapiens
gcctcctggcctttgctcctca

SEQ ID NO: 9033173 - DNA, 22 bp, Homo sapiens
gcctctggcttctgcatcagtg

SEQ ID NO: 9033174 - DNA, 22 bp, Homo sapiens
gcctctgggctctgcccctggc

SEQ ID NO: 9033175 - DNA, 22 bp, Homo sapiens
gcctctgggctctgcccctggc

SEQ ID NO: 9033176 - DNA, 22 bp, Homo sapiens
gcctctgggctctgcccctggc

SEQ ID NO: 9033177 - DNA, 22 bp, Homo sapiens
gcctctgggctctgcccctggc

SEQ ID NO: 9033178 - DNA, 22 bp, Homo sapiens
gcctctggcttctgcatcagtg

SEQ ID NO: 9033179 - DNA, 22 bp, Homo sapiens
gcctctggcttctgcatcagtg

SEQ ID NO: 9033180 - DNA, 22 bp, Homo sapiens
gcctctggagtcgcagcgtctt

SEQ ID NO: 9033181 - DNA, 22 bp, Homo sapiens
gcctctggagtcgcagcgtctt

SEQ ID NO: 9033182 - DNA, 22 bp, Homo sapiens
gcctctggagtcgcagcgtctt

SEQ ID NO: 9033183 - DNA, 22 bp, Homo sapiens
gcctcctgagaagccacaggct

SEQ ID NO: 9033184 - DNA, 22 bp, Homo sapiens
gcctcctgagaagccacaggct

SEQ ID NO: 9033185 - DNA, 22 bp, Homo sapiens
gcctcctgagaagccacaggct

SEQ ID NO: 9033186 - DNA, 22 bp, Homo sapiens
gcctcctgagaagccacaggct

SEQ ID NO: 9033187 - DNA, 22 bp, Homo sapiens
gcctcctgagaagccacaggct

SEQ ID NO: 9033188 - DNA, 22 bp, Homo sapiens
gcctcctgagaagccacaggct

SEQ ID NO: 9033189 - DNA, 22 bp, Homo sapiens
gcctcctgagtagctgggattg

SEQ ID NO: 9033190 - DNA, 22 bp, Homo sapiens
gcctcctgagtagctgggattg

SEQ ID NO: 9033191 - DNA, 22 bp, Homo sapiens
gcctcctgagaagccacaggct

SEQ ID NO: 9033192 - DNA, 22 bp, Homo sapiens
gcctcctgagaagccacaggct

SEQ ID NO: 9033193 - DNA, 22 bp, Homo sapiens
gcctcctgacttacactgagct

SEQ ID NO: 9033194 - DNA, 22 bp, Homo sapiens
gcctcctgacttacactgagct

SEQ ID NO: 9033195 - DNA, 22 bp, Homo sapiens
gcctcctgacttacactgagct

SEQ ID NO: 9033196 - DNA, 22 bp, Homo sapiens
gcctcctggaagtcacatgttt

SEQ ID NO: 9033197 - DNA, 22 bp, Homo sapiens
gcctcctggattttagtgccat

SEQ ID NO: 9033198 - DNA, 22 bp, Homo sapiens
gcctcctggattttagtgccat

SEQ ID NO: 9033199 - DNA, 22 bp, Homo sapiens
gcctcctggattttagtgccat

SEQ ID NO: 9033200 - DNA, 22 bp, Homo sapiens
gcctcctggcctttgctcctca

SEQ ID NO: 9033201 - DNA, 22 bp, Homo sapiens
gcctcctgagtagctgggattg

SEQ ID NO: 9033202 - DNA, 22 bp, Homo sapiens
gcctcctgcccagatgagtgat

SEQ ID NO: 9033203 - DNA, 22 bp, Homo sapiens
gcctcctgcccagatgagtgat

SEQ ID NO: 9033204 - DNA, 22 bp, Homo sapiens
gcctcctggaagtcacatgttt

SEQ ID NO: 9033205 - DNA, 22 bp, Homo sapiens
gcctcctgaagtgctgggatta

SEQ ID NO: 9033206 - DNA, 22 bp, Homo sapiens
gcctcctgacttacactgagct

SEQ ID NO: 9033207 - DNA, 22 bp, Homo sapiens
gcctcctgaaaggaagagctcc

SEQ ID NO: 9033208 - DNA, 22 bp, Homo sapiens
gcctcctgaagtgctgggatta

SEQ ID NO: 9033209 - DNA, 22 bp, Homo sapiens
gcctcctgaagtgctgggatta

SEQ ID NO: 9033210 - DNA, 22 bp, Homo sapiens
gcctcctcttgagggtcaggga

SEQ ID NO: 9033211 - DNA, 22 bp, Homo sapiens
gcctcctcttgagggtcaggga

SEQ ID NO: 9033212 - DNA, 22 bp, Homo sapiens
gcctcctgaaaggaagagctcc

SEQ ID NO: 9033213 - DNA, 22 bp, Homo sapiens
gcctcctgaaaggaagagctcc

SEQ ID NO: 9033214 - DNA, 22 bp, Homo sapiens
gcctcctgaaaggaagagctcc

SEQ ID NO: 9033215 - DNA, 22 bp, Homo sapiens
gcctcctaattgccactctgga

SEQ ID NO: 9033216 - DNA, 22 bp, Homo sapiens
gcctcctagagctccagggact

SEQ ID NO: 9033217 - DNA, 22 bp, Homo sapiens
gcctcctagagctccagggact

SEQ ID NO: 9033218 - DNA, 22 bp, Homo sapiens
gcctcctaccacaccctcagtc

SEQ ID NO: 9033219 - DNA, 22 bp, Homo sapiens
gcctcctattaaaatttacctt

SEQ ID NO: 9033220 - DNA, 22 bp, Homo sapiens
gcctcctcacaatgtacccacg

SEQ ID NO: 9033221 - DNA, 22 bp, Homo sapiens
gcctcctattaaaatttacctt

SEQ ID NO: 9033222 - DNA, 23 bp, Homo sapiens
gcctcctagcagtaaacatgtta

SEQ ID NO: 9033223 - DNA, 22 bp, Homo sapiens
gcctcctatcatttccttgctt

SEQ ID NO: 9033224 - DNA, 22 bp, Homo sapiens
gcctcctatggggccatcgcag

SEQ ID NO: 9033225 - DNA, 23 bp, Homo sapiens
gcctcctagcagtaaacatgtta

SEQ ID NO: 9033226 - DNA, 22 bp, Homo sapiens
gcctcctccttcccgagggtct

SEQ ID NO: 9033227 - DNA, 22 bp, Homo sapiens
gcctcctcacaatgtacccacg

SEQ ID NO: 9033228 - DNA, 22 bp, Homo sapiens
gcctcctcacaatgtacccacg

SEQ ID NO: 9033229 - DNA, 22 bp, Homo sapiens
gccctgtgtatcccctgtgctt

SEQ ID NO: 9033230 - DNA, 22 bp, Homo sapiens
gccctgtgtatcccctgtgctt

SEQ ID NO: 9033231 - DNA, 22 bp, Homo sapiens
gccctgtgtatcccctgtgctt

SEQ ID NO: 9033232 - DNA, 22 bp, Homo sapiens
gccctgtgtatcccctgtgctt

SEQ ID NO: 9033233 - DNA, 22 bp, Homo sapiens
gccctgtgtatcccctgtgctt

SEQ ID NO: 9033234 - DNA, 22 bp, Homo sapiens
gccctgtgtgatcacatgaaca

SEQ ID NO: 9033235 - DNA, 22 bp, Homo sapiens
gccctgtgtgatcacatgaaca

SEQ ID NO: 9033236 - DNA, 22 bp, Homo sapiens
gccctgtgtatcccctgtgctt

SEQ ID NO: 9033237 - DNA, 22 bp, Homo sapiens
gccctgtgtatcccctgtgctt

SEQ ID NO: 9033238 - DNA, 22 bp, Homo sapiens
gccctgtggttccaggaagcaa

SEQ ID NO: 9033239 - DNA, 22 bp, Homo sapiens
gccctgtggttccaggaagcaa

SEQ ID NO: 9033240 - DNA, 22 bp, Homo sapiens
gccctgtggttccaggaagcaa

SEQ ID NO: 9033241 - DNA, 22 bp, Homo sapiens
gcctcccttggtgtctcccggg

SEQ ID NO: 9033242 - DNA, 22 bp, Homo sapiens
gccctgttatccagatgaggat

SEQ ID NO: 9033243 - DNA, 22 bp, Homo sapiens
gcctcccttggtgtctcccggg

SEQ ID NO: 9033244 - DNA, 22 bp, Homo sapiens
gccctgtgtgtttgcactgatt

SEQ ID NO: 9033245 - DNA, 22 bp, Homo sapiens
gccctgtgtgtttgcactgatt

SEQ ID NO: 9033246 - DNA, 22 bp, Homo sapiens
gccctgtgtgtttgcactgatt

SEQ ID NO: 9033247 - DNA, 22 bp, Homo sapiens
gccctgtgtgtttgcactgatt

SEQ ID NO: 9033248 - DNA, 22 bp, Homo sapiens
gccctgtgtgatctgctgttag

SEQ ID NO: 9033249 - DNA, 22 bp, Homo sapiens
gccctgtgtgatctgctgttag

SEQ ID NO: 9033250 - DNA, 22 bp, Homo sapiens
gcctccggagtcacagtgtctt

SEQ ID NO: 9033251 - DNA, 22 bp, Homo sapiens
gcctccggagtcacagtgtctt

SEQ ID NO: 9033252 - DNA, 22 bp, Homo sapiens
gcctccggagtcacagtgtctt

SEQ ID NO: 9033253 - DNA, 22 bp, Homo sapiens
gcctccggagtcacagtgtctt

SEQ ID NO: 9033254 - DNA, 22 bp, Homo sapiens
gcctccggagttgcagtgtctt

SEQ ID NO: 9033255 - DNA, 22 bp, Homo sapiens
gcctccggagttgcagtgtctt

SEQ ID NO: 9033256 - DNA, 22 bp, Homo sapiens
gcctccggagttgcagtgtctt

SEQ ID NO: 9033257 - DNA, 22 bp, Homo sapiens
gcctccggagttgcagtgtctt

SEQ ID NO: 9033258 - DNA, 22 bp, Homo sapiens
taactctgaatcctcacagcag

SEQ ID NO: 9033259 - DNA, 22 bp, Homo sapiens
taactctagtcccaggcatgaa

SEQ ID NO: 9033260 - DNA, 22 bp, Homo sapiens
taactctagtcccaggcatgaa

SEQ ID NO: 9033261 - DNA, 22 bp, Homo sapiens
taactctagtcccaggcatgaa

SEQ ID NO: 9033262 - DNA, 22 bp, Homo sapiens
taactaggattacaagcgtgcg

SEQ ID NO: 9033263 - DNA, 22 bp, Homo sapiens
taactaggattacaagcgtgcg

SEQ ID NO: 9033264 - DNA, 22 bp, Homo sapiens
taactaggattacaagcgtgcg

SEQ ID NO: 9033265 - DNA, 22 bp, Homo sapiens
taactaggattacaagcgtgcg

SEQ ID NO: 9033266 - DNA, 22 bp, Homo sapiens
taactcatggagaggcggagtt

SEQ ID NO: 9033267 - DNA, 22 bp, Homo sapiens
taactcactccaaaaaggcatt

SEQ ID NO: 9033268 - DNA, 22 bp, Homo sapiens
taactgaacatctcaaatcaag

SEQ ID NO: 9033269 - DNA, 22 bp, Homo sapiens
taactgaacatctcaaatcaag

SEQ ID NO: 9033270 - DNA, 22 bp, Homo sapiens
taactgaatgtattacaacaga

SEQ ID NO: 9033271 - DNA, 20 bp, Homo sapiens
taactgatcattttcaccag

SEQ ID NO: 9033272 - DNA, 22 bp, Homo sapiens
taactgatgtgaacttaccatt

SEQ ID NO: 9033273 - DNA, 22 bp, Homo sapiens
taactgatattgaaaaacatca

SEQ ID NO: 9033274 - DNA, 22 bp, Homo sapiens
taactgatgttcccttactgta

SEQ ID NO: 9033275 - DNA, 22 bp, Homo sapiens
taactgatgttcccttactgta

SEQ ID NO: 9033276 - DNA, 22 bp, Homo sapiens
taactgaatgtattacaacaga

SEQ ID NO: 9033277 - DNA, 23 bp, Homo sapiens
taacctgagttttttagatgcaa

SEQ ID NO: 9033278 - DNA, 23 bp, Homo sapiens
taacctgagttttttagatgcaa

SEQ ID NO: 9033279 - DNA, 23 bp, Homo sapiens
taacctgagttttttagatgcaa

SEQ ID NO: 9033280 - DNA, 22 bp, Homo sapiens
taacctgaggagaacagtgctt

SEQ ID NO: 9033281 - DNA, 22 bp, Homo sapiens
taacctgaggagaacagtgctt

SEQ ID NO: 9033282 - DNA, 22 bp, Homo sapiens
taacctgaggagaacagtgctt

SEQ ID NO: 9033283 - DNA, 22 bp, Homo sapiens
taacctgactgctctttagaat

SEQ ID NO: 9033284 - DNA, 22 bp, Homo sapiens
taacctgactgctctttagaat

SEQ ID NO: 9033285 - DNA, 22 bp, Homo sapiens
taacctgactgctctttagaat

SEQ ID NO: 9033286 - DNA, 22 bp, Homo sapiens
taacctgactgctctttagaat

SEQ ID NO: 9033287 - DNA, 23 bp, Homo sapiens
taacctgagattgcaagggagct

SEQ ID NO: 9033288 - DNA, 23 bp, Homo sapiens
taacctgagattgcaagggagct

SEQ ID NO: 9033289 - DNA, 22 bp, Homo sapiens
taacctgaggagaacagtgctt

SEQ ID NO: 9033290 - DNA, 23 bp, Homo sapiens
taacctgagattgcaagggagct

SEQ ID NO: 9033291 - DNA, 22 bp, Homo sapiens
taactaactagtgttcaaaata

SEQ ID NO: 9033292 - DNA, 22 bp, Homo sapiens
taactacaagggcggtctctgt

SEQ ID NO: 9033293 - DNA, 22 bp, Homo sapiens
taactacaagggcggtctctgt

SEQ ID NO: 9033294 - DNA, 22 bp, Homo sapiens
taactacatttcactgcaatta

SEQ ID NO: 9033295 - DNA, 22 bp, Homo sapiens
taactacatttcactgcaatta

SEQ ID NO: 9033296 - DNA, 22 bp, Homo sapiens
taactacatttcactgcaatta

SEQ ID NO: 9033297 - DNA, 22 bp, Homo sapiens
taactactaattgatgataatg

SEQ ID NO: 9033298 - DNA, 22 bp, Homo sapiens
taactacatttcactgcaatta

SEQ ID NO: 9033299 - DNA, 23 bp, Homo sapiens
taactaggaatagtttaccctta

SEQ ID NO: 9033300 - DNA, 22 bp, Homo sapiens
taactagaatggctattttgag

SEQ ID NO: 9033301 - DNA, 22 bp, Homo sapiens
taaattcactcctggtagacct

SEQ ID NO: 9033302 - DNA, 22 bp, Homo sapiens
taaattcagtgagtaatttctg

SEQ ID NO: 9033303 - DNA, 22 bp, Homo sapiens
taaattcccaactctgctcttc

SEQ ID NO: 9033304 - DNA, 22 bp, Homo sapiens
taaattcagtgagtaatttctg

SEQ ID NO: 9033305 - DNA, 22 bp, Homo sapiens
taaattcagtgagtaatttctg

SEQ ID NO: 9033306 - DNA, 22 bp, Homo sapiens
taaattgaaaatctacagaaca

SEQ ID NO: 9033307 - DNA, 22 bp, Homo sapiens
taaattgaaaatctacagaaca

SEQ ID NO: 9033308 - DNA, 22 bp, Homo sapiens
taaattgaaaatctacagaaca

SEQ ID NO: 9033309 - DNA, 22 bp, Homo sapiens
taaattgaaaatctacagaaca

SEQ ID NO: 9033310 - DNA, 22 bp, Homo sapiens
taaattctacaacttcaaagat

SEQ ID NO: 9033311 - DNA, 22 bp, Homo sapiens
taaattctacaacttcaaagat

SEQ ID NO: 9033312 - DNA, 22 bp, Homo sapiens
taaattctacaacttcaaagat

SEQ ID NO: 9033313 - DNA, 22 bp, Homo sapiens
taaattgagattattagggtaa

SEQ ID NO: 9033314 - DNA, 23 bp, Homo sapiens
taaattgatggtatgggttaagc

SEQ ID NO: 9033315 - DNA, 22 bp, Homo sapiens
taaatttacccaaggaacatgt

SEQ ID NO: 9033316 - DNA, 22 bp, Homo sapiens
taaattgttttctagaagttgt

SEQ ID NO: 9033317 - DNA, 18 bp, Homo sapiens
taacatgttttcattaag

SEQ ID NO: 9033318 - DNA, 22 bp, Homo sapiens
taacattaaaagagataattga

SEQ ID NO: 9033319 - DNA, 23 bp, Homo sapiens
taaatttcttgattcttatgtga

SEQ ID NO: 9033320 - DNA, 23 bp, Homo sapiens
taaatttcttgattcttatgtga

SEQ ID NO: 9033321 - DNA, 22 bp, Homo sapiens
taacattacagacaccttgtgt

SEQ ID NO: 9033322 - DNA, 22 bp, Homo sapiens
taaccaaagggcctaaggaatg

SEQ ID NO: 9033323 - DNA, 22 bp, Homo sapiens
taacattacggacatctgtcag

SEQ ID NO: 9033324 - DNA, 22 bp, Homo sapiens
taacattaaaagagataattga

SEQ ID NO: 9033325 - DNA, 22 bp, Homo sapiens
taacattaaaagagataattga

SEQ ID NO: 9033326 - DNA, 22 bp, Homo sapiens
taaccatattttccattaagtt

SEQ ID NO: 9033327 - DNA, 22 bp, Homo sapiens
taacctacatgagaactttaaa

SEQ ID NO: 9033328 - DNA, 22 bp, Homo sapiens
taacctctctgtgcctcagttt

SEQ ID NO: 9033329 - DNA, 17 bp, Homo sapiens
taacctctctgaacctg

SEQ ID NO: 9033330 - DNA, 22 bp, Homo sapiens
taacctctatttttataaaagt

SEQ ID NO: 9033331 - DNA, 22 bp, Homo sapiens
taacctctgagctccagcttct

SEQ ID NO: 9033332 - DNA, 22 bp, Homo sapiens
taacctgaacacacaataggga

SEQ ID NO: 9033333 - DNA, 22 bp, Homo sapiens
taacctgaacacacaataggga

SEQ ID NO: 9033334 - DNA, 22 bp, Homo sapiens
taacctgaacacacaataggga

SEQ ID NO: 9033335 - DNA, 22 bp, Homo sapiens
taaccacattattatgggttct

SEQ ID NO: 9033336 - DNA, 22 bp, Homo sapiens
taaccaataaccaataagatac

SEQ ID NO: 9033337 - DNA, 22 bp, Homo sapiens
taaccaagcaaactttcattgt

SEQ ID NO: 9033338 - DNA, 22 bp, Homo sapiens
taaccaataaccaataagatac

SEQ ID NO: 9033339 - DNA, 22 bp, Homo sapiens
taaccaaagggcctaaggaatg

SEQ ID NO: 9033340 - DNA, 22 bp, Homo sapiens
taaccagcatgaaatctgcagc

SEQ ID NO: 9033341 - DNA, 22 bp, Homo sapiens
taaccatattttccattaagtt

SEQ ID NO: 9033342 - DNA, 22 bp, Homo sapiens
taaagtgctcataaaaatggat

SEQ ID NO: 9033343 - DNA, 22 bp, Homo sapiens
taaagtgctcataaaaatggat

SEQ ID NO: 9033344 - DNA, 22 bp, Homo sapiens
taaagtgctcataaaaatggat

SEQ ID NO: 9033345 - DNA, 23 bp, Homo sapiens
taaagtgctgatggtgagggagc

SEQ ID NO: 9033346 - DNA, 23 bp, Homo sapiens
taaagtgctgatggtgagggagc

SEQ ID NO: 9033347 - DNA, 22 bp, Homo sapiens
taaagtgcgacccagtccccag

SEQ ID NO: 9033348 - DNA, 22 bp, Homo sapiens
taaagtgctcataaaaatggat

SEQ ID NO: 9033349 - DNA, 22 bp, Homo sapiens
taaagtgcctcaggtcctgggt

SEQ ID NO: 9033350 - DNA, 22 bp, Homo sapiens
taaagtgcgacccagtccccag

SEQ ID NO: 9033351 - DNA, 22 bp, Homo sapiens
taaagtgcctcaggtcctgggt

SEQ ID NO: 9033352 - DNA, 22 bp, Homo sapiens
taaagtgcttatgataaccaag

SEQ ID NO: 9033353 - DNA, 22 bp, Homo sapiens
taaagtgcttatgataaccaag

SEQ ID NO: 9033354 - DNA, 22 bp, Homo sapiens
taaagtgctgggattataggcc

SEQ ID NO: 9033355 - DNA, 22 bp, Homo sapiens
taaagtgctgggattataggcc

SEQ ID NO: 9033356 - DNA, 22 bp, Homo sapiens
taaagtgctggatttgagtaaa

SEQ ID NO: 9033357 - DNA, 22 bp, Homo sapiens
taaagtgctggatttgagtaaa

SEQ ID NO: 9033358 - DNA, 22 bp, Homo sapiens
taaagtgctggatttgagtaaa

SEQ ID NO: 9033359 - DNA, 22 bp, Homo sapiens
taaagtgctggatttgagtaaa

SEQ ID NO: 9033360 - DNA, 23 bp, Homo sapiens
taaagtgctgatggtgagggagc

SEQ ID NO: 9033361 - DNA, 22 bp, Homo sapiens
taaagtataagcattggagtat

SEQ ID NO: 9033362 - DNA, 22 bp, Homo sapiens
taaagtatattttttctcaata

SEQ ID NO: 9033363 - DNA, 22 bp, Homo sapiens
taaagtataagcattggagtat

SEQ ID NO: 9033364 - DNA, 22 bp, Homo sapiens
taaagtatattttttctcaata

SEQ ID NO: 9033365 - DNA, 22 bp, Homo sapiens
taaagtatccagttattcttct

SEQ ID NO: 9033366 - DNA, 22 bp, Homo sapiens
taaagtatccagttattcttct

SEQ ID NO: 9033367 - DNA, 22 bp, Homo sapiens
taaagtatattttttctcaata

SEQ ID NO: 9033368 - DNA, 22 bp, Homo sapiens
taaagtatattttttctcaata

SEQ ID NO: 9033369 - DNA, 22 bp, Homo sapiens
taaagtatccagttattcttct

SEQ ID NO: 9033370 - DNA, 22 bp, Homo sapiens
taaagtcaaaatatgggtaggc

SEQ ID NO: 9033371 - DNA, 22 bp, Homo sapiens
taaagtcaaaatatgggtaggc

SEQ ID NO: 9033372 - DNA, 22 bp, Homo sapiens
taaagtatccagttattcttct

SEQ ID NO: 9033373 - DNA, 22 bp, Homo sapiens
taaagtgcctcaggtcctgggt

SEQ ID NO: 9033374 - DNA, 22 bp, Homo sapiens
taaagtcaaggtactgtttcac

SEQ ID NO: 9033375 - DNA, 22 bp, Homo sapiens
taaagtcaaggtactgtttcac

SEQ ID NO: 9033376 - DNA, 22 bp, Homo sapiens
taaagtgcccagggaaagcggg

SEQ ID NO: 9033377 - DNA, 22 bp, Homo sapiens
taaaggtacgaagtgagggatt

SEQ ID NO: 9033378 - DNA, 22 bp, Homo sapiens
taaaggtaacatgaactgcttt

SEQ ID NO: 9033379 - DNA, 22 bp, Homo sapiens
taaaggtagcatgaaactgcaa

SEQ ID NO: 9033380 - DNA, 22 bp, Homo sapiens
taaaggtagtgtgacatattgt

SEQ ID NO: 9033381 - DNA, 22 bp, Homo sapiens
taaaggtagtgtgacatattgt

SEQ ID NO: 9033382 - DNA, 22 bp, Homo sapiens
taaaggtagtgtgacatattgt

SEQ ID NO: 9033383 - DNA, 22 bp, Homo sapiens
taaaggtagtgtgacatattgt

SEQ ID NO: 9033384 - DNA, 22 bp, Homo sapiens
taaaggtatgtcttaatcaaac

SEQ ID NO: 9033385 - DNA, 22 bp, Homo sapiens
taaaggtatgtcttaatcaaac

SEQ ID NO: 9033386 - DNA, 22 bp, Homo sapiens
taaaggttagtagcagggaaac

SEQ ID NO: 9033387 - DNA, 22 bp, Homo sapiens
taaaggttataaaggttagggg

SEQ ID NO: 9033388 - DNA, 22 bp, Homo sapiens
taaagtaatccttcataaggag

SEQ ID NO: 9033389 - DNA, 22 bp, Homo sapiens
taaagtaatccttcataaggag

SEQ ID NO: 9033390 - DNA, 22 bp, Homo sapiens
taaagtagcaagtttagactga

SEQ ID NO: 9033391 - DNA, 22 bp, Homo sapiens
taaagtataagcattggagtat

SEQ ID NO: 9033392 - DNA, 22 bp, Homo sapiens
taaagtagcgcctaactaatgt

SEQ ID NO: 9033393 - DNA, 22 bp, Homo sapiens
taaagtataagcattggagtat

SEQ ID NO: 9033394 - DNA, 22 bp, Homo sapiens
taaaggttagtagcagggaaac

SEQ ID NO: 9033395 - DNA, 22 bp, Homo sapiens
taaaggttataaaggttagggg

SEQ ID NO: 9033396 - DNA, 22 bp, Homo sapiens
taaaggttattgcactggagtt

SEQ ID NO: 9033397 - DNA, 22 bp, Homo sapiens
taaaggttattgcactggagtt

SEQ ID NO: 9033398 - DNA, 22 bp, Homo sapiens
taaaggttgaaaactgactgcc

SEQ ID NO: 9033399 - DNA, 22 bp, Homo sapiens
taaagtaatccttcataaggag

SEQ ID NO: 9033400 - DNA, 22 bp, Homo sapiens
taaaggtatgtcttaatcaaac

SEQ ID NO: 9033401 - DNA, 22 bp, Homo sapiens
taaaggtttattcaacaaaata

SEQ ID NO: 9033402 - DNA, 22 bp, Homo sapiens
taaaggtttattcaacaaaata

SEQ ID NO: 9033403 - DNA, 22 bp, Homo sapiens
taaagtgcttcctaacccagag

SEQ ID NO: 9033404 - DNA, 22 bp, Homo sapiens
taaagtgcttcctaacccagag

SEQ ID NO: 9033405 - DNA, 22 bp, Homo sapiens
taaagtgcttatgataaccaag

SEQ ID NO: 9033406 - DNA, 22 bp, Homo sapiens
taaagtgcttcctaacccagag

SEQ ID NO: 9033407 - DNA, 22 bp, Homo sapiens
taaagtggtggtgctaatgtat

SEQ ID NO: 9033408 - DNA, 22 bp, Homo sapiens
taaagtgggcaaactctcatgg

SEQ ID NO: 9033409 - DNA, 22 bp, Homo sapiens
taaagtggtggtgctaatgtat

SEQ ID NO: 9033410 - DNA, 22 bp, Homo sapiens
taaagtggaaggatccactaag

SEQ ID NO: 9033411 - DNA, 22 bp, Homo sapiens
taaagtgcttcctaacccagag

SEQ ID NO: 9033412 - DNA, 22 bp, Homo sapiens
taaattaaagattggagaagga

SEQ ID NO: 9033413 - DNA, 22 bp, Homo sapiens
taaattaaagattggagaagga

SEQ ID NO: 9033414 - DNA, 22 bp, Homo sapiens
taaattaaagattggagaagga

SEQ ID NO: 9033415 - DNA, 22 bp, Homo sapiens
taaagtgtgcatggtcaaatat

SEQ ID NO: 9033416 - DNA, 22 bp, Homo sapiens
taaattaaagattggagaagga

SEQ ID NO: 9033417 - DNA, 23 bp, Homo sapiens
taaattacctttccagtgcaggg

SEQ ID NO: 9033418 - DNA, 22 bp, Homo sapiens
taaattaaagattggagaagga

SEQ ID NO: 9033419 - DNA, 22 bp, Homo sapiens
taaattaaagattggagaagga

SEQ ID NO: 9033420 - DNA, 22 bp, Homo sapiens
taaattaaagattggagaagga

SEQ ID NO: 9033421 - DNA, 22 bp, Homo sapiens
taaattactcaatgcacataaa

SEQ ID NO: 9033422 - DNA, 22 bp, Homo sapiens
taaattactcaatgcacataaa

SEQ ID NO: 9033423 - DNA, 22 bp, Homo sapiens
taaattactcaatgcacataaa

SEQ ID NO: 9033424 - DNA, 22 bp, Homo sapiens
taaattagagccaggtaagttt

SEQ ID NO: 9033425 - DNA, 22 bp, Homo sapiens
taaattagagccaggtaagttt

SEQ ID NO: 9033426 - DNA, 20 bp, Homo sapiens
taaattagccttgaagatta

SEQ ID NO: 9033427 - DNA, 20 bp, Homo sapiens
taaattagccttgaagatta

SEQ ID NO: 9033428 - DNA, 22 bp, Homo sapiens
taaattatgttccatgtccttt

SEQ ID NO: 9033429 - DNA, 22 bp, Homo sapiens
taaattatgttccatgtccttt

SEQ ID NO: 9033430 - DNA, 22 bp, Homo sapiens
taaattatgttccatgtccttt

SEQ ID NO: 9033431 - DNA, 22 bp, Homo sapiens
taaattatgttccatgtccttt

SEQ ID NO: 9033432 - DNA, 22 bp, Homo sapiens
taaattatgttccatgtccttt

SEQ ID NO: 9033433 - DNA, 22 bp, Homo sapiens
taaattcactcctggtagacct

SEQ ID NO: 9033434 - DNA, 22 bp, Homo sapiens
taaattatgtcacatgactctg

SEQ ID NO: 9033435 - DNA, 22 bp, Homo sapiens
taaattatgtcacatgactctg

SEQ ID NO: 9033436 - DNA, 22 bp, Homo sapiens
taaattatgtcacatgactctg

SEQ ID NO: 9033437 - DNA, 22 bp, Homo sapiens
taaattatggctggcagagcag

SEQ ID NO: 9033438 - DNA, 22 bp, Homo sapiens
taaattagggactttagttaat

SEQ ID NO: 9033439 - DNA, 22 bp, Homo sapiens
taaattagggactttagttaat

SEQ ID NO: 9033440 - DNA, 22 bp, Homo sapiens
taaattatggctggcagagcag

SEQ ID NO: 9033441 - DNA, 22 bp, Homo sapiens
taaattatggctggcagagcag

SEQ ID NO: 9033442 - DNA, 22 bp, Homo sapiens
taaattatggctggcagagcag

SEQ ID NO: 9033443 - DNA, 22 bp, Homo sapiens
taaattatggctggcagagcag

SEQ ID NO: 9033444 - DNA, 20 bp, Homo sapiens
taaattagccttgaagatta

SEQ ID NO: 9033445 - DNA, 20 bp, Homo sapiens
taaattagccttgaagatta

SEQ ID NO: 9033446 - DNA, 20 bp, Homo sapiens
taaattagccttgaagatta

SEQ ID NO: 9033447 - DNA, 20 bp, Homo sapiens
taaattagccttgaagatta

SEQ ID NO: 9033448 - DNA, 20 bp, Homo sapiens
taaattagccttgaagatta

SEQ ID NO: 9033449 - DNA, 22 bp, Homo sapiens
taaattagggactttagttaat

SEQ ID NO: 9033450 - DNA, 22 bp, Homo sapiens
taaattagggactttagttaat

SEQ ID NO: 9033451 - DNA, 20 bp, Homo sapiens
taaattagccttgaagatta

SEQ ID NO: 9033452 - DNA, 22 bp, Homo sapiens
taaacaagaaacattttctgtt

SEQ ID NO: 9033453 - DNA, 22 bp, Homo sapiens
taaacaagctggactgataagt

SEQ ID NO: 9033454 - DNA, 22 bp, Homo sapiens
taaaatttgtccctgagtgttg

SEQ ID NO: 9033455 - DNA, 22 bp, Homo sapiens
taaaatttgtccctgagtgttg

SEQ ID NO: 9033456 - DNA, 22 bp, Homo sapiens
taaaatttgtccctgagtgttg

SEQ ID NO: 9033457 - DNA, 22 bp, Homo sapiens
taaaatttgtccctgagtgttg

SEQ ID NO: 9033458 - DNA, 22 bp, Homo sapiens
taaaatttgtccctgagtgttg

SEQ ID NO: 9033459 - DNA, 22 bp, Homo sapiens
taaaatttgtccctgagtgttg

SEQ ID NO: 9033460 - DNA, 22 bp, Homo sapiens
taaaattgcggtgaatatttcc

SEQ ID NO: 9033461 - DNA, 22 bp, Homo sapiens
taaaattgcggtgaatatttcc

SEQ ID NO: 9033462 - DNA, 22 bp, Homo sapiens
taaaatttgtccctgagtgttg

SEQ ID NO: 9033463 - DNA, 22 bp, Homo sapiens
taaaatttgtccctgagtgttg

SEQ ID NO: 9033464 - DNA, 22 bp, Homo sapiens
taaaatgtgtttctgtatggtt

SEQ ID NO: 9033465 - DNA, 22 bp, Homo sapiens
taaaatgtgtttctgtatggtt

SEQ ID NO: 9033466 - DNA, 22 bp, Homo sapiens
taaaatgtgtttctgtatggtt

SEQ ID NO: 9033467 - DNA, 22 bp, Homo sapiens
taaaatgtgtttctgtatggtt

SEQ ID NO: 9033468 - DNA, 22 bp, Homo sapiens
taaaatgtgtttctgtatggtt

SEQ ID NO: 9033469 - DNA, 22 bp, Homo sapiens
taaaatgtttgcaagagaccag

SEQ ID NO: 9033470 - DNA, 18 bp, Homo sapiens
taaaattcaaggcagggt

SEQ ID NO: 9033471 - DNA, 18 bp, Homo sapiens
taaaattcaaggcagggt

SEQ ID NO: 9033472 - DNA, 22 bp, Homo sapiens
taaaattgcggtgaatatttcc

SEQ ID NO: 9033473 - DNA, 22 bp, Homo sapiens
taaaattgcggtgaatatttcc

SEQ ID NO: 9033474 - DNA, 22 bp, Homo sapiens
taaacaagctgtctgatattct

SEQ ID NO: 9033475 - DNA, 22 bp, Homo sapiens
taaacaagctggactgataagt

SEQ ID NO: 9033476 - DNA, 22 bp, Homo sapiens
taaacaagctggactgataagt

SEQ ID NO: 9033477 - DNA, 22 bp, Homo sapiens
taaacaagaaacattttctgtt

SEQ ID NO: 9033478 - DNA, 22 bp, Homo sapiens
taaacaagggttactgagcatg

SEQ ID NO: 9033479 - DNA, 22 bp, Homo sapiens
taaacaagctgtctgatattct

SEQ ID NO: 9033480 - DNA, 22 bp, Homo sapiens
taaacaagggttactgagcatg

SEQ ID NO: 9033481 - DNA, 22 bp, Homo sapiens
taaacaagggttactgagcatg

SEQ ID NO: 9033482 - DNA, 22 bp, Homo sapiens
taaacactcacttcatagccat

SEQ ID NO: 9033483 - DNA, 22 bp, Homo sapiens
taaacaattcctctctaggcat

SEQ ID NO: 9033484 - DNA, 22 bp, Homo sapiens
taaacaattcctctctaggcat

SEQ ID NO: 9033485 - DNA, 22 bp, Homo sapiens
taaacaattcctctctaggcat

SEQ ID NO: 9033486 - DNA, 22 bp, Homo sapiens
taaacactgccttggtgggtca

SEQ ID NO: 9033487 - DNA, 22 bp, Homo sapiens
taaacagaatgcgtaagaagtg

SEQ ID NO: 9033488 - DNA, 22 bp, Homo sapiens
taaacagaaagcagatgtactt

SEQ ID NO: 9033489 - DNA, 22 bp, Homo sapiens
taaacactgccttggtgggtca

SEQ ID NO: 9033490 - DNA, 22 bp, Homo sapiens
taaaggcttttagtgatggtaa

SEQ ID NO: 9033491 - DNA, 22 bp, Homo sapiens
taaacagaattcaggcaagata

SEQ ID NO: 9033492 - DNA, 22 bp, Homo sapiens
taaagggtaggttttactgtaa

SEQ ID NO: 9033493 - DNA, 22 bp, Homo sapiens
taaagggtaggttttactgtaa

SEQ ID NO: 9033494 - DNA, 19 bp, Homo sapiens
gttttgtttgcagaactta

SEQ ID NO: 9033495 - DNA, 22 bp, Homo sapiens
gttttgttttgagtcaactcca

SEQ ID NO: 9033496 - DNA, 19 bp, Homo sapiens
gttttgtttgcagaactta

SEQ ID NO: 9033497 - DNA, 22 bp, Homo sapiens
gttttgttttgagtcaactcca

SEQ ID NO: 9033498 - DNA, 22 bp, Homo sapiens
gttttgttttgagtcaactcca

SEQ ID NO: 9033499 - DNA, 22 bp, Homo sapiens
gtttttatctaatagcagttat

SEQ ID NO: 9033500 - DNA, 22 bp, Homo sapiens
gtttttatatcctgtggagtgt

SEQ ID NO: 9033501 - DNA, 19 bp, Homo sapiens
gtttttagtttctgaactg

SEQ ID NO: 9033502 - DNA, 22 bp, Homo sapiens
gtttttactaaggttgctaagt

SEQ ID NO: 9033503 - DNA, 22 bp, Homo sapiens
gtttttattgtgtaaatgtggg

SEQ ID NO: 9033504 - DNA, 22 bp, Homo sapiens
gtttttattgtgtaaatgtggg

SEQ ID NO: 9033505 - DNA, 22 bp, Homo sapiens
taaaagttttagttgtacataa

SEQ ID NO: 9033506 - DNA, 22 bp, Homo sapiens
taaaagttttagttgtacataa

SEQ ID NO: 9033507 - DNA, 22 bp, Homo sapiens
taaaagttagctaggacaaagt

SEQ ID NO: 9033508 - DNA, 19 bp, Homo sapiens
taaaatgtctgtggtcagt

SEQ ID NO: 9033509 - DNA, 19 bp, Homo sapiens
taaaatgtctgtggtcagt

SEQ ID NO: 9033510 - DNA, 19 bp, Homo sapiens
taaaatgtctgtggtcagt

SEQ ID NO: 9033511 - DNA, 22 bp, Homo sapiens
taaaatgtagcttctaggctgg

SEQ ID NO: 9033512 - DNA, 19 bp, Homo sapiens
taaaatgtctgtggtcagt

SEQ ID NO: 9033513 - DNA, 19 bp, Homo sapiens
taaaatgtctgtggtcagt

SEQ ID NO: 9033514 - DNA, 19 bp, Homo sapiens
taaaatgtctgtggtcagt

SEQ ID NO: 9033515 - DNA, 19 bp, Homo sapiens
taaaatgtctgtggtcagt

SEQ ID NO: 9033516 - DNA, 22 bp, Homo sapiens
taaaatgtgtttctgtatggtt

SEQ ID NO: 9033517 - DNA, 22 bp, Homo sapiens
taaaatggtaactttcatttgc

SEQ ID NO: 9033518 - DNA, 22 bp, Homo sapiens
taaaatggtaactttcatttgc

SEQ ID NO: 9033519 - DNA, 22 bp, Homo sapiens
taaaatgtagcttctaggctgg

SEQ ID NO: 9033520 - DNA, 22 bp, Homo sapiens
taaaatgtagcttctaggctgg

SEQ ID NO: 9033521 - DNA, 22 bp, Homo sapiens
taaaatggtaactttcatttgc

SEQ ID NO: 9033522 - DNA, 22 bp, Homo sapiens
taaaatggtaactttcatttgc

SEQ ID NO: 9033523 - DNA, 22 bp, Homo sapiens
taaaatgatctctcatgttctt

SEQ ID NO: 9033524 - DNA, 22 bp, Homo sapiens
taaaatagaggatgtcatgcta

SEQ ID NO: 9033525 - DNA, 22 bp, Homo sapiens
taaaatgatctctcatgttctt

SEQ ID NO: 9033526 - DNA, 22 bp, Homo sapiens
taaaatgcacagcagttgaaag

SEQ ID NO: 9033527 - DNA, 22 bp, Homo sapiens
taaaatgatctctcatgttctt

SEQ ID NO: 9033528 - DNA, 22 bp, Homo sapiens
taaaatagaggatgtcatgcta

SEQ ID NO: 9033529 - DNA, 22 bp, Homo sapiens
taaaatagaggatgtcatgcta

SEQ ID NO: 9033530 - DNA, 22 bp, Homo sapiens
taaaatagaggatgtcatgcta

SEQ ID NO: 9033531 - DNA, 22 bp, Homo sapiens
taaaatagaggatgtcatgcta

SEQ ID NO: 9033532 - DNA, 22 bp, Homo sapiens
taaaatagaggatgtcatgcta

SEQ ID NO: 9033533 - DNA, 22 bp, Homo sapiens
taaaatagaggatgtcatgcta

SEQ ID NO: 9033534 - DNA, 22 bp, Homo sapiens
taaaatagaggatgtcatgcta

SEQ ID NO: 9033535 - DNA, 22 bp, Homo sapiens
taaaagttttagttgtacataa

SEQ ID NO: 9033536 - DNA, 22 bp, Homo sapiens
taaaagttttagttgtacataa

SEQ ID NO: 9033537 - DNA, 22 bp, Homo sapiens
taaaagttttagttgtacataa

SEQ ID NO: 9033538 - DNA, 18 bp, Homo sapiens
gttttgaattgtcttaca

SEQ ID NO: 9033539 - DNA, 18 bp, Homo sapiens
gttttgaattgtcttaca

SEQ ID NO: 9033540 - DNA, 18 bp, Homo sapiens
gttttgaattgtcttaca

SEQ ID NO: 9033541 - DNA, 22 bp, Homo sapiens
gttttgatatatgcatacatta

SEQ ID NO: 9033542 - DNA, 22 bp, Homo sapiens
gttttgatatatgcatacatta

SEQ ID NO: 9033543 - DNA, 22 bp, Homo sapiens
gttttgcagagtgcaataaatc

SEQ ID NO: 9033544 - DNA, 21 bp, Homo sapiens
gttttgctggtatctggggat

SEQ ID NO: 9033545 - DNA, 19 bp, Homo sapiens
gttttgcaggcagagggga

SEQ ID NO: 9033546 - DNA, 19 bp, Homo sapiens
gttttgcaggcagagggga

SEQ ID NO: 9033547 - DNA, 22 bp, Homo sapiens
gttttgcagagtgcaataaatc

SEQ ID NO: 9033548 - DNA, 22 bp, Homo sapiens
gttttgcagagtgcaataaatc

SEQ ID NO: 9033549 - DNA, 22 bp, Homo sapiens
gttttggagtcaggcttagatg

SEQ ID NO: 9033550 - DNA, 22 bp, Homo sapiens
gttttggtaagaatagtcatcc

SEQ ID NO: 9033551 - DNA, 22 bp, Homo sapiens
gttttgtgaggcacccacaggt

SEQ ID NO: 9033552 - DNA, 22 bp, Homo sapiens
gttttggtaagaatagtcatcc

SEQ ID NO: 9033553 - DNA, 22 bp, Homo sapiens
gttttgtgaggcacccacaggt

SEQ ID NO: 9033554 - DNA, 22 bp, Homo sapiens
gttttggtaggactgtaaaaga

SEQ ID NO: 9033555 - DNA, 22 bp, Homo sapiens
gttttgttgctgcagagctcaa

SEQ ID NO: 9033556 - DNA, 22 bp, Homo sapiens
gttttgttgctgcagagctcaa

SEQ ID NO: 9033557 - DNA, 22 bp, Homo sapiens
gttttgttcttgtccagggaaa

SEQ ID NO: 9033558 - DNA, 22 bp, Homo sapiens
gttttgttcatgaacattgggt

SEQ ID NO: 9033559 - DNA, 21 bp, Homo sapiens
gttttctttgatagagggaag

SEQ ID NO: 9033560 - DNA, 21 bp, Homo sapiens
gttttctttgatagagggaag

SEQ ID NO: 9033561 - DNA, 21 bp, Homo sapiens
gttttctttgatagagggaag

SEQ ID NO: 9033562 - DNA, 21 bp, Homo sapiens
gttttctttgatagagggaag

SEQ ID NO: 9033563 - DNA, 22 bp, Homo sapiens
gttttctttgaatgcttctaga

SEQ ID NO: 9033564 - DNA, 22 bp, Homo sapiens
gttttgaaatgaaagaaccaag

SEQ ID NO: 9033565 - DNA, 22 bp, Homo sapiens
gttttgaaatgaaagaaccaag

SEQ ID NO: 9033566 - DNA, 22 bp, Homo sapiens
gttttctttgaatgcttctaga

SEQ ID NO: 9033567 - DNA, 22 bp, Homo sapiens
gttttctttgaatgcttctaga

SEQ ID NO: 9033568 - DNA, 22 bp, Homo sapiens
gttttctttgaatgcttctaga

SEQ ID NO: 9033569 - DNA, 22 bp, Homo sapiens
gttttctttgaatgcttctaga

SEQ ID NO: 9033570 - DNA, 22 bp, Homo sapiens
gttttcttcctgcaattggcat

SEQ ID NO: 9033571 - DNA, 22 bp, Homo sapiens
gttttcttcctgcaattggcat

SEQ ID NO: 9033572 - DNA, 22 bp, Homo sapiens
gttttcttcctgcaattggcat

SEQ ID NO: 9033573 - DNA, 22 bp, Homo sapiens
gttttcttcctgcaattggcat

SEQ ID NO: 9033574 - DNA, 22 bp, Homo sapiens
gttttcattactgctgtgattt

SEQ ID NO: 9033575 - DNA, 22 bp, Homo sapiens
gttttcattactgctgtgattt

SEQ ID NO: 9033576 - DNA, 22 bp, Homo sapiens
gttttcattactgctgtgattt

SEQ ID NO: 9033577 - DNA, 22 bp, Homo sapiens
gttttcatgtctattgggcata

SEQ ID NO: 9033578 - DNA, 22 bp, Homo sapiens
gttttcattactgctgtgattt

SEQ ID NO: 9033579 - DNA, 22 bp, Homo sapiens
gttttcatgtctattgggcata

SEQ ID NO: 9033580 - DNA, 22 bp, Homo sapiens
gttttcattactgctgtgattt

SEQ ID NO: 9033581 - DNA, 22 bp, Homo sapiens
gtttccaggcactttttctgct

SEQ ID NO: 9033582 - DNA, 22 bp, Homo sapiens
gtttccaggaggctacacctga

SEQ ID NO: 9033583 - DNA, 22 bp, Homo sapiens
gtttccaggaagggttgggagg

SEQ ID NO: 9033584 - DNA, 22 bp, Homo sapiens
gtttccagctttctgatgcttg

SEQ ID NO: 9033585 - DNA, 22 bp, Homo sapiens
gtttccagcttgggcccgggga

SEQ ID NO: 9033586 - DNA, 22 bp, Homo sapiens
gtttccagagggaatatttgct

SEQ ID NO: 9033587 - DNA, 22 bp, Homo sapiens
gtttccagagtgagggcacttg

SEQ ID NO: 9033588 - DNA, 22 bp, Homo sapiens
gtttccagccaatcccctcagg

SEQ ID NO: 9033589 - DNA, 22 bp, Homo sapiens
gtttccagcctcctgggtaaag

SEQ ID NO: 9033590 - DNA, 22 bp, Homo sapiens
gtttccagagggaatatttgct

SEQ ID NO: 9033591 - DNA, 22 bp, Homo sapiens
gtttccagagatcatttacata

SEQ ID NO: 9033592 - DNA, 22 bp, Homo sapiens
gtttccacttgagaggactcct

SEQ ID NO: 9033593 - DNA, 22 bp, Homo sapiens
gtttccaagttttctttgagct

SEQ ID NO: 9033594 - DNA, 22 bp, Homo sapiens
gtttccacttatatggtaccta

SEQ ID NO: 9033595 - DNA, 22 bp, Homo sapiens
gtttccacttgagaggactcct

SEQ ID NO: 9033596 - DNA, 22 bp, Homo sapiens
gtttccacgtctcagttccaaa

SEQ ID NO: 9033597 - DNA, 22 bp, Homo sapiens
gtttccacgtctcagttccaaa

SEQ ID NO: 9033598 - DNA, 22 bp, Homo sapiens
gtttccacttatatggtaccta

SEQ ID NO: 9033599 - DNA, 22 bp, Homo sapiens
gtttccaagtctctcaacaccc

SEQ ID NO: 9033600 - DNA, 22 bp, Homo sapiens
gtttccaagatgctgccatcag

SEQ ID NO: 9033601 - DNA, 22 bp, Homo sapiens
gtttccaagtctctcaacaccc

SEQ ID NO: 9033602 - DNA, 22 bp, Homo sapiens
gtttccaaccccaccaaagtgc

SEQ ID NO: 9033603 - DNA, 22 bp, Homo sapiens
gtttccaaccccaccaaagtgc

SEQ ID NO: 9033604 - DNA, 21 bp, Homo sapiens
gtttccaacaaacctctgctt

SEQ ID NO: 9033605 - DNA, 20 bp, Homo sapiens
gtttccaaattgtgcatttt

SEQ ID NO: 9033606 - DNA, 20 bp, Homo sapiens
gtttccaaattgtgcatttt

SEQ ID NO: 9033607 - DNA, 20 bp, Homo sapiens
gtttccaaattgtgcatttt

SEQ ID NO: 9033608 - DNA, 22 bp, Homo sapiens
gtttcatttacatctgtaggta

SEQ ID NO: 9033609 - DNA, 22 bp, Homo sapiens
gtttcatttacatctgtaggta

SEQ ID NO: 9033610 - DNA, 21 bp, Homo sapiens
gtttccaacaaacctctgctt

SEQ ID NO: 9033611 - DNA, 22 bp, Homo sapiens
gtttccaactagtatgatcagg

SEQ ID NO: 9033612 - DNA, 22 bp, Homo sapiens
gtttccaactagtatgatcagg

SEQ ID NO: 9033613 - DNA, 22 bp, Homo sapiens
gtttccaaccccaccaaagtgc

SEQ ID NO: 9033614 - DNA, 22 bp, Homo sapiens
gtttccaagatgctgccatcag

SEQ ID NO: 9033615 - DNA, 22 bp, Homo sapiens
gtttccaagatgctgccatcag

SEQ ID NO: 9033616 - DNA, 22 bp, Homo sapiens
gtttccaagtctctcaacaccc

SEQ ID NO: 9033617 - DNA, 22 bp, Homo sapiens
gtttccaagatgctgccatcag

SEQ ID NO: 9033618 - DNA, 22 bp, Homo sapiens
gtttccatgcagtagagcttag

SEQ ID NO: 9033619 - DNA, 22 bp, Homo sapiens
gtttccatgaaaatgtttctgc

SEQ ID NO: 9033620 - DNA, 22 bp, Homo sapiens
gtttccatctccaggacataat

SEQ ID NO: 9033621 - DNA, 22 bp, Homo sapiens
gtttccagggctctcttcatga

SEQ ID NO: 9033622 - DNA, 22 bp, Homo sapiens
gtttccagggctctcttcatga

SEQ ID NO: 9033623 - DNA, 22 bp, Homo sapiens
gtttccaggctgggcagcgagc

SEQ ID NO: 9033624 - DNA, 22 bp, Homo sapiens
gtttccaggctgggcagcgagc

SEQ ID NO: 9033625 - DNA, 22 bp, Homo sapiens
gtttccaggctttggtatggtt

SEQ ID NO: 9033626 - DNA, 22 bp, Homo sapiens
gtttccaggcccctccctagac

SEQ ID NO: 9033627 - DNA, 22 bp, Homo sapiens
gtttccaggcgatatcagctgc

SEQ ID NO: 9033628 - DNA, 22 bp, Homo sapiens
gtttccaggcccctccctagac

SEQ ID NO: 9033629 - DNA, 22 bp, Homo sapiens
gtttccaggcagggtgattctc

SEQ ID NO: 9033630 - DNA, 22 bp, Homo sapiens
gtttccattgtcctatctatag

SEQ ID NO: 9033631 - DNA, 22 bp, Homo sapiens
gtttccatggctctgttaatgg

SEQ ID NO: 9033632 - DNA, 22 bp, Homo sapiens
gtttccatggctctgttaatgg

SEQ ID NO: 9033633 - DNA, 22 bp, Homo sapiens
gtttccatgggagaagacagtg

SEQ ID NO: 9033634 - DNA, 22 bp, Homo sapiens
gtttcccaggctgtggggccct

SEQ ID NO: 9033635 - DNA, 21 bp, Homo sapiens
gttttcatgatagagtctgta

SEQ ID NO: 9033636 - DNA, 21 bp, Homo sapiens
gttttcatgatagagtctgta

SEQ ID NO: 9033637 - DNA, 22 bp, Homo sapiens
gttttcatgtctattgggcata

SEQ ID NO: 9033638 - DNA, 22 bp, Homo sapiens
gttttcatgtctattgggcata

SEQ ID NO: 9033639 - DNA, 22 bp, Homo sapiens
gttttcatgtctattgggcata

SEQ ID NO: 9033640 - DNA, 22 bp, Homo sapiens
gttttcatgtctattgggcata

SEQ ID NO: 9033641 - DNA, 21 bp, Homo sapiens
gttttcatgatagagtctgta

SEQ ID NO: 9033642 - DNA, 22 bp, Homo sapiens
gttacaaaggaagcttcactgc

SEQ ID NO: 9033643 - DNA, 22 bp, Homo sapiens
gttacaaaggaagcttcactgc

SEQ ID NO: 9033644 - DNA, 22 bp, Homo sapiens
gttacaaaggaagcttcactgc

SEQ ID NO: 9033645 - DNA, 22 bp, Homo sapiens
gttacaaaggaagcttcactgc

SEQ ID NO: 9033646 - DNA, 22 bp, Homo sapiens
gttacaaaggaagcttcactgc

SEQ ID NO: 9033647 - DNA, 22 bp, Homo sapiens
gttacaaaggaagcttcactgc

SEQ ID NO: 9033648 - DNA, 22 bp, Homo sapiens
gttacaaaggaagcttcactgc

SEQ ID NO: 9033649 - DNA, 22 bp, Homo sapiens
gttacaaagcacttcaagtgaa

SEQ ID NO: 9033650 - DNA, 22 bp, Homo sapiens
gttacaaagcacttcaagtgaa

SEQ ID NO: 9033651 - DNA, 22 bp, Homo sapiens
gttacaaagcacttcaagtgaa

SEQ ID NO: 9033652 - DNA, 22 bp, Homo sapiens
gttacaaagcacttcaagtgaa

SEQ ID NO: 9033653 - DNA, 22 bp, Homo sapiens
gttacaaagcacttcaagtgaa

SEQ ID NO: 9033654 - DNA, 22 bp, Homo sapiens
gttacaaagcacttcaagtgaa

SEQ ID NO: 9033655 - DNA, 22 bp, Homo sapiens
gttacaaagcacttcaagtgaa

SEQ ID NO: 9033656 - DNA, 22 bp, Homo sapiens
gttacaaactcaggtgccaaaa

SEQ ID NO: 9033657 - DNA, 22 bp, Homo sapiens
gttacaaactcaggtgccaaaa

SEQ ID NO: 9033658 - DNA, 22 bp, Homo sapiens
gttacaaactcaggtgccaaaa

SEQ ID NO: 9033659 - DNA, 22 bp, Homo sapiens
gttacaaactcaggtgccaaaa

SEQ ID NO: 9033660 - DNA, 22 bp, Homo sapiens
gttacaaactcaggtgccaaaa

SEQ ID NO: 9033661 - DNA, 18 bp, Homo sapiens
gttaattttgaagttcat

SEQ ID NO: 9033662 - DNA, 18 bp, Homo sapiens
gttaattttgaagttcat

SEQ ID NO: 9033663 - DNA, 22 bp, Homo sapiens
gttacaaactcaggtgccaaaa

SEQ ID NO: 9033664 - DNA, 22 bp, Homo sapiens
gttacaaactcaggtgccaaaa

SEQ ID NO: 9033665 - DNA, 22 bp, Homo sapiens
gttaatttagtagagtccagat

SEQ ID NO: 9033666 - DNA, 22 bp, Homo sapiens
gttaatttgcagctttcgagct

SEQ ID NO: 9033667 - DNA, 23 bp, Homo sapiens
gttaataatgaacactttctccc

SEQ ID NO: 9033668 - DNA, 23 bp, Homo sapiens
gttaataatgaacactttctccc

SEQ ID NO: 9033669 - DNA, 23 bp, Homo sapiens
gttaataatgaacactttctccc

SEQ ID NO: 9033670 - DNA, 22 bp, Homo sapiens
gttaatacaaccatgatcttct

SEQ ID NO: 9033671 - DNA, 22 bp, Homo sapiens
gttaataaaggtatagaatcag

SEQ ID NO: 9033672 - DNA, 22 bp, Homo sapiens
gttaataaaggtatagaatcag

SEQ ID NO: 9033673 - DNA, 22 bp, Homo sapiens
gttaataaaggtatagaatcag

SEQ ID NO: 9033674 - DNA, 22 bp, Homo sapiens
gttaagtgagggcttttgagtc

SEQ ID NO: 9033675 - DNA, 22 bp, Homo sapiens
gttaaggctgagcaggacactg

SEQ ID NO: 9033676 - DNA, 22 bp, Homo sapiens
gttaatgcctacatattaagca

SEQ ID NO: 9033677 - DNA, 22 bp, Homo sapiens
gttaatgtcttcctattctaca

SEQ ID NO: 9033678 - DNA, 22 bp, Homo sapiens
gttaatgccattaggaaattta

SEQ ID NO: 9033679 - DNA, 22 bp, Homo sapiens
gttaatacaaccatgatcttct

SEQ ID NO: 9033680 - DNA, 22 bp, Homo sapiens
gttaatatttacctgtcaagaa

SEQ ID NO: 9033681 - DNA, 22 bp, Homo sapiens
gttaatatttacctgtcaagaa

SEQ ID NO: 9033682 - DNA, 22 bp, Homo sapiens
gttaatgtgtctgacacaatgg

SEQ ID NO: 9033683 - DNA, 22 bp, Homo sapiens
gttaatgtgtctgacacaatgg

SEQ ID NO: 9033684 - DNA, 22 bp, Homo sapiens
gttaatgtgtctgacacaatgg

SEQ ID NO: 9033685 - DNA, 22 bp, Homo sapiens
gttaatgttatctgaagacagt

SEQ ID NO: 9033686 - DNA, 23 bp, Homo sapiens
gtgtgcctttatcttctgtactc

SEQ ID NO: 9033687 - DNA, 22 bp, Homo sapiens
gtgtggcctcaacgggatgcaa

SEQ ID NO: 9033688 - DNA, 22 bp, Homo sapiens
gtgtggcctcaacgggatgcaa

SEQ ID NO: 9033689 - DNA, 22 bp, Homo sapiens
gtgtggccttgggagaggtctg

SEQ ID NO: 9033690 - DNA, 22 bp, Homo sapiens
gtgtggctacctcagaggagca

SEQ ID NO: 9033691 - DNA, 22 bp, Homo sapiens
gtgtgccctggctccagcacca

SEQ ID NO: 9033692 - DNA, 22 bp, Homo sapiens
gtgtgcccaggtaaagcatttc

SEQ ID NO: 9033693 - DNA, 22 bp, Homo sapiens
gtgtgcccgggggaagcaggtg

SEQ ID NO: 9033694 - DNA, 22 bp, Homo sapiens
gtgtgcctcccattagggtgta

SEQ ID NO: 9033695 - DNA, 22 bp, Homo sapiens
gtgtgccctggctccagcacca

SEQ ID NO: 9033696 - DNA, 22 bp, Homo sapiens
gtgtgcctcgccaagctgtcgg

SEQ ID NO: 9033697 - DNA, 22 bp, Homo sapiens
gtgtgcccttgttcagcagagt

SEQ ID NO: 9033698 - DNA, 18 bp, Homo sapiens
gtgtggctgagatgaggc

SEQ ID NO: 9033699 - DNA, 22 bp, Homo sapiens
gtgtggctgaaatcaaggcagg

SEQ ID NO: 9033700 - DNA, 22 bp, Homo sapiens
gtgtggctacctcagaggagca

SEQ ID NO: 9033701 - DNA, 22 bp, Homo sapiens
gtgtggctgtttagtgactttc

SEQ ID NO: 9033702 - DNA, 22 bp, Homo sapiens
gtgtggctgattgacatggtca

SEQ ID NO: 9033703 - DNA, 22 bp, Homo sapiens
gtgtggctgattgacatggtca

SEQ ID NO: 9033704 - DNA, 18 bp, Homo sapiens
gtgtggctgagatgaggc

SEQ ID NO: 9033705 - DNA, 22 bp, Homo sapiens
gtgtgggaatggcggtcgtgca

SEQ ID NO: 9033706 - DNA, 22 bp, Homo sapiens
gtgtgggaaggctaggatgctg

SEQ ID NO: 9033707 - DNA, 22 bp, Homo sapiens
gtgtgggaatggcggtcgtgca

SEQ ID NO: 9033708 - DNA, 22 bp, Homo sapiens
gtgtgggaaggctaggatgctg

SEQ ID NO: 9033709 - DNA, 22 bp, Homo sapiens
gtgtggcttgggtgaggcgcct

SEQ ID NO: 9033710 - DNA, 22 bp, Homo sapiens
gtgtggcttgggtgaggcgcct

SEQ ID NO: 9033711 - DNA, 22 bp, Homo sapiens
gtgtgggaaggctaggatgctg

SEQ ID NO: 9033712 - DNA, 22 bp, Homo sapiens
gtgtgggaaggctaggatgctg

SEQ ID NO: 9033713 - DNA, 22 bp, Homo sapiens
gttaaccatgatgttttaaaag

SEQ ID NO: 9033714 - DNA, 22 bp, Homo sapiens
gttaactttttacagaaatgaa

SEQ ID NO: 9033715 - DNA, 22 bp, Homo sapiens
gttaagaacttgttgaaggtct

SEQ ID NO: 9033716 - DNA, 22 bp, Homo sapiens
gttaaccaaggcaccaagtgta

SEQ ID NO: 9033717 - DNA, 22 bp, Homo sapiens
gttaacatttctaggtgcaggg

SEQ ID NO: 9033718 - DNA, 22 bp, Homo sapiens
gtgtgggacgggtgagtggcca

SEQ ID NO: 9033719 - DNA, 22 bp, Homo sapiens
gtgtgggacgggtgagtggcca

SEQ ID NO: 9033720 - DNA, 22 bp, Homo sapiens
gttaacattcaattaaacagtc

SEQ ID NO: 9033721 - DNA, 22 bp, Homo sapiens
gttaagaattcgttctcatgtt

SEQ ID NO: 9033722 - DNA, 22 bp, Homo sapiens
gttaagaattcgttctcatgtt

SEQ ID NO: 9033723 - DNA, 22 bp, Homo sapiens
gttaagaattcgttctcatgtt

SEQ ID NO: 9033724 - DNA, 22 bp, Homo sapiens
gttaagaatgcattatgcatat

SEQ ID NO: 9033725 - DNA, 22 bp, Homo sapiens
gttaagaatcaagacttatctt

SEQ ID NO: 9033726 - DNA, 22 bp, Homo sapiens
gttaagaatcaagacttatctt

SEQ ID NO: 9033727 - DNA, 22 bp, Homo sapiens
gttaagaacttgttgaaggtct

SEQ ID NO: 9033728 - DNA, 22 bp, Homo sapiens
gttaagaagctagagatgaaca

SEQ ID NO: 9033729 - DNA, 22 bp, Homo sapiens
gttaagaagctagagatgaaca

SEQ ID NO: 9033730 - DNA, 23 bp, Homo sapiens
gtgctcttcagttttagggtcat

SEQ ID NO: 9033731 - DNA, 22 bp, Homo sapiens
gtgctctgtggattgagttgaa

SEQ ID NO: 9033732 - DNA, 22 bp, Homo sapiens
gtgctctgtgtattaggatgtc

SEQ ID NO: 9033733 - DNA, 22 bp, Homo sapiens
gtgctctgtggattgagttgaa

SEQ ID NO: 9033734 - DNA, 22 bp, Homo sapiens
gtgctctgtggattgagttgaa

SEQ ID NO: 9033735 - DNA, 22 bp, Homo sapiens
gtgctctgtgtattaggatgtc

SEQ ID NO: 9033736 - DNA, 21 bp, Homo sapiens
gtgctctgggcagcagagggc

SEQ ID NO: 9033737 - DNA, 21 bp, Homo sapiens
gtgctctgggcagcagagggc

SEQ ID NO: 9033738 - DNA, 22 bp, Homo sapiens
gtgctctggctggtctcccggt

SEQ ID NO: 9033739 - DNA, 22 bp, Homo sapiens
gtgctctggctggtctcccggt

SEQ ID NO: 9033740 - DNA, 22 bp, Homo sapiens
gtgctctgggctgcctgacatg

SEQ ID NO: 9033741 - DNA, 21 bp, Homo sapiens
gtgctctgggcagcagagggc

SEQ ID NO: 9033742 - DNA, 21 bp, Homo sapiens
gtgctctgggcagcagagggc

SEQ ID NO: 9033743 - DNA, 18 bp, Homo sapiens
gtgtgcagttgcaggggt

SEQ ID NO: 9033744 - DNA, 22 bp, Homo sapiens
gtgctgaagtgaaattcatcaa

SEQ ID NO: 9033745 - DNA, 22 bp, Homo sapiens
gtgtgcatatgtgtggctctcc

SEQ ID NO: 9033746 - DNA, 18 bp, Homo sapiens
gtgtgcagttgcaggggt

SEQ ID NO: 9033747 - DNA, 18 bp, Homo sapiens
gtgtgcagttgcaggggt

SEQ ID NO: 9033748 - DNA, 22 bp, Homo sapiens
gtgtgcatatgtgtggctctcc

SEQ ID NO: 9033749 - DNA, 22 bp, Homo sapiens
gtgtgcatgaggataggaataa

SEQ ID NO: 9033750 - DNA, 22 bp, Homo sapiens
gtgtgcatcttttctgcttgat

SEQ ID NO: 9033751 - DNA, 22 bp, Homo sapiens
gtgtgcatctcacccttccccg

SEQ ID NO: 9033752 - DNA, 22 bp, Homo sapiens
gtgctgaaatggacctcaggaa

SEQ ID NO: 9033753 - DNA, 22 bp, Homo sapiens
gtgctgaaatggacctcaggaa

SEQ ID NO: 9033754 - DNA, 22 bp, Homo sapiens
gtgctgaaatagaggaggtggc

SEQ ID NO: 9033755 - DNA, 22 bp, Homo sapiens
gtgctgaacatttgggacttgt

SEQ ID NO: 9033756 - DNA, 22 bp, Homo sapiens
gtgctgaactataaaaagcttt

SEQ ID NO: 9033757 - DNA, 22 bp, Homo sapiens
gtgctgaagaagtctgttcgcc

SEQ ID NO: 9033758 - DNA, 18 bp, Homo sapiens
gtgtgcagttgcaggggt

SEQ ID NO: 9033759 - DNA, 18 bp, Homo sapiens
gtgtgcagttgcaggggt

SEQ ID NO: 9033760 - DNA, 22 bp, Homo sapiens
gtgtgccagacatgatgctatg

SEQ ID NO: 9033761 - DNA, 22 bp, Homo sapiens
gtgtgccagacatgatgctatg

SEQ ID NO: 9033762 - DNA, 22 bp, Homo sapiens
gtgtgccaggaactggctgctg

SEQ ID NO: 9033763 - DNA, 22 bp, Homo sapiens
gtgtgccactgcctgaggaccc

SEQ ID NO: 9033764 - DNA, 22 bp, Homo sapiens
gtgtgccaccagtcaaggtgaa

SEQ ID NO: 9033765 - DNA, 22 bp, Homo sapiens
gtgtgccaccactgacaggatt

SEQ ID NO: 9033766 - DNA, 22 bp, Homo sapiens
gtgtgccaccagtcaaggtgaa

SEQ ID NO: 9033767 - DNA, 22 bp, Homo sapiens
gtgtgccaccactgacaggatt

SEQ ID NO: 9033768 - DNA, 22 bp, Homo sapiens
gtgtgccaccactgacaggatt

SEQ ID NO: 9033769 - DNA, 22 bp, Homo sapiens
gtgtgccaacaaaagacagtgc

SEQ ID NO: 9033770 - DNA, 22 bp, Homo sapiens
gtgtgccaacaaaagacagtgc

SEQ ID NO: 9033771 - DNA, 23 bp, Homo sapiens
gtgtgccaagcactgtgccagga

SEQ ID NO: 9033772 - DNA, 23 bp, Homo sapiens
gtgtgccaagcactgtgccagga

SEQ ID NO: 9033773 - DNA, 22 bp, Homo sapiens
gtgtgcatgtgcttgcacagat

SEQ ID NO: 9033774 - DNA, 22 bp, Homo sapiens
gtgtgcatgtgcttgcacagat

SEQ ID NO: 9033775 - DNA, 22 bp, Homo sapiens
gtgtgcatggagggggcagtga

SEQ ID NO: 9033776 - DNA, 22 bp, Homo sapiens
gtgtgcatgcatagacaccaca

SEQ ID NO: 9033777 - DNA, 22 bp, Homo sapiens
gtgtgcatgtatatacttttat

SEQ ID NO: 9033778 - DNA, 22 bp, Homo sapiens
gtgtgcatggagggggcagtga

SEQ ID NO: 9033779 - DNA, 22 bp, Homo sapiens
gtgtgcatgtgcttgcacagat

SEQ ID NO: 9033780 - DNA, 22 bp, Homo sapiens
gtgtgcatgtggaagcatgtat

SEQ ID NO: 9033781 - DNA, 22 bp, Homo sapiens
gtgctccctccttcctcaagga

SEQ ID NO: 9033782 - DNA, 22 bp, Homo sapiens
gtgctccctccttcctcaagga

SEQ ID NO: 9033783 - DNA, 22 bp, Homo sapiens
gtgctcctcacagtgtggccct

SEQ ID NO: 9033784 - DNA, 22 bp, Homo sapiens
gtgctctaggaccttagaagtg

SEQ ID NO: 9033785 - DNA, 23 bp, Homo sapiens
gtgctctgcggtctgctagtctg

SEQ ID NO: 9033786 - DNA, 22 bp, Homo sapiens
gtgctctgcctggggtcatggc

SEQ ID NO: 9033787 - DNA, 23 bp, Homo sapiens
gtgctctgcggtctgctagtctg

SEQ ID NO: 9033788 - DNA, 22 bp, Homo sapiens
gtgctctggccaagcgcgtgcg

SEQ ID NO: 9033789 - DNA, 23 bp, Homo sapiens
gtgctctgcggtctgctagtctg

SEQ ID NO: 9033790 - DNA, 23 bp, Homo sapiens
gtgctctgcggtctgctagtctg

SEQ ID NO: 9033791 - DNA, 23 bp, Homo sapiens
gtgctctgcggtctgctagtctg

SEQ ID NO: 9033792 - DNA, 22 bp, Homo sapiens
gtgctctgcctggggtcatggc

SEQ ID NO: 9033793 - DNA, 22 bp, Homo sapiens
gtgctctgatctgtctgacatc

SEQ ID NO: 9033794 - DNA, 22 bp, Homo sapiens
gtgctctgagtttgcatgtcag

SEQ ID NO: 9033795 - DNA, 22 bp, Homo sapiens
gtgctctgagtttgcatgtcag

SEQ ID NO: 9033796 - DNA, 22 bp, Homo sapiens
gtgctccctccttcctcaagga

SEQ ID NO: 9033797 - DNA, 22 bp, Homo sapiens
gtgctccctccttcctcaagga

SEQ ID NO: 9033798 - DNA, 22 bp, Homo sapiens
gtgctccctccttcctcaagga

SEQ ID NO: 9033799 - DNA, 22 bp, Homo sapiens
gtgctccctccttcctcaagga

SEQ ID NO: 9033800 - DNA, 22 bp, Homo sapiens
gtgctccctccttcctcaagga

SEQ ID NO: 9033801 - DNA, 22 bp, Homo sapiens
gtgctccctccttcctcaagga

SEQ ID NO: 9033802 - DNA, 22 bp, Homo sapiens
gtgctcatgtcctttcactgca

SEQ ID NO: 9033803 - DNA, 22 bp, Homo sapiens
gtgctccaggtcgctcagagag

SEQ ID NO: 9033804 - DNA, 22 bp, Homo sapiens
gtgctccaggtcgctcagagag

SEQ ID NO: 9033805 - DNA, 22 bp, Homo sapiens
gtgctcatcgtggagcctgagg

SEQ ID NO: 9033806 - DNA, 22 bp, Homo sapiens
gtgctcatcgtggagcctgagg

SEQ ID NO: 9033807 - DNA, 22 bp, Homo sapiens
gtgctcatagatgatgctcttt

SEQ ID NO: 9033808 - DNA, 22 bp, Homo sapiens
gtgctcagggcctggctgggga

SEQ ID NO: 9033809 - DNA, 22 bp, Homo sapiens
gtgctcaggggcaatcctggga

SEQ ID NO: 9033810 - DNA, 22 bp, Homo sapiens
gtgctatgtgctaggcactgaa

SEQ ID NO: 9033811 - DNA, 22 bp, Homo sapiens
gtgctcactccccacagtgccc

SEQ ID NO: 9033812 - DNA, 22 bp, Homo sapiens
gtgctcactgtgagacgtcctg

SEQ ID NO: 9033813 - DNA, 22 bp, Homo sapiens
gtgctcagcccggatgagatca

SEQ ID NO: 9033814 - DNA, 22 bp, Homo sapiens
gtgctcaggaccaaatgaacca

SEQ ID NO: 9033815 - DNA, 22 bp, Homo sapiens
gttcattctgaaaagcagcttg

SEQ ID NO: 9033816 - DNA, 22 bp, Homo sapiens
gttcattcatcaaatatttact

SEQ ID NO: 9033817 - DNA, 22 bp, Homo sapiens
gttcatttaggaaaggaagagt

SEQ ID NO: 9033818 - DNA, 22 bp, Homo sapiens
gttcatttaggaaaggaagagt

SEQ ID NO: 9033819 - DNA, 22 bp, Homo sapiens
gttcattgttaacgtgtccact

SEQ ID NO: 9033820 - DNA, 19 bp, Homo sapiens
gttcattgttcaggaaaat

SEQ ID NO: 9033821 - DNA, 19 bp, Homo sapiens
gttcatgtgaggaaggaac

SEQ ID NO: 9033822 - DNA, 19 bp, Homo sapiens
gttcatgtgaggaaggaac

SEQ ID NO: 9033823 - DNA, 22 bp, Homo sapiens
gttcatgtggtttttaaaggat

SEQ ID NO: 9033824 - DNA, 22 bp, Homo sapiens
gttcatgtggaaatttaaaaca

SEQ ID NO: 9033825 - DNA, 22 bp, Homo sapiens
gttgaggtgatgccagccctgc

SEQ ID NO: 9033826 - DNA, 22 bp, Homo sapiens
gttgaggtgatgccagccctgc

SEQ ID NO: 9033827 - DNA, 22 bp, Homo sapiens
gttgaggtgatgccagccctgc

SEQ ID NO: 9033828 - DNA, 22 bp, Homo sapiens
gttgaggtgatgccagccctgc

SEQ ID NO: 9033829 - DNA, 22 bp, Homo sapiens
gttgaggaggttcagggtggtt

SEQ ID NO: 9033830 - DNA, 22 bp, Homo sapiens
gttgaggaggcactcactgtca

SEQ ID NO: 9033831 - DNA, 22 bp, Homo sapiens
gttgaggagcaagcatgtgtct

SEQ ID NO: 9033832 - DNA, 22 bp, Homo sapiens
gttcatttatgatgtaacatgt

SEQ ID NO: 9033833 - DNA, 22 bp, Homo sapiens
gttcatcctgacttggattagt

SEQ ID NO: 9033834 - DNA, 22 bp, Homo sapiens
gttcatctcacagataggcagt

SEQ ID NO: 9033835 - DNA, 22 bp, Homo sapiens
gttcatccatattatagcatgt

SEQ ID NO: 9033836 - DNA, 22 bp, Homo sapiens
gttcatccatgtcagcgtatat

SEQ ID NO: 9033837 - DNA, 22 bp, Homo sapiens
gttcatccatgtcagcgtatat

SEQ ID NO: 9033838 - DNA, 22 bp, Homo sapiens
gttcatcctgacttggattagt

SEQ ID NO: 9033839 - DNA, 22 bp, Homo sapiens
gttcatatttaactaagatagg

SEQ ID NO: 9033840 - DNA, 22 bp, Homo sapiens
gttcatatttaactaagatagg

SEQ ID NO: 9033841 - DNA, 22 bp, Homo sapiens
gttcatccatattatagcatgt

SEQ ID NO: 9033842 - DNA, 22 bp, Homo sapiens
gttcatcactcagagacctccc

SEQ ID NO: 9033843 - DNA, 22 bp, Homo sapiens
gttcataatttgaaggaatagg

SEQ ID NO: 9033844 - DNA, 22 bp, Homo sapiens
gttcataatttgaaggaatagg

SEQ ID NO: 9033845 - DNA, 22 bp, Homo sapiens
gttcataatttgaaggaatagg

SEQ ID NO: 9033846 - DNA, 22 bp, Homo sapiens
gttcatattactttgagtgcag

SEQ ID NO: 9033847 - DNA, 22 bp, Homo sapiens
gttcagttttgaaatgttaatt

SEQ ID NO: 9033848 - DNA, 22 bp, Homo sapiens
gttcagttttggggctgttaca

SEQ ID NO: 9033849 - DNA, 22 bp, Homo sapiens
gttcagtttgagattaccatgg

SEQ ID NO: 9033850 - DNA, 22 bp, Homo sapiens
gttcagtttggggtatttgaag

SEQ ID NO: 9033851 - DNA, 22 bp, Homo sapiens
gttcagtttggggtatttgaag

SEQ ID NO: 9033852 - DNA, 22 bp, Homo sapiens
gttcagtgtttacatgattgtt

SEQ ID NO: 9033853 - DNA, 22 bp, Homo sapiens
gttcagtgtttacatgattgtt

SEQ ID NO: 9033854 - DNA, 22 bp, Homo sapiens
gttcagtgtttgatttctgctg

SEQ ID NO: 9033855 - DNA, 22 bp, Homo sapiens
gttcagtgtttttattgacagg

SEQ ID NO: 9033856 - DNA, 22 bp, Homo sapiens
gttcagttatttctgaagatat

SEQ ID NO: 9033857 - DNA, 22 bp, Homo sapiens
gttcagtttgacaacctttata

SEQ ID NO: 9033858 - DNA, 22 bp, Homo sapiens
gttcagtttgagattaccatgg

SEQ ID NO: 9033859 - DNA, 22 bp, Homo sapiens
gttcagtttgagattaccatgg

SEQ ID NO: 9033860 - DNA, 22 bp, Homo sapiens
gttcagtgccagttctaagact

SEQ ID NO: 9033861 - DNA, 22 bp, Homo sapiens
gttcagtggggccttgggggac

SEQ ID NO: 9033862 - DNA, 22 bp, Homo sapiens
gttcagtgtctctctattttat

SEQ ID NO: 9033863 - DNA, 22 bp, Homo sapiens
gttcagtggtgtatccccagtg

SEQ ID NO: 9033864 - DNA, 22 bp, Homo sapiens
gttcagtattaatgagatgatt

SEQ ID NO: 9033865 - DNA, 22 bp, Homo sapiens
gttcagtgattctcggtgttca

SEQ ID NO: 9033866 - DNA, 22 bp, Homo sapiens
gttcactgtactggtgatggtt

SEQ ID NO: 9033867 - DNA, 22 bp, Homo sapiens
gttcacatggcattttcacatc

SEQ ID NO: 9033868 - DNA, 22 bp, Homo sapiens
gttcacatggcattttcacatc

SEQ ID NO: 9033869 - DNA, 22 bp, Homo sapiens
gttcacatgtggtcatgctgtc

SEQ ID NO: 9033870 - DNA, 22 bp, Homo sapiens
gttcacatgtggtcatgctgtc

SEQ ID NO: 9033871 - DNA, 22 bp, Homo sapiens
gttcacatgtggtcatgctgtc

SEQ ID NO: 9033872 - DNA, 22 bp, Homo sapiens
gttcacattaactcaccggtgc

SEQ ID NO: 9033873 - DNA, 22 bp, Homo sapiens
gttcacattaactcaccggtgc

SEQ ID NO: 9033874 - DNA, 22 bp, Homo sapiens
gttcacatgtgttatcttcttt

SEQ ID NO: 9033875 - DNA, 22 bp, Homo sapiens
gttcacatgtgttatcttcttt

SEQ ID NO: 9033876 - DNA, 20 bp, Homo sapiens
gttcactgagcttaaatgtt

SEQ ID NO: 9033877 - DNA, 22 bp, Homo sapiens
gttcactgctttcttagtactc

SEQ ID NO: 9033878 - DNA, 22 bp, Homo sapiens
gttcagggagggacagatgaag

SEQ ID NO: 9033879 - DNA, 22 bp, Homo sapiens
gttcagcagcagtgattttgtg

SEQ ID NO: 9033880 - DNA, 22 bp, Homo sapiens
gttcagcagcagtgattttgtg

SEQ ID NO: 9033881 - DNA, 22 bp, Homo sapiens
gttcagcacaggtgctcagaca

SEQ ID NO: 9033882 - DNA, 22 bp, Homo sapiens
gttcagatttcatgagtaattg

SEQ ID NO: 9033883 - DNA, 22 bp, Homo sapiens
gttcagatggagaaggaaaact

SEQ ID NO: 9033884 - DNA, 22 bp, Homo sapiens
gttcagcaagtactcagtccac

SEQ ID NO: 9033885 - DNA, 22 bp, Homo sapiens
gttcagcaagaatgtttctatt

SEQ ID NO: 9033886 - DNA, 22 bp, Homo sapiens
gttcacatcccagaaagagcat

SEQ ID NO: 9033887 - DNA, 22 bp, Homo sapiens
gttcacatcccagaaagagcat

SEQ ID NO: 9033888 - DNA, 22 bp, Homo sapiens
gttcacatcacttcactgaacc

SEQ ID NO: 9033889 - DNA, 22 bp, Homo sapiens
gttcacatcacttcactgaacc

SEQ ID NO: 9033890 - DNA, 22 bp, Homo sapiens
gttcacatcctgctttttccct

SEQ ID NO: 9033891 - DNA, 22 bp, Homo sapiens
gttcacatcctgctttttccct

SEQ ID NO: 9033892 - DNA, 22 bp, Homo sapiens
gttcacatcctggctgtgccac

SEQ ID NO: 9033893 - DNA, 22 bp, Homo sapiens
gttcacatcctggctgtgccac

SEQ ID NO: 9033894 - DNA, 22 bp, Homo sapiens
gttcacatgctctcatgctttt

SEQ ID NO: 9033895 - DNA, 22 bp, Homo sapiens
gttcacatgctctcatgctttt

SEQ ID NO: 9033896 - DNA, 22 bp, Homo sapiens
gttcacatccttgtgaggattt

SEQ ID NO: 9033897 - DNA, 22 bp, Homo sapiens
gttcacatccttgtgaggattt

SEQ ID NO: 9033898 - DNA, 22 bp, Homo sapiens
gttcaattatacagtcagaggg

SEQ ID NO: 9033899 - DNA, 22 bp, Homo sapiens
gttcaatttagaaagcacagtt

SEQ ID NO: 9033900 - DNA, 21 bp, Homo sapiens
gttcaatagctctttgaatgc

SEQ ID NO: 9033901 - DNA, 22 bp, Homo sapiens
gttcaatttcagcatccattga

SEQ ID NO: 9033902 - DNA, 22 bp, Homo sapiens
gttcacaaagtactgtatgcat

SEQ ID NO: 9033903 - DNA, 22 bp, Homo sapiens
gttacaaaggactgggggccac

SEQ ID NO: 9033904 - DNA, 22 bp, Homo sapiens
gttacaaaggactgggggccac

SEQ ID NO: 9033905 - DNA, 22 bp, Homo sapiens
gttacaaaggactgggggccac

SEQ ID NO: 9033906 - DNA, 22 bp, Homo sapiens
gttacaaaggactgggggccac

SEQ ID NO: 9033907 - DNA, 22 bp, Homo sapiens
gttacaaaggactgggggccac

SEQ ID NO: 9033908 - DNA, 22 bp, Homo sapiens
gttacaaaggtcataaaagtgt

SEQ ID NO: 9033909 - DNA, 22 bp, Homo sapiens
gttacaaaggtcataaaagtgt

SEQ ID NO: 9033910 - DNA, 22 bp, Homo sapiens
gttgagtgggttaggatgctga

SEQ ID NO: 9033911 - DNA, 22 bp, Homo sapiens
gttgatgaaaatgaattgcatg

SEQ ID NO: 9033912 - DNA, 22 bp, Homo sapiens
gttgattgattgattgactggt

SEQ ID NO: 9033913 - DNA, 22 bp, Homo sapiens
gttgatttgaagagcagaaagt

SEQ ID NO: 9033914 - DNA, 22 bp, Homo sapiens
gttgatttagtgagtgagcagt

SEQ ID NO: 9033915 - DNA, 22 bp, Homo sapiens
gttgatttagtgagtgagcagt

SEQ ID NO: 9033916 - DNA, 22 bp, Homo sapiens
gttgatttagtgagtgagcagt

SEQ ID NO: 9033917 - DNA, 22 bp, Homo sapiens
gttgcaaatgggaagatggtta

SEQ ID NO: 9033918 - DNA, 22 bp, Homo sapiens
gttgcacaacttgaatggctgg

SEQ ID NO: 9033919 - DNA, 22 bp, Homo sapiens
gttgcagatgtggaactcgtgc

SEQ ID NO: 9033920 - DNA, 22 bp, Homo sapiens
gttgcagatgtggaactcgtgc

SEQ ID NO: 9033921 - DNA, 22 bp, Homo sapiens
gttgcagacggggtgcactgaa

SEQ ID NO: 9033922 - DNA, 22 bp, Homo sapiens
gttgcagactcaagaaaataaa

SEQ ID NO: 9033923 - DNA, 22 bp, Homo sapiens
gttgcagacactccacagtcga

SEQ ID NO: 9033924 - DNA, 22 bp, Homo sapiens
gttgcacactggctataacaag

SEQ ID NO: 9033925 - DNA, 22 bp, Homo sapiens
gttgcacactggctataacaag

SEQ ID NO: 9033926 - DNA, 22 bp, Homo sapiens
gttgcacagttcctcaagcagg

SEQ ID NO: 9033927 - DNA, 22 bp, Homo sapiens
gttgcctaggctggtcttgaac

SEQ ID NO: 9033928 - DNA, 22 bp, Homo sapiens
gttgccgtttgttctaccagac

SEQ ID NO: 9033929 - DNA, 22 bp, Homo sapiens
gttgcattttccctccagaggt

SEQ ID NO: 9033930 - DNA, 22 bp, Homo sapiens
gttgcattttaaatgcatgttg

SEQ ID NO: 9033931 - DNA, 22 bp, Homo sapiens
gttgcattgagagttgcattgg

SEQ ID NO: 9033932 - DNA, 22 bp, Homo sapiens
gttgcattttccctccagaggt

SEQ ID NO: 9033933 - DNA, 22 bp, Homo sapiens
gttgccagacttctgtggctcc

SEQ ID NO: 9033934 - DNA, 22 bp, Homo sapiens
gttgccagccctcagggactga

SEQ ID NO: 9033935 - DNA, 22 bp, Homo sapiens
gttgcaggaggatggctgcata

SEQ ID NO: 9033936 - DNA, 22 bp, Homo sapiens
gttgcattaatctgctcaggct

SEQ ID NO: 9033937 - DNA, 22 bp, Homo sapiens
gttgcataaagccttcctcata

SEQ ID NO: 9033938 - DNA, 22 bp, Homo sapiens
gttgcaggaggatggctgcata

SEQ ID NO: 9033939 - DNA, 22 bp, Homo sapiens
gttgcaggaggatggctgcata

SEQ ID NO: 9033940 - DNA, 22 bp, Homo sapiens
gttgcaggaagcacacacatgt

SEQ ID NO: 9033941 - DNA, 22 bp, Homo sapiens
gttgcaggaggatggctgcata

SEQ ID NO: 9033942 - DNA, 22 bp, Homo sapiens
gttgggctcattacagcctgct

SEQ ID NO: 9033943 - DNA, 22 bp, Homo sapiens
gttgggcagaagcttgttgtgc

SEQ ID NO: 9033944 - DNA, 22 bp, Homo sapiens
gttggggaaggtgggagaatgt

SEQ ID NO: 9033945 - DNA, 22 bp, Homo sapiens
gttggggtaccttgaggctggg

SEQ ID NO: 9033946 - DNA, 22 bp, Homo sapiens
gttggggtaccttgaggctggg

SEQ ID NO: 9033947 - DNA, 22 bp, Homo sapiens
gttggtccagcattgcctcact

SEQ ID NO: 9033948 - DNA, 19 bp, Homo sapiens
gttggtcattctacacaac

SEQ ID NO: 9033949 - DNA, 22 bp, Homo sapiens
gttggtcatatcattgaagctt

SEQ ID NO: 9033950 - DNA, 22 bp, Homo sapiens
gttggtcaggatggtctcaaac

SEQ ID NO: 9033951 - DNA, 22 bp, Homo sapiens
gttgctcaggcaggagtacagt

SEQ ID NO: 9033952 - DNA, 22 bp, Homo sapiens
gttgctcaggcaggagtacagt

SEQ ID NO: 9033953 - DNA, 22 bp, Homo sapiens
gttgctcaggcaggagtacagt

SEQ ID NO: 9033954 - DNA, 22 bp, Homo sapiens
gttgccttcactggtcttggca

SEQ ID NO: 9033955 - DNA, 22 bp, Homo sapiens
gttgctcaatgggaataagaat

SEQ ID NO: 9033956 - DNA, 22 bp, Homo sapiens
gttgggagcagcagaccaagag

SEQ ID NO: 9033957 - DNA, 22 bp, Homo sapiens
gttgtacagcatccagtgcaga

SEQ ID NO: 9033958 - DNA, 22 bp, Homo sapiens
gtttcagaaatgttctcctgct

SEQ ID NO: 9033959 - DNA, 22 bp, Homo sapiens
gtttcagagttagtgctggctg

SEQ ID NO: 9033960 - DNA, 22 bp, Homo sapiens
gtttcagatttggtttcagaag

SEQ ID NO: 9033961 - DNA, 22 bp, Homo sapiens
gtttcagatatatttgtactta

SEQ ID NO: 9033962 - DNA, 22 bp, Homo sapiens
gtttcagatttggtttcagaag

SEQ ID NO: 9033963 - DNA, 22 bp, Homo sapiens
gtttcagatttggtttcagaag

SEQ ID NO: 9033964 - DNA, 22 bp, Homo sapiens
gtttcagctcttcctggaacca

SEQ ID NO: 9033965 - DNA, 23 bp, Homo sapiens
gttgtaatggataatgcaaattg

SEQ ID NO: 9033966 - DNA, 23 bp, Homo sapiens
gttgtaatggataatgcaaattg

SEQ ID NO: 9033967 - DNA, 22 bp, Homo sapiens
gttgtacagacatgaaacttgc

SEQ ID NO: 9033968 - DNA, 22 bp, Homo sapiens
gttgtaaatacagtactgaaac

SEQ ID NO: 9033969 - DNA, 19 bp, Homo sapiens
gttgtaaatggaggtttct

SEQ ID NO: 9033970 - DNA, 23 bp, Homo sapiens
gttgtaatggataatgcaaattg

SEQ ID NO: 9033971 - DNA, 22 bp, Homo sapiens
gttgtaagtttaatgtcaattg

SEQ ID NO: 9033972 - DNA, 22 bp, Homo sapiens
gttgtaaatacagtactgaaac

SEQ ID NO: 9033973 - DNA, 22 bp, Homo sapiens
gttgtaaatacagcagataatt

SEQ ID NO: 9033974 - DNA, 22 bp, Homo sapiens
gttggtggatgtgggcagagca

SEQ ID NO: 9033975 - DNA, 22 bp, Homo sapiens
gttggtggatgtgggcagagca

SEQ ID NO: 9033976 - DNA, 22 bp, Homo sapiens
gtttcattcggcagctcataag

SEQ ID NO: 9033977 - DNA, 20 bp, Homo sapiens
gtttccaaattgtgcatttt

SEQ ID NO: 9033978 - DNA, 22 bp, Homo sapiens
gtttcatttacatctgtaggta

SEQ ID NO: 9033979 - DNA, 22 bp, Homo sapiens
gtttcattcggcagctcataag

SEQ ID NO: 9033980 - DNA, 22 bp, Homo sapiens
gtttcatttacatctgtaggta

SEQ ID NO: 9033981 - DNA, 19 bp, Homo sapiens
gtttcattaagataggaaa

SEQ ID NO: 9033982 - DNA, 22 bp, Homo sapiens
gtttcatgccatttccagattg

SEQ ID NO: 9033983 - DNA, 18 bp, Homo sapiens
gtttcatgcatgtgaaac

SEQ ID NO: 9033984 - DNA, 18 bp, Homo sapiens
gtttcatgcatgtgaaac

SEQ ID NO: 9033985 - DNA, 22 bp, Homo sapiens
gtttcatggagagctgaatatt

SEQ ID NO: 9033986 - DNA, 22 bp, Homo sapiens
gtttcatggagagctgaatatt

SEQ ID NO: 9033987 - DNA, 22 bp, Homo sapiens
gtttcatggttgtttgatggca

SEQ ID NO: 9033988 - DNA, 22 bp, Homo sapiens
gtttcatatgcagttaacagca

SEQ ID NO: 9033989 - DNA, 22 bp, Homo sapiens
gtttcatgactgatgttgttga

SEQ ID NO: 9033990 - DNA, 18 bp, Homo sapiens
gtttcatgcatgtgaaac

SEQ ID NO: 9033991 - DNA, 22 bp, Homo sapiens
gtttcatatatagtaactgaaa

SEQ ID NO: 9033992 - DNA, 22 bp, Homo sapiens
gtttcatatgcagttaacagca

SEQ ID NO: 9033993 - DNA, 22 bp, Homo sapiens
gtttcatagcatatacgtgtgt

SEQ ID NO: 9033994 - DNA, 22 bp, Homo sapiens
gtttcatagctacgattttggg

SEQ ID NO: 9033995 - DNA, 22 bp, Homo sapiens
gtttcataggcatgtgacctat

SEQ ID NO: 9033996 - DNA, 22 bp, Homo sapiens
gtttcatataccaagcacttga

SEQ ID NO: 9033997 - DNA, 22 bp, Homo sapiens
gtttcatataccaagcacttga

SEQ ID NO: 9033998 - DNA, 22 bp, Homo sapiens
gtttcaggtttaggcacctgga

SEQ ID NO: 9033999 - DNA, 22 bp, Homo sapiens
gtttcataattcaatcaaatga

SEQ ID NO: 9034000 - DNA, 22 bp, Homo sapiens
gtttcatacagattattcatgg

SEQ ID NO: 9034001 - DNA, 22 bp, Homo sapiens
taagggctctatcctactgttt

SEQ ID NO: 9034002 - DNA, 22 bp, Homo sapiens
taagggttcagaatgcagtggt

SEQ ID NO: 9034003 - DNA, 22 bp, Homo sapiens
taagggttcagaatgcagtggt

SEQ ID NO: 9034004 - DNA, 22 bp, Homo sapiens
taagggttcagaatgcagtggt

SEQ ID NO: 9034005 - DNA, 22 bp, Homo sapiens
taaggtctttaacaggtctttt

SEQ ID NO: 9034006 - DNA, 22 bp, Homo sapiens
taaggtttaacgccctgtctcg

SEQ ID NO: 9034007 - DNA, 22 bp, Homo sapiens
taaggtttctagtttctaaact

SEQ ID NO: 9034008 - DNA, 19 bp, Homo sapiens
taaggtttaccagcaaaat

SEQ ID NO: 9034009 - DNA, 22 bp, Homo sapiens
taaggtttcttcagatactagt

SEQ ID NO: 9034010 - DNA, 22 bp, Homo sapiens
taaggtttgaagaagactgagc

SEQ ID NO: 9034011 - DNA, 22 bp, Homo sapiens
taaggtttgcttatcttcgcct

SEQ ID NO: 9034012 - DNA, 22 bp, Homo sapiens
taaggccaccgttatagaacca

SEQ ID NO: 9034013 - DNA, 22 bp, Homo sapiens
taaggccagcatgaatgcagca

SEQ ID NO: 9034014 - DNA, 22 bp, Homo sapiens
taaggccagccagcaaatctgt

SEQ ID NO: 9034015 - DNA, 22 bp, Homo sapiens
taaggccaagttcatatacaac

SEQ ID NO: 9034016 - DNA, 22 bp, Homo sapiens
taaggccaattaacaaccaggg

SEQ ID NO: 9034017 - DNA, 22 bp, Homo sapiens
taaggccaattacatatgttca

SEQ ID NO: 9034018 - DNA, 22 bp, Homo sapiens
taaggccaccgttatagaacca

SEQ ID NO: 9034019 - DNA, 22 bp, Homo sapiens
taaggccaggctgtggtcggca

SEQ ID NO: 9034020 - DNA, 22 bp, Homo sapiens
taaggccattatggtgggcccg

SEQ ID NO: 9034021 - DNA, 22 bp, Homo sapiens
taaggctactgtcagcttcagg

SEQ ID NO: 9034022 - DNA, 22 bp, Homo sapiens
taaggctatcttttgagtgtgt

SEQ ID NO: 9034023 - DNA, 22 bp, Homo sapiens
taaggctatctgagtttatgtg

SEQ ID NO: 9034024 - DNA, 22 bp, Homo sapiens
taaggctagtgcctgactgggt

SEQ ID NO: 9034025 - DNA, 22 bp, Homo sapiens
taaggctaggaattctctgaag

SEQ ID NO: 9034026 - DNA, 22 bp, Homo sapiens
taaggctagcaagatgagaata

SEQ ID NO: 9034027 - DNA, 22 bp, Homo sapiens
taaggctttctaaatatgcaga

SEQ ID NO: 9034028 - DNA, 22 bp, Homo sapiens
taaggctttggtcaccatggag

SEQ ID NO: 9034029 - DNA, 22 bp, Homo sapiens
taagggaacagcttcaaactca

SEQ ID NO: 9034030 - DNA, 22 bp, Homo sapiens
taaggcttatgatcagaaggtt

SEQ ID NO: 9034031 - DNA, 22 bp, Homo sapiens
taaggcttatgatcagaaggtt

SEQ ID NO: 9034032 - DNA, 20 bp, Homo sapiens
taaggctgttttgtattcct

SEQ ID NO: 9034033 - DNA, 22 bp, Homo sapiens
taaggcttatatacttagacat

SEQ ID NO: 9034034 - DNA, 22 bp, Homo sapiens
taaggcttagaagctatctgct

SEQ ID NO: 9034035 - DNA, 22 bp, Homo sapiens
taaggcaggtagatgactacgg

SEQ ID NO: 9034036 - DNA, 22 bp, Homo sapiens
taaggcaggctttcatccagag

SEQ ID NO: 9034037 - DNA, 22 bp, Homo sapiens
taaggcaggtatggtaccaggc

SEQ ID NO: 9034038 - DNA, 22 bp, Homo sapiens
taaggcaggtagatgactacgg

SEQ ID NO: 9034039 - DNA, 22 bp, Homo sapiens
taaggcaggtatggtaccaggc

SEQ ID NO: 9034040 - DNA, 22 bp, Homo sapiens
taaggcaggactggatagctat

SEQ ID NO: 9034041 - DNA, 22 bp, Homo sapiens
taaggcaatggcattcttgaca

SEQ ID NO: 9034042 - DNA, 22 bp, Homo sapiens
taaggcaagagcagggtctttg

SEQ ID NO: 9034043 - DNA, 22 bp, Homo sapiens
taaggcaatggcattcttgaca

SEQ ID NO: 9034044 - DNA, 22 bp, Homo sapiens
taaggcaagaaactcctgtgta

SEQ ID NO: 9034045 - DNA, 22 bp, Homo sapiens
taaggcaagagcagggtctttg

SEQ ID NO: 9034046 - DNA, 22 bp, Homo sapiens
taactgattcctttttgaaaat

SEQ ID NO: 9034047 - DNA, 22 bp, Homo sapiens
taactgcaacctccatcttgtg

SEQ ID NO: 9034048 - DNA, 22 bp, Homo sapiens
taactgccagcagcgatgaaca

SEQ ID NO: 9034049 - DNA, 22 bp, Homo sapiens
taactgcctactgtgcaaatat

SEQ ID NO: 9034050 - DNA, 22 bp, Homo sapiens
taactggtactctggtagcctg

SEQ ID NO: 9034051 - DNA, 22 bp, Homo sapiens
taaggcaaagtgatttcttaaa

SEQ ID NO: 9034052 - DNA, 22 bp, Homo sapiens
taaggcaaagtgatttcttaaa

SEQ ID NO: 9034053 - DNA, 22 bp, Homo sapiens
taaggattcaggcaggccatac

SEQ ID NO: 9034054 - DNA, 22 bp, Homo sapiens
taaggcattagagtgaaagcaa

SEQ ID NO: 9034055 - DNA, 22 bp, Homo sapiens
taaggccaaggggccatagtct

SEQ ID NO: 9034056 - DNA, 21 bp, Homo sapiens
taaggccaagtctatttctgt

SEQ ID NO: 9034057 - DNA, 22 bp, Homo sapiens
taaggccaaactattatagttc

SEQ ID NO: 9034058 - DNA, 19 bp, Homo sapiens
taaggccaaaagtaagtgt

SEQ ID NO: 9034059 - DNA, 22 bp, Homo sapiens
taaggcagttttgcctgagata

SEQ ID NO: 9034060 - DNA, 22 bp, Homo sapiens
taaggcataaggccagaggcta

SEQ ID NO: 9034061 - DNA, 22 bp, Homo sapiens
taaggcagtgaaactattctgt

SEQ ID NO: 9034062 - DNA, 22 bp, Homo sapiens
taaggcagtagtgtctgtaggg

SEQ ID NO: 9034063 - DNA, 22 bp, Homo sapiens
taaggcagtgagaagaaacagg

SEQ ID NO: 9034064 - DNA, 22 bp, Homo sapiens
taaggcagtgagaagaaacagg

SEQ ID NO: 9034065 - DNA, 22 bp, Homo sapiens
taaggcagtgagaagaaacagg

SEQ ID NO: 9034066 - DNA, 22 bp, Homo sapiens
taagtgcatctgatctttcatg

SEQ ID NO: 9034067 - DNA, 22 bp, Homo sapiens
taagtgcaatgttttacttaaa

SEQ ID NO: 9034068 - DNA, 22 bp, Homo sapiens
taagtgcatgattgaacttggc

SEQ ID NO: 9034069 - DNA, 22 bp, Homo sapiens
taagtgcaatgttttacttaaa

SEQ ID NO: 9034070 - DNA, 22 bp, Homo sapiens
taagtgatttgtagtatactat

SEQ ID NO: 9034071 - DNA, 23 bp, Homo sapiens
taagtgattccaagtttcaggga

SEQ ID NO: 9034072 - DNA, 22 bp, Homo sapiens
taagtgatttgtagtatactat

SEQ ID NO: 9034073 - DNA, 22 bp, Homo sapiens
taagtgatgagcacagtaatta

SEQ ID NO: 9034074 - DNA, 22 bp, Homo sapiens
taagtgatgtcttggttaatga

SEQ ID NO: 9034075 - DNA, 23 bp, Homo sapiens
taagtgattagaatttgctgtca

SEQ ID NO: 9034076 - DNA, 22 bp, Homo sapiens
taagtgagttcttgctagattt

SEQ ID NO: 9034077 - DNA, 22 bp, Homo sapiens
taagtgatgaaagcagatgtct

SEQ ID NO: 9034078 - DNA, 23 bp, Homo sapiens
taagtgataaagagtagagatgg

SEQ ID NO: 9034079 - DNA, 20 bp, Homo sapiens
taagtgagaacatgtggtat

SEQ ID NO: 9034080 - DNA, 22 bp, Homo sapiens
taagtgagaactaaaccttctg

SEQ ID NO: 9034081 - DNA, 22 bp, Homo sapiens
taagtgaatccttgagaagaaa

SEQ ID NO: 9034082 - DNA, 22 bp, Homo sapiens
taagtgaattgtccgaggacac

SEQ ID NO: 9034083 - DNA, 22 bp, Homo sapiens
taagtgaattgtccgaggacac

SEQ ID NO: 9034084 - DNA, 22 bp, Homo sapiens
taagtgagaaagacattaactg

SEQ ID NO: 9034085 - DNA, 22 bp, Homo sapiens
taagtgagctagcagaagtgac

SEQ ID NO: 9034086 - DNA, 22 bp, Homo sapiens
taagtgagctagcagaagtgac

SEQ ID NO: 9034087 - DNA, 22 bp, Homo sapiens
taagtgagggagctgggacttg

SEQ ID NO: 9034088 - DNA, 22 bp, Homo sapiens
taagtgagatctgaaatgaaat

SEQ ID NO: 9034089 - DNA, 22 bp, Homo sapiens
taagtgagccctcagagtatgg

SEQ ID NO: 9034090 - DNA, 22 bp, Homo sapiens
taagtagatgcaaaatggagtt

SEQ ID NO: 9034091 - DNA, 22 bp, Homo sapiens
taagtgaatattttcttctgta

SEQ ID NO: 9034092 - DNA, 22 bp, Homo sapiens
taagtgaatattttcttctgta

SEQ ID NO: 9034093 - DNA, 22 bp, Homo sapiens
taagtgaatattttcttctgta

SEQ ID NO: 9034094 - DNA, 22 bp, Homo sapiens
taagtagactgttgaacttggt

SEQ ID NO: 9034095 - DNA, 22 bp, Homo sapiens
taagtacatttgggaccacctg

SEQ ID NO: 9034096 - DNA, 22 bp, Homo sapiens
taagtacatttgggaccacctg

SEQ ID NO: 9034097 - DNA, 22 bp, Homo sapiens
taagtacaaatgtatacataag

SEQ ID NO: 9034098 - DNA, 22 bp, Homo sapiens
taagtacaaatgtatacataag

SEQ ID NO: 9034099 - DNA, 22 bp, Homo sapiens
taagtacaaatgtatacataag

SEQ ID NO: 9034100 - DNA, 22 bp, Homo sapiens
taagtacagaatgaggagatgt

SEQ ID NO: 9034101 - DNA, 22 bp, Homo sapiens
taagtacagaatgaggagatgt

SEQ ID NO: 9034102 - DNA, 22 bp, Homo sapiens
taagtacaaatgtatacataag

SEQ ID NO: 9034103 - DNA, 22 bp, Homo sapiens
taagtacaaatgtatacataag

SEQ ID NO: 9034104 - DNA, 22 bp, Homo sapiens
taagtaactgcataattaaatt

SEQ ID NO: 9034105 - DNA, 22 bp, Homo sapiens
taagtacaaatgtatacataag

SEQ ID NO: 9034106 - DNA, 22 bp, Homo sapiens
taagtacaaatgtatacataag

SEQ ID NO: 9034107 - DNA, 22 bp, Homo sapiens
taagtaattgcagcaatttgcc

SEQ ID NO: 9034108 - DNA, 22 bp, Homo sapiens
taagtaatttgtgcagagatac

SEQ ID NO: 9034109 - DNA, 22 bp, Homo sapiens
taagtaatttgtgcagagatac

SEQ ID NO: 9034110 - DNA, 22 bp, Homo sapiens
taagtaaatttataatgtgatt

SEQ ID NO: 9034111 - DNA, 22 bp, Homo sapiens
taagtaaatttataatgtgatt

SEQ ID NO: 9034112 - DNA, 22 bp, Homo sapiens
taagtaaatttataatgtgatt

SEQ ID NO: 9034113 - DNA, 22 bp, Homo sapiens
taagtaaatttataatgtgatt

SEQ ID NO: 9034114 - DNA, 22 bp, Homo sapiens
taagtaaaacattcaagaagtc

SEQ ID NO: 9034115 - DNA, 22 bp, Homo sapiens
taagtaaaacattcaagaagtc

SEQ ID NO: 9034116 - DNA, 22 bp, Homo sapiens
taagtaaatttataatgtgatt

SEQ ID NO: 9034117 - DNA, 22 bp, Homo sapiens
taagtaaatttataatgtgatt

SEQ ID NO: 9034118 - DNA, 22 bp, Homo sapiens
taagtaaaacattcaagaagtc

SEQ ID NO: 9034119 - DNA, 22 bp, Homo sapiens
taaggttttgagaccagaacgt

SEQ ID NO: 9034120 - DNA, 22 bp, Homo sapiens
taaggttttgagaccagaacgt

SEQ ID NO: 9034121 - DNA, 22 bp, Homo sapiens
taagtaaaacattcaagaagtc

SEQ ID NO: 9034122 - DNA, 22 bp, Homo sapiens
taagtaaaacattcaagaagtc

SEQ ID NO: 9034123 - DNA, 22 bp, Homo sapiens
taaggtttgtggggagcaaaag

SEQ ID NO: 9034124 - DNA, 22 bp, Homo sapiens
taaggtttggctgtctcttggt

SEQ ID NO: 9034125 - DNA, 22 bp, Homo sapiens
taatacatgtattccagagagt

SEQ ID NO: 9034126 - DNA, 22 bp, Homo sapiens
taatacattacctaacctctct

SEQ ID NO: 9034127 - DNA, 22 bp, Homo sapiens
taatacattacctaacctctct

SEQ ID NO: 9034128 - DNA, 22 bp, Homo sapiens
taatacattacctaacctctct

SEQ ID NO: 9034129 - DNA, 22 bp, Homo sapiens
taataccactgtgctcattata

SEQ ID NO: 9034130 - DNA, 22 bp, Homo sapiens
taatacatcattcatctaagga

SEQ ID NO: 9034131 - DNA, 22 bp, Homo sapiens
taatacatcattcatctaagga

SEQ ID NO: 9034132 - DNA, 22 bp, Homo sapiens
taatacatcattcatctaagga

SEQ ID NO: 9034133 - DNA, 22 bp, Homo sapiens
taatacatcattcatctaagga

SEQ ID NO: 9034134 - DNA, 22 bp, Homo sapiens
taatacatcattcatctaagga

SEQ ID NO: 9034135 - DNA, 21 bp, Homo sapiens
taatactgaaagtgacatctg

SEQ ID NO: 9034136 - DNA, 22 bp, Homo sapiens
taatactagtgaatagcaggat

SEQ ID NO: 9034137 - DNA, 22 bp, Homo sapiens
taatactgaaagggaaatgtcc

SEQ ID NO: 9034138 - DNA, 22 bp, Homo sapiens
taagtggcagagcttgttctca

SEQ ID NO: 9034139 - DNA, 22 bp, Homo sapiens
taagtggaaggttatatgctaa

SEQ ID NO: 9034140 - DNA, 22 bp, Homo sapiens
taagtggtaccaagctcagtga

SEQ ID NO: 9034141 - DNA, 22 bp, Homo sapiens
taagtggttgcttgttttcatt

SEQ ID NO: 9034142 - DNA, 22 bp, Homo sapiens
taagtgtccctattgtgatttt

SEQ ID NO: 9034143 - DNA, 22 bp, Homo sapiens
taagtgttgatctgagtgctaa

SEQ ID NO: 9034144 - DNA, 22 bp, Homo sapiens
taagtgtctctcgaattatgct

SEQ ID NO: 9034145 - DNA, 22 bp, Homo sapiens
taataagtctgttgtttaattg

SEQ ID NO: 9034146 - DNA, 22 bp, Homo sapiens
taataagtctgttgtttaattg

SEQ ID NO: 9034147 - DNA, 22 bp, Homo sapiens
taatacagggcactttgagtga

SEQ ID NO: 9034148 - DNA, 22 bp, Homo sapiens
taataattaacagtgatgggtc

SEQ ID NO: 9034149 - DNA, 22 bp, Homo sapiens
taataatagcagtagctgccac

SEQ ID NO: 9034150 - DNA, 22 bp, Homo sapiens
taataatagcagtagctgccac

SEQ ID NO: 9034151 - DNA, 22 bp, Homo sapiens
taataatagcagtagctgccac

SEQ ID NO: 9034152 - DNA, 22 bp, Homo sapiens
taatacatcattcatctaagga

SEQ ID NO: 9034153 - DNA, 22 bp, Homo sapiens
taatacagtagcttttacacag

SEQ ID NO: 9034154 - DNA, 22 bp, Homo sapiens
taatagaatagtggaaacattg

SEQ ID NO: 9034155 - DNA, 22 bp, Homo sapiens
taatagaatagtggaaacattg

SEQ ID NO: 9034156 - DNA, 22 bp, Homo sapiens
taatagaatagtggaaacattg

SEQ ID NO: 9034157 - DNA, 22 bp, Homo sapiens
taatagaatagtggaaacattg

SEQ ID NO: 9034158 - DNA, 22 bp, Homo sapiens
taatagaatagtggaaacattg

SEQ ID NO: 9034159 - DNA, 22 bp, Homo sapiens
taatagcattatcatcaaaact

SEQ ID NO: 9034160 - DNA, 22 bp, Homo sapiens
taatagcattatcatcaaaact

SEQ ID NO: 9034161 - DNA, 22 bp, Homo sapiens
taatagctttgttgtttgtgat

SEQ ID NO: 9034162 - DNA, 22 bp, Homo sapiens
taatagcttttatgcagtctgt

SEQ ID NO: 9034163 - DNA, 22 bp, Homo sapiens
taatggcattgattacatgaaa

SEQ ID NO: 9034164 - DNA, 22 bp, Homo sapiens
taatggcagagtcatgctttct

SEQ ID NO: 9034165 - DNA, 22 bp, Homo sapiens
taatggcagagtcatgctttct

SEQ ID NO: 9034166 - DNA, 22 bp, Homo sapiens
taatagctgttattgttataac

SEQ ID NO: 9034167 - DNA, 23 bp, Homo sapiens
taatagctgatgttggttttaat

SEQ ID NO: 9034168 - DNA, 22 bp, Homo sapiens
taatagctgttattgttataac

SEQ ID NO: 9034169 - DNA, 22 bp, Homo sapiens
taatggctaaaattcagaagaa

SEQ ID NO: 9034170 - DNA, 22 bp, Homo sapiens
taatggtatttcaagacttgcc

SEQ ID NO: 9034171 - DNA, 22 bp, Homo sapiens
taatgtttccagtctatgatgg

SEQ ID NO: 9034172 - DNA, 22 bp, Homo sapiens
taatgtttagaagcagacagct

SEQ ID NO: 9034173 - DNA, 22 bp, Homo sapiens
taatgtttagaagcagacagct

SEQ ID NO: 9034174 - DNA, 22 bp, Homo sapiens
taatgtttagaagcagacagct

SEQ ID NO: 9034175 - DNA, 22 bp, Homo sapiens
taatacttttgccttgtattca

SEQ ID NO: 9034176 - DNA, 22 bp, Homo sapiens
taatacttaccttgcagagtct

SEQ ID NO: 9034177 - DNA, 22 bp, Homo sapiens
taatacttaccttgcagagtct

SEQ ID NO: 9034178 - DNA, 22 bp, Homo sapiens
taatacttttgccttgtattca

SEQ ID NO: 9034179 - DNA, 22 bp, Homo sapiens
taatagaaaggtattttttgca

SEQ ID NO: 9034180 - DNA, 22 bp, Homo sapiens
taatagaatagtggaaacattg

SEQ ID NO: 9034181 - DNA, 22 bp, Homo sapiens
taatagaatagtggaaacattg

SEQ ID NO: 9034182 - DNA, 22 bp, Homo sapiens
taatagaatagtggaaacattg

SEQ ID NO: 9034183 - DNA, 22 bp, Homo sapiens
taatagaatagtggaaacattg

SEQ ID NO: 9034184 - DNA, 22 bp, Homo sapiens
taatagaatagtggaaacattg

SEQ ID NO: 9034185 - DNA, 22 bp, Homo sapiens
taatactgtgcttcattttcct

SEQ ID NO: 9034186 - DNA, 22 bp, Homo sapiens
taattataacagttacatctta

SEQ ID NO: 9034187 - DNA, 22 bp, Homo sapiens
taattataacagttacatctta

SEQ ID NO: 9034188 - DNA, 22 bp, Homo sapiens
taattataacagttacatctta

SEQ ID NO: 9034189 - DNA, 22 bp, Homo sapiens
taattataacagttacatctta

SEQ ID NO: 9034190 - DNA, 22 bp, Homo sapiens
taattataacagttacatctta

SEQ ID NO: 9034191 - DNA, 22 bp, Homo sapiens
taattataacagttacatctta

SEQ ID NO: 9034192 - DNA, 22 bp, Homo sapiens
taattataacagttacatctta

SEQ ID NO: 9034193 - DNA, 22 bp, Homo sapiens
taattataaactgcagtaggta

SEQ ID NO: 9034194 - DNA, 22 bp, Homo sapiens
taattataaactgcagtaggta

SEQ ID NO: 9034195 - DNA, 21 bp, Homo sapiens
taattagcaaagctgagattc

SEQ ID NO: 9034196 - DNA, 23 bp, Homo sapiens
taattagatgttgattcctgaga

SEQ ID NO: 9034197 - DNA, 23 bp, Homo sapiens
taattagatgttgattcctgaga

SEQ ID NO: 9034198 - DNA, 22 bp, Homo sapiens
taattataacatgctttctggc

SEQ ID NO: 9034199 - DNA, 22 bp, Homo sapiens
taattataacatgctttctggc

SEQ ID NO: 9034200 - DNA, 22 bp, Homo sapiens
taattataacatgctttctggc

SEQ ID NO: 9034201 - DNA, 22 bp, Homo sapiens
taattataacatgctttctggc

SEQ ID NO: 9034202 - DNA, 22 bp, Homo sapiens
taattatacaaaaaggcatgca

SEQ ID NO: 9034203 - DNA, 22 bp, Homo sapiens
taattatacaaaaaggcatgca

SEQ ID NO: 9034204 - DNA, 22 bp, Homo sapiens
taattataacagttacatctta

SEQ ID NO: 9034205 - DNA, 22 bp, Homo sapiens
taattataacagttacatctta

SEQ ID NO: 9034206 - DNA, 22 bp, Homo sapiens
taattataacatgctttctggc

SEQ ID NO: 9034207 - DNA, 22 bp, Homo sapiens
taattataacagttacatctta

SEQ ID NO: 9034208 - DNA, 22 bp, Homo sapiens
taattataacatgctttctggc

SEQ ID NO: 9034209 - DNA, 22 bp, Homo sapiens
taattatacaaaaaggcatgca

SEQ ID NO: 9034210 - DNA, 22 bp, Homo sapiens
taattatagcattggagtggcc

SEQ ID NO: 9034211 - DNA, 22 bp, Homo sapiens
taattatacaaaaaggcatgca

SEQ ID NO: 9034212 - DNA, 22 bp, Homo sapiens
taattatacaaaaaggcatgca

SEQ ID NO: 9034213 - DNA, 22 bp, Homo sapiens
taattatacaaaaaggcatgca

SEQ ID NO: 9034214 - DNA, 22 bp, Homo sapiens
taattatagccgctattttgct

SEQ ID NO: 9034215 - DNA, 22 bp, Homo sapiens
taattacaggtccaaaacaatc

SEQ ID NO: 9034216 - DNA, 22 bp, Homo sapiens
taattacaggtccaaaacaatc

SEQ ID NO: 9034217 - DNA, 22 bp, Homo sapiens
taattacaggtccaaaacaatc

SEQ ID NO: 9034218 - DNA, 22 bp, Homo sapiens
taattacaggtccaaaacaatc

SEQ ID NO: 9034219 - DNA, 22 bp, Homo sapiens
taattactggaaatttcaaata

SEQ ID NO: 9034220 - DNA, 22 bp, Homo sapiens
taattagagtttggtaaacaat

SEQ ID NO: 9034221 - DNA, 22 bp, Homo sapiens
taattacaggtccaaaacaatc

SEQ ID NO: 9034222 - DNA, 22 bp, Homo sapiens
taattacagaggtttgccagtt

SEQ ID NO: 9034223 - DNA, 22 bp, Homo sapiens
taatgtttttctcaacattgct

SEQ ID NO: 9034224 - DNA, 22 bp, Homo sapiens
taatgtttttctcaacattgct

SEQ ID NO: 9034225 - DNA, 22 bp, Homo sapiens
taatgtttgggaaggtgctttg

SEQ ID NO: 9034226 - DNA, 22 bp, Homo sapiens
taatgtttgggaaggtgctttg

SEQ ID NO: 9034227 - DNA, 22 bp, Homo sapiens
taatgtttgagatgttggattt

SEQ ID NO: 9034228 - DNA, 22 bp, Homo sapiens
taattaacatacaaaacagctg

SEQ ID NO: 9034229 - DNA, 22 bp, Homo sapiens
taatgtttttctcaacattgct

SEQ ID NO: 9034230 - DNA, 22 bp, Homo sapiens
taattacaaagcaagcacaggg

SEQ ID NO: 9034231 - DNA, 22 bp, Homo sapiens
taattacaaagcaagcacaggg

SEQ ID NO: 9034232 - DNA, 22 bp, Homo sapiens
tacaaagagtttggtctctaga

SEQ ID NO: 9034233 - DNA, 22 bp, Homo sapiens
tacaaagagtttggtctctaga

SEQ ID NO: 9034234 - DNA, 22 bp, Homo sapiens
tacaaagaggtaattgcatata

SEQ ID NO: 9034235 - DNA, 22 bp, Homo sapiens
tacaaagagtttggtctctaga

SEQ ID NO: 9034236 - DNA, 22 bp, Homo sapiens
tacaaagagtttggtctctaga

SEQ ID NO: 9034237 - DNA, 22 bp, Homo sapiens
tacaaagagtttggtctctaga

SEQ ID NO: 9034238 - DNA, 22 bp, Homo sapiens
tacaaagaggtaattgcatata

SEQ ID NO: 9034239 - DNA, 22 bp, Homo sapiens
tacaaagaggtaattgcatata

SEQ ID NO: 9034240 - DNA, 22 bp, Homo sapiens
tacaaactgttattattattgt

SEQ ID NO: 9034241 - DNA, 22 bp, Homo sapiens
tacaaacttgttttaagtaagt

SEQ ID NO: 9034242 - DNA, 22 bp, Homo sapiens
tacaaactgttattattattgt

SEQ ID NO: 9034243 - DNA, 22 bp, Homo sapiens
tacaaactgttattattattgt

SEQ ID NO: 9034244 - DNA, 22 bp, Homo sapiens
tacaaacttgttttaagtaagt

SEQ ID NO: 9034245 - DNA, 22 bp, Homo sapiens
tacaaacttgttttaagtaagt

SEQ ID NO: 9034246 - DNA, 20 bp, Homo sapiens
tacaaagaatgaggttcagg

SEQ ID NO: 9034247 - DNA, 20 bp, Homo sapiens
tacaaagaatgaggttcagg

SEQ ID NO: 9034248 - DNA, 20 bp, Homo sapiens
tacaaagaatgaggttcagg

SEQ ID NO: 9034249 - DNA, 22 bp, Homo sapiens
tacaaagaggcagctccatttt

SEQ ID NO: 9034250 - DNA, 20 bp, Homo sapiens
tacaaagagcccctctcttc

SEQ ID NO: 9034251 - DNA, 20 bp, Homo sapiens
tacaaagagcccctctcttc

SEQ ID NO: 9034252 - DNA, 20 bp, Homo sapiens
tacaaagaatgaggttcagg

SEQ ID NO: 9034253 - DNA, 22 bp, Homo sapiens
tacaaactctttatatttcata

SEQ ID NO: 9034254 - DNA, 22 bp, Homo sapiens
tacaaactctttatatttcata

SEQ ID NO: 9034255 - DNA, 22 bp, Homo sapiens
tacaaactctttatatttcata

SEQ ID NO: 9034256 - DNA, 18 bp, Homo sapiens
tacaaactccttgaaggc

SEQ ID NO: 9034257 - DNA, 22 bp, Homo sapiens
tacaaactccgaagtttgtacc

SEQ ID NO: 9034258 - DNA, 22 bp, Homo sapiens
tacaaactccgaagtttgtacc

SEQ ID NO: 9034259 - DNA, 22 bp, Homo sapiens
tacaaactgttattattattgt

SEQ ID NO: 9034260 - DNA, 22 bp, Homo sapiens
tacaaactgttattattattgt

SEQ ID NO: 9034261 - DNA, 22 bp, Homo sapiens
tacaaactgttattattattgt

SEQ ID NO: 9034262 - DNA, 22 bp, Homo sapiens
tacaaactgttattattattgt

SEQ ID NO: 9034263 - DNA, 22 bp, Homo sapiens
tacaaactctttatatttcata

SEQ ID NO: 9034264 - DNA, 22 bp, Homo sapiens
tacaaactctttatatttcata

SEQ ID NO: 9034265 - DNA, 22 bp, Homo sapiens
tacaaactgtccagcccagagg

SEQ ID NO: 9034266 - DNA, 22 bp, Homo sapiens
tacaaactgtccagcccagagg

SEQ ID NO: 9034267 - DNA, 22 bp, Homo sapiens
tacaaactctttatatttcata

SEQ ID NO: 9034268 - DNA, 22 bp, Homo sapiens
taattatagccgctattttgct

SEQ ID NO: 9034269 - DNA, 22 bp, Homo sapiens
taattatagccgctattttgct

SEQ ID NO: 9034270 - DNA, 22 bp, Homo sapiens
taattatagccgctattttgct

SEQ ID NO: 9034271 - DNA, 22 bp, Homo sapiens
taattatagccgctattttgct

SEQ ID NO: 9034272 - DNA, 23 bp, Homo sapiens
taattatggaataatttgcaacg

SEQ ID NO: 9034273 - DNA, 23 bp, Homo sapiens
taattatggaataatttgcaacg

SEQ ID NO: 9034274 - DNA, 23 bp, Homo sapiens
taattatggaataatttgcaacg

SEQ ID NO: 9034275 - DNA, 22 bp, Homo sapiens
taattatagccgctattttgct

SEQ ID NO: 9034276 - DNA, 22 bp, Homo sapiens
taattatagccgctattttgct

SEQ ID NO: 9034277 - DNA, 22 bp, Homo sapiens
tacaaaaaattgatactgacga

SEQ ID NO: 9034278 - DNA, 22 bp, Homo sapiens
taattatgtatgcaagctcagt

SEQ ID NO: 9034279 - DNA, 22 bp, Homo sapiens
taattatgtatgcaagctcagt

SEQ ID NO: 9034280 - DNA, 23 bp, Homo sapiens
taattatggaataatttgcaacg

SEQ ID NO: 9034281 - DNA, 22 bp, Homo sapiens
tacaaaaaattgatactgacga

SEQ ID NO: 9034282 - DNA, 22 bp, Homo sapiens
tacaaaaaattgatactgacga

SEQ ID NO: 9034283 - DNA, 22 bp, Homo sapiens
tacaaaaaattgatactgacga

SEQ ID NO: 9034284 - DNA, 22 bp, Homo sapiens
tacaaagctgtatagcctggtc

SEQ ID NO: 9034285 - DNA, 22 bp, Homo sapiens
tacaaagcctggtagatatctg

SEQ ID NO: 9034286 - DNA, 22 bp, Homo sapiens
tacaaagcttgtactgtgtgac

SEQ ID NO: 9034287 - DNA, 22 bp, Homo sapiens
tacaaaggacagcagaaaaata

SEQ ID NO: 9034288 - DNA, 22 bp, Homo sapiens
tacaaaggacagcagaaaaata

SEQ ID NO: 9034289 - DNA, 22 bp, Homo sapiens
tacaaaggacagcagaaaaata

SEQ ID NO: 9034290 - DNA, 22 bp, Homo sapiens
tacaaaggacagcagaaaaata

SEQ ID NO: 9034291 - DNA, 22 bp, Homo sapiens
tacaaaggagactctgtattta

SEQ ID NO: 9034292 - DNA, 22 bp, Homo sapiens
tacaaaggagactctgtattta

SEQ ID NO: 9034293 - DNA, 19 bp, Homo sapiens
tacaaaggaggatgtaaaa

SEQ ID NO: 9034294 - DNA, 22 bp, Homo sapiens
tacaaaggagataaattggagg

SEQ ID NO: 9034295 - DNA, 22 bp, Homo sapiens
tacaaagataaaatctcaccat

SEQ ID NO: 9034296 - DNA, 22 bp, Homo sapiens
tacaaagatagtgttagagtaa

SEQ ID NO: 9034297 - DNA, 22 bp, Homo sapiens
tacaaagatagtgttagagtaa

SEQ ID NO: 9034298 - DNA, 22 bp, Homo sapiens
tacaaagatagtgttagagtaa

SEQ ID NO: 9034299 - DNA, 22 bp, Homo sapiens
tacaaagatagtgttagagtaa

SEQ ID NO: 9034300 - DNA, 22 bp, Homo sapiens
tacaaagatggaaggttatgtt

SEQ ID NO: 9034301 - DNA, 22 bp, Homo sapiens
tacaaagcaaatcatctaagag

SEQ ID NO: 9034302 - DNA, 22 bp, Homo sapiens
tacaaagatagtgttagagtaa

SEQ ID NO: 9034303 - DNA, 22 bp, Homo sapiens
tacaaaggcttaaagagatttc

SEQ ID NO: 9034304 - DNA, 22 bp, Homo sapiens
tacaaaggcttaaagagatttc

SEQ ID NO: 9034305 - DNA, 22 bp, Homo sapiens
tacaaaggcttaaagagatttc

SEQ ID NO: 9034306 - DNA, 22 bp, Homo sapiens
tacaaagtaatgtataatatcg

SEQ ID NO: 9034307 - DNA, 22 bp, Homo sapiens
tacaaagggggaagagattctg

SEQ ID NO: 9034308 - DNA, 22 bp, Homo sapiens
tacaaaggagtagagaaggctt

SEQ ID NO: 9034309 - DNA, 22 bp, Homo sapiens
tacaaaggagtagagaaggctt

SEQ ID NO: 9034310 - DNA, 22 bp, Homo sapiens
tacaaaggaggtgcatagaaca

SEQ ID NO: 9034311 - DNA, 22 bp, Homo sapiens
tacaaaggaggtgcatagaaca

SEQ ID NO: 9034312 - DNA, 22 bp, Homo sapiens
tacaaaggaggtgcatagaaca

SEQ ID NO: 9034313 - DNA, 22 bp, Homo sapiens
tacaaagtcacattgaaatgaa

SEQ ID NO: 9034314 - DNA, 22 bp, Homo sapiens
tacaaagtatatttctagctgt

SEQ ID NO: 9034315 - DNA, 22 bp, Homo sapiens
tacaaagtaatgtataatatcg

SEQ ID NO: 9034316 - DNA, 22 bp, Homo sapiens
tacaaagtaatgtataatatcg

SEQ ID NO: 9034317 - DNA, 22 bp, Homo sapiens
tacagagtgttattacagaatc

SEQ ID NO: 9034318 - DNA, 22 bp, Homo sapiens
tacagagtggtgagatcttttg

SEQ ID NO: 9034319 - DNA, 22 bp, Homo sapiens
tacagagtatttttaatatggt

SEQ ID NO: 9034320 - DNA, 22 bp, Homo sapiens
tacagagttttcctgccaagaa

SEQ ID NO: 9034321 - DNA, 22 bp, Homo sapiens
tacagagttttcctgccaagaa

SEQ ID NO: 9034322 - DNA, 22 bp, Homo sapiens
tacagaagtaaataccaaaagc

SEQ ID NO: 9034323 - DNA, 22 bp, Homo sapiens
tacagagtgttattacagaatc

SEQ ID NO: 9034324 - DNA, 22 bp, Homo sapiens
tacagagtgttattacagaatc

SEQ ID NO: 9034325 - DNA, 22 bp, Homo sapiens
tacagagtatttttaatatggt

SEQ ID NO: 9034326 - DNA, 22 bp, Homo sapiens
tacagaagtaaataccaaaagc

SEQ ID NO: 9034327 - DNA, 22 bp, Homo sapiens
tacagaagtaaataccaaaagc

SEQ ID NO: 9034328 - DNA, 17 bp, Homo sapiens
tacagaaggcaccacaa

SEQ ID NO: 9034329 - DNA, 17 bp, Homo sapiens
tacagaaggcaccacaa

SEQ ID NO: 9034330 - DNA, 22 bp, Homo sapiens
tacagatacagatctagataca

SEQ ID NO: 9034331 - DNA, 22 bp, Homo sapiens
tacagatagaattagtgagtta

SEQ ID NO: 9034332 - DNA, 22 bp, Homo sapiens
tacagatacagatctagataca

SEQ ID NO: 9034333 - DNA, 22 bp, Homo sapiens
tacagataactgaatgcagact

SEQ ID NO: 9034334 - DNA, 22 bp, Homo sapiens
tacagataaattttaagtagaa

SEQ ID NO: 9034335 - DNA, 22 bp, Homo sapiens
tacagataactgaatgcagact

SEQ ID NO: 9034336 - DNA, 22 bp, Homo sapiens
tacagagttttcctgccaagaa

SEQ ID NO: 9034337 - DNA, 22 bp, Homo sapiens
tacagaaatcacatcgctttga

SEQ ID NO: 9034338 - DNA, 22 bp, Homo sapiens
tacagaaattgccaccagctct

SEQ ID NO: 9034339 - DNA, 22 bp, Homo sapiens
tacagaaattgccaccagctct

SEQ ID NO: 9034340 - DNA, 22 bp, Homo sapiens
tacagaaattgccaccagctct

SEQ ID NO: 9034341 - DNA, 22 bp, Homo sapiens
tacagaaatacagtcaggccta

SEQ ID NO: 9034342 - DNA, 22 bp, Homo sapiens
tacagaaatacagtcaggccta

SEQ ID NO: 9034343 - DNA, 22 bp, Homo sapiens
tacagaaatactggggggttct

SEQ ID NO: 9034344 - DNA, 22 bp, Homo sapiens
tacagaaatcacatcgctttga

SEQ ID NO: 9034345 - DNA, 23 bp, Homo sapiens
tacagaaggagtagtcactaaga

SEQ ID NO: 9034346 - DNA, 22 bp, Homo sapiens
tacagaaggaagtttagctaaa

SEQ ID NO: 9034347 - DNA, 23 bp, Homo sapiens
tacagaaggagtagtcactaaga

SEQ ID NO: 9034348 - DNA, 23 bp, Homo sapiens
tacagaaggagtagtcactaaga

SEQ ID NO: 9034349 - DNA, 23 bp, Homo sapiens
tacagaaggagtagtcactaaga

SEQ ID NO: 9034350 - DNA, 22 bp, Homo sapiens
tacagaagcttttgaaaagatg

SEQ ID NO: 9034351 - DNA, 22 bp, Homo sapiens
tacagaagcttttgaaaagatg

SEQ ID NO: 9034352 - DNA, 22 bp, Homo sapiens
tacagaagcttttgaaaagatg

SEQ ID NO: 9034353 - DNA, 22 bp, Homo sapiens
tacagaagctgagacactgaga

SEQ ID NO: 9034354 - DNA, 22 bp, Homo sapiens
tacagaagctgagacactgaga

SEQ ID NO: 9034355 - DNA, 18 bp, Homo sapiens
tacagaactggagtagaa

SEQ ID NO: 9034356 - DNA, 22 bp, Homo sapiens
tacagaactgaagtagtgaaaa

SEQ ID NO: 9034357 - DNA, 22 bp, Homo sapiens
tacagaagctgagacactgaga

SEQ ID NO: 9034358 - DNA, 22 bp, Homo sapiens
tacagaactgaagtagtgaaaa

SEQ ID NO: 9034359 - DNA, 22 bp, Homo sapiens
tacagaaattgccaccagctct

SEQ ID NO: 9034360 - DNA, 22 bp, Homo sapiens
tacagcaatggttctaagagtc

SEQ ID NO: 9034361 - DNA, 22 bp, Homo sapiens
tacagcaatggttctaagagtc

SEQ ID NO: 9034362 - DNA, 22 bp, Homo sapiens
tacagcaatgctacaagatgac

SEQ ID NO: 9034363 - DNA, 22 bp, Homo sapiens
tacagcaatgctacaagatgac

SEQ ID NO: 9034364 - DNA, 22 bp, Homo sapiens
tacagcacagcaaagaggacgg

SEQ ID NO: 9034365 - DNA, 22 bp, Homo sapiens
tacagcacagcaaagaggacgg

SEQ ID NO: 9034366 - DNA, 22 bp, Homo sapiens
tacagcacaaagggcctttacc

SEQ ID NO: 9034367 - DNA, 22 bp, Homo sapiens
tacagcaatggttctaagagtc

SEQ ID NO: 9034368 - DNA, 22 bp, Homo sapiens
tacagcaatgcctgaaatagta

SEQ ID NO: 9034369 - DNA, 22 bp, Homo sapiens
tacagcaatgcctgaaatagta

SEQ ID NO: 9034370 - DNA, 22 bp, Homo sapiens
tacagcaatgcctgaaatagta

SEQ ID NO: 9034371 - DNA, 22 bp, Homo sapiens
tacagcaatgcctgaaatagta

SEQ ID NO: 9034372 - DNA, 22 bp, Homo sapiens
tacagcaatgcctgaaatagta

SEQ ID NO: 9034373 - DNA, 22 bp, Homo sapiens
tacagcaatgcctgaaatagta

SEQ ID NO: 9034374 - DNA, 22 bp, Homo sapiens
tacagcaatgcctgaaatagta

SEQ ID NO: 9034375 - DNA, 22 bp, Homo sapiens
tacagattttgtgaagaagtgt

SEQ ID NO: 9034376 - DNA, 22 bp, Homo sapiens
tacagcaaagaaaccctcagtc

SEQ ID NO: 9034377 - DNA, 22 bp, Homo sapiens
tacagcaaagaaaccctcagtc

SEQ ID NO: 9034378 - DNA, 21 bp, Homo sapiens
tacagcaacggaggttttcta

SEQ ID NO: 9034379 - DNA, 22 bp, Homo sapiens
tacagatttggggagtaaagtt

SEQ ID NO: 9034380 - DNA, 22 bp, Homo sapiens
tacagatttggggagtaaagtt

SEQ ID NO: 9034381 - DNA, 22 bp, Homo sapiens
tacagattttgtgaagaagtgt

SEQ ID NO: 9034382 - DNA, 22 bp, Homo sapiens
tacagattttgtgaagaagtgt

SEQ ID NO: 9034383 - DNA, 22 bp, Homo sapiens
tacagattttgtgaagaagtgt

SEQ ID NO: 9034384 - DNA, 22 bp, Homo sapiens
tacagcaataatgacaccgctc

SEQ ID NO: 9034385 - DNA, 22 bp, Homo sapiens
tacagcaataatgacaccgctc

SEQ ID NO: 9034386 - DNA, 22 bp, Homo sapiens
tacagcaataatgacaccgctc

SEQ ID NO: 9034387 - DNA, 23 bp, Homo sapiens
tacagcaaggacaacataggtgg

SEQ ID NO: 9034388 - DNA, 23 bp, Homo sapiens
tacagcaaggacaacataggtgg

SEQ ID NO: 9034389 - DNA, 22 bp, Homo sapiens
tacagcaagacagaccgctcaa

SEQ ID NO: 9034390 - DNA, 22 bp, Homo sapiens
tacagatatagagatttataga

SEQ ID NO: 9034391 - DNA, 22 bp, Homo sapiens
tacagataggaggaatctgaaa

SEQ ID NO: 9034392 - DNA, 22 bp, Homo sapiens
tacagataggaggaatctgaaa

SEQ ID NO: 9034393 - DNA, 22 bp, Homo sapiens
tacagatatagggcgagcttag

SEQ ID NO: 9034394 - DNA, 22 bp, Homo sapiens
tacagatatgtatgcacttttt

SEQ ID NO: 9034395 - DNA, 22 bp, Homo sapiens
tacagatatgttccatgcatcg

SEQ ID NO: 9034396 - DNA, 22 bp, Homo sapiens
tacagatatgttccatgcatcg

SEQ ID NO: 9034397 - DNA, 22 bp, Homo sapiens
tacagatatgtatgcacttttt

SEQ ID NO: 9034398 - DNA, 22 bp, Homo sapiens
tacagatatagagatttataga

SEQ ID NO: 9034399 - DNA, 22 bp, Homo sapiens
tacagatattgtacagttatag

SEQ ID NO: 9034400 - DNA, 21 bp, Homo sapiens
tacagatgaggagaccaaggc

SEQ ID NO: 9034401 - DNA, 21 bp, Homo sapiens
tacagatgaggagaccaaggc

SEQ ID NO: 9034402 - DNA, 22 bp, Homo sapiens
tacagatatttctcttcaacaa

SEQ ID NO: 9034403 - DNA, 18 bp, Homo sapiens
tacagattatagatacat

SEQ ID NO: 9034404 - DNA, 22 bp, Homo sapiens
tacagattgaggtttttaatat

SEQ ID NO: 9034405 - DNA, 22 bp, Homo sapiens
tacagatttggggagtaaagtt

SEQ ID NO: 9034406 - DNA, 22 bp, Homo sapiens
tacagatttggggagtaaagtt

SEQ ID NO: 9034407 - DNA, 18 bp, Homo sapiens
tacagattatagatacat

SEQ ID NO: 9034408 - DNA, 22 bp, Homo sapiens
tacagattgaggtttttaatat

SEQ ID NO: 9034409 - DNA, 18 bp, Homo sapiens
tacagattatagatacat

SEQ ID NO: 9034410 - DNA, 18 bp, Homo sapiens
tacagattatagatacat

SEQ ID NO: 9034411 - DNA, 18 bp, Homo sapiens
tacagattatagatacat

SEQ ID NO: 9034412 - DNA, 22 bp, Homo sapiens
tacagaaagacctctcgggaaa

SEQ ID NO: 9034413 - DNA, 20 bp, Homo sapiens
tacagaaacaggacttttgg

SEQ ID NO: 9034414 - DNA, 20 bp, Homo sapiens
tacagaaacaggacttttgg

SEQ ID NO: 9034415 - DNA, 20 bp, Homo sapiens
tacagaaacaggacttttgg

SEQ ID NO: 9034416 - DNA, 22 bp, Homo sapiens
tacagaaagggatgattgatct

SEQ ID NO: 9034417 - DNA, 22 bp, Homo sapiens
tacagaaagggatgattgatct

SEQ ID NO: 9034418 - DNA, 22 bp, Homo sapiens
tacagaaagggatgattgatct

SEQ ID NO: 9034419 - DNA, 22 bp, Homo sapiens
tacagaaagggatgattgatct

SEQ ID NO: 9034420 - DNA, 22 bp, Homo sapiens
tacagaaagacctctcgggaaa

SEQ ID NO: 9034421 - DNA, 22 bp, Homo sapiens
tacagaaaaacttggaggcttt

SEQ ID NO: 9034422 - DNA, 22 bp, Homo sapiens
tacagaaaaactggcattgaag

SEQ ID NO: 9034423 - DNA, 22 bp, Homo sapiens
tacagaaaaactggcattgaag

SEQ ID NO: 9034424 - DNA, 22 bp, Homo sapiens
tacagaaaaacatctggagccg

SEQ ID NO: 9034425 - DNA, 22 bp, Homo sapiens
tacagaaaaactggcattgaag

SEQ ID NO: 9034426 - DNA, 22 bp, Homo sapiens
tacagaaacagcgtggttagaa

SEQ ID NO: 9034427 - DNA, 22 bp, Homo sapiens
tacagaaaaacttggaggcttt

SEQ ID NO: 9034428 - DNA, 22 bp, Homo sapiens
tacagaaacagcgtggttagaa

SEQ ID NO: 9034429 - DNA, 22 bp, Homo sapiens
tacaacagtaatcaaggttttt

SEQ ID NO: 9034430 - DNA, 22 bp, Homo sapiens
tacaacagttcatgaaatgaaa

SEQ ID NO: 9034431 - DNA, 22 bp, Homo sapiens
tacaacagttcatgaaatgaaa

SEQ ID NO: 9034432 - DNA, 22 bp, Homo sapiens
tacaacaggaatttcaactttg

SEQ ID NO: 9034433 - DNA, 22 bp, Homo sapiens
tacaacaggaatttcaactttg

SEQ ID NO: 9034434 - DNA, 22 bp, Homo sapiens
tacaacagtaatcaaggttttt

SEQ ID NO: 9034435 - DNA, 22 bp, Homo sapiens
tacactattttactgatacaaa

SEQ ID NO: 9034436 - DNA, 22 bp, Homo sapiens
tacaacagttcatgaaatgaaa

SEQ ID NO: 9034437 - DNA, 22 bp, Homo sapiens
tacaacagttcatgaaatgaaa

SEQ ID NO: 9034438 - DNA, 22 bp, Homo sapiens
tacaacataacgggcattcagt

SEQ ID NO: 9034439 - DNA, 22 bp, Homo sapiens
tacactcacccagcttggggcc

SEQ ID NO: 9034440 - DNA, 21 bp, Homo sapiens
tacactcatcctctcccaagg

SEQ ID NO: 9034441 - DNA, 21 bp, Homo sapiens
tacactcatcctctcccaagg

SEQ ID NO: 9034442 - DNA, 22 bp, Homo sapiens
tacactgaaagagaggattgaa

SEQ ID NO: 9034443 - DNA, 22 bp, Homo sapiens
tacactctaattctttggtcct

SEQ ID NO: 9034444 - DNA, 22 bp, Homo sapiens
tacactcttaggaattggttat

SEQ ID NO: 9034445 - DNA, 22 bp, Homo sapiens
tacactgaagtgtcttggtata

SEQ ID NO: 9034446 - DNA, 22 bp, Homo sapiens
tacagaaaaacatctggagccg

SEQ ID NO: 9034447 - DNA, 22 bp, Homo sapiens
tacagaaaaacatctggagccg

SEQ ID NO: 9034448 - DNA, 22 bp, Homo sapiens
tacagaaaaacatctggagccg

SEQ ID NO: 9034449 - DNA, 22 bp, Homo sapiens
tacagaaaaacatctggagccg

SEQ ID NO: 9034450 - DNA, 22 bp, Homo sapiens
tacactttttactacagattct

SEQ ID NO: 9034451 - DNA, 22 bp, Homo sapiens
tacactttttactacagattct

SEQ ID NO: 9034452 - DNA, 22 bp, Homo sapiens
tacactttttactacagattct

SEQ ID NO: 9034453 - DNA, 22 bp, Homo sapiens
tacacttttctggttactcttg

SEQ ID NO: 9034454 - DNA, 22 bp, Homo sapiens
tacacttttctggttactcttg

SEQ ID NO: 9034455 - DNA, 22 bp, Homo sapiens
tacactttttactacagattct

SEQ ID NO: 9034456 - DNA, 22 bp, Homo sapiens
tacacttttctggttactcttg

SEQ ID NO: 9034457 - DNA, 22 bp, Homo sapiens
tacactgagcaggaagaagtgg

SEQ ID NO: 9034458 - DNA, 22 bp, Homo sapiens
tacacttttcaatgtagtctgt

SEQ ID NO: 9034459 - DNA, 22 bp, Homo sapiens
tacaaagtcagaataacaggtg

SEQ ID NO: 9034460 - DNA, 22 bp, Homo sapiens
tacaaagtcagaataacaggtg

SEQ ID NO: 9034461 - DNA, 22 bp, Homo sapiens
tacaaagtcccattgccatgga

SEQ ID NO: 9034462 - DNA, 22 bp, Homo sapiens
tacaaagtgagcaacctctttt

SEQ ID NO: 9034463 - DNA, 22 bp, Homo sapiens
tacaaagtgagcaacctctttt

SEQ ID NO: 9034464 - DNA, 22 bp, Homo sapiens
tacaaagtgattttggaattga

SEQ ID NO: 9034465 - DNA, 22 bp, Homo sapiens
tacaaagtgaaataattctgag

SEQ ID NO: 9034466 - DNA, 22 bp, Homo sapiens
tacaaagtgaaataattctgag

SEQ ID NO: 9034467 - DNA, 22 bp, Homo sapiens
tacaaagtttgagaatgctttc

SEQ ID NO: 9034468 - DNA, 22 bp, Homo sapiens
tacaaagtttgagaatgctttc

SEQ ID NO: 9034469 - DNA, 22 bp, Homo sapiens
tacaaagtgctttagaaatgaa

SEQ ID NO: 9034470 - DNA, 22 bp, Homo sapiens
tacaaagtgctttagaaatgaa

SEQ ID NO: 9034471 - DNA, 22 bp, Homo sapiens
tacaaagtgctttagaaatgaa

SEQ ID NO: 9034472 - DNA, 22 bp, Homo sapiens
tacaaagtgggaaacgaaggtt

SEQ ID NO: 9034473 - DNA, 22 bp, Homo sapiens
tacaaagtgtgcccatgctgag

SEQ ID NO: 9034474 - DNA, 22 bp, Homo sapiens
tacaaagtgtgcccatgctgag

SEQ ID NO: 9034475 - DNA, 22 bp, Homo sapiens
tacaacaatttccacattagaa

SEQ ID NO: 9034476 - DNA, 22 bp, Homo sapiens
tacaacaatttccacattagaa

SEQ ID NO: 9034477 - DNA, 22 bp, Homo sapiens
tacaacaatttccacattagaa

SEQ ID NO: 9034478 - DNA, 20 bp, Homo sapiens
tacaacaagtagagacatac

SEQ ID NO: 9034479 - DNA, 22 bp, Homo sapiens
tacaacaatttccacattagaa

SEQ ID NO: 9034480 - DNA, 20 bp, Homo sapiens
tacaacaagtagagacatac

SEQ ID NO: 9034481 - DNA, 20 bp, Homo sapiens
tacaacaagtagagacatac

SEQ ID NO: 9034482 - DNA, 20 bp, Homo sapiens
tacaacaagtagagacatac

SEQ ID NO: 9034483 - DNA, 20 bp, Homo sapiens
tacaacaagtagagacatac

SEQ ID NO: 9034484 - DNA, 22 bp, Homo sapiens
tacaaatcagatcatgagttta

SEQ ID NO: 9034485 - DNA, 22 bp, Homo sapiens
tacaaatcagatcatgagttta

SEQ ID NO: 9034486 - DNA, 22 bp, Homo sapiens
tacaaatccaagacccatacaa

SEQ ID NO: 9034487 - DNA, 22 bp, Homo sapiens
tacaacagacaggaataagatt

SEQ ID NO: 9034488 - DNA, 22 bp, Homo sapiens
tacaacagacctagatgaatga

SEQ ID NO: 9034489 - DNA, 22 bp, Homo sapiens
tacaacagacctagatgaatga

SEQ ID NO: 9034490 - DNA, 22 bp, Homo sapiens
tacaacagacaggaataagatt

SEQ ID NO: 9034491 - DNA, 22 bp, Homo sapiens
tacaacagacaggaataagatt

SEQ ID NO: 9034492 - DNA, 22 bp, Homo sapiens
tacaacagacaggaataagatt

SEQ ID NO: 9034493 - DNA, 22 bp, Homo sapiens
tacaacaggaatttcaactttg

SEQ ID NO: 9034494 - DNA, 22 bp, Homo sapiens
tacaacaggaatttcaactttg

SEQ ID NO: 9034495 - DNA, 22 bp, Homo sapiens
tacaacaggaatttcaactttg

SEQ ID NO: 9034496 - DNA, 22 bp, Homo sapiens
tacaacagacctagatgaatga

SEQ ID NO: 9034497 - DNA, 22 bp, Homo sapiens
tacaacaggaatttcaactttg

SEQ ID NO: 9034498 - DNA, 22 bp, Homo sapiens
tacaacagaagtgtttatttag

SEQ ID NO: 9034499 - DNA, 22 bp, Homo sapiens
tacaacagaagtgtttatttag

SEQ ID NO: 9034500 - DNA, 22 bp, Homo sapiens
tacaacagaagtgtttatttag

SEQ ID NO: 9034501 - DNA, 22 bp, Homo sapiens
tacaacagacaggaataagatt

SEQ ID NO: 9034502 - DNA, 22 bp, Homo sapiens
tacaacagacaggaataagatt

SEQ ID NO: 9034503 - DNA, 22 bp, Homo sapiens
tacaacactgttcagcctcttc

SEQ ID NO: 9034504 - DNA, 22 bp, Homo sapiens
tacaacactggttcgacatgtg

SEQ ID NO: 9034505 - DNA, 22 bp, Homo sapiens
tacaacaatttccacattagaa

SEQ ID NO: 9034506 - DNA, 22 bp, Homo sapiens
tacaacaatttccacattagaa

SEQ ID NO: 9034507 - DNA, 22 bp, Homo sapiens
tacagtaatgtgtccctgcagg

SEQ ID NO: 9034508 - DNA, 22 bp, Homo sapiens
tacagtaatgtgtccctgcagg

SEQ ID NO: 9034509 - DNA, 22 bp, Homo sapiens
tacagtaatgtgtccctgcagg

SEQ ID NO: 9034510 - DNA, 22 bp, Homo sapiens
tacagtaatctggacatgattt

SEQ ID NO: 9034511 - DNA, 22 bp, Homo sapiens
tacagtaatctggacatgattt

SEQ ID NO: 9034512 - DNA, 22 bp, Homo sapiens
tacagtaatctggacatgattt

SEQ ID NO: 9034513 - DNA, 22 bp, Homo sapiens
tacagtaatctggacatgattt

SEQ ID NO: 9034514 - DNA, 22 bp, Homo sapiens
tacagtaatctggacatgattt

SEQ ID NO: 9034515 - DNA, 22 bp, Homo sapiens
tacagtaataaaatgagctaca

SEQ ID NO: 9034516 - DNA, 22 bp, Homo sapiens
tacagtaatctggacatgattt

SEQ ID NO: 9034517 - DNA, 22 bp, Homo sapiens
tacagtaataaaatgagctaca

SEQ ID NO: 9034518 - DNA, 22 bp, Homo sapiens
tacagtaataaaatgagctaca

SEQ ID NO: 9034519 - DNA, 22 bp, Homo sapiens
tacagtaataaaatgagctaca

SEQ ID NO: 9034520 - DNA, 22 bp, Homo sapiens
tacagtaataaaatgagctaca

SEQ ID NO: 9034521 - DNA, 22 bp, Homo sapiens
tacagtaataaaatgagctaca

SEQ ID NO: 9034522 - DNA, 22 bp, Homo sapiens
tacagtaataaaatgagctaca

SEQ ID NO: 9034523 - DNA, 22 bp, Homo sapiens
tacagtaataaaatgagctaca

SEQ ID NO: 9034524 - DNA, 22 bp, Homo sapiens
tacagtaataaaatgagctaca

SEQ ID NO: 9034525 - DNA, 21 bp, Homo sapiens
tacagtaagttgggtggtcct

SEQ ID NO: 9034526 - DNA, 21 bp, Homo sapiens
tacagtaagttgggtggtcct

SEQ ID NO: 9034527 - DNA, 21 bp, Homo sapiens
tacagtaagttgggtggtcct

SEQ ID NO: 9034528 - DNA, 22 bp, Homo sapiens
tacagtagaatgcggtgccagt

SEQ ID NO: 9034529 - DNA, 22 bp, Homo sapiens
tacagtacctgccacgttgttg

SEQ ID NO: 9034530 - DNA, 22 bp, Homo sapiens
tacagtagacaatgttagtatg

SEQ ID NO: 9034531 - DNA, 22 bp, Homo sapiens
tacagtagaatttttagtaact

SEQ ID NO: 9034532 - DNA, 22 bp, Homo sapiens
tacagtagacaatgttagtatg

SEQ ID NO: 9034533 - DNA, 22 bp, Homo sapiens
tacagtagacaatgttagtatg

SEQ ID NO: 9034534 - DNA, 22 bp, Homo sapiens
tacagtagctactcaataacta

SEQ ID NO: 9034535 - DNA, 22 bp, Homo sapiens
tacagtagacaggaccacaggc

SEQ ID NO: 9034536 - DNA, 22 bp, Homo sapiens
tacagtagctgaggttctcagg

SEQ ID NO: 9034537 - DNA, 22 bp, Homo sapiens
tacagtagctactcaataacta

SEQ ID NO: 9034538 - DNA, 22 bp, Homo sapiens
tacagtacagtctagactctgg

SEQ ID NO: 9034539 - DNA, 22 bp, Homo sapiens
tacagtacagtctagactctgg

SEQ ID NO: 9034540 - DNA, 22 bp, Homo sapiens
tacagtacacaggtaccaagct

SEQ ID NO: 9034541 - DNA, 22 bp, Homo sapiens
tacagtacacaggtaccaagct

SEQ ID NO: 9034542 - DNA, 22 bp, Homo sapiens
tacagtagaatcttatagccca

SEQ ID NO: 9034543 - DNA, 22 bp, Homo sapiens
tacagtagaatcttatagccca

SEQ ID NO: 9034544 - DNA, 22 bp, Homo sapiens
tacagtaccctgatgaactaaa

SEQ ID NO: 9034545 - DNA, 22 bp, Homo sapiens
tacagtaccagaaatgctaaga

SEQ ID NO: 9034546 - DNA, 22 bp, Homo sapiens
tacatactccataatgacagca

SEQ ID NO: 9034547 - DNA, 22 bp, Homo sapiens
tacatactccataatgacagca

SEQ ID NO: 9034548 - DNA, 22 bp, Homo sapiens
tacatacattacctcatttagt

SEQ ID NO: 9034549 - DNA, 22 bp, Homo sapiens
tacatacattacctcatttagt

SEQ ID NO: 9034550 - DNA, 22 bp, Homo sapiens
tacatacattacctcatttagt

SEQ ID NO: 9034551 - DNA, 22 bp, Homo sapiens
tacatacatggtggaatggtta

SEQ ID NO: 9034552 - DNA, 22 bp, Homo sapiens
tacatacatgtatgtgtgtatt

SEQ ID NO: 9034553 - DNA, 22 bp, Homo sapiens
tacatacatgtatgtgtgtatt

SEQ ID NO: 9034554 - DNA, 22 bp, Homo sapiens
tacatacattacctcatttagt

SEQ ID NO: 9034555 - DNA, 22 bp, Homo sapiens
tacatacattacctcatttagt

SEQ ID NO: 9034556 - DNA, 22 bp, Homo sapiens
tacatagagggtaatagcatca

SEQ ID NO: 9034557 - DNA, 22 bp, Homo sapiens
tacatagagggtaatagcatca

SEQ ID NO: 9034558 - DNA, 22 bp, Homo sapiens
tacatagattttgaaactggac

SEQ ID NO: 9034559 - DNA, 22 bp, Homo sapiens
tacatagattttgaaactggac

SEQ ID NO: 9034560 - DNA, 22 bp, Homo sapiens
tacaggcactgaaatgcttatt

SEQ ID NO: 9034561 - DNA, 19 bp, Homo sapiens
tacaggcagtttctacaat

SEQ ID NO: 9034562 - DNA, 19 bp, Homo sapiens
tacaggcagtttctacaat

SEQ ID NO: 9034563 - DNA, 22 bp, Homo sapiens
tacaggcactgaaatgcttatt

SEQ ID NO: 9034564 - DNA, 19 bp, Homo sapiens
tacaggcagtttctacaat

SEQ ID NO: 9034565 - DNA, 19 bp, Homo sapiens
tacaggaggcctgcaatct

SEQ ID NO: 9034566 - DNA, 22 bp, Homo sapiens
tacaggaggattatcaaaggat

SEQ ID NO: 9034567 - DNA, 19 bp, Homo sapiens
tacaggaggcctgcaatct

SEQ ID NO: 9034568 - DNA, 20 bp, Homo sapiens
tacaggagtgagtgggtggg

SEQ ID NO: 9034569 - DNA, 20 bp, Homo sapiens
tacaggagtgagtgggtggg

SEQ ID NO: 9034570 - DNA, 22 bp, Homo sapiens
tacagcacggtgcatttactac

SEQ ID NO: 9034571 - DNA, 22 bp, Homo sapiens
tacagcaatgctacaagatgac

SEQ ID NO: 9034572 - DNA, 22 bp, Homo sapiens
tacagcacattgtgatggcact

SEQ ID NO: 9034573 - DNA, 22 bp, Homo sapiens
tacagcacagcaaagaggacgg

SEQ ID NO: 9034574 - DNA, 22 bp, Homo sapiens
tacagcactctggggagcatga

SEQ ID NO: 9034575 - DNA, 22 bp, Homo sapiens
tacagcactctggggagcatga

SEQ ID NO: 9034576 - DNA, 17 bp, Homo sapiens
tacaggagagcaggaac

SEQ ID NO: 9034577 - DNA, 17 bp, Homo sapiens
tacaggagagcaggaac

SEQ ID NO: 9034578 - DNA, 22 bp, Homo sapiens
tacagcactctggggagcatga

SEQ ID NO: 9034579 - DNA, 22 bp, Homo sapiens
tacaggagcacaaaagagttga

SEQ ID NO: 9034580 - DNA, 22 bp, Homo sapiens
tacaggagcacaaaagagttga

SEQ ID NO: 9034581 - DNA, 22 bp, Homo sapiens
tacaggagcatggggaagggat

SEQ ID NO: 9034582 - DNA, 22 bp, Homo sapiens
tacaggagcatggggaagggat

SEQ ID NO: 9034583 - DNA, 22 bp, Homo sapiens
tacaggagctgctctgtgatac

SEQ ID NO: 9034584 - DNA, 22 bp, Homo sapiens
tacagtaactggaattcttctt

SEQ ID NO: 9034585 - DNA, 22 bp, Homo sapiens
tacagtaactggaattcttctt

SEQ ID NO: 9034586 - DNA, 22 bp, Homo sapiens
tacagtaagatgaaatagcaat

SEQ ID NO: 9034587 - DNA, 22 bp, Homo sapiens
tacagtaagatgaaatagcaat

SEQ ID NO: 9034588 - DNA, 22 bp, Homo sapiens
tacagtaactggaattcttctt

SEQ ID NO: 9034589 - DNA, 22 bp, Homo sapiens
tacagtaagatgaaatagcaat

SEQ ID NO: 9034590 - DNA, 22 bp, Homo sapiens
tacagtaagatgaaatagcaat

SEQ ID NO: 9034591 - DNA, 22 bp, Homo sapiens
tacagtaagatgaaatagcaat

SEQ ID NO: 9034592 - DNA, 22 bp, Homo sapiens
tacagtaagatgaaatagcaat

SEQ ID NO: 9034593 - DNA, 22 bp, Homo sapiens
tacagtaagatgaaatagcaat

SEQ ID NO: 9034594 - DNA, 22 bp, Homo sapiens
tacagtaagatgaaatagcaat

SEQ ID NO: 9034595 - DNA, 22 bp, Homo sapiens
tacagggacatggaacaggctc

SEQ ID NO: 9034596 - DNA, 22 bp, Homo sapiens
tacagggacatggaacaggctc

SEQ ID NO: 9034597 - DNA, 22 bp, Homo sapiens
tacagggaccaataataactat

SEQ ID NO: 9034598 - DNA, 22 bp, Homo sapiens
tacagggacatggaacaggctc

SEQ ID NO: 9034599 - DNA, 22 bp, Homo sapiens
tacagggaatgggacataaatc

SEQ ID NO: 9034600 - DNA, 22 bp, Homo sapiens
tacagggaccaataataactat

SEQ ID NO: 9034601 - DNA, 22 bp, Homo sapiens
tacagggaccaataataactat

SEQ ID NO: 9034602 - DNA, 22 bp, Homo sapiens
tacagggactcccgcagagata

SEQ ID NO: 9034603 - DNA, 22 bp, Homo sapiens
tacagggactcccgcagagata

SEQ ID NO: 9034604 - DNA, 22 bp, Homo sapiens
tacagtaactggaattcttctt

SEQ ID NO: 9034605 - DNA, 22 bp, Homo sapiens
tacagggactcccgcagagata

SEQ ID NO: 9034606 - DNA, 22 bp, Homo sapiens
tacaggcatgaatgaaatctgt

SEQ ID NO: 9034607 - DNA, 22 bp, Homo sapiens
tacaggcatgtagcatggtgat

SEQ ID NO: 9034608 - DNA, 22 bp, Homo sapiens
tacaggcatgtagcatggtgat

SEQ ID NO: 9034609 - DNA, 22 bp, Homo sapiens
tacaggcccatagtccctgctt

SEQ ID NO: 9034610 - DNA, 22 bp, Homo sapiens
tacaggcatgtagcatggtgat

SEQ ID NO: 9034611 - DNA, 20 bp, Homo sapiens
tacaggctctgagagatgat

SEQ ID NO: 9034612 - DNA, 22 bp, Homo sapiens
tacagggaatgggacataaatc

SEQ ID NO: 9034613 - DNA, 22 bp, Homo sapiens
tacagggaatgggacataaatc

SEQ ID NO: 9034614 - DNA, 22 bp, Homo sapiens
tacaggctgaactcaatgatga

SEQ ID NO: 9034615 - DNA, 22 bp, Homo sapiens
tacatagctcctagtgatgcat

SEQ ID NO: 9034616 - DNA, 22 bp, Homo sapiens
tacatagctcctagtgatgcat

SEQ ID NO: 9034617 - DNA, 22 bp, Homo sapiens
tacatagcaaggaaatgacaga

SEQ ID NO: 9034618 - DNA, 22 bp, Homo sapiens
tacatagctcctagtgatgcat

SEQ ID NO: 9034619 - DNA, 22 bp, Homo sapiens
tacatagtattcacattgtttt

SEQ ID NO: 9034620 - DNA, 22 bp, Homo sapiens
tacatatactgagtgatttgct

SEQ ID NO: 9034621 - DNA, 22 bp, Homo sapiens
tacatatactgagtgatttgct

SEQ ID NO: 9034622 - DNA, 22 bp, Homo sapiens
tacatatactgagtgatttgct

SEQ ID NO: 9034623 - DNA, 22 bp, Homo sapiens
tacatagtattcacattgtttt

SEQ ID NO: 9034624 - DNA, 22 bp, Homo sapiens
tacatagtgaacatttacagag

SEQ ID NO: 9034625 - DNA, 22 bp, Homo sapiens
tacatagttccatttacaggaa

SEQ ID NO: 9034626 - DNA, 22 bp, Homo sapiens
tacatatactgagtgatttgct

SEQ ID NO: 9034627 - DNA, 22 bp, Homo sapiens
tacatatactgagtgatttgct

SEQ ID NO: 9034628 - DNA, 22 bp, Homo sapiens
tacatatagacagttactctag

SEQ ID NO: 9034629 - DNA, 22 bp, Homo sapiens
tacatatagacagttactctag

SEQ ID NO: 9034630 - DNA, 22 bp, Homo sapiens
tacatatagacagttactctag

SEQ ID NO: 9034631 - DNA, 22 bp, Homo sapiens
tacatcatgtaagcagaatcat

SEQ ID NO: 9034632 - DNA, 22 bp, Homo sapiens
tacatcatggcttcatgctgca

SEQ ID NO: 9034633 - DNA, 22 bp, Homo sapiens
tacatctagccttacaattatt

SEQ ID NO: 9034634 - DNA, 22 bp, Homo sapiens
tacatctatactgatctacatt

SEQ ID NO: 9034635 - DNA, 22 bp, Homo sapiens
tacatctatactgatctacatt

SEQ ID NO: 9034636 - DNA, 22 bp, Homo sapiens
tacatctagccttacaattatt

SEQ ID NO: 9034637 - DNA, 19 bp, Homo sapiens
tacatcctcttcctctttg

SEQ ID NO: 9034638 - DNA, 22 bp, Homo sapiens
tacatctagccttacaattatt

SEQ ID NO: 9034639 - DNA, 22 bp, Homo sapiens
tacatcatgtaagcagaatcat

SEQ ID NO: 9034640 - DNA, 22 bp, Homo sapiens
tacatcattttggagatgagca

SEQ ID NO: 9034641 - DNA, 22 bp, Homo sapiens
tacatccaaatgaattagaatt

SEQ ID NO: 9034642 - DNA, 22 bp, Homo sapiens
tacatcccagccagcagaatca

SEQ ID NO: 9034643 - DNA, 22 bp, Homo sapiens
tacatccaaatgaattagaatt

SEQ ID NO: 9034644 - DNA, 22 bp, Homo sapiens
tacatccaaagttgaggtgcct

SEQ ID NO: 9034645 - DNA, 22 bp, Homo sapiens
tacatcattttggagatgagca

SEQ ID NO: 9034646 - DNA, 22 bp, Homo sapiens
tacatctatttgacagatacag

SEQ ID NO: 9034647 - DNA, 22 bp, Homo sapiens
tacatctatctagatgctcaga

SEQ ID NO: 9034648 - DNA, 22 bp, Homo sapiens
tacatctatctagatgctcaga

SEQ ID NO: 9034649 - DNA, 22 bp, Homo sapiens
tacatctgatttacctactgaa

SEQ ID NO: 9034650 - DNA, 22 bp, Homo sapiens
tacatctcatctgtgctctccg

SEQ ID NO: 9034651 - DNA, 22 bp, Homo sapiens
tacatgaacaaaatagcagaaa

SEQ ID NO: 9034652 - DNA, 22 bp, Homo sapiens
tacatgaacaaaatagcagaaa

SEQ ID NO: 9034653 - DNA, 22 bp, Homo sapiens
tacattcccccaattaccaatg

SEQ ID NO: 9034654 - DNA, 22 bp, Homo sapiens
tacatctgtctggctttccatt

SEQ ID NO: 9034655 - DNA, 22 bp, Homo sapiens
tacatctttgtctatgaccagc

SEQ ID NO: 9034656 - DNA, 21 bp, Homo sapiens
tacatttgagagctataagct

SEQ ID NO: 9034657 - DNA, 21 bp, Homo sapiens
tacatttgagagctataagct

SEQ ID NO: 9034658 - DNA, 21 bp, Homo sapiens
tacatttgagagctataagct

SEQ ID NO: 9034659 - DNA, 21 bp, Homo sapiens
tacatttgagagctataagct

SEQ ID NO: 9034660 - DNA, 22 bp, Homo sapiens
tacatttgattctctcctccaa

SEQ ID NO: 9034661 - DNA, 22 bp, Homo sapiens
tacattgatggagtacctagct

SEQ ID NO: 9034662 - DNA, 22 bp, Homo sapiens
tacatttcctgtcagagatata

SEQ ID NO: 9034663 - DNA, 22 bp, Homo sapiens
tacattgaggcagtagctggag

SEQ ID NO: 9034664 - DNA, 22 bp, Homo sapiens
tacattgagcacgtactatgtg

SEQ ID NO: 9034665 - DNA, 22 bp, Homo sapiens
tacattgaggcagtagctggag

SEQ ID NO: 9034666 - DNA, 22 bp, Homo sapiens
tacattgagtattatttagcca

SEQ ID NO: 9034667 - DNA, 22 bp, Homo sapiens
tacatttgctttgattttcagc

SEQ ID NO: 9034668 - DNA, 22 bp, Homo sapiens
tacatttggatgtgcttaagtg

SEQ ID NO: 9034669 - DNA, 22 bp, Homo sapiens
tacatttgctttgattttcagc

SEQ ID NO: 9034670 - DNA, 22 bp, Homo sapiens
tacatttgctttgattttcagc

SEQ ID NO: 9034671 - DNA, 22 bp, Homo sapiens
tacattgaattttttagcatgt

SEQ ID NO: 9034672 - DNA, 22 bp, Homo sapiens
tacattgacctttgttaggttg

SEQ ID NO: 9034673 - DNA, 21 bp, Homo sapiens
tacattgaagaatgggaatga

SEQ ID NO: 9034674 - DNA, 22 bp, Homo sapiens
tacattgaattttttagcatgt

SEQ ID NO: 9034675 - DNA, 21 bp, Homo sapiens
tacattgactacaaataaagc

SEQ ID NO: 9034676 - DNA, 21 bp, Homo sapiens
tacattgactacaaataaagc

SEQ ID NO: 9034677 - DNA, 21 bp, Homo sapiens
tacattgactacaaataaagc

SEQ ID NO: 9034678 - DNA, 21 bp, Homo sapiens
tacattgactacaaataaagc

SEQ ID NO: 9034679 - DNA, 22 bp, Homo sapiens
tacattgagcacgtactatgtg

SEQ ID NO: 9034680 - DNA, 22 bp, Homo sapiens
tacattgagcacgtactatgtg

SEQ ID NO: 9034681 - DNA, 22 bp, Homo sapiens
tacattgacttggattgttaga

SEQ ID NO: 9034682 - DNA, 22 bp, Homo sapiens
tacattgacttggattgttaga

SEQ ID NO: 9034683 - DNA, 22 bp, Homo sapiens
tacattgagaaccactgcttag

SEQ ID NO: 9034684 - DNA, 22 bp, Homo sapiens
tacattgacttggattgttaga

SEQ ID NO: 9034685 - DNA, 22 bp, Homo sapiens
tacattgacttggattgttaga

SEQ ID NO: 9034686 - DNA, 22 bp, Homo sapiens
tacattgactgtgtgcatcaca

SEQ ID NO: 9034687 - DNA, 22 bp, Homo sapiens
tacattgactctctgtccctaa

SEQ ID NO: 9034688 - DNA, 22 bp, Homo sapiens
tacattctactttttcactccc

SEQ ID NO: 9034689 - DNA, 22 bp, Homo sapiens
tacattctatatctgttacatc

SEQ ID NO: 9034690 - DNA, 22 bp, Homo sapiens
tacattctatatctgttacatc

SEQ ID NO: 9034691 - DNA, 22 bp, Homo sapiens
tacattctatatctgttacatc

SEQ ID NO: 9034692 - DNA, 22 bp, Homo sapiens
tacattctcttcccattgtctc

SEQ ID NO: 9034693 - DNA, 22 bp, Homo sapiens
tacattctgaaataaatggttt

SEQ ID NO: 9034694 - DNA, 22 bp, Homo sapiens
tacattctgaaataaatggttt

SEQ ID NO: 9034695 - DNA, 22 bp, Homo sapiens
tacattgaaagtcatttaatcc

SEQ ID NO: 9034696 - DNA, 22 bp, Homo sapiens
tacattgaaagtcatttaatcc

SEQ ID NO: 9034697 - DNA, 23 bp, Homo sapiens
tacattctgtatttttatagagt

SEQ ID NO: 9034698 - DNA, 22 bp, Homo sapiens
tacattgaaagtcatttaatcc

SEQ ID NO: 9034699 - DNA, 22 bp, Homo sapiens
tacattgaaagtcatttaatcc

SEQ ID NO: 9034700 - DNA, 22 bp, Homo sapiens
tacattgaaatcaatggatgtg

SEQ ID NO: 9034701 - DNA, 22 bp, Homo sapiens
tacattgaaagtcatttaatcc

SEQ ID NO: 9034702 - DNA, 22 bp, Homo sapiens
tacattgaaatcaatggatgtg

SEQ ID NO: 9034703 - DNA, 22 bp, Homo sapiens
tacattgaactatgagttcagt

SEQ ID NO: 9034704 - DNA, 23 bp, Homo sapiens
tacattctgtatttttatagagt

SEQ ID NO: 9034705 - DNA, 23 bp, Homo sapiens
tacattctgtatttttatagagt

SEQ ID NO: 9034706 - DNA, 23 bp, Homo sapiens
tacattctgtatttttatagagt

SEQ ID NO: 9034707 - DNA, 22 bp, Homo sapiens
tacattctggtggagaaagtaa

SEQ ID NO: 9034708 - DNA, 22 bp, Homo sapiens
tacattctggtggagaaagtaa

SEQ ID NO: 9034709 - DNA, 22 bp, Homo sapiens
tacattctggtggagaaagtaa

SEQ ID NO: 9034710 - DNA, 22 bp, Homo sapiens
tacattctggtggagaaagtaa

SEQ ID NO: 9034711 - DNA, 22 bp, Homo sapiens
tagccctcagcttggagcgtgg

SEQ ID NO: 9034712 - DNA, 22 bp, Homo sapiens
tagccctcatctgctcaaaagg

SEQ ID NO: 9034713 - DNA, 22 bp, Homo sapiens
tagcccctgcctttgaacctgg

SEQ ID NO: 9034714 - DNA, 22 bp, Homo sapiens
tagcccctgcctttgaacctgg

SEQ ID NO: 9034715 - DNA, 22 bp, Homo sapiens
tagcccctgcctttgaacctgg

SEQ ID NO: 9034716 - DNA, 22 bp, Homo sapiens
tagccccagctactcggaagct

SEQ ID NO: 9034717 - DNA, 22 bp, Homo sapiens
tagccccagctactcggaagct

SEQ ID NO: 9034718 - DNA, 22 bp, Homo sapiens
tagccgcttaattatttggtga

SEQ ID NO: 9034719 - DNA, 22 bp, Homo sapiens
tagcccttttctgagcccacat

SEQ ID NO: 9034720 - DNA, 22 bp, Homo sapiens
tagcccttttctgagcccacat

SEQ ID NO: 9034721 - DNA, 22 bp, Homo sapiens
tagccctgtccttggcctgtgc

SEQ ID NO: 9034722 - DNA, 19 bp, Homo sapiens
tagccctggccatcatgag

SEQ ID NO: 9034723 - DNA, 22 bp, Homo sapiens
tagccctgtccttggcctgtgc

SEQ ID NO: 9034724 - DNA, 21 bp, Homo sapiens
tagcccttctccacctcgccc

SEQ ID NO: 9034725 - DNA, 22 bp, Homo sapiens
tagccctctccagcgaggtctg

SEQ ID NO: 9034726 - DNA, 21 bp, Homo sapiens
tagccctctctgtctgtgtac

SEQ ID NO: 9034727 - DNA, 22 bp, Homo sapiens
tagccctctttaatccttccct

SEQ ID NO: 9034728 - DNA, 22 bp, Homo sapiens
tagccctgctgtgatgtgaagt

SEQ ID NO: 9034729 - DNA, 22 bp, Homo sapiens
tagccctggagcagggaaatac

SEQ ID NO: 9034730 - DNA, 19 bp, Homo sapiens
tagccctggccatcatgag

SEQ ID NO: 9034731 - DNA, 22 bp, Homo sapiens
tagcagctcactaactctgcgt

SEQ ID NO: 9034732 - DNA, 22 bp, Homo sapiens
tagcagctccatttctctggca

SEQ ID NO: 9034733 - DNA, 22 bp, Homo sapiens
tagcagctcactaactctgcgt

SEQ ID NO: 9034734 - DNA, 22 bp, Homo sapiens
tagcagctatgccattttgaca

SEQ ID NO: 9034735 - DNA, 22 bp, Homo sapiens
tagcagctcactaactctgcgt

SEQ ID NO: 9034736 - DNA, 22 bp, Homo sapiens
tagcagctccatttctctggca

SEQ ID NO: 9034737 - DNA, 22 bp, Homo sapiens
tagcagctccatttctctggca

SEQ ID NO: 9034738 - DNA, 22 bp, Homo sapiens
tagcccagcatgagcagagctg

SEQ ID NO: 9034739 - DNA, 22 bp, Homo sapiens
tagcccagcatgagcagagctg

SEQ ID NO: 9034740 - DNA, 22 bp, Homo sapiens
tagcccagcatgagcagagctg

SEQ ID NO: 9034741 - DNA, 22 bp, Homo sapiens
tagcccagctaactcggtgagc

SEQ ID NO: 9034742 - DNA, 22 bp, Homo sapiens
tagcccagctaactcggtgagc

SEQ ID NO: 9034743 - DNA, 22 bp, Homo sapiens
tagcccaggctgtagtgcagtg

SEQ ID NO: 9034744 - DNA, 22 bp, Homo sapiens
tagcccaggctggagtgcaggg

SEQ ID NO: 9034745 - DNA, 22 bp, Homo sapiens
tagcccaggctggagtgcaggg

SEQ ID NO: 9034746 - DNA, 22 bp, Homo sapiens
tagcccaggctgtagtgcagtg

SEQ ID NO: 9034747 - DNA, 22 bp, Homo sapiens
tagcccaggctggagggcagtg

SEQ ID NO: 9034748 - DNA, 22 bp, Homo sapiens
tagcccaggagaattgtctttc

SEQ ID NO: 9034749 - DNA, 22 bp, Homo sapiens
tagcccaggctggagggcagtg

SEQ ID NO: 9034750 - DNA, 22 bp, Homo sapiens
tagcccagctcaaatgaccggt

SEQ ID NO: 9034751 - DNA, 22 bp, Homo sapiens
tagcccagctcaaatgaccggt

SEQ ID NO: 9034752 - DNA, 21 bp, Homo sapiens
tagctttaatattcccacatt

SEQ ID NO: 9034753 - DNA, 22 bp, Homo sapiens
tagcttaaaccaatctgaataa

SEQ ID NO: 9034754 - DNA, 22 bp, Homo sapiens
tagctgttttttgtgaggaaat

SEQ ID NO: 9034755 - DNA, 22 bp, Homo sapiens
tagctgttttttgtgaggaaat

SEQ ID NO: 9034756 - DNA, 22 bp, Homo sapiens
tagctttaatgagttggtaaga

SEQ ID NO: 9034757 - DNA, 22 bp, Homo sapiens
tagctttaatgagttggtaaga

SEQ ID NO: 9034758 - DNA, 22 bp, Homo sapiens
tagctgttcccagctctgtgta

SEQ ID NO: 9034759 - DNA, 22 bp, Homo sapiens
tagctgttggcttacatctgtt

SEQ ID NO: 9034760 - DNA, 22 bp, Homo sapiens
tagctgttggcttacatctgtt

SEQ ID NO: 9034761 - DNA, 22 bp, Homo sapiens
tagctgttgcaataaacagttc

SEQ ID NO: 9034762 - DNA, 22 bp, Homo sapiens
tagctgttgcaataaacagttc

SEQ ID NO: 9034763 - DNA, 22 bp, Homo sapiens
tagctgttggcttacatctgtt

SEQ ID NO: 9034764 - DNA, 22 bp, Homo sapiens
tagctgttcatgtggctttatg

SEQ ID NO: 9034765 - DNA, 22 bp, Homo sapiens
tagctgttgggagagggctaga

SEQ ID NO: 9034766 - DNA, 22 bp, Homo sapiens
tagctgtttatcaagttcttga

SEQ ID NO: 9034767 - DNA, 22 bp, Homo sapiens
tagctgtttcagtgcagcagaa

SEQ ID NO: 9034768 - DNA, 22 bp, Homo sapiens
tagctgtttctaagtgttgttt

SEQ ID NO: 9034769 - DNA, 22 bp, Homo sapiens
tagctgtttgaagtatttttct

SEQ ID NO: 9034770 - DNA, 22 bp, Homo sapiens
tagctgttcccagctctgtgta

SEQ ID NO: 9034771 - DNA, 22 bp, Homo sapiens
tagctgttcccagctctgtgta

SEQ ID NO: 9034772 - DNA, 22 bp, Homo sapiens
tagctgttctctgtaaattgga

SEQ ID NO: 9034773 - DNA, 22 bp, Homo sapiens
tagctgttgaaggtggtggtgc

SEQ ID NO: 9034774 - DNA, 22 bp, Homo sapiens
tagctgttgcaataaacagttc

SEQ ID NO: 9034775 - DNA, 22 bp, Homo sapiens
tagctgttgcaataaacagttc

SEQ ID NO: 9034776 - DNA, 22 bp, Homo sapiens
tagctgaatgtgaccttaaaga

SEQ ID NO: 9034777 - DNA, 22 bp, Homo sapiens
tagctgttcaagttcctggaaa

SEQ ID NO: 9034778 - DNA, 22 bp, Homo sapiens
tagctgaagagggtattgtagg

SEQ ID NO: 9034779 - DNA, 22 bp, Homo sapiens
tagctgaaggctacagcagaac

SEQ ID NO: 9034780 - DNA, 22 bp, Homo sapiens
tagctgaatgccttggattttt

SEQ ID NO: 9034781 - DNA, 22 bp, Homo sapiens
tagctgaagggcatttaataaa

SEQ ID NO: 9034782 - DNA, 22 bp, Homo sapiens
tagctcttgatgctggcaggac

SEQ ID NO: 9034783 - DNA, 22 bp, Homo sapiens
tagcctctctcctccacaacct

SEQ ID NO: 9034784 - DNA, 22 bp, Homo sapiens
tagccttttgggaagggctatt

SEQ ID NO: 9034785 - DNA, 22 bp, Homo sapiens
tagccgggtgtggtggaactcc

SEQ ID NO: 9034786 - DNA, 22 bp, Homo sapiens
tagccgggtgtggtggaactcc

SEQ ID NO: 9034787 - DNA, 22 bp, Homo sapiens
tagccgggtgtggtggaactcc

SEQ ID NO: 9034788 - DNA, 22 bp, Homo sapiens
tagccgggtgttgtgtcatgca

SEQ ID NO: 9034789 - DNA, 22 bp, Homo sapiens
tagccgggtgttgtgtcatgca

SEQ ID NO: 9034790 - DNA, 22 bp, Homo sapiens
tagctcctggtgagcctactct

SEQ ID NO: 9034791 - DNA, 22 bp, Homo sapiens
tagcgaggtgtttctaggactg

SEQ ID NO: 9034792 - DNA, 22 bp, Homo sapiens
tagcgaggtgtttctaggactg

SEQ ID NO: 9034793 - DNA, 22 bp, Homo sapiens
tagctctgtgctctggatctgt

SEQ ID NO: 9034794 - DNA, 19 bp, Homo sapiens
tagctctgtcttattccaa

SEQ ID NO: 9034795 - DNA, 22 bp, Homo sapiens
tagctctggagtcttctcagaa

SEQ ID NO: 9034796 - DNA, 22 bp, Homo sapiens
tagctctggcattctttccaaa

SEQ ID NO: 9034797 - DNA, 22 bp, Homo sapiens
tagctctgccaaatggaggctg

SEQ ID NO: 9034798 - DNA, 22 bp, Homo sapiens
tagcagagtgattggccatgag

SEQ ID NO: 9034799 - DNA, 22 bp, Homo sapiens
tagcagagtatcttgcaaatta

SEQ ID NO: 9034800 - DNA, 22 bp, Homo sapiens
tagcagagtagtgcctccagat

SEQ ID NO: 9034801 - DNA, 17 bp, Homo sapiens
tagcagcagtaattgtg

SEQ ID NO: 9034802 - DNA, 22 bp, Homo sapiens
tagcagagtgattggccatgag

SEQ ID NO: 9034803 - DNA, 17 bp, Homo sapiens
tagcagcagtaattgtg

SEQ ID NO: 9034804 - DNA, 22 bp, Homo sapiens
tagcagcagtggtgtatttaga

SEQ ID NO: 9034805 - DNA, 22 bp, Homo sapiens
tagcagagtaatactttggagc

SEQ ID NO: 9034806 - DNA, 22 bp, Homo sapiens
tagcagagtagtgcctccagat

SEQ ID NO: 9034807 - DNA, 22 bp, Homo sapiens
tagcagagtaatactttggagc

SEQ ID NO: 9034808 - DNA, 22 bp, Homo sapiens
tagcagaggtaagtgtggcaat

SEQ ID NO: 9034809 - DNA, 22 bp, Homo sapiens
tagcagagggtagtgccggggc

SEQ ID NO: 9034810 - DNA, 22 bp, Homo sapiens
tagcagcatgtaagtgagtaga

SEQ ID NO: 9034811 - DNA, 22 bp, Homo sapiens
tagcagcatgtaagtgagtaga

SEQ ID NO: 9034812 - DNA, 22 bp, Homo sapiens
tagcagcatcctgtggtgatgg

SEQ ID NO: 9034813 - DNA, 23 bp, Homo sapiens
tagcagcatttttagcctctgtc

SEQ ID NO: 9034814 - DNA, 22 bp, Homo sapiens
tagcagcattaattccatttgc

SEQ ID NO: 9034815 - DNA, 22 bp, Homo sapiens
tagcagcatgtaagtgagtaga

SEQ ID NO: 9034816 - DNA, 23 bp, Homo sapiens
tagcagcatttttagcctctgtc

SEQ ID NO: 9034817 - DNA, 22 bp, Homo sapiens
tagcagcatttttgtagagtat

SEQ ID NO: 9034818 - DNA, 22 bp, Homo sapiens
tagcagcatttttgtagagtat

SEQ ID NO: 9034819 - DNA, 23 bp, Homo sapiens
tagcagcatttttagcctctgtc

SEQ ID NO: 9034820 - DNA, 22 bp, Homo sapiens
tagcagctacctggctaagagt

SEQ ID NO: 9034821 - DNA, 22 bp, Homo sapiens
tagcagcgactaatgaataagt

SEQ ID NO: 9034822 - DNA, 19 bp, Homo sapiens
tagcagagatgactccagc

SEQ ID NO: 9034823 - DNA, 22 bp, Homo sapiens
tagcagagatatgggcatagat

SEQ ID NO: 9034824 - DNA, 21 bp, Homo sapiens
tagcagagatcattttctcct

SEQ ID NO: 9034825 - DNA, 22 bp, Homo sapiens
tagcagagcacatcttcattct

SEQ ID NO: 9034826 - DNA, 19 bp, Homo sapiens
tagcagagatgactccagc

SEQ ID NO: 9034827 - DNA, 21 bp, Homo sapiens
tagcagagatcattttctcct

SEQ ID NO: 9034828 - DNA, 19 bp, Homo sapiens
tagcagagatgactccagc

SEQ ID NO: 9034829 - DNA, 19 bp, Homo sapiens
tagcagagatgactccagc

SEQ ID NO: 9034830 - DNA, 22 bp, Homo sapiens
tagcagagcagggatcagagcc

SEQ ID NO: 9034831 - DNA, 22 bp, Homo sapiens
tagcagagcagggatcagagcc

SEQ ID NO: 9034832 - DNA, 22 bp, Homo sapiens
tagcagagcgggtgcgaggcgg

SEQ ID NO: 9034833 - DNA, 22 bp, Homo sapiens
tagcagagctgcaatatagacc

SEQ ID NO: 9034834 - DNA, 22 bp, Homo sapiens
tagcagaggcaaggatgtgaat

SEQ ID NO: 9034835 - DNA, 22 bp, Homo sapiens
tagcagaggctactgctccttg

SEQ ID NO: 9034836 - DNA, 22 bp, Homo sapiens
tagcagaggcaaggatgtgaat

SEQ ID NO: 9034837 - DNA, 22 bp, Homo sapiens
tagcagaggcaaggatgtgaat

SEQ ID NO: 9034838 - DNA, 22 bp, Homo sapiens
tagcagaggctgtctgacttaa

SEQ ID NO: 9034839 - DNA, 22 bp, Homo sapiens
tagcagaggctgtctgacttaa

SEQ ID NO: 9034840 - DNA, 22 bp, Homo sapiens
tagcagagctgggactagatta

SEQ ID NO: 9034841 - DNA, 22 bp, Homo sapiens
tagcagaggaaaagagaacatt

SEQ ID NO: 9034842 - DNA, 22 bp, Homo sapiens
tagcagaggaaaagagaacatt

SEQ ID NO: 9034843 - DNA, 22 bp, Homo sapiens
tagcagaggaaaagagaacatt

SEQ ID NO: 9034844 - DNA, 22 bp, Homo sapiens
tagcagaggaaaagagaacatt

SEQ ID NO: 9034845 - DNA, 22 bp, Homo sapiens
tagcagaggaaatccagagtaa

SEQ ID NO: 9034846 - DNA, 22 bp, Homo sapiens
tagcagaggaaatccagagtaa

SEQ ID NO: 9034847 - DNA, 22 bp, Homo sapiens
tagcagagcacatcttcattct

SEQ ID NO: 9034848 - DNA, 22 bp, Homo sapiens
tagaggtgttgttgatatagaa

SEQ ID NO: 9034849 - DNA, 22 bp, Homo sapiens
tagaggtgttgttgatatagaa

SEQ ID NO: 9034850 - DNA, 22 bp, Homo sapiens
tagcagaaccagtcagtgagcc

SEQ ID NO: 9034851 - DNA, 22 bp, Homo sapiens
tagagtaacacaaacgaattgg

SEQ ID NO: 9034852 - DNA, 22 bp, Homo sapiens
tagcagaaccagtcagtgagcc

SEQ ID NO: 9034853 - DNA, 22 bp, Homo sapiens
tagcagaaccagtcagtgagcc

SEQ ID NO: 9034854 - DNA, 22 bp, Homo sapiens
tagcagaaccagtcagtgagcc

SEQ ID NO: 9034855 - DNA, 22 bp, Homo sapiens
tagaggtgttcattctctccat

SEQ ID NO: 9034856 - DNA, 22 bp, Homo sapiens
tagaggtgttgacgccaaggta

SEQ ID NO: 9034857 - DNA, 22 bp, Homo sapiens
tagaggtgttcattctctccat

SEQ ID NO: 9034858 - DNA, 22 bp, Homo sapiens
tagaggtgttgacgccaaggta

SEQ ID NO: 9034859 - DNA, 22 bp, Homo sapiens
tagaggtgttgacgccaaggta

SEQ ID NO: 9034860 - DNA, 20 bp, Homo sapiens
tagaggtgggatttgggttt

SEQ ID NO: 9034861 - DNA, 22 bp, Homo sapiens
tagaggtgagccatcaaggggc

SEQ ID NO: 9034862 - DNA, 20 bp, Homo sapiens
tagaggtgggatttgggttt

SEQ ID NO: 9034863 - DNA, 22 bp, Homo sapiens
tagaggtgttcattctctccat

SEQ ID NO: 9034864 - DNA, 22 bp, Homo sapiens
tagaggtgtcactttgggaagt

SEQ ID NO: 9034865 - DNA, 22 bp, Homo sapiens
tagaggtgtcactttgggaagt

SEQ ID NO: 9034866 - DNA, 21 bp, Homo sapiens
tagcagagagttaacttctcc

SEQ ID NO: 9034867 - DNA, 22 bp, Homo sapiens
tagcagagatatgggcatagat

SEQ ID NO: 9034868 - DNA, 21 bp, Homo sapiens
tagcagagagttaacttctcc

SEQ ID NO: 9034869 - DNA, 22 bp, Homo sapiens
tagcagagaggggacagtggca

SEQ ID NO: 9034870 - DNA, 22 bp, Homo sapiens
tagcagagaggggacagtggca

SEQ ID NO: 9034871 - DNA, 22 bp, Homo sapiens
tagcagagaggggacagtggca

SEQ ID NO: 9034872 - DNA, 22 bp, Homo sapiens
tagcagagaggggacagtggca

SEQ ID NO: 9034873 - DNA, 22 bp, Homo sapiens
tagcagagaggtttcagctaat

SEQ ID NO: 9034874 - DNA, 22 bp, Homo sapiens
tagcagagaggggacagtggca

SEQ ID NO: 9034875 - DNA, 22 bp, Homo sapiens
tagcagaagaacaacatgatct

SEQ ID NO: 9034876 - DNA, 22 bp, Homo sapiens
tagcagaagaacaacatgatct

SEQ ID NO: 9034877 - DNA, 22 bp, Homo sapiens
tagcagaagaacaacatgatct

SEQ ID NO: 9034878 - DNA, 22 bp, Homo sapiens
tagcagaagttccaatgcatat

SEQ ID NO: 9034879 - DNA, 22 bp, Homo sapiens
tagcagaagttccaatgcatat

SEQ ID NO: 9034880 - DNA, 22 bp, Homo sapiens
tagcagaagttgcaaactaggg

SEQ ID NO: 9034881 - DNA, 22 bp, Homo sapiens
tagcagaagttgcaaactaggg

SEQ ID NO: 9034882 - DNA, 22 bp, Homo sapiens
tagcagaagttgcaaactaggg

SEQ ID NO: 9034883 - DNA, 22 bp, Homo sapiens
tagaggtgagatattttatttt

SEQ ID NO: 9034884 - DNA, 22 bp, Homo sapiens
tagaggtgagatattttatttt

SEQ ID NO: 9034885 - DNA, 22 bp, Homo sapiens
tagaggtgagaggaactttgga

SEQ ID NO: 9034886 - DNA, 22 bp, Homo sapiens
tagaggtgagaggaactttgga

SEQ ID NO: 9034887 - DNA, 22 bp, Homo sapiens
tagaggtgagccatcaaggggc

SEQ ID NO: 9034888 - DNA, 22 bp, Homo sapiens
tagaggtgagccatcaaggggc

SEQ ID NO: 9034889 - DNA, 22 bp, Homo sapiens
tagaggtgagccatcaaggggc

SEQ ID NO: 9034890 - DNA, 22 bp, Homo sapiens
tagaggtgacactgagaccata

SEQ ID NO: 9034891 - DNA, 22 bp, Homo sapiens
tagaggtgagattgtggtgctg

SEQ ID NO: 9034892 - DNA, 22 bp, Homo sapiens
tagaggtgagattgtggtgctg

SEQ ID NO: 9034893 - DNA, 22 bp, Homo sapiens
tagaggtatttttgatggtcat

SEQ ID NO: 9034894 - DNA, 22 bp, Homo sapiens
tagaggtatttttgatggtcat

SEQ ID NO: 9034895 - DNA, 22 bp, Homo sapiens
tagaggtataccaaaaaggcat

SEQ ID NO: 9034896 - DNA, 22 bp, Homo sapiens
tagaggtgagacttcagtgaca

SEQ ID NO: 9034897 - DNA, 22 bp, Homo sapiens
tagaggtgagacttcagtgaca

SEQ ID NO: 9034898 - DNA, 22 bp, Homo sapiens
tagaggtgagacttcagtgaca

SEQ ID NO: 9034899 - DNA, 22 bp, Homo sapiens
tagaggtgacactgagaccata

SEQ ID NO: 9034900 - DNA, 22 bp, Homo sapiens
tagaggtgacactgagaccata

SEQ ID NO: 9034901 - DNA, 18 bp, Homo sapiens
tagagggggcctgggcat

SEQ ID NO: 9034902 - DNA, 20 bp, Homo sapiens
tagaggggacaatcattgcc

SEQ ID NO: 9034903 - DNA, 22 bp, Homo sapiens
tagaggggaatctgcctcctct

SEQ ID NO: 9034904 - DNA, 22 bp, Homo sapiens
tagaggtagatggtcagccaat

SEQ ID NO: 9034905 - DNA, 22 bp, Homo sapiens
tagaggtagagttacattagtc

SEQ ID NO: 9034906 - DNA, 22 bp, Homo sapiens
tagaggtagcaacaggactaga

SEQ ID NO: 9034907 - DNA, 22 bp, Homo sapiens
tagaggtagagttacattagtc

SEQ ID NO: 9034908 - DNA, 22 bp, Homo sapiens
tagaggtagagttacattagtc

SEQ ID NO: 9034909 - DNA, 22 bp, Homo sapiens
tagaggtactcccctcaaagtt

SEQ ID NO: 9034910 - DNA, 22 bp, Homo sapiens
tagagggttattaggacagaag

SEQ ID NO: 9034911 - DNA, 22 bp, Homo sapiens
tagagggttattaggacagaag

SEQ ID NO: 9034912 - DNA, 22 bp, Homo sapiens
taggcactgagtacatattggt

SEQ ID NO: 9034913 - DNA, 22 bp, Homo sapiens
taggcactgaggggagcaaggt

SEQ ID NO: 9034914 - DNA, 22 bp, Homo sapiens
taggcactgaggggagcaaggt

SEQ ID NO: 9034915 - DNA, 22 bp, Homo sapiens
taggcactgaccttctcagatt

SEQ ID NO: 9034916 - DNA, 22 bp, Homo sapiens
taggcactgggctaggacaggt

SEQ ID NO: 9034917 - DNA, 22 bp, Homo sapiens
taggcactgggctaggacaggt

SEQ ID NO: 9034918 - DNA, 22 bp, Homo sapiens
taggcactggatgaccgaagag

SEQ ID NO: 9034919 - DNA, 22 bp, Homo sapiens
taggcacaaaatgaaaatggca

SEQ ID NO: 9034920 - DNA, 20 bp, Homo sapiens
taggcaattagtagataaca

SEQ ID NO: 9034921 - DNA, 20 bp, Homo sapiens
taggcaattagtagataaca

SEQ ID NO: 9034922 - DNA, 22 bp, Homo sapiens
taggcacaagaccatgcaaagg

SEQ ID NO: 9034923 - DNA, 22 bp, Homo sapiens
taggcactagacatggttacca

SEQ ID NO: 9034924 - DNA, 22 bp, Homo sapiens
taggcactagacatggttacca

SEQ ID NO: 9034925 - DNA, 22 bp, Homo sapiens
taggcactagacatggttacca

SEQ ID NO: 9034926 - DNA, 22 bp, Homo sapiens
taggattttttggattctggat

SEQ ID NO: 9034927 - DNA, 22 bp, Homo sapiens
taggattttttggattctggat

SEQ ID NO: 9034928 - DNA, 22 bp, Homo sapiens
taggattttttggattctggat

SEQ ID NO: 9034929 - DNA, 22 bp, Homo sapiens
taggattttaacccacctctga

SEQ ID NO: 9034930 - DNA, 22 bp, Homo sapiens
taggatttattctacaatattg

SEQ ID NO: 9034931 - DNA, 22 bp, Homo sapiens
taggatttattctacaatattg

SEQ ID NO: 9034932 - DNA, 22 bp, Homo sapiens
taggatttggctttagtcaggt

SEQ ID NO: 9034933 - DNA, 22 bp, Homo sapiens
taggatttggctttagtcaggt

SEQ ID NO: 9034934 - DNA, 22 bp, Homo sapiens
taggcaagttgcccaatctctc

SEQ ID NO: 9034935 - DNA, 22 bp, Homo sapiens
taggcaagtggaccagaggttt

SEQ ID NO: 9034936 - DNA, 22 bp, Homo sapiens
taggcaagtggaccagaggttt

SEQ ID NO: 9034937 - DNA, 22 bp, Homo sapiens
taggcaagtggaccagaggttt

SEQ ID NO: 9034938 - DNA, 22 bp, Homo sapiens
taggctgggcattctggccagg

SEQ ID NO: 9034939 - DNA, 22 bp, Homo sapiens
taggctgggcctgccttccagg

SEQ ID NO: 9034940 - DNA, 22 bp, Homo sapiens
tagggactgtgtgagggacttg

SEQ ID NO: 9034941 - DNA, 22 bp, Homo sapiens
tagggagaaacaccaatttatt

SEQ ID NO: 9034942 - DNA, 22 bp, Homo sapiens
tagggaccctccctgctctaac

SEQ ID NO: 9034943 - DNA, 22 bp, Homo sapiens
tagggactagtttcaaggctaa

SEQ ID NO: 9034944 - DNA, 20 bp, Homo sapiens
tagggagatatgctcttttc

SEQ ID NO: 9034945 - DNA, 22 bp, Homo sapiens
tagggagatgcaagggacggag

SEQ ID NO: 9034946 - DNA, 22 bp, Homo sapiens
tagggagaggaagcaggccgct

SEQ ID NO: 9034947 - DNA, 22 bp, Homo sapiens
taggctgggcattctggccagg

SEQ ID NO: 9034948 - DNA, 22 bp, Homo sapiens
taggctgggcattctggccagg

SEQ ID NO: 9034949 - DNA, 22 bp, Homo sapiens
taggctgggcattctggccagg

SEQ ID NO: 9034950 - DNA, 22 bp, Homo sapiens
taggctgggcattctggccagg

SEQ ID NO: 9034951 - DNA, 22 bp, Homo sapiens
taggctgggagcctgaggctag

SEQ ID NO: 9034952 - DNA, 22 bp, Homo sapiens
taggctgggagcctgaggctag

SEQ ID NO: 9034953 - DNA, 22 bp, Homo sapiens
taggctgggagcctgaggctag

SEQ ID NO: 9034954 - DNA, 22 bp, Homo sapiens
taggctgggagcctgaggctag

SEQ ID NO: 9034955 - DNA, 22 bp, Homo sapiens
taggcagaaaggaaggcaagtt

SEQ ID NO: 9034956 - DNA, 22 bp, Homo sapiens
taggcacttaataaatggtata

SEQ ID NO: 9034957 - DNA, 22 bp, Homo sapiens
taggcagaaaggaaggcaagtt

SEQ ID NO: 9034958 - DNA, 22 bp, Homo sapiens
taggcactggggaggcagcatg

SEQ ID NO: 9034959 - DNA, 22 bp, Homo sapiens
taggcactggttgtggatagtt

SEQ ID NO: 9034960 - DNA, 22 bp, Homo sapiens
taggcactggggaggcagcatg

SEQ ID NO: 9034961 - DNA, 22 bp, Homo sapiens
tagggatgacgaaaggacagag

SEQ ID NO: 9034962 - DNA, 22 bp, Homo sapiens
tagggatgactatgattcccac

SEQ ID NO: 9034963 - DNA, 22 bp, Homo sapiens
tagggatgacgaaaggacagag

SEQ ID NO: 9034964 - DNA, 22 bp, Homo sapiens
tagggatgaagatggtatttct

SEQ ID NO: 9034965 - DNA, 22 bp, Homo sapiens
tagggatgaagttgctatttac

SEQ ID NO: 9034966 - DNA, 22 bp, Homo sapiens
tagggatgaagttgctatttac

SEQ ID NO: 9034967 - DNA, 22 bp, Homo sapiens
tagggatgaagatggtatttct

SEQ ID NO: 9034968 - DNA, 22 bp, Homo sapiens
tagggatgagccagtgggtagt

SEQ ID NO: 9034969 - DNA, 22 bp, Homo sapiens
tagggatgagccagtgggtagt

SEQ ID NO: 9034970 - DNA, 22 bp, Homo sapiens
tagggatgaggatagatttttc

SEQ ID NO: 9034971 - DNA, 22 bp, Homo sapiens
tagggatgaggatagatttttc

SEQ ID NO: 9034972 - DNA, 22 bp, Homo sapiens
tagggatgagcaactggtagtg

SEQ ID NO: 9034973 - DNA, 22 bp, Homo sapiens
tagggatgagcaactggtagtg

SEQ ID NO: 9034974 - DNA, 22 bp, Homo sapiens
tagggatgactatgattcccac

SEQ ID NO: 9034975 - DNA, 22 bp, Homo sapiens
tagggaggctacttcttgtagg

SEQ ID NO: 9034976 - DNA, 22 bp, Homo sapiens
tagggaggctacttcttgtagg

SEQ ID NO: 9034977 - DNA, 22 bp, Homo sapiens
tagggaggctacttcttgtagg

SEQ ID NO: 9034978 - DNA, 22 bp, Homo sapiens
tagggaggagggttttcaaatc

SEQ ID NO: 9034979 - DNA, 22 bp, Homo sapiens
tagggaggagggttttcaaatc

SEQ ID NO: 9034980 - DNA, 22 bp, Homo sapiens
tagggagctctggcagaaggaa

SEQ ID NO: 9034981 - DNA, 22 bp, Homo sapiens
tagggagatgcaagggacggag

SEQ ID NO: 9034982 - DNA, 22 bp, Homo sapiens
tagggagaggaagcaggccgct

SEQ ID NO: 9034983 - DNA, 22 bp, Homo sapiens
tagggagcagccctgccactcc

SEQ ID NO: 9034984 - DNA, 22 bp, Homo sapiens
tagggagcagccctgccactcc

SEQ ID NO: 9034985 - DNA, 22 bp, Homo sapiens
tagggagctctggcagaaggaa

SEQ ID NO: 9034986 - DNA, 22 bp, Homo sapiens
tagggcagagcttgtacacgat

SEQ ID NO: 9034987 - DNA, 22 bp, Homo sapiens
tagggcagagcttgtacacgat

SEQ ID NO: 9034988 - DNA, 22 bp, Homo sapiens
tagggcagagcttgtacacgat

SEQ ID NO: 9034989 - DNA, 22 bp, Homo sapiens
tagggcaatatttcccagaaaa

SEQ ID NO: 9034990 - DNA, 22 bp, Homo sapiens
tagggcagagcttgtacacgat

SEQ ID NO: 9034991 - DNA, 22 bp, Homo sapiens
tagggcagagcttgtacacgat

SEQ ID NO: 9034992 - DNA, 22 bp, Homo sapiens
tagggcaatatttcccagaaaa

SEQ ID NO: 9034993 - DNA, 22 bp, Homo sapiens
tagggcaatatttcccagaaaa

SEQ ID NO: 9034994 - DNA, 22 bp, Homo sapiens
tagggatgtggtgagaactgag

SEQ ID NO: 9034995 - DNA, 22 bp, Homo sapiens
tagggatgtggtgagaactgag

SEQ ID NO: 9034996 - DNA, 22 bp, Homo sapiens
tagggatgtcctgagacttggc

SEQ ID NO: 9034997 - DNA, 22 bp, Homo sapiens
tagggatgtcctgagacttggc

SEQ ID NO: 9034998 - DNA, 22 bp, Homo sapiens
tagggatgtaaacatagtaatt

SEQ ID NO: 9034999 - DNA, 22 bp, Homo sapiens
tagggatgtaaacatagtaatt

SEQ ID NO: 9035000 - DNA, 22 bp, Homo sapiens
tagggatgtaaacatagtaatt

SEQ ID NO: 9035001 - DNA, 22 bp, Homo sapiens
tagggatggaaacccgttttct

SEQ ID NO: 9035002 - DNA, 22 bp, Homo sapiens
tagggatggaaacccgttttct

SEQ ID NO: 9035003 - DNA, 22 bp, Homo sapiens
tagggatgcttagtaggaccca

SEQ ID NO: 9035004 - DNA, 22 bp, Homo sapiens
tagggatgcttagtaggaccca

SEQ ID NO: 9035005 - DNA, 20 bp, Homo sapiens
tagggatgccagtacttctc

SEQ ID NO: 9035006 - DNA, 20 bp, Homo sapiens
tagggatgccagtacttctc

SEQ ID NO: 9035007 - DNA, 22 bp, Homo sapiens
tagggatgatgtctaaaatcat

SEQ ID NO: 9035008 - DNA, 22 bp, Homo sapiens
tagggatgatgtctaaaatcat

SEQ ID NO: 9035009 - DNA, 22 bp, Homo sapiens
tagggatgatggagcctatgta

SEQ ID NO: 9035010 - DNA, 22 bp, Homo sapiens
tagggatgatggagcctatgta

SEQ ID NO: 9035011 - DNA, 22 bp, Homo sapiens
tagggatggatgatgcctggca

SEQ ID NO: 9035012 - DNA, 22 bp, Homo sapiens
tagggatggatgatgcctggca

SEQ ID NO: 9035013 - DNA, 22 bp, Homo sapiens
tagggatggaaactaggaatct

SEQ ID NO: 9035014 - DNA, 22 bp, Homo sapiens
tagggatggaaactaggaatct

SEQ ID NO: 9035015 - DNA, 22 bp, Homo sapiens
tagggatggaaactaggaatct

SEQ ID NO: 9035016 - DNA, 22 bp, Homo sapiens
tagggatgggagattctcaaac

SEQ ID NO: 9035017 - DNA, 22 bp, Homo sapiens
tagggatgggagattctcaaac

SEQ ID NO: 9035018 - DNA, 22 bp, Homo sapiens
tagggatggcagcatgtagctt

SEQ ID NO: 9035019 - DNA, 22 bp, Homo sapiens
tagggatggcagcatgtagctt

SEQ ID NO: 9035020 - DNA, 22 bp, Homo sapiens
tagggatggcagcatgtagctt

SEQ ID NO: 9035021 - DNA, 22 bp, Homo sapiens
tagctttccttgttgcctgtgc

SEQ ID NO: 9035022 - DNA, 22 bp, Homo sapiens
tagctttagtgaaaaatatcag

SEQ ID NO: 9035023 - DNA, 22 bp, Homo sapiens
tagctttagtgaaaaatatcag

SEQ ID NO: 9035024 - DNA, 22 bp, Homo sapiens
tagctttaggcacgtttgaatt

SEQ ID NO: 9035025 - DNA, 22 bp, Homo sapiens
tagctttagtgaaaaatatcag

SEQ ID NO: 9035026 - DNA, 22 bp, Homo sapiens
tagctttaggcacgtttgaatt

SEQ ID NO: 9035027 - DNA, 22 bp, Homo sapiens
tagctttacaaagtgctgcacc

SEQ ID NO: 9035028 - DNA, 22 bp, Homo sapiens
tagctttaccatagaagagtat

SEQ ID NO: 9035029 - DNA, 22 bp, Homo sapiens
tagctgttttgccataagcgct

SEQ ID NO: 9035030 - DNA, 22 bp, Homo sapiens
tagctttaggatggttctcttg

SEQ ID NO: 9035031 - DNA, 22 bp, Homo sapiens
tagctttagaaatattctcaga

SEQ ID NO: 9035032 - DNA, 22 bp, Homo sapiens
tagctttgcctgttaatcacaa

SEQ ID NO: 9035033 - DNA, 22 bp, Homo sapiens
tagctttgcctgaagtaatcag

SEQ ID NO: 9035034 - DNA, 22 bp, Homo sapiens
tagctttgcctgaagtaatcag

SEQ ID NO: 9035035 - DNA, 22 bp, Homo sapiens
tagctttgccatctgtcacata

SEQ ID NO: 9035036 - DNA, 22 bp, Homo sapiens
taggaaaaatacagaattatat

SEQ ID NO: 9035037 - DNA, 22 bp, Homo sapiens
taggaaaacgtgattttctcac

SEQ ID NO: 9035038 - DNA, 22 bp, Homo sapiens
taggaaaacgtgattttctcac

SEQ ID NO: 9035039 - DNA, 22 bp, Homo sapiens
taggaaaagcacaggatgttct

SEQ ID NO: 9035040 - DNA, 22 bp, Homo sapiens
taggaaaagtctagattgatga

SEQ ID NO: 9035041 - DNA, 22 bp, Homo sapiens
taggaaaagtctagattgatga

SEQ ID NO: 9035042 - DNA, 22 bp, Homo sapiens
tagctttgttagaatgtcttca

SEQ ID NO: 9035043 - DNA, 22 bp, Homo sapiens
tagctttgttagaatgtcttca

SEQ ID NO: 9035044 - DNA, 22 bp, Homo sapiens
tagctttgtgtatgatgtctgt

SEQ ID NO: 9035045 - DNA, 22 bp, Homo sapiens
tagcttttaagtcataacctca

SEQ ID NO: 9035046 - DNA, 22 bp, Homo sapiens
taggaaaaatacagaattatat

SEQ ID NO: 9035047 - DNA, 22 bp, Homo sapiens
taggaaaaatacagaattatat

SEQ ID NO: 9035048 - DNA, 22 bp, Homo sapiens
taggaaaaagaggctggcaagg

SEQ ID NO: 9035049 - DNA, 22 bp, Homo sapiens
taggaaaaagaggctggcaagg

SEQ ID NO: 9035050 - DNA, 20 bp, Homo sapiens
taggatgaaagtggtttctg

SEQ ID NO: 9035051 - DNA, 22 bp, Homo sapiens
taggatggtacaaggcaggggt

SEQ ID NO: 9035052 - DNA, 22 bp, Homo sapiens
taggatttactttgacaatatt

SEQ ID NO: 9035053 - DNA, 22 bp, Homo sapiens
taggatttaataaaagaataga

SEQ ID NO: 9035054 - DNA, 22 bp, Homo sapiens
taggatttaggctttaacatct

SEQ ID NO: 9035055 - DNA, 22 bp, Homo sapiens
taggatttaggctttaacatct

SEQ ID NO: 9035056 - DNA, 22 bp, Homo sapiens
taggatttaggctttaacatct

SEQ ID NO: 9035057 - DNA, 22 bp, Homo sapiens
taggatctatttgtatttcagg

SEQ ID NO: 9035058 - DNA, 22 bp, Homo sapiens
taggatatgtgaaatcatatta

SEQ ID NO: 9035059 - DNA, 22 bp, Homo sapiens
taggatatgtgaaatcatatta

SEQ ID NO: 9035060 - DNA, 22 bp, Homo sapiens
taggagggttagagggaaatat

SEQ ID NO: 9035061 - DNA, 22 bp, Homo sapiens
taggatatgcatttttatacat

SEQ ID NO: 9035062 - DNA, 22 bp, Homo sapiens
taggaaaatatctcttattggg

SEQ ID NO: 9035063 - DNA, 22 bp, Homo sapiens
taggaaacaaacctgcctcttc

SEQ ID NO: 9035064 - DNA, 22 bp, Homo sapiens
taggaaacaaagcttagcagga

SEQ ID NO: 9035065 - DNA, 22 bp, Homo sapiens
taggaaacaaagtaatgcaact

SEQ ID NO: 9035066 - DNA, 22 bp, Homo sapiens
taggaaacaaagtggatgaaat

SEQ ID NO: 9035067 - DNA, 22 bp, Homo sapiens
taggaaacagtgcatatatagt

SEQ ID NO: 9035068 - DNA, 22 bp, Homo sapiens
taggaaacaaagtggatgaaat

SEQ ID NO: 9035069 - DNA, 22 bp, Homo sapiens
taggaaacagtgcatatatagt

SEQ ID NO: 9035070 - DNA, 22 bp, Homo sapiens
taggaaacatttgaagaggatt

SEQ ID NO: 9035071 - DNA, 22 bp, Homo sapiens
taggaaactaatacagtctgga

SEQ ID NO: 9035072 - DNA, 22 bp, Homo sapiens
taggaaactaatacagtctgga

SEQ ID NO: 9035073 - DNA, 22 bp, Homo sapiens
taggaaaccaatcttttgggag

SEQ ID NO: 9035074 - DNA, 22 bp, Homo sapiens
taggaaactcaaagggaagtgg

SEQ ID NO: 9035075 - DNA, 22 bp, Homo sapiens
taggagggttagagggaaatat

SEQ ID NO: 9035076 - DNA, 22 bp, Homo sapiens
taggagggggaacaaggcatac

SEQ ID NO: 9035077 - DNA, 22 bp, Homo sapiens
taggagggggaacaaggcatac

SEQ ID NO: 9035078 - DNA, 22 bp, Homo sapiens
taggacagtggagataaccaga

SEQ ID NO: 9035079 - DNA, 22 bp, Homo sapiens
tagaaacacagagagacccatg

SEQ ID NO: 9035080 - DNA, 22 bp, Homo sapiens
tagaaacaatgacatgcttgta

SEQ ID NO: 9035081 - DNA, 22 bp, Homo sapiens
tagaaacacagagagacccatg

SEQ ID NO: 9035082 - DNA, 22 bp, Homo sapiens
tagaaacacagagagacccatg

SEQ ID NO: 9035083 - DNA, 22 bp, Homo sapiens
tagaaacaatgacatgcttgta

SEQ ID NO: 9035084 - DNA, 22 bp, Homo sapiens
tagaaacaatgacatgcttgta

SEQ ID NO: 9035085 - DNA, 22 bp, Homo sapiens
tagaaacaagtttctctttggg

SEQ ID NO: 9035086 - DNA, 22 bp, Homo sapiens
tagaaaagccccagctggaggg

SEQ ID NO: 9035087 - DNA, 22 bp, Homo sapiens
tagaaacaatgacatgcttgta

SEQ ID NO: 9035088 - DNA, 22 bp, Homo sapiens
tagaaacaagtttctctttggg

SEQ ID NO: 9035089 - DNA, 22 bp, Homo sapiens
tagaaacagaaaactgtaatag

SEQ ID NO: 9035090 - DNA, 22 bp, Homo sapiens
tagaaacagaatatgagtgaga

SEQ ID NO: 9035091 - DNA, 22 bp, Homo sapiens
tagaaacagaatatgagtgaga

SEQ ID NO: 9035092 - DNA, 22 bp, Homo sapiens
tagaaacagaatatgagtgaga

SEQ ID NO: 9035093 - DNA, 22 bp, Homo sapiens
tagaaacagaatatgagtgaga

SEQ ID NO: 9035094 - DNA, 22 bp, Homo sapiens
tagaaacacagatctggtgtca

SEQ ID NO: 9035095 - DNA, 22 bp, Homo sapiens
tagaaacagaaaactgtaatag

SEQ ID NO: 9035096 - DNA, 22 bp, Homo sapiens
tagaaacagaaaactgtaatag

SEQ ID NO: 9035097 - DNA, 22 bp, Homo sapiens
tagaaacagaaaactgtaatag

SEQ ID NO: 9035098 - DNA, 22 bp, Homo sapiens
tagaaacagcatatattagccc

SEQ ID NO: 9035099 - DNA, 22 bp, Homo sapiens
tagaaacagcatatattagccc

SEQ ID NO: 9035100 - DNA, 22 bp, Homo sapiens
tagaaacagcatatattagccc

SEQ ID NO: 9035101 - DNA, 22 bp, Homo sapiens
tagaaacagcatatattagccc

SEQ ID NO: 9035102 - DNA, 22 bp, Homo sapiens
tagaaacagcatatattagccc

SEQ ID NO: 9035103 - DNA, 22 bp, Homo sapiens
tagaaacatataggatggcagg

SEQ ID NO: 9035104 - DNA, 22 bp, Homo sapiens
tagaaacatataggatggcagg

SEQ ID NO: 9035105 - DNA, 22 bp, Homo sapiens
tagaaacatataggatggcagg

SEQ ID NO: 9035106 - DNA, 22 bp, Homo sapiens
tagaaacatataggatggcagg

SEQ ID NO: 9035107 - DNA, 22 bp, Homo sapiens
tagaaacagatgtttttgaaga

SEQ ID NO: 9035108 - DNA, 22 bp, Homo sapiens
tagaaacagatgtttttgaaga

SEQ ID NO: 9035109 - DNA, 22 bp, Homo sapiens
tagaaacagaatatgagtgaga

SEQ ID NO: 9035110 - DNA, 22 bp, Homo sapiens
tagaaacagagagatatgcccc

SEQ ID NO: 9035111 - DNA, 22 bp, Homo sapiens
tagaaacagagagatatgcccc

SEQ ID NO: 9035112 - DNA, 22 bp, Homo sapiens
tagaaacatcagctaaccaaaa

SEQ ID NO: 9035113 - DNA, 22 bp, Homo sapiens
tagaaacatcagctaaccaaaa

SEQ ID NO: 9035114 - DNA, 22 bp, Homo sapiens
tagaaacatcagctaaccaaaa

SEQ ID NO: 9035115 - DNA, 22 bp, Homo sapiens
tagaaacatgagagaaactctt

SEQ ID NO: 9035116 - DNA, 22 bp, Homo sapiens
tagaaacatcagctaaccaaaa

SEQ ID NO: 9035117 - DNA, 22 bp, Homo sapiens
tagaaacatcagctaaccaaaa

SEQ ID NO: 9035118 - DNA, 22 bp, Homo sapiens
tagaaacatcagctaaccaaaa

SEQ ID NO: 9035119 - DNA, 22 bp, Homo sapiens
tagaaacatatgtttgagacat

SEQ ID NO: 9035120 - DNA, 22 bp, Homo sapiens
tagaaacatatgtttgagacat

SEQ ID NO: 9035121 - DNA, 22 bp, Homo sapiens
tagaaacatatgtttgagacat

SEQ ID NO: 9035122 - DNA, 22 bp, Homo sapiens
tagaaacatcagctaaccaaaa

SEQ ID NO: 9035123 - DNA, 22 bp, Homo sapiens
tagaaacatcagctaaccaaaa

SEQ ID NO: 9035124 - DNA, 22 bp, Homo sapiens
tagaaacatgttctgttctgtt

SEQ ID NO: 9035125 - DNA, 22 bp, Homo sapiens
tagaaacattcagttgcagtcc

SEQ ID NO: 9035126 - DNA, 22 bp, Homo sapiens
tagaaacattcagttgcagtcc

SEQ ID NO: 9035127 - DNA, 22 bp, Homo sapiens
tagaaacatgagagaaactctt

SEQ ID NO: 9035128 - DNA, 22 bp, Homo sapiens
tagaaacatgagagaaactctt

SEQ ID NO: 9035129 - DNA, 22 bp, Homo sapiens
tagaaacatgttctgttctgtt

SEQ ID NO: 9035130 - DNA, 22 bp, Homo sapiens
tagaaaccatctcactgctcag

SEQ ID NO: 9035131 - DNA, 22 bp, Homo sapiens
tagaaaccatctcactgctcag

SEQ ID NO: 9035132 - DNA, 22 bp, Homo sapiens
tagaaacccaggatttgtattt

SEQ ID NO: 9035133 - DNA, 22 bp, Homo sapiens
tagaaaccatctcactgctcag

SEQ ID NO: 9035134 - DNA, 22 bp, Homo sapiens
tagaaacattcagttgcagtcc

SEQ ID NO: 9035135 - DNA, 22 bp, Homo sapiens
tagaaacattcagttgcagtcc

SEQ ID NO: 9035136 - DNA, 22 bp, Homo sapiens
tagaaacctcagggaaatcttt

SEQ ID NO: 9035137 - DNA, 22 bp, Homo sapiens
tagaaaccctgccttagtagct

SEQ ID NO: 9035138 - DNA, 22 bp, Homo sapiens
tagaaacccatgtttattcagt

SEQ ID NO: 9035139 - DNA, 22 bp, Homo sapiens
tagaaactactagaataagaga

SEQ ID NO: 9035140 - DNA, 22 bp, Homo sapiens
tagaaactactagaataagaga

SEQ ID NO: 9035141 - DNA, 22 bp, Homo sapiens
tagaaacctcagggaaatcttt

SEQ ID NO: 9035142 - DNA, 22 bp, Homo sapiens
tagaaactactagaataagaga

SEQ ID NO: 9035143 - DNA, 22 bp, Homo sapiens
tagaaactcaggatactcttcc

SEQ ID NO: 9035144 - DNA, 22 bp, Homo sapiens
tagaaactcacgttatcattgc

SEQ ID NO: 9035145 - DNA, 22 bp, Homo sapiens
tagaaactcacgttatcattgc

SEQ ID NO: 9035146 - DNA, 22 bp, Homo sapiens
tagaaactctcaatctgggatg

SEQ ID NO: 9035147 - DNA, 22 bp, Homo sapiens
tagaaactagattgatagcgga

SEQ ID NO: 9035148 - DNA, 22 bp, Homo sapiens
tagaaactagattgatagcgga

SEQ ID NO: 9035149 - DNA, 22 bp, Homo sapiens
tagaaactcacgttatcattgc

SEQ ID NO: 9035150 - DNA, 22 bp, Homo sapiens
tagaaactcacgttatcattgc

SEQ ID NO: 9035151 - DNA, 22 bp, Homo sapiens
tagaaactctcaatctgggatg

SEQ ID NO: 9035152 - DNA, 22 bp, Homo sapiens
tagaaactctcacgagtgaaac

SEQ ID NO: 9035153 - DNA, 22 bp, Homo sapiens
tagaaactctcacgagtgaaac

SEQ ID NO: 9035154 - DNA, 22 bp, Homo sapiens
tagaaactctcacgagtgaaac

SEQ ID NO: 9035155 - DNA, 22 bp, Homo sapiens
tagaaactcaggatactcttcc

SEQ ID NO: 9035156 - DNA, 22 bp, Homo sapiens
tagaaactgatagtcttgtgct

SEQ ID NO: 9035157 - DNA, 22 bp, Homo sapiens
tagaaactgatagtcttgtgct

SEQ ID NO: 9035158 - DNA, 22 bp, Homo sapiens
tagaaagaaattcagattggct

SEQ ID NO: 9035159 - DNA, 22 bp, Homo sapiens
tactttggatccttacaatagc

SEQ ID NO: 9035160 - DNA, 22 bp, Homo sapiens
tactttgcagcttgataaaatg

SEQ ID NO: 9035161 - DNA, 22 bp, Homo sapiens
tactttgcagcttgataaaatg

SEQ ID NO: 9035162 - DNA, 22 bp, Homo sapiens
tactttggggacaatatggaat

SEQ ID NO: 9035163 - DNA, 22 bp, Homo sapiens
tactttggggacaatatggaat

SEQ ID NO: 9035164 - DNA, 22 bp, Homo sapiens
tactttggtatcaaactaaaac

SEQ ID NO: 9035165 - DNA, 22 bp, Homo sapiens
tactttgggtttagaataaact

SEQ ID NO: 9035166 - DNA, 22 bp, Homo sapiens
tacttttagcctatttgattct

SEQ ID NO: 9035167 - DNA, 22 bp, Homo sapiens
tacttttagcctatttgattct

SEQ ID NO: 9035168 - DNA, 22 bp, Homo sapiens
tactttgtggagattaaaaata

SEQ ID NO: 9035169 - DNA, 22 bp, Homo sapiens
tactttgtggagattaaaaata

SEQ ID NO: 9035170 - DNA, 22 bp, Homo sapiens
tactttgtggagattaaaaata

SEQ ID NO: 9035171 - DNA, 22 bp, Homo sapiens
tactttgtcattctaaccttcc

SEQ ID NO: 9035172 - DNA, 22 bp, Homo sapiens
tactttgtcattctaaccttcc

SEQ ID NO: 9035173 - DNA, 22 bp, Homo sapiens
tactttgtcattctaaccttcc

SEQ ID NO: 9035174 - DNA, 22 bp, Homo sapiens
tactttggttgaatatgtaatg

SEQ ID NO: 9035175 - DNA, 22 bp, Homo sapiens
tactttgtcatgctaagagtga

SEQ ID NO: 9035176 - DNA, 22 bp, Homo sapiens
tactttgtcatgctaagagtga

SEQ ID NO: 9035177 - DNA, 22 bp, Homo sapiens
tactttgacgccggtgggaata

SEQ ID NO: 9035178 - DNA, 22 bp, Homo sapiens
taccaaagaatattttaaatag

SEQ ID NO: 9035179 - DNA, 22 bp, Homo sapiens
taccaaagatacataaatgtga

SEQ ID NO: 9035180 - DNA, 22 bp, Homo sapiens
taccaaaaccaagccattatct

SEQ ID NO: 9035181 - DNA, 22 bp, Homo sapiens
taccaaaagcttgtttcataca

SEQ ID NO: 9035182 - DNA, 22 bp, Homo sapiens
taccaaaagcttgtttcataca

SEQ ID NO: 9035183 - DNA, 22 bp, Homo sapiens
taccaaaagcttgtttcataca

SEQ ID NO: 9035184 - DNA, 22 bp, Homo sapiens
taccaaaagcttgtttcataca

SEQ ID NO: 9035185 - DNA, 22 bp, Homo sapiens
taccaaagaatattttaaatag

SEQ ID NO: 9035186 - DNA, 22 bp, Homo sapiens
taccaaaagcttgtttcataca

SEQ ID NO: 9035187 - DNA, 22 bp, Homo sapiens
taccaaaagcttgtttcataca

SEQ ID NO: 9035188 - DNA, 22 bp, Homo sapiens
taccaaaaccaagccattatct

SEQ ID NO: 9035189 - DNA, 22 bp, Homo sapiens
taccaaaaccaagccattatct

SEQ ID NO: 9035190 - DNA, 22 bp, Homo sapiens
taccaaaaccaagccattatct

SEQ ID NO: 9035191 - DNA, 22 bp, Homo sapiens
taccaaaaagtgagccccagag

SEQ ID NO: 9035192 - DNA, 22 bp, Homo sapiens
taccaaaaccaagccattatct

SEQ ID NO: 9035193 - DNA, 22 bp, Homo sapiens
tacattttctaggggaccaaga

SEQ ID NO: 9035194 - DNA, 22 bp, Homo sapiens
tacattttctaggggaccaaga

SEQ ID NO: 9035195 - DNA, 22 bp, Homo sapiens
taccaaaaagtgagccccagag

SEQ ID NO: 9035196 - DNA, 22 bp, Homo sapiens
tacattttctaggggaccaaga

SEQ ID NO: 9035197 - DNA, 22 bp, Homo sapiens
tacatttgggacaataagagaa

SEQ ID NO: 9035198 - DNA, 22 bp, Homo sapiens
tacatttgggacaataagagaa

SEQ ID NO: 9035199 - DNA, 19 bp, Homo sapiens
tacatttgtgtacacttgt

SEQ ID NO: 9035200 - DNA, 19 bp, Homo sapiens
tacatttgtgtacacttgt

SEQ ID NO: 9035201 - DNA, 22 bp, Homo sapiens
tacatttgttatagaaatgaag

SEQ ID NO: 9035202 - DNA, 22 bp, Homo sapiens
tacatttgttatagaaatgaag

SEQ ID NO: 9035203 - DNA, 22 bp, Homo sapiens
tacattttctaggggaccaaga

SEQ ID NO: 9035204 - DNA, 22 bp, Homo sapiens
tacttttagcctatttgattct

SEQ ID NO: 9035205 - DNA, 22 bp, Homo sapiens
tacttttagcctatttgattct

SEQ ID NO: 9035206 - DNA, 22 bp, Homo sapiens
tacttttatgtgatgaaatctg

SEQ ID NO: 9035207 - DNA, 22 bp, Homo sapiens
tacttttatgtgatgaaatctg

SEQ ID NO: 9035208 - DNA, 22 bp, Homo sapiens
tacttttatgtgatgaaatctg

SEQ ID NO: 9035209 - DNA, 22 bp, Homo sapiens
tacttttcctggaaccactgct

SEQ ID NO: 9035210 - DNA, 22 bp, Homo sapiens
tacttttctataggtttgaaat

SEQ ID NO: 9035211 - DNA, 22 bp, Homo sapiens
tactttttatgataagaactga

SEQ ID NO: 9035212 - DNA, 22 bp, Homo sapiens
tactttttatgataagaactga

SEQ ID NO: 9035213 - DNA, 22 bp, Homo sapiens
tactttttatgataagaactga

SEQ ID NO: 9035214 - DNA, 22 bp, Homo sapiens
tactttttatgataagaactga

SEQ ID NO: 9035215 - DNA, 22 bp, Homo sapiens
tactttttatgataagaactga

SEQ ID NO: 9035216 - DNA, 22 bp, Homo sapiens
tactttttatgataagaactga

SEQ ID NO: 9035217 - DNA, 22 bp, Homo sapiens
tactttttatgataagaactga

SEQ ID NO: 9035218 - DNA, 22 bp, Homo sapiens
tacttttctttgtcatgcatct

SEQ ID NO: 9035219 - DNA, 22 bp, Homo sapiens
tactttttagcacagtgtgtgc

SEQ ID NO: 9035220 - DNA, 22 bp, Homo sapiens
tactttttagcacagtgtgtgc

SEQ ID NO: 9035221 - DNA, 22 bp, Homo sapiens
tactttttagcacagtgtgtgc

SEQ ID NO: 9035222 - DNA, 22 bp, Homo sapiens
tactttttagcacagtgtgtgc

SEQ ID NO: 9035223 - DNA, 22 bp, Homo sapiens
tagaaaactaatacatgcttga

SEQ ID NO: 9035224 - DNA, 22 bp, Homo sapiens
tagaaaactaatacatgcttga

SEQ ID NO: 9035225 - DNA, 22 bp, Homo sapiens
tagaaaactaatacatgcttga

SEQ ID NO: 9035226 - DNA, 22 bp, Homo sapiens
tactttttgtctctttgaatgt

SEQ ID NO: 9035227 - DNA, 22 bp, Homo sapiens
tagaaaactaatacatgcttga

SEQ ID NO: 9035228 - DNA, 22 bp, Homo sapiens
tactttttgtctctttgaatgt

SEQ ID NO: 9035229 - DNA, 22 bp, Homo sapiens
tactttttgtctctttgaatgt

SEQ ID NO: 9035230 - DNA, 19 bp, Homo sapiens
tactttttcaggacagagt

SEQ ID NO: 9035231 - DNA, 22 bp, Homo sapiens
tactttttatgataagaactga

SEQ ID NO: 9035232 - DNA, 22 bp, Homo sapiens
tactttttgtctctttgaatgt

SEQ ID NO: 9035233 - DNA, 22 bp, Homo sapiens
tagaaaagaagtctggccggga

SEQ ID NO: 9035234 - DNA, 22 bp, Homo sapiens
tagaaaagaagtctggccggga

SEQ ID NO: 9035235 - DNA, 22 bp, Homo sapiens
tagaaaagaattttatttgata

SEQ ID NO: 9035236 - DNA, 22 bp, Homo sapiens
tagaaaagaattttatttgata

SEQ ID NO: 9035237 - DNA, 22 bp, Homo sapiens
tagaaaagaattttatttgata

SEQ ID NO: 9035238 - DNA, 22 bp, Homo sapiens
tagaaaagaattttatttgata

SEQ ID NO: 9035239 - DNA, 22 bp, Homo sapiens
tagaaaagccccagctggaggg

SEQ ID NO: 9035240 - DNA, 22 bp, Homo sapiens
tagaaaagataacattctgtgc

SEQ ID NO: 9035241 - DNA, 22 bp, Homo sapiens
tagaaaagataacattctgtgc

SEQ ID NO: 9035242 - DNA, 22 bp, Homo sapiens
tagaaaagataacattctgtgc

SEQ ID NO: 9035243 - DNA, 22 bp, Homo sapiens
tagaaaagataacattctgtgc

SEQ ID NO: 9035244 - DNA, 22 bp, Homo sapiens
tagaaaagataacattctgtgc

SEQ ID NO: 9035245 - DNA, 22 bp, Homo sapiens
tagaaaagataacattctgtgc

SEQ ID NO: 9035246 - DNA, 22 bp, Homo sapiens
tagaaaggagcattttagacta

SEQ ID NO: 9035247 - DNA, 22 bp, Homo sapiens
tagaaaggaagctacttagggg

SEQ ID NO: 9035248 - DNA, 22 bp, Homo sapiens
tagaaaggagcattttagacta

SEQ ID NO: 9035249 - DNA, 22 bp, Homo sapiens
tagaaaggatattgagatgaat

SEQ ID NO: 9035250 - DNA, 22 bp, Homo sapiens
tagaaaggatattgagatgaat

SEQ ID NO: 9035251 - DNA, 22 bp, Homo sapiens
tagaaaggatattgagatgaat

SEQ ID NO: 9035252 - DNA, 22 bp, Homo sapiens
tagaaaggagcattttagacta

SEQ ID NO: 9035253 - DNA, 22 bp, Homo sapiens
tagaaaggcaagcgtgaaatat

SEQ ID NO: 9035254 - DNA, 22 bp, Homo sapiens
tagaaagctgagtaatacattt

SEQ ID NO: 9035255 - DNA, 22 bp, Homo sapiens
tagaaagctggaggaattcttt

SEQ ID NO: 9035256 - DNA, 22 bp, Homo sapiens
tagaaaggaacaggtcagcgtt

SEQ ID NO: 9035257 - DNA, 22 bp, Homo sapiens
tagaaagcttggggtgtttaaa

SEQ ID NO: 9035258 - DNA, 22 bp, Homo sapiens
tagaaagcttggggtgtttaaa

SEQ ID NO: 9035259 - DNA, 22 bp, Homo sapiens
tagaaagcgttaaatctacaga

SEQ ID NO: 9035260 - DNA, 22 bp, Homo sapiens
tagaaagctgagtaatacattt

SEQ ID NO: 9035261 - DNA, 22 bp, Homo sapiens
tagaaagcgttaaatctacaga

SEQ ID NO: 9035262 - DNA, 22 bp, Homo sapiens
tagaaagcgttaaatctacaga

SEQ ID NO: 9035263 - DNA, 22 bp, Homo sapiens
tagaaagctgagtaatacattt

SEQ ID NO: 9035264 - DNA, 22 bp, Homo sapiens
tagaaactgatagtcttgtgct

SEQ ID NO: 9035265 - DNA, 22 bp, Homo sapiens
tagaaagaacttcatgtaaaac

SEQ ID NO: 9035266 - DNA, 22 bp, Homo sapiens
tagaaagaacttcatgtaaaac

SEQ ID NO: 9035267 - DNA, 22 bp, Homo sapiens
tagaaaggctgctgccaaccca

SEQ ID NO: 9035268 - DNA, 22 bp, Homo sapiens
tagaaaggctgctgccaaccca

SEQ ID NO: 9035269 - DNA, 22 bp, Homo sapiens
tagaaaggcaatcattcttgga

SEQ ID NO: 9035270 - DNA, 22 bp, Homo sapiens
tagaaaggcaatcattcttgga

SEQ ID NO: 9035271 - DNA, 22 bp, Homo sapiens
tagaaagtaaacacgaagtctc

SEQ ID NO: 9035272 - DNA, 22 bp, Homo sapiens
tagaaagtaaacacgaagtctc

SEQ ID NO: 9035273 - DNA, 22 bp, Homo sapiens
tagaaagtaaatcagttttatt

SEQ ID NO: 9035274 - DNA, 22 bp, Homo sapiens
tagaaagtaaatcagttttatt

SEQ ID NO: 9035275 - DNA, 22 bp, Homo sapiens
tagaaagtactaaatttaactg

SEQ ID NO: 9035276 - DNA, 22 bp, Homo sapiens
tagaaagtactaaatttaactg

SEQ ID NO: 9035277 - DNA, 22 bp, Homo sapiens
tagaaagtactaaatttaactg

SEQ ID NO: 9035278 - DNA, 22 bp, Homo sapiens
tagaaagtactaaatttaactg

SEQ ID NO: 9035279 - DNA, 22 bp, Homo sapiens
tagaaagtactaaatttaactg

SEQ ID NO: 9035280 - DNA, 22 bp, Homo sapiens
tagaaagtaaatcagttttatt

SEQ ID NO: 9035281 - DNA, 22 bp, Homo sapiens
tagaaagtaaatcagttttatt

SEQ ID NO: 9035282 - DNA, 22 bp, Homo sapiens
tagaaagtaaatcagttttatt

SEQ ID NO: 9035283 - DNA, 22 bp, Homo sapiens
tagaaagtagggaaggtaggat

SEQ ID NO: 9035284 - DNA, 22 bp, Homo sapiens
tagaaagtcaaaacactgtgtt

SEQ ID NO: 9035285 - DNA, 22 bp, Homo sapiens
tagaaagtcaaaacactgtgtt

SEQ ID NO: 9035286 - DNA, 22 bp, Homo sapiens
tagaaagtagccacttacagag

SEQ ID NO: 9035287 - DNA, 22 bp, Homo sapiens
tagaaagtagccacttacagag

SEQ ID NO: 9035288 - DNA, 22 bp, Homo sapiens
tagaaagtagccacttacagag

SEQ ID NO: 9035289 - DNA, 22 bp, Homo sapiens
tagaaagtcatgaattacacca

SEQ ID NO: 9035290 - DNA, 22 bp, Homo sapiens
tagaaagtcatgaattacacca

SEQ ID NO: 9035291 - DNA, 22 bp, Homo sapiens
tagaaagtgaaggttaattaat

SEQ ID NO: 9035292 - DNA, 22 bp, Homo sapiens
tagaaagtcatgaattacacca

SEQ ID NO: 9035293 - DNA, 22 bp, Homo sapiens
tagaaagtcatgaattacacca

SEQ ID NO: 9035294 - DNA, 21 bp, Homo sapiens
tagaaagtcaaagctatcagc

SEQ ID NO: 9035295 - DNA, 22 bp, Homo sapiens
tagaaagtcaaaacactgtgtt

SEQ ID NO: 9035296 - DNA, 21 bp, Homo sapiens
tagaaagtcaaagctatcagc

SEQ ID NO: 9035297 - DNA, 21 bp, Homo sapiens
tagaaagtcaaagctatcagc

SEQ ID NO: 9035298 - DNA, 22 bp, Homo sapiens
tagaaagtcaaaacactgtgtt

SEQ ID NO: 9035299 - DNA, 22 bp, Homo sapiens
tagaaatccccagtctcatagt

SEQ ID NO: 9035300 - DNA, 22 bp, Homo sapiens
tagaaatccccagtctcatagt

SEQ ID NO: 9035301 - DNA, 22 bp, Homo sapiens
tagaaatctacttagactttct

SEQ ID NO: 9035302 - DNA, 22 bp, Homo sapiens
tagaaatcatttagaagtattg

SEQ ID NO: 9035303 - DNA, 22 bp, Homo sapiens
tagaaatcatttagaagtattg

SEQ ID NO: 9035304 - DNA, 21 bp, Homo sapiens
tagaaatcagctggtgcctct

SEQ ID NO: 9035305 - DNA, 22 bp, Homo sapiens
tagaaatcaggtttttagaaag

SEQ ID NO: 9035306 - DNA, 22 bp, Homo sapiens
tagaaataaatctgcagctggg

SEQ ID NO: 9035307 - DNA, 22 bp, Homo sapiens
tagaaagtggttgagagtttag

SEQ ID NO: 9035308 - DNA, 22 bp, Homo sapiens
tagaaagtggttgagagtttag

SEQ ID NO: 9035309 - DNA, 22 bp, Homo sapiens
tagaaagtgaaggttaattaat

SEQ ID NO: 9035310 - DNA, 22 bp, Homo sapiens
tagaaagtgaaggttaattaat

SEQ ID NO: 9035311 - DNA, 22 bp, Homo sapiens
tagaaagtgaaggttaattaat

SEQ ID NO: 9035312 - DNA, 22 bp, Homo sapiens
tagaaagtgaaggttaattaat

SEQ ID NO: 9035313 - DNA, 22 bp, Homo sapiens
tagaaatcagcaggcatatgta

SEQ ID NO: 9035314 - DNA, 22 bp, Homo sapiens
tagaaataaatctgcagctggg

SEQ ID NO: 9035315 - DNA, 22 bp, Homo sapiens
tagaaataaatctgcagctggg

SEQ ID NO: 9035316 - DNA, 22 bp, Homo sapiens
tagaaatgaatgtttaaaagtc

SEQ ID NO: 9035317 - DNA, 22 bp, Homo sapiens
tagaaatgaatgtttaaaagtc

SEQ ID NO: 9035318 - DNA, 22 bp, Homo sapiens
tagaaatcttgttactatgtgt

SEQ ID NO: 9035319 - DNA, 22 bp, Homo sapiens
tagaaatcttgttactatgtgt

SEQ ID NO: 9035320 - DNA, 22 bp, Homo sapiens
tagaaatcttgttactatgtgt

SEQ ID NO: 9035321 - DNA, 22 bp, Homo sapiens
tagaaatcttgttactatgtgt

SEQ ID NO: 9035322 - DNA, 22 bp, Homo sapiens
tagaaatgattgagctgtaata

SEQ ID NO: 9035323 - DNA, 22 bp, Homo sapiens
tagaaatgagccatggtagagc

SEQ ID NO: 9035324 - DNA, 22 bp, Homo sapiens
tagaaatgagccatggtagagc

SEQ ID NO: 9035325 - DNA, 22 bp, Homo sapiens
tagaaatgattgagctgtaata

SEQ ID NO: 9035326 - DNA, 22 bp, Homo sapiens
tagaaatgattggttgagctct

SEQ ID NO: 9035327 - DNA, 22 bp, Homo sapiens
tagaaatgattggttgagctct

SEQ ID NO: 9035328 - DNA, 22 bp, Homo sapiens
tagaaatgcagtgtactgtgtc

SEQ ID NO: 9035329 - DNA, 22 bp, Homo sapiens
tagaaatgcagtgtactgtgtc

SEQ ID NO: 9035330 - DNA, 22 bp, Homo sapiens
tagaaatgcccagattctgcta

SEQ ID NO: 9035331 - DNA, 22 bp, Homo sapiens
tagaaatggagaacagattaat

SEQ ID NO: 9035332 - DNA, 22 bp, Homo sapiens
tagaaatgcccagattctgcta

SEQ ID NO: 9035333 - DNA, 22 bp, Homo sapiens
tagaaatgcccagattctgcta

SEQ ID NO: 9035334 - DNA, 22 bp, Homo sapiens
tagaaatgcccagattctgcta

SEQ ID NO: 9035335 - DNA, 22 bp, Homo sapiens
tagaaatgattggttgagctct

SEQ ID NO: 9035336 - DNA, 22 bp, Homo sapiens
tagaaatgattttgatgcttca

SEQ ID NO: 9035337 - DNA, 22 bp, Homo sapiens
tagaaatgcagtgtactgtgtc

SEQ ID NO: 9035338 - DNA, 22 bp, Homo sapiens
tagaaatgattttgatgcttca

SEQ ID NO: 9035339 - DNA, 22 bp, Homo sapiens
tagaatgttcacctttaaatga

SEQ ID NO: 9035340 - DNA, 22 bp, Homo sapiens
tagaatgttaagaatatgtata

SEQ ID NO: 9035341 - DNA, 22 bp, Homo sapiens
tagaattcatgttactgttagc

SEQ ID NO: 9035342 - DNA, 22 bp, Homo sapiens
tagaattcaagattcaacaggc

SEQ ID NO: 9035343 - DNA, 23 bp, Homo sapiens
tagaatgtcattcaatgatatgg

SEQ ID NO: 9035344 - DNA, 23 bp, Homo sapiens
tagaatgtcattcaatgatatgg

SEQ ID NO: 9035345 - DNA, 22 bp, Homo sapiens
tagaatgtgcaaatgtgcacac

SEQ ID NO: 9035346 - DNA, 22 bp, Homo sapiens
tagaatgtggaggtaacagact

SEQ ID NO: 9035347 - DNA, 22 bp, Homo sapiens
tagaatgtggaggtaacagact

SEQ ID NO: 9035348 - DNA, 19 bp, Homo sapiens
tagaatgcccacttaaaaa

SEQ ID NO: 9035349 - DNA, 21 bp, Homo sapiens
tagaatgctattgtcttttct

SEQ ID NO: 9035350 - DNA, 19 bp, Homo sapiens
tagaatgcccacttaaaaa

SEQ ID NO: 9035351 - DNA, 22 bp, Homo sapiens
tagaatgagaaagtgtagcagg

SEQ ID NO: 9035352 - DNA, 22 bp, Homo sapiens
tagaatgacctcctcttagctt

SEQ ID NO: 9035353 - DNA, 22 bp, Homo sapiens
tagaatgagaaagtgtagcagg

SEQ ID NO: 9035354 - DNA, 22 bp, Homo sapiens
tagaatgtagtgcttcaagatt

SEQ ID NO: 9035355 - DNA, 22 bp, Homo sapiens
tagaaatggagaacagattaat

SEQ ID NO: 9035356 - DNA, 20 bp, Homo sapiens
tagaatctgttctgattcat

SEQ ID NO: 9035357 - DNA, 20 bp, Homo sapiens
tagaatctgttctgattcat

SEQ ID NO: 9035358 - DNA, 22 bp, Homo sapiens
tagaatctttaaaattcatagt

SEQ ID NO: 9035359 - DNA, 22 bp, Homo sapiens
tagaatctttaaaattcatagt

SEQ ID NO: 9035360 - DNA, 22 bp, Homo sapiens
tagaatctttaaaattcatagt

SEQ ID NO: 9035361 - DNA, 22 bp, Homo sapiens
tagaatgagaaagtgtagcagg

SEQ ID NO: 9035362 - DNA, 22 bp, Homo sapiens
tagacaatctcagcaaacacac

SEQ ID NO: 9035363 - DNA, 22 bp, Homo sapiens
tagacaatatttgaaagtagtg

SEQ ID NO: 9035364 - DNA, 22 bp, Homo sapiens
tagacaatatttgaaagtagtg

SEQ ID NO: 9035365 - DNA, 22 bp, Homo sapiens
tagacaatatttgaaagtagtg

SEQ ID NO: 9035366 - DNA, 22 bp, Homo sapiens
tagacaatatttgaaagtagtg

SEQ ID NO: 9035367 - DNA, 22 bp, Homo sapiens
tagacacaaatctcagtgacac

SEQ ID NO: 9035368 - DNA, 22 bp, Homo sapiens
tagacaatgccatcttgtggtt

SEQ ID NO: 9035369 - DNA, 22 bp, Homo sapiens
tagacacaggggaatgtgaggt

SEQ ID NO: 9035370 - DNA, 22 bp, Homo sapiens
tagacacaggggaatgtgaggt

SEQ ID NO: 9035371 - DNA, 22 bp, Homo sapiens
tagacacaagagaagggtataa

SEQ ID NO: 9035372 - DNA, 22 bp, Homo sapiens
tagacacatacccttgcccaaa

SEQ ID NO: 9035373 - DNA, 22 bp, Homo sapiens
tagacacaggggaatgtgaggt

SEQ ID NO: 9035374 - DNA, 22 bp, Homo sapiens
tagacaaaagggggcagatatg

SEQ ID NO: 9035375 - DNA, 22 bp, Homo sapiens
tagacaaaagggggcagatatg

SEQ ID NO: 9035376 - DNA, 22 bp, Homo sapiens
tagaattttctgctttgatagt

SEQ ID NO: 9035377 - DNA, 22 bp, Homo sapiens
tagaattttctgctttgatagt

SEQ ID NO: 9035378 - DNA, 22 bp, Homo sapiens
tagacaaactgatacttggcga

SEQ ID NO: 9035379 - DNA, 22 bp, Homo sapiens
tagacaaactgatacttggcga

SEQ ID NO: 9035380 - DNA, 22 bp, Homo sapiens
tagaatttcatgtatgttgggg

SEQ ID NO: 9035381 - DNA, 22 bp, Homo sapiens
tagaatttcatgtatgttgggg

SEQ ID NO: 9035382 - DNA, 22 bp, Homo sapiens
tagaattttctgctttgatagt

SEQ ID NO: 9035383 - DNA, 22 bp, Homo sapiens
tagaattttctgctttgatagt

SEQ ID NO: 9035384 - DNA, 22 bp, Homo sapiens
tagaattttctgctttgatagt

SEQ ID NO: 9035385 - DNA, 22 bp, Homo sapiens
tagaattttctgctttgatagt

SEQ ID NO: 9035386 - DNA, 22 bp, Homo sapiens
tagaggcataagagggaagcag

SEQ ID NO: 9035387 - DNA, 22 bp, Homo sapiens
tagaggcataagagggaagcag

SEQ ID NO: 9035388 - DNA, 22 bp, Homo sapiens
tagaggcataagagggaagcag

SEQ ID NO: 9035389 - DNA, 22 bp, Homo sapiens
tagaggcattgcttaatttcag

SEQ ID NO: 9035390 - DNA, 22 bp, Homo sapiens
tagaggcattgcttaatttcag

SEQ ID NO: 9035391 - DNA, 22 bp, Homo sapiens
tagaggcattaatgaataaaca

SEQ ID NO: 9035392 - DNA, 22 bp, Homo sapiens
tagaggcattaatgaataaaca

SEQ ID NO: 9035393 - DNA, 22 bp, Homo sapiens
tagaggcctgaaagaatgatca

SEQ ID NO: 9035394 - DNA, 22 bp, Homo sapiens
tagaggctactagaggcacctg

SEQ ID NO: 9035395 - DNA, 22 bp, Homo sapiens
tagaggccgaatgctgagctgg

SEQ ID NO: 9035396 - DNA, 22 bp, Homo sapiens
tagaggctcctgtgtgtaggtt

SEQ ID NO: 9035397 - DNA, 22 bp, Homo sapiens
tagaggcctgaaagaatgatca

SEQ ID NO: 9035398 - DNA, 22 bp, Homo sapiens
tagaggctcttcattgcagtag

SEQ ID NO: 9035399 - DNA, 22 bp, Homo sapiens
tagaggctcctgtgtgtaggtt

SEQ ID NO: 9035400 - DNA, 22 bp, Homo sapiens
tagaggggaaaatgcgtattaa

SEQ ID NO: 9035401 - DNA, 22 bp, Homo sapiens
tagagggccagctggacagcga

SEQ ID NO: 9035402 - DNA, 22 bp, Homo sapiens
tagagggccagctggacagcga

SEQ ID NO: 9035403 - DNA, 22 bp, Homo sapiens
tagagggcaggagtgtcctact

SEQ ID NO: 9035404 - DNA, 22 bp, Homo sapiens
tagagggaagactgctagattt

SEQ ID NO: 9035405 - DNA, 22 bp, Homo sapiens
tagaggctttcagcggtaggtc

SEQ ID NO: 9035406 - DNA, 22 bp, Homo sapiens
tagaggcttctactgctcactt

SEQ ID NO: 9035407 - DNA, 22 bp, Homo sapiens
tagaggctttcagcggtaggtc

SEQ ID NO: 9035408 - DNA, 22 bp, Homo sapiens
tagaggcttctactgctcactt

SEQ ID NO: 9035409 - DNA, 22 bp, Homo sapiens
tagaggcttctactgctcactt

SEQ ID NO: 9035410 - DNA, 22 bp, Homo sapiens
tagaggctgggaattattttca

SEQ ID NO: 9035411 - DNA, 22 bp, Homo sapiens
tagaggctgggaattattttca

SEQ ID NO: 9035412 - DNA, 22 bp, Homo sapiens
tagaggctgggaattattttca

SEQ ID NO: 9035413 - DNA, 22 bp, Homo sapiens
tagaggctcttcattgcagtag

SEQ ID NO: 9035414 - DNA, 21 bp, Homo sapiens
tagaggcaggagggactgcag

SEQ ID NO: 9035415 - DNA, 21 bp, Homo sapiens
tagaggcaggagggactgcag

SEQ ID NO: 9035416 - DNA, 21 bp, Homo sapiens
tagaggcaggagggactgcag

SEQ ID NO: 9035417 - DNA, 22 bp, Homo sapiens
tagacagatttaaaggaatgga

SEQ ID NO: 9035418 - DNA, 22 bp, Homo sapiens
tagacagatttaaaggaatgga

SEQ ID NO: 9035419 - DNA, 22 bp, Homo sapiens
tagaggcagaagaaattgacaa

SEQ ID NO: 9035420 - DNA, 22 bp, Homo sapiens
tagacactttagaagtaagggt

SEQ ID NO: 9035421 - DNA, 22 bp, Homo sapiens
tagacagaatccagcccacgcc

SEQ ID NO: 9035422 - DNA, 22 bp, Homo sapiens
tagacactttagaagtaagggt

SEQ ID NO: 9035423 - DNA, 22 bp, Homo sapiens
tagacactgtatgagctgggtg

SEQ ID NO: 9035424 - DNA, 22 bp, Homo sapiens
tagacagaatccagcccacgcc

SEQ ID NO: 9035425 - DNA, 22 bp, Homo sapiens
tagacagagtgaagacaagtgg

SEQ ID NO: 9035426 - DNA, 22 bp, Homo sapiens
tagacacatcttcatccacaat

SEQ ID NO: 9035427 - DNA, 22 bp, Homo sapiens
tagacacatcttcatccacaat

SEQ ID NO: 9035428 - DNA, 22 bp, Homo sapiens
tagacacatcaagtatagttaa

SEQ ID NO: 9035429 - DNA, 22 bp, Homo sapiens
tagacacatcaaggatcagttt

SEQ ID NO: 9035430 - DNA, 22 bp, Homo sapiens
tagacacatcttcatccacaat

SEQ ID NO: 9035431 - DNA, 22 bp, Homo sapiens
tagacactagggatttagtact

SEQ ID NO: 9035432 - DNA, 22 bp, Homo sapiens
tagacactagggatttagtact

SEQ ID NO: 9035433 - DNA, 23 bp, Homo sapiens
tagacactcctttgtctgtcctt

SEQ ID NO: 9035434 - DNA, 22 bp, Homo sapiens
tagacactgtatgagctgggtg

SEQ ID NO: 9035435 - DNA, 22 bp, Homo sapiens
tataatttggggaaagtggtgt

SEQ ID NO: 9035436 - DNA, 22 bp, Homo sapiens
tataatttggggaaagtggtgt

SEQ ID NO: 9035437 - DNA, 22 bp, Homo sapiens
tataatttggggaaagtggtgt

SEQ ID NO: 9035438 - DNA, 22 bp, Homo sapiens
tataatttggggaaagtggtgt

SEQ ID NO: 9035439 - DNA, 22 bp, Homo sapiens
tataatttatcatgtcacagtt

SEQ ID NO: 9035440 - DNA, 22 bp, Homo sapiens
tataattttaagtggtaaatta

SEQ ID NO: 9035441 - DNA, 22 bp, Homo sapiens
tataattttaagtggtaaatta

SEQ ID NO: 9035442 - DNA, 22 bp, Homo sapiens
tataattttaagtggtaaatta

SEQ ID NO: 9035443 - DNA, 22 bp, Homo sapiens
tataatttggggaaagtggtgt

SEQ ID NO: 9035444 - DNA, 22 bp, Homo sapiens
tataatttggggaaagtggtgt

SEQ ID NO: 9035445 - DNA, 22 bp, Homo sapiens
tataatttggggaaagtggtgt

SEQ ID NO: 9035446 - DNA, 22 bp, Homo sapiens
tatacaagtgagaagaagagtt

SEQ ID NO: 9035447 - DNA, 22 bp, Homo sapiens
tatacaagtaatgctgaatgat

SEQ ID NO: 9035448 - DNA, 22 bp, Homo sapiens
tatacaagtgagaagaagagtt

SEQ ID NO: 9035449 - DNA, 22 bp, Homo sapiens
tatacaagtaatgctgaatgat

SEQ ID NO: 9035450 - DNA, 22 bp, Homo sapiens
tatacaagtaatgctgaatgat

SEQ ID NO: 9035451 - DNA, 22 bp, Homo sapiens
tatacaatgagtacattctggg

SEQ ID NO: 9035452 - DNA, 22 bp, Homo sapiens
tatacaatgagtacattctggg

SEQ ID NO: 9035453 - DNA, 22 bp, Homo sapiens
tatacaatgagtacattctggg

SEQ ID NO: 9035454 - DNA, 22 bp, Homo sapiens
tatacaagaggtgagatgagca

SEQ ID NO: 9035455 - DNA, 22 bp, Homo sapiens
tataattttaagtggtaaatta

SEQ ID NO: 9035456 - DNA, 22 bp, Homo sapiens
tatacaatggctgaatcatcca

SEQ ID NO: 9035457 - DNA, 22 bp, Homo sapiens
tatacacaaacaaggggttaag

SEQ ID NO: 9035458 - DNA, 22 bp, Homo sapiens
tatacacaaacaaggggttaag

SEQ ID NO: 9035459 - DNA, 22 bp, Homo sapiens
tatacaatggctgaatcatcca

SEQ ID NO: 9035460 - DNA, 22 bp, Homo sapiens
tatacaatggctgaatcatcca

SEQ ID NO: 9035461 - DNA, 22 bp, Homo sapiens
tatacaatggctgaatcatcca

SEQ ID NO: 9035462 - DNA, 22 bp, Homo sapiens
tatacaatggctgaatcatcca

SEQ ID NO: 9035463 - DNA, 22 bp, Homo sapiens
tatacaatggctgaatcatcca

SEQ ID NO: 9035464 - DNA, 22 bp, Homo sapiens
tatacaatggctgaatcatcca

SEQ ID NO: 9035465 - DNA, 22 bp, Homo sapiens
tatacaatggctgaatcatcca

SEQ ID NO: 9035466 - DNA, 22 bp, Homo sapiens
tatacaatgagtacattctggg

SEQ ID NO: 9035467 - DNA, 22 bp, Homo sapiens
tatacaatgagtacattctggg

SEQ ID NO: 9035468 - DNA, 22 bp, Homo sapiens
tatacaatgagtacattctggg

SEQ ID NO: 9035469 - DNA, 22 bp, Homo sapiens
tatacacacatgctccggcctt

SEQ ID NO: 9035470 - DNA, 22 bp, Homo sapiens
tatacacacatgctccggcctt

SEQ ID NO: 9035471 - DNA, 22 bp, Homo sapiens
tatacacacctccaaagcagga

SEQ ID NO: 9035472 - DNA, 22 bp, Homo sapiens
tatacacacctccaaagcagga

SEQ ID NO: 9035473 - DNA, 22 bp, Homo sapiens
tatacacacctccaaagcagga

SEQ ID NO: 9035474 - DNA, 22 bp, Homo sapiens
tatacacacctccaaagcagga

SEQ ID NO: 9035475 - DNA, 22 bp, Homo sapiens
tatacacacctccaaagcagga

SEQ ID NO: 9035476 - DNA, 22 bp, Homo sapiens
tatacacaaggtgtgcatttgt

SEQ ID NO: 9035477 - DNA, 22 bp, Homo sapiens
tatacacaaggtgtgcatttgt

SEQ ID NO: 9035478 - DNA, 22 bp, Homo sapiens
tatacacaaggtgtgcatttgt

SEQ ID NO: 9035479 - DNA, 22 bp, Homo sapiens
tatacacaaggtgtgcatttgt

SEQ ID NO: 9035480 - DNA, 22 bp, Homo sapiens
tatacacaaggtgtgcatttgt

SEQ ID NO: 9035481 - DNA, 22 bp, Homo sapiens
tatacacaaggtgtgcatttgt

SEQ ID NO: 9035482 - DNA, 22 bp, Homo sapiens
tatacacatatcttctaggcct

SEQ ID NO: 9035483 - DNA, 22 bp, Homo sapiens
tatacacatatcttctaggcct

SEQ ID NO: 9035484 - DNA, 22 bp, Homo sapiens
tatacacatatcttctaggcct

SEQ ID NO: 9035485 - DNA, 22 bp, Homo sapiens
tatacacatatcttctaggcct

SEQ ID NO: 9035486 - DNA, 22 bp, Homo sapiens
tatacacatcctccaaagatag

SEQ ID NO: 9035487 - DNA, 22 bp, Homo sapiens
tatacacatcctccaaagatag

SEQ ID NO: 9035488 - DNA, 22 bp, Homo sapiens
tatacacatcctccaaagatag

SEQ ID NO: 9035489 - DNA, 23 bp, Homo sapiens
tatacacatgtggcagtatagtg

SEQ ID NO: 9035490 - DNA, 23 bp, Homo sapiens
tatacacatgtggcagtatagtg

SEQ ID NO: 9035491 - DNA, 22 bp, Homo sapiens
tatacacatcctccaaagatag

SEQ ID NO: 9035492 - DNA, 22 bp, Homo sapiens
tatacacatcctccaaagatag

SEQ ID NO: 9035493 - DNA, 22 bp, Homo sapiens
tatacacatcctccaaagatag

SEQ ID NO: 9035494 - DNA, 22 bp, Homo sapiens
tatacacatcctccaaagatag

SEQ ID NO: 9035495 - DNA, 22 bp, Homo sapiens
tatacacatatacgtttgtgtg

SEQ ID NO: 9035496 - DNA, 22 bp, Homo sapiens
tatacacatatacgtttgtgtg

SEQ ID NO: 9035497 - DNA, 22 bp, Homo sapiens
tatacacatatacgtttgtgtg

SEQ ID NO: 9035498 - DNA, 22 bp, Homo sapiens
tatacacaggaatctgtgaaaa

SEQ ID NO: 9035499 - DNA, 22 bp, Homo sapiens
tatacacaggaatctgtgaaaa

SEQ ID NO: 9035500 - DNA, 22 bp, Homo sapiens
tatacacacctccaaagcagga

SEQ ID NO: 9035501 - DNA, 22 bp, Homo sapiens
tatacacacctccaaagcagga

SEQ ID NO: 9035502 - DNA, 17 bp, Homo sapiens
tatacacagacagactg

SEQ ID NO: 9035503 - DNA, 17 bp, Homo sapiens
tatacacagacagactg

SEQ ID NO: 9035504 - DNA, 17 bp, Homo sapiens
tatacacagacagactg

SEQ ID NO: 9035505 - DNA, 22 bp, Homo sapiens
tatacacattacagtttcagga

SEQ ID NO: 9035506 - DNA, 22 bp, Homo sapiens
tatacacattacagtttcagga

SEQ ID NO: 9035507 - DNA, 22 bp, Homo sapiens
tatacacattacagtttcagga

SEQ ID NO: 9035508 - DNA, 22 bp, Homo sapiens
tatacacatgtgtgtattcata

SEQ ID NO: 9035509 - DNA, 22 bp, Homo sapiens
tatacacatgtgtgtattcata

SEQ ID NO: 9035510 - DNA, 22 bp, Homo sapiens
tatacacatgtgtgtattcata

SEQ ID NO: 9035511 - DNA, 22 bp, Homo sapiens
tatacacatgtgtgtattcata

SEQ ID NO: 9035512 - DNA, 22 bp, Homo sapiens
tatacacatgtgtgtattcata

SEQ ID NO: 9035513 - DNA, 22 bp, Homo sapiens
tatacacatgtgtgtattcata

SEQ ID NO: 9035514 - DNA, 23 bp, Homo sapiens
tatacacatgtggcagtatagtg

SEQ ID NO: 9035515 - DNA, 23 bp, Homo sapiens
tatacacatgtggcagtatagtg

SEQ ID NO: 9035516 - DNA, 23 bp, Homo sapiens
tatacacatgtggcagtatagtg

SEQ ID NO: 9035517 - DNA, 23 bp, Homo sapiens
tatacacatgtggcagtatagtg

SEQ ID NO: 9035518 - DNA, 22 bp, Homo sapiens
tatacacatttttacctatagt

SEQ ID NO: 9035519 - DNA, 22 bp, Homo sapiens
tatacacatttttacctatagt

SEQ ID NO: 9035520 - DNA, 22 bp, Homo sapiens
tatacacatttttacctatagt

SEQ ID NO: 9035521 - DNA, 22 bp, Homo sapiens
tatacacatttttacctatagt

SEQ ID NO: 9035522 - DNA, 22 bp, Homo sapiens
tatacacatttttacctatagt

SEQ ID NO: 9035523 - DNA, 22 bp, Homo sapiens
tatacacatttttacctatagt

SEQ ID NO: 9035524 - DNA, 22 bp, Homo sapiens
tatacacatttttacctatagt

SEQ ID NO: 9035525 - DNA, 22 bp, Homo sapiens
tatacagaaagaattcaagtct

SEQ ID NO: 9035526 - DNA, 22 bp, Homo sapiens
tatacactgatataaggagtaa

SEQ ID NO: 9035527 - DNA, 22 bp, Homo sapiens
tatacactgttgttgggagtct

SEQ ID NO: 9035528 - DNA, 22 bp, Homo sapiens
tatacagaacattaagaactgt

SEQ ID NO: 9035529 - DNA, 22 bp, Homo sapiens
tataaatgccaggactttagat

SEQ ID NO: 9035530 - DNA, 22 bp, Homo sapiens
tataaatgccaggactttagat

SEQ ID NO: 9035531 - DNA, 22 bp, Homo sapiens
tataaatgcacttttgaaatat

SEQ ID NO: 9035532 - DNA, 22 bp, Homo sapiens
tataaatgcacttttgaaatat

SEQ ID NO: 9035533 - DNA, 22 bp, Homo sapiens
tataaattattaggctgctaaa

SEQ ID NO: 9035534 - DNA, 22 bp, Homo sapiens
tataaattattaggctgctaaa

SEQ ID NO: 9035535 - DNA, 22 bp, Homo sapiens
tataaattattaggctgctaaa

SEQ ID NO: 9035536 - DNA, 22 bp, Homo sapiens
tataaattaatgtgcccatgag

SEQ ID NO: 9035537 - DNA, 22 bp, Homo sapiens
tataaattaatgtgcccatgag

SEQ ID NO: 9035538 - DNA, 22 bp, Homo sapiens
tataaattaatgtgcccatgag

SEQ ID NO: 9035539 - DNA, 22 bp, Homo sapiens
tataaattaatgtgcccatgag

SEQ ID NO: 9035540 - DNA, 22 bp, Homo sapiens
tataaattaatgtgcccatgag

SEQ ID NO: 9035541 - DNA, 22 bp, Homo sapiens
tataaatgccaggactttagat

SEQ ID NO: 9035542 - DNA, 22 bp, Homo sapiens
tataaagtttcgaaagatgtat

SEQ ID NO: 9035543 - DNA, 22 bp, Homo sapiens
tataaagtttcgaaagatgtat

SEQ ID NO: 9035544 - DNA, 22 bp, Homo sapiens
tataaagtttcgaaagatgtat

SEQ ID NO: 9035545 - DNA, 22 bp, Homo sapiens
tataaatgcacttttgaaatat

SEQ ID NO: 9035546 - DNA, 22 bp, Homo sapiens
tataaatgcacttttgaaatat

SEQ ID NO: 9035547 - DNA, 22 bp, Homo sapiens
tataaatgcacttttgaaatat

SEQ ID NO: 9035548 - DNA, 22 bp, Homo sapiens
tataaatgcacttttgaaatat

SEQ ID NO: 9035549 - DNA, 22 bp, Homo sapiens
tataaatgcacttttgaaatat

SEQ ID NO: 9035550 - DNA, 22 bp, Homo sapiens
tataaatgcacttttgaaatat

SEQ ID NO: 9035551 - DNA, 22 bp, Homo sapiens
tataaatctttgttcctagaat

SEQ ID NO: 9035552 - DNA, 22 bp, Homo sapiens
tataaagtttcgaaagatgtat

SEQ ID NO: 9035553 - DNA, 22 bp, Homo sapiens
tataaagtttcgaaagatgtat

SEQ ID NO: 9035554 - DNA, 22 bp, Homo sapiens
tataacactcagaaagaatcat

SEQ ID NO: 9035555 - DNA, 22 bp, Homo sapiens
tataacaggaagtattcaaaca

SEQ ID NO: 9035556 - DNA, 22 bp, Homo sapiens
tataacaggaagtattcaaaca

SEQ ID NO: 9035557 - DNA, 18 bp, Homo sapiens
tataacctctgttactca

SEQ ID NO: 9035558 - DNA, 22 bp, Homo sapiens
tataacagtttaggtggtgtca

SEQ ID NO: 9035559 - DNA, 22 bp, Homo sapiens
tataacctggattctggcacta

SEQ ID NO: 9035560 - DNA, 22 bp, Homo sapiens
tataattagtaaatggcagatt

SEQ ID NO: 9035561 - DNA, 22 bp, Homo sapiens
tataactacttgaagagttcag

SEQ ID NO: 9035562 - DNA, 20 bp, Homo sapiens
tataaattcagagctttggt

SEQ ID NO: 9035563 - DNA, 20 bp, Homo sapiens
tataaattcagagctttggt

SEQ ID NO: 9035564 - DNA, 20 bp, Homo sapiens
tataaattcagagctttggt

SEQ ID NO: 9035565 - DNA, 20 bp, Homo sapiens
tataaattcagagctttggt

SEQ ID NO: 9035566 - DNA, 22 bp, Homo sapiens
tataaattattaggctgctaaa

SEQ ID NO: 9035567 - DNA, 22 bp, Homo sapiens
tataaattattaggctgctaaa

SEQ ID NO: 9035568 - DNA, 22 bp, Homo sapiens
tataaattattaggctgctaaa

SEQ ID NO: 9035569 - DNA, 22 bp, Homo sapiens
tataaattattaggctgctaaa

SEQ ID NO: 9035570 - DNA, 22 bp, Homo sapiens
tataaattattaggctgctaaa

SEQ ID NO: 9035571 - DNA, 20 bp, Homo sapiens
tataaattcagagctttggt

SEQ ID NO: 9035572 - DNA, 20 bp, Homo sapiens
tataaattcagagctttggt

SEQ ID NO: 9035573 - DNA, 21 bp, Homo sapiens
tataacacacttcagcttctc

SEQ ID NO: 9035574 - DNA, 22 bp, Homo sapiens
tataacaccatgttctacagat

SEQ ID NO: 9035575 - DNA, 20 bp, Homo sapiens
tataaattcagagctttggt

SEQ ID NO: 9035576 - DNA, 20 bp, Homo sapiens
tataaattcagagctttggt

SEQ ID NO: 9035577 - DNA, 20 bp, Homo sapiens
tataaattcagagctttggt

SEQ ID NO: 9035578 - DNA, 22 bp, Homo sapiens
taggtctctcttcttgatggga

SEQ ID NO: 9035579 - DNA, 22 bp, Homo sapiens
taggtctcctggcctagagatt

SEQ ID NO: 9035580 - DNA, 22 bp, Homo sapiens
taggtctctcttcttgatggga

SEQ ID NO: 9035581 - DNA, 22 bp, Homo sapiens
taggtctgatttccattcagtc

SEQ ID NO: 9035582 - DNA, 22 bp, Homo sapiens
taggtcccagcatcttctgagc

SEQ ID NO: 9035583 - DNA, 22 bp, Homo sapiens
taggtcccagcatcttctgagc

SEQ ID NO: 9035584 - DNA, 22 bp, Homo sapiens
taggtgagtttggggaagatag

SEQ ID NO: 9035585 - DNA, 22 bp, Homo sapiens
taggggtgaggccaggcatcag

SEQ ID NO: 9035586 - DNA, 22 bp, Homo sapiens
taggggtgaggccaggcatcag

SEQ ID NO: 9035587 - DNA, 22 bp, Homo sapiens
taggggtgggatccaggaatta

SEQ ID NO: 9035588 - DNA, 22 bp, Homo sapiens
taggggtggagctaagagtccc

SEQ ID NO: 9035589 - DNA, 22 bp, Homo sapiens
taggggtgtttcgagagaggtt

SEQ ID NO: 9035590 - DNA, 22 bp, Homo sapiens
taggggtgtttcgagagaggtt

SEQ ID NO: 9035591 - DNA, 22 bp, Homo sapiens
taggggtgtttcgagagaggtt

SEQ ID NO: 9035592 - DNA, 21 bp, Homo sapiens
taggtatttctatcatgtctc

SEQ ID NO: 9035593 - DNA, 22 bp, Homo sapiens
taggtcagaacaagcagtatcg

SEQ ID NO: 9035594 - DNA, 21 bp, Homo sapiens
taggtatttctatcatgtctc

SEQ ID NO: 9035595 - DNA, 22 bp, Homo sapiens
taggtgtctgctcttatttaac

SEQ ID NO: 9035596 - DNA, 22 bp, Homo sapiens
taggtgtctgctcttatttaac

SEQ ID NO: 9035597 - DNA, 22 bp, Homo sapiens
taggtgctggataaagaatggt

SEQ ID NO: 9035598 - DNA, 22 bp, Homo sapiens
taggtggttgtctgctttccta

SEQ ID NO: 9035599 - DNA, 22 bp, Homo sapiens
tatgagaaaataaatatctgtt

SEQ ID NO: 9035600 - DNA, 22 bp, Homo sapiens
tatgagaaaataaatatctgtt

SEQ ID NO: 9035601 - DNA, 22 bp, Homo sapiens
tatgagaaaataaatatctgtt

SEQ ID NO: 9035602 - DNA, 22 bp, Homo sapiens
tatgagaaaataaatatctgtt

SEQ ID NO: 9035603 - DNA, 22 bp, Homo sapiens
tatgagaaaggagaatgacttt

SEQ ID NO: 9035604 - DNA, 22 bp, Homo sapiens
tatgagaaaggagaatgacttt

SEQ ID NO: 9035605 - DNA, 22 bp, Homo sapiens
tatgagaacaagaacaatctcc

SEQ ID NO: 9035606 - DNA, 22 bp, Homo sapiens
tatgagaacaagaacaatctcc

SEQ ID NO: 9035607 - DNA, 22 bp, Homo sapiens
tatgagaaattgctgatatttg

SEQ ID NO: 9035608 - DNA, 22 bp, Homo sapiens
tatgagaataatctggtaaata

SEQ ID NO: 9035609 - DNA, 22 bp, Homo sapiens
tatgagaataatctggtaaata

SEQ ID NO: 9035610 - DNA, 22 bp, Homo sapiens
tatgacattttgccagcattgc

SEQ ID NO: 9035611 - DNA, 22 bp, Homo sapiens
tatgactatagggcttagtgtt

SEQ ID NO: 9035612 - DNA, 22 bp, Homo sapiens
tatgactttggaaaaattactt

SEQ ID NO: 9035613 - DNA, 22 bp, Homo sapiens
tatgactttggaaaaattactt

SEQ ID NO: 9035614 - DNA, 22 bp, Homo sapiens
tatgacttatttcatcagttct

SEQ ID NO: 9035615 - DNA, 22 bp, Homo sapiens
tatgacattgctttttagaact

SEQ ID NO: 9035616 - DNA, 22 bp, Homo sapiens
tatgacattgctttttagaact

SEQ ID NO: 9035617 - DNA, 22 bp, Homo sapiens
tatgacatcagaagactttaaa

SEQ ID NO: 9035618 - DNA, 22 bp, Homo sapiens
tatgacattataaaggattatt

SEQ ID NO: 9035619 - DNA, 22 bp, Homo sapiens
tatgacattatgtattacatgt

SEQ ID NO: 9035620 - DNA, 22 bp, Homo sapiens
tatgacagcaaatatccatgag

SEQ ID NO: 9035621 - DNA, 19 bp, Homo sapiens
tatgacaagtactagttct

SEQ ID NO: 9035622 - DNA, 22 bp, Homo sapiens
tatgacaatgtgggcctaaggg

SEQ ID NO: 9035623 - DNA, 22 bp, Homo sapiens
tatgacagcaaatatccatgag

SEQ ID NO: 9035624 - DNA, 22 bp, Homo sapiens
tatgacaatgtgggcctaaggg

SEQ ID NO: 9035625 - DNA, 22 bp, Homo sapiens
tatgacaggcatgagatcctaa

SEQ ID NO: 9035626 - DNA, 22 bp, Homo sapiens
tatgacagtgaaaaaaatcaga

SEQ ID NO: 9035627 - DNA, 22 bp, Homo sapiens
tatgacagtgaaaaaaatcaga

SEQ ID NO: 9035628 - DNA, 22 bp, Homo sapiens
tatctagaaatttcttttgttg

SEQ ID NO: 9035629 - DNA, 22 bp, Homo sapiens
tatctagaaacagagttttact

SEQ ID NO: 9035630 - DNA, 22 bp, Homo sapiens
tatctagaactccagaatgtag

SEQ ID NO: 9035631 - DNA, 22 bp, Homo sapiens
tatctagagcagtggttctcaa

SEQ ID NO: 9035632 - DNA, 22 bp, Homo sapiens
tatctagagcctggaagtcttg

SEQ ID NO: 9035633 - DNA, 22 bp, Homo sapiens
tatctagagtcctgctgagaac

SEQ ID NO: 9035634 - DNA, 22 bp, Homo sapiens
tatctagagcctggaagtcttg

SEQ ID NO: 9035635 - DNA, 16 bp, Homo sapiens
tatctagagttgaggt

SEQ ID NO: 9035636 - DNA, 22 bp, Homo sapiens
tatctagataccaagaagcaca

SEQ ID NO: 9035637 - DNA, 22 bp, Homo sapiens
tatctagataccaagaagcaca

SEQ ID NO: 9035638 - DNA, 22 bp, Homo sapiens
tatctagatagtttagccatct

SEQ ID NO: 9035639 - DNA, 19 bp, Homo sapiens
tatgacaagtactagttct

SEQ ID NO: 9035640 - DNA, 22 bp, Homo sapiens
tatctagatatttggataaatg

SEQ ID NO: 9035641 - DNA, 19 bp, Homo sapiens
tatgacaagtactagttct

SEQ ID NO: 9035642 - DNA, 22 bp, Homo sapiens
tatctacagttaatatgtcatc

SEQ ID NO: 9035643 - DNA, 22 bp, Homo sapiens
tatctacagttaatatgtcatc

SEQ ID NO: 9035644 - DNA, 22 bp, Homo sapiens
tatctacatgtaggtatgtatg

SEQ ID NO: 9035645 - DNA, 22 bp, Homo sapiens
tatctacatgtaggtatgtatg

SEQ ID NO: 9035646 - DNA, 22 bp, Homo sapiens
tatctacagttaatatgtcatc

SEQ ID NO: 9035647 - DNA, 21 bp, Homo sapiens
tatctacagtgtccattcagt

SEQ ID NO: 9035648 - DNA, 21 bp, Homo sapiens
tatctacagtgtccattcagt

SEQ ID NO: 9035649 - DNA, 22 bp, Homo sapiens
tatctacaggtgtcaggtaaga

SEQ ID NO: 9035650 - DNA, 22 bp, Homo sapiens
tatctagaaacagagttttact

SEQ ID NO: 9035651 - DNA, 23 bp, Homo sapiens
tatctactttgcaattcagtacc

SEQ ID NO: 9035652 - DNA, 22 bp, Homo sapiens
tatctagaaacagagttttact

SEQ ID NO: 9035653 - DNA, 21 bp, Homo sapiens
tatctactggtgtctttcaga

SEQ ID NO: 9035654 - DNA, 22 bp, Homo sapiens
tatctactcctctttcagatgc

SEQ ID NO: 9035655 - DNA, 22 bp, Homo sapiens
tatctacatgtaggtatgtatg

SEQ ID NO: 9035656 - DNA, 22 bp, Homo sapiens
tatccgtgatgtttataaacca

SEQ ID NO: 9035657 - DNA, 22 bp, Homo sapiens
tatcccatgagccagctgcagc

SEQ ID NO: 9035658 - DNA, 22 bp, Homo sapiens
tatcccatgcctcattaaagtt

SEQ ID NO: 9035659 - DNA, 22 bp, Homo sapiens
tatcctactccttcacaccttg

SEQ ID NO: 9035660 - DNA, 23 bp, Homo sapiens
tatcctaaaggcaacaggaagtc

SEQ ID NO: 9035661 - DNA, 22 bp, Homo sapiens
tatcctgtgtactgtctagtac

SEQ ID NO: 9035662 - DNA, 22 bp, Homo sapiens
tatcctgtccatcctcccactg

SEQ ID NO: 9035663 - DNA, 22 bp, Homo sapiens
tatcctgttttacctggcacag

SEQ ID NO: 9035664 - DNA, 23 bp, Homo sapiens
tatcctaaaggcaacaggaagtc

SEQ ID NO: 9035665 - DNA, 22 bp, Homo sapiens
tatcctgttttgcacaattata
